United States Patent 9,061,059 (MODIFIED POLYNUCLEOTIDES FOR TREATING PROTEIN DEFICIENCY) - sequence listing, part 70

SEQ ID NO: 133922 - DNA, 966 bp, Artificial Sequence
  Description of Artificial Sequence: Synthetic coding sequence
atgctggtgtgtgccagtcctccccccctgccagcgctgacagggttgcgggatgacaagctgactctgctctcttccagtccaggtcttggaggaacacctggggagaccgtgagacattgttcagcccccgaagatcctatattccggttttcgtcgctgcactcttatcccttcccgggcactatcaaatcacgggatatgagctggaaaaggcaccacctcatcccagagacattcggtgtcaaacgtcggcgaaaacgcggccccgttgagtcagatcctctgcgcggcgagcccggcagcgccagggctgccgtctccgagctgatgcagctgtttccacggggacttttcgaagacgctctgccacctatagtattgcggtcccaggtgtactcacttgttcctgaccggaccgtcgctgaccgtcaacttaaagagcttcaagagcaaggtgagattagaatcgtgcaactgggcttcgatttggacgctcacggcatcatctttacggaggactaccgaacacgtgttcttaaggcttgtgacggcaggccttacgccggagctgtccagaagttcctagcctctgtgctgcctgcctgcggcgatctatctttccaacaagaccagatgacacagacgtttggtttccgcgattcggagatcactcatctggtcaacgccggagtcctgacagtgagagacgcaggttcctggtggctggcagtaccaggagccgggcggtttatcaaatatttcgttaaaggcaggcaagccgtactgtctatggtgcgaaaagccaaatatagagaactgctcctcagtgaactccttgggcggcgggccccagtcgtagtccgactgggccttacataccacgtgcatgacttgatcggagcgcaacttgtcgactgtatctccacaacgtctggaactttattgcgcctacccgagacatag

SEQ ID NO: 133923 - DNA, 966 bp, Artificial Sequence
  Description of Artificial Sequence: Synthetic coding sequence
atgctcgtttgcgcctcccctccgccgctacccgcccttacaggattgcgggatgacaagctgaccctgctgagctcaagccccgggctcgggggaacccctggggagactgtgcgccattgcagcgctcccgaagatcccatttttagattcagttcccttcatagttatccttttccgggaactatcaagagtcgcgatatgtcatggaaaagacaccatctgatacccgagacatttggtgttaaacggagaagaaaaagaggaccggtcgagtccgatcctctccgcggcgaaccagggagcgcccgcgccgccgtgagtgaactgatgcagctgttcccgaggggtttatttgaggatgcactccccccaatagtgcttaggagtcaggtatactcacttgtgcccgacagaaccgtagctgatcgacaattgaaggaactgcaggagcagggggagatccgcatcgtccagttaggattcgacctagatgcacatgggatcatattcaccgaagattataggactcgcgtcctgaaggcatgcgacggccgcccctatgccggcgccgtccagaaattcttggcgagcgtcctcccagcttgtggcgacctcagttttcaacaagaccagatgactcagacctttggctttcgggattcagagataacacatctcgtaaatgccggcgtcctgactgtccgcgacgctgggagttggtggctggctgtaccaggtgctggccgatttatcaaatattttgtgaagggtagacaggcagtgctcagcatggtaaggaaagctaagtatcgcgagctgctgttgtcagagctgttgggaagacgggctcccgtcgtagtccgcttaggcctcacctaccacgtccacgaccttattggtgctcagcttgtcgactgtatcagcactacgtcagggacattgttgcggttacccgagacctag

SEQ ID NO: 133924 - DNA, 1320 bp, Artificial Sequence
  Description of Artificial Sequence: Synthetic coding sequence
atgcagaatttgaaggctgaccccgaagaattattcacgaaactagagaaaattgggaaaggaagttttggagaagtgttcaaggggatcgataataggacccagaaggttgttgccatcaaaataatcgacttagaggaagccgaggacgaaattgaagatatacagcaggagatcactgtgttaagccagtgcgattcaccatacgtaactaagtattacggcagttacctgaaggacaccaagctttggattatcatggaatatctcggcggcggatccgcgttagacctgttagagcccggcccgctcgacgagactcagatagccactattttgagagagattctgaaaggacttgactatctgcacagcgagaagaagatccaccgagacattaaggccgccaacgttctactgtccgaacatggggaagtgaagctggcagactttggtgtggccggacagctcacagacacgcagatcaagcggaatacattcgtgggcacgccgttttggatggcacccgaggtaatcaaacagagtgcctatgactctaaggccgacatttggagcctgggcatcacagcaattgagcttgcacggggcgagcctccacactcagaactgcatcctatgaaagtgctgttcctcatccctaagaacaatccgcccaccttagagggaaattatagcaagccgctcaaagaattcgtggaagcatgcctaaacaaagagcctagctttcgtccaacagccaaagagctactcaagcacaaatttatactaagaaatgccaagaagacttcatatctcactgagctcatcgacaggtacaagcgttggaaagcagaacagagccacgatgacagctcttcagaagactctgacgccgaaacagatggccaagcctccggaggcagtgatagcggcgattggatctttacaatcagggagaaagaccccaagaatctggaaaatggcgctctgcaaccatctgatctagaccgcaacaagatgaaggacatccccaagcgaccattcagccaatgtttgtccacaatcatcagccccctgttcgctgagttgaaagagaagagtcaggcttgcggcgggaatttaggctccattgaagagctacgtggcgcgatctacctcgctgaggaggcatgcccggggatctccgatacaatggttgcgcaactcgtgcaaaggcttcaaagaagcatacatggcaaccaagcaccgcccgattgccatctagcacaagtccaggcctttggcggctcaggctgcgtgttaggcagcagatcggtgtag

SEQ ID NO: 133925 - DNA, 672 bp, Artificial Sequence
  Description of Artificial Sequence: Synthetic coding sequence
atggccccagaggttatcaaacagagtgcctacgacagcaaggcagacatctggagtctgggcattacagctatcgagctggctaggggcgagccacctcactctgaactgcaccccatgaaggtactctttctgataccgaaaaataaccctcctacactcgagggtaattactccaagccgttgaaagagttcgtggaggcctgtttaaacaaggagccatcatttcgcccaactgcaaaagagctgctgaagcacaaattcatcctgcgtaatgcaaaaaaaacctcgtatctgaccgaattgatcgatcgctacaagcgctggaaagccgagcagtcacacgatgattcatcgtctgaagactctgatgcagagactgatggacaggcttccgggggctccgatagcggcgattggattttcacaattagggagaaagatcctaagaacctggaaaacggtgcccttcagccctctgacctagacaggaacaagctgaaggagaagtcccaagcatgcgggggcaacctggggagcattgaggaactgaggggagccatatacctggcagaggaagcttgtcccggcatatcggataccatggtagcgcagctggtgcagcggctgcagcgctactccctgtctggtggaggtactagtagccactag

SEQ ID NO: 133926 - DNA, 1332 bp, Artificial Sequence
  Description of Artificial Sequence: Synthetic coding sequence
atggattctagggcccaattatggggacttgctctgaataaacgcagagctaccttacctcaccccggggggtccacaaatcttaaagccgaccctgaagagctatttaccaaattagaaaagattgggaaggggtcgtttggcgaagtcttcaagggcatcgacaatcgcactcaaaaagtggtcgccattaaaattatagaccttgaggaagccgaagacgagatcgaggacattcagcaggagataacggtgttgagccagtgtgactctccctatgtcactaaatactacgggtcatacttaaaggataccaagttatggatcatcatggagtacctcggcggagggtcagccctggatctccttgagcccgggccattggacgagacccaaatagcgacaatcttgagggaaatcctgaaaggactggactatcttcactccgagaagaaaatccatagagacatcaaagccgctaacgtgctgctctcggaacatggtgaggtaaagcttgccgattttggagtcgctggccaactgacagatacacagataaagcgcaacacgttcgtaggcactccattctggatggccccagaggtcattaaacaatcagcgtacgattcgaaggccgacatctggtcattagggatcacagccatcgagctggcgcgaggagaaccaccacattccgaattgcatcccatgaaggtgctctttctgatcccgaaaaataatcctcccactctcgaagggaactactccaaaccacttaaagagtttgtggaggcctgtcttaataaggagccatcttttcgccccaccgctaaggaactgctgaaacacaaattcatcctgcgaaacgctaagaaaaccagttatcttacagaattaattgaccgatacaaacgctggaaggctgagcaaagccatgatgactcttcatccgaggactccgatgcggaaacagatggccaggcttctggcggcagtgattccggagattggatctttactatacgagaaaaggaccccaagaacctcgaaaatggcgctctgcagcctagcgacttggatagaaacaaaatgaaggatatcccgaagcgaccctttagtcagtgcttgtcgacgattatttcacctctgttcgccgagttaaaagagaagagccaggcctgcggcggaaacttaggatccattgaagagctgcgcggcgccatctacttagcagaggaagcctgtcccggtatctctgatacaatggtggcacagctggtccagcgtctgcagcggtactccctgagtggaggaggtacatctagtcactag

SEQ ID NO: 133927 - DNA, 1296 bp, Artificial Sequence
  Description of Artificial Sequence: Synthetic coding sequence
atggcccactctccagttcaatcaggcctcccagggatgcagaatctgaaggccgaccccgaggaactctttaccaaattagagaagattggcaaggggagcttcggagaagtatttaagggaatagacaaccggacccagaaagtggttgcgatcaagattatcgacctggaagaagctgaagacgaaatcgaggatatccagcaagaaattacagtgctatcccaatgtgactctccctacgtcacaaaatactatggctcatatctgaaagacacaaagctgtggatcattatggagtatcttggcggcggctccgccctagatttgctggagcccgggccactggatgagacccaaatcgccaccattctgcgcgaaatcctgaaaggactggactaccttcattccgagaaaaaaatccatagggacattaaagcagccaatgttctcttgagcgagcatggcgaggtaaaactcgctgatttcggggtggccggtcagctcacagatacacagatcaagcgaaatacctttgttggcacgcccttctggatggctcctgaggtaatcaaacaatccgcctatgacagcaaggccgatatctggtcacttggcatcacggccatcgaactcgctaggggcgagcccccccactctgagctgcatcctatgaaagtgttgtttctcatccccaagaataacccccctaccctcgaggggaattattcaaagccactgaaagagttcgtggaggcttgccttaataaggagccaagctttaggccgactgctaaggagctgctgaagcataagttcattttacgcaacgccaaaaaaaccagctacctaactgagttgatcgacagatacaagaggtggaaggccgaacagtctcatgacgattcaagcagtgaggattcggatgctgaaacagacggacaggcatcaggcggttcagatagcggcgattggattttcaccatccgcgaaaaggatccgaagaacctggaaaacggcgcacttcagccctcagatcttgacagaaataagatgaaggacattcccaaacgaccattcagtcagtgcctgtctacaatcattagtcccctctttgctgaattaaaggagaagtcccaagcctgcggcggcaatctggggtctatcgaagagttaagaggagccatctatcttgcagaggaggcttgcccggggatctcggataccatggtcgctcagctcgtgcagagactgcaaagatatagcctttcgggtgggggtactagtagtcattag

SEQ ID NO: 133928 - DNA, 1239 bp, Artificial Sequence
  Description of Artificial Sequence: Synthetic coding sequence
atggctcacagtcccgtccaaagcgggctcccggggatgcaaaacttaaaggccgacccagaggaattgtttaccaaactcgagaaaataggcaagggatcgttcggggaggtgttcaaaggaatcgataatagaacacagaaagttgtggccattaaaatcatcgacctggaagaggcggaggacgagattgaggacatacagcaagagatcaccgtgctgtcccagtgcgattctccgtatgttaccaaatattacggcagttacctgaagttggaacccgggcccctcgatgaaacgcagattgctaccattcttagggagattctcaaaggcctcgactacctccactcagagaaaaagattcatagggacattaaggccgctaacgtgctgctaagcgagcacggagaagtcaagcttgcggatttcggagtggctggtcagttaactgatacccagatcaagaggaatacgttcgtcggcacacctttctggatggctcctgaggtcattaaacaatccgcatacgactcaaaagcggacatctggtcgctggggattacggccatcgaactggctaggggcgagccaccacattccgagctccacccaatgaaagtgctgttcttgatcccaaaaaacaacccccccacactggagggcaactacagtaaacctctcaaggagttcgtggaagcctgtctgaacaaggagccaagttttcgacctaccgctaaggagctgctgaaacacaaatttattctgagaaatgctaagaaaacatcctaccttactgaacttatcgatcgatacaagaggtggaaggctgaacagtcgcacgatgactccagctcggaggattcagacgcagaaactgacggtcaggcttctggcgggtcagactcgggggactggatcttcactataagggaaaaagaccctaaaaacctcgaaaacggtgccctgcagcccagcgaccttgacaggaacaagatgaaggacatccccaaacggccattcagtcagtgtctctcaaccataatctcccctctgttcgccgagttaaaggaaaaatcgcaagcatgcggaggcaatcttgggtccatcgaagagttacggggtgcaatatacctcgctgaagaggcttgtcccggcatatctgataccatggtggctcagttagtgcagagacttcaacgttacagcctgagcgggggcggtacttctagtcattag

SEQ ID NO: 133929 - DNA, 1029 bp, Artificial Sequence
  Description of Artificial Sequence: Synthetic coding sequence
atggcacattcccctgttcaatcaggtttgcccggaatgcagaacttaaaagccgaccctgaggagctgttcaccaagctcgagaaaatcggtaagggctcttttggagaagtcttcaaaggcattgacaataggacgcagaaggtggtagccattaagatcatagacctagaagaggctgaagacgagatcgaagacatacagcaggagatcaccgtgctctcccagtgtgactctccctatgtgacaaagtattatggatcgtatttgaaggatactaaactatggataattatggagtacctcggtggcggttccgctctggatctgcttgaacccgggcctctagacgaaacccagattgcaaccattctgcgcgagatcctgaagggactcgactacctgcatagtgaaaaaaaaattcaccgggacatcaaagccgcaaatgtgctgctttcagaacacggggaggttaagctggccgacttcggtgttgcaggccagttaaccgacacacagattaaaagaaatacctttgtaggcacaccattctggatggctcccgaggtgataaaacagagcgcatacgacagcaaggccgatatctggagcttgggaatcacagccatcgaacttgcacggggggagccaccacactctgagctgcacccaatgaaggtgctattcctgattcccaaaaacaatccccccacccttgaggggaattattcaaaacctttaaaggagttcgttgaagcgtgcctgaacaaagaaccatctttcaggccaactgctaaggaactcctgaaacacaaattcatactcaggaatgccaagaagactagttacctgaccgagctgatcgaccgctataaacgctggaaagccgaacagtcacacgacgactcttcctccgaggatagcgatgccgagactgatggtcaagcgtcaggggggtcagattcaggcgactggatctttaccatacgggagtggagcagtagtgctatcggtctaggccagaagtag

SEQ ID NO: 133930 - DNA, 2991 bp, Artificial Sequence
  Description of Artificial Sequence: Synthetic coding sequence
atggatgaggacacccactacgacaaggtggaggacgtggtcggctcacatattgaggatgccgtcaccttctgggctcagagtatcaacaggaataaggacatcatgaaaattgggtgctccttatccgaggtttgtccccaagcatcttccgtcctgggaaatctcgatcccaacaaaatatacggtggtctcttcagtgaggatcagtgttggtaccggtgtaaggtgctcaagattattagtgtggaaaagtgcttggtgaggtatatagattatggtaacaccgagatattgaaccggagcgacattgtcgagatcccactggagttgcagttctcttccgtggccaagaaatataaactgtggggattgcacattccatctgatcaggaagtgacacagttcgaccagggtactacattcctgggctctcttatcttcgaaaaggagattaaaatgaggattaaggccacttcagaagatggaaccgttatcgctcaggctgaatacgggtccgttgacatcggtgaggaggtactcaagaaaggattcgccgaaaaatgcagactcgcaagccgaaccgacatttgtgaggagaagaaactcgacccgggtcagctcgtgctgagaaacctgaaatctcctattcccctgtgggggcaccggtcaaatcagtccacattctcccgaccaaaagggcacctgagtgaaaagatgactctagacttgaaagacgagaatgacgctggcaatctcatcacatttcctaaggagagtctggcagtaggggactttaatcttggttcaaatgtgagtttagaaaagatcaaacaggaccagaagttgatagaggaaaatgagaagctgaaaacagaaaaggatgccctgctagagtcatataaggcactcgaactgaaagtggagcagatagcccaggaactgcagcaggagaaggctgccgcagtcgacttgactaatcacttggagtacacattaaagacatatatcgacacacgcatgaaaaacttagcagctaagatggagatcctgaaggagatgaggcacgtggacattagtgtgagatttggcaaagacctgtcggacgccatacaagttctcgacgaggggtgtttcaccacccccgcctcactaaacggactcgagataatctgggctgagtacagccttgcccaagagaacattaagacgtgcgagtatgtgtcagaaggcaatattttaatcgcacagaggaatgagatgcagcagaaactttacatgtctgtagaggatttcattctggaggtggatgagtcatccctgaataagcggctcaagactctgcaggacttgtctgttagtctggaggctgtgtatggacaggcaaaggaaggagcaaacagtgacgaaattctcaaaaaattttatgactggaaatgcgacaagagagaggaattcacttccgtgcggtcagagacagatgccagcctccatcgacttgtagcatggtttcagcgcactcttaaagtcttcgacctatctgtggaaggctccttgatctctgaagatgctatggataacattgacgaaatcttggagaagacagagagcagtgtgtgtaaagaactggaaatcgcattggtggatcaaggagatgccgacaaggagattattagcaatacttattcgcaggtattgcagaaaatacactctgaagaaagactaattgccaccgtgcaggccaagtacaaggattctattgaattcaagaagcaactgattgagtacctgaacaagtccccgtccgtggatcacttgttgtctatcaaaaagacgctgaaaagtctgaaggcacttctccgctggaagttggtggaaaagtcgaatttagaggagagcgacgaccctgatggttcgcagatcgaaaaaatcaaggaagaaatcacacagctaaggaacaatgtcttccaggaaatatatcatgaaagggaggagtacgaaatgctaacatctttggcccagaagtggtttccagaactgccgttactccatccggaaataggcctgttgaagtatatgaactccggaggtttgctaaccatgagtctggagcgggatctcctcgatgctgagcctatgaaggaactgagcagcaaaagaccactggttaggagcgaggtgaacgggcagattattctccttaagggatactcagtagatgtggacaccgaggctaaagtgatcgagagagccgctacatatcatagagcttggcgagaagccgagggggacagcgggctcctgcccctgatattcttgtttctgtgtaagtccgacccaatggcttatctcatggtgccttactaccctagagccaatctgaacgccgttcaggctaacatgccattgaactcagaagaaaccctgaaagttatgaagggggtcgcacaaggactgcacactcttcataaagccgacattatccacggttcccttcatcaaaacaatgtgtttgcgctgaaccgtgagcaaggcatcgtgggagattttgacttcaccaagagcgtttcccagcgcgcaagtgtgaacatgatggttggcgatcttagtctgatgtcccctgagctcaaaatggggaaacctgcgagcccaggctccgatttgtacgcatatggatgcctgttgctctggctaagcgttcagaatcaggaattcgaaattaacaaagacggcatcccaaaagtggaccagtttcatctggatgataaggtgaaatctctgctctgctcgctcatttgctatcggtccagtatgactgccgagcaggtgctgaatgcagaatgcttcttaatgcccaaagaacagtctgttcctaatccagaaaaagatactgaatataccctgtacaaaaaagaggaagaaattaaaacagaaaacttggacaagtgcatggaaaagacacggaatggggaggccaatttcgattgctag

SEQ ID NO: 133931 - DNA, 3060 bp, Artificial Sequence
  Description of Artificial Sequence: Synthetic coding sequence
atgtgggtacaggggcacagctcgcgagcgtccgctactgagtccgtctctttctcaggaatagtccagatggatgaggacacccactatgataaggtagaagacgtcgtgggttctcacatagaagacgccgttacgttttgggctcagtccatcaataggaataaggatatcatgaagatcggatgttccctctcagaagtgtgccctcaggccagctctgtattggggaacctggaccctaataaaatttatggcgggcttttcagcgaggatcagtgctggtacagatgcaaggtcctcaagatcatctctgtggagaaatgcctggttcgttacattgactacggaaatactgagattttgaacagatccgacatcgttgagataccactcgagcttcagttttctagtgtcgctaagaaatataaattgtgggggctgcacataccttctgatcaagaagttacgcagttcgaccaggggacgacgttccttggttccctgattttcgagaaagagatcaagatgcgcataaaagccacatccgaggatggaacagtgatcgcgcaagccgagtatggctccgtggacataggagaggaagtgctgaaaaaaggatttgcagaaaagtgtcgactggcaagtcgtaccgacatttgtgaagagaaaaagctggacccaggtcagctggtactgcgtaacctgaagtcgccgattcccctctggggccatagaagtaaccaatctacattctcaagaccaaagggtcatttatcagagaagatgaccctggacctcaaagacgaaaatgatgctggaaacttgatcacctttccaaaagaatcattggcagtcggcgattttaatctgggcagtaacgtcagtcttgagaagatcaagcaagaccagaagcttatcgaggaaaacgaaaaactaaaaacagaaaaggatgccctcctggaatcgtacaaagcgcttgaactaaaggtggaacagattgctcaggagctgcagcaggagaaggcagccgcggtagatctgacaaaccaccttgagtacacacttaaaacgtacatcgatacaaggatgaagaacttagctgcaaagatggaaatcctcaaggagatgcgtcacgtcgatatatcagtgcggttcggcaaggacctttctgatgcaatccaggtacttgatgagggttgcttcaccaccccggcgagtttgaatgggcttgaaatcatctgggcagaatattccctcgcacaagagaacattaaaacttgcgagtacgtgagtgaaggcaatattttgattgcgcaacggaatgagatgcagcaaaaactgtacatgagcgttgaggatttcatcctagaggtggacgagtcttcactgaacaaacgccttaagaccttgcaggacctcagcgtgtcgctggaagccgtttatggccaagcgaaggagggggctaacagtgatgaaattcttaaaaaattctatgattggaaatgcgacaagagagaggaatttacgtcagtgcgcagcgagacagacgcgagtcttcaccgcctcgtggcgtggtttcagaggaccctgaaggtgtttgacctttcagtagaaggctccttgatctccgaggacgcaatggacaatattgatgagatactggagaaaaccgaatcatccgtgtgcaaagagttggagatcgcactcgttgaccaaggcgatgccgataaggaaataatctccaatacatatagtcaggtcctgcagaagatccacagtgaggagcggctgatcgctaccgttcaggcaaaatacaaagatagcattgaattcaaaaagcagctcatcgagtatctaaacaaatctccgagcgtggatcacctgctttctatcaaaaaaaccttgaagtcgctaaaggccctcctgaggtggaaactcgtggagaaaagtaatctggaggaatccgacgaccctgatggctcccagatcgaaaaaatcaaggaagagatcacacagcttcgcaacaacgtgtttcaggagatatatcacgaaagagaagagtacgagatgctgactagcctggcccagaaatggtttcctgaacttcctttattgcacccggaaatcgggctccttaaatatatgaacagcggcggactgttaacaatgagccttgaacgagacctcttggacgccgaacccatgaaagagctgagttcaaaacggccactggttcggagtgaagtgaacggacagatcatcctcctgaaggggtatagcgtggatgtagacactgaggctaaggtcatcgagagggcagccacttatcatagagcttggagggaagctgagggcgatagtggactgcttcctcttatcttcttatttctgtgcaagtccgaccccatggcatacctgatggtgccatactaccctcgagccaatcttaatgcggtgcaggccaatatgcccttaaactcggaagagaccctgaaagtaatgaaaggagtggcccagggattacatactctacacaaagcggacatcatccacgggtctctccaccagaacaacgtcttcgccctaaaccgcgaacaggggattgtgggggatttcgatttcacgaagagcgtatcccagcgcgcatccgtaaacatgatggttggtgacttgagcttgatgtccccggagctcaagatgggcaagcctgcttcacctgggtctgacctgtatgcctacggctgccttttgctctggttaagcgtccagaaccaggagtttgagattaataaagatggcatccctaaggtcgatcagtttcacctcgacgacaaagtgaagtctctcctgtgttccctcatctgttatcggtcatctatgaccgccgagcaggtgctcaacgcagagtgcttcctcatgcccaaagaacaatctgtgcctaaccccgagaaagataccgagtataccctatataaaaaagaagaggagattaagactgagaatctggataaatgtatggagaaaacccgcaacggcgaggcaaactttgactgctag

SEQ ID NO: 133932 - DNA, 2991 bp, Artificial Sequence
  Description of Artificial Sequence: Synthetic coding sequence
atggacgaggacacacactatgataaagttgaagatgttgtgggatctcatattgaggacgccgtgacgttttgggcgcagagcattaacaggaacaaggacattatgaaaattgggtgctcactgtccgaagtctgcccccaggcctccagcgtcctcggaaacttggacccgaataaaatttacggcggtcttttttccgaggatcagtgttggtatagatgcaaggttctgaaaataatctctgtcgagaaatgtttagtgcgctacattgactacgggaataccgaaatcctaaatcgcagtgacatcgtcgaaatcccccttgaactccagttctcctccgtggccaaaaaatacaaactgtgggggcttcatattcccagcgaccaggaagtcacccagtttgaccaaggcactaccttcttgggctcattaatctttgagaaggagattaaaatgaggataaaggccacgagcgaggatggcaccgttatcgcgcaagccgagtacggaagtgtggatatcggcgaagaggtccttaagaaaggcttcgcggagaagtgtaggctcgctagtaggacagacatatgtgaagagaaaaagctggatcccggacagcttgtactcaggaacttaaagtcaccaatccctctatggggtcaccgaagtaaccagtccacattcagccggcctaagggacacctctcagagaagatgactctggacctcaaggacgagaatgatgccggcaatctcatcacattcccaaaagagtctctagccgtgggggattttaaccttggcagcaatgtgtcattggagaagattaagcaagaccagaagcttattgaagagaacgaaaagctgaagacagagaaggatgccttgcttgaatcctacaaagccctggagcttaaggtggaacaaatcgcacaggagttacagcaagagaaggccgctgccgttgaccttactaaccacctagaatacacccttaagacctacattgacactagaatgaagaatttggccgccaagatggagatcctgaaagagatgaggcatgttgacatatctgttaggttcggcaaagaccttagcgatgctatacaagtgttagacgagggctgttttactacacctgcatccctcaatggacttgaaataatatgggcggagtactcactcgcgcaagagaacatcaaaacatgcgaatacgtgagtgaggggaacatccttatagcgcaaagaaatgaaatgcagcaaaaattgtacatgtccgtggaagatttcattctggaagtggatgaaagcagtctcaataagcgcctgaagactttgcaagatctgtccgtgagcctggaggctgtgtacggccaggcaaaggagggagccaatagtgatgaaatcttaaagaagttttacgactggaagtgcgataagcgcgaggaattcacctctgttaggtcggagactgacgcttccctgcataggcttgttgcttggttccagagaacgttgaaagtgttcgatctctccgttgagggaagcctgatatccgaggacgccatggataacattgacgagatcctcgaaaagacagagagctccgtctgcaaagaattggagatcgctttggtggaccagggcgacgccgacaaggagataatctccaatacctattctcaggtgttgcaaaaaatccattcggaggagcggctgatcgccactgtgcaagccaaatataaggattcgattgagttcaagaaacaacttattgagtacctgaacaagagcccgtcagtcgaccatctgttgagcataaaaaagaccctaaagtccttaaaagccttgctgagatggaagctggtggaaaaatctaatctcgaggagtccgatgatccagacgggtcgcagattgagaagatcaaagaggagatcacacagctgcgaaataacgtctttcaggagatttaccacgaaagagaggaatatgaaatgctcacgtcgctggcacagaaatggtttcctgaattacctcttttgcaccccgagataggtctgctgaaatatatgaattccggaggcctgctcaccatgtcacttgagcgggacctgctggatgctgaacccatgaaggagctgtcctctaagagacctctcgtcagatccgaggtcaatggccaaatcatcctgctgaagggctactccgttgacgtggacacagaggccaaagtgattgagagagcagcaacataccaccgcgcttggagggaagcggagggtgatagcgggttgctgcctctaatattcttatttctgtgtaagagcgacccaatggcgtacctcatggtcccttattatcccagagccaatttaaacgcagttcaggccaacatgccactgaactctgaagagaccctcaaagtaatgaagggagtcgcgcaaggcttgcacactctgcataaggcagatatcatccatgggtcattgcatcaaaataatgtgtttgcacttaatcgtgagcagggcatagttggcgattttgacttcacgaaatccgtgagccagcgcgcatctgttaatatgatggtcggcgacttatctctgatgtccccggagctgaagatgggcaagcctgcaagccccggaagcgacttgtacgcctatggttgcctccttctttggctaagcgtgcagaatcaggagttcgagataaacaaggacggtattccaaaggtagatcaatttcaccttgacgacaaagtcaaaagtcttttatgctccttgatttgctatcgatcatccatgacggctgaacaagttctgaatgctgaatgttttctgatgcctaaagagcagtcggtacccaaccccgagaaagacacggaatacacattatacaaaaaagaggaggagattaagacagagaacttggacaaatgtatggagaagacgaggaatggcgaggctaactttgactgttag

SEQ ID NO: 133933 - DNA, 285 bp, Artificial Sequence
  Description of Artificial Sequence: Synthetic coding sequence
atggacgaagatactcattatgacaaggtcgaggacgttgtggggagccacattgaggatgccgtcaccttctgggcccaaagtatcaaccgcaataaggatataatgaaaatcggatgtagcctgtctgaagtttgccctcaggccagcagtgtgctcggaaacctggatccaaacaaaatctatggcgggttattcagtgaagaccagtgttggtatagatgtaaagttctgaaaattatctccgtcgagaagtgtttggtgagatatatagattatggatag

SEQ ID NO: 133934 - DNA, 132 bp, Artificial Sequence
  Description of Artificial Sequence: Synthetic coding sequence
atggacgaagacacgcattacgataaagtagaggatgtggtggggtcacacatcgaggacgccgtcaccttttgggcccagagcattaataggaacaaagacatcatgaagatcggttgctctctgtcctag

SEQ ID NO: 133935 - DNA, 2991 bp, Artificial Sequence
  Description of Artificial Sequence: Synthetic coding sequence
atgtgggtacaagggcattcttcaagggcttcggccaccgagtccgtctccttctcaggtatcgtacaaatggatgaagatacacattatgacaaggttgaggatgtggtgggctcacatattgaggacgctgtgacattttgggcacagtctattaaccgaaataaggatatcatgaagataggttgctccctttccgaggtctgtccacaggcaagttctgttttgggaaacctcgaccctaataagatctacggcggcctgttttctgaggaccaatgctggtatcgttgcaaggtgcttaagatcattagcgtggagaaatgcttggttcgatatatagattacggcaacactgagattttgaatcgctctgatatagtcgagattccgcttgagctgcaattctcatctgtcgccaagaagtataaactgtggggtcttcatatacccagtgatcaagaggtcacacaatttgatcagggaaccacctttcttggctcactcatttttgagaaggagattaaaatgcgcattaaagcaacctccgaggatggaacagtgatcgcgcaagccgaatatggtagtgttgatatcggagaagaagttctgaaaaagggcttcgctgagaaatgccgactggcttcaagaacagatatctgcgaagaaaaaaaactcgatcctggccagctggtgctccgtaacctaaaatccccaatacctctttggggccaccggtcgaaccaaagtacattctcgcggccaaaaggccacctctcagagaagatgactctagatctgaaagacgaaaatgatgccgggaatctgatcacattccctaaagaatcactcgccgtgggagatttcaatttaggttcaaacgtcagccttgaaaaaataaaacaagaccagaagctcattgaagagaacgagaagcttaagaccgagaaggatgcactcctggaaagttacaaagctctggagctgaaggtggagcagatcgcacaggagctgcaacaggaaaaagcagcggcagtcgatttaactaaccacctggaatatactttgaagacctatattgacactcgtatgaagaacttagccgcaaaaatggagatcctgaaggagatgcgccacgttgatatctcagtccggtttgggaaggacctttctgatgccattcaggtgctggacgagggctgcttcaccacacctgccagtttgaatggtctggaaatcatctgggccgagtatagcctagcccaggaaaatattaaaacatgcgagtacgtcagtgagggtaacatactgatcgcccaacggaacgaaatgcaacagaaattatacatgagcgtggaagattttatccttgaggtggatgagagctcccttaacaagaggctgaaaactctgcaggacctgtccgtgagtttggaagccgtgtatggccaggccaaggagggagctaacagcgacgaaatcctgaaaaagttctatgattggaagtgcgacaagagagaggagttcacttccgtacgctcagagactgacgccagtttgcatagactggtggcttggttccagaggactctgaaggttttcgatttgtccgtggaaggctctctcatctccgaagacgctatggataatattgatgagattctcgaaaaaaccgagagtagtgtctgtaaagagctggaaatagcactggtcgaccagggagacgccgacaaggaaattatctccaatacctactcacaggtgttacagaagattcactcggaggagcggctaatcgctactgtacaagcaaagtacaaagacagcattgagtttaagaagcaactgatcgagtatctgaataaaagcccaagcgtggaccatttgttgagcattaaaaagacacttaagagtctgaaggctctgctgcggtggaaattggttgaaaagtccaatctcgaagaaagcgatgatcctgacggcagtcaaatagagaaaatcaaagaggaaatcacacaactgaggaataacgtttttcaagaaatttatcacgagcgcgaggaatatgaaatgctgaccagcctcgcacagaagtggtttcctgagctgcccctcctgcaccctgaaatcggcctgcttaaatacatgaattctggggggctcctcactatgagcttagaacgcgatttgctagacgcggaaccaatgaaggagctcagcagcaaacggccgctggtccgatccgaggtgaatggacaaatcattctgttaaaaggctattcagtggacgtcgataccgaagccaaggtaattgaaagggcggcaacctaccacagggcttggcgggaagcagaaggggatagcggtcttctgcctctcatcttcctcttcctgtgcaaaagcgatccgatggcatatttgatggtaccatactaccctagagcgaatctgaacgctgtgcaagccaacatgcctttgaattccgaggagacactgaaagtcatgaagggggtggcccaaggtctgcatacgttacataaggctgatataattcacggctctctacaccagaacaatgtttttgccctgaaccgcgaacagggcattgtgggcgatttcgacttcacaaaatcagtgagccagagggccagcgtgaatatgatggtgggcgacctaagtctgatgagccctgagctcaaaatgggaaaacctgcgtctcctggatctgatctgtacgcctacggatgtctcctcctttgggacgacaaggtaaaaagtctcctttgctcactcatctgttacagatcctctatgaccgcagaacaggtgttaaacgctgaatgcttcctaatgcctaaggagcagagcgtcccaaatccggaaaaagataccgagtacactttgtataagaaagaggaagagattaagacggagaatttagacaagtgtatggaaaaaaccaggaacggggaggcaaatttcgattgctag

SEQ ID NO: 133936 - DNA, 1545 bp, Artificial Sequence
  Description of Artificial Sequence: Synthetic coding sequence
atggcagattccggactcgataagaaatccaccaagtgccccgattgctcttcagccagtcagaaagacgtgctttgcgtctgttcctccaaaacgagagtccctccagtgctggtcgttgaaatgagccagacatcctctattggctccgcggagtctttgatttctcttgagcggaagaaggagaagaacatcaatagagatataaccagtagaaaagacctgcccagtcgaacaagcaacgtggaaagaaaggcttcccagcagcagtggggcagagggaatttcacagaaggaaaagtgccccacatcagaatcgagaatggagccgccattgaggagatttacactttcggccggatccttgggaagggctcatttggcatcgtgatagaagccactgataaagagacagaaacgaagtgggccataaagaaagtgaataaagaaaaggccggcagttccgccgtcaaacttttggaaagggaggtcaatatcctcaaatccgtgaagcacgagcacataattcacctagaacaggtgtttgaaacacctaagaagatgtatcttgtcatggaactctgtgaggatggagagctgaaggagatcttggaccgcaaagggcatttctccgagaacgaaactcgatggattatccagagcctcgcttccgccattgcttatcttcataataacgacatagtgcaccgggatctgaaactggagaatatcatggtgaagagctccctgatcgatgacaacaatgaaatcaacctcaatattaaagtcactgacttcgggcttgctgtgaagaagcagtctaggagcgaagctatgctccaggcgacctgcggcactccaatttatatggctccagaagtgatcagcgctcacgactactcgcagcagtgcgatatttggagtatcggcgttgtgatgtatatgctgctgcgaggggaacccccattcctagcctcgtccgaagaaaagttgtttgaacttataaggaagggcgagctgcatttcgaaaacgctgtctggaatagcattagtgattgtgccaagagcgtgttgaaacagctgatgaaggtggacccggcccaccgaataactgcaaaggagttgcttgataaccagtggctcacagggaataagctgtccagtgtgcgcccaaccaacgtgctggagatgatgaaggagtggaagaacaaccccgagtctgtggaagaaaacactacagaggaaaaaaataagccgtccacagaggagaaattgaaatcctatcaaccttgggggaacgtgcccgatgcaaactatacctcggatgaggaggaagaaaagcaatctaccgcatacgagaagcaattccccgccacttccaaagacaactttgacatgtgctcgagcagtttcactagtagtaaacttctgcccgccgagattaaaggagaaatggaaaagaccccagtaactcccagccagggaaccgccacaaaataccctgctaaatccggcgctttgtccagaaccaagaagaagctatag

SEQ ID NO: 133937 - DNA, 1545 bp, Artificial Sequence
  Description of Artificial Sequence: Synthetic coding sequence
atggccgatagcggtctggacaagaaatccactaaatgccccgattgcagttctgcatctcaaaaggacgtcttgtgcgtttgcagctcaaaaacccgggtgccaccggtgctggtggttgagatgagtcagacaagctctattggtagcgctgagtctctcatctctctggagaggaagaaggaaaaaaacattaacagagacatcactagcagaaaagacctgccatctcggacgtctaatgtggaaagaaaagcatcccagcagcagtgggggcggggaaactttactgaaggaaaagtgccgcacatcaggatagagaatggtgcagccattgaggaaatctatacttttggtagaattctcggcaaagggagctttgggatcgtcatcgaggctaccgacaaggaaacagaaacgaaatgggccataaagaaagtgaataaggagaaggctggctctagcgccgttaagttgctcgaacgggaagtgaatatcctgaaaagtgtcaaacacgagcacatcatccacttagaacaggtgtttgagactccaaagaagatgtacctggtaatggagctgtgtgaagacggggaactgaaagaaatattggatcggaaaggccattttagtgagaacgaaacacgctggattatccagtcgctggcctcggcgatagcctaccttcataataacgatatcgtccatcgagacctgaaattagaaaacattatggttaagagttcgttaattgatgacaacaatgagatcaatttaaatattaaggtcactgacttcggcctcgctgtgaagaagcagtctaggtcagaagctatgctccaggctacctgcggcacaccaatctatatggcccccgaggtcatttctgcacacgactacagccagcagtgcgacatttggtctatcggagtggtgatgtacatgctgttaaggggtgagccaccattcctggcatcctctgaggaaaagctattcgagctcatcaggaagggagagctccactttgaaaacgccgtgtggaattccatctctgactgcgccaaatcggtgctcaagcagcttatgaaagttgatcccgcccatcggatcacggccaaagagctgctggacaaccaatggttgactggcaacaaattgtcctcagtgagaccaacgaatgtgctagagatgatgaaggagtggaaaaataatcccgaaagcgttgaggaaaacactacggaggagaaaaataagcctagcaccgaggagaagttgaagtcctatcagccttggggtaacgttcccgatgctaactacacaagcgatgaggaagaggagaagcagtctaccgcctatgagaagcaattcccagctacgtccaaggacaatttcgatatgtgtagttcaagtttcacaagttccaaactgctacctgccgaaattaagggcgagatggagaaaacccccgtcactccatcccaagggactgctaccaaataccccgctaagagtggagccctatccagaacaaagaagaagttgtag

SEQ ID NO: 133938 - DNA, 1347 bp, Artificial Sequence
  Description of Artificial Sequence: Synthetic coding sequence
atggcagacagtggattggacaaaaagtccactaagtgccccgactgttcgagcgccagtcaaaaagatgttctgtgtgtatgtagcagcaagacacgcgtgcctcccgtgctcgtggtcgaaatgagccagacctccagcatcggttcagccgagtccctcataagtctggagcgcaaaaaagaaaagaatattaatcgtgatatcacatctcggaaggatctgcccagcagaaccagtaacgtggagcgcaaagccagccagcagcaatggggcaggggcaatttcactgaggggaaagttccccatatcaggattgagaacggagctgcaattgaagagatttataccttcggccggatccttggcaagggctcgtttggcattgtaattgaggccaccgataaggaaactgaaacgaagtgggctattaagaaggtgaataaggagaaggccggatcctccgcagtaaagctgttagaaagagaagtgaatattttgaagtcagtcaagcatgagcacattattcaccttgagcaagtgttcgaaacgcctaagaaaatgtatctcgttatggagctgtgtgaggatggagaactgaaggagatccttgacaggaaaggacatttttcagaaaacgagactcgatggatcattcaatcccttgcctccgctatagcctacctccataataatgatattgttcacagagatctgaaattagagaatattatggtaaaatctagcctgatcgatgataacaacgaaattaacctcaatattaaggtgacagattttggattagccgtgaaaaagcagtcccggagcgaagctatgcttcaagctacctgtgggacaccaatctacatggcccctgaagttatctctgcccatgattactcccagcaatgcgacatttggagcatcggggtcgtaatgtacatgcttctgagaggggagcctccctttttagcatcgtctgaggaaaagctgtttgagttgattagaaagggtgaactgcacttcgaaaacgctgtttggaatagtatcagcgactgcgccaaatccgtgctgaagcaactgatgaaggtagatccagctcatcgcatcaccgctaaagaactccttgataatcagtggttgacaagcaccgcttatgaaaaacagtttcctgctacctccaaggataacttcgacatgtgctcaagtagtttcacctcgtcaaagctgctgcctgccgaaatcaagggcgaaatggagaagacacccgtcacaccttctcaagggacggccacaaaatacccagctaagagtggggccctgagcaggacaaaaaaaaagttgtag

SEQ ID NO: 133939 - DNA, 192 bp, Artificial Sequence
  Description of Artificial Sequence: Synthetic coding sequence
atggccgacagcggtttggataaaaagagtacaaagtgccccgattgttcgagtgctagccagaaagacgtgttgtgcgtgtgctcttctaagacacgggttccccctgtgctggtcgttgaaatgtctcagacgtcgtccataggatctgcagagtccctgatatccttagagcggaaaaaagaaaaatag

SEQ ID NO: 133940 - DNA, 1545 bp, Artificial Sequence
  Description of Artificial Sequence: Synthetic coding sequence
atggctgattcaggcctcgataagaaatctaccaagtgtcccgattgttcaagtgcctctcagaaagacgtcttgtgcgtgtgcagctcaaagacaagagtcccccctgtactcgttgttgagatgtcacaaaccagctcaattgggtccgctgagtcgttaatcagcctggagcgcaaaaaggagaaaaacattaaccgcgatatcacaagtcgcaaagacctcccatcccggacaagtaacgtggagagaaaagcctcacagcagcaatggggccgtggcaacttcacggagggcaaagttccccacatccgcatagaaaacggggccgccatcgaggaaatctacactttcgggagaatcttgggcaagggttcgtttggcattgttattgaagctacggataaggagaccgagactaagtgggctatcaagaaggttaacaaagaaaaggcggggagttcagccgtcaagcttctggagagggaggttaacatcctaaaaagcgttaagcacgagcatatcattcatctagaacaggtcttcgagactcctaagaagatgtatctcgtgatggagctgtgcgaggacggtgaactcaaggaaatccttgatcgcaaaggccatttttcagagaacgagacgcgttggattatccagtccctggcgtccgctattgcctacttacacaacaatgacattgttcacagggacctgaagctggagaacatcatggttaaatcttcacttatagacgataacaatgagatcaacctcaacatcaaggtcactgatttcggtttggctgtgaagaagcagtccagaagtgaagctatgcttcaggctacttgtggcacaccgatctatatggcaccggaggtcatatcagcacacgactacagccagcagtgtgacatttggtctataggcgttgtgatgtacatgcttctaagaggagaaccgccgtttctcgcaagcagcgaagagaagctcttcgaactgattaggaagggagaattacactttgagaacgcagtgtggaacagcatcagtgactgcgccaagagcgttctaaaacagctgatgaaagtggaccctgctcatagaatcactgccaaagagcttttggacaaccaatggctgaccgggaacaagttgtctagcgtccgccctacaaatgtactggaaatgatgaaggagtggaaaaataaccctgaaagtgtggaagagaataccacggaggagaaaaacaagccttctaccgaagaaaagctcaagagttaccagccatggggtaatgtccccgatgccaactatacatctgatgaagaagaggagaaacaatcgacggcctatgagaagcaatttcccgctacgtctaaagataacttcgacatgtgcagctcaagcttcaccagttcaaagctgctcccggccgaaattaagggggagatggaaaaaacacccgtcaccccaagccagggcactgccacaaaatatccagccaaatcgggtgcactttcgcggacaaagaagaaactgtag

SEQ ID NO: 133941 - DNA, 114 bp, Artificial Sequence
  Description of Artificial Sequence: Synthetic coding sequence
atggccgactccggactcgataaaaaatctactaagtgtcctgactgctcttccgcctctcagaaagatgtgttgtgtgtctgctcatccaaaacccgagtgccccctgtgtag

SEQ ID NO: 133942 - DNA, 516 bp, Artificial Sequence
  Description of Artificial Sequence: Synthetic coding sequence
atggctgactccgggctagacaagaagtctaccaagtgtcccgactgcagctccgcctcccagaaagacgtgttgtgcgtgtgctccagcaaaactcgagttccccccgtgctggtggtggagatgtcgcagacttccagtataggttcagctgagtctctgatttctctcgaaaggaaaaaggaaaagaacattaatagggacatcacatcaagaaaggacctgccttcacgaacttcaaacgttgagcgaaaagccagccagcagcagtggggccgaggcaacttcactgagggcaaagttccccacatccggatagagaacggcgctgctattgaggagatctacactttcgggcggatcttggggaaagggtctttcggtatcgtgatcgaagccactgataaggaaacagaaactaagtgggcaattaagaaggtgaataaggaaaaggctggttcttccgcagttaaactgcttgagagggaggtgaacatactgaaaagtgtgaagtag

SEQ ID NO: 133943 - DNA, 90 bp, Artificial Sequence
  Description of Artificial Sequence: Synthetic coding sequence
atggcagacagcggtctcgacaaaaagtcaactaagtgccccgattgttcatccgcctctcagaaggacgttctgtgtgtgtgttcctag

SEQ ID NO: 133944 - DNA, 1206 bp, Artificial Sequence
  Description of Artificial Sequence: Synthetic coding sequence
atggaaaccgggaaagatggggccaggagaggaacccagtctcccgagaggaagcggaggagcccagtcccaagagccccttctactaagctgcgcccggctgccgcagcaagggcaatggaccctgtggcagctgaggctcctggagaagctttccttgccaggagaaggcccgagggcggggggggcagtgcgaggcccaggtactctctcctggcggagatcgggcggggttcatacggagtggtgtatgaagccgtggcaggccggagtggggcaagggtggcagtgaagaagatcaggtgcgacgctcctgaaaatgtggagctggcacttgccgagttttgggctctaacatctcttaagaggcgccatcagaatgttgttcagtttgaggaatgtgtcctgcaacgcaacggcttggcgcagcggatgagccacgggaacaagtcttcacagctctacctgaggctcgtggagactagcctgaagggggaacgcatcctcgggtacgccgaggaaccttgctacctctggttcgtcatggagttctgtgaagggggggacttgaaccagtatgtgctttcaaggagacccgaccccgcaaccaataagagcttcatgctccagcttaccagtgctatcgctttcttgcacaagaaccacatcgtgcatagggatctgaagcctgataatattctcataacagagcgtagcggaacccctatactaaaggttgcagactttggcctctcgaaagtgtgcgccggactcgccccccgaggcaaagagggcaaccaagataacaaaaacgtcaacgttaacaagtactggctctcctccgcttgcggctccgatttctacatggcccccgaagtatgggagggacactatactgccaaggccgacatctttgccctcggaatcattatttgggctatgatagaaaggattaccttcatcgactctgaaactaaaaaggagctgctgggaacgtacataaagcagggcactgaaattgtgccagtaggcgaggctctgctcgaaaacccaaagatggaattgcatatcccgcagaagaggcgaacatcaatgagcgagggaattaaacagctcctcaaggacatgctcgcagccaaccctcaagacagaccagacgctttcgagttggagacgcggatggaccaagttacatgtgccgcttag

SEQ ID NO: 133945 - DNA, 1605 bp, Artificial Sequence
  Description of Artificial Sequence: Synthetic coding sequence
atgggacatcaggagagtccactcgccagggctcctgccggcggcgctgcttacgtgaagcgattatgtaagggcttaagctggcgagaacatgtggagtcgcacgggtcactcggagctcaggcgtctcctgctagcgcagccgccgccgagggttcggcgacacgccgggctagagctgccacgagccgtgcggcgcgatctcgacggcagcctgggcccggtgctgaccacccacaggctggggccccaggcggcaagcgtgccgccagaaagtggagatgtgccgggcaggtcaccatccagggacctgccccaccaagacctcgcgctggccggagagacgaagcaggcggagcacgagccgcgcctctgctgctcccgccacccccagccgccatggaaactggtaaagacggggctcgtcgtgggactcagagccccgaaagaaagcgcagatctcctgtgccccgtgccccaagcacaaaattgcgtccggccgctgccgccagggctatggatcccgtggcagccgaggcccctggggaggctttcttagcaaggagacgcccagaaggtgggggcggaagtgcacgtccacgatacagtctcctcgccgagatagggcgagggagctatggggtggtctatgaggctgtcgctggtcgctccggagcacgggtcgcagtcaaaaaaattcggtgtgacgctccggagaacgtggaacttgccctcgccgagttctgggctctgacaagtctcaagaggcggcaccagaacgtcgtgcaatttgaggagtgcgtgctacagaggaatggcttggcacagcgtatgtcacatgggaataagtcttcccagctgtacttacggctagtggagacttcccttaagggggagaggatcctcggctacgctgaagagccatgctatctctggtttgtgatggaattctgcgagggtggcgacctaaaccaatacgtgctctcacgccgcccagaccctgccaccaataagtcgtttatgttacagttaactagtgcaatcgccttcctgcacaaaaaccatatcgtacacagggatttaaaaccggacaatatcctgatcaccgaacgcagtggcacccccatcctcaaggtggctgacttcggattatctaaagtgtgtgcgggtctggctccaagagggaaggaaggcaaccaggataataaaaatgtcaacgtcaataagtactggctgagttcggcctgtggctcggatttctatatggcccccgaagtgtgggagggccattatactgccaaggccgatatatttgcccttgggattattatttgggccatgattgagcggattacatttatagattccgaaaccaagaaggagctcctgggaacgtacatcaagcagggcaccgagatcgtccctgttggcgaggcactattagaaaatcccaagatggagttgcacatccctcagaaaagacgtaccagcatgagcgagggcatcaaacagttacttaaagatatgctagcggcgaatcctcaggaccgtcctgatgcattcgagctagaaacaagaatggatcaagtcacctgtgcggcctag

SEQ ID NO: 133946 - DNA, 489 bp, Artificial Sequence
  Description of Artificial Sequence: Synthetic coding sequence
atggacccggttgctgccgaagcgcctggtgaagcctttctggctcgaaggcggcctgagggagggggtggaagcgctcgccccagatactctctcctagcagagattgggcgcggcagttacggagtggtctatgaagcagtcgcagggagatctggagcgcgtgtcgccgtgaagaagatccggtgtgatgcacctgagaatgtcgagctggctcttgctgaattctgggccctgacatcacttaaaaggcggcaccaaaacgtggtgcagttcgaggagtgtgtcctgcagcgcaacggcctagcccagcgcatgtcccacggcaacaagtcttcacagttatacctcaggctcgttgaaacatcactgaaaggtcgattcctgggcactcatagtctgaccacatccccccccgaggacgggcggggctacagatggtggcctggccggttagccatctcgcgtcagctagatccagctatgtag

SEQ ID NO: 133947 - DNA, 3948 bp, Artificial Sequence
  Description of Artificial Sequence: Synthetic coding sequence
atggaaaagtaccacgtcctggaaatgatcggcgagggatcctttgggagggtctataagggcaggcgcaagtactcagcccaggtagtcgcactgaaattcattcctaaattgggtcggtcggagaaagaactgaggaatttgcagagagagattgaaatcatgaggggcctcaggcaccccaatattgttcacatgctggattctttcgaaactgataaagaagttgttgtcgtgaccgactacgccgaaggcgagctgttccagattctcgaagatgacggcaagctgccggaagaccaggtgcaggccatcgctgcgcaactggtgtccgcgctgtattatctccactcccaccggatcctgcatagagatatgaagccccagaatatcctgctcgcgaagggaggtggaatcaaattgtgcgacttcggcttcgccagagctatgtcgacgaacaccatggttctcactagtattaaaggcacccccctatacatgagtcccgaactggtggaggagagaccctacgaccacacggcagatttatggtccgttggctgcatcctatatgaattggctgtaggaacgccaccattttatgctaccagcatcttccagttagtctccctgatcctgaaagatcccgttcgctggcccagtaccatatctccgtgctttaagaatttcctccagggcctgctgacaaaggatcctcggcagcggttgtcatggcccgacttgctgtaccatccctttattgcgggccacgtcactatcatcacggaacccgccggtcccgacctcgggactccatttacgtctagactcccccccgagctgcaagtgcttaaggacgagcaggcgcatcgactggctccaaaaggcaatcagtctcgcattttgacccaagcttacaaacgcatggctgaggaggctatgcagaaaaaacatcagaacactggccctgctttggagcaggaggataagacatctaaggtggctcccggaaccgctccacttccacggctcggagctacgcctcaagaaagtagcctcctcgcagggatccttgcctccgagctcaagtcttcatgggctaagtcgggaactggcgaggtcccaagtgccccaagggaaaaccgaactacccctgattgtgagagagcgtttcccgaggagaggccggaggtcctgggacagcgaagtactgacgttgtggacttggaaaatgaggagcctgactcggataacgaatggcagcatcttctagaaactaccgaaccagtacctattcagctcaaagcgccgctgactctgctgtgtaatccagatttttgtcagcggatccagtctcagttacacgaggccggcggacagattctgaagggaatattggaaggggccagccatattctgcctgcatttcgcgtgttgtcaagccttctgagctcctgcagcgactcagttgccctctacagcttctgtcgcgaggcgggcctcccgggcctgctgctgagcctactgagacactctcaggaaagcaactcgttgcagcagcagtcctggtacggcactttcctccaggaccttatggccgtgattcaagcttactttgcttgcacctttaatttggagagatcacagacctctgattctctgcaggtttttcaggaggccgcgaatctctttctggacctgcttgggaaactacttgcccaaccggatgatagtgagcagactttgcggcgggactccctgatgtgtttcactgtactctgtgaagccatggatggtaactcacgggccatctcaaaggccttttatagctccttgctcaccacgcagcaggtcgtattggacgggttgcttcacggtctcaccgtgccccagctgcccgtgcataccccccagggcgcaccccaggtgagccagccacttagagagcagagcgaggatatcccgggggctatcagttctgctttggctgctatttgcaccgcccctgttgggctcccagattgctgggacgccaaggaacaagtgtgttggcatttggccaatcagctaactgaggactcttcgcagcttagaccttcattaattagtggacttcagcatcctatcttgtgcctccatctgctgaaagtgttgtactcatgttgtttggtaagcgaaggattgtgtaggctcctgggtcaggagccgttggctctagagtctctctttatgttaatccaaggaaaggtcaaagtcgtagattgggaggaatcgactgaggtaaccctctacttcctgtcacttctggtttttcgactgcaaaacttgccgtgcgggatggaaaaacttgggtcagacgtagcgaccttgttcacacacagccacgttgtgagtttggtgtcagccgccgcctgtctcctggggcagctcgggcagcagggtgtgacatttgacctgcagccaatggaatggatggctgccgctacccacgcccttagcgcccctgcagaagttagactcacaccgccagggagttgcggattttatgacggcctccttatcctgctgctgcaattgttaactgagcaggggaaggctagcctgatcagggacatgtccagctccgaaatgtggactgtgctttggcatcggttcagcatggtcctgcggcttccagaggaagcctctgcccaggagggcgagctcagcctgtcatctcctccgtccccggaacctgactggacgctgatcagcccacagggcatggctgcccttcttagtttggcgatggccacctttacacaggaaccccagctgtgcctcagctgtcttagccagcatgggtccatccttatgtccattctgaagcacctgctgtgcccctcgtttctcaatcagttgagacaggcaccccatgggtctgagtttctaccggtcgtggtgctcagtgtttgtcagctgctgtgttttcctttcgcccttgacatggacgctgatctgctcatcggcgttctcgcagatctcagggactctgaggtggcagctcacctgctccaggtttgttgctatcacctgcccctcatgcaagttgagctgccgatctcactgttgacacgtcttgcactgatggaccccacatcccttaatcaatttgtaaataccgtgtcggcaagccctagaacaatcgtttcatttctgtccgtggctctgctgtcagaccaacctctgctgacttcggacctcctgtcccttcttgcacacacagcccgagtgctcagcccatcacatctcagctttattcaggagctgctggccggaagcgacgaatcctatcggccgctgaggtctttgctagggcatccagaaaactccgtgagagcccatacataccgcctccttggacatctgcttcagcattctatggctctgcggggagccttacagagtcagtcgggcctgcttagtcttctgctcctagggcttggagataaggaccccgtggtgcggtgttctgcaagttttgccgtgggtaatgctgcctatcaagcgggccccctgggcccagccttggcagccgctgtaccatcaatgacgcagctgttgggagatcctcaagcaggcatcagacgcaatgttgcgagcgccctcggaaacctgggacccgagggtcttggagaggagctactgcaatgcgaggtgccccaacggctgcttgagatggcttgcggagatcctcagccgaacgtcaaggaagctgctcttatcgcattgcgcagtctgcagcaggaacctggcatccaccaagtgttggtgagtcttggtgcaagcgagaagctttcccttctgtctcttggaaaccagagcctaccgcatagcagcccacgaccagcctcagccaagcattgtaggaagctcatccacctgctacgccccgctcatagcatgtag

SEQ ID NO: 133948 - DNA, 3885 bp, Artificial Sequence
  Description of Artificial Sequence: Synthetic coding sequence
atggagaagtatcatgtgctggagatgataggtgaaggaagtttcggccgagtctacaagggtaggagaaagtatagcgcgcaggttgtggctctgaaatttatacctaaattgggccggagcgagaaggaactgcgcaaccttcagagagaaatagaaataatgagaggtctgcgccacccgaatatcgtccacatgttggactcattcgagacagacaaggaggtggtggtggtaactgactatgcagaaggggagctcttccagatcctcgaagatgatggaaagctgcccgaagatcaagtacaggctatcgcagcccagttggtctctgccctgtattacttacacagccacagaattctgcacagggacatgaagccccagaacattctgctggccaaggggggtgggatcaaactctgtgattttgggtttgctcgtgcaatgagcactaacacaatggtgctgacatccattaagggcaccccgctttatatgagtccagagcttgtcgaggaaaggccttacgaccatactgccgatctatggagtgtgggatgcatcctgtacgaacttgctgtggggaccccacctttctacgctacttctattttccagctggtgagccttattctgaaggatccggttcggtggccctccaccatatccccctgttttaaaaactttctacagggcttattgactaaggatccgcgacagcgcctaagttggcctgatcttctgtaccaccctttcattgctggacacgtaacaatcatcacagaacccgccggcccagacttgggtacaccctttacttctaggctgccacccgagttacaggtcttgaaagatgaacaggcacaccgattggcgccaaaggggaaccagtcgaggatcttgacacaggcatacaagcgcatggcagaggaggcaatgcagaagaagcatcagaacacaggccccgctctggaacaagaagacaaaacctccaaagttgctcctgggactgcgcctctaccacggctgggcgctacaccacaagagtcgagcctcctcgctggaattctggcgagcgagctgaagtcaagttgggcaaagtcaggcactggcgaagtgcccagcgctccccgcgagaatcggactactccggactgcgaaagagctttcccggaggaacggcccgaagtgctcggccagagatccaccgacgtggtagacttagagaacgaggagcccgattcagataatgagtggcagcacttgctggagaccacagagcccgtccctatccaactcaaagcaccgctgacactcttgtgtaacccagatttttgccaacgtatccagagtcaactgcacgaggccggtggccagatattaaaaggcatattagagggcgcgtctcatatcttgcccgctttcagggtgctgagctcgctgttgagcagctgtagtgatagcgtcgcactgtacagcttttgcagggaagctggcctgccaggtctactgctgagcctcctgaggcatagccaggagagcaattctttacaacagcagtcctggtatgggaccttcctgcaggatctgatggctgtgattcaggcttactttgcatgcacctttaacttagagcgcagtcagacatccgattcccttcaggtatttcaggaggcggccaacttattcctggacctgttagggaagctgctagcgcagccagatgactcagagcagacactaaggagggactccctcatgtgcttcacggtgctgtgcgaagccatggacggcaatagccgtgctataagtaaggctttttatagctcactattgaccacccagcaggtggttctcgatgggctccttcacgggttaactgtgccacagctgcctgtgcacaccccccaaggggccccccaggtctcccagccactgcgagagcaatccgaagatattcccggagcaatatcgagcgctctggccgccatttgcactgcaccagtgggtttgccagactgttgggatgcaaaggaacaggtgtgctggcaccttgcaaaccagctgaccgaggattctagccagctccgtcctagcctgatctccggactgcagcatcctatcctttgccttcacttgctgaaggtgctttatagttgctgcctagtctctgaaggcctgtgcagactgctgggccaggaacccctggcactagagtccctgtttatgctcatccaaggcaaagtcaaagtggttgactgggaggagtctacagaagtgacattgtattttttgtcactattggtctttcgcttgcagaatcttccgtgtggaatggaaaagctcgggtcagacgtagccacgcttttcacacattcccatgtggtcagcttggtctctgccgctgcttgtctgctagggcagttggggcagcagggcgtaacatttgaccttcagccaatggaatggatggcagcagccacccatgccctttccgcccccgccgagctgttaaccgagcagggcaaagcctccttgatcagagacatgagcagttctgaaatgtggaccgttctgtggcatcgcttcagcatggtcctgcggctgcccgaggaagcttccgctcaggagggggagctctcgttgtcaagtcctcccagccccgagcctgactggacccttatcagccctcagggcatggcggccctgttgtctctcgctatggccactttcactcaggaacctcagctgtgcttaagttgccttagccagcacgggtcaattctaatgagtattcttaaacatctactctgcccaagctttctcaaccagctgcggcaggccccccatggatccgagttcctgccagtggtcgtgctgtccgtgtgtcaactgctctgctttcctttcgctctagacatggacgcggacctcctaatcggggtgttagcagacttgagggattctgaagtggccgcccaccttcttcaagtctgttgttaccacctcccccttatgcaggtagagctgccaatttcactgctgacaaggttggctctgatggaccccacatcacttaaccagtttgtgaacacagttagtgctagcccccgcacgatcgtgtccttcctttcagttgctctactctcagaccagcccctgctcaccagcgacttattatccctcctagcgcacaccgcaagagtgttgagtccatctcatctgtcttttatccaggagttgctggccggaagcgatgagtcttatcgacctctccgctcactgctcggacaccccgagaacagtgtccgagctcacacataccgactattagggcatctcctgcagcattcaatggctctcagaggcgccctccaatcccaatcaggcttactgtccctgctactactgggtcttggagataaagaccctgttgtgaggtgttcagcatctttcgccgtgggcaatgcggcgtaccaggccggacccctcggccctgccctggccgccgcggtgcccagcatgacccagctgttgggcgacccgcaggctgggatcaggcgtaatgttgcttctgcactgggcaacctcggcccggaaggtctgggtgaggagctgctgcagtgcgaagtaccacagcgccttcttgagatggcttgtggagaccctcagcctaacgtgaaagaggccgccctcattgccctgcgatcacttcaacaagagccaggcatacaccaggtgctggtttctctgggtgcgagcgaaaagctgtcactactaagcctgggcaatcagtccttgccccattcttcaccccgcccagcttccgctaaacattgtaggaagctgattcatttactccgaccagcccatagtatgtag

SEQ ID NO: 133949 - DNA, 3885 bp, Artificial Sequence
  Description of Artificial Sequence: Synthetic coding sequence
atggagaaataccacgtgctggagatgatcggagagggcagttttgggagggtttataagggtcgccgtaaatacagtgcccaggtcgtggctctcaagttcatacccaaattgggaagatccgaaaaggagctcaggaacctgcagagagaaatcgagattatgagggggcttcgtcacccaaacatcgtgcatatgctcgatagttttgaaaccgacaaggaggtggtggtggttaccgattatgctgagggcgaacttttccagattctcgaggacgatggaaaattgccggaagatcaggtccaggcaatcgcagcccagcttgtttcagctctttactatttgcattctcatcgcatcctgcaccgggatatgaagccccagaatattctgctggccaaagggggtgggattaagctgtgcgacttcggcttcgcccgcgccatgtcaacaaatacaatggtgcttactagcattaaaggaacccctctgtatatgtctcctgaacttgtggaggagcgaccctatgatcataccgcggacctttggtccgtcggctgtattctgtacgagttggcagtgggaacgccccccttctacgccaccagtatctttcagctggtcagcctcattctgaaggacccagtaagatggccttccacgatatccccatgtttcaaaaactttctgcaagggctgctcaccaaggaccctcgccaaaggctttcatggcctgatctattgtaccacccattcattgccgggcatgttactatcattactgaacccgctgggcctgatctgggcaccccattcacaagtaggctgccccccgaacttcaagtactcaaagacgagcaggcccaccgtctggcccccaaaggcaatcaatctagaattctaacacaagcgtataagcgcatggctgaagaggctatgcagaagaaacaccagaacaccggtccagctttagaacaagaagacaagacatctaaagtagcaccgggaactgctccgttaccccggctgggagcaactccccaagagtcatctctgttggcaggcattttggcgtctgagctgaaatccagctgggccaagtctggcaccggagaagttccatccgcacctagagaaaacaggacgaccccagattgcgagagagcctttcccgaagagcgacccgaagtgttgggccagcggagcaccgacgtggtggacctcgagaacgaggagcccgacagcgataatgaatggcaacacttacttgagaccaccgagccggtacccatccagctcaaagccccacttaccctactgtgcaaccccgatttttgccagaggatccagagtcagctgcacgaggccggcgggcagattcttaagggcattctggaaggggcgtctcacattctccccgccttccgggtgctgtcctccctcctcagcagctgtagtgactcggtggcactgtacagcttttgccgcgaggctggattgcctggattgctcctaagcttactgcggcactctcaagagtccaatagcctgcagcagcaatcctggtatggcacatttttacaggacctcatggctgtgatccaggcttattttgcttgtacgttcaatttagagcgctcccagacaagcgatagcttacaggtcttccaggaagccgccaatctctttcttgacttgctggggaaactgctcgcacagcctgatgacagcgaacagacactgcgccgagattcccttatgtgctttaccgttctttgtgaggctatggacggtaactcacgagctatttccaaagctttctactccagccttttaaccacacagcaggtcgtcctcgatggattgctgcatgggctgactgtaccccagctgccggtgcacactccacaaggcgcccctcaggttagccagccccttagggaacagtcagaggatattcctggcgctatttcaagtgctcttgccgccatttgtacagccccagttggtttgcccgattgctgggatgctaaggagcaggtgtgctggcatctcgccaaccagctgaccgaagattcaagccagctgcggccatctttaatttccggcctgcagcaccctatcttgtgcctccacctgttgaaggtgctgtacagctgctgtttagtgtctgaaggactgtgcagacttttgggccaagaacccctggcactggagtctctcttcatgctcatccagggaaaggtaaaagtggtggattgggaagagagcacagaggtaacgttgtattttttgtccctgcttgtcttcaggctccaaaacttgccctgcggtatggaaaagctgggaagtgatgtggccacactgtttacccactcgcacgttgtcagtctagtgtcggcagcggcatgtctgctcgggcaactggggcagcagggagtcacctttgacctgcagcccatggagtggatggccgcggcaactcatgcgcttagtgcccccgcggaaatgagctgtgaacaaggaaaggcaagtctaattagagatatgtcctccagcgagatgtggaccgtcctgtggcaccgttttagtatggtgttgcgattacctgaagaggcctcggcccaggagggagagttatccctctctagccctccatcacccgaacccgattggacattgatctctcctcaagggatggcagcgttgttaagcctggctatggcaacatttacacaggagccacagctgtgtctgtcctgtctgagtcagcatggatccattttaatgtctattttaaagcatcttctgtgtcctagttttctgaatcaattgagacaagcgccccatggttctgaatttttgcccgttgtcgtcctcagcgtgtgccagttgctctgcttcccgtttgctttagatatggacgctgatctcctgattggagtgctggccgaccttcgggattctgaggtggcagcacatttgcttcaggtttgctgctaccacctgccgctgatgcaggtggagctccctatctcgctcttgacgcgcctggccctgatggacccaacctctctcaaccagtttgtcaacaccgtgtccgcaagcccccgcacaatagtgtctttcctaagcgtagcacttctatccgaccagcccctgctgacttcggatctcctcagccttttagcacacaccgcccgggtgctgtcaccaagccacttgtccttcatccaggagctgctcgcaggatccgatgaaagctacagaccactgagatccctcctgggtcatcccgaaaattccgttcgcgcacacacttacagattactgggacacctgttgcagcactcaatggctctccggggggcactccaaagccagagcggccttttgtctcttctgctgctgggacttggggacaaggatcccgtggttcgatgttccgccagctttgccgttgggaacgctgcctatcaggcaggtccactcggacccgccctggccgcagcagtcccctcaatgactcagcttttaggcgatccacaggccggcattaggcgaaatgtggctagcgctttgggtaatttgggacccgagggccttggagaggagcttcttcagtgcgaagtgccacaacggctgctggagatggcctgcggcgatccccagcccaatgtcaaagaggccgctcttattgccctgcggtccttacaacaggaacctggcattcaccaggtgttagtctcattgggagcctccgagaagttaagcttactgtccctcggcaaccagtctctgcctcactccagtccacgcccagcctcagccaagcactgccgcaagctgattcacctcctaagacccgctcattccatgtag

SEQ ID NO: 133950 - DNA, 840 bp, Artificial Sequence
  Description of Artificial Sequence: Synthetic coding sequence
atggagaaataccacgtcctggagatgataggagaaggaagcttcggcagggtgtacaaggggcggaggaaatattcggctcaggtggtggccttgaaattcattcctaagctgggcagaagcgagaaagagctgaggaatctgcaaagagagattgagatcatgcgcggattgcggcaccccaatatcgtgcatatgttggatagctttgagactgataaggaagtggtggtggttaccgattatgctgagggggagcttttccagatattagaagacgatgggaaactgcctgaagaccaggttcaggcgatcgccgcccagctcgtgtcagccctctattatctgcattcacacagaattctccatcgcgacatgaagcctcaaaatattttactggccaaaggagggggaataaaactgtgcgattttgggttcgccagagcaatgagtacaaacaccatggtcttaacctcaatcaagggaacgcccctgtatatgagtccagagctcgtggaggagagaccctacgaccacactgccgatttgtggtcagttggctgtatcctgtacgagctggcggtgggcacccctccattctatgccacttccatctttcagctggtgtcgcttatccttaaagatcccgtccgctggccctccacaatctctccttgctttaagaatttcctacagggacttctgacaaaagaccctaggcagagactgagctggcctgacctgctgtaccatccattcatagcaggccatgttacgataatcacagaaccagcgggaccagatttggggacaccgttcaccagccgcctgccgccgtag

SEQ ID NO: 133951 - DNA, 3948 bp, Artificial Sequence
  Description of Artificial Sequence: Synthetic coding sequence
atggaaaaataccacgtgctggaaatgataggcgagggcagctttgggagggtttataagggaaggaggaaatattccgcacaggtcgtcgcccttaagttcatcccaaagcttggcaggtctgagaaagagctccggaatctccagcgcgaaatcgaaatcatgcgagggctgcgacaccccaatatcgtccacatgctggactcgtttgagaccgataaagaagtagttgtcgtgactgattacgccgaaggtgaactgttccaaatactcgaggatgacggcaagctaccagaagaccaggtgcaggccatcgctgcacagctcgtaagtgccctgtactacctgcattcacaccggattctacacagagacatgaagcctcagaacatcctgctcgcaaaagggggaggcataaagctgtgcgatttcggcttcgccagggccatgtcaaccaataccatggttctgacaagtattaagggcaccccactttacatgagccctgagctggtggaggagcggccttatgaccacaccgctgatctttggtcagtggggtgtatactgtatgagttggctgtgggtacaccacctttctacgctacctcaattttccaacttgtctcgcttattttgaaagaccccgtgagatggcctagcaccatctccccgtgcttcaaaaacttcctgcaaggactgctcacaaaggatcctcgccagcggctttcctggcccgaccttctataccatccattcattgccgggcacgtaaccatcatcaccgagcctgcaggcccagatttaggcactccctttacctccaggctgcctccagaactgcaggttttgaaagatgagcaggcccacagactcgctccaaaagggaatcagagcaggatactaactcaggcgtataaacggatggctgaagaggcaatgcagaagaagcaccagaacaccgggccggcacttgaacaggaagacaaaacgtccaaagtggccccagggacagccccactgccccgcctcggggctacaccccaggagtcctctttactagccggaatcctggcttctgagctgaagtcatcttgggctaagtcgggcacaggggaggtacccagcgccccccgggagaaccgcacgactccagattgcgaaagggcttttccggaggaacgccccgaggtcctgggacagagatcaaccgatgtcgtggacctagaaaatgaggaacccgatagcgacaatgagtggcagcacctcctggaaaccacagaaccggtccctattcagctcaaggctcctcttacactgctgtgcaaccctgatttctgtcagagaatccagtcacagctccatgaggccggaggacagatactgaagggaatcctcgaaggcgcgtcccacattcttcctgcctttagagtcctgtcttctttgctgtcgtcttgtagtgactctgtggctctctatagtttttgtcgcgaagcagggttaccaggccttctgctctctttactgcgtcattcacaggaatcgaattccttgcaacagcagtcctggtatgggaccttccttcaagatttgatggctgttatccaggcatactttgcatgcactttcaatctggagaggtcgcagacttcagacagcctgcaggtcttccaggaggccgctaatctgtttcttgacctcctggggaagctcctggctcagccagacgattctgaacagactttacgccgcgatagcttgatgtgtttcactgtgctgtgtgaggctatggacggcaactcccgggctatttcgaaagctttttattcaagtttgctaaccacccagcaagtcgtgctcgacgggctgctgcatggactgaccgtccctcaattacctgtccataccccccagggggctccccaggtcagccaacccctgagagaacagagtgaagacatccccggagcgatctccagcgcattggctgccatctgtactgctcccgtggggttgccagattgttgggacgccaaggagcaagtgtgctggcaccttgcaaaccaactgaccgaggacagctctcaactgcgcccatctctgatctccggtctgcagcacccaattctctgcctccacctcctgaaagtgttgtacagctgctgtcttgtctctgagggactatgccggctgctcggccaggagcccctggccctcgaatcactgttcatgctgatccagggcaaagtgaaagtggtggattgggaagaaagcacagaggtgactttgtacttcctcagcctgttagtttttcgattgcaaaatctcccatgtggtatggagaagctgggtagcgacgtcgcgactctcttcactcacagccatgtcgtctctctggttagcgccgccgcctgcctgctcgggcaacttggccagcagggggtaacattcgacttgcaaccaatggagtggatggcggccgcaacccacgctctgtccgcccccgcagaagtccgcctgacccctccaggaagttgcggcttctacgatggcctccttatcttactgctgcagctgctcacagaacaagggaaagcgtctctgatcagagatatgtccagtagcgagatgtggacagtactatggcatcgattctccatggtgctgcggctaccggaagaggcatctgcacaagaaggggagctatctctgtcgtctccaccatccccagaacctgactggactctgatctccccccaggggatggccgcactcctgagccttgccatggccaccttcacccaggaaccgcaactttgtctatcctgtctgtcccaacatggcagtatcctaatgtctattctgaagcatttgctatgcccctcgtttctcaatcagctgcgccaggcgccacatggctccgagttcctgccagttgttgtcctgtcagtatgccaacttctgtgttttccctttgctctggacatggacgctgatttgctgatcggcgtcttggctgatttacgcgattctgaagtcgcggctcatctactacaggtatgctgttaccatctgcccctgatgcaggttgagctccccataagcctgctcactcgactggcacttatggacccaaccagcttaaaccagtttgtcaacaccgtgtcggcaagtcccagaacaattgtcagctttctgtcagtggcattgcttagtgatcaaccattattgacctcagatctgctttcattgctggcccatacagcccgcgttctgtcacccagtcatttatcgtttattcaggaactgttggccggttccgatgaatcttacagacccctgcggtctctcttgggccacccggaaaactccgtcagagcccacacttatcgtctgcttggccacctcctccagcactctatggctcttaggggggccctgcaatcgcagtcagggttactatcactgcttctgctcgggctgggagataaagatccagtggtgaggtgctctgcttcctttgctgtggggaacgcagcttatcaagccggccccctaggccccgcattggctgctgccgttccgtctatgacacaactgctgggggatccccaggcgggtatcagaaggaacgtcgccagcgcactgggcaatctaggcccagagggattgggagaggaactgttacaatgcgaggtcccccagcgcctgctagagatggcctgcggcgacccacagcctaacgtaaaggaggcggccctcatagccctgagatccctgcagcaggagcctggaattcatcaggtgctagtttctcttggagcctcagagaagctgtctctattgagtctcgggaatcagtcccttccccacagttcaccacgcccggctagcgctaaacattgtaggaagctgattcacttattaaggcctgcgcacagcatgtag

SEQ ID NO: 133952 - DNA, 1056 bp, Artificial Sequence
  Description of Artificial Sequence: Synthetic coding sequence
atgcggtttaccttccctctgatggctattgtcttggaaatcgccatgattgttcttttcgggctgtttgttgagtatgaaaccgaccaaaccgttcttgagcagttgaatataaccaaacctactgatatggggatcttctttgagctgtacccactatttcaggacgtccatgtgatgatctttgtaggtttcggattcctcatgactttcctcaaaaagtatgggttctcatcggtggggataaatctgctggtcgccgccttgggcttgcagtggggcacgattgttcagggaatattacagagtcagggccaaaaatttaacattggcattaagaacatgatcaacgccgatttttccgctgccaccgtgctcataagcttcggcgcagtactggggaagacgtctcctacccaaatgttgattatgacgatcctcgaaatcgttttctttgcacacaacgaataccttgtcagcgagatctttaaggcgagcgatatcggcgcaagtatgactattcacgctttcggggcctattttggcctggctgtggcaggcatcctctaccggtctgggctccggaaaggccacgagaatgaggagtcagcatattacagtgacctgttcgctatgatcgggacactattcctttggatgttctggcccagcttcaacagtgctatcgccgagcccggtgacaagcagtgtcgggccattgtgaacacctactttagtctggctgcttgcgtgctgactgcttttgccttttcctcgcttgtggagcaccggggcaaactaaacatggttcatatccagaacgctacattggcgggcggggtagccgtaggcacatgcgccgacatggccattcatccttttggatccatgattattggcagtatcgcggggatggtgtctgtcctggggtataaattcctgacagtttacggccatgcggggagctgcacaggcttcttataccggaattcttcttgttggaggagcgacgataggttcaactcgaaggtggcctccctcgggactgccatttag

SEQ ID NO: 133953 - DNA, 1389 bp, Artificial Sequence
  Description of Artificial Sequence: Synthetic coding sequence
atggagactgtgcagttgaggaatccacctaggagacagctaaagaaactggacgaggactccctgacaaaacagcccgaggaggtctttgacgtgcttgaaaaactcggcgagggatcctacggcagtgtgtataaggccatccacaaggagacggggcagatcgtggccattaagcaggtgccagtggagtctgatctacaagagattatcaaggagatctcaatcatgcagcagtgcgactctccacacgtggttaagtattatggaagttactttaagaacactgacttatggatcgttatggaatactgcggcgcggggagtgtgagcgacattatcagactgaggaataagacactgacagaggacgagattgccactatcctgcagtccacactgaagggtcttgaatatctccactttatgcgcaaaattcaccgtgacattaaggccgggaatatcctgctcaataccgagggacacgctaagctggcagactttggagttgccggacagttgacagacacaatggcgaagcggaatactgtgataggaactcccttctggatggctccagaagtaatacaggaaattggctataactgcgtggctgatatatggtcgctcggcatcacagctattgaaatggctgagggaaaaccaccttatgccgacatacatccgatgcgggctatcttcatgatccctacaaatcctcctccaacgtttagaaagcccgaactgtggtccgacaacttcaccgattttgtgaagcagtgcttggtcaagtcccccgaacagagagcaacggccacccagctgttgcagcatccattcgtgcggtccgccaagggcgtgtcgatcttgagagacctcatcaatgaagccatggatgtgaaactcaaaaggcaggagagtcaacagcgtgaagttgatcaggatgatgaggaaaatagcgaagaagatgaaatggacagcggaaccatggtacgcgcggtgggcgacgagatgggcaccgttcgagtagccagtaccatgaccgatggagcaaacaccatgattgagcacgatgacaccttgcccagccagctcggtaccatggtgataaacgcagaagacgaggaagaggaaggcacaatgaaacgcagggacgagacgatgcaaccggccaagccttctttcctcgagtatttcgaacagaaggagaaagagaatcagatcaactcattcgggaagtcagtgccaggccccctgaaaaattccagcgattggaaaatcccccaggatggggactacgagtttaagacatcacaagagcagcagtctgggaaagacatctgtatccaaaattgtcagggaaatctgctgtgtagatatgctttttag

SEQ ID NO: 133954 - DNA, 1464 bp, Artificial Sequence
  Description of Artificial Sequence: Synthetic coding sequence
atggaaaccgtgcagctgcgaaatcctccccggcggcaactgaagaaactcgatgaagattcacttaccaaacagccagaggaggtgttcgatgtgctcgagaagcttggggaagggtcctatggaagtgtatacaaggctatccataaagagacaggccagattgtagctatcaaacaagtgcctgtcgagagcgacttgcaggaaattatcaaggaaattagcatcatgcagcagtgtgactcaccgcatgtggtaaagtattatgggtcttacttcaaaaacactgatctgtggatcgtgatggagtattgtggcgccggctccgttagcgatattatccgcctgagaaataaaaccctcaccgaggatgaaattgctacgatcctccagagcacgctgaaggggctggagtatctgcacttcatgcgcaagatccatagagacatcaaggcaggaaatatcttactaaatacagagggccacgctaagttagcggactttggggtcgccggacaacttaccgacacaatggccaaacggaatacagtaattggtacccctttttggatggcacccgaagtgatccaggagatcggctataattgtgtcgcggatatttggtctctggggatcaccgccatagagatggctgaggggaagccaccctatgctgacatccaccctatgcgggcgatttttatgatccccaccaacccaccaccaacattccgaaaacccgaactgtggtctgataattttacagacttcgtgaagcagtgtttagtcaaatcccccgaacaaagagcgactgcaacacagctgctgcagcacccatttgtacgcagcgctaagggcgtgtccatcctaagggatttgattaacgaagcaatggacgttaaactgaaacggcaggagtctcagcagcgtgaggtagaccaagacgacgaagaaaattcagaggaggatgaaatggactccggaaccatggtgcgcgccgtaggtgatgagatgggcactgttagggtcgcctcaacgatgaccgatggcgccaataccatgatcgagcatgatgacaccctgccatcgcaacttggaaccatggtgattaatgccgaagatgaagaagaggaaggaactatgaagagacgcgacgagactatgcagcctgctaagccatcctttcttgagtattttgaacaaaaggagaaagaaaaccagattaattcctttggcaagtccgtccccggtcctctcaagaatagttccgactggaagatccctcaagatggggattatgagttcttgaagtcttggacagtggaagatctccagaagagactgctcgcattggatcccatgatggagcaggagatagaggaaatacggcaaaagtatcagagcaaacggcagccgatcctcgatgctattgaagccaaaaagaggcggcagcaaaatttttag

SEQ ID NO: 133955 - DNA, 1389 bp, Artificial Sequence
  Description of Artificial Sequence: Synthetic coding sequence
atggaaaccgtgcagctgcgcaaccctccacggaggcagttaaagaagctggatgaggatagcttgacgaaacaacccgaggaagtgttcgatgtcctcgaaaagctgggcgaaggaagttacggatctgtctacaaggctatccacaaagaaacaggtcaaatagtggctattaagcaggtgccagtcgaatcggatctgcaggaaatcataaaagagatctccattatgcaacagtgcgattccccccacgtggtgaagtactatgggtcgtactttaagaatacagacctctggattgtcatggaatattgcggcgccggcagtgtgtcggacattattaggctgaggaataagaccctcaccgaagatgagattgccacgatccttcaatctaccctcaaaggactcgaatacttgcactttatgcgtaaaattcatcgggacattaaggccggcaatattctgctcaatacagagggtcacgccaagttagcggacttcggtgtggccggacagctgacagatacgatggcgaaaagaaacacagtgatcggaacccccttttggatggcaccggaagttatccaggagatcggatacaactgtgttgccgacatctggtccctgggcatcaccgctatcgagatggctgagggaaaaccaccttacgcagatatccacccgatgagggctatttttatgatcccaacaaacccaccccccacttttcgaaagccagaactgtggtctgacaacttcacagacttcgtgaagcaatgcctggtcaaatcccccgaacagcgcgctacagctacacaactcctgcagcaccctttcgttcgaagtgcaaagggagtctctatccttagggacctgatcaatgaagccatggacgtgaagctgaaacgtcaagagtcacagcagagggaggtagatcaggatgacgaggagaactccgaggaggatgagatggactccggtactatggtccgggccgtaggagatgaaatgggcacagtccgcgttgcctccaccatgacagatggtgctaacacaatgattgaacatgatgataccctgccaagtcagctcggcacgatggtgatcaatgcagaggacgaagaggaggaaggaactatgaaaaggcgagacgaaacaatgcaaccggccaagccctcatttctcgaatattttgagcagaaggagaaagaaaatcagatcaattcattcggcaagtccgtgcctggacctttgaaaaatagctctgactggaagatccctcaggatggagactacgaatttaagacaagccaggagcagcagagcgggaaggacatctgcatccagaactgtcaggggaaccttctgtgcaggtatgccttttag

SEQ ID NO: 133956 - DNA, 1299 bp, Artificial Sequence
  Description of Artificial Sequence: Synthetic coding sequence
atggagaccgtgcagttgcgtaatccaccccggcgccagcttaagaagctcgatgaggactcactgacaaaacagccagaagaggttttcgatgtgctggagaaattaggtgagggatcctatggctcagtgtacaaggccatccacaaagagacaggccagattgttgccatcaagcaggtgccagttgagtccgacctgcaggagatcattaaggagatctctatcatgcaacaatgcgattcccctcacgtggtgaagtattacgggtcctacttcaagaatactgatctgtggatcgtgatggagtattgcggcgctggcagcgtaagcgacatcatccgtttacgcaacaaaactgacacgatggctaagaggaacactgtgattgggactcccttctggatggcacccgaggtgatccaggagatcggctataactgcgtggctgatatctggtccctggggataactgcaattgaaatggcagagggtaagcccccttacgccgacattcacccaatgcgggctatcttcatgattcctaccaacccccctccaactttcaggaagcctgagttgtggagtgacaacttcacggatttcgtgaagcagtgcctcgttaaatcccctgaacagcgagcgactgccactcagttgctacaacatccatttgtcagatctgctaagggagtgagtattctgagagatctcatcaacgaggccatggatgtgaaactgaaaaggcaggaatcacagcagcgcgaggtggatcaggatgacgaggaaaacagtgaggaggatgaaatggattcaggcacaatggttcgtgcagtgggtgacgagatgggtacagtcagggtggcctccacaatgactgacggagctaacacgatgatcgagcacgacgacacactccctagtcagcttggcaccatggtgatcaatgccgaggacgaggaggaggaggggaccatgaagagaagagatgagacgatgcagcccgccaagccgtcatttttggagtactttgagcagaaagaaaaagagaatcagatcaacagctttggtaaatccgtccccggccctctgaagaactcctccgactggaaaataccgcaagacggagactacgaatttctcaagagttggaccgtggaggatttgcagaagcgcctgttggccctggatccaatgatggagcaggaaatcgaggaaattagacagaaatatcagtcgaagagacagcccatactggacgcaatcgaagctaaaaaacgcaggcaacagaatttctag

SEQ ID NO: 133957 - DNA, 1254 bp, Artificial Sequence
  Description of Artificial Sequence: Synthetic coding sequence
atgaaacgcagggcttcagacagaggagctggcgagaccagtgcccgggcaaaagctcttgggtcggggatttccggcaataatgcaaagagagctgggccctttatccttggtccgagactgggcaacagccctgtaccatcgatcgttcaatgcctggcccgaaaggacggaacagacgacttttatcagctaaagatcctaacattggaagagaggggggaccagggtatcgagtcgcaggaggagagacaagggaaaatgctgctgcatacagaatactcattgttaagtctcttgcatacccaggatggggtggtgcaccaccatggccttttccaggacagaacgtgcgagattgtggaagatacagagagttccagaatggtgaagaaaatgaaaaaaaggatctgcctggtactggattgcctgtgtgcacacgatttctctgataagaccgccgaccttatcaacctgcagcactatgtcattaaagagaaacgactgtctgaacgcgagactgtcgtaattttctacgacgtcgtgagagtcgttgaggctcttcaccagaagaatatagtgcacagagatctaaagctgggtaacatggttctgaacaagcggacacaccgcatcactattacaaacttctgcctcggcaagcatctcgtgtctgagggtgatctgttgaaggatcaaaggggatccccagcttacattagccctgatgtactgagcgggagaccctaccgtgggaaacccagtgacatgtgggctctcggcgtggtcttgttcacaatgctttacggacaatttcccttctacgacagcattccacaagagctgttccgtaagatcaaagcggccgaatacactatcccagaagatgggcgagtttccgaaaacacggtgtgcctaattcggaagctcctcgttctcgacccccagcagcggctggccgctgccgatgttctggaagctctgtcggcaatcatcgcttcttggcagtcactcagctcattgagcggcccgctgcaggttgtgcccgatatagatgaccagatgtctaacgcagactcgtcccaggaagtgtcatgggggggacagatgggacactaccccgcccctcgggatcgcttattgggggccggaagagccagagccgaggtggccgctacccgtagaccacagagcttcctgggcctattaccccagccttgggggggcaagggcagactgcagtcgagcgcctag

SEQ ID NO: 133958 - DNA, 1308 bp, Artificial Sequence
  Description of Artificial Sequence: Synthetic coding sequence
atgaagcgccgggcatcagatcggggggcaggagagaccagcgcaagggccaaggccctgggctccggaatttctggaaataatgccaaacgcgccggtccttttatccttggtccacggctcggcaatagccccgtgccgtcaattgttcagtgtctcgcacgcaaggatggtaccgacgacttttatcaactcaaaatcctgacactggaggagcgaggggatcagggcattgagagtcaagaagagcgtcagggcaaaatgttgctgcacactgagtactcgctcctatccctactccatacccaagacggagtggtgcaccatcacgggctgtttcaggataggacctgcgagatcgttgaagacacggaatcctctcggatggttaaaaagatgaagaaaagaatatgtttagtactcgactgtctatgtgcccacgacttttctgataaaaccgccgatttgatcaatcttcaacactatgtaatcaaggagaaaagactctctgagcgggaaaccgttgtgattttctacgacgtggttagggtggtggaggctcttcatcagaagaatattgtgcacagagatttgaagctggggaacatggtcctcaataaacgaacacaccgaattactataacaaacttttgtcttggcaagcatctggtgtcagaaggagatctgctcaaggatcagcggggtagccccgcttacatcagtcctgacgtgctgagcgggaggccctatagagggaaaccttccgatatgtgggcgctgggtgttgtactgttcacaatgctctatgggcagttcccgttctacgacagcatcccccaggaactcttcagaaagattaaggctgcagaatataccatcccagaggacggaagggtgagtgaaaacaccgtctgcctgatccggaaactgttggtgctggacccgcagcagagactggcagctgccgatgtcctcgaggcactctccgcaatcatagcctcctggcaatccctctcctctctgtcagggcctctccaggttgtccctgatatcgatgaccaaatgagcaacgcggattccagccaagaggctaaagtcacagaggagtgcagccagtacgagtttgagaactacatgagacaacaactgttactggccgaagaaaagtcttccattcatgatgcaaggtcatgggtgcctaaaagacaatttggaagcgcgccccccgtgcgacgcctggggcatgatgcccaacccatgacatccttggacacggctatccttgcccagcgctacctgcggaaatag

SEQ ID NO: 133959 - DNA, 1323 bp, Artificial Sequence
  Description of Artificial Sequence: Synthetic coding sequence
atgaaacggagggcatccgatcgaggggccggtgagaccagtgcaagagctaaggctttaggatctgggatctccggaaacaatgccaagagggcaggccccttcatcctggcattatgcgccgtggggcctaggcttggaaatagccctgtgccgtccatagtccagtgcctggcccggaaggacggcaccgatgacttttaccagctgaaaatcttgaccttagaagagcgaggagaccagggaatcgagagccaggaggaacgacagggcaagatgcttttgcacaccgaatattccctactcagtctgctgcacacccaggatggcgtcgtgcaccatcacggactgttccaagaccgaacctgtgagatagttgaggacacagaaagcagcaggatggtcaagaaaatgaagaagagaatctgtctcgtgctggattgcctgtgtgcccacgacttttcggataagaccgccgatctaatcaacctgcagcactatgtgattaaggagaaaagattgagcgagagagaaacagtggtgatattttatgacgtggtgagagtagtggaagcactgcatcagaagaacatcgttcaccgagatctcaagttaggtaacatggtgcttaacaaacgaacacaccgaatcacaataactaatttttgtctgggcaaacacctggtatccgagggagacttactgaaggatcagcgcggaagcccagcttacatctcccctgacgtgttatctgggagaccatatcgtggaaagccatcggatatgtgggcattgggagttgtgttgtttaccatgctatatggccagtttcctttttacgacagtataccccaggaactgttcaggaagatcaaggccgccgagtatactatccctgaagacgggagagtttcagagaatactgtgtgtctgatcaggaaattgttggtcctcgatccccagcagcgtctggccgcggccgatgtgctcgaggccctgagcgcaataatcgcctcttggcagagcctgagtagcctctccggaccactgcaagtcgtgcctgacattgacgaccaaatgtctaacgccgacagctctcaggaagcgaaggtcaccgaggaatgttcgcagtacgaattcgagaactatatgcgacagcagttgttactggcagaagagaagtctagtatacatgatgcccgttcttgggtgccgaaaaggcagttcggctcagctcctcccgtccggagattgggccatgacgcacagccaatgacgtccctggatactgccatcctggcccagaggtacttaaggaaatag

SEQ ID NO: 133960 - DNA, 1308 bp, Artificial Sequence
  Description of Artificial Sequence: Synthetic coding sequence
atgaagcgcagggcaagtgatagaggagcaggtgaaacatctgccagggccaaggcactgggctccggcatctcggggaataacgccaagcgggcagggcccttcatcttaggcccacgccttggcaacagtcctgtaccctccattgtccagtgtctggctaggaaggatgggaccgatgatttttatcagctcaaaatactgactctcgaggaacggggggaccagggtatcgaatcccaggaggaaaggcaaggaaagatgctactgcatactgaatattcgcttctctctttactgcacacgcaggacggcgtagtgcaccaccacggtctgttccaggataggacttgtgagatcgtggaggacactgagtcctcaagaatggttaagaagatgaaaaagcggatttgtttggtgctcgactgtctctgcgcacatgacttcagtgataaaacagccgacttgattaatttgcagcactatgtgattaaggaaaagcggttgagcgagcgcgaaactgtggttatattttacgatgtggtgcgagtcgtggaagccctgcatcaaaagaatattgtgcaccgcgacttgaaacttgggaatatggtgctgaataagagaacacatagaattactatcaccaatttttgtctaggaaagcacctggtgagcgaaggagatcttttgaaagaccagagaggctcaccagcctacatctctcccgacgttttaagcggcagaccatataggggtaagccaagcgatatgtgggccctcggggtggtacttttcacaatgttatacgggcagttccccttttatgacagtattccacaagaactgttccgaaaaattaaggctgcagaatataccatccccgaggacggcagagtctcagagaatacagtgtgcttgatccgcaagctgctcgttctagacccacaacaacgcctggctgccgccgacgttctggaagctctcagtgcaatcattgcaagttggcagtctctgagtagcctctccggacccttgcaggtcgtgccggatatcgatgaccagatgtccaacgccgacagcagtcaagaagccaaggtcacggaagaatgttcccaatacgagtttgagaattatatgcgccagcaactcctgctagccgaggaaaaatcctctatccacgacgcccggtcttgggttcccaaaagacagttcggctccgctcccccggtccgacgcctgggacacgacgctcagcctatgacctctctggacacagcaatccttgctcaacgctacctaaggaagtag

SEQ ID NO: 133961 - DNA, 1092 bp, Artificial Sequence
  Description of Artificial Sequence: Synthetic coding sequence
atggccatgcgccaaacaccgctcacctgcagtggccacactcggcccgttgtggatctcgcattctcggggatcactccctatggctactttctgatatctgcttgtaaaggagcaggtcagcaccttccgagactctctggtcagcatgacggaaaacccatgctaagacagggcgatacgggggattggattgggacctttttaggccataaaggcgcggtgtggggagcgaccttaaataaggacgccaccaaagctgcaactgcagcagcagacttcaccgctaaagtctgggatgctgtgtcaggagatgaactcatgacacttgcgcacaagcacatcgtcaagactgtggacttcacccaagattccaactaccttctgactggcgggcaagacaaattgcttcggatctacgacttaaacaagcctgaggcagaacccaaagaaattagcggacatactagtgggatcaagaaagcactgtggtgttctgaggataaacaaattttaagcgccgatgacaagacagtgcggctgtgggaccatgccaccatgactgaggtgaaaagcctgaactttaatatgtcagtgtcttcaatggagtatatccctgagggagaaattctagtcatcacctacggtcgaagcatagcctttcactctgccgtatccctggacccaataaagagttttgaggccccggcaaccatcaatagtgccagcttgcaccccgagaaggaatttctcgttgcgggcggagaagactttaagttgtataagtatgactataattccggcgaggaactcgaaagttacaagggacattttggcccaatccactgtgtgagattttcaccagacggagagctctatgcttctggcagcgaagacggaacactaagactgtggcagacagtggtgggaaagacctatggactgtggaaatgcgtgctgcccgaggaagacagcggggagcttgccaaacccaaaatcgggtttcctgagacaaccgaagaggagctggaggaaattgcctccgagaactccgactgcatattcccgtccgccccggatgtcaaggcatag

SEQ ID NO: 133962 - DNA, 1053 bp, Artificial Sequence
  Description of Artificial Sequence: Synthetic coding sequence
atggccatgcggcagactccacttacatgcagcggccacacacgtccagtcgttgacctggccttctcaggtatcacgccgtatggctattttctgatttccgcctgcaaggacggtaaacccatgcttagacagggcgacaccggcgactggattggcactttcttgggacacaaaggcgctgtttggggggccacactgaataaagacgccacgaaggcggcaaccgccgctgccgatttcaccgcgaaggtgtgggatgcagtcagtggggacgaattgatgacactggcacacaagcatatcgtgaagactgttgatttcacccaagactccaactaccttctgaccggagggcaggataagctgcttaggatttatgatttaaacaagcccgaagccgaaccaaaggagatctctgggcacaccagtggaatcaagaaagcactgtggtgctccgaagataaacagatcctaagcgccgacgacaagacagttaggctttgggaccacgccacgatgactgaggtcaagagtctaaattttaatatgtctgtgtctagcatggaatacattccagagggggagatcctcgttattacctacggaagaagcatcgcatttcattcggctgtgtctcttgatcctattaaatcttttgaggccccggcgactattaactcggcctctctgcaccctgaaaaggagtttctggtggctggcggagaagactttaagctttacaaatatgattataatagtggcgaagagttagagtcctataagggacatttcggcccgattcactgtgtgcgctttagtccagacggcgagctctacgcctccggctctgaagatgggacccttcgactgtggcaaactgtggtgggaaaaacttatggactctggaaatgcgttttacctgaggaggatagcggggagctggccaagcctaagattggctttccagagacaaccgaggaagagttggaagaaattgctagtgaaaactccgactgcatatttccatctgcgccggatgtgaaggcttag

SEQ ID NO: 133963 - DNA, 771 bp, Artificial Sequence
  Description of Artificial Sequence: Synthetic coding sequence
atgaccctggcgcacaagcacattgtcaaaactgtggactttacacaggactccaactacctgctgacaggtggccaggataagttgctccggatttatgatctcaacaagccagaggcagagcctaaggagatctccggacacacgagcggtatcaaaaaggccctatggtgctcagaggataaacagatattgtctgccgatgataagaccgtgcggctttgggaccacgccaccatgacagaggtgaaatcactcaacttcaatatgtccgtatcatccatggagtatatacccgagggagagatactcgtcatcacatacggccggagtatcgccttccacagcgctgtgagcttggaccctattaaaagttttgaggctccagcaaccattaactcagcttctctgcatcctgagaaagagttcctcgtggccggaggggaggattttaaactgtacaaatacgactataactctggagaggagcttgaaagctacaaggggcacttcggcccaatccactgcgtccggttctcccccgatggggaactgtacgcctccggatccgaagacggaacattgcgcctgtggcaaaccgtcgtgggaaagacctatgggctttggaagtgcgtcctacccgaggaagactcgggagagctggcgaagccaaagataggattccccgagacaaccgaagaggaactggaggaaattgcctccgaaaattccgactgtatattcccatccgcccccgacgtcaaggcttag

SEQ ID NO: 133964 - DNA, 1707 bp, Artificial Sequence
  Description of Artificial Sequence: Synthetic coding sequence
atgaagaataaaattcaggtggtagtactggagaacgaaggcctccagcagcagctcaaatcccagcgacaggaggaaacactcagagagcagacactgctggatgctagtggcaacatgcacaacagctggatcaccactggagaagactctggtgtcggcgagacaagcaaacgaccattctcacatgataatgcggattttggcaaagcggcctccgctggcgaacaactggagctcgagaagcttaaactgacgtacgaagagaagtgtgagatagaagagtcgcaactcaaattccttcgaaacgatctggcagagtatcagcgaacctgtgaagatctcaaggagcaattaaagcacaaagagtttctgctcgcagctaatacttgcaacagagtcggtggtttatgtctgaagtgtgcccagcatgaggccgttctatcccagactcatactaatgtgcatatgcaaacaatcgaaaggcttgtgaaggagagggacgacctcatgtctgccttggtttccgtacgttctagtttggccgacacgcagcaacgagaagcctccgcttatgagcaggttaagcaggtgcttcaaataagcgaagaagccaacttcgaaaaaaccaaggccctcattcagtgtgaccagctccgcaaagaactcgagaggcaggccgaaagactggagaaagagctagccagccagcaagaaaagcgcgcaatagaaaaagatatgatgaagaaagaaatcactaaagaaagggaatacatgggcagcaagatgctgatcctgtctcaaaatatcgcccaacttgaggctcaggtggagaaggtaaccaaggaaaagatctcagccatcaatcagctggaggagatccagagtcaactcgcatccagggaaatggacgtcaccaaggtctgcggcgagatgcgttatcagctgaacaaaacaaatatggagaaagacgaagctgaaaaagagcaccgagagtttagagccaagacaaaccgtgaccttgagatcaaggaccaagagattgaaaagttgcgcatcgaactagacgaatctaagcaacacttagaacaggaacagcagaaagcagcactcgcgagggaggaatgcctgagactgacggaactgctcggcgaatccgagcatcagctgcatctgacacgccaggaaaaggactcgatccagcagagcttcagcaaagaggccaaggctcaggcactgcaggctcagcagcgggagcaggaactgacgcaaaaaatccaacagatggaagcccagcatgataagacagaaaatgaacagtacctcctgctgactagccaaaataccttcctgaccaaactgaaagaggagtgttgcacactagcgaagaagttggagcagatttcccagaaaaccaggagcgagatcgcccagctgagccaggaaaaacgatacacctacgacaagctgggcaagttgcagagaagaaacgaagagctggaggagcagtgcgtccagcacgggcgagtccatgagactatgaaacagcggttacgtcagctggacaaacattctcaagctacagcacagcagttggttcagttactctcaaagcaaaatcagctcttactagagagacaatcactgtctgaggaagtggaccggttgcggactcaactcccctctatgcctcagtccgattgttag

SEQ ID NO: 133965 - DNA, 2013 bp, Artificial Sequence
  Description of Artificial Sequence: Synthetic coding sequence
atggctaagtcccctgagaactccacattagaggagattcttggacagtatcaaaggtccttacgggagcatgcctcgaggagcattcaccagctcacctgtgcactcaaagagggggacgtgacaatcggtgaggatgcccctaatttaagcttttcaacgagcgtggggaacgaggatgcgagaaccgcgtggcctgagttgcagcagtctcacgctgtaaatcagctgaaagacttactccggcagcaggcagataaggagtcagaagtttccccatctcgacgacggaagatgagtccactcagaagcttggagcatgaagagaccaacatgcccaccatgcacgacctcgtacacacaataaacgaccagtcacaatacattcaccaccttgaggccgaggtcaagttctgtaaggaggagctaagcggaatgaaaaacaaaatccaggtagtggtgctggagaatgagggcctccaacagcaactgaaatcccagcgccaggaagagactctgagagaacaaaccctcctggacgcatccgaaaagttgaaacttacgtacgaggagaagtgcgagatcgaggaatcccagctgaaatttctcagaaacgacctggcggagtatcagagaacttgcgaagacctaaaggaacagctcaagcataaagagttcctgttggctgcaaatacttgcaacagggtgggagggttgtgtctgaaatgcgctcagcacgaagcagtgctaagccagacacacactaatgtgcacatgcagactatcgagcggctggtgaaggaacgtgacgacttaatgtccgcattagtaagcgttcgctccagtctggcggatacgcagcagagagaggctagtgcgtatgaacaggtcaagcaagtgttgcaaatctcagaagaagcaaacttcgaaaaaaccaaggcactcatccagtgtgatcagttgcggaaggagctcgaacgccaggccgaacgcctcgagaaagagttggcctcccaacaagaaaaacgggccatagagaaagacatgatgaagaaggagatcaccaaagagagagaatatatggggagcaagatgctaatactgtcacagaatatcgctcaactggaagcccaggttgaaaaagtgaccaaagagaagatttccgcaattaatcagctcgaggaaatccaatcccagctggcaagccgcgaaatggatgtaaccaaagtttgtggagaaatgcgttaccaattgaacaaaaccaacatggagaaggacgaggccgagaaagagcacagggaatttcgagccaaaacaaaccgagatctggagatcaaggatcaggaaatcgaaaagctacggattgagctggatgagagcaaacagcacctcgagcaggaacaacagaaggctgctctggctagagaggagtgcctgcgcctgacggaactcttgggcgagtccgagcaccaactacacctaacccggcaggaaaaggactcaattcagcagtccttttctaaggaggccaaggcccaggcgctccaggctcagcagagggagcaggagctcactcagaagattcaacaaatggaggctcagcatgataagacggaaaatgaacagtatctcctgctaaccagccagaatacatttctgacgaagctgaaagaggagtgctgtactcttgcaaagaaattggaacaaattagtcaaaagacccgtagcgagatcgctcagctgtctcaggaaaaacgctacacctacgataagctcggaaagttacagcggcggaatgaggaactcgaagaacaatgtgtgcagcacggcagagtacacgagaccatgaaacaaagactgaggcagctggacaaacattctcaagctacagctcaacagctggtgcagctgctctccaaacagaaccaactgctcctcgaacgccagtcactaagcgaggaggttgatcgcctcagaacccaactgccaagtatgcctcaaagcgactgttag

SEQ ID NO: 133966 - DNA, 2142 bp, Artificial Sequence
  Description of Artificial Sequence: Synthetic coding sequence
atggcaaaaagccctgaaaattccacactggaggagatcctgggtcagtatcaacgaagcctgagggagcatgcatctcggagtatacaccaacttacatgcgcgttgaaggaaggcgatgtgacaattggtgaagacgctccaaatctcagcttctccacgagtgtgggaaacgaggatgccaggacagcttggccggaactgcagcagtcccacgcagttaaccagctgaaggacttgctcaggcagcaggcagacaaggagtccgaggtgagtcctagtcgtcggcggaagatgtcgcctctgcggtctctcgagcacgaggagaccaatatgccaactatgcacgatcttgttcacactatcaacgatcaatcccagtacatccaccacctcgaggccgaggtcaaattttgcaaggaagagctgtcagggatgaagaataaaattcaagttgtcgtcctcgagaatgaagggctgcagcagcaactgaaaagccagcgccaagaggagacactccgtgagcagaccctgcttgacgcatccgggaacatgcataattcctggatcactactggcgaagacagcggagtcggggagactagcaagcggcctttttctcacgacaacgccgatttcggcaaggccgcttcggctggcgaacagcttgaattggaaaaactgaagcttacatacgaggaaaagtgcgaaattgaggaaagccagttaaagttcctacgcaatgacctcgccgaataccagagaacatgtgaagacttgaaggaacaattgaaacacaaggaattcttactggcggccaacacttgcaaccgagtagggggactgtgcctgaaatgtgctcagcacgaagctgtgttgagtcagacacataccaatgtccatatgcagacaatcgagcggctcgtgaaagagagagatgatcttatgagcgcgctggtgtctgtgagatccagcctagctgatactcagcagagagaggcatccgcttatgaacaagtaaaacaggtgctccaaatcagcgaggaggctaacttcgagaaaaccaaagcactgatccaatgcgaccagctgaggaaagaactggaacggcaagccgagagactcgaaaaagagctcgcatctcagcaggaaaagcgggctattgagaaagacatgatgaaaaaagaaataactaaagagagagaatatatgggcagcaagatgctaatcctgagccagaacattgctcagctggaagcccaggtcgaaaaggtcaccaaagaaaagatttctgcgatcaaccagctcgaagaaatccagtctcagctggcctcccgagaaatggacgtgacaaaagtgtgtggcgagatgaggtatcaattaaataaaacaaacatggagaaagacgaagcagagaaggagcacagggaatttagggcaaagacaaatcgggatctggagatcaaggaccaagagattgaaaagctgagaatcgaactggacgaatcaaaacaacacttagagcaggaacaacaaaaggccgccctggccagggaggagtgcctgcggcttacagagttgttgggtgaaagcgaacaccagctacatctgacgagacaagagaaggatagtattcagcagtctttttccaaggaagccaaagcccaagccttgcaggcgcagcagcgggagcaggaacttactcagaaaatccagcagatggaggcccaacacgataagacggaaaacgaacagtatcttctgttgacgtcgcagaacacttttcttactaagttgaaagaagaatgttgcactctcgctaaaaagctagaacagattagccagaagacccggagcgagattgcccagttgtcacaggagaagcgctatacgtacgacaaactcggcaagcttcagagacgtaacgaggagctggaagagcagtgcgttcagcatggaagggtacacgaaaccatgaaacaacgcttacggcaactggacaagcactcacaagctacagctcaacagctagtccagctgctgagcaagcagaatcagctgctgctggaacggcagagtctcagtgaggaggtagatcggctgcgaactcaacttccatctatgccccaatctgactgctag

SEQ ID NO: 133967 - DNA, 1083 bp, Artificial Sequence
  Description of Artificial Sequence: Synthetic coding sequence
atggccaagtctcctgaaaattccactcttgaagaaattctgggccaataccagagatcgctcagagaacacgcctcacgtagtatccatcaactgacatgcgcacttaaagagggtgatgtgacaatcggggaggacgcccctaatctctctttttccacatcagtgggaaatgaagatgctagaacagcctggcccgagctgcagcagagccacgctgtgaatcagctcaaggacctgctacgccaacaagccgacaaagagagtgaggtgagcccatcccgacggcggaaaatgagcccactgcgctctctggagcacgaagagaccaatatgccaacgatgcacgaccttgtgcacaccatcaatgatcagagccagtacattcaccatctggaggctgaggttaaattctgtaaggaagagctgtctggaatgaaaaacaaaatccaagtggtggtcctcgagaacgaaggactgcaacagcagctcaagagccagcgacaggaggaaaccctgcgagagcagacactcctggacgccagtggcaatatgcataattcttggattacgactggtgaggactcaggtgtgggcgagaccagcaaaaggccgttctcgcatgataatgcggactttgggaaagcggctagcgcaggtgagcaactcgaattggaaaaactgaagctgacttatgaggaaaagtgtgagatcgaagaaagtcaattaaaattcttgcgaaatgacctggccgaatatcagagaacgtgcgaagacctcaaagaacagctcaagcacaaggaattcctccttgctgccaatacgtgtaaccgtgtgggaggcctgtgcttgaagtgcgcacagcatgaagcggtgctttcccagactcacaccaatgttcacatgcaaaccatcgagcgtctcgtgaaagaaagagacgacctgatgtccgctttggtctccgtgaggtcatctctggccgacacacagcagcgtgaggcgagcgcatacgagcaggtaaagcaggtgctacagattagcgaggaagcaaattttgagaagacaaaacatccaagtcagtag

SEQ ID NO: 133968 - DNA, 1245 bp, Artificial Sequence
  Description of Artificial Sequence: Synthetic coding sequence
cttctggacgcgtcagagaaactgaagttgacgtacgaggaaaagtgcgaaattgaggagagtcagttgaagttcctccgcaatgatctggccgaatatcagcgtacatgcgaggacctgaaggaacaactgaaacacaaggaatttttgttagcagccaacacctgtaaccgggtagggggcctgtgtttgaaatgcgcacaacatgaggccgtcctttctcagacccacactaacgtccacatgcaaacaatcgaaaggctcgtaaaagagcgagacgatctgatgtccgcgttggttagtgtgcggtcttcccttgctgacacccaacagcgggaggcatccgcatacgaacaggtgaaacaagtcctgcaaatttcagaagaggcaaactttgaaaagacgaaggctttaattcagtgcgaccaactgcggaaggagttggaaaggcaggccgagcgtctggaaaaagaactcgcttcccagcaggaaaagagggccattgagaaagatatgatgaagaaggaaatcacaaaggagcgcgagtacatggggtcaaaaatgctgatcttaagtcagaacatagcacagctcgaggctcaggtggaaaaggttaccaaagagaagatatcagccataaaccaacttgaagagatccaatcgcagcttgcttctagagagatggacgtgacgaaagtgtgtggagagatgaggtaccagcttaataaaaccaacatggaaaaagatgaggcggaaaaggaacaccgggagttcagagccaaaaccaatcgcgacctcgaaatcaaagatcaggaaatcgagaagctgcgaatcgaactggacgaaagcaagcagcatcttgagcaagaacagcaaaaggccgctctggctcgggaggagtgcctgcggctcactgaactactgggcgagtccgaacaccagcttcaccttacccggtctgaaattgctcagctctcacaggagaagcgctatacctacgataagttgggcaaactgcagcggcggaacgaggaacttgaagagcaatgcgtacagcacggtcgagttcatgaaacaatgaaacagcgcctgaggcaattagataaacatagtcaagctacagcccagcagctggtgcagctgttgtcaaaacaaaaccagctacttctcgagcggcagtctctctcagaggaggtggatagactacgaacgcagctgccatcaatgccacagagtgactgttag

SEQ ID NO: 133969 - DNA, 729 bp, Artificial Sequence
  Description of Artificial Sequence: Synthetic coding sequence
atggatgatttatgtgaggcaaacggaacattcgcaatctcattgtttaagattcttggcgaagaggataattctcggaatgtgttctttagtcctatgtctataagctcggccctggccatggtgtttatgggcgctaaaggttccactgcagcacaaatgtcccaggctctctgtctctacaaggacggagatatacaccgtggattccagtctctgctcagcgaagtcaaccgtactggaacccaataccttctccgcaccgcgaacaggctgtttggcgaaaagacatgcgactttttgcccgactttaaagagtattgccagaagttctatcaagccgagctggaagaactctcctttgcagaggacaccgaagagtgccgcaaacacataaacgactgggtggctgagaagaccgaggggaaaatctctgaggtgctggatgccggaaccgtcgaccctttaaccaagctggtgctggtgaatgcgatctactttaaaggtaaatggaacgagcagttcgatcgaaagtatacaagagggatgttgtttaagaccaacgaggagaagaagactgtgcagatgatgttcaaggaggctaagttcaaaatggggtacgcggatgaggtgcatacgcaggtgcttgaattgccatacgtcgaagaagaacttagtatggttatcctgctgcccgacgataataccgatcttgccgtcaaggaatag

SEQ ID NO: 133970 - DNA, 1335 bp, Artificial Sequence
  Description of Artificial Sequence: Synthetic coding sequence
atgaaagttgttccatcactcctcctctctgtcttacttgcgcaggtgtggttagttccaggactggcccctagcccccagtctccagagacacccgcgccacagaatcagactagtcgggtggttcaggccccaaaggaagaggaagaagacgaacaggaagcatctgaagagaaggccagcgaggaggaaaaggcctggctgatggcaagccgtcagcaacttgcaaaagagacatccaacttcgggttcagtctgctgcgcaaaatctcaatgaggcacgatgggaacatggtgtttagtcccttcggcatgtccttggctatgacagggctgatgctgggcgctacagggcccaccgagactcagatcaagcgggggctgcacctgcaagccctgaagcctacaaaaccgggcctcctgccctcattgtttaagggactacgcgagacgctgagccgtaatttggagcttggtctgacgcaggggagttttgccttcatccataaggattttgacgttaaggaaacttttttcaacctcagtaaaagatattttgacacggagtgtgttccaatgaacttcaggaacgctagccaggcgaagcgtctgatgaatcattacattaataaggaaacccggggaaagatacctaaacttttcgatgaaataaaccctgagaccaagttgattctggtggattatatcctttttaaagggaaatggctgacgccctttgaccctgtcttcactgaagtggacacgttccacttagataaatataaaacaattaaggtacctatgatgtacggtgccggcaagtttgccagcacctttgacaaaaatttccggtgtcacgtattgaagttgccatatcagggcaatgcaacaatgctggttgtcctgatggagaagatgggcgatcacctggccctcgaggattaccttaccaccgatctggtggagacatggcttcgcaacatgaagaccagaaatatggaggtgttctttcccaaattcaagctggaccagaaatacgaaatgcacgaactgttgcgccagatgggcattcgcagaattttcagcccctttgccgatctctccgagctgagtgccacgggacgaaacctgcaggtctcccgggtcctgcagaggacagttattgaggtggacgagagaggtactgaggctgtggcgggcatactcagcgagattactgcctattctatgccccccgtcatcaaggtggaccggcctttccactttatgatctacgaggagacgagcgggatgctgctatttctcggacgagttgtcaatccaaccctcctttag

SEQ ID NO: 133971 - DNA, 1335 bp, Artificial Sequence
  Description of Artificial Sequence: Synthetic coding sequence
atgaaggtggtgccatcccttttgcttagtgtgctattggctcaagtgtggctggtgcctggcctggcgccttcgcctcaaagtcccgagaccccggcgccccagaaccagacatctcgggtcgtacaggctccgaaagaggaggaggaagacgagcaggaagccagcgaggaaaaggcctcggaggaagaaaaagcatggcttatggcaagcagacagcaattggcgaaagaaacctctaactttgggttctcactgcttcggaaaatatcaatgcggcatgacggtaacatggtcttcagccctttcggcatgtccctcgccatgacaggcctgatgctcggcgccaccggaccaacggagacacagattaaaagaggattgcacctgcaggccctcaagccgaccaagcctggtctgctgccatctctctttaaaggcttgcgtgagactcttagcagaaaccttgagctcgggctgactcagggctcttttgcgtttattcataaggattttgatgtgaaagagaccttctttaatctgtccaagcggtacttcgacaccgaatgcgtgccgatgaatttccgaaacgcgtcccaggcaaaacgcctgatgaaccactatattaataaagagacccgtggcaagatcccgaaattattcgatgagatcaatccagagaccaagctgatccttgttgactatatcctgttcaaggggaaatggctgacaccctttgaccctgttttcaccgaggtggatacattccacctggacaaatataagacaatcaaagtaccgatgatgtatggcgccggtaagttcgcaagcacctttgataagaattttcgttgccacgtccttaagttaccctaccaggggaatgccacaatgctcgtggttctgatggagaagatgggcgaccatttggcgttggaggattatttgacgaccgatcttgtggagacatggttgcgcaacatgaagacacgtaatatggaggtgttcttccctaagttcaagttggaccagaagtacgaaatgcacgagttactgagacagatggggatacgccgcatcttctcaccatttgcagacttgagcgagctgagcgctaccggtcggaacctacaggtgtctcgagtgttgcagcgcaccgtaattgaggttgacgagcgaggcaccgaagccgtggctggcatcctgagcgagatcaccgcttattctatgccaccagtgatcaaggtcgatagaccttttcactttatgatctacgaggagacatctggaatgctgctcttcttgggtagggttgttaacccgactcttttgtag

SEQ ID NO: 133972 - DNA, 1335 bp, Artificial Sequence
  Description of Artificial Sequence: Synthetic coding sequence
atgaaggtagtcccatcactgttactctctgtcctgctggcccaggtgtggctcgtacctggcctcgccccatcaccacagagccccgaaacacctgccccccagaaccagacatcaagagtggtccaggcacccaaagaggaggaggaagacgagcaagaggcatccgaggagaaggccagtgaggaagaaaaggcctggttgatggctagtagacagcagctggctaaagagacctcaaattttggcttttctctgcttagaaaaatttctatgcggcatgacgggaatatggttttctccccttttgggatgtccctggccatgaccggcctcatgctaggcgccacagggcccactgagacccagattaaacggggcctccacttgcaggcgcttaaacctaccaaacctggtttactacctagccttttcaaaggactgagagagaccctgtctaggaatctggagcttggcttgacccagggaagttttgccttcatccataaggactttgacgtcaaggaaaccttctttaacctttctaaaagatattttgacactgaatgtgtgcccatgaattttcggaacgcttcacaagcgaagagactcatgaatcattatattaataaagaaacccgcgggaaaatccctaagctatttgatgaaatcaaccccgagacaaaattgatcttggtcgattatatactgttcaagggcaagtggctgactccatttgatccggtgtttaccgaagtggacacgtttcatctcgataaatataagacaattaaagtgccgatgatgtatggagcaggcaagttcgcgtccacctttgataaaaatttcagatgtcacgtgctgaaattgccctatcagggtaacgctactatgctcgtggttttaatggagaagatgggggatcatttggctttggaggattatctgacaaccgacctagtggaaacctggctcaggaatatgaaaacgagaaacatggaagtgttttttccaaagtttaagttggatcagaagtatgagatgcatgagttgctgcgtcagatgggaatcagacgcattttttctccttttgccgacctgtctgagttgtcagccacggggagaaatctgcaagtttcccgcgtacttcagaggaccgtaattgaggtggatgagagaggcaccgaggcagtggctggaattttatccgagattacagcctattccatgccacctgtaatcaaggttgacagacctttccactttatgatctacgaggaaacaagtggaatgctgctgttcctgggaagggtcgtcaatccaacgctgctgtag

SEQ ID NO: 133973 - DNA, 1455 bp, Artificial Sequence
  Description of Artificial Sequence: Synthetic coding sequence
atgagtcgcagcacccaggaacttctcggataccattgtcgactccaggacaagctccaggagcaggagggttccttggcagccgaaggcagacactccctggcctccgcagccgatcatatgaaagtcgtgccttctctgctcctgagtgtattactggctcaagtttggctcgtcccaggtctggcccctagcccacaaagcccagagacccccgccccacagaaccagacatcacgcgtcgtgcaggccccaaaagaggaggaggaagatgagcaagaggcatccgaggaaaaggctagcgaagaggagaaggcttggctgatggcgagccgacaacagctggccaaggaaactagtaatttcggctttagcttgctgcggaagatcagtatgagacacgacggcaatatggtgttctcaccttttgggatgtcgctggcaatgaccggcctgatgcttggtgccaccggacccactgagacccagattaaaagaggtcttcacctgcaagcactcaaacctaccaagcctggtctcctaccttcgctcttcaagggcctccgtgaaacgctctcccgaaatctcgagttagggctgacgcaagggagttttgcttttatccacaaggattttgatgtcaaagagactttttttaatctgagcaaacgatattttgataccgagtgcgtccccatgaacttcaggaacgcttcacaagcaaagcgcctcatgaaccactatataaataaagagacccgggggaaaattcctaaactctttgatgaaatcaaccctgaaaccaagctgattctggttgattacattctgtttaaggggaagtggcttacaccgtttgatccagttttcaccgaggtcgataccttccacttagataagtacaagaccattaaagtgcccatgatgtatggggccggtaagttcgcttccacctttgataagaacttcagatgccacgtactgaaactgccttaccagggcaatgcaactatgttagtggtcctcatggagaaaatgggcgaccacctggctcttgaggactatctcaccaccgatctcgtcgagacatggctgcggaatatgaagacacgaaacatggaagttttcttccctaaatttaaactggatcagaagtatgaaatgcacgagctgctcaggcaaatgggcattcgacgcatcttttctccgtttgccgaccttagcgaactgtcagctacaggaaggaatctgcaggtttctcgggtgttgcagcgtaccgtgattgaagtggacgaaagaggaaccgaggccgtggccggaatactgtctgaaatcacagcgtactccatgccaccagtcattaaggtggatcgccccttccatttcatgatctacgaggagacaagcggcatgttactgtttctgggtcgagtggtgaacccaaccttactgtag

SEQ ID NO: 133974 - DNA, 288 bp, Artificial Sequence
  Description of Artificial Sequence: Synthetic coding sequence
atggagagaatgctgcccctccttgcattaggtctgcttgctgcagggttctgtccagctgtcctgtgccatcctaactctcccctcgacgaggagaatctgacccaggaaaaccaagatcggggaacacacgtagatctggggctggcttccgcaaatgtggattttgccttcagcctctataagcaccctcatcggtggtccatccgcctgtgtctgatgtaccttagacgtgctcagaagcatctcctgccccagcaatctaagagtccatcattcctccattag

SEQ ID NO: 133975 - DNA, 1272 bp, Artificial Sequence
  Description of Artificial Sequence: Synthetic coding sequence
atggaacgcatgttgcccttgttggctctgggcctccttgctgccggattttgtccagccgttctgtgtcatcccaattcccccttagatgaggaaaatctgactcaggaaaaccaggatagagggacccatgtggacctcgggctggcttctgcaaatgtggacttcgccttttctctatataaacaactggtcctcaaggcaccagataaaaatgtaatcttctcacccctgtcaatctccacggccctagcatttctcagcctgggggcccataacacgacgctgaccgagattttaaagggccttaaattcaacctcacagagacaagcgaagcggaaattcatcagtcatttcagcacctgctgaggactctgaaccagtccagcgatgagctccagctctccatgggcaacgcaatgtttgtcaaggagcagctgtccctattggaccggttcacagaggacgccaagaggctgtatggcagcgaagccttcgccacggatttccaagattccgcggcagcaaaaaagctgatcaacgattatgtaaagaatggaacgcgaggcaagatcaccgacctcatcaaagacctggattcccagaccatgatggtactagtgaactatatcttctttaaggcaaaatgggaaatgccatttgacccccaggacacacatcagagccggttttacctgagcaaaaagaagtgggtcatggtcccaatgatgtcactacatcatctaacaattccttatttccgggacgaggaattgtcgtgtaccgttgttgaactgaaatatactggcaacgctagcgccctgtttatcctacctgatcaggacaagatggaggaggttgaagccatgctgctgcccgaaacgctaaaacgctggcgcgacagtctggagtttagagagattggcgaactatacttacccaagttttctatatcccgtgattacaacctcaacgatatccttcttcagctcggcatcgaggaggcttttacatcaaaagccgatctgagcggaataaccggggcccgcaacctagcggtatcccaagtggtccacaaggcagttcttgatgtgttcgaggaaggcaccgaggcatcagcagccaccgctgtcaaaatcacactcctttccgcattggtggagacaaggacgatcgtcagatttaaccgtccgtttttgatgattatagtgcccactgacacacagaacatcttttttatgagcaaggtgaccaacccaaagcaggcttag

SEQ ID NO: 133976 - DNA, 1272 bp, Artificial Sequence
  Description of Artificial Sequence: Synthetic coding sequence
atggagaggatgctgcccctgctggcacttggcctgctcgcggccggattttgcccagcggtgctgtgtcacccaaattcaccattggatgaggagaacttgactcaagaaaatcaagacagaggtacccatgttgatctgggcttagccagcgctaatgttgattttgcctttagtctgtacaagcagctggtgcttaaggcacctgacaaaaacgtgattttcagccctctatcaatttccaccgcactggcttttctgtccctcggcgcccacaatacgacccttactgaaatcctcaagggccttaagttcaacttgacagagacttcagaggcggagatacaccagtcgttccaacatctcctgcgcacattaaatcaatcctccgatgagctgcagctgagcatgggcaacgccatgtttgtgaaggagcagctatctttgttagaccgttttaccgaggacgctaaacggctgtacgggagcgaggcctttgcgaccgactttcaggacagcgccgctgccaaaaaacttatcaatgattatgtcaagaacggaacacgcggaaagattacagacctgatcaaagatttggactctcagactatgatggtgctggtcaattatatattttttaaagcaaagtgggagatgccatttgatccacaggacacccatcaatcccggttctatttgagtaagaaaaaatgggtgatggtccctatgatgtctcttcatcacctcaccatcccttacttccgggatgaggagttatcctgtacagttgtggagctgaaatatactggcaacgcttctgccctcttcattctcccagatcaggataagatggaagaggtggaagcgatgctgttacctgagaccctgaaacgatggagggactccctcgaattcagagagatcggcgagctatatttgccgaaattttctatcagtcgtgactacaatcttaatgacatcttgctgcagctcggaatcgaggaggcctttacctccaaagcagatctgtcaggtatcacgggcgcaagaaacttggcagtgagccaagttgtccataaggcagttttggatgtgtttgaggaagggaccgaggccagtgctgccaccgcagtgaaaatcacgcttctgagtgctttggttgaaacaagaacgattgtcagatttaacaggcccttcctgatgattatagtgcccactgatacccagaacatcttcttcatgagcaaggttacaaatccgaaacaggcgtag

SEQ ID NO: 133977 - DNA, 1272 bp, Artificial Sequence
  Description of Artificial Sequence: Synthetic coding sequence
atggaaaggatgctccctctcctcgcccttgggctcttggcagccggcttctgccctgcggtgttatgccatcctaacagccccttggatgaagagaatctgacccaggaaaatcaggatagaggcacacatgtcgatctgggactggcatcagcgaacgttgacttcgccttttctctgtacaaacagctggtgttgaaagccccagacaagaacgtaatctttagcccgctatccatttcaacagctctggccttcctgagcctcggagcccacaataccacactcaccgagatacttaaagggctgaaattcaatttaacagagactagcgaagccgagatacatcagagcttccagcacctcctgaggactttaaatcagtcatctgacgagttgcagctaagcatgggcaacgccatgttcgtgaaagagcaactgagtcttctggaccggttcactgaagatgcgaagcgactgtatggtagcgaagcctttgctacggactttcaggattctgcagcggccaagaagctcataaatgactacgtgaaaaacggcacacgagggaaaattacggatctgattaaggatctagacagccagacaatgatggtcctcgtgaactatatctttttcaaagctaaatgggagatgccgtttgacccacaggacacccatcagagtcggttctatctgagcaagaaaaagtgggtcatggtgcctatgatgtcactgcatcatctcaccattccttactttagagatgaagaactctcctgcacagtggtcgagctcaagtacactgggaacgcatctgccttatttatccttcctgatcaagataaaatggaggaggttgaggctatgcttctgccggaaacactcaaacgctggcgtgatagcctagagtttcgagagataggggaattgtatttgccaaagttttccatcagccgagattataatctcaacgatatactcctgcagcttggcatcgaagaagcttttacaagtaaggccgacctgtccggcatcaccggtgctcgcaatttggccgtttcgcaggttgtccacaaagctgtgctagacgtctttgaagagggaacagaagcctccgcggccacggcagtaaagatcactctgctgagtgcccttgtggagaccaggaccattgtccgatttaatcgcccctttctcatgattatcgtgccgactgacacacagaacatatttttcatgtcaaaagtgacaaacccaaagcaggcgtag

SEQ ID NO: 133978 - DNA, 1347 bp, Artificial Sequence
  Description of Artificial Sequence: Synthetic coding sequence
atgaagatccactactctaggcaaacagctctcgagagtacgtcatacattcagttgcctgaagcagaactgagaatggaacgaatgctaccgctgcttgcactgggcctgctggcggccgggttctgtcctgccgtcctgtgccatccaaattctcccctggatgaggagaacctgactcaggagaaccaggatagggggactcacgtagaccttggactcgctagcgccaacgtggatttcgctttctctctgtacaagcagctggtactcaaagcccccgacaagaacgtcatcttttcccctttatcaatttccacggccctcgctttccttagtctgggagcacataatactactctgactgaaattttgaaggggctcaaatttaacctgaccgagacgagtgaggccgaaatacaccagtctttccagcatctgcttcggaccttgaaccaaagctctgacgagctgcagctgagcatggggaacgccatgtttgtcaaggagcagctttccctgctggaccgattcactgaggatgcaaaaagattgtacggcagtgaggccttcgctaccgacttccaggactctgccgccgcaaagaagttaatcaatgattatgtgaaaaacgggacccgaggcaagatcactgacctcatcaaggatctggactcacagaccatgatggtactggtgaactatattttttttaaggcgaagtgggagatgccttttgacccacaggacactcaccagagcagattctatctctctaaaaagaaatgggtgatggtaccaatgatgagtcttcaccacctgacaatcccctattttcgggatgaagagctgagctgtaccgtggttgaactcaaatacaccggcaatgccagcgctctcttcatcctccccgaccaggataaaatggaagaggtcgaggccatgttgcttcctgagactttaaaacgatggcgagattctctcgaatttagagagattggagaactgtatctcccaaagttctccatttctagggactataatctcaacgatatcttgctacagcttggtattgaggaggccttcaccagcaaagcagacttgagcggaatcacaggagccaggaatctcgccgtgagtcaggtagttcataaagccgtgctcgacgtgttcgaggagggcaccgaggctagtgccgcaacagccgtgaagatcacgctactcagcgcccttgtcgaaacaaggacaatcgtgcgattcaatcgcccttttctgatgatcatcgtccccacagacacacagaatattttcttcatgagtaaggtgaccaaccccaagcaggcctag

SEQ ID NO: 133979 - DNA, 918 bp, Artificial Sequence
  Description of Artificial Sequence: Synthetic coding sequence
atggaacggatgcttccccttcttgccctgggactcctggcagcaggcttttgcccagccgtgctttgtcatcctaattctccccttgacgaggagaacctcacccaggagaaccaggaccgtggcacacatgtcgacctcgggctagcttcagctaacgtggactttgcgttctccctctacaagcagctcgtgctaaaagccccagataaaaatgttattttctcgcctttatctatcagtaccgctttagccttcctctctctgggggcccataacacaacgttgaccgagatcttaaaggggctgaagttcaatcttactgaaactagcgaagccgagatccaccagtctttccaacacctgcttcggacattgaaccagtccagcgatgagcttcagctgtctatgggaaacgccatgtttgttaaggagcagctgtcacttcttgatagattcacggaagatgcgaaacgattgtatgggtccgaggcttttgctacagacttccaagatagcgcagccgccaaaaagttgattaatgattatgttaagaacggaacacgtggcaagattaccgatttgatcaaagacttggacagtcagacaatgatggtgcttgtaaattacattttctttaaagccaaatgggaaatgccattcgatccacaggatactcatcagtcacggttttatctgagcaagaaaaagtgggttatggtgccaatgatgtcgctccaccacctgacaataccttattttagagacgaggagctctcatgtacagtggtggaactgaaatacacaggaaacgcttccgccctcttcatcctgcctgatcaagataagatggaagaggtcgaagcgatgctcttgcccgagaccctgaaacgctggagggatagcctggagttctag

SEQ ID NO: 133980 - DNA, 1284 bp, Artificial Sequence
  Description of Artificial Sequence: Synthetic coding sequence
atgcatctgattgactacctgctgctgttgctcgtaggactgctggcattatcccacggacagctgcacgttgagcacgacggcgagtcttgctctaacagtagtcatcaacagatcttggagactggcgaagggagcccttccctcaagattgccccagcaaatgccgactttgctttccgattttattatctcatcgccagtgaaacacctggtaagaacatattcttctctccactttctatctcagctgcctacgcgatgctgtcccttggcgcttgttcccatagtcgatctcagatcttagaaggcctcgggtttaacctgactgagttatctgaatccgacgtgcatagagggttccagcatctactgcatacccttaatctgcctggtcatggactggagacgagagtaggttccgccttatttctgagccacaacctgaaatttctggccaaatttttgaatgataccatggctgtctacgaagccaagctcttccataccaacttctacgataccgtgggtacgatccagctcattaacgatcacgtgaagaaggaaactcgaggcaaaattgttgatcttgtgtccgaactaaaaaaggatgtccttatggtgctggtcaattacatttactttaaagccctgtgggaaaaaccattcatctcatctcgcaccacacccaaggatttctacgtggatgagaacaccacagtcagagtacccatgatgcttcaggatcaggagcaccactggtacttacacgaccggtaccttccctgttctgtgttgaggatggattacaaaggcgacgcaactgtgttttttatcttgcccaatcagggtaaaatgagagagatagaggaagtgctgacccccgagatgttaatgagatggaacaatcttttgagaaaacggaacttctataagaaactggagctccacttgcccaagttttccatcagtgggtcatatgtcctcgaccagatcctcccaagactggggttcacagatctgtttagcaagtgggcggacctgagtggaataacgaagcaacagaaactggaagccagtaaatcattccacaaagccacactcgatgtggacgaagccggcaccgaagccgcagccgccacgagcttcgccatcaaatttttttctgcccaaaccaaccgtcacatactgcggttcaacaggccctttctcgtagtgatattctctacctctactcagagtgttctgttcctcggcaaagtagtggatccaactaagccctag

SEQ ID NO: 133981 - DNA, 1284 bp, Artificial Sequence
  Description of Artificial Sequence: Synthetic coding sequence
atgcacctgattgattaccttctgctattactcgtgggcctgctagccctgtcccatggtcagctgcatgtggaacacgacggggagagctgttccaatagcagtcaccaacagatcctggaaactggggaagggagcccatctttgaagatcgcgcctgctaacgccgactttgcgtttcgattctattacctgatagctagcgagacacccggcaagaacatctttttcagtccgctctctatcagcgccgcctatgccatgctctctctgggggcttgttcccactcacgcagtcagatcttggaaggactaggatttaatttaactgagctcagcgagagcgacgtacacagaggcttccagcatctactccacacactgaacctgcctggtcatggcctggagacccgtgtcgggagtgctttgttcctttcccacaacctgaaattcctggccaagtttctcaacgatacaatggcagtctatgaggccaaattgttccacaccaatttctacgatacagtcggtacaattcaactcatcaacgaccatgtgaaaaaagaaacacgcggaaaaatcgtggacctcgtcagcgagctaaaaaaagatgtgttgatggtcctggtgaattatatatatttcaaggccttgtgggagaagccttttatttcctcacgtactactccaaaagatttctatgtcgatgaaaacacaactgtaagggttccaatgatgctgcaggaccaggaacatcactggtacctccatgacagatacttaccgtgcagcgtcctccgcatggactacaagggcgatgccacagttttctttattctgccaaaccagggcaagatgagggaaattgaggaggtcctgaccccagaaatgctgatgcgctggaataatctgctccgaaaacgcaatttttacaaaaagttggaactacatctcccaaaattttcgatcagcggtagttatgttctggaccaaattcttccacgccttggcttcacggacctgttcagcaagtgggcagaccttagcggcataaccaagcagcaaaagctcgaggcctcgaagagcttccacaaagcgacactggacgttgatgaagcgggaacggaagccgccgctgctacttcatttgctataaagttcttctcggcccaaacaaatcgacacatccttcgattcaatcgcccgttcctggtggtgattttctcaacatcaacccagagcgtgctgtttctcggtaaggtagtcgatccaacaaagccctag

SEQ ID NO: 133982 - DNA, 1284 bp, Artificial Sequence
  Description of Artificial Sequence: Synthetic coding sequence
atgcatctgattgattatctccttctgctgctcgtgggcctgcttgccttgtcccacggccagctccatgttgagcacgatggggagtcttgctctaatagttcacaccagcagattcttgagactggcgagggctctcctagtctgaaaatagcccctgccaacgcagattttgccttccgcttttactacttaattgctagtgagacccccgggaaaaatattttcttctccccactgtcaatcagtgccgcgtacgccatgctttctcttggagcctgtagccactcaaggtctcagatccttgaaggtctggggttcaacttgacggagttgtccgagtctgacgtgcaccgtggtttccagcatctgctccacactctcaatctcccgggccacggcctcgagacaagggtggggtctgccctgtttctgtcccataatcttaaattcttagcaaagttcctgaacgacacaatggcagtatatgaggcaaagctcttccacactaatttctacgacacagtcgggacaatccagcttattaacgaccacgtgaaaaaggagactcgaggaaaaatcgtggacttggtgtcagagctgaaaaaggacgtccttatggtccttgtgaattacatctactttaaagccctgtgggagaaaccatttatctcctcccgtacgacgcctaaggatttttacgtggacgaaaacaccacagtgagagtacctatgatgctacaggaccaagaacatcactggtacctccatgataggtacctcccgtgtagcgtcctgaggatggactataagggcgatgctactgtcttcttcatactgcctaatcaggggaaaatgagggagatcgaagaagttctcacacccgaaatgcttatgagatggaacaacctgttgcgaaaacgtaacttttataaaaaactggagctgcatctgcctaaattcagcatttccgggtcttacgttctcgaccaaattctcccacgacttggcttcacagacctgttcagtaagtgggcagacctttccggtataaccaagcaacagaaacttgaggcatcgaaatcctttcataaggctaccctggacgtcgatgaggccggcaccgaggctgccgccgctacttccttcgcaatcaaattcttctcagctcaaacgaacaggcacatcttaagattcaatcgaccgttcttggtcgtcattttttctacctctacacaatccgtactgttcctgggtaaagtggtggatcccacgaaaccatag

SEQ ID NO: 133983 - DNA, 1218 bp, Artificial Sequence
  Description of Artificial Sequence: Synthetic coding sequence
atgcccctgttgttgtacacctgcctgctgtggctgccaacaagcggcttgtggaccgtccaagccatggatccgaacgccgcttacgtgaacatgtcgaatcatcaccgaggactggcgagcgcaaacgtggattttgcatttagcttgtataagcatctcgtagcactctccccaaaaaaaaacatattcatttctcccgtgtcaatttctatggctctagccatgctgagcctgggaacatgtgggcacacacgcgctcagttactgcagggtcttggcttcaacttgactgaaaggtccgagacagagatccatcaaggctttcagcacctgcaccagctatttgctaagtccgatacatccctcgaaatgacgatgggcaatgctctgttcctggacggcagcctggaattgctggagtctttctcggcagacataaaacactattacgaaagtgaggtactggctatgaactttcaagattgggcaactgcctcgaggcaaatcaattcctacgtgaagaacaagacgcagggaaagatcgttgatctgttttccgggctggactctccagcaatccttgtcctggtcaactacatcttcttcaagggaacatggacacaaccttttgatctggcctctacaagagaagagaacttttacgtagatgagacaacagtcgttaaagttcccatgatgctgcagagcagcactatctcttacctgcatgacagcgaattaccatgccagcttgtgcagatgaactacgttggaaacggcactgtgtttttcatccttccagacaaggggaaaatgaataccgtcatagccgctctgagccgtgatactatcaacaggtggtcagctggactgacaagttctcaggtagatctgtacattccaaaagtcaccatcagtggggtttacgacctgggcgacgtgcttgaggagatgggcatcgccgacctctttacaaaccaagctaacttttcgcggattactcaggatgcccaactgaagtctagcaaagttgtgcataaggccgttctgcaactgaatgaggagggtgtggacactgccggatccacaggcgtaacattgaatcttacatccaaacctatcatcctgcggtttaatcagcccttcatcataatgatttttgaccacttcacttggtcgtctcttttccttgcccgcgtgatgaatcccgtctag

SEQ ID NO: 133984 - DNA, 411 bp, Artificial Sequence
  Description of Artificial Sequence: Synthetic coding sequence
atgcctctgttgctttacacctgcctgttgtggttgcctacttctggcctgtggacagtgcaggctatggacccaaacgcagcctatgttaacatgtctaaccaccaccgcgggctagcctctgcaaacgtcgatttcgccttctcgttatacaaacatctggtggccctgtcccctaagaaaaatatttttatctccccagtcagcatttcgatggcgctcgccatgttatctttggggacatgtgggcatactcgcgcacagcttctgcagggattggggttcaacctgaccgaacggtctgagacagagatccaccaggggtttcagcacctacaccaactgttcgccaagtccgacaccagcctcgaaatgacaatggggaacgcattattccttgatggctcatag

SEQ ID NO: 133985 - DNA, 1194 bp, Artificial Sequence
  Description of Artificial Sequence: Synthetic coding sequence
atggactccctggccacgagtatcaatcagttcgcactggaactgagtaagaaacttgccgaatctgctcaggggaaaaacatattcttttccagctggagcatcagcacgagtctgacgattgtatacctgggagccaaaggcacaacggcggcccagatggcccaggtgctacagtttaacagagatcagggcgttaagtgtgatcccgagtccgagaagaaacgaaagatggagtttaatctttccaactcagaggagatacactcagacttccagactttaatcagcgagatcctgaaacctaacgacgattatctgctaaaaactgcgaacgcgatctacggggagaaaacctatgccttccacaacaagtacttggaggatatgaagacttattttggggcggagccccaaccagtaaactttgttgaggcatccgaccagattagaaaagatattaactcctgggtggagcgacagacagagggaaaaatccagaatcttctgcccgacgattcagttgacagcacaacgcgaatgattctggtgaacgcactgtactttaagggcatttgggagcaccagttcctggtgcaaaatactaccgagaaaccttttaggataaatgaaactacgtctaagcccgtccaaatgatgttcatgaagaaaaagctgcacatttttcacattgagaagcccaaggctgtcggcctacagctttattataaatcacgtgatcttagcctgcttattctactaccagaagatatcaacggacttgagcagcttgagaaagcgattacatacgagaagcttaacgaatggacatccgctgatatgatggagctttacgaggttcaattgcacctcccaaagttcaaactcgaagacagctatgatttaaagtcgaccctgagctctatgggcatgtcagacgctttttcccaaagcaaagctgacttttccggcatgagcagcgcacgcaacctgtttctgtccaatgtgtttcacaaagcatttgtggagatcaacgagcaggggaccgaagctgccgctggaagtggctctgaaattgatattagaattagggtcccgtcgatagaattcaatgctaatcacccttttctgtttttcatccgccacaacaaaacgaacactattttattttatggcaggctgtgctctccttag

SEQ ID NO: 133986 - DNA, 1020 bp, Artificial Sequence
  Description of Artificial Sequence: Synthetic coding sequence
atggatagtttgggggccgtctctaccaggttggggttcgatctctttaaagagttgaagaagactaacgacggcaatatcttcttcagtcctgtgggcatactgaccgctatcggaatggtcctattgggtactcgaggggctactgcatcccagcttgaagaggtattccattcagaaaaagaaaccaagtcctcaaggatcaaggccgaggaaaaggaggtcatcgagaatacggaggctgtgcaccagcagttccagaagtttttgacggagatcagcaaactgacaaatgactatgaattgaatattactaacaggttgttcggcgagaagacctatctctttctgcagaagtacctggattatgttgagaagtattaccacgcttcactcgagcctgttgatttcgtcaatgccgctgatgaatccaggaaaaagatcaatagctgggttgagtccaaaacaaacgagaaaatcaaggacctgttcccagacgggtcaatcagcagcagtaccaagctggttctggttaatatggtttatttcaaaggccagtgggacagggagttcaaaaaagaaaacacaaaagaggagaagttctggatgaataagattattgataagattagtcccgagaaactagtggagtggacatcccctggacacatggaggagcgcaaagttaacctccacctacctaggttcgaggtggaggacggctatgacttagaagcagtccttgctgcaatgggcatgggcgatgcatttagcgaacacaaagcagattacagcggtatgtccagtgggtccgggttatacgcacaaaagtttcttcactcctcctttgtagcagtgacagaagaaggaactgaggctgctgccgctaccggaattggatttaccgtgacatccgcaccggggcatgagaatgtacactgcaatcacccctttctattcttcatccggcataatgagtccaattctatactctttttcggaaggttcagttcaccgtag

SEQ ID NO: 133987 - DNA, 1176 bp, Artificial Sequence
  Description of Artificial Sequence: Synthetic coding sequence
atggactccctcggggccgtaagcaccaggctcgggtttgatctgtttaaagagctgaagaagactaacgacggaaacattttcttcagccctgtgggtatcttgaccgccattgggatggttttgctcggaaccaggggcgctaccgcttcccaactcgaggaggtattccatagcgaaaaagagaccaagtcctctcgcatcaaagcagaggagaaggaggttattgagaatactgaggctgtgcaccaacagtttcagaagtttttgacggagatctctaaactaacaaatgactatgaacttaatattacgaatcggttgttcggcgaaaagacttacttattccttcaaaaatacctcgattacgttgaaaaatattaccacgctagtctggaaccagtcgacttcgtcaacgccgcggatgagtcccggaagaagatcaatagctgggttgagagcaaaactaacgaaaagatcaaggacctgttccctgacggaagcatatcgagcagtaccaaattggtcctcgttaacatggtgtactttaagggtcagtgggatcgtgagtttaagaaggaaaacacaaaagaagagaaattttggatgaataagtccacctctaaatccgtacagatgatgacccaatctcactccttctcttttacgttccttgaggacctgcaggccaaaattctgggcatcccatataagaataatgacttatctatgttcgtgctacttcctaacgacatcgatggtctcgagaaaattatcgacaaaatctcacccgagaagctggtcgagtggacgagtcccggccacatggaagagcgtaaggtgaacttgcacctccccaggttcgaggtggaagacggatatgacctggaagccgtgctggctgctatggggatgggcgatgccttcagtgaacataaggccgattactccgggatgtcatcggggtcaggtctgtatgcccagaagttcctgcacagctcctttgtcgccgtcaccgaggagggcaccgaagccgcagcagccacaggaatcggatttaccgtgacgtctgcgccgggtcacgagaacgtgcactgcaaccacccctttctcttttttatcagacataatgagtccaatagcattctgttcttcggcagatttagctctccttag

SEQ ID NO: 133988 - DNA, 930 bp, Artificial Sequence
  Description of Artificial Sequence: Synthetic coding sequence
atggattctctgggggctgtatctacccgtttgggctttgatctgtttaaggagttaaagaaaacaaatgatggcaacatctttttcagcccagtgggaattctgacagcgatcggcatggtgctgctgggaactaggggtgcaacggcaagccagctggaggaggtgttccacagcgagaaggaaaccaaatcttctcggattaaagctgaggaaaaggaagtggagaaaatcaaagatctcttcccagacggctcaatcagtagcagtactaaactcgtcttggtgaacatggtgtactttaaggggcaatgggatcgcgagttcaaaaaggaaaacaccaaagaagagaagttctggatgaataagagcacatctaagtccgtccagatgatgacacagagccattccttctcattcacctttcttgaggacttacaggcaaagatcctgggcattccgtacaagaacaacgatctgagtatgtttgtcctgctgcctaatgatattgatggtctggagaagattattgataaaatcagtcctgaaaaactggtggaatggacctcccctggccatatggaggagcgtaaggttaatctgcacctgcctcgctttgaagtcgaggacggatacgatctggaggccgtgttagctgccatgggcatgggcgacgcttttagcgagcacaaagcggattacagcggaatgtctagtgggagcggcctctatgcgcagaaatttctgcactcatcttttgtagccgttactgaggaagggactgaggctgctgcagccaccggtatcgggttcaccgtgacctctgcacccggacatgagaatgtccattgcaaccaccctttcctgttctttatccggcacaatgagtctaattcaatactcttcttcggccgcttctccagcccttag

SEQ ID NO: 133989 - DNA, 1173 bp, Artificial Sequence
  Description of Artificial Sequence: Synthetic coding sequence
atgaactctcttagcgaggccaacactaagtttatgttcgatttatttcaacagtttcggaaatcgaaagagaataacattttctacagccctattagtatcaccagcgctctgggtatggttttactgggcgctaaagacaatactgcccagcagatcaagaaagttctccatttcgatcaagtgaccgagaataccacgggcaaagctgccacctaccatgtggaccggtccggcaatgtgcaccaccagtttcaaaagctcctgactgaattcaacaaatctacggacgcctacgagttaaaaatcgctaataaattgttcggcgaaaagacatacctgtttttgcaagaatacctcgacgcaattaagaaattttaccagacgtctgtagaaagtgtggatttcgctaatgccccggaggagagtaggaagaagataaattcttgggtggaatctcagaccaacgagaaaatcaagaacttgattccagaggggaacatcggctcaaacaccacactggtactcgtcaatgccatctattttaaggggcagtgggagaaaaagttcaataaggaggacactaaggaggaaaagttctggccaaacaagaacacctataagagtatccagatgatgcgtcagtacactagcttccacttcgcatccctcgaagatgtgcaggcaaaagtcctggagatcccttataagggtaaagatctctcaatgatagtcctgctgccaaacgagatcgacggactgcagaaactggaggagaaattaaccgccgaaaaactgatggagtggacctctttgcaaaatatgcgagagacccgggtggacttacacttgccgcggttcaaggtggaggaatcctatgacctcaaggatactctgagaactatgggaatggtggacatcttcaacggagacgctgatctcagcggaatgaccggctctcggggtctagttttatccggcgtactgcacaaggccttcgtcgaggtaaccgaggagggagccgaagccgcagccgcgaccgccgtggtcgggttcggatcttcccccacatctacgaatgaggaatttcactgcaatcatccattcctgtttttcataagacaaaacaagacgaatagtatcttgttctacggtcggtttagctctccctag

SEQ ID NO: 133990 - DNA, 1173 bp, Artificial Sequence
  Description of Artificial Sequence: Synthetic coding sequence
atgaattctctgagcgaggctaataccaaattcatgtttgatttgtttcagcagttccgtaaatcaaaagagaataacatcttctattcccctatctcaatcacctctgctctggggatggtgttactgggggccaaagacaatactgcccagcaaatcagcaaggtactacacttcgatcaggtgacagagaacacaactgagaaggccgccacgtaccacgtggatagaagcggaaatgtgcaccaccagtttcagaaattgttaacagaattcaataaatccactgatgcttacgagttgaaaatcgctaataaactattcggcgagaaaacctatcagtttttgcaggaataccttgatgccataaaaaagttttaccagactagtgtggagtctaccgacttcgctaatgccccagaggaaagcagaaaaaaaattaactcctgggttgaatcccagaccaacgaaaagatcaagaatctttttcccgacggtacaatcgggaacgataccacccttgtgttggtgaatgctatctatttcaagggtcagtgggaaaacaaatttaaaaaagaaaataccaaggaagagaagttttggccaaacaagaacacctacaagtctgtacagatgatgcgtcaatacaatagcttcaatttcgctctgttagaggatgtccaggccaaggtactcgagataccttacaaaggcaaggacttgtcaatgattgttctgttgccaaatgaaatcgacgggctccaaaagctagaggagaagctgaccgctgaaaaactgatggaatggacaagcctgcagaatatgcgagagacctgcgtggatctgcatctgcctcggtttaaaatggaagagagctacgacctcaaagatacactgcgaactatgggcatggtgaacattttcaacggcgatgctgacctcagtgggatgacttggagccatggcctgtcggtgagtaaagtactccacaaggcattcgtggaggtgacagaagagggtgtggaagcagctgctgcaaccgctgtcgttgttgtggaactttccagtccatcaaccaacgaggagttctgctgcaaccacccatttctcttcttcatacggcagaataaaaccaacagcattctattctacgggagattctcatctccgtag

SEQ ID NO: 133991 - DNA, 1017 bp, Artificial Sequence
  Description of Artificial Sequence: Synthetic coding sequence
atgaactccttgagcgaagcgaatacgaagttcatgtttgatcttttccagcagttcagaaaatccaaagagaacaacatcttctattctcctatcagtatcactagtgccttgggcatggtacttttaggcgcaaaagataacaccgcccagcagataagtaaagtattgcactttgaccaagtaactgagaataccacagagaaggcggctacctatcacgtggacagaagcggtaatgtacatcaccagtttcagaagctgctcacggaattcaacaaaagcaccgacgcttacgaacttaaaatcgctaacaaactgtttggagagaaaacataccagtttctccaagagtacctggatgctatcaagaagttctatcagaccagtgtggaatctaccgacttcgctaatgcacctgaagaatccaggaagaagattaatagctgggtggaatcacagaccaacgagaaaattaagaacctgttccccgatggaactattggtaatgacacaaccttagtgttggtcaatgcaatctactttaaggggcaatgggaaaacaagtttaaaaaagagaacactaaagaagagaagttctggccgaataagctggaggagaaactgactgctgagaagcttatggagtggacatccctgcagaacatgcgcgaaacttgtgtcgacctgcacctcccgagatttaagatggaggagtcatacgatcttaaagacacgttgcggactatggggatggtgaacatttttaacggcgacgcagatctgagtgggatgacctggagccacggactctcagtgagcaaggtgctgcacaaggcattcgttgaggtaactgaagagggtgttgaggccgccgccgcaaccgccgtagtggtggttgagctgtctagcccatccaccaatgaggagttctgttgtaatcatcctttcctgttttttatccgacagaacaagacaaactcaatcttattttacggacgatttagttcaccgtag

SEQ ID NO: 133992 - DNA, 1128 bp, Artificial Sequence
  Description of Artificial Sequence: Synthetic coding sequence
atggacgctcttcagctcgccaattccgcgttcgcagtggatctgttcaaacagctgtgtgagaaagaacctctcggaaacgtgctattctcgcccatatgtctatctacttcactatcactggctcaggtgggagccaagggagacacggctaatgaaattgggcaggttctacattttgagaacgtcaaagatgttccatttggtttccagacagttacctctgacgtcaacaagctcagctcattctatagcctgaaactgattaaacggctgtacgtcgataagagcttaaaccttagtacagaatttatcagcagtacaaagagaccatacgctaaagaactcgagactgtggattttaaagacaagctcgaggaaactaaaggacagatcaacaattccatcaaggatctgaccgacggacatttcgagaatatcctggcggataactctgtgaacgaccaaacaaaaatattagttgtcaacgctgcgtatttcgtcgggaagtggatgaaaaaattctcagaatccgaaaccaaggaatgcccttttagggtcaataagacggatactaaaccggtacagatgatgaatatggaagcaacgttctgtatggggaacatcgattctatcaattgcaagatcattgaactgccttttcaaaacaaacacctttctatgttcatcctgcttccaaaggacgtggaagatgagagtactggcctcgaaaagattgaaaagcagctgaacagcgaatcactgagccagtggacaaacccctccactatggccaatgctaaagttaaactttccatccccaagtttaaggtagagaagatgattgacccaaaagcatgtctggaaaacctaggactcaaacacatctttagcgaagacacatcagacttttctgggatgagcgaaacaaagggagtggcactctctaacgtcatccacaaagtctgcttggagatcaccgaggacggaggagacagcattgaggtgcccggggctcggattttacagcacaaggacgaactcaacgcggatcacccttttatttacattattagacataataaaacgagaaatatcatcttctttggtaaattctgcagtccatag

SEQ ID NO: 133993 - DNA, 390 bp, Artificial Sequence
  Description of Artificial Sequence: Synthetic coding sequence
atggatgccctgcagctggcgaatagcgctttcgccgtggatctgttcaaacaactgtgcgaaaaagagccactggggaacgtattattttccccaatctgcctcagtacctcattgtccctggctcaggtgggcgcaaaaggggacactgctaatgagatcgggcaggtgcttcactttgaaaacgttaaggacgttcctttcggattccagactgtcacctcagatgtaaataaactgtcttccttctatagccttaaactgattaagagactttatgttgataagagcttgaacctcagcaccgagttcattagtagtacaaaaaggccctacgccaaagagcttgagactgtcgacttcaaggataagctggaagaaacaaagtag

SEQ ID NO: 133994 - DNA, 1131 bp, Artificial Sequence
  Description of Artificial Sequence: Synthetic coding sequence
atggacgtcctggccgaggcaaacggaacctttgctctgaacctgctcaagaccctgggaaaagacaattccaagaatgtgtttttttcacccatgagcatgtcctgcgccttggccatggtgtatatgggagctaagggcaatactgccgctcagatggcccagattctttccttcaacaaaagcggcgggggcggtgacatccatcagggattccagtccctgttgaccgaagttaataaaactgggacacaatacctcctgcgcatggcaaaccgcctgttcggggaaaagagctgcgatttcctttccagctttagagacagctgtcagaagttctatcaggctgaaatggaggagttggatttcatctcagccgtggagaagagccggaaacacatcaacacttgggtggctgagaagactgaaggaaagatcgccgagcttttaagcccaggatctgtggatcccctgactaggctagtgctagttaatgctgtttacttcagaggcaattgggacgaacagtttgacaaggagaataccgaggaaagactgttcaaagtgagcaagaatgaggagaagcctgtccagatgatgttcaagcagtctacctttaaaaaaacttatataggggagatcttcacccagatcctggttctcccctatgtggggaaagagctcaacatgattatcatgctgcctgacgaaacaacagacctgagaaccgtggagaaggagttgacctacgagaagtttgtggagtggacacggcttgatatgatggacgaagaggaagtggaagtgtcactcccgcgttttaagctcgaggagagctacgatatggagagcgttctgagaaacctcgggatgacggatgccttcgagctggggaaggcagattttagcggtatgtctcaaacagacctctcactcagtaaagtggtgcacaagtcatttgtcgaagttaacgaggagggcaccgaggccgccgcggctaccgctgccatcatgatgatgagatgcgcccgatttgtaccaaggttttgtgctgatcacccatttcttttcttcatccagcattcgaagacaaacggcatccttttttgtggtcggttttcaagtccgtag

SEQ ID NO: 133995 - DNA, 546 bp, Artificial Sequence
  Description of Artificial Sequence: Synthetic coding sequence
taacttaatctgctgaaaactctgggcaaagataacagcaagaatgtgttctttagccccatgagcatgagctgtgcgctggccatggtgtatatgggagctaaagggaatacggctgcccaaatggcacagatactcagcttcaataaatcaggcggagggggagacatacaccagggatttcaatccctgttaaccgaggtcaacaaaacaggcacacagtatctgctgaggatggcaaatcgagagagttacgacatggagtcagtgttaagaaatcttgggatgactgacgcgtttgaactgggcaaagctgacttttctggtatgtcacaaaccgatctgtctttgtccaaagtcgtgcacaagagctttgtagaagtgaatgaggaaggaaccgaagcagctgccgcaacagccgctataatgatgatgagatgtgcgcggttcgtgccgagattttgcgcagatcacccttttctattcttcatccaacacagcaaaactaatggtatcctcttctgtggcagattttcctctccttag

SEQ ID NO: 133996 - DNA, 1131 bp, Artificial Sequence
  Description of Artificial Sequence: Synthetic coding sequence
atggatgttcttgccgaggccaacggtacgtttgcactcaacctgctgaagaccctaggcaaggataattccaagaatgtattcttctcccctatgtctatgagctgcgccctggccatggtttatatgggagcgaagggaaacaccgccgctcagatggctcagatcctgtcattcaataagagcggtggagggggcgatattcaccagggttttcagagtctgctgactgaagtgaacaagacagggacacagtaccttttacggatggccaatcgcttgttcggggaaaagtcatgtgatttcctctcctcatttcgcgatagttgtcagaaattctatcaggccgaaatggaagagttagacttcatcagcgcagttgaaaagtctcgcaaacacatcaatacttgggtggccgagaagacagaaggaaagattgccgagctcctgtcacccgggtcggtcgacccccttacacgactcgtcctggtcaatgccgtgtacttccgcggaaattgggacgagcagtttgataaggaaaatacggaggaaagactctttaaggtcagcaagaatgaagaaaagcctgtccaaatgatgtttaaacaatcaacttttaagaagacctatattggagagatcttcactcagattctcgtgttgccatacgtggggaaagagctgaacatgatcataatgttacctgatgagactactgatctgaggactgtggagaaggaactaacctatgagaagttcgttgagtggacccgcctcgatatgatggacgaagaggaagtggaagtgtcacttcccagattcaagttggaggagagctatgacatggagtctgttcttagaaatctgggcatgacagacgccttcgagctggggaaagccgatttcagcggcatgtcacaaaccgatctgagcctctccaaggtcgtccacaaaagttttgtcgaagtgaacgaagagggcaccgaggcagccgccgccactgcagccatcatgatgatgaggtgcgctcgcttcgttccaaggttttgtgctgatcatcccttcttgttttttattcagcacagcaaaacaaacggcatactcttctgtggccgcttttcatcaccatag

SEQ ID NO: 133997 - DNA, 1131 bp, Artificial Sequence
  Description of Artificial Sequence: Synthetic coding sequence
atggacgttttggctgaggccaacggcacctttgccctcaacctccttaaaaccttgggcaaagataattccaagaacgtctttttttcccccatgtccatgagctgtgccctagcaatggtgtacatgggggcgaagggcaacacagccgctcagatggcccaaattctgagctttaacaagtcagggggtggcggagatattcatcagggcttccagtcgttgctcacggaggttaataagaccgggacgcaatatctcctgcgcatggctaatagactcttcggggaaaagtcatgtgattttctgtccagtttccgggattcctgccagaaattttaccaggccgagatggaggagctagactttatttccgcagttgagaagtctagaaaacacattaacacatgggtggccgaaaaaaccgaaggcaagatcgctgaattactgagtcccggaagcgtggatccactgactagactggtcctggtcaatgcagtgtacttcagagggaattgggacgagcagttcgataaggagaacaccgaagaacggctgtttaaggtgtccaagaatgaggagaaaccagtgcagatgatgttcaaacagtcaacgtttaagaagacctacatcggtgagatctttacccagattcttgtattaccttacgtgggtaaggagctcaacatgataatcatgttgccagacgagactaccgacctgcgcaccgtggagaaggaactgacctatgaaaaattcgtcgaatggacacgcctggatatgatggatgaggaggaagtggaggtgagccttcccaggttcaaactggaggaatcatatgacatggaaagcgtcctccgaaacttgggtatgaccgatgctttcgaactggggaaagctgacttcagcggaatgtcccaaaccgacctgtctctatcaaaggttgtccacaagagctttgtggaggtcaatgaagaagggacagaggctgcggctgctactgccgccatcatgatgatgaggtgtgcccgtttcgtgcctagattttgcgcagaccatcccttcttgttcttcattcaacattctaagaccaatgggatacttttttgtggacggttctcatcgccatag

SEQ ID NO: 133998 - DNA, 1131 bp, Artificial Sequence
  Description of Artificial Sequence: Synthetic coding sequence
atggatgtgctcgccgaagccaatggaacttttgcgctcaacctgctaaagacgttgggaaaagacaattctaaaaatgtcttcttctctccaatgtccatgtcctgtgcactcgccatggtgtatatgggcgctaaggggaacactgcagctcaaatggcacagatcctgagcttcaacaaaagcggaggcggaggggatattcaccaaggtttccagagtttactgactgaagtcaacaaaactggtacacagtacctcttacgcatggccaatcgacttttcggagaaaagtcctgtgacttcttatccagttttcgggactcctgtcagaaattttatcaggctgagatggaggaactggatttcatcagtgccgttgagaaaagtcggaaacacatcaacacatgggtggctgaaaaaacagaagggaagattgccgaacttcttagtcctggatcagtggatccacttacaagactggttctcgtcaatgctgtgtatttccgtggcaattgggacgagcaatttgataaggaaaacaccgaagagcgcctgttcaaggtctcgaagaacgaggaaaagccagtacagatgatgtttaagcaaagcacttttaagaaaacttacattggtgaaatctttacccagattttggtgctcccctatgtagggaaggaactcaatatgataattatgctgccagatgagacaaccgatctgaggaccgtcgagaaagagctcacctacgagaaattcgtggaatggacaagacttgacatgatggatgaagaagaagtagaggtctccctgcctcgcttcaagctggaggagtcttacgacatggagtctgtgctacgcaatctcggaatgaccgatgcttttgagcttggcaaggccgacttcagcgggatgagccagaccgatttgagcctttccaaggttgttcataagtcttttgttgaagtgaacgaagagggcacggaggctgcagctgcaaccgccgcgatcatgatgatgagatgcgctcgttttgttcctcggttttgcgcggatcaccccttcttgttcttcatacagcattcgaagaccaatggcatcctgttttgcggtagattctcaagtccatag

SEQ ID NO: 133999 - DNA, 1131 bp, Artificial Sequence
  Description of Artificial Sequence: Synthetic coding sequence
atggacgtccttgcagaggcaaatggaaccttcgcactcaacttgctgaagactttaggcaaagataacagcaagaatgtgttctttagccctatgtccatgagttgcgcgctggccatggtgtatatgggtgctaagggtaacactgccgcacagatggcccagattctcagcttcaataaatcgggcggagggggcgatattcatcaaggctttcaatcactgctcacagaggtaaataagacagggactcagtacctgttacgtatggctaatcgactgtttggagagaaatcatgtgacttcctctccagtttcagagattcctgccagaaattttatcaggccgagatggaggagctggattttatttctgcagtcgagaaaagtaggaagcatatcaatacttgggtggccgagaagacggaaggaaaaattgcggagctgctctcacccggatcagtggaccctctgactcggttggtgttagtgaatgctgtgtactttcgtggaaactgggacgagcagttcgacaaagagaatacagaggaacggctgtttaaagtatccaagaacgaggagaagcccgtgcagatgatgttcaaacagagcacttttaaaaagacctatatcggcgaaatctttacccagattctggtacttccttacgtgggcaaagagctcaacatgatcatcatgctgccggatgagaccactgaccttagaactgtcgagaaggagcttacctacgagaaattcgtggaatggactcgattagacatgatggacgaagaagaggtggaggtgagccttccgcgattcaagcttgaggaatcctatgacatggaatctgtactgcggaaccttggtatgaccgacgcctttgagctcggtaaagctgacttctccggaatgtcacaaaccgacttgagtctctctaaggtggttcacaaaagctttgtcgaggtgaatgaagaagggacggaggctgccgccgcaaccgcggcgattatgatgatgaggtgtgccagattcgtgccacgattctgcgccgatcacccattcctgtttttcatccagcacagtaagaccaacggcatactcttttgtggccgcttcagttcaccttag

SEQ ID NO: 134000 - DNA, 1131 bp, Artificial Sequence
  Description of Artificial Sequence: Synthetic coding sequence
atggacgtgttggcagaggccaatgggacttttgcccttaacctcctgaaaactctaggcaaagacaatagcaaaaatgtgttcttctcaccaatgagcatgagctgtgcccttgctatggtctacatgggagctaaaggtaatacagcagcccagatggcccagatccttagctttaataagtccggcggaggcggcgatatccatcagggctttcagagccttctaactgaagtgaataagaccggaacccagtacctgctaaggatggccaatcgcttatttggggaaaagtcttgtgatttcctcagctcatttcgggattcctgtcaaaagttctaccaggcggagatggaggaactggattttatctctgccgtggaaaagtcacggaagcacatcaacacatgggtggcggagaaaactgagggtaagatcgcggagctattatcacccggcagtgtggatcctctaacaaggctggttttagtcaacgccgtatatttccgcggaaactgggatgaacagttcgacaaagaaaacactgaagagagactgttcaaggtgagtaagaacgaagaaaaacccgtccagatgatgttcaaacaatctacctttaagaaaacctacatcggcgaaatattcacccagatattagtgctgccgtacgttggcaaagaactgaacatgatcataatgctgccagatgaaactaccgacctccgaaccgtggagaaagagctgacatacgagaaatttgtcgagtggacacggctcgatatgatggacgaagaagaagtagaagtgtctctgcccaggtttaagctggaagagtcgtatgacatggaatccgtcctccgtaatttggggatgactgacgcttttgagctcgggaaagctgacttctctggaatgtcccagaccgacctgtccctctctaaagtggtgcacaagtcttttgtagaagttaacgaggaaggaacggaagctgccgctgccacagccgctatcatgatgatgaggtgcgctagattcgtcccacgcttctgcgcagaccaccccttcctcttctttatccaacattcaaaaaccaacgggatcctcttctgtggccgctttagcagcccctag

SEQ ID NO: 134001 - DNA, 579 bp, Artificial Sequence
  Description of Artificial Sequence: Synthetic coding sequence
atggacgtcctagccgaggccaacggcaccttcgccctgaacttacttaagaccctggggaaagacaattctaaaaatgtgtttttcagcccaatgagtatgtcttgcgcgctagccatggtctatatgggtgcaaagggaaacacggcagcccagatggcacaaattctgagcttcaacaaatccggtggcgggggcgatattcaccaaggattccagtcgttgctgacagaggtaaacaaaacagggacccagtatctcctgcgcatggcaaacagagaaagttatgatatggagagcgtgctcagaaatcttggcatgaccgatgccttcgagttaggcaaggccgatttttcgggcatgtctcaaaccgacctgtcgctgagcaaggtggtccacaagtcatttgtggaagtgaatgaggaaggcactgaggctgccgctgccacggctgcaattatgatgatgaggtgtgccagatttgtgccgaggttttgcgccgaccaccctttcctcttcttcatccagcactctaagaccaatggcattctcttctgtggacgtttttctagcccttag

SEQ ID NO: 134002 - DNA, 1143 bp, Artificial Sequence
  Description of Artificial Sequence: Synthetic coding sequence
atggcgtccctcgccgccgctaacgccgaattctgctttaacctattccgggagatggacgataatcagggcaatggcaacgtgttcttctcttctcttagcctttttgccgcactggcactggtgcggctcggggcccaggacgacagtttatcccagattgataagcttctgcatgtcaacacagcctctggctatgggaacagttccaatagccagtccggcctgcagtcccagctcaagcgagtgttctcagatatcaatgcctctcacaaggactatgacctatcaatcgtgaacgggctgtttgccgaaaaggtgtacggatttcacaaggactacatcgaatgcgccgagaagctttacgacgctaaggtcgaacgtgtagatttcaccaatcatctagaagacacacggcggaacatcaataagtgggtggaaaatgaaacacacgggaagatcaaaaacgttattggagaaggaggtatcagcagcagtgccgttatggtgctcgtcaatgcggtttatttcaaaggaaagtggcagtctgcattcacaaaatcagagacaatcaactgccacttcaaatctccaaagtgttctggaaaagccgtggctatgatgcatcaggagagaaaatttaacctgtctgtgatcgaggaccctagtatgaagatccttgaactcagatataatggaggcatcaatatgtacgtgttactgccggagaatgacttatccgagatcgagaataagctgacttttcagaacctgatggaatggactaatcctcgccggatgacttctaagtacgtggaagtgttttttcctcagttcaaaatcgagaagaattacgaaatgaagcagtatctgagggccttgggactgaaagacatttttgacgaatctaaagccgacctgtccgggattgcttcaggcgggaggctttatatcagtcggatgatgcacaaaagctatatcgaagtcacagaggaagggaccgaggcaactgccgctacaggttctaatatagtggaaaagcaactgcctcaatcaaccctgtttagagcggatcacccattcctctttgtcattcgcaaagatgacattattctgtttagtgggaaggtgagctgtccatag

SEQ ID NO: 134003 - DNA, 1143 bp, Artificial Sequence
  Description of Artificial Sequence: Synthetic coding sequence
atggcaagtctcgccgcagccaatgctgaattttgttttaacctttttcgagaaatggatgataatcaagggaatggcaatgtgtttttctcttctcttagcttgtttgcagcactggcacttgttagactgggtgctcaggatgactcattatctcagatcgataagctactacacgtgaacactgcctccggctatggtaactcctctaactcgcagtctggattacaatcccaattgaaaagggtgttttcggatatcaacgcatcacataaggactatgacctgagcattgtaaatggccttttcgccgaaaaagtgtatgggtttcataaggattacatcgaatgtgccgaaaagctctacgacgccaaagtggagcgagtcgacttcaccaaccacctagaggacacccgaaggaatatcaacaaatgggtggagaacgaaacacacggcaaaatcaagaatgtaatcggcgagggaggcatatccagctcagctgtgatggtccttgtgaacgcagtgtattttaaaggaaaatggcagtccgcatttacgaaaagtgaaacaatcaactgtcacttcaaatcacccaagtgctcagggaaagctgtcgcaatgatgcatcaagaacggaaattcaatcttagtgttatcgaagatccgagcatgaagatcctggaacttagatacaatggcggtattaatatgtatgtgctgctacccgagaacgatctgtccgaaatagagaacaaacttaccttccagaacctgatggaatggacaaacccccgcaggatgacgtcaaagtatgtggaagtcttctttccacaatttaaaatcgaaaaaaattacgagatgaagcagtacctccgcgccctgggactgaaagacatcttcgatgaatccaaggcggacttatccggaatagccagcggagggagactgtacatctccaggatgatgcataaatcctacattgaagttactgaggaagggacagaggctacagccgccaccggctctaacattgtggagaagcagctgcctcaaagtactctattccgggcagaccatccattcctcttcgtgattcggaaggacgatataatcttgttcagtgggaaggtcagttgtccgtag

SEQ ID NO: 134004 - DNA, 387 bp, Artificial Sequence
  Description of Artificial Sequence: Synthetic coding sequence
atggcttcccttgccgcagctaatgccgaattctgctttaacctcttcagagagatggacgataatcaaggcaacgggaatgtatttttcagttcattatctctattcgcagccctggctctggtgagactgggcgcccaagatgacagccttagtcagattgataaactgttgcacgtaaacaccgcctcgggatacggtaacagttcaaatagccagtctggtctccagtcgcagttgaaaagggttttttccgacatcaatgccagccacaaggattatgacctgagcatcgtgaacgggctatttgccgaaaaagtgtacggctttcataaggattatatcgagtgtgcggaaaaactttacgatgcgaaagtggagagatag

SEQ ID NO: 134005 - DNA, 387 bp, Artificial Sequence
  Description of Artificial Sequence: Synthetic coding sequence
atggcatccttggctgcagccaatgctgaattttgcttcaacttgttcagggagatggatgataaccaggggaatggcaatgtgtttttttcttccctctcactgttcgccgctctggcgttagttcggctcggcgcacaagatgatagtttgtcccagatcgataagcttttgcacgtgaatacggctagtggctacgggaacagctccaattcacaatcaggactgcagagccagcttaaacgtgtattctcggatatcaacgcctctcacaaggactatgacctatctatcgtcaacggattatttgccgaaaaagtctacggttttcataaagattacattgaatgtgcagaaaaactttacgatgctaaggtggagcgatag

SEQ ID NO: 134006 - DNA, 498 bp, Artificial Sequence
  Description of Artificial Sequence: Synthetic coding sequence
atggcctctctggcagcggcaaacgcggaattttgctttaacctgtttcgagaaatggatgacaaccagggcaatgggaatgtctttttcagttccctgtccctgttcgccgccctggcactggtgcggctgggggcccaagacgactccctcagccagatcgacaaactacttcatgttaacacagcatccgggtacggcaacagttcaaactcgcagtcgggcctgcagtcccagcttaaacgagtcttctctgacattaatgccagccataaggattacgatctgtcgatcgtgaacggcctgtttgcagaaaaagtatacggcttccacaaagactatatcgaatgcgctgaaaagctttacgatgccaaggttgaacgcgttgacttcacaaatcaccttgaagacacaaggcggaatataaacaaatgggtggagaacgagacccacggaaaaatcaaaaacgtcataggggagggcggaatcagtagctag

SEQ ID NO: 134007 - DNA, 1092 bp, Artificial Sequence
  Description of Artificial Sequence: Synthetic coding sequence
atggcttcactggcggccgccaatgctgagttctgcttcaatctgtttagggaaatggacgataatcagggcaatggcaacgtgttctttagctctttgtcgctgtttgcggcgcttgcgctggtcagattaggcgcgcaggatgatagtctctctcagattgataaatccggtctgcaatcacagttgaaaagagtcttctcggacataaatgctagccacaaggactacgatctctcaattgtgaatgggctgtttgctgagaaggtgtacggctttcacaaggactacattgagtgtgccgagaaactatacgatgctaaagtggaaagggtcgatttcactaatcacctcgaggacactaggcgcaacatcaacaagtgggtagagaacgagacgcatggaaagattaagaatgtgattggcgaggggggcataagctcatctgctgtgatggtgctagtcaatgctgtgtattttaagggaaagtggcagtctgcctttacgaaatcagagaccatcaattgccacttcaagtctcctaagtgttcaggcaaagctgttgccatgatgcaccaggagagaaaatttaatctgtcagtaatcgaggatccttcgatgaaaatcctcgaacttcgttacaacggcgggattaatatgtatgtcctcctccccgaaaatgacctgagcgagatagaaaataaacttaccttccagaacttgatggagtggacgaacccgcggcgcatgacttccaaatatgtcgaggtgtttttcccgcaatttaagattgagaagaattacgaaatgaagcaatacctgcgcgccttgggactcaaagacatcttcgatgagagtaaagccgatctgtccgggatcgcctctgggggtagactttacataagccgaatgatgcataagagctacatcgaggtgacggaagagggaaccgaggctacagccgcaaccggcagcaacatcgttgagaagcagttacctcagtccacactgttcagagccgaccatcccttcctgttcgtgatacgtaaagatgacattatcctcttctcagggaaggtaagctgtccatag

SEQ ID NO: 134008 - DNA, 1143 bp, Artificial Sequence
  Description of Artificial Sequence: Synthetic coding sequence
atggcctcactggccgctgcaaacgctgaattctgctttaatctgtttagagaaatggatgacaaccaggggaacgggaatgtctttttctcttcattgagcctctttgctgcgctggcgctggtgaggcttggcgcccaggatgatagtctcagtcaaattgacaaacttctgcacgtcaacacagcctctggatatggaaactctagcaactctcagtcagggctgcaatctcagctcaaacgggtcttttctgatataaacgctagtcataaagattacgatctatcaatcgtgaacggattgtttgcagaaaaagtgtacggcttccataaagattacattgagtgcgcggaaaaactgtacgacgccaaggtggagagggtggacttcactaaccaccttgaagacactcgtcgtaacatcaataagtgggttgaaaatgagactcatgggaagatcaagaacgtgatcggagagggaggaataagctcctctgccgtgatggtgctggtgaacgccgtgtattttaagggtaagtggcaaagtgccttcacaaagtccgagacaattaactgtcatttcaaatccccaaaatgctctggtaaagcagtagcgatgatgcatcaagagcggaaattcaacctgtctgtgattgaagatccttcaatgaagattctcgagctccgatacaacggcggcatcaatatgtacgtcctcctgcctgaaaatgacttgtcagagatcgagaacaagctgaccttccagaacctcatggaatggactaatcctaggaggatgacttccaagtatgtggaggtcttcttcccccaattcaagatcgagaagaactacgaaatgaaacagtaccttagggcactgggcctgaaagacatcttcgatgagtctaaagctgatctttcagggattgcgtcaggaggtcgcctgtatatctcaaggatgatgcacaagagctacatcgaggtgactgaagagggcaccgaggctacagccgcgacaggctctaatatcgtggaaaagcaactgccccagagcacactgtttcgcgcagaccacccatttctttttgtcatcagaaaagacgacatcatccttttcagcggcaaagtttcatgcccctag

SEQ ID NO: 134009 - DNA, 1125 bp, Artificial Sequence
  Description of Artificial Sequence: Synthetic coding sequence
atggacgacctttgcgaagccaatggaacttttgccatctccctctttaagatcctcggtgaggaagacaattctcggaatgtattcttttctcccatgtcaatttcttcagcgttagctatggtgttcatgggcgctaaaggatcaactgctgcgcagatgagccaggctctgtgtctctacaaagacggagatatccaccggggtttccagagcttactttctgaggtgaaccgtactggtacacagtacctgctgaggaccgcgaacaggctctttggcgagaaaacctgcgatttcctgcccgatttcaaggaatactgtcagaagttctatcaggctgagctggaggaactgagtttcgccgaagacacagaagagtgccgaaaacatatcaacgactgggtcgcggaaaaaaccgagggaaagatttccgaggtgctcgacgcgggcactgttgacccccttaccaagctggtgctggtgaatgctatttattttaagggcaagtggaacgaacagttcgaccggaagtacactcgcgggatgctctttaagactaacgaagagaagaagacagtgcagatgatgtttaaggaagctaagtttaagatgggttacgcagacgaagtacatacacaggtgcttgagctgccctacgtggaggaagaattgtcgatggtgattctgttgcccgacgataacaccgatctggcagtggtggagaaagcgctcacatatgagaagtttaaggcatggacgaatagtgagaagctcactaagtcaaaggtgcaagttttccttccaagactcaagctcgaagagtcatacgacctggaaccatttctgcggcgcctgggaatgatcgacgcattcgatgaagcaaaggccgatttcagcggcatgtcaacggagaagaacgtgcccctgtccaaagttgcccacaagtgcttcgtggaggtgaacgaagagggaacggaagccgctgctgccactgccgtcgttcggaactccagatgctcgagaatggagcccagattttgcgctgatcacccctttctattcttcattcgtcaccacaaaaccaactgtatactgttctgcgggagattcagctctccttag

SEQ ID NO: 134010 - DNA, 1125 bp, Artificial Sequence
  Description of Artificial Sequence: Synthetic coding sequence
atggacgatctctgcgaggcgaacggcacctttgcgataagtctgtttaaaatactgggcgaggaggataactcccgcaatgttttctttagtcccatgtccatatctagtgccttggcgatggtttttatgggggcaaaagggtctacagcggctcagatgagtcaagccttgtgcctatataaggatggcgacatccataggggctttcagtcactcctttcggaagtaaatcggaccggaactcagtacttgctccggaccgctaacagactcttcggggagaagacctgcgacttcctacctgatttcaaggagtactgccaaaagttctaccaggctgagctggaggaactctcctttgccgaggataccgaagaatgtcgcaagcacatcaatgattgggtggcggagaaaacagaagggaaaatcagcgaggtactggatgcagggacagtcgatccactcactaaactagtccttgtcaacgcaatctatttcaagggaaaatggaatgaacagtttgaccggaagtatactaggggaatgctcttcaaaaccaacgaggaaaaaaagaccgttcaaatgatgtttaaagaggcaaagtttaagatgggttacgccgatgaggtgcatacacaggtgttggaattaccttatgtggaggaggaactaagtatggtaattctgttgccggacgacaacacggatcttgcagttgtcgagaaggccctgacctacgaaaaattcaaggcctggaccaactctgaaaagctgacaaagtcgaaggtacaagtctttctccccagactgaagctcgaagagtcctatgacctggaacctttccttaggcggctggggatgattgatgctttcgatgaggcaaaggcagacttttccgggatgagtacggagaagaatgtgccactaagcaaggtcgctcataagtgcttcgtggaggttaacgaggagggaactgaggcagccgcagctacggccgtcgttaggaattcgaggtgctctaggatggaaccaaggttctgtgctgaccacccatttttgttcttcatccgacatcataagaccaactgcattctgttttgcgggcgcttttccagcccttag

SEQ ID NO: 134011 - DNA, 495 bp, Artificial Sequence
  Description of Artificial Sequence: Synthetic coding sequence
atggacgatctgtgcgaggcaaatggaacatttgccatttcactgttcaaaattctgggagaagaagacaatagcagaaatgtattcttttcccctatgtccatctcatcagccctcgctatggtcttcatgggcgctaaaggaagtaccgccgcacagatgagccaggccctttgcttgtacaaggatggggacattcaccgtgggtttcagtccttactctcagaggtcaatagaacagggacacagtacctactccgcacagcaaaccgattatttggcgagaagacttgtgactttttgccagatttcaaggagtattgccaaaagttttaccaggccgagctcgaggagctaagctttgccgaggataccgaggaatgtcggaagcatattaacgactgggtggcagagaaaacagaaggaaagatatcagaagtgctggacgccgggactgttgatccccttaccaagctggtactcgtgaatgcttag

SEQ ID NO: 134012 - DNA, 375 bp, Artificial Sequence
  Description of Artificial Sequence: Synthetic coding sequence
atggacgacttatgcgaagccaatggtacgtttgcaatatcattgtttaaaatcttgggagaagaagacaatagtcgaaatgtattcttttcacccatgtccattagctcagcactggctatggtgttcatgggtgcgaaaggcagcaccgcggctcaaatgtcgcaagctctgtgcctgtataaggacggagatattcatcggggcttccagagcctgctcagcgaagtcaatcgcacaggaacgcagtacctgctcagaaccgccaaccgcctcttcggggaaaagacctgcgactttctccctgattttaaagagtattgtcaaaagttctaccaggcagagcttgaggagctcagtttcgcggaagattag

SEQ ID NO: 134013 - DNA, 579 bp, Artificial Sequence
  Description of Artificial Sequence: Synthetic coding sequence
atgttgttcaagaccaacgaagagaagaaaactgtccagatgatgtttaaagaggcaaagtttaaaatgggatatgctgacgaggtgcacacgcaggtgcttgaactgccttatgttgaggaggagctgtccatggtgattttgctgcctgacgataacaccgacctggccgtggtggagaaggctttgacttacgaaaaattcaaggcctggaccaattcagaaaagctgaccaaaagcaaggtccaggtcttccttccccggctgaagctcgaagagagctatgacctcgagccgttccttcgcaggctcggtatgattgacgcattcgacgaagctaaggcagatttctccggcatgagcacagagaaaaatgtaccactttcaaaggtggcccacaaatgcttcgtagaggtgaacgaggagggtacagaggctgcggctgccactgcagttgtccggaatagccggtgttcccggatggagcccaggttttgcgcagaccacccgtttctctttttcataagacatcataagaccaactgtatcttgttctgcggtaggttttcttccccttag

SEQ ID NO: 134014 - DNA, 1131 bp, Artificial Sequence
  Description of Artificial Sequence: Synthetic coding sequence
atggagacattatccaatgcctccggaaccttcgcgattaggctgctgaagatcctatgtcaagataaccctagccacaacgtgttctgctctccagtgagcatcagcagcgctcttgccatggtgctgctgggagcaaaaggtaacaccgctacgcagatggctcaagcactttccttgaataccgaggaggatatccatcgggcgtttcagtccctcttgacagaggtgaacaaggccggaacccagtaccttcttagaaccgcaaatcgcttattcggggaaaaaacctgccagtttctcagtacctttaaagaatcttgcttgcagttctaccacgctgagttgaaagaactaagcttcatccgtgcggccgaggaatctcggaagcacatcaatacctgggtcagcaaaaagacagaaggaaagatagaggagctcctccctggttcaagcatcgacgccgaaacccggctggtgctcgtgaacgccatctattttaaggggaaatggaatgaaccctttgatgaaacttacacccgtgagatgcccttcaagatcaaccaggaggagcaacgacccgtccagatgatgtatcaagaagcaacatttaaactggctcacgtcggagaagtgcgagctcagctcttggagctcccctacgcaaggaaagagctgagcttactggtgctcctccctgacgatggcgtagagctgtctaccgtggagaagagcctgaccttcgagaaactgaccgcttggactaagccagactgcatgaaatcaaccgaagttgaagtgctgctccctaagttcaaattacaggaagactatgatatggagtcagtgttgcggcacttggggatcgttgacgctttccagcaagggaaggccgatcttagcgcgatgtccgccgagcgtgacttatgtctctccaaatttgtccataagagctttgttgaagtgaatgaagaagggaccgaggcagctgctgcctcctcatgtttcgtggtggcagagtgttgtatggagagtggccccagattttgcgcagatcaccctttcctcttttttattcggcataatcgggctaactctatcttgttttgtggacgattcagcagtccctag

SEQ ID NO: 134015 - DNA, 1104 bp, Artificial Sequence
  Description of Artificial Sequence: Synthetic coding sequence
atgagctccccccctcctgcccgctcggggttctaccggcaggaagtgacaaagaccgcttgggaggtcagagctgtataccgagacttacagcctgtgggcagtggtgcttacggagctgtatgttccgccgtggacgggaggacgggcgccaaggtggctatcaagaagctgtataggccttttcagagcgagctgtttgccaaacgcgcataccgagagctgcggttgttgaagcatatgcgccacgaaaatgtgattggcttactcgatgtgttcacacccgatgagaccctggatgattttactgatttctacctggtgatgccatttatgggaactgacctcggcaaattgatgaaacacgagaaactaggtgaagaccgcattcagttcctggtgtaccagatgctcaaaggactgcggtacattcatgctgccggtattattcacagagatctgaagccggggaacttggcagtcaatgaggattgcgagttaaagatattggactttggcttggctagacaagccgactcagagatgaccggatatgttgtgacacggtggtatcgggcccccgaggtcattttaaactggatgaggtatacgcagactgtggacatctggagcgtggggtgcattatggccgagatgattactgggaagaccctctttaaaggctctgatcacctggaccagctcaaagaaatcatgaaggttacaggaaccccgcctgccgagtttgtccagcggttacaatccgatgaagccaagaactacatgaagggtctcccggagctggaaaagaaagacttcgcttccatcttgacgaatgctagcccattggctgttaatcttttggagaagatgctcgtcctggatgccgaacagcgggtgacggctggagaagccctcgcccacccctatttcgagtcgttgcatgacaccgaagatgagcctcaggtccagaaatacgacgattcctttgatgatgtggatcgcacactcgacgaatggaagcgcgtcacctacaaggaggtactgtcatttaaacccccccggcagctgggagccagggtgtccaaagagacccctctgtag

SEQ ID NO: 134016 - DNA, 1500 bp, Artificial Sequence
  Description of Artificial Sequence: Synthetic coding sequence
atgaagcattcattgaacgccctgcttatattcctgataataactagtgcctggggcggctcaaagggccccctggatcagctggagaaaggaggagaaacagctcaatcggccgatcctcagtgggagcagctcaataataagaatttgtccatgccactcttaccagcggactttcataaggagaatactgtgacaaatgactggatacctgagggggaagaggatgatgattatctggacctcgagaagatctttagcgaagacgatgattacattgatatcgtcgactctctctcggtttctccaactgatagtgacgttagtgcaggtaatatactccagcttttccatggcaagagcaggattcaacgactcaacatcctcaatgcaaagtttgcatttaacttgtatcgagtgcttaaagaccaggtgaatacgttcgataatatcttcatagccccagttggaatttccaccgcaatgggtatgattagcctaggactgaagggtgaaacacacgagcaggtgcactcaattctgcattttaaggacttcgtcaatgcttcttccaagtacgaaatcaccactattcacaatctgttccgaaagctcactcaccgactgttccgccggaattttggatacactctgcgaagtgttaatgacttgtacattcagaaacagtttcccatcctcctggacttcaagacaaaggtgcgcgagtactacttcgccgaagcccaaatagccgatttcagtgaccctgctttcattagcaagactaataaccatattatgaaacttactaaaggactgatcaaggatgcactcgaaaacatcgacccggctacacagatgatgatcctgaactgcatctatttcaaagggtcctgggtcaacaagttccctgtcgagatgacacataatcacaatttccgcctgaatgaacgggaagtggtcaaagtgagtatgatgcagacgaaaggaaactttctcgcggcaaacgaccaggagctggattgcgatatcctgcagttggaatacgtaggggggatctcgatgctgattgtagttccccataagatgtcaggtatgaaaaccctggaggcacagctgacccccagagtcgtcgaaaggtggcagaagtctatgaccaatcggactcgggaggtgctcttgcccaagtttaagctcgaaaaaaattataacctcgttgagagcctgaagctgatgggcataagaatgctgttcgataaaaatggtaatatggcaggaatctctgatcagcggattgctatagatctgtttaagcaccagggtaccattacagtgaacgaggagggcacccaagcgacaacagtcacaaccgtcggatttatgcccctgagcacccaggtgagattcaccgttgacagaccgttcctgttcctgatctacgagcaccggaccagttgtctcctgttcatgggccgcgtagccaaccctagccgaagctag

SEQ ID NO: 134017 - DNA, 1197 bp, Artificial Sequence
  Description of Artificial Sequence: Synthetic coding sequence
atgaactggcacttgcctctttttctgctcgcttccgtgactctgcctagtatttgctcacattttaacccactgagcctggaggaactcggatctaacaccggcatccaggtgttcaaccagatagtcaaaagtaggccacatgacaatatcgtcattagccctcatggcattgctagtgtgttgggaatgttgcagctgggggctgacggaagaaccaaaaagcaactcgccatggttatgcgctatggcgtgaatggtgttggtaaaattcttaaaaaaattaacaaagcaattgtgtccaagaaaaataaggacattgttactgttgctaatgctgtctttgtaaaaaacgcgtctgagatcgaagtgcccttcgttaccaggaacaaagatgtctttcagtgtgaggtgcggaacgtgaattttgaggatcccgcgtctgcctgtgacagtatcaacgcatgggtgaagaatgaaacgcgggacatgattgataatcttttgtctcctgacctcatcgacggtgtgttaacacggctggttctggtgaacgcagtctactttaaggggctatggaaaagcaggtttcagcccgagaataccaagaagagaacgtttgtggccgcagacggaaagtcatatcaggtcccaatgctggcccagctaagcgtgttcaggtgcgggtcaacatctgcccccaacgatctgtggtataactttatagaacttccatatcacggcgagagcatcagcatgctgatcgcgctgcctacagaaagtagcacccccctctcggctattatcccacacattagtacgaaaactatcgattcttggatgtctataatggttccaaagagagtgcaggtcatcctcccgaaattcacagctgtggctcaaaccgacctcaaggagccactgaaggttctgggcattactgatatgttcgattcttcaaaggccaattttgccaagatcacaaccggatctgaaaaccttcacgtgagtcacattctccagaaagccaagatcgaggtatctgaggacgggactaaagcctctgcagccacgactgctattctgatcgcccggagctcaccgccttggttcatcgtcgataggcctttcctgttctttatccgccataatccgaccggcgcagtgctctttatgggacagattaataagccctag

SEQ ID NO: 134018 - DNA, 1194 bp, Artificial Sequence
  Description of Artificial Sequence: Synthetic coding sequence
atgaattggcacttgccactttttttacttgccagtgtgactttacccagcatctgttcccattttaaccctctatcactagaggaactggggtcaaatacaggtattcaagtgttcaaccaaatagtgaagtcccgaccacatgataatattgttatcagccctcacggtatcgccagcgtcctgggtatgctacagctgggagcggatggacgcactaagaagcaattagccatggtcatgcgctacggcgtcaacggcgttgggaagatcttgaagaagattaataaggccattgtgtccaagaagaacaaggatatagtgaccgtggctaacgcggtcttcgttaagaatgctagcgagatcgaggtacctttcgtcactaggaataaggatgttttccagtgtgaggtacggaatgtgaacttcgaagatccagctagcgcatgtgacagtatcaatgcttgggtcaagaacgaaaccagggacatgatcgacaatctgttatctcctgaccttatcgatggagtactgaccaggcttgtactagtgaatgcagtttacttcaagggattatggaaatctagattccaaccggagaatacaaaaaagaggacattcgtggccgccgatggcaagagttatcaagtgccaatgctagcccaactctccgtgtttcgatgtgggtctacttcagccccaaatgatctatggtataatttcatcgaactcccataccacggcgaaagcatctctatgctcatcgccctacctactgagtcatctacccctctttcagccatcatcccacatatctctactaagacaatcgatagctggatgtccataatggtgcctaagagagtccaagtgatcctgccaaagttcaccgctgtcgcccagaccgacctgaaggaacccctgaaagtcctgggaattactgacatgtttgactccagcaaagcaaactttgctaaaattacacggagtgaaaatctgcacgtgtcacatatcctgcagaaagctaagattgaagtgagcgaagacgggacgaaagcttccgccgctacgacagccatccttatcgctcggtcatcaccaccctggttcattgtcgatcgcccattcctgtttttcattaggcataacccaacaggtgctgtgctgttcatgggccagattaataagccttag

SEQ ID NO: 134019 - DNA, 1194 bp, Artificial Sequence
  Description of Artificial Sequence: Synthetic coding sequence
atgaattggcaccttccgctgttcctgctcgccagcgtaactctaccctcaatctgcagtcacttcaaccccctgagtctcgaggagctggggtccaataccgggattcaggtattcaatcaaattgtgaagtcaaggccacacgacaatatcgtcataagtccacacgggatcgctagcgtgctggggatgttgcagctgggggccgatggaagaaccaagaagcaattggccatggtgatgcggtacggcgtgaacggcgtaggtaaaattctgaagaaaataaataaggctatagtgagtaagaagaacaaggatatagtcaccgtggcaaacgccgtatttgtgaaaaatgcatctgaaatcgaggtcccattcgtgactcgcaataaggatgttttccagtgtgaagtcaggaacgtaaacttcgaggatcctgcctctgcttgcgacagtattaacgcatgggtgaaaaatgagacccgggatatgatcgataatcttctgtcaccagatctgattgacggagtccttacaaggctcgtgctggtgaacgccgtgtacttcaagggactgtggaagtcccgattccaacccgagaacaccaaaaagcggaccttcgtggcggcggatggaaagtcttatcaagtgcccatgttagcacagctgagtgtatttcggtgtggttctacgtcggcccccaatgacctgtggtacaattttatcgaattgccgtatcacggcgagtccatctccatgcttatagccctgcccaccgagagttccacacctctttccgcaatcattccacacatttccacaaaaactatcgactcatggatgtctataatggtgccaaaacgagtgcaagtcatactgcccaagttcaccgctgttgcccagaccgatctcaaggagcccttgaaggtcctagggattactgatatgtttgattcaagcaaggcaaactttgcgaagataacaaggtctgaaaacctacatgtgagccacatcttgcagaaagctaaaatcgaggtgtctgaggacgggacaaaggctagtgccgccaccaccgccatccttattgcgcgttctagcccaccttggtttatagtcgaccgtccatttttattttttatccggcataatcccacaggggcggtgctttttatggggcagattaataagccctag

SEQ ID NO: 134020 - DNA, 129 bp, Artificial Sequence
  Description of Artificial Sequence: Synthetic coding sequence
atgaactggcacctccccctgtttctcctcgcctcagtcaccctaccttctatctgcagtcacttcaatccactttcactggaagaactggggtctaatacaggcatccaggtttttaatcagatctag

SEQ ID NO: 134021 - DNA, 831 bp, Artificial Sequence
  Description of Artificial Sequence: Synthetic coding sequence
atgaattggcaccttcccctgttcctgctcgcatctgtgacgctccccagtatttgctcccacttcaatccactgtccctggaggagctgggcagtaatacaggaatacaggttttcaaccaaatagttaaaagcagaccacacgataatattgtgattagcccacatggcatcgcctcggtactcggaatgctgcagttgggagctgatggacgaacgaaaaaacaactggccatggtcatgcggtacggggtcaacggggtaggaaagatactcaagaagatcaacaaggctatcgtgtctaaaaaaaataaggacatcgtaacagtggcgaatgccgttttcgtgaagaatgctagtgagatcgaggtcccttttgtaacccggaataaggatgtgtttcagtgtgaggttaggaacgtgaactttgaggatcctgctagcgcatgtgacagcattaacgcctgggtaaaaaatgaaacaagggatatgatagacaatcttctgagccccgatttgatcgacggcgtgctgacacgcctcgttttggtaaacgccgtgtattttaagggactatggaaaagcagattccagcccgagaacacaaagaaacgaacatttgtcgctgcagacggtaagtcctatcaggtgccgatgctggctcagctgtctgtattccgctgcgggtcaacaagcgccccaaatgacttgtggtacaatttcatcgagttgccttaccacggggagagtatctcaatgctgatcgccctgcccacagagagcagtactcccctctccgctatcatcccccacatatccacgaaaacctag

SEQ ID NO: 134022 - DNA, 1230 bp, Artificial Sequence
  Description of Artificial Sequence: Synthetic coding sequence
atgtcggattgtcgcagtagcttagtggaggggactatgaattggcaccttccgctgttcctacttgcttccgttacccttcccagcatctgctcccacttcaatccattgtccctcgaggaactgggatccaacacagggattcaggtcttcaaccagatcgtgaagagccgaccccacgataacattgtgatcagtccgcacggaattgcgagcgttctggggatgctgcagctgggggccgacggcaggacaaagaagcaactggcgatggtgatgagatacggagtcaatggcgtgggcaagatcctgaagaaaattaataaggccatcgtaagcaaaaagaataaggacattgttaccgtcgctaacgccgtctttgtgaaaaacgccagtgaaattgaggtcccattcgtcacacggaataaagacgtcttccagtgtgaggttcgcaacgtgaattttgaggatcctgccagtgcatgtgatagtatcaacgcctgggtgaaaaacgagacaagggacatgattgataacttgttgagccccgacctcatagacggggtcctaacccggttggttctcgtgaatgctgtgtactttaagggtctgtggaaatctcggtttcagcccgagaatactaaaaagcgaacgttcgtggccgccgatggtaaaagctatcaagtacccatgctggcacagcttagcgtcttccgctgcggtagcacaagcgccccaaacgacctttggtacaatttcatcgaacttccctaccatggggagtcaatctcaatgctgatagccctcccaactgagtccagcacacccctgtccgctattatcccccacattagcactaagaccatcgactcctggatgtcaattatggtgcccaagcgggtgcaggtgatcctgccaaagtttactgccgtggctcagacggatctaaaagagccgctaaaagtccttggaatcacagatatgtttgactcatctaaagccaatttcgccaaaatcaccaggtccgaaaatcttcacgtttcacatattttacagaaggccaaaattgaggtttcagaagatggcacaaaggcaagtgcggccactaccgccatattaatagccaggtcttcccccccttggtttatcgtcgacaggccctttctgtttttcatcaggcacaatccaacaggggcggtcctttttatggggcagatcaataagccctag

SEQ ID NO: 134023 - DNA, 264 bp, Artificial Sequence
  Description of Artificial Sequence: Synthetic coding sequence
atgaattggcacctcccactatttctcctggccagtgtgacactcccatccatttgcagccacttcaaccccctcagcctggaagaactgggatccaacaccggcatccaggtgtttaaccagattgtgaagtccaggccacacgacaatatcgttatctctccacacggcattgcatcagtgttgggaatgcttcagttgggcgccgacggccgaaccaagaaacagctcgccatggtgatgaggtatggcgtcaacggttag

SEQ ID NO: 134024 - DNA, 1257 bp, Artificial Sequence
  Description of Artificial Sequence: Synthetic coding sequence
atgcaggcccttgtgctgctgctgtgtattggtgcattgcttggccactcttcttgccaaaaccctgcgtctcctccagaagaaggctcccccgatcccgacagcaccggtgctctagtggaagaggaggatcccttcttcaaagtgccggtaaacaaactggcggccgccgtgtctaactttggatacgatctttacagagtaaggtcatcaacctcccccacgacaaatgtgctgctgtcccctctgtcagtggctacagcactgtctgctctgagcctgggggcagagcaacgaacggagagtattatccatcgtgccctgtattacgacctgatctcatctcctgacatacatggaacctataaggagttgctcgacacagtgacagcgccccagaagaacctgaaaagtgcttctaggatcgtgttcgagaagaagctgcgaattaagagttctttcgtagctcccctggagaaaagctacggcactcgccccagagttcttacgggcaaccctaggctggacttgcaggaaataaacaattgggtccaggcacagatgaaagggaagcttgcgcgctcaacaaaggagattcccgatgagatctcaatcctactcctgggtgttgcccactttaaaggccagtgggtcaccaaatttgattcgcgaaagacgtccctcgaagacttttacctagatgaagagaggacagtgcgggtgccaatgatgtcagatcccaaggcagtgctgcgttatggcttagattccgacctgtcctgtaaaatcgcacaactaccgcttacaggctccatgtctatcattttctttttacccctaaaagtaacacaaaacctcactttgattgaggaaagcctcacatcagagttcattcacgatatagaccgggagctgaagaccgtgcaagcggtcctgactgtgcccaagctgaaactatcttatgagggcgaggttacgaaaagccttcaggagatgaaattgcagtctctattcgattcaccagacttttctaagattaccgggaaaccaatcaagctgacgcaggttgaacacagagcggggttcgagtggaacgaagacggcgcaggtactactccctcacccggcctccagccagctcacctcacctttccccttgactatcacctgaaccagccatttattttcgtgctgagggacaccgatacgggcgctctcctattcatcggcaagatcctagatccgaggggtccctag

SEQ ID NO: 134025 - DNA, 1233 bp, Artificial Sequence
  Description of Artificial Sequence: Synthetic coding sequence
atggcttttttgggactgttttctctgctggtcctgcagtcaatggccacaggcgccacattccccgaagaagcaatcgctgacttatctgtgaacatgtacaacaggctccgggcaactggagaagatgagaatatactgttcagcccattgtcaatcgccctggctatgggcatgatggagctgggagcccaggggtctacgcaaaaagagattagacactctatgggctatgattcgctcaaaaatggggaggagttctcattcctgaaggaatttagcaatatggtgacagccaaggagagccagtatgttatgaaaatcgccaatagcctcttcgtacagaacgggtttcacgtgaatgaggagttcctccagatgatgaagaagtattttaacgctgccgtgaaccacgtggacttttcacagaacgtcgcagtagctaattacatcaataagtgggtagaaaataacacaaataatctggtcaaggacttggtgtcaccccgcgacttcgacgccgctacgtatctggctctgatcaatgcggtctatttcaagggcaactggaaatcccagtttcgccccgagaacacacgcacctttagttttaccaaggacgacgagagcgaagttcagatccctatgatgtaccagcagggcgagttctactatggagagttcagtgacggctccaatgaggccggaggaatctatcaggtgctggagattccatacgaaggtgatgaaatcagcatgatgttggtcttgagcagacaggaagtcccattggcaactctggagcccctggtcaaggcgcagctggtcgaagagtgggcaaattccgtaaagaagcagaaagtcgaagtgtatctgcccaggtttactgtggaacaggagatcgacctgaaggatgtactgaaagctctgggcattactgaaatctttattaaggacgctaaccttactggactctcagataacaaggagatctttctttctaaggccatacataagtcatttctagaggtgaatgaggaaggttctgaggcagctgccgtttcggggatgatagcaatttctcgcatggccgttctctatcctcaggtgattgtggaccacccattttttttccttatcagaaatagaaggacggggaccatcctatttatggggagagttatgcacccagagactatgaataccagcggacacgatttcgaggaactgtag

SEQ ID NO: 134026 - DNA, 1233 bp, Artificial Sequence
  Description of Artificial Sequence: Synthetic coding sequence
atggcattcctgggcctgttcagcttactagtgctccagagtatggctaccggagctacctttccggaggaggctattgccgatctaagcgtgaatatgtacaataggctacgggctaccggagaggacgaaaacatactattttcccccctgagtatcgccctcgcaatgggcatgatggagctgggcgcacaagggagcactcagaaagaaattcgccacagtatggggtacgatagccttaaaaacggcgaggagttcagcttccttaaagaattcagtaacatggtcaccgctaaggagtctcagtatgtaatgaagatagctaactcactgtttgtgcagaacgggtttcatgtgaacgaagagtttctgcagatgatgaagaaatacttcaacgcagctgtcaatcacgtcgacttctcacagaatgttgccgttgccaactatataaataaatgggtggaaaataatactaacaatctcgttaaggacctagtcagccccagggatttcgacgctgccacgtacttggccctcattaacgctgtgtatttcaagggcaattggaaaagtcaattccgtcctgaaaacactcgaaccttcagcttcaccaaggatgacgaatctgaggtacagatccccatgatgtaccagcaaggggagttctactatggggagtttagcgacgggagcaacgaggctgggggcatttatcaggtgctggagataccatatgagggagatgagatctcaatgatgttggttctcagccggcaggaagtgccgctggccacactggagccccttgtgaaagctcagctggtagaagagtgggctaatagcgtcaaaaagcaaaaggtggaggtgtatctgccccgctttaccgtcgaacaggaaattgatctgaaggacgtgctgaaagcgttgggcatcacggagatttttatcaaggacgcgaacctgaccggtctttccgataataaggagatatttctgtccaaggctattcacaagagtttcctggaagtcaacgaggagggtagtgaagcagccgccgtgagcggaatgatcgctatctctcgcatggccgtactctaccctcaggtcattgtagaccacccctttttttttctgattcgaaataggaggacaggcaccattctgtttatgggacgggtcatgcacccggagaccatgaacaccagcgggcatgattttgaagaactatag

SEQ ID NO: 134027 - DNA, 738 bp, Artificial Sequence
  Description of Artificial Sequence: Synthetic coding sequence
atggccttcctgggacttttttcgctgctcgtgctgcagagtatggccacaggtgcaacattccctgaggaagcaatcgcagatctgagtgtcaatatgtacaacaggcttcgagctacaggtgaggacgaaaatattttatttagtccgctctccatcgctctggcaatgggcatgatggagctgggagcccaggggtccacccagaaagaaatccggcattctatggggtatgattcgctcaaaaacggagaagaattttctttcttgaaagaattttctaacatggtcacggctaaagagtctcagtatgtgatgaagatagcaaacagtctgtttgtgcaaaatgggtttcatgtgaacgaagaattcctccagatgatgaaaaagtatttcaatgctgccgtgaaccatgtggatttctcacagaatgtcgccgtggccaattacataaacaagtgggtagaaaacaatactaacaacttagttaaagacctcgtgtcacccagagattttgacgccgctacgtacctggctttgattaatgctgtctattttaagggaaattggaaatcccaattccgccccgaaaacacaagaaccttttcttttaccaaggacgatgaatcagaggtgcaaatcccaatgatgtaccagcagggcgagttttactatggggagtttagcgacggctcgaatgaagccggggggatttatcaagtgttagagataccatag

SEQ ID NO: 134028 - DNA, 483 bp, Artificial Sequence
  Description of Artificial Sequence: Synthetic coding sequence
atggcctttctcgggctatttagtctattggtgctgcagtcaatggccaccggtgcaacatttcctgaagaggccattgcagatttaagcgttaatatgtataatcgccttcgcgctacaggggaagatgaaaatatccttttttctcccctgtcaattgccctggctatgggtatgatggagctgggggcccagggaagcacacagaaagaaattcggcatagcatggggtacgatagtctgaaaaatggcgaggaattctcctttctgaaggagtttagcaacatggtgactgccaaggagtcccagtacgtcatgaagatcgcaaactcgctctttgtacagaacgggtttcacgtgaacgaggagtttcttcagatgatgaaaaaatacttcaacgccgctgttaaccacgtagatttcagtcaaaatgtggctgtagctaactacatcaataaatgggtcgaaaacaacacaaattag

SEQ ID NO: 134029 - DNA, 591 bp, Artificial Sequence
  Description of Artificial Sequence: Synthetic coding sequence
atggtcggagggctgaaaagaaagcactcagatcttgaggaggaggaggagaggtgggagtggtcaccagccggactgcagagctatcagcaagccctgcttaggatatctttggataaagttcagcgaagccttggtccccgtgctcctagtctgagacggcacgtgctaatccataacaccctccaacaactgcaggccgcgctaagattggctcctgccccggccctgcccccggaaccgctgttcctgggcgaagaagacttcagcctctcagccactattggctctatccttagagagttggataccagcatggacgggaccgaacccccacagaaccctgtgactccactaggattgcagaacgaggtgcctcctcagcccgatcccgtgttcctggaggctctttcttcgagatatttaggcgactccggactcgacgacttcttcctggacatcgacacttccgccgtcgaaaaagagcccgctagggcgcccccagagcccccgcataatttgttctgcgctcctggaagttgggagtggaacgagcttgatcacatcatggaaataattctgggctcatag

SEQ ID NO: 134030 - DNA, 591 bp, Artificial Sequence
  Description of Artificial Sequence: Synthetic coding sequence
atggtaggtgggcttaagagaaagcactcagatctggaggaggaggaggagcgctgggaatggtcacccgctggcctccaaagctaccagcaggcacttctaaggatctctttagacaaggttcagagaagcctgggcccgagggcccccagtctgcgacggcacgtgttaatacacaatactctgcagcagctgcaggctgctctaaggctcgctcccgcacccgccttgccccctgaacccctttttttgggggaggaggacttcagcctgagcgcaactataggtagcatcctccgggaactcgacaccagcatggacggaacggaacctccacagaatcctgttacgccgctcgggctgcagaacgaagtacctcctcaaccggatcccgtgttcctcgaggccttgagttctcgctaccttggagattctgggctggatgacttcttcctcgacatcgacacatctgctgtggagaaggagcccgcccgggcccctcctgagcccccacacaatctgttttgcgcacctgggtcatgggagtggaacgagctggatcacatcatggaaattattctgggtagctag

SEQ ID NO: 134031 - DNA, 369 bp, Artificial Sequence
  Description of Artificial Sequence: Synthetic coding sequence
atgaagctcctgactggtctggtgttctgcagtcttgtgctgggggtgtcctccaggagttttttttcatttctgggggaagcttttgacggcgctcgcgacatgtggagggcatactccgatatgagggaggctaattatatcggctcagacaagtatttccacgctcgaggcaactacgatgcagctaaacgaggcccaggcggcgcctgggccgccgaagttatcacagacgctcgtgaaaacattcagcggttcttcggccatggcgccgaggattccttagctgaccaggctgccaacgagtggggacgttctgggaaggacccaaaccattttcgacctgctggacttccagagaaatattag

SEQ ID NO: 134032 - DNA, 369 bp, Artificial Sequence
  Description of Artificial Sequence: Synthetic coding sequence
atgaagctattaacaggtcttgtcttttgtagcctagtattaggcgtgtctagcagatctttttttagctttcttggagaggctttcgatggtgcccgagacatgtggagagcgtactcagacatgagagaggccaattatatcggctcggacaagtactttcacgcacgtggcaactacgacgctgctaagagaggccctggaggcgcctgggccgcagaagtgatcacagacgctcgcgagaacatccagcggttttttgggcacggtgctgaagatagtctagcagatcaggcagcaaacgaatggggcaggtcaggcaaggaccccaatcactttagaccagcaggcctacccgaaaaatattag

SEQ ID NO: 134033 - DNA, 369 bp, Artificial Sequence
  Description of Artificial Sequence: Synthetic coding sequence
atgaagctactaactggcctggtcttttgcagcctagtgctaggtgttagttctcgatctttcttttccttcctgggtgaagcctttgacggagcaagagacatgtggcgcgcatacagcgacatgcgcgaggccaactatattggttcagacaaatacttccacgctcgggggaattacgatgccgccaagagagggccagggggcgcctgggccgctgaggtgatcactgatgcccgggaaaacatacagaggtttttcggacatggcgctgaggacagcctggccgaccaggcagcaaatgaatggggacgctcgggtaaagatcccaatcactttagaccagcaggactcccagaaaaatactag

SEQ ID NO: 134034 - DNA, 369 bp, Artificial Sequence
  Description of Artificial Sequence: Synthetic coding sequence
atgaaactgcttacaggtttggtgttctgcagccttgtgttgtccgtgagcagtcgatcgttcttctccttccttggggaagcttttgacggtgctagggacatgtggagggcatatagcgatatgagggaggccaactatatagggagcgacaaatacttccacgcaaggggcaattatgacgccgcgaaaagaggcccagggggggcatgggcagctgaagtaatttcaaacgcccgagaaaatatccagcgtctgactggccgcggcgcagaggactcccttgccgatcaagccgccaacaaatggggaagaagcggccgagacccgaatcatttccgacctgcaggtctgcctgagaagtattag

SEQ ID NO: 134035 - DNA, 252 bp, Artificial Sequence
  Description of Artificial Sequence: Synthetic coding sequence
atgaaactgctcaccgggctggtgttttgctcgctcgtcttgtctgtgagctcacgctcctttttcagcttccttggcgaggcgtttgacggtgcccgtgatatgtggcgggcctactctgatatgagggaagctaattatatcggctccgacaagtatttccatgcaaggggaaattatgatgcggcaaagagaggcccaggaggcgcttgggccgccgaggtcatcagtctgttttcagctgaactttag

SEQ ID NO: 134036 - DNA, 369 bp, Artificial Sequence
  Description of Artificial Sequence: Synthetic coding sequence
atgaaactcctgactggtctggtcttttgcagcctggtgctcagtgtcagctctaggagtttctttagcttcctgggcgaggcctttgatggcgcacgtgatatgtggagagcctacagcgacatgcgcgaggccaactacattggtagcgataaatattttcacgcaagaggaaattacgacgcagcaaaacgagggcctggcggagcgtgggcggctgaggtgatctcgaatgcaagagaaaacatacaacgtcttacgggccgcggggctgaggacagcctcgctgaccaggcagcaaacaagtgggggagatcaggtcgagatcctaatcacttcagacccgcaggattgccagagaaatattag

SEQ ID NO: 134037 - DNA, 369 bp, Artificial Sequence
  Description of Artificial Sequence: Synthetic coding sequence
atgaaactgctcacagggctggtcttttgcagccttgttttatcagtcagctctcgcagtttcttttcattccttggtgaggcttttgatggagcgagagatatgtggcgcgcttacagcgatatgcgagaggccaattatatcgggtctgataaatattttcacgcacgtggaaattatgacgcagcaaagcggggcccgggtggggcctgggccgcagaggtcatatcaaacgcgcgcgagaacatacagcgcctgaccggtaggggggcggaagactccttggctgaccaggcggccaataaatggggaagaagtggacgggaccctaatcactttcgtcctgctggactccctgaaaaatattag

SEQ ID NO: 134038 - DNA, 393 bp, Artificial Sequence
  Description of Artificial Sequence: Synthetic coding sequence
atgcgactgtttacaggaatcgtgttttgtagcctggtgatgggcgtgactagtgagtcatggcgttcttttttcaaggaggccctccagggagtgggcgatatgggccgcgcctactgggacattatgatatcaaatcatcaaaattctaatcggtacctgtatgctcggggcaattatgacgctgctcagcggggacccgggggggtttgggcagctaagctgatatccaggtccagggtgtacttgcaaggcctcattgattgctatctcttcggcaactcctcaacagtcctggaggactcaaagtctaatgaaaaagcagaggagtggggcaggagcggtaaggacccagaccgatttcgtcccgatgggcttcctaagaaatactag

SEQ ID NO: 134039 - DNA, 1278 bp, Artificial Sequence
  Description of Artificial Sequence: Synthetic coding sequence
atgggagaagacgccgcccaggcggagaaatttcagcatcccggttccgacatgcgccaggaaaagccttcctccccttctccgatgccctcatctacacctagcccaagtctgaatcttggtaataccgaggaagccatccgggacaattcccaagtcaacgccgtgacagtgttgaccctgctcgataagctggtgaacatgttggatgctgtgcaagagaaccagcataaaatggaacagagacagatttctttagaaggttctgtaaaagggattcagaacgacctgactaaactgtctaagtaccaggccagcacttccaataccgtcagtaaactccttgaaaagagtcgcaaagtgtctgcccacacccgggccgtgaaagagaggatggacagacaatgcgcacaagtgaagcgacttgaaaacaatcacgcacagctattgagacgaaaccatttcaaggtgttaatttttcaggaagagaacgagatccctgcaagtgttttcgtgaaacagcctgtctccggtgccgtggagggaaaggaagagcttcccgatgaaaacaagagccttgaggagactttacataccgtagatctgtcatcggacgacgacttgcctcacgatgaggaggccctcgaagacagtgccgaagagaaagtggaggagtcacgcgcagaaaagataaagaggtcatcactgaagaaagtagatagtttgaaaaaagccttcagcagacagaatatagaaaaaaagatgaataagttggggacaaagatcgtgtccgttgagcgtcgagagaaaattaaaaagtccttgacctcaaatcaccaaaaaatatcttccggaaagtcttcaccgttcaaggtttcacccctgacttttgggaggaaaaaagttagagagggcgagtctcacgctgaaaatgaaacaaaaagtgaggacctgccaagctcggaacaaatgccaaatgaccaggaggaggagtccttcgcggaaggccatagtgaggcaagcctggctagtgccctggtcgaaggggagattgccgaggaggctgccgaaaaagcgacgtcccgaggatccaattcggggatggattcaaatatcgatctgacaatcgtggaggacgaagaggaagagtctgtcgctctagaacaggctcagaaggtgcgctatgagggatcatatgcactgacatcagaggaggccgaaagaagtgacggagacccagtgcaacccgccgtcctgcaagtgcatcagacttcctag

SEQ ID NO: 134040 - DNA, 1290 bp, Artificial Sequence
  Description of Artificial Sequence: Synthetic coding sequence
atggcacagccgggtaccttgaatttaaacaacgaggtggtgaagatgaggaaagaggtaaagcgaatccgggttctggtcatcagaaagctcgttagatctgtcgggcgacttaagtctaagaagggaactgaggacgctctgctgaagaatcagaggcgggctcaacgtctcttggaagagatccatgcaatgaaagagctcaaaccagatattgtaactaaatctgcgctcggcgacgatattaactttgaaaagatcttcaaaaagcctgacagtaccgccacagagcgagctatagctcgtcttgccgtgcacccactacttaagaagaagattgacgttctgaaggctgcagtgcaggcgtttaaggaggcccggcaaaacgtggcagaagtcgagagtagcaagaacgccagcgaagacaaccactcagagaatacactgtattctaatgacaatgggtccaacctgcagagggaggccacagtcataagtgaacagaaggtcaaggaaactaaaatcctcgccaagaagccaatccataatagcaaagagaaaattgctaagatggaacacgggccaaaagccgtcacgatcgccaacagcccttctaagccttctgagaaggacagcgtggtgtcactcgagagccagaagacacctgctgaccctaagttgaaaaccctttctcaaaccaaaaagaacaaagggagcgactcctccctgtctggtaattcagacggtggtgaggaattctgcgaagaagagaaggagtattttgatgactcaaccgaagaacgtttttataagcagtcaagcatgtctgaagacagcgactccggtgacgatttcttcatcggcaaagtcaggcgaactcgcaagaaggagagtagctgccactccagcgtcaaagagcagaagccattagagaaggtttttttgaaagaggacacaggagagacacacggcgatacacgaaatgataaaattaaaccctcaaccgagacgcgaaaattggagagtgtattcttccacagcctttccgggagcaagtccagcagaagaaactttaaggaacaggcacccaaaacgcgtagtcttgacttcccgcagaatgaacctcagatcaagaaccaattcaataagaagttatctgggaggttggaaaataccaaacagcaattgcagctgcctcttcatccctcatgggaagcttcccggagaagaaaagaacagcagtcaaacattgccgtgttccaggggaagaagattacgtttgacgactag

SEQ ID NO: 134041 - DNA, 1296 bp, Artificial Sequence
  Description of Artificial Sequence: Synthetic coding sequence
atgacagtgaaaactgaagcggccaagggcacactgacttacagccgcatgcggggtatggtggcgatcctcattgcattcatgaaacagagacgcatggggctgaacgactttattcagaaaattgcgaacaatagttacgcctgcaagcaccccgaagtccagagcattctcaagattagccagccacaagagcctgagctcatgaacgcaaacccttcgccccctcctagtccaagtcagcagattaacttgggcccatcctcaaatccccatgccaaaccttcagattttcacttcttaaaagtgatcgggaaaggcagctttggaaaagtgctgctagcacgacacaaagccgaggaggtgttctatgcggtgaaggtccttcagaagaaagcaatcttgaagaaaaaggaagagaagcacattatgtcagaacgcaatgtactcctcaaaaacgtgaagcacccttttctagtgggcctgcattttagttttcagaccgccgacaaactttactttgtactcgactatatcaacggcggggagctgttttatcacctccagagagaacggtgcttcctggagccgcgggctcggttctacgccgctgagatcgcgtcggccctaggctaccttcactccttaaacatagtgtatagggatctgaagccggagaatatccttctggactcccaagggcacatcgtgctgacagattttggcctctgcaaagaaaacatcgagcataattcaactacctcgacattttgcggaactcctgaatacctggcacctgaggtgctccacaagcagccttatgacaggaccgtggattggtggtgcctcggtgccgtgctgtatgaaatgctgtacggactgccccccttctacagtcgcaacacagccgagatgtacgacaatattctcaataagccactgcagctgaagccaaacatcacaaatagcgctagacatctgctcgaaggactgcttcaaaaagaccgaacaaagcgactgggcgccaaggacgacttcatggagatcaaatctcatgtctttttttccctgataaactgggacgacttgataaataaaaagatcacgccacccttcaatccaaatgttagcggtcccaacgacttgcggcattttgatcctgagttcaccgaggaacccgtaccaaacagtattggaaaatcacccgacagtgtgctggtgactgcctcagttaaagaagctgccgaggcattcctgggcttctcttacgccccacccactgactcctttctgtag

SEQ ID NO: 134042 - DNA, 1266 bp, Artificial Sequence
  Description of Artificial Sequence: Synthetic coding sequence
atgaaacccagcaaaagattttttatctcaccccccagcagcacggcctttatgaaacagagaaggatgggactgaatgattttatccagaagatagctaataacagctatgcttgcaagcacccagaggtccaaagcatcctcaaaatatctcagcctcaagagcccgagctgatgaacgccaacccatcacctccacctagtccatcccagcagatcaatctcggaccttctagcaaccctcacgctaagccttccgattttcatttcttgaaggtcataggtaagggttcatttggaaaagtgctccttgcacgccacaaggccgaggaggtgttctacgccgtgaaagttctgcagaaaaaggcgattttaaagaagaaggaagagaagcacatcatgtcagaacgcaatgtcttgctaaagaacgtgaagcatccttttcttgtcggcctgcacttcagctttcagacagcagacaaattgtacttcgtactggattacatcaatggtggcgaattgttctaccacttacagcgggagcggtgtttcctggagccaagggccagattttacgcagcggaaatcgccagcgccttggggtacctccacagcctaaatatcgtatatcgcgatcttaagcctgagaatatcctcctggattcacagggacacatcgtgctgacggacttcggactatgtaaggaaaacatagaacacaattcgaccacatccacattctgtggcacacctgagtacctggcgcctgaagtcttacacaagcagccatatgatcggacagtggattggtggtgcttgggggcggtcctgtatgagatgttatatggattgcccccgttctactcccgtaacacagccgagatgtatgacaatattctgaataagcctctccaactcaagcccaatatcacaaacagcgctaggcatttacttgagggcctgttgcagaaagatagaactaaacggctcggagcgaaggacgactttatggagatcaagagtcacgtgtttttctctctcatcaactgggatgatttgataaataagaagattacccccccattcaacccaaacgtaagcgggcccaatgatctgaggcacttcgatcccgaattcacagaggagccagtgcctaactcgatcggtaaaagcccagacagcgtgctggtcactgcaagtgtgaaggaggccgctgaggcatttcttggattcagctacgcacccccaactgactcctttctttag

SEQ ID NO: 134043 - DNA, 1581 bp, Artificial Sequence
  Description of Artificial Sequence: Synthetic coding sequence
atggttaacaaggacatgaacggttttcccgtcaaaaagtgttctgcatttcagtttttcaagaagcgggtgaggaggtggatcaagtcgcccatggtgagcgtggacaaacatcaatctccaagcctgaaatacaccgggagctccatggtgcacattccgccaggcgaacctgacttcgagagttccttatgccagacctgtctgggcgaacatgctttccagagaggggttctgccccaggagaacgagtcttgttcttgggagacacagtccggctgtgaggtgagggaaccgtgtaatcacgccaatatcctaactaagccagatccaaggaccttttggacaaacgacgatcccgcctttatgaagcaaagacgcatgggtttgaatgattttattcagaagatcgcgaacaattcatatgcttgtaagcaccccgaagtgcagagcattcttaaaatcagtcagccgcaggagccggagctgatgaacgccaatccatcacccccgcctagtccttcccagcagatcaatttgggcccgtctagcaatcctcacgctaagccttcggactttcacttcctgaaagttatcggcaagggcagctttggcaaggttctcttagcacggcacaaagccgaggaggtcttctacgccgtgaaagtcctacagaagaaggctatactcaagaagaaagaggaaaagcatattatgagtgagagaaacgtgctcctcaaaaacgtgaagcaccccttcctggtagggctgcacttttccttccagacagcggacaagctctactttgtgcttgactatatcaacgggggagagcttttttaccacctacagagagagagatgctttctcgagccccgcgcccggttttacgctgccgagatcgccagtgctttgggctatctccactccctcaatattgtataccgggatctgaaaccagagaatatcctgctggattcccaaggccatatcgtactcactgatttcggattgtgcaaggagaacattgagcataacagcacaaccagcaccttttgcgggacgcctgaatatctcgctcctgaagtgctccataagcagccctatgacagaacggtggactggtggtgtctcggagccgttttgtatgaaatgctctatggactgcccccgttctatagccgcaacacagccgaaatgtacgacaacatcctgaataaaccgcttcaactgaagcctaatattactaactctgcccgacacttgctcgaaggtctcctccaaaaggaccggactaagcgactgggcgctaaagacgatttcatggagattaagagtcatgtcttcttctccctaattaattgggacgatctgatcaataagaaaattacccccccctttaaccccaacgtctccggccccaacgatctccgtcactttgatcctgaattcactgaggagcctgtacctaatagcatcggcaaaagcccagatagcgtcctggtcaccgcctccgtcaaggaggcagcagaagccttcctcggtttctcttacgcgccacccacggactccttcctttag

SEQ ID NO: 134044 - DNA, 1338 bp, Artificial Sequence
  Description of Artificial Sequence: Synthetic coding sequence
atgggcgagatgcagggtgcattggcaagagctcggcttgaaagcttgctccggcctagacacaagaaaagagctgaggcccaaaaacgttctgagtcatttctgctatctggactcgcgtttatgaagcagagacggatggggctcaacgactttatccagaaaattgctaacaattcttatgcctgcaaacatcccgaggtgcagagcatcctgaaaatttcacagccccaggagcctgagctgatgaacgcgaacccctcaccacccccttcgccctcacaacagatcaatctggggccctcctcaaatcctcacgctaagccctccgattttcattttctaaaggtgatcggaaaggggagtttcggaaaggtgcttctcgcgagacacaaggccgaggaggtcttctacgctgtgaaagtgctgcagaagaaagccatactaaagaagaaggaggagaaacatattatgtctgagcgcaacgttctcctgaaaaatgtgaaacacccatttctcgttggcctgcacttcagtttccagacagcggacaagctgtattttgtgcttgattacatcaacggaggcgagctgttctaccacttgcaacgtgagcggtgttttctggagccaagggcaaggttttacgccgccgagatcgccagtgccctcggctacctgcactctctcaatattgtgtaccgcgacctgaaacccgaaaatattttgctggatagccaggggcatattgtactgactgatttcgggctctgcaaggaaaatatcgaacacaattccacgacatcaaccttctgtggtacgcctgaatacttggctcccgaggtgctgcacaagcagccttacgatcgaaccgtagattggtggtgtctcggtgccgtgctgtacgaaatgctgtatggtctgccccccttttacagtcgcaatactgctgaaatgtatgacaacattctaaataagccccttcagttaaaacctaatattactaatagcgcaaggcatcttctggaaggcctgctgcaaaaggatagaaccaagagactgggcgcaaaggatgactttatggaaattaaatcccatgtctttttttccctcattaattgggacgacttgataaacaaaaagataactcccccatttaaccccaacgtctctggccctaatgacctgcggcatttcgatcctgaatttactgaggaaccagtccccaattctattgggaagtccccagatagcgtgctcgtaaccgctagcgtcaaggaggccgccgaggccttcttaggattttcgtacgctccaccaacggactccttcctgtag

SEQ ID NO: 134045 - DNA, 435 bp, Artificial Sequence
  Description of Artificial Sequence: Synthetic coding sequence
atggtgtccgtggacaagcatcagtccccctctctcaaatacacaggatcaagtatggttcatattccccccggggaacccgatttcgaatccagcctatgtcagacttgcttgggagaacacgcctttcagcggggcgtactcccacaagagaacgaatcatgttcgtgggaaactcagtcggggtgcgaggtccgggagccttgtaaccacgcaaatattcttactaaacccgacccacgaacattctggacaaacgacgaccctgcttttatgaaacaaagaagaatgggactaaacgactttatccaaaaaattgccaataactcctacgcctgtaagcacccggaggtccagtccatcttaaagatcagccagcctcaagaacccgagcttatgaatgctaatccttcgcccccccccagcccgagttag

SEQ ID NO: 134046 - DNA, 1380 bp, Artificial Sequence
  Description of Artificial Sequence: Synthetic coding sequence
atgtcctctcagtcaagttcgctgtctgaggcttgctcccgcgaggcctacagttcccataactgggctttgcccccagctagccgctcgaatccacaacccgcctacccatgggccacaaggagaatgaaagaggaagcgataaagccacccctcaaggcgtttatgaaacagagacgaatggggctgaatgattttattcagaaaatcgccaacaatagttacgcttgtaagcaccccgaggtgcagtcgattttgaagattagccagccccaggagcctgagctcatgaacgcaaacccttcgccccctccttcgccttctcagcagatcaacctaggaccatctagtaacccgcatgcaaaacccagtgacttccatttcctcaaagtgattgggaagggaagcttcggcaaagtgctactggctagacataaggccgaggaggtcttttacgccgtcaaagttctgcagaagaaagccatcctaaagaaaaaggaggagaagcacatcatgagcgagaggaacgttctcctgaagaacgtgaaacacccgtttttggtgggcttgcacttttcattccagactgctgacaaactgtattttgtccttgattacattaatggcggcgaattgttctatcatttacaacgagagagatgtttcctggaaccacgagctcggttctacgcggctgagatcgcctctgcgctaggataccttcatagtttgaacatcgtatatagggatctgaagcccgagaatatcttgctggattctcagggtcacatcgtgctgacagactttggtctttgtaaggaaaatatcgaacataactctactaccagcaccttctgcggtacccctgaatatttggcccccgaggtgcttcacaagcagccctatgacaggacggtcgactggtggtgcctgggagccgtgctttacgaaatgctctacggtctgccccccttttacagcagaaacaccgccgagatgtatgacaacatccttaacaaacccctgcagctaaagcccaacattaccaattccgcaaggcacctgttagaaggacttctccaaaaagacagaacaaaaaggctgggggctaaagatgactttatggaaatcaaatcacacgtgtttttttcgctaattaactgggacgacctgattaataagaagatcacacctccttttaacccgaatgtctcggggcctaatgatcttcgacactttgaccccgagttcactgaggagccagtgcccaattccattggaaaatctcccgatagcgtgctggtgacagcttctgttaaagaggcagctgaggcatttcttggtttctcttacgcgcctcctacagattcatttctttag

SEQ ID NO: 134047 - DNA, 183 bp, Artificial Sequence
  Description of Artificial Sequence: Synthetic coding sequence
atggtgaataaggatatgaacggcttcccagtcaagaagtgcagcgcctttcagttcttcaaaaagcgggtaagacgctggatcaagtcccctatggtatcagttgataagcaccagagtccttcactgaagtacaccgggtcatctatggtccacatcccacctggggagccagatttctag

SEQ ID NO: 134048 - DNA, 1284 bp, Artificial Sequence
  Description of Artificial Sequence: Synthetic coding sequence
atgcaaggcctacttacctccgggcgcaagccctcagggggagggagatgcacagggcgaggcggctggcgcggacagtggtgtctcaagccctggatgggaggcgcagacccacccaccccaaccctcagctgcctgctgctgcctgtcccccctgagcttccagaccactgttaccgcatgaacagtagccccgccggcactccctctccacagccatctagggccaacgggaacattaacttggggccaagtgccaaccccaatgctcagccaaccgatttcgatttcttgaaagtcattggaaagggcaattatggcaaagttctgctggcgaagcgaaagagcgatggggccttctatgcggtgaaagtcctgcagaaaaagagcatactgaagaaaaaagagcagtctcatatcatggccgagcggagtgtgctgctaaaaaacgtgagacacccttttctcgttggactcagatactcatttcaaacccccgagaagctgtattttgtgctggattacgtcaatgggggagagttgttctttcacttacagcgagagcgtcggttcttagaaccacgcgctcgattttacgcggcagaagttgcatcagcgattggctacttgcactccctgaatattatctatagggacctgaaacctgagaacatcctgctggattgccagggtcacgtggtcttaaccgacttcggcctctgtaaagagggcgttgaacctgaggatacaacctctacgttttgtggaactccggagtatcttgcgccagaggttttgaggaaagagccttacgaccgcgccgtggattggtggtgcctgggcgcagtgctgtatgagatgctgcatggtctaccaccgttctacagccaagacgtgagtcaaatgtacgaaaatatcctccatcagcccttacaaatccctggggggcgaactgtggccgcgtgcgatttgcttcagtctttactgcacaaagaccagcgccagcggctcgggtccaaagctgacttcctggaaatcaagaatcatgttttctttagccccattaactgggatgatctgtatcataagagattgacaccacccttcaaccccaatgtcacaggccctgccgatctgaaacacttcgaccctgagttcacacaggaagccgtctccaaatctataggttgcactcccgacaccgtcgcatcttctagcggagcctcctccgcttttcttgggttcagctatgcaccagaggacgatgatatactggactgctag

SEQ ID NO: 134049 - DNA, 1101 bp, Artificial Sequence
  Description of Artificial Sequence: Synthetic coding sequence
atgaattcatctcccgctggtacacccagtccacaaccttctcgggctaatggcaatataaacctggggccaagtgccaatccgaacgcgcagcctactgactttgacttcctgaaggttatcggtaaagggaactatggcaaagtgctgcttgctaagagaaagtcagacggcgcattctacgcagtgaaggtgttacagaaaaagagcatcctcaagaagaaagagagtcatatcatggctgagagatccgttctccttaagaatgtgcgacacccattcttagttggactgcgttactcatttcagacacctgagaagctatattttgtactagattatgtcaatggtggggagctgttttttcatctgcagagggagagacgatttctcgagcctagggccagattctacgctgccgaggtggcatctgctataggctatctgcatagcttaaatatcatctacagagatctgaagccagagaacatactgctggattgtcaggggcatgtggttttgactgacttcggcttatgcaaggagggagtagaaccagaagatacaacatccacattttgcgggactcccgagtatctggccccagaggtccttaggaaggagccatacgacagggctgtggactggtggtgcctgggggctgtgctttacgagatgttgcacggcctgcccccattttattcacaggatgtctcacaaatgtacgaaaatatcctgcatcagcctctgcagatacctggagggcggacagtggcggcctgcgatctcctacagagcctcctccacaaggatcagaggcaaaggttaggctcaaaagccgactttctcgagatcaagaatcacgtctttttttcacctatcaactgggacgacctataccacaaacgattaaccccccctttcaaccccaatgtgaccggacccgccgaccttaaacattttgatccggaatttactcaggaggcagtcagcaaaagcataggttgcacgccggacacagtggcatccagctcaggtgcctcttctgcgttcctcggcttctcttacgcccccgaggacgatgacattctggactgctag

SEQ ID NO: 134050 - DNA, 1104 bp, Artificial Sequence
  Description of Artificial Sequence: Synthetic coding sequence
atgaacagttctccggctgggacaccaagccctcagccaagccgggccaatggcaacattaacctcgggccctccgctaaccctaatgcacagccaacagatttcgactttctgaaggtcatcggaaaggggaactacggcaaggtcctcctcgccaagcgaaaatctgatggcgctttctacgccgtcaaagtgttacagaaaaaatctattctgaaaaagaaggaacaatctcacatcatggccgagagatccgtcctgctgaaaaacgtcaggcaccccttcctcgttggactcagatattcttttcagacaccagaaaaactgtactttgtgctggattacgtgaacggtggagaattgttttttcacctccagagggagcgcaggttccttgagcctcgtgcaagattctacgcggccgaggtagcatctgccattggatatctgcacagcctaaatattatctacagagatttgaagccggagaacattctcctcgattgccagggacatgtcgtgctgacagattttggtctgtgtaaagagggagtggagcctgaagacactacaagtaccttctgcggtaccccggagtacctggcaccggaagtcctgcgcaaagagccatacgaccgcgctgtggactggtggtgcttgggggccgtcctgtatgaaatgctgcatggattgcctcccttttacagccaggacgtctcacagatgtacgagaatattttgcaccaacctctacagatcccagggggccgaaccgtcgctgcatgcgacctgttgcagagtttgctgcataaggaccaacgacagcgcttgggatctaaagctgattttcttgagattaagaaccacgttttctttagcccgattaattgggatgacctgtaccataagaggctgacacccccattcaatcccaacgtcacaggccctgcagacttgaagcacttcgacccggagttcacacaagaagccgtgtctaaaagcatcggatgcacgcctgatactgtggcctctagttcaggggcctcttcggcctttctgggttttagctatgccccagaggacgacgatatccttgattgttag

SEQ ID NO: 134051 - DNA, 1104 bp, Artificial Sequence
  Description of Artificial Sequence: Synthetic coding sequence
atgaactcctcccccgctgggacgcctagcccccaacctagcagggccaacggaaacatcaacctaggccccagcgctaacccaaatgcccagccaactgacttcgatttcttaaaggtaattggaaagggtaactacggaaaggtgctcctcgccaaaagaaaatcagacggcgctttctatgctgtaaaagtgttacaaaaaaagtctatcctcaaaaaaaaagagcagtcccacatcatggctgagcggtcagtattactcaaaaacgtgaggcatccctttctcgtcgggttaaggtactcattccaaacccctgagaaactctattttgtgttggactatgtcaacggaggcgagttattcttccaccttcagcgggagaggaggtttttagaaccaagggctcgattctacgcggcagaggtggccagtgctatcggatacctgcattcgcttaacattatataccgggaccttaagcccgagaacatcctcctagactgccagggccacgtggtgctgaccgactttgggctgtgcaaagaaggcgtggaacccgaggatactacctccactttctgtggcacaccagagtatctcgcccccgaggtgttgagaaaagagccgtatgatcgtgctgtcgattggtggtgcctaggggctgtcctgtatgagatgttacacggtttaccaccgttctattctcaggacgtatcgcagatgtatgaaaacatcctgcatcagccgttgcaaatcccaggcgggcgaacggtggcagcatgcgacctgttgcagtcactactacacaaggatcaaagacagaggctcggaagcaaggcggattttctggaaataaagaatcatgtctttttcagccccataaactgggacgatttataccacaaaaggcttacgccaccttttaaccccaacgtgaccggccccgcagatctgaaacacttcgatccagagtttacccaggaggcggtcagtaaatctattgggtgcacgcctgacaccgttgcatcctccagcggggctagttctgcattcttggggttctcttatgcccctgaagatgatgacattttggattgttag

SEQ ID NO: 134052 - DNA, 597 bp, Artificial Sequence
  Description of Artificial Sequence: Synthetic coding sequence
atgaatagttctccagcgggcacaccctccccccagcctagtcgggctaacggcaacatcaatctggggccaagcgccaatccaaacgctcaacctactgacttcgacttcctcaaggttatcgggaagggcaactatggtaaagtcctgctcgccaaaaggaagagtgacggcgctttctacgccgtcaaagtgttacagaagaagagcattctgaagaaaaaagagtctcacatcatggccgaacggagtgtgctacttaaaaacgtgcggcaccccttcctggtcggtctcaggtactcctttcaaacgccagaaaagctttatttcgtcctcgattatgtgaatggcggagagctattctttcaccttcaacgcgaacgtaggttcctggaaccccgcgcccgcttttacgccgccgaagtagcgtccgccatcgggtaccttcacagtcttaacatcatctatagggacttgaaacctgagaatatcttgctggattgtcaggggcacgtcgtgctgacagattttggcctgtgcaaggaaggcgtggaacctgaggataccacctccacattttgtggaaccccggagtag

SEQ ID NO: 134053 - DNA, 1104 bp, Artificial Sequence
  Description of Artificial Sequence: Synthetic coding sequence
atgaattcatcccccgccggaacaccaagtcctcagcctagtagagccaacggcaacatcaatctgggcccgtcagcgaatccgaacgcccagcctacagattttgacttccttaaagtcattggcaaaggaaattatggtaaggtgttgctggcaaagagaaagagcgacggcgcattctacgctgtgaaagtcctgcagaagaagagtatcctgaagaagaaagagcagagccacatcatggccgagcggagcgttctgctaaagaacgttcggcaccctttcttggtgggccttcgctatagttttcaaactccggagaaattgtactttgtacttgactatgttaacggaggggagctcttcttccatctgcagcgcgaaagacgcttcctggaacccagggcccggttttatgccgctgaggttgcttccgctatcgggtacctgcacagtctcaatataatttaccgggatctgaaaccagaaaacatattactggattgccaaggccatgtggtcctgaccgactttgggctgtgtaaagaaggagtggaacccgaggacacaacctctactttttgtggcactcccgaatacctggcccccgaggtactgaggaaggagccttatgaccgagccgtcgattggtggtgcttgggggcagtcctgtatgagatgctacacggactgcccccattctattcacaagatgtcagtcaaatgtatgaaaacatccttcatcaacccttgcagatccccggtggcaggacagtggcagcatgtgatttgctgcagtcactgttacacaaagatcaaagacagagactgggcagcaaggccgattttctggagattaaaaaccatgtatttttctctcctattaactgggacgatctctatcataagcgactgaccccgcctttcaatccgaatgtgacgggcccggccgatctcaagcacttcgatcccgaattcacacaggaggcagtctccaaatcaatcggatgcacacccgacaccgtcgcgtctagttcaggtgcaagctccgcttttctgggattctcatatgcacctgaggatgacgatatcctggattgttag

SEQ ID NO: 134054 - DNA, 1182 bp, Artificial Sequence
  Description of Artificial Sequence: Synthetic coding sequence
atgcaggggcttctaacttccggcaggaaaccctccgggggtgggaggtgtacagagctccccgatcattgctatcgcatgaatagctcaccagctggaactccttccccacagccgtccagagcaaatggcaatattaatttgggcccaagtgccaacccaaatgcacaaccaaccgacttcgattttctaaaggtgataggcaagggaaactatggcaaagtactcctcgctaagagaaaaagcgatggcgctttctatgcagtgaaggtgttgcagaagaagtctatcttgaaaaaaaaggagcagagccatatcatggcagaacgcagcgtcctgttgaaaaacgtgcgtcacccctttttggtgggacttcggtattctttccagacacctgagaaactgtatttcgttctcgactacgtgaacggcggggagctgtttttccacttgcagagggagagaagatttctggagccccgtgccagattctatgctgctgaggttgccagcgcaataggataccttcattcactcaacatcatttacagagacttgaaaccagagaatatactgctggattgtcaggggcacgtcgtgctgaccgactttggactgtgtaaggagggcgtggagcctgaggatactacaagcacattttgcggtacgcccgaatatctggcccctgaagtactgcggaaagaaccatacgaccgggcagtagattggtggtgtctaggagccgttctctacgagatgctgcatgggctgccacctttttactcccaggacgttagccagatgtacgagaacatcctgcatcaaccccttcaaatccccggaggacgtaccgtggccgcctgcgacttgctgcagagtctgctacataaggaccagaggcagcggctcggtagcaaagccgacttccttgagatcaaaaatcacgtgtttttctccccaatcaattgggacgacctttaccataagcgattgacccccccattcaatccaaacgtgacagggcccgcggatttaaaacacttcgaccctgagttcacccaggaggcagtcagcaagagtattggttgcactcccgatacggtggcttcgtcaagtggagcatcatcggctttcctgggattttcttatgcgcctgaggatgacgatatccttgattgctag

SEQ ID NO: 134055 - DNA, 1491 bp, Artificial Sequence
  Description of Artificial Sequence: Synthetic coding sequence
atgcagagggatcatacgatggactataaagaatcctgtccctcagtgagtatcccgagcagtgatgaacaccgggaaaaaaagaaacggttcaccgtgtataaggtgctcgtcagcgtgggccgctcggagtggtttgtcttcaggaggtacgctgaattcgataagctgtacaacacactgaagaagcagtttcctgcaatggccctgaagatccctgcaaaacgcatattcggggataatttcgatcctgatttcattaagcaacgccgggcaggcctgaatgagttcatacagaaccttgtaagatatcctgaactctataaccatcctgacgttagagccttcctgcagatggacagtcctaagcatcaatctgacccttcagaggatgaggatgagaggtccagtcagaaactgcattctacatcgcagaatattaacctaggtccatccggtaatcctcatgcaaaacctaccgactttgatttcctcaaagtgatcggtaaggggtcctttggcaaggtcttactggctaagagaaaattggatggaaaattctacgcggtgaaggtgctgcagaaaaaaattgtgcttaacaggaaggaacagaaacatattatggccgagaggaatgtgttgctgaagaatgtgaaacaccctttccttgtgggcctgcattattccttccagactactgaaaagttatacttcgttctagactttgttaatgggggagaactctttttccatctccagagagagagaagtttccccgaacaccgcgcgaggttttacgctgccgagatcgcctctgccctcggatacttgcactcaattaaaatcgtgtatcgagatctgaaaccagaaaatattctgctggactcggtggggcacgtagttctaaccgattttggcttatgcaaggagggcatcgccatcagcgacaccactactaccttctgcggaaccccagagtatctcgctccagaggtgatccgcaagcaaccttacgataacacggtggattggtggtgtctcggtgctgtgctgtacgaaatgttatatggtctgccccctttttattgccgtgatgtggcagagatgtatgataatatactccacaaacctctgtccttacgacccggggtctccttaacggcgtggtcgattctggaggagctgttggagaaggataggcaaaatcgtttgggcgccaaggaggatttcctcgagattcagaaccaccctttttttgagtccctgtcttgggcggatctcgtccagaaaaaaattccgcctccttttaaccccaacgtcgcgggcccggacgacatcagaaattttgacaccgcattcaccgaggaaaccgtaccgtacagtgtctgcgtgagtagcgattacagcatcgtcaatgcctccgtgctggaggctgatgatgcttttgtggggttttcatacgcccccccttcggaagatcttttcctctag

SEQ ID NO: 134056 - DNA, 1491 bp, Artificial Sequence
  Description of Artificial Sequence: Synthetic coding sequence
atgcagagggatcacacaatggattataaggaatcatgtccttcagtcagcatcccgtcttcagacgaacatagggagaagaagaagcgcttcactgtttataaggttctggtttccgtcggaaggtcagagtggttcgttttccggaggtacgctgagttcgataagttatacaacacactgaaaaagcaatttcccgccatggccctgaaaattcctgcaaaacgtatctttggcgacaacttcgacccagatttcatcaagcagagacgggcaggtctaaacgaattcatccagaacttagtacggtatcctgagttgtacaaccacccggacgtcagggccttcctgcagatggactccccgaaacaccaatctgatccgagcgaagacgaagacgagagatcatctcagaaactccacagcacttcgcagaacattaaccttggaccttctggaaacccacacgctaagccgacagacttcgattttctgaaagttatcgggaaaggctcctttggaaaagtgctgctcgctaaacggaaactcgatgggaagttctacgctgtcaaggtcctccagaagaagatcgtgttaaatcggaaggagcagaaacatataatggccgagaggaacgttcttctgaaaaacgtgaaacatccctttttggtgggcctgcactattcatttcagacgaccgaaaaactctacttcgttctggactttgttaacggtggtgagcttttcttccacctgcagagggaaagaagcttccccgaacaccgcgctaggttctatgcggcagaaattgcttctgccttgggataccttcattccattaaaatcgtctatcgggacctgaagccagagaatatcctgttagactcagttgggcacgtcgtgcttacagatttcggtctgtgcaaggagggtatcgcaatctccgacacaaccaccacattttgcggcacccctgagtacctggcacctgaggtaatcaggaaacagccctatgacaacacggtcgactggtggtgtctgggggcagtcctgtatgagatgctttacggcttaccaccattctactgcagagacgtggccgagatgtacgataacatcttgcacaaaccactgagtctgaggcctggtgtgtcgctcacagcctggtccatcctagaagagctgcttgagaaggatcggcaaaaccggctgggagctaaagaagattttctagagatccagaaccatcccttttttgagtcattgtcatgggccgaccttgttcagaagaagatccctccgcctttcaatcctaatgtagcaggccctgacgatatccgcaacttcgacaccgcctttacggaagaaacggtgccctacagcgtctgcgtttcttcagactatagcatagtgaacgccagcgtactcgaggctgatgatgccttcgttggattttcctatgctccaccttccgaagatctgttcctttag

SEQ ID NO: 134057 - DNA, 1491 bp, Artificial Sequence
  Description of Artificial Sequence: Synthetic coding sequence
atgcaaagggatcatacaatggactacaaagagtcgtgccccagtgtctcaattccaagcagcgatgagcacagagagaagaagaaacgtttcactgtatacaaagtgctcgtatcagttggcagaagtgagtggtttgtgtttaggcgctacgcggagttcgataaattatacaacacactcaaaaagcagttccccgcgatggccctgaaaatccctgccaagagaattttcggagacaattttgatcccgacttcatcaagcagaggagggctgggctgaatgaatttatccagaacctggtcagatatcctgagttatacaaccatccagacgtgagagccttccttcagatggactcaccaaagcatcaaagcgacccttccgaggatgaagatgaacgcagcagccagaagctccacagtaccagccagaatattaatctcggcccgagcggaaatcctcacgctaagcccacagacttcgatttcctcaaggttatcggcaaggggagcttcggcaaggtattgttagcgaagagaaagctggacgggaagttttacgcagtcaaggtgctacagaagaagattgtcctgaacaggaaggaacagaagcacattatggccgaaagaaacgtgctgctgaaaaacgtgaagcatcctttcctggtaggccttcattatagtttccaaacaacggagaagttgtatttcgtactggattttgtaaatgggggagagttattctttcacttacagagagaacggtctttccccgagcatcgcgcccgtttttatgctgcggagattgcaagtgctcttgggtacctgcattccatcaaaattgtatacagggacctaaaaccagagaatattctgctggactcagttggccacgtggtgttgacagacttcgggctgtgtaaagagggcatcgccatatccgacaccaccaccacattttgtggcacgccagagtacctagctccggaggtgatacggaagcagccatatgataacacagtagattggtggtgcttaggcgctgtgctgtatgaaatgctctacggcctcccccctttctactgtcgggatgtggctgaaatgtatgacaatatcctgcataaacctctgtccctcagaccaggggtgagccttactgcttggtcaatactcgaggagctactggagaaagaccgacaaaatagattgggggccaaggaggattttctggaaatccaaaaccacccattcttcgaaagtctctcatgggctgatttggtgcagaagaagattccaccccctttcaatcccaatgtcgccggcccagacgacatcagaaacttcgacaccgcatttaccgaggagacagtgccgtacagtgtgtgtgtgtcctccgactactcaatagtgaacgcctcggtactggaagccgatgatgctttcgtcggattctcttatgcccctccaagtgaggatctctttctttag

SEQ ID NO: 134058 - DNA, 1491 bp, Artificial Sequence
  Description of Artificial Sequence: Synthetic coding sequence
atgcagcgggatcacacaatggactataaggagtcctgccctagcgtgtccatcccctccagcgacgagcaccgggaaaaaaagaagcgctttacggtatataaggtcctagtgtctgtcgggcgcagtgagtggttcgttttcagaagatatgctgaattcgacaagctgtacaacactctgaagaaacaatttcccgcaatggctcttaaaatccccgctaagagaatctttggcgataacttcgatcccgacttcatcaaacaacggcgcgccggtcttaacgagtttattcaaaatttagttaggtatcccgagctgtacaatcacccagatgttagggctttcctccagatggattcccccaagcatcaaagtgaccctagtgaggatgaggatgagcgaagctcgcagaaactgcactccacgagccaaaacatcaacctgggcccctcaggaaacccacatgccaaacctaccgacttcgactttcttaaggtgataggaaaaggctcctttgggaaggtactcctggctaagcgcaagctcgatggcaagttctatgccgttaaggtgctccagaagaagatcgttttgaacaggaaggagcagaagcatatcatggcggagcgtaatgtcctgctgaagaatgtaaagcacccctttctcgtgggcttgcactactcattccaaaccaccgagaaactctatttcgtactggattttgtgaatgggggggagttattctttcacttgcagcgggagcgttcttttccggaacaccgggctagattttatgctgccgagatcgcttcggctctgggctacctgcactcaatcaagattgtctaccgcgatctgaaaccagaaaatatactattagatagcgtagggcacgttgttctcacagatttcggcctctgcaaagaaggaatcgctatctccgacaccaccaccacgttctgcgggaccccggagtatctggcccccgaggtgatccgtaaacagccttacgacaacacagttgattggtggtgcttgggtgcggtgctgtacgagatgctgtatgggcttccgccattctattgcagggatgtagcggaaatgtacgacaacattctgcataaaccactttcactcaggcctggcgtctccttgacagcctggtcgatcctggaggaactgttggaaaaagatcggcagaatcgactgggtgctaaagaagattttctggagatccaaaaccaccccttcttcgaatcattaagctgggcagacctcgtgcaaaagaagataccaccgccattcaatccaaatgttgccggccccgatgacatacggaatttcgataccgcattcacagaagagaccgtgccttacagtgtgtgcgtgtcttctgattactctatagtgaatgcttccgtcttggaggccgacgacgcttttgtgggattttcatacgccccgccaagcgaggacctcttcctctag

SEQ ID NO: 134059 - DNA, 1395 bp, Artificial Sequence
  Description of Artificial Sequence: Synthetic coding sequence
atgcagagagaccacaccatggattacaaagagtcctgcccctcagtgagcattcccagtagcgacgaacatagagaaaagaagaagaggtttacagtgtataaggtcttggtgtccgtcggtagatccgagtggttcgtgttcaggcggtatgccgaatttgataagctgtacaacactctgaagaaacagtttccagcgatggctctcaaaatacccgcgaagcgcatctttggcgataatttcgaccccgactttatcaagcaacggcgggcaggcctgaatgagttcatacagaatttggtgcgctatcctgagctttataatcatcctgacgtccgcgctttcctgcagatggactcaccaaagcaccagtctgatcctagcgaggatgaggatgagaggtcctcccaaaagctgcattctacatctcaaaacattaacttgggaccttccgggaatcctcacgccaagccaaccgattttgacttcctcaaagtgataggaaaagggtccttcgggaaggtgcttctggccaagcggaagttagacgggaagttctacgccgtgaaggtgttgcagaagaaaatcgttctcaaccggaaggagcagaagcacatcatggccgagagaaacgtgctgctgaagaatgtaaaacacccgtttctagtgggtctgcattattcattccagactacagaaaagctctacttcgtgttggattttgtgaacggcggcgagctgttctttcacctccaaagggagaggagtttccccgaacacagggcgaggttctatgctgccgagattgccagtgcgctgggttacctgcattctataaagattgtgtaccgcgatcttaagcctgagaacatcctgctggacagcgttggtcacgtagtgcttacagattttggactgtgtaaggaaggcatagcaatttcggatacaacaacaacattttgcggcacacccgagcctcctttctactgtagagacgtcgccgaaatgtacgataacattctgcacaaacccctgtccctcaggccaggagtctctttaaccgcttggtccatcctggaggagctgctggaaaaggatagacagaaccggctcggcgcgaaggaagacttcctagagatccagaatcatcccttttttgaatcactctcgtgggccgacctggtacagaagaaaatcccgccgccctttaaccctaacgtggcaggccccgacgacatccgcaatttcgataccgccttcacagaagaaacagtgccttattctgtgtgcgtgtcatctgactattctatcgtaaatgcatcggtgctagaggccgacgacgccttcgtgggcttcagctacgcccctccatcggaagacctgttcctgtag

SEQ ID NO: 134060 - DNA, 1491 bp, Artificial Sequence
  Description of Artificial Sequence: Synthetic coding sequence
atgcagagagaccacaccatggactataaggaatcttgccccagcgtctccatcccttcgtctgatgagcatagagaaaagaaaaagcgcttcactgtttacaaagtgctggtaagcgtgggccgctctgagtggttcgtatttaggagatatgccgaatttgataaactttataacactctgaagaaacagtttcctgccatggccctcaaaattccagcaaagcggatctttggcgataacttcgaccctgacttcattaagcagcgaagggctggcctgaacgagtttattcagaacttggtgcgctaccctgaactgtacaaccacccggatgtgcgcgcatttctccagatggactcccccaagcatcagagtgatccttccgaggatgaagatgagcgatctagccagaagctgcactcgacatcacagaacattaacctgggtccaagcgggaaccctcacgccaaacccaccgattttgatttcctgaaggttatcggcaaagggagtttcggcaaagtgttgctcgcgaaaagaaaactggacggtaaattctacgccgtgaaagtattgcagaaaaagatcgtcctgaaccgtaaggagcagaaacacattatggccgaaagaaacgtgttgcttaagaatgtgaaacatcccttcctggttggtctccactactcattccaaacaaccgagaagctatattttgtcttagactttgtcaacggcggtgagctctttttccatttgcagcgcgagcggtccttccctgagcacagggcccggttctacgccgcagaaatcgcaagtgcactgggctatttgcacagcatcaagatcgtctacagagacttgaagcctgaaaacatcttgttggatagcgtcgggcacgttgttctaaccgatttcggcctgtgcaaggaagggattgcaatctctgacaccaccacaaccttctgcgggactccggagtatttagcacctgaggtgatcagaaagcagccctacgacaatacagtggactggtggtgtcttggggccgtgctatacgagatgctgtatggcttaccccctttctactgccgggacgtcgcggagatgtacgataacatcctgcacaagcctctctcacttcgccccggagtctctctcaccgcgtggtcaatcctggaggagctgctggaaaaggacagacagaaccggctgggagccaaggaagacttcctggagatccaaaaccacccattctttgagtctcttagctgggctgatctggtgcaaaagaagataccaccgccctttaatcccaacgtagccgggccggacgatatcaggaactttgacaccgccttcacagaggaaacagtgccttatagtgtgtgtgtctcatcagactatagcatcgttaacgcgtccgtgctggaagccgatgacgcctttgtggggttttcatatgcacccccctccgaagatctctttctgtag

SEQ ID NO: 134061 - DNA, 1491 bp, Artificial Sequence
  Description of Artificial Sequence: Synthetic coding sequence
atgcagcgggatcatacaatggactataaagaaagctgtccaagcgtgtcaataccgtcctcagatgagcaccgggagaagaagaagcgatttaccgtgtataaggttttagtctccgtcgggagatcggaatggttcgtgttcaggcggtatgccgagtttgacaaattgtataacacacttaagaaacagtttcccgctatggcattaaaaattccagccaagaggatctttggagataatttcgatcctgattttataaaacaacgcagggcagggctgaacgagtttattcagaatctggttaggtatccggaactctacaatcatccggatgtcagggcctttctccagatggacagccccaaacaccagtctgatcctagcgaagatgaggacgaaagatcctcccagaaactacacagcacaagccagaacattaatcttggccccagcggaaatccacacgccaagccaaccgattttgattttctgaaggttataggtaaaggctctttcggaaaggtgttgcttgctaaacgcaagcttgatggcaagttttatgctgtcaaggtgctccaaaagaagattgtattaaatcgcaaggagcagaaacatattatggcagaaaggaatgttctattaaagaacgtaaagcacccattcctcgtgggactgcactactccttccagaccaccgaaaaactttacttcgtactcgacttcgtcaacggtggtgagctgtttttccacttgcaaagagagcggagctttcccgaacaccgagcccggttctacgccgctgaaatcgcaagtgccctggggtacctgcactcaatcaagattgtctacagagacttgaagcccgagaatatcctgctggatagcgtggggcacgtcgtcctgactgactttggtctctgcaaagagggcatcgccatctccgacactaccacgaccttttgtgggaccccagagtatcttgcgccagaggtgattcgaaagcaaccctacgacaacacagtcgattggtggtgtctcggagccgtactgtatgagatgctgtatggtctgcctcctttctactgcagggacgtggcagagatgtatgataacatcctgcataagcctctgagtctgagaccaggggtttccctgaccgcgtggtccatactggaggagctattggaaaaagacaggcagaacagacttggagccaaggaggactttctcgaaatccagaatcacccattcttcgagtccctgtcatgggcagacctcgtgcagaagaaaattccccccccttttaatccgaatgtcgctggtcctgacgatattcggaacttcgacacagcattcacggaggaaacagttccctactccgtctgcgtgtcgtccgactacagcattgtcaatgcttccgtactggaagccgatgacgcgtttgtcggattcagctatgcgcccccgagcgaggatcttttcctgtag

SEQ ID NO: 134062 - DNA, 1725 bp, Artificial Sequence
  Description of Artificial Sequence: Synthetic coding sequence
atggaggccagtctggggatacagatggacgaacctatggccttctccccacaacgcgatagattccaagccgaagggtctctgaaaaagaatgagcagaacttcaaattagccggcgtgaaaaaagatattgagaagctatatgaggcggtcccacagctctccaacgtgttcaaaatagaggataaaatcggcgaggggacattctcaagtgtctatctggccacagcacagcttcaggtcggtcccgaggagaagatcgccctgaagcacctgatccctacatcgcatccgatccgtatagcagcggagttgcagtgcctgaccgtggccggcggtcaagataatgtcatgggtgtgaagtactgctttcgcaagaatgaccacgtggtcatagcaatgccttatttggagcatgaatcttttctggacattttaaactctctgagcttccaggaggtcagagaatacatgttaaacctttttaaagcactgaagaggatccaccagttcggaatagtgcaccgggacgtgaagccctcgaacttcttgtataaccgccgactgaagaaatacgccctggtagactttggcttggcccagggaacccatgatactaaaatcgaactcctgaaatttgtgcagtctgaagcccagcaggaacgatgctcccagaacaagagccacatcattactggtaataaaatccccttgagtggccccgtgccaaaagagctcgatcaacaaagcactactaaagccagtgtgaagcggccgtataccaatgcccagattcagatcaagcagggtaaagacggaaaagagggatctgtagggttatcagtgcaacgatccgtgttcggtgagcgtaatttcaatatccatagcagtatctcccacgagtccccagctgtgaagctgatgaagcagtctaagactgtagacgtgctgtccagaaagctggcgaccaagaaaaaagctatctctacaaaagtaatgaactctgccgtgatgcggaaaacagcctcctcttgccccgcgtcacttacatgcgactgttacgccacggataaggtttgctctatttgcttgtctcgacgtcagcaggtggcgcctcgggcagggacaccgggttttcgggccccagaagtcctgactaagtgtccaaatcagacgaccgcaatcgatatgtggtctgccggggtaatctttctgagcctgctgtctgggcggtaccctttctataaggcaagtgatgacctgactgcccttgcccaaatcatgactatccgcggctctcgtgaaaccatccaggcagccaagacttttggtaagtcgatcctctgcagcaaggaggtgccagcccaagacctccgcaaactgtgcgagcgcctgcgaggcatggacagcagtactcccaaactgacctctgatattcaaggacacgcctcacatcagccagcgatttctgagaaaactgatcacaaagcgagttgtctggtgcaaaccccgcctggtcagtattcaggaaatagcttcaagaaaggagatagcaattcttgtgaacattgctttgatgaatacaatactaacctcgaaggatggaacgaagtacccgacgaagcgtatgacttgcttgataagctgctggatctgaaccctgcttctcgcatcaccgccgaggaagccctgctgcatccgttttttaaggatatgagcttatag

SEQ ID NO: 134063 - DNA, 1611 bp, Artificial Sequence
  Description of Artificial Sequence: Synthetic coding sequence
atggtactggacctcgatctgttccgagtagataagggcggagatcctgccctgatccgtgaaacacaggaaaagaggtttaaggacccggggctcgtcgatcagctggtgaaggcagactccgaatggagacgttgtcggtttcgcgcagataatctgaataagctgaaaaatctttgttccaaaacaattggggagaagatgaagaaaaaggagccagtcggagatgacgagagtgtgcctgaaaatgtactctcatttgacgacctgactgccgatgcactcgccaacctgaaggtttcccagataaaaaaggtccggctgctcattgacgaggctatactgaaatgtgacgcggaacggatcaagctagaggctgaacgctttgagaacctcagagaaatcgggaaccttctgcacccatcagttcctatcagtaatgacgaagacgtagacaataaggtcgagcgtatctggggggactgcaccgtccggaagaagtacagtcacgtggacctcgtggtgatggtagatgggtttgaaggcgaaaagggcgccgtcgtagcgggatcaagaggctattttctgaagggagtacttgtgttcctggagcaggccctgattcagtatgccctaagaacactggggagccgcggctatattcccatttacactccattttttatgcggaaagaggtgatgcaagaggttgctcagctgagccagtttgacgaagaattatacaaggttattggcaaagggagcgaaaagtcggacgataactcatacgacgagaaatatctaattgctacttccgagcagccgatcgcggccctgcacagagatgagtggctcagaccggaggacctgccaattaaatacgcaggtctgagcacctgcttccgtcaggaggtcggctctcatgggagggatactcgggggatcttccgcgtacaccagttcgaaaagatcgaacaatttgtttactctagcccccacgataacaaaagttgggagatgttcgaagaaatgatcaccactgcggaggagttttatcagagcctcggaatcccctatcatatcgtcaatatcgtgtctgggagcctgaatcacgcagcatctaaaaaattggacctcgaggcctggttcccggggagcggcgcgttccgagaactcgtttcttgttccaattgcaccgattatcaggcccgccgcctgcgtatccgctacggacagactaaaaaaatgatggataaacgcaaaaacaacctccacctgagcacacagaacaagctcgaggcctccctgttcagtccaaagaaagtggagttcgtgcatatgcttaacgcaacaatgtgtgctacaactagaaccatttgtgcgattctggagaactatcaaaccgaaaagggaataaccgtgccagagaagctaaaggaatttatgccgccaggcctccaggagctcattcccttcgttaaacctgcccccatcgagcaggagccatcgaagaagcaaaagaagcaacacgaaggatctaaaaagaaggctgccgccagggatgtgactctggagaatcgccttcaaaatatggaagttaccgatgcctag

SEQ ID NO: 134064 - DNA, 1563 bp, Artificial Sequence
  Description of Artificial Sequence: Synthetic coding sequence
atggctgctagcatggccagacgtctctggcccctgctcacgagaaggggtttccgacctaggggcggctgtatctcgaatgactcccctcgccggtcctttacaaccgaaaaacgaaaccgaaacctgctgtacgagtatgctcgagagggatattctgccttgcctcaattagatatcgaacggttctgtgcctgccctgaagaagccgcccacgccttggagttgaggaagggtgagctgcggagtgccgacttgcccgccataatctcgacctggcaagagctcagacagctccaggaacagatccgttcgctcgaagaggagaaagctgcagtgacggaagccgttcgggcacttctagcaaatcaagacagtggggaagtgcaacaggtgcggctggatcccggtgctggctccattttcggcccaaccttcctcccatttcccgggcagctatcccttctggtggaggcccagctggaagagcagttctacctgcaggccctgaaactacccaaccaaacacacccggatgtgccagtgggggatgagtcacaggcccgggtgctgcacatggtaggcgacaagcccgtctttagcttccaaccgagaggccacttggaaatcggcgaaaagctcgacatcatcaggcagaagaggctgtctcacgtctccggccatcgtagctactacctcaggggggcaggcgctctcctccagcatggactcgttaatttcacgtttaacaagctcctgagaaggggattcacccctatgactgtgcccgaccttctgaggggggcggtcttcgaaggttgcggaatgactcctaacgctaaccccagtcagatttataacatcgaccccgctcgatttaaggatctgaacctggcaggtacagctgaggtgggactagccgggtacttcatggaccataccgtggcatttcgggacctgccggttcgcatggtgtgtagcagcacctgctatagagctgagaccaatacaggtcaggaaccccggggactgtatcgagttcaccatttcacaaaggtcgaaatgttcggcgttacaggacctggcttggaacagtcctcacagcttctcgaggaattcctatccctacaaatggaaatcctgaccgagctggggctgcacttccgggtgctcgacatgccaactcaggagttaggcttgcccgcatatcgtaagtttgatatcgaggcctggatgcctggccgcggtaggttcggcgaggtgacctccgcgtcaaactgtactgattttcaaagcagaagactccatatcatgttccagactgaggcaggggagctccagtttgcccatacagtgaatgctacagcatgtgccgtccctaggctgcttatcgctctgctggaatctaatcagcagaaagacggatctgtgcttgtgcccccagcactgcagagctacctgggcaccgaccggatcactgccccaacccatgtcccattacagtacattggtccgaaccagcccagaaagcccgggctacccggccagcctgccgtgtcttag

SEQ ID NO: 134065 - DNA, 426 bp, Artificial Sequence
  Description of Artificial Sequence: Synthetic coding sequence
atggagatgctacagggcctgctcctcttgttgttactctctatgggtggggcgtgggcatctagagagccactgcgtccttggtgtcatcccatcaacgcaattctggcagtggaaaaagaaggatgcccggtgtgtattacagtgaacactaccatttgcgctggctactgccctaccatgatgagagtgttacaggccgttctgccacctttgcctcaggtggtgtgtacctatagggacgtaaggttcgaatccatccgcctgcctggctgcccccgaggggtggaccctgtggtgagtttccccgtggctctctcatgtaggtgcggaccctgtagacggtcaactagcgactgtggcggtcccaaggatcatcctctcacgtgtgaccacccccagctttccggactgctgtttctttag

SEQ ID NO: 134066 - DNA, 837 bp, Artificial Sequence
  Description of Artificial Sequence: Synthetic coding sequence
atgggggcccggctctcaagacggcgactgcctgccgatccttctctggcattagacgcacttccccctgagttacttgttcaggtcctctcccacgtacctccgagatctctcgtgactcggtgccgtccagtgtgcagagcatggcgcgatatagtggacggtcccacagtatggctgctgcagctggcacgcgaccgcagtgcagagggtagagctctttacgcggtcgcacagcggtgtctgccatctaacgaagataaggaggaattcccactgtgtgccctggccaggtattgtttgcgggctccattcggcagaaacctaatttttaattcttgcggggaacaaggctttcgaggttgggaggtagagcacggggggaacggctgggccattgagaagaacttgacacccgttcctggcgccccctctcagacgtgctttgtcacctctttcgagtggtgctcgaaaaggcagttagtggatctcgtaatggagggggtttggcaggaacttcttgatagtgctcagattgagatctgcgtcgcggattggtggggcgcgcgcgagaactgcggatgtgtgtatcaactgagagtgcggctgctggacgtctatgaaaaggaagtcgtcaaattctcagccagtccagaccctgtgttacaatggacggaaagaggatgccgtcaggttagccacgtgtttaccaattttggaaaggggatacgttatgttagttttgaacaatatgggcgcgatgtctcttcctgggttgggcactatggcgcgttggtcacccattcgtcagtgagagtgcggattcggctgagttag

SEQ ID NO: 134067 - DNA, 864 bp, Artificial Sequence
  Description of Artificial Sequence: Synthetic coding sequence
ttcaagcaaggcctgtggctgctcgaaatgggagcccgactttctagaaggcgccttcctgccgacccaagccttgctctcgacgcacttcccccagagctgctagtccaggtcttgtctcatgtgccacctcggtcactggtgacaaggtgcaggcccgtctgccgagcctggcgggatattgtcgacggaccaaccgtatggctgctccaactggcccgcgatcgttcggcggaaggccgagcgttgtacgccgtggcacaaagatgtctgcctagcaatgaggacaaagaggaattccccttgtgcgctctggctcgttattgtctgagagcgcccttcggcaggaacctgatcttcaactcttgcggagaacagggttttaggggatgggaagtagagcacggaggcaatgggtgggccattgaaaagaatctcacccctgtgccaggcgccccttcccagacctgttttgtgacctcctttgaatggtgtagtaaacgccagctggtagacctcgtgatggagggcgtgtggcaggaactgctggatagcgctcagatcgaaatttgtgtggccgactggtggggagccagggagaactgcggatgtgtctatcagcttcgtgtgaggcttcttgacgtctacgaaaaagaggtggtgaagttctccgcatcacctgatccggtgttgcagtggacagagcgcggttgtaggcaggtgagccatgtgtttacaaactttgggaagggcatccggtacgtgagcttcgagcaatacggtcgagacgtctcttcttgggttgggcattacggcgccctggtgacccattcatccgtaagagtacgtatcagactgagctag

SEQ ID NO: 134068 - DNA, 1563 bp, Artificial Sequence
  Description of Artificial Sequence: Synthetic coding sequence
atggccgcatctatggcaaggcggctttggccactgctgacccggcgaggttttagacccaggggcggatgtatatccaacgatagcccacggagatccttcaccaccgagaagcgaaacaggaatctcctgtatgagtatgcgcgggaggggtactctgctctgccgcagctggacatcgagcgattctgtgcttgccccgaggaggccgcgcacgcattggagcttcgtaagggagagttacggagtgcagaccttcctgcaatcatcagcacgtggcaggagctaaggcagctccaagagcaaattcgcagtttagaggaagagaaagcagccgtgactgaggcagtgagggccctgctggctaatcaggattctggtgaagtgcaacaggtgaggctagaccctggtgcgggcagtatcttcggccctacttttctcccttttcccggacagctttccttgctggtcgaagcacagcttgaggagcagttctatctccaggcccttaaacttcctaatcaaacacacccagatgtccctgtgggagatgagtctcaggcccgagtgctgcacatggtgggcgataagcctgtgttctcctttcagccacgtggccatttagaaattggggaaaagctcgacattatccggcagaagcgactatctcatgttagtggacacagaagttattacctgcggggagccggcgctctgcttcagcacggcctcgtgaattttaccttcaacaagttgctgagaaggggattcaccccaatgactgtcccagacctgctgcgcggcgccgttttcgaagggtgcgggatgacgcctaacgctaaccccagccagatttataatatagatccagctcgtttcaaggacctcaatctagcaggtacagctgaggtgggtctcgccggctactttatggaccacacagtggcctttagggatttaccggtgcggatggtgtgttctagcacttgctaccgggccgagacgaatacaggccaggagccacggggcctctatcgggtgcaccattttactaaggtcgaaatgtttggtgtaacggggcccgggttagaacaatctagtcagctcctagaagagtttctgagtctgcagatggagattctgaccgaactgggtttgcattttcgcgtgttggacatgcctacccaggaattaggcctacccgcctataggaaattcgacatcgaagcttggatgccaggtagagggcgatttggagaagtgacctccgcatctaactgtaccgatttccaatccaggcgtctacacataatgtttcagacagaagcaggggaactgcagttcgctcatacagtgaatgctaccgcctgtgctgttcctcgtctccttatcgctctactggagtccaatcagcagaaggatggctctgtgctggtcccgcctgccttgcagtcctacttgggcacagaccgcattacagcccccactcacgtgccactgcagtacatcggtcctaaccaacccagaaagcccggcctccctggtcaacccgctgtgtcttag

SEQ ID NO: 134069 - DNA, 1557 bp, Artificial Sequence
  Description of Artificial Sequence: Synthetic coding sequence
atggaaggcgtctggcaggagttgctggactctgcccagatcgagatatgtgttgccgactggtggggtgctagggagaattgcggttgtgtctaccaactcagggtgcggcttctggatgtgtacgaaaaagaggtcgtcaaattcagtgcctctccagaccctgtgctccaatggactgaacgtggatgtaggcaggttagccatgtcttcacaaacttcggtaagggcatacgctacgtttccttcgaacaatatgggcgcgacatcagtacctggcaagagctgcgccagctccaggaacagattcggagcttggaggaggaaaaggcggccgtcaccgaggccgtgcgggcgttgctggcaaaccaagattctggggaagtgcagcaggaccccaagtatcagggtctgcgagcccgggggcgggagatccgcaaggagctggtgcacctctaccctagagaggcccagctcgaagagcagttctatctccaggctttgaaactccccaatcaaactcacccagacgtgcctgtgggagatgaatctcaggcgcgggtgctccatatggtcggcgacaaacccgtcttctccttccaaccgcgcggacacttggagatcggcgagaagttagacatcattcgccagaagcggctgtcccacgtgtcaggccatcgatcttattatcttcgtggggcaggcgcgctgctgcagcacggactggtgaacttcacgtttaataaattgctgcgccgcggtttcactccaatgacggtgccagacctgctaagaggagccgtatttgagggatgcggtatgacccccaacgctaatcctagccaaatttataatatcgaccctgcccgatttaaagacttaaacctagcaggcaccgcagaggtgggactcgcgggctattttatggaccacacggtggcattcagggatctcccagtgcgaatggtttgctcctccacctgttacagggcggaaactaacacggggcaggagccaaggggcctgtatcgagtacatcacttcacaaaggtggaaatgttcggagtcaccgggcccgggttagaacagagtagccagctactcgaagaattcctgtctcttcagatggagatcctcacggagctcggacttcactttagagtcctggatatgccgacccaagagctgggcctgcccgcgtacaggaaatttgacattgaggcctggatgccaggacgtggccgcttcggtgaggtgacatctgctagtaattgtaccgacttccagtcacgtcgactccacatcatgtttcagacggaggctggcgaacttcagtttgcacataccgtgaacgctactgcatgcgcagtgcccaggctcttgatcgcactactcgagagcaaccaacagaaagacgggtcagtcctcgtacccccggcgctgcagagctacttgggaacagataggatcacggccccaacacacgttccgctgcaatatattggcccaaaccaaccacggaagcccgggctacccgggcagccagccgtatcctag

SEQ ID NO: 134070 - DNA, 711 bp, Artificial Sequence
  Description of Artificial Sequence: Synthetic coding sequence
atggccgcatccatggcccggcggctgtggcccctgctgacacggcgtggatttcgccctaggggaggatgtatcagtaatgattcaccgaggaggtcattcaccaccgagaaacgaaacagaaacctgctatacgagtacgctagagaaggctatagcgcgctgccgcagttagacatcgaaagattttgcgcctgtcctgaggaggctgctcacgcacttgaactgcggaagggcgagttgagatcggctgaccttcctgctattatctcaacatggcaagagctccgtcaattgcaggagcagatccgcagccttgaagaggaaaaggctgcagttacagaagcggttagggccctcctggctaatcaggatagtggtgaggtccagcaggatccaaagtaccagggtcttagagcccggggccgggagattcgtaaggagctggtccatctttaccctcgcgaggctcagctggaagaacagttctaccttcaagccctcaagctgccaaaccagacccacccagatgtgcccgtgggagacgaatctcaagcgagagtcttgcatatggtaggtgacaagcctggggcgtgtcctacctgtctcgccaccggaccaataacctgcgccgggctggagccgagctgttctactgcctggtctacctctcactccacctcattcagtgccggggccagccctccatag

SEQ ID NO: 134071 - DNA, 1281 bp, Artificial Sequence
  Description of Artificial Sequence: Synthetic coding sequence
atgcatgctctcttcgcagactcatttgcagcgttaggcagattggataatatcacgttagtgatggtctttcacccacagtatctggaatcgttcctcaagacgcagcactacttgttacagatggatgggcccctccctctgcactacaggcattatatcggtatcatggctgcagcacgtcaccaatgttcctatctggtcaatctacacgtgaacgactttctacacgtgggcggagaccccaaatggcttaacgggctggagaatgcaccgcagaaactccagaatctcggggagttaaacaaggtgctggcccatcggccttggcttatcacaaaggagcatatcgaaggattgcttaaggcagaagaacacagctggtcactggccgagctagtccacgctgtcgtgttgctaacacattatcacagcttggcctccttcacctttggctgtggcatctccccagagatccattgcgatggggggcacacttttcggccacccagtgtttctaactactgcatttgtgacattacaaatgggaaccacagtgtcgacgaaatgcccgttaactctgccgagaatgtttctgtgagcgattctttcttcgaggttgaagccctgatggagaaaatgagacagttgcaagagtgccgcgatgaggaagaagccagccaagaagaaatggcctcccgatttgaaattgaaaaacgggagagcatgttcgtgttcagctcagacgacgaagaggtcacccccgcacgcgcggtcagccggcatttcgaggatactagttacggatacaaggacttttctagacacggaatgcatgtgccaaccttccgggttcaggactactgctgggaagatcatggctactctcttgtgaaccgcctgtaccccgacgtgggccaacttatcgacgagaagttccacatcgcctataacctgacctacaacacaatggcaatgcacaaggacgtcgacacatcaatgctcagacgcgccatatggaattacatacactgtatgtttggtattcggtatgatgactatgactatggggaaatcaaccagcttctggaccggtcttttaaagtgtacattaagacagtggtgtgcacccccgaaaaggtgactaaaaggatgtacgacagcttttggaggcagtttaagcactcagagaaggttcacgtcaatcttcttcttattgaagcgaggatgcaggccgagttgctttatgccctgcgggctattacaaggtacatgacctag

SEQ ID NO: 134072 - DNA, 1479 bp, Artificial Sequence
  Description of Artificial Sequence: Synthetic coding sequence
atgcgactggctgcagcagccaacgaggcttatacagcacctctcgctgtttccggattgctgggttgcaaacagtgcgggggaggtcgggatcaggacgaggagcttggaattcgaatccccagacccttgggccagggcccttcgagatttatccccgagaaggagatactccaggtaggctctgaagatgcacagatgcacgctctgtttgccgacagcttcgccgccttagggcggctggacaacatcacgttggttatggtgtttcatcctcaataccttgagagctttcttaagacacagcactatctgctccagatggacggacccctgcccctccactatcgccactatatcggcattatggctgctgcgagacaccagtgtagttatctcgtgaatttgcacgtgaacgacttcctgcacgtgggaggcgaccctaaatggctgaacggactggagaacgccccacagaaacttcaaaacctgggagagctgaataaagtcttggctcatcgcccctggctgattaccaaggagcatatcgagggcctgttaaaggcagaggaacactcatggtccctggccgaactcgttcatgccgtagtgctattgacccactatcacagcctcgcttctttcaccttcgggtgcggtattagccctgagatccattgcgatggcggccacacattccgaccaccctctgtctccaactactgtatttgtgacataaccaacggaaaccatagcgtagatgagatgcctgtgaactccgctgaaaatgtctccgtgagcgactctttcttcgaagtggaagccctgatggagaagatgcggcagctacaggaatgcagagatgaggaggaagccagccaggaagagatggcttcccggtttgagatagagaaaagagaaagtatgtttgtgtttagcagtgacgatgaagaggtgacaccagcccgggctgtctctaggcactttgaagatacatcctatggatacaaagacttttctcgccatggcatgcacgtgccaacttttagagtgcaggattattgctgggaagatcacgggtactctttggtcaatcgcttgtatcccgatgtaggccagcttattgacgagaagtttcacatcgcctacaacctaacttataataccatggcgatgcacaaagatgtggatacttctatgctacgaagagccatctggaactacatccattgtatgtttgggattcggtatgatgattatgactatggcgagatcaatcagctgcttgacaggtctttcaaagtctacattaaaacagtggtctgtactccagaaaaagtgacgaaacgcatgtacgattccttttggagacagtttaaacattccgaaaaggtacatgttaatcttctgttaatagaagctcggatgcaggcagagctcctctacgccttgcgggccataacacggtatatgacttag

SEQ ID NO: 134073 - DNA, 1656 bp, Artificial Sequence
  Description of Artificial Sequence: Synthetic coding sequence
atggcggagggagaaaatgaagtgagatgggatggtctgtgtagtcgggattccacaacccgggagactgcgctggagaatattaggcagacgatcttacgcaaaacagaatatttgcggtcggtgaaagagacacctcaccggcctagtgacgggctctccaatacggaaagctctgatggactgaataaactccttgctcatctgttgatgctctccaagagatgcccattcaaggacgttcgggaaaagagcgaatttatcctgaaatctattcaggaactggggattcgcatccctcgacccctgggccaggggccctctcgtttcatcccagagaaggaaatcttgcaagtgggcagtgaggacgcccagatgcatgctttatttgccgacagcttcgccgccctggggcgactggataatattacactggtgatggttttccatccacagtatctagagagtttcctcaaaactcaacactacctcttgcagatggatgggccactgcccttgcactacaggcattacattgggattatggccgcggccaggcaccagtgtagctacctagtcaacctccatgtaaatgactttctgcacgtcgggggagacccgaaatggctaaacggtttagaaaacgcacctcagaagttgcagaacttgggggagcttaataaggtcctggctcatcgcccttggctgattacgaaagaacatattgagggactgctaaaagcagaagaacactcttggtcacttgctgaattagtccacgccgtggtgctcctaacacattatcactcgttggcttccttcacattcggctgtggaatcagccctgaaatccactgcgacggaggccacactttccgaccccctagcgtgagcaattactgcatttgcgacatcactaacggcaatcattccgttgatgaaatgccagtgaattccgctgaaaatgtgtctgttagtgacagtttcttcgaggtagaggctctgatggagaaaatgcggcagcttcaagagtgtcgggatgaggaagaagcatcccaggaggagatggcatctcgatttgagatcgagaagcgggaatcaatgtttgtgttcagctccgacgacgaggaagtgacgccagccagggcggtctcaaggcactttgaagatactagctatgggtacaaggatttttctcggcatgggatgcatgtgccgacgttccgggtgcaggactactgttgggaggatcacggatactcactagtaaacaggctctaccccgatgtagggcagttgatagatgagaagttccacatcgcctataatttaacctacaacacaatggcaatgcataaagatgtagatacctcaatgctcagacgcgccatctggaattacatccactgtatgttcggaatcaggtacgacgactatgactacggcgagataaatcaattactggaccgatcgttcaaggtgtatatcaagaccgtggtttgcacccccgagaaggtcaccaagaggatgtatgatagcttctggagacagttcaaacactcagaaaaggttcacgtgaatctgctgcttatagaagcaagaatgcaagcggagcttctgtacgctttacgcgccattactaggtacatgacatag

SEQ ID NO: 134074 - DNA, 1302 bp, Artificial Sequence
  Description of Artificial Sequence: Synthetic coding sequence
atgagggcagagggccttgggggccttgagcgtttctgcagcccaggaaagggccgtggactgagggcgctccagccttttcaggtcggggacctgctgttctcttgtccagcatacgcctacgtgcttacagtcaacgagcgggggaatcactgtgaatattgctttacacggaaagaaggcttatctaaatgtgggcgatgtaaacaagccttttactgcaacgtcgagtgtcagaaggaagactggcccatgcataagctggagtgcagtccgatggtggtgtttggggagaattggaaccctagcgagaccgttcggctcactgctaggattctggcaaagcagaagatccacccagagagaaccccttctgaaaagctcctggccgtaaaagaatttgaatcccatctggacaaactggacaacgaaaagaaggatctgatccagtccgacatagccgctcttcaccatttctattcaaaacacctgggattcccggacaacgattcgctggtggtgttgtttgctcaggtgaattgcaacggatttaccatcgaggacgaggagctgtcacatctgggctccgctatcttccctgatgtagcccttatgaaccactcctgctgtccgaatgtgatcgtgacttataaaggtacgctcgccgaagtgcgtgctgtacaggaaattaaacctggagaggaagttttcaccagctacatcgaccttttgtatcctacagaggatcgcaatgatagactgcgcgactcttatttctttacctgtgagtgtcaagaatgcacgactaaagataaggacaaggccaaagtggagattcgcaaactgagcgacccgcctaaggccgaggccatccgagacatggtgcgctatgctcgcaatgtgatcgaagaatttcgacgtgccaagcactataaaagtccctccgaattgctggagatttgtgaactgtcccaggagaagatgagttcggtttttgaagattcgaacgtctacatgcttcacatgatgtatcaggccatgggagtctgtctgtatatgcaggactgggaaggggccctccaatacggccagaaaatcattaaaccgtactcgaaacattaccctttgtactccctcaacgtcgcgtctatgtggctgaagttgggcaggctgtacatgggccttgagcacaaagctgctggggaaaaggcactcaagaaagccatcgcgattatggaggtggcccacggaaaggaccatccatacattagcgaaattaagcaagagatcgagagccattag

SEQ ID NO: 134075 - DNA, 819 bp, Artificial Sequence
  Description of Artificial Sequence: Synthetic coding sequence
atgagggccgaagggctggggggcctggaaaggttttgtagccctgggaaggggcggggcctgcgcgctctgcagccctttcaagttggggatctgctgttctcctgtcctgcttacgcctatgttctgacagttaacgagcgcgggaatcactgtgagtactgcttcacccgcaaggaaggtctctctaagtgcggcagatgtaagcaggccttttactgtaacgtagaatgtcaaaaggaagattggccgatgcacaagcttgaatgtagcccaatggtcgtatttggagaaaactggaatccctcggaaacagtgagactgacagcccgtattctcgctaagcaaaaaattcatcccgaacgcacacctagtgaaaaactcctggcggttaaggagtttgagtctcatctggacaaactggacaacgagaaaaaggacctcattcaatctgatatcgcagccctgcaccatttctatagcaagcatctggggttccccgacaatgactcccttgttgtgctattcgctcaggtgaactgcaacggatttacaatagaagatgaagagctgtctcatctggggtccgcaattttccctgatgtggcacttatgaaccactcatgctgtcccaacgtcatcgtaacatataagggaacgttggccgaagtccgcgcggtgcaagagatcaaacccggtgaagaagtgttcacttcctacatagacctactgtaccctaccgaggataggaatgataggctcagagattcctatttttttacgtgtgaatgtcaggaatgtacaaccaaggacaaatag

SEQ ID NO: 134076 - DNA, 5712 bp, Artificial Sequence
  Description of Artificial Sequence: Synthetic coding sequence
atggccgccgggacctgggcagcagcagccgccgccgccgcggccgattatttcgtcttggttgcgtttggaccacatcctcgtgggtctggcgagggccaaggccagatccttcagaggtttccagagaaagactgggaagataatccctttcctcagggaattgagcttttctgccagccatccggctggcagctctgtccagaaaggaaccccccgactttttttgtggcggtgttaaccgacatcaattcagaaagacattactgcgcctgtctaaccttctgggagccagcagagccaagtcaagaaaccacccgagtggaggacgcgaccgaacgcgaagaggagggcgatgagggtggacaaactcacctgagtccgaccgcacctgctccttccgcccagctgtttgcccctaagactcttgttctggtatcccggctcgatcatacagaggtgttccggaatagcctgggactgatctacgccatccacgttgagggtctcaatgtgtgcctggagaacgtcataggaaatctccttacctgcactgtgcccctggccggggggtctcagcgtacaatcagcttgggggctggggatcgtcaggtcatccaaacacccctggccgattcactgccagtttcacgctgctcagtcgcgttactgttcagacaattgggcatcaccaacgtgctgagcctgttctgtgccgcgctgacagagcacaaagtgctctttttgtcaaggtcctaccagcggctggcagatgcatgccggggtctcctagccctcttgtttcctcttagatactctttcacttacgttcccatactgcccgctcagctgctcgaagtgctgagcacacctactcctttcatcataggggtgaacgccgcctttcaggctgagacacaggagttacttgacgtcatcgttgccgatttggacggaggaacagtgactattcctgagtgtgtgcatatccccccacttcccgaacctctccagtctcagacacatagtgtcctcagtatggtgttggatcccgagctcgagctcgcggacctcgcattcccacctccaaccacttccacaagttctctaaaaatgcaggataaggagctgcgtgctgttttcctacggctgtttgctcagctccttcagggctaccgttggtgccttcacgtcgtacgcattcatccggaacctgttattaggttccacaaagccgcatttctgggacagaggggtctggtagaggatgacttcctgatgaaagtactcgaaggaatggcctttgcaggcttcgtcagcgaaagaggcgtgccatatcgacctaccgaccttttcgatgagttggttgctcacgaggtcgcccgtatgagagccgatgaaaaccacccccagagagtcctgcgccatgttcaggagctagctgaacaattgtataagaacgagaacccataccccgcagttgcaatgcacaaggtccagcggcccggcgagagttctcacctgcgaagagttcctaggccctttccgcgactggatgagggcaccgtgcagtggatcgtggatcaggcagcagccaaaatgcaaggagccccccctgcagtaaaagccgagaggcgcaccactgtgcccagcggaccccccatgaccgcgatcttggagcgctgtagcggactgcatgttaatagtgcaaggagactcgaagttgtgcgcaattgcatttcctacgtgttcgagggcaagatgctggaggctaagaaattgctccctgcagttctccgcgcgctgaagggacgcgctgccagacggtgtctggcacaggaactgcacctgcacgtccagcagaatcgcgcagtcctcgatcatcagcaattcgactttgtggtccggatgatgaattgttgcctacaggattgcacgtcactggacgaacatggaatcgctgccgcactgctccccttagtgacagcgttttgtaggaagctctcgcccggagttacccagtttgcctattcatgcgttcaggagcatgtcgtctggagcactccacaattttgggaggcaatgttttatggggatgtgcagacacatataagggccctttacctggagcccacggaggatttagctcccgcgcaagaggttggagaggcgcccagccaggaggacgaaagaagtgcactggacgtcgcatctgagcaacgtaggctgtggcctacactcagtagggagaagcagcaggagctggtgcagaaggaggaatctaccgtgttctcgcaggcaatacattacgcaaaccgaatgagctatctcctgctcccccttgattcttccaagagcaggttactgcgcgaaagggccgggctaggtgacttagagagtgcttccaattctctggtaaccaattctatggccgggtccgttgccgagagttacgacacagagtcaggatttgaagacgcagaaacttgcgatgtggccggagctgtcgtgagattcatcaataggtttgtagataaggtatgcacagaatccggggtgacatcagatcatctaaaaggtcttcacgtgatggtcccagatatcgtgcagatgcatatcgagacactggaagccgtccagcgcgagtctaggcgtctgcctcccatccagaaacctaaattgttgcgtccaaggctattacccggagaagaatgtgtgctcgacggtctccgcgtatacctgctgccggacggccgggaggagggcgcggggggctctgctgggggcccagcactgctgcccgccgagggtgcggtcttcctgaccacttacagggtaatcttcaccggaatgcctaccgaccctctcgtcggggagcaggtcgtggttagaagcttccctgttgctgctctcacaaaagaaaaacggatctctgtacagacccccgtggatcagttactgcaggacggtctgcaactacggagttgtacattccaactgctgaaaatggcgtttgacgaagaggtggggtctgactcagccgagctgttccgtaagcaactacacaaactgagataccctcccgatatcagggccacattcgcctttactctgggcagcgctcatactccaggccgaccacctcgggtgaccaaggataagggtccctcgctgaggaccctgagcagaaacttagtgaaaaacgcaaaaaagacaataggacgtcagcacgtgacgcgcaaaaaatacaatccacctagctgggagcatagaggccagcctccacccgaggaccaagaggacgagatttcagtgtccgaggaactggaaccttcaacactcacgccatcctctgctcttaagcctagtgatcgtatgaccatgtcttctcttgttgaacgcgcgtgttgtcgagactaccaaaggctcggcctgggaactttgtcttcaagtttaagtagggcaaaatcagaacccttcagaattagccccgtcaaccgaatgtacgctatctgccgatcctacccagggcttctgatcgtgcctcagagcgtgcaagacaatgcactacagagggttagtaggtgctaccgccaaaaccgcttccccgtagtgtgctggcgctccggcaggagcaaagcagtcctcctcagaagcgggggccttcatggtaagggtgttgtcggactgtttaaggcacaaaatgccccatcgccgggacaatcccaggctgacagctcaagcctggagcaagaaaagtacctgcaggcagtggtctccagcatgcctaggtatgctgacgcgtccgggcgaaacaccctgagcggtttctctagtgcccacatgggaagccatgtgcccagcccaagagcacgggttaccaccctcagcaaccctatggcagcctcggcgagccgtcgaaccgcaccccggggaaaatggggtagtgtcaggacgtctggcagaagctctggactgggaaccgatgtgggctctaggttggctggacgagacgccttggcgccgcctcaagcgaacggagggcctcccgaccctggcttccttaggccccagagagcagccctgtacattctgggtgataaggcccagctcaaaggcgtgagatccgatccactccaacaatgggagctggtcccaatagaggttttcgaagcacgccaggtcaaagcctcattcaagaagctccttaaggcatgcgtccctggttgcccagcagcagagcctagtcccgctagcttcctgagatctctggaagattctgaatggctcattcaaatccataaactgcttcaggttagcgtgttagtggtggaattactggattcggggtcttccgtgttggtaggcttggaggatggctgggatattaccacccaggtcgtgtccctggtacagctcttgtcggatcctttttaccggactttggagggctttaggttgttagtggagaaagaatggctgtccttcggtcaccgcttttcacacagaggcgcccacactctcgccggccagtcttctggattcacccctgtgttcctccagtttttggattgtgtccaccaggtccacttgcagttccccatggagtttgaattctctcagttttatctgaaatttctggggtaccaccatgttagtcggcgtttccgtaccttcttgctggactctgactatgagcgcatcgaattaggcctgctgtatgaagagaaaggagagcgcagagggcaggtgccttgcaggtccgtgtgggagtacgtagatagattgagcaagcgaacccccgtgttccacaattacatgtatgcaccagaggatgccgaagtcctgcgaccgtattcaaatgtgagcaacctgaaggtgtgggatttttatacagaggagaccttggcagaaggacccccttacgactgggagctcgcacaagggcctccagagcctcccgaggaggagcgcagcgatggtggggcaccacagtccaggcgaagggtggtctggccttgttatgacagctgtccacgggctcagcccgacgctatatccagactgctggaagagcttcagcggctggagaccgaactgggacaacccgctgaaagatggaaggacacatgggaccgggtgaaggcagcccagaggcttgaagggcggcctgacggcaggggcaccccgtctagcctgctggtgtctacagcccctcaccatcgcaggtcattgggcgtatacctgcaggaggggcccgtcggtagtacactgtctttatcgctggacagtgaccagtccagtgggtccaccacaagcggatcaagacaggctgcgagacggagtacctccaccctctattctcagtttcagaccgccgaatctgaaaacagatcttatgaaggcacattatacaaaaaaggtgccttcatgaagccgtggaaggccagatggtttgtgttggacaagacaaaacaccagctcaggtactatgatcaccgagtcgataccgagtgcaaaggagtcatcgatctcgcagaggtggaagccgttgcacccggcaccccgactatgggggctccaaagaccgttgacgaaaaagccttttttgatgtgaagaccactaggcgcgtgtacaacttctgtgcccaagatgtgcctagcgcccagcaatgggtggacagaattcagagctgcctgagtgacgcctag

SEQ ID NO: 134077 - DNA, 2697 bp, Artificial Sequence
  Description of Artificial Sequence: Synthetic coding sequence
atggccgccggaacttgggctgcagccgctgcagctgcagctgccgactatttcgtcctggtggcctttgggccgcatccccgagggtccggtgagggacaaggacaaatcctgcagcgttttcccgagaaggactgggaggacaatcctttcccccagggcatcgagctgttctgccagccctcaggttggcagttgtgcccggaacgtaatccaccgaccttcttcgttgccgtactcaccgacattaatagcgagcggcactactgcgcgtgcctgaccttttgggaacccgcagagccctcacagcaggaaaccactcgcgtcgaggatgcgactgagcgcgaggaagaaggagacgagggcgggcaaactcacctttcccccacagctcctgcacccagtgcgcagttgttcgccccgaaaacgttggtccttgtgagccggctggaccacacggaggtgttcagaaacagtctgggcctcatctacgctatccacgtggaaggccttaatgtttgcctggaaaacgtcatcggaaacctcctgacctgtacagttcctctcgctggtggcagccagcgtaccattagtttgggcgccggagacaggcaggtaattcagacccccttggcagacagcctgccggtatcacgttgctctgtggccctcctcttccggcagctcggtatcactaatgtgctctctcttttctgcgctgccctgactgaacataaggtgctgttcctgtcacggtcttatcagcgcttggccgacgcttgcagaggactgctagccctcctgttccctctgagatacagtttcacttacgtgcctatactccccgcgcagctgttggaggtactctcaacgcccactccattcataattggagtgaacgcggcttttcaggcggagacacaggagttattagacgtgatcgttgccgacttagatggaggtacagttactattccagagtgtgtgcacatccctccccttccggagccattgcagagccagactcatagcgttctgtctatggtgctggatcccgagctggagcttgctgacctcgccttcccccctccaaccacgtctacttccagcctaaaaatgcaagacaaagaacttagggccgtgttcctgaggctgttcgcccaacttctgcagggttatcgctggtgtttgcacgttgttcggatccatcccgagccagttatccggttccacaaagccgccttcctgggtcaacgggggctcgtcgaggatgattttctgatgaaggtgttagagggaatggcctttgccggctttgttagcgagaggggtgttccttatcgccctacagacctgttcgacgagttggttgctcatgaggtggcacgcatgagggccgatgaaaatcacccacaacgggtcttacgacatgtgcaagaactagcagagcagttgtataagaacgagaacccgtatcctgctgttgccatgcataaggtgcaacgcccgggcgagtcttcccatctacgccgggttcctcgaccgtttcctagactcgacgaaggtacagtgcagtggatcgtggatcaagctgccgcaaagatgcagggtgcgcctcccgcagtgaaggctgagagaaggaccacggtgccatccggcccacccatgaccgctattctggaacgttgtagcggcttacacgtaaactccgcccgcaggctcgaagtggtcagaaattgtatctcatatgtatttgaaggaaagatgctcgaagctaaaaagttgctgcctgcagttttgcgagcccttaagggtcgagcagcgagacgctgtttagcccaggagctccatttacacgtgcagcagaaccgtgctgttctcgatcaccagcagttcgacttcgtcgtgaggatgatgaattgctgcctacaggattgcacctccctggacgagcacggcattgctgcagcactactacctctggtcacagcattctgccggaaactgagtccaggtgtcacacaattcgcctactcttgcgtgcaagaacacgtcgtctggtcaacgccacaattttgggaggccatgttttacggcgacgtgcaaacgcacatccgggccctgtacttagaacccaccgaagatttggctcctgctcaggaggtgggcgaagcccctagtcaagaggatgagcggagcgctctggacgtggcctcggagcagcggcgtctctggccaactctcagtcgggaaaagcaacaggagttggttcagaaagaagaaagtacggtcttcagccaggcgatacactatgcgaaccgcatgtcctacttgctgcttcccctcgactccagcaaatcacgcctgctcagggaacgcgctggtcttggggacttggagagcgcgtctaatagcctggtcaccaattcgatggcggggagcgtcgctgagtcatacgataccgaaagcggcttcgaggacgcagaaacttgcgacgtggcaggagcagtggtgaggtttataaataggttcgtggataaagtatgcacagagagcggggtcacctcagatcacctgaaggggcttcacgttatggtgcctgatatcgtccagatgcacatagaaaccttagaggctgttcagcgagagtctagacggctccctcctatccagaaacctaaactactccggccttag

SEQ ID NO: 134078 - DNA, 5682 bp, Artificial Sequence
  Description of Artificial Sequence: Synthetic coding sequence
atggctaggttggctgactattttgttctggtggccttcggtccccacccgagggggagcggggagggccaggggcagatcctgcaacgcttccctgagaaagactgggaggacaatcccttccctcagggaattgaattgttttgtcagccaagtggttggcaactttgtccggaacggaaccctccaaccttcttcgtcgctgtcctcacagacataaattcagagcgccactattgtgcgtgtctgacattttgggagccggcagagcctagccaagagaccacgcgtgtcgaggacgcgaccgaacgtgaggaggagggggatgaagggggtcagacacatctttccccaaccgcgccggcaccatccgcccagctgttcgctcctaagaccctggtgttggtctctagactggaccacaccgaagtcttccggaacagcctgggccttatttacgctatacacgtagaggggctcaacgtttgtctagaaaacgttattgggaacctgcttacgtgcaccgtccccttagctggcgggtcacagcgcaccatatcactcggtgccggggatcggcaggttatccaaactcctttggctgattcgctccccgtatctcgttgcagcgttgccctactcttcaggcagcttggtatcaccaacgtgctgagcctcttctgtgccgcccttacagaacacaaggtattatttctcagcaggtcctaccagagactggcggatgcctgtagagggcttctcgctctgctgtttccactgcgctattccttcacctatgtgcccattcttcctgcccagctgctggaggtactgagtacccctacacctttcatcatcggggtgaacgccgcctttcaggccgaaactcaagaactgttagatgtaattgtggcggatctggatggtgggaccgtgacgattcccgaatgcgtccacatcccaccactgccagagccacttcagtcacagacacactccgtgttatctatggtgctcgaccccgagcttgaactggcggaccttgcattccctccccccacaacttcaacgagcagcctgaagatgcaggataaggaactccgggccgtgtttcttaggctgttcgcccagctcctgcagggctaccggtggtgccttcatgtagtcaggatccaccctgaacccgttattaggttccacaaggccgcattcctaggccagcggggactggtcgaagacgattttctaatgaaagtgcttgagggtatggcattcgctgggtttgtgagtgagcgcggggttccttacaggcctactgacctgttcgacgaactcgtcgcccacgaagtagccagaatgcgagccgatgagaatcatcctcagagagtactcaggcacgtgcaagaactagccgagcaactttacaaaaacgaaaacccatatcccgctgtggctatgcacaaagttcagcggccgggagaatcaagtcacctgagacgggttcctaggccgttcccccggttggatgaagggactgtccagtggatcgtggaccaggccgccgctaaaatgcagggagctccccctgctgtcaaggcagagaggcgcactaccgtcccttccggtcctcccatgaccgctatcctggaacgatgctcagggctgcacgttaattctgcgcggcggttagaagttgtgcgaaattgcatttcttacgtctttgaggggaagatgctcgaggcgaaaaagctgctaccagccgtcctgcgagctctcaaaggacgtgctgcccggcgatgcctggcgcaggaactccatcttcatgtacagcagaacagagcagtgctagatcaccagcaattcgacttcgtcgtccgcatgatgaactgttgtctccaggattgcacgtcattggacgagcatgggattgctgccgctctccttccgctcgtaaccgccttctgcagaaagttgagccctggagtcacacaattcgcctacagttgtgtccaggagcatgtggtgtggagtacaccccaattctgggaggctatgttctatggcgatgtccaaacccacatccgagcactgtatctggaacccaccgaggatttggctcctgcacaggaggttggcgaggccccttctcaggaagatgagcggtctgccttggacgttgcttccgaacagagacgtctctggcccaccctttcaagggaaaaacaacaagaattagttcaaaaagaagaatctacagtgttttctcaggcaattcactacgccaacagaatgtcatacctcctgttaccccttgactcaagcaaatcgcgtctattgagggagagggcaggactcggcgaccttgagagtgcgtcaaattctctagtgacaaatagtatggcaggctctgttgccgagtcctacgatactgaaagcggcttcgaagatgctgagacatgtgacgtagccggagccgtcgtgcggtttataaatcgctttgtagacaaggtctgtacggaaagcggggtgacctccgaccacttgaagggcttacacgtcatggtcccagatatcgtccagatgcatatcgaaactctcgaggcagtccagcgcgaaagccggcgtctaccacccattcagaaaccgaagttgttgagaccgaggctcctgcctggggaggaatgcgtactggacggccttcgtgtctatctgctcccagacggacgggaagagggagcaggcgggtctgccggcggtcccgcccttcttcctgctgaaggcgcggtcttcttgacaacgtacagagtgatatttaccggtatgccaactgatccactggtgggagagcaggtggtcgtgaggagcttcccggttgccgcactaaccaaagagaaaagaatctccgtgcagacacctgtggatcagctgctgcaggatggcctgcaactgcgttcttgcacctttcaactcttgaagatggctttcgacgaggaagtagggagtgatagtgccgagctgtttcgcaaacagctgcataagctgcgctatcctcctgacatccgggccacatttgcttttacattaggcagcgcgcataccccaggcagaccccctcgcgtgacaaaagacaaagggccttcactccgcaccctgagccgcaaccttgttaaaaacgctaagaaaaccattggacggcagcacgtgacaagaaagaaatataatccgccctcatgggagcacaggggccaacctcccccagaagaccaggaagacgagatatctgtgtctgaagaactggagccttcaaccttgaccccttcctctgccctaaagcctagtgatcggatgactatgagctcattagtggagcgagcatgttgtcgtgactatcagcggctgggactggggactttaagctcttccctttccagagctaagtctgaaccgtttcgaatttctcctgtaaatcgcatgtacgccatatgcaggtcgtatccaggcctgctgattgtcccccaatcggtgcaggacaacgccctgcagcgggtatccaggtgctaccgccagaacaggtttccggtcgtctgctggcgcagcggccggagcaaagccgtactcctacggtctggtggccttcatggaaaaggcgttgtaggcctttttaaggctcagaatgcgccgtctcccggccagagtcaggccgactccagttctttggagcaggaaaagtatttgcaagccgtggtgtctagcatgccacgatacgctgacgcgagcggccgaaatactctgtcaggcttctcaagtgctcatatggggtcacatgtgcctagcccaagagccagagtgaccacgctaagtaatcccatggccgcaagtgcaagccgtcgcacggcacccaggggtaagtggggtagtgtgcgcacctccgggaggtctagcggtttaggtacggatgtggggtctaggttagccgggagggacgccctggctcccccacaggccaacggaggaccacccgatcctggatttctcagacctcagcgcgccgcactctacatcctgggagataaagcccagctcaagggagtccggagcgaccctttgcagcagtgggaactagtacctattgaggttttcgaagcccgacaggtgaaagcctcgtttaaaaagcttttaaaggcctgtgttccaggatgtccagcagccgagccatctccagcaagttttttgcgcagccttgaggacagcgaatggcttatacaaattcacaaacttctccaggtttctgttctagtcgtggaactgcttgactcgggaagctcagtgcttgttggactcgaggacggatgggacatcactactcaggtggtaagcttggtccaacttttaagcgatcccttctaccggaccctggaggggttccgcctgctggtggaaaaggaatggctctccttcggacacagattcagccatcggggcgcacatacccttgcaggtcaatcttcaggcttcacgcctgtatttctccagtttcttgactgcgttcaccaggttcaccttcagttccccatggaatttgaatttagtcagttctatttgaaattcctgggttatcatcacgtgtcacgcagattcaggaccttcttattagacagcgactacgaacgcattgaacttggattactgtatgaagagaaaggcgaacggcgcggtcaggttccatgccgctccgtctgggaatatgttgacagattaagcaagcggacccccgtgtttcataattatatgtacgcaccggaggacgcggaggtgcttcgtccctattccaacgtgtcgaatctgaaagtgtgggacttctataccgaagaaacattggcggaagggcctccatatgactgggaactggcccagggaccccccgaaccaccagaagaagagagaagcgatggaggggccccccagtcccgacgccgcgtcgtttggccttgctacgactcatgtcctcgcgcacagcccgatgcaattagccgcctcctcgaagagctgcagaggctcgaaactgagctcggccagcctgccgaaagatggaaggatacctgggaccgagtgaaggcagcccagagactggagggacgtcctgacggccggggaacaccatcaagcctactcgtgtctacagccccccaccacagacgatctctgggtgtgtacctgcaggagggtccagttggctccaccctgtctctgtcattggattcagatcagagttcagggagtacgacctctgggtcccgtcaggctgcccggcgatcaacttccaccctgtacagccagtttcagacggctgagagcgagaaccggagttatgaaggtactttatataagaaaggggctttcatgaaaccatggaaagcccggtggttcgttctcgacaagacgaaacatcaactgcgttactacgaccacagggtagacacggagtgtaaaggtgttatcgacctggctgaagtggaagctgtggccccgggcacccccacaatgggggcgcccaagaccgtcgacgaaaaagcgttttttgacgtcaagacaaccagaagggtttacaatttctgtgctcaggacgtgcccagcgctcagcaatgggtcgatagaatccaatcgtgcctctcagatgcttag

SEQ ID NO: 134079 - DNA, 5604 bp, Artificial Sequence
  Description of Artificial Sequence: Synthetic coding sequence
atggcccgactggccgattactttgttctggtagccttcggcccacaccctcgggggagtggggagggacaaggccagatactgcagcggttcccagagaaggactgggaagataacccatttcctcaggggatagaactcttctgccagccatccgggtggcaactttgtccggagaggaatccacctacattctttgtcgcagtgctcacagatatcaacagtgagagacattactgcgcgtgtctgaccttctgggagccggctgaaccttcacaggagacaacccgagtagaggatgcaaccgagagagaggaggaaggagatgaaggtggccaaactcatctcagccccactgcccccgcccccagcgcccagctgtttgctcccaagacattggtgttggtctccaggctggaccacactgaggtcttcaggaacagcctgggacttatttatgccatccacgtggagggtctaaatgtatgccttgagaacgtgatcggcaatcttctcacctgcacagtaccacttgccggaggctcacaaaggaccatatctctaggtgcaggagatcggcaggtgatccaaacacccctggctgactccctgcctgtgagtcgttgtagtgttgctctgcttttccgtcagttagggatcaccaatgtccttagtttgttctgtgcagcactcactgaacacaaagtgctgtttttgtcaagaagctaccagcggctggcggatgcctgtaggggcctgctggccttgctgtttccattaaggtacagctttacgtatgtaccaatactacccgcccagctattggaagtactgagcacccctaccccattcatcataggcgtcaatgcagcttttcaggccgagacacaggaactgctagatgtaatcgtggccgacctggatgggggaactgtcaccatacctgagtgtgtacatatcccccctctgccagagccgctgcagagtcagacccactcggttctgtccatggtattggacccagagttggaactggcagacctggcttttcctccacctactacctccactagttctctgaaaatgcaggacaaggaactgcgggccgtttttctccggctttttgcccagttactgcagggctatcgatggtgcctgcatgttgtcagaattcaccccgagcctgtcattcgatttcacaaagctgcttttttggggcagagaggtctggtagaagacgattttctcatgaaggtcctggaagggatggcctttgctgggtttgtgtccgagcgtggggtgccctaccgccccactgatctgttcgacgaacttgtcgctcatgaagtggctcggatgcgtgctgacgagaatcatccccagagagtactcaggcacgtgcaggaacttgctgagcagctgtataagaatgagaacccataccctgctgttgcgatgcataaggtgcagcggcccggggaatcgtcccatctgcgcagagtgcctcggccctttcctcgcttggacgaagggacagtgcagtggattgtggatcaagctgccgcgaagatgcagggggctccccctgccgtcaaagcagagagacggactactgtgcctagcggccctcctatgaccgctatcttggaacggtgctctggcctgcacgtgaatagcgcgaggcgcctggaggttgtaagaaactgcatctcctacgtgttcgaaggcaaaatgctggaagcaaagaagttacttcctgccgtgcttcgcgctctgaaaggtcgcgcagctcgccgatgtctggctcaggagttacatctacatgtccagcagaacagggcagtgctcgatcatcagcaatttgacttcgtggtcaggatgatgaattgctgcctacaagattgtacatcattagatgaacatggcatcgcagcagctttactgcccctggtgactgccttctgtcggaagctcagccccggagtgactcagttcgcgtactcctgcgttcaggagcacgtcgtttggtctaccccacagttctgggaggccatgttctatggcgatgtccagactcatatccgcgctctgtacctcgagccaactgaagacctggctccagcgcaggaagtgggtgaagctccaagccaggaagacgagagaagtgccctggacgtagctagtgagcaaagacggctatggcccactctctcgcgggagaagcagcaggagctggttcagaaagaagagtccaccgtcttctctcaggcgattcattacgcgaaccgcatgagttatctgctgctgcctctggactcctctaagagccggctcctaagggaacgagctgggctgggtgatcttgaatccgcatcaaatagtttagtgaccaactcaatggcgggctctgtggccgagagttacgatacagaaagtgggttcgaggatgcggaaacttgcgatgtggccggagcggtggtccgtttcatcaaccggttcgtggataaggtgtgcactgaatccggcgtgactagcgaccatctcaaggggctgcacgtcatggtgcccgacattgttcagatgcacattgaaactctggaagcagtgcagagggagtcgcggcgactgccgcctatacaaaaacccaagctgctccggcctaggttacttcctggagaggagtgcgtccttgacgggctcagagtgtacctgttgccagacggtagagaggaaggggccggcggcagcgccggcggacctgcgctactgcctgccgagggggccgtgttcttgacaacttatcgggtgatcttcaccggtatgccaacagatcccttggtgggagagcaggtcgtcgtgcgcagcttccctgtggcggcacttacaaaagagaagcggatctccgtacagactcctgtggaccaactactccaggatgggctccagttgcggtcttgtacttttcagctgctgaagatggcctttgacgaggaggtgggaagcgattctgcggaattgtttcgcaagcagctgcataagcttaggtaccctccagacataagggcgacctttgctttcacattaggaagtgcccacacccctggcagacccccaagggtaaccaaggataaaggcccgtctctgcgcacactctccaggaatctggttaagaatgccaagaaaaccattggcagacagcacgtcaccaggaaaaaatacaaccctccttcttgggagcaccgaggccagcccccacctgaagaccaggaagacgagatatcagtctccgaggagttagagccttcaaccctcaccccatcatccgccctcaaacccagtgatcgtatgactatgtcaagcttggtggagagagcctgttgcagagactatcaacgccttgggctgggaactttaagtagcagcctttcacgagcaaaaagcgaacccttccggatatctcccgttaaccgcatgtacgccatatgcagatcttacccaggattactgatagtgccacagagcgttcaggacaatgccctgcagcgggtttctagatgttaccggcagaataggtttcctgtcgtgtgttggcgcagcggacgcagcaaagcagtgctgctcaggtccggaggattacacggcaagggggttgtgggactgtttaaagcacagaacgctccatcacccggtcagagccaagccgactcatccagcttagaacaggagaaatacttgcaggcggtggtttcctccatgcccaggtacgctgacgcctcagggcgcaataccctgtccggattttcatccgctcacatgggctctcacggaaaatggggatctgtgcgcacgtccggtaggagcagcggccttggcacggatgttgggagccgcctggccggacgcgatgccctcgcacccccccaggccaatgggggtccgccagaccctggattcctgcggccacagcgagcggcactctacattctcggagataaggctcaactcaagggagttaggagtgaccctctccagcagtgggagctcgtgccaattgaggtgtttgaagccagacaggtgaaagccagctttaaaaagcttctaaaggcgtgtgtgccaggttgtccagcggccgaaccatcccctgcctctttcctgcggagtctggaagactctgaatggctcatccagattcacaaactgctgcaagtttccgtactggttgtggagctacttgacagtggatcgagtgtgctggttggccttgaggatggatgggatatcactacccaggtggtgagtctggtgcaactcctctcagaccctttctaccgcacactcgagggctttaggctgctcgtggagaaagagtggctgagttttggtcacaggtttagccaccgtggcgcccataccctagctggacaatcctccgggtttaccccagtcttccttcagtttctggattgcgtccatcaagttcacttacagttcccaatggaatttgaatttagccagttctacctgaagtttctcggctatcaccacgtgagtaggaggttccggaccttccttcttgattccgattatgagagaattgaactcggactgctctatgaggaaaagggtgagcgccgaggccaggtcccctgccgatcggtctgggagtacgttgaccgactcagtaaacgaacgcctgttttccacaattacatgtatgcccctgaggacgccgaggtgttacggccctactcaaatgtttccaacctgaaggtctgggacttttacactgaggaaaccctggctgaaggacctccttacgactgggagctcgcccaaggccccccggagccaccggaagaggaaagatctgatgggggagcaccgcagtcccggcggcgagtggtgtggccttgttatgactcctgtccacgggcccaacctgacgcgatttcacggctgctggaggagctacagcgattagagacagagctcggccagcctgctgagagatggaaggatacatgggatcgagtcaaagctgcgcagcgactcgagggtcgcccggatgggcggggcaccccgtcctctctccttgtcagcacggctccccaccacaggaggtcactgggcgtctaccttcaggagggacccgtgggttcaaccctctccctgtccctggattctgatcagtcgtccggatccaccactagcggttcccggcaggctgcccgacgctccacttcaactctgtattcacagtttcaaaccgcggagagcgaaaatagatcctacgaagggactctgtacaagaagggcgcttttatgaagccatggaaggctcggtggttcgtgctggacaagacaaaacaccagctgcgatactacgatcatcgcgtggacaccgaatgtaaaggagtgatcgacctcgccgaagtggaggccgtagcgcctggcacccccacgatgggagccccgaagacggtcgatgagaaggccttttttgacgtgaaaacgactaggcgggtgtacaatttctgtgcgcaagacgtgcctagcgcccagcagtgggtggatagaatacagagctgtctctccgacgcctag

SEQ ID NO: 134080 - DNA, 5550 bp, Artificial Sequence
  Description of Artificial Sequence: Synthetic coding sequence
atggcccgcctggcagactatttcatcgtggtcggctacgaccacgagaagccagggtcaggagaaggactcgggaagatcattcagagattccctcagaaagactgggacgatacccccttcccgcagggaatcgaattgttctgtcagccggggggatggcagctgagccgcgagcggaaacagccgaccttctttgtggttgtgttgacagacattgacagtgatcgccactattgtagctgtttaaccttttatgaagcagagattaacctccagggtactaaaaaagaagagatcgaaggggaggccaaagtatctggcctgatccagcccgccgaggtgtttgcacccaagtccctcgtccttgtgagccgcctgtactacccagagatcttcagagcttgcttgggcctgatttatacggtgtatgtagactcactcaatgtgagcctggagtccttgatcgctaacctgtgcgcatgtcttgtccctgccgctgggggaagtcagaaattattttctttgggcgcaggcgatcgacaacttattcagacccctctccatgacagcctgccaattacgggcaccagcgtggccctgctattccagcagttgggtatccagaacgttctgtccctgttttgcgcagtcctcactgagaacaaagtactgttccactcagctagtttccaaaggttatcggacgcctgtcgggcacttgagagtctaatgtttcccttgaagtactcctatccctacatccccatcctgccggcacagctgctcgaagtcctaagcagtccaacgccatttattataggggtgcattccgtgttcaagaccgacgttcacgagctgttggatgtcatcatagccgacttggacggcggaaccatcaagataccagaatgcattcacctctccagcctgcctgagcccctcctgcaccagacgcagtccgcattgtccctcatccttcacccggacctggaggtggctgaccatgcctttcctccaccgagaacggctttgagtcactcgaagatgctcgataaagaggtgcgggccgtgtttttgcgtctgtttgcacaactgttccagggctatcgctcgtgtttgcagcttatcagaatacacgccgagcccgtgattcactttcacaagaccgccttcttagggcaacgtggactagtggagaacgactttctgaccaaagttctgtctggcatggcgttcgccggcttcgtgtccgaaaggggaccaccttaccgatcttgtgatctgttcgacgaactcgtggcatttgaagtggaaaggataaaggtagaagagaacaaccccgtcaagatgataaaacatgtgagagagctggctgagcaactgttcaaaaacgagaaccctaacccacatatggccttccagaaggtgccaaggcccaccgagggcagccacttacgcgtgcacatcctcccattccccgagattaacgaggccagggtccaggagctgattcaggagaatgtcgccaagaatcaaaacgccccacccgcgacacgaattgaaaaaaagtgcgtcgtccccgcgggcccacccgtcgtgtccattatggataaggtgacaaccgtgttcaacagcgcacagcgtttggaggttgttagaaactgcatttccttcatttttgagaataaaatcctggagaccgaaaagaccctcccagccgcactgagagctcttaagggcaaagcagctcgacagtgcctgacagacgagttaggacttcacgtgcagcagaaccgtgcaatcttggatcatcaacagtttgactacatcattcgcatgatgaattgtacgctacaggactgttcatccttagaggaatacaatatcgcagcagctctgctccctctgactagtgccttctatcgcaagttggcccccggggtgtcgcagtttgcctacacttgcgtccaggatcatccaatttggacaaaccagcagttctgggaaactactttttacaatgcagtccaggagcaagtgcggtctctatatctatcggccaaggaggacaatcatgcgccccacctgaagcaaaaggataagctccctgatgatcactaccaggagaagactgctatggatctggccgccgagcagctgagactgtggcccaccctgagcaagtcaactcagcaggagcttgtccagcatgaggaaagtaccgtctttagtcaggcaatccattttgccaatctcatggttaatctactagtgccccttgatacaagtaagaataaactgcttagaacaagcgctccaggagactgggagagcggttcaaacagcattgtgacaaactcgattgctggcagcgtggccgagagctacgatactgaaagtgggttcgaggatagtgagaacactgacatcgcaaacagtgtggtgcggttcattacacgattcatcgacaaagtgtgcaccgagtctggagttacccaggaccacataaagagtctgcattgcatgatccccggtatcgtcgctatgcatatcgagactctggaggctgtccatagagaaagccgacggttacctccgattcagaaacccaagattttgagaccggctcttctacccggggaagagatcgtgtgtgaaggcctccgtgtgctgctggatccagacggcagagaggaggctaccggcggactgctgggcggccctcagctgcttcctgccgaaggagctctgttcttgacaacatatcgaatcctcttccgcggcacgcctcatgatcagctcgtgggagagcagaccgtggttaggagtttccctatcgcctcaataacgaaagaaaaaaaaattacaatgcagaatcaactgcaacagaacatgcaggaaggccttcagataacttccgccagcttccagctgataaaagtcgcgtttgatgaggaggtctctccagaggtcgttgaaatattcaagaagcagttgatgaagtttcggtacccacagtccattttttctacatttgccttcgcggccgggcagaccactccacagattatattacctaaacagaaagagaaaaatacatcatttcggaccttcagtaagactattgtgaaaggcgccaaaagggccggaaaaatgacaattgggagacagtacctgctgaagaagaagactggaaccatcgttgaagagagggttaacagacccggttggaatgaggacgacgacgtgtctgtgagtgatgagagcgagctccccacatcaaccacattgaaggcttcagaaaaatcaaccatggagcagctggtggagaaggcatgctttcgcgattatcaacgcctgggactgggtactatctcaggctccagcagtcgatccagaccagaatacttccggatcactgcctcgaaccgcatgtacagcctgtgtcgatcctatcccggtctgcttgtggtacctcaggctgtccaggacagttccctgccccgcgtcgctagatgttaccgccataaccgactgcctgtggtgtgctggaagaattcaaggtccggcacgctgctgctccgaagtggcggcttccacggaaaaggtgtggtgggactttttaaaagccaaaactcccctcaggccgctcctactagctcattagaaagcagtagctccattgagcaggagaaatacctccaggccttattgaacgcggtgtcagttcaccagaagctgcggggaaatagcacgttgaccgtgaggcccgccttcgccctgtcgccgggcgtgtgggcttctcttcgctccagcactcgcctcatttcctctcccacgtcattcattgacgtgggtgcccgcctggctggcaaagatcattccgcaagtttctccaatagctcctatctccagaaccagttgttaaaacgccaagccgccctctatatttttggagaaaaatcacagctgaggaactttaaagtagagtttgcccttaactgcgagttcgtcccagtcgaattccatgaaattcgacaagtgaaagcctcgtttaagaaactgatgcgagcctgcatcccgagtacaatcccgacggattcggaggttacatttctcaaagctctgggggatagcgaatggttcccgcagctgcacaggatcatgcaactagcagttgtggtctccgaggttcttgagaacggttccagtgtactggtgtgcctggaagaagggtgggacataactgctcaagtaacatcgctagtgcagttgctttccgatcctttctatcgcactttggaaggtttccagatgctggtagagaaagagtggctatcgttcggacacaaattctcccagcgctcttcccttacactaaactgccaggggagcggctttgcaccggtgttccttcaatttctggactgcgtccatcaggttcacaaccagtaccccactgaatttgagttcaacttgtattatctaaagttcttggcttttcactatgtctccaaccggtttaagacatttttgctcgactccgattacgaacgcttagagcacggcaccctgttcgatgacaaaggcgagaagcatgccaaaaagggcgtctgcatctgggaatgcattgataggatgcacaaacgcagtccaatcttcttcaattatctctacagtccactcgaaatcgaggcactgaaacctaatgtgaacgtcagtagcctaaagaagtgggactactacattgaagagactctatctaccgggccaagctatgactggatgatgttgacccccaaacacttccccagcgaggacagtgatttggccggcgaagccggaccaagaagccagcgccggaccgtgtggccttgctacgatgacgtgagttgcactcagcctgatgccttaactagcctgttttctgagatcgagaagcttgaacataagctgaaccaggcccctgagaaatggcagcagctgtgggagcgggtcacggtcgacttaaaggaggagcccaggacagatcgcagccaacgtcatttaagtcgtagtcctggaattgtgagtacgaatctcccgtcctaccaaaagagatcactcttacacctgcctgactcctccatgggcgaggaacagaacagctcaatatccccaagcaacggcgttgagagacgagcagcaaccctatattcccagtataccagcaagaatgacgaaaatcgctcctttgaaggaaccctatacaagcggggcgcactgctgaaggggtggaagccccgatggttcgtgctagatgtgaccaaacaccagctgcgctactatgattctggtgaagataccagctgtaaagggcatatcgatttggctgaagtcgaaatggtcattcctgccggaccatcaatgggggccccaaagcacacttcagacaaagccttcttcgatctgaaaacatctaaacgcgtgtataacttctgcgcacaggacggtcagagcgcccagcagtggatggacaagatccagagctgcatctccgatgcgtag

SEQ ID NO: 134081 - DNA, 4791 bp, Artificial Sequence
  Description of Artificial Sequence: Synthetic coding sequence
atggagtctagggaaaccctcagttcctcacgtcagcgcggcggcgagagtgactttctgccggtttcgtccgcaaagcctcctgccgcccctggctgcgccggcgaacccctgctatctacccctggcccggggaagggaattccagtcgggggcgaacgcatggaaccagaggaggaagacgaactgggttcaggtcgggacgttgattctaatagtaatgccgactccgagaaatgggttgccggcgatgggcttgaggagcaggagttctccatcaaggaagcgaacttcaccgagggcagccttaaattgaaaatacagacaacaaagagagcgaaaaaaccgcctaaaaatttagagaattacatctgtcctcccgagataaagattacaattaagcagagtggcgatcagaaggtgagtcgtgcaggtaagaacagtaaggctaccaaggaagaggaaagatctcacagcaagaagaaactgctcactgcgtctgaccttgccgcctcagacttgaaaggtttccaaccccaagcgtatgagcgtcctcagaaacacagcaccctacattatgatacaggcctcccccaggatttcacaggtgataccttgaagcctaagcatcagcagaaatcctccagccagaatcatatggattggtcaacgaactctgactctggtccagtgacccagaactgcttcatttcaccagaatcagggagagagacagcttcaacaagcaagatccctgcacttgagccagtagcaagcttcgcgaaagcccagggcaagaaagggagcgctggaaatacctggtctcagctatccaacaacaataaagacttgctcctggggggcgtcgccccttctccttcctcacattcttcgcccgctccgccgagctcatctgctgaatgtaatggactccagcccttagtcgaccaggacggcggaggcacaaaagaaccaccggaaccccccacagtgggctcaaagaaaaagagcagcaagaaggatgtcatctcacagacaatccctaatcccgatctcgattgggtgaaaaacgcccagaaggcctttgataacaccgagggaaagagggaggggtacagtgcagattctgcccaagaagcttcacccgcccggcaaaacgtatctagtgcctctaatcctgaaaacgattcttcccacgtgaggataactatccctattaaggccccctcgctagaccctacaaaccacaaacggaagaagcgtcagtccatcaaggcagtggtcgagaagatcatgcctgaaaaggcacttgcaagtggtatcacgatgtcatcagaggtagtaaacaggatcctctctaattctgagggcaataagaaagatccacgagtgcctaagttatctaaaatgatagagaacgaatcgcctagcgtcggactggaaaccggaggaaatgcggagaaagtgatcccaggcggcgtttctaagcccagaaaacctcctatggttatgacgcccccgacatgtaccgaccatagtccttccagaaagcttccagagatccaacaccccaagttcgccgccaagcggagatggacttgttccaaaccaaagccgtccaccatgctgagagaagccgtcatggcaaccagtgacaaactgatgctcgagcccccaagtgcctaccctatcacccccagctcacccctgtatactaacaccgactctctgaccgtcattacccccgtgaaaaaaaaacgggggcgcccgaaaaaacagcctctgctaactgtggagaccattcatgagggaacatccacatctccagtcagtcccattagcagagagtttcctgggactaaaaaaaggaagagacgcagaaacctcgcaaagcttgcacaattggtacccggggaggataagccaatgtctgagatgaaatttcataagaaagtcggaaagctaggagtgctcgataagaagaccataaaaactattaataagatgaagactcttaaacgaaagaatattcttaatcaaatccttagctgtagctcatcggtcgctctgaaagctaaggccccaccagaaacttcccccggggccgccgccatagaatctaagctgggaaagcagatcaacgtgagcaagaggggcaccatatacattggcaaaaagcgaggaaggaaaccccgtgcagaactgccccctccatccgaggagcccaagaccgcaattaaacacccgcggcccgtgagttcccagcctgacgtaccagctgtgccaagtaacttccagtcgcttgtggcctcctcacccgccgctatgcacccactaagcacacaacttggggggtcgaacggtaatttatcaccggccagtaccgaaaccaacttctccgagctcaagaccatgcccaatctgcagcccatctcggccctgccaacaaagacgcagaaagggatccattccggcacttggaagctgtcgccacccagactcatggcgaattctcccagccatctctgcgaaatagggagtcttaaggagatcacgctgtctcccgttagtgaaagccattccgaagagaccattcctagtgattcaggaataggcacagacaacaattccacatccgaccaggcagagaagagtagtgaatcacggaggagatactcctttgatttttgctccctggacaatcccgaggcaatcccatctgacaccagcaccaaaaatcgacacgggcacagacagaagcacctcatcgtagataacttcctggctcacgaatcgcttaagaagcctaaacacaagcgaaaaaggaagtcgctccagaatagagacgatttacaatttctggcagacctggaggaactcatcacgaagttccaggtttttaggatcagccaccgctcatacaccttttaccatgaaaatccctacccaagcatctttagaatcaatttcgatcattactatcccgtcccctacattcagtacgacccattactctatctaagacggacgtccgacctcaagtcaaaaaaaaaaagggggagacctgccaaaacaaatgatactatgactaaggttcccttcctacagggcttttcctatccgattcccagcgggtcctactacgcaccgtacgggatgccgtatacctcaatgccaatgatgaacctgggttactatggccagtaccccgcacctttatacttatcccatactctaggagctgcttccccctttatgcgacccactgtgcctcctccccaattccacacaaactctcatgtaaagatgtctggcgcagccaagcacaaagccaaacacggcgtgcatttgcaagggcctgtcagtatgggcctgggggacatgcagccaagtctcaatccgcccaaagttggctcggcctcactgagctcgggccggcttcataaacgaaaacacaagcacaaacataaacacaaggaggatcggatcttaggaactcatgataatctgagtgggctctttgctgggaaagctaccgggttttcaagtcacatcctgagcgagcgattgagcagtgcagataaagagctacctctagtgtctgagaagaacaagcataaagagaagcagaagcatcaacattccgaagccggacataaagctagcaagaacaattttgaggtcgatacactttcaaccttgtccctttccgatgcccagcattggacgcaggccaaagagaagggggacctgtcctctgaacctgtggactcatgcaccaagagatactctggctcaggcggggacggtggaagtacacggtcggagaacctcgacgtgtttagtgagatgaatcctagtaatgataaatgggattccgatgtgtcaggatctaagagaaggtcatacgaggggttcggcacataccgcgaaaaagacattcaggccttcaagatgaataggaaggagcggtcttcctatgacagcagtatgtctccgggcatgccgtctccacacctgaaggtcgaccaaaccgcagtacacagtaaaaatgaagggagcgtcccaactatgatgaccagaaaaaagcctgcagcggtggatagcgttaccatcccgcccgcccccgtcctatctctgctcgccgcgtccgccgctacaagtgacgcagttgggagcagcctaaagaagagatttaagcgacgagaaatcgaagcgattcagtgcgaagtgaggaagatgtgcaattatacaaagattttgtcgactaagaagaacttggatcacgtcaacaagatcttgaaagcaaaaaggctgcagcgccagtccaaaacaggtaataattttgtcaaaaagcggagaggccggccccgcaagcagcccacccagtttgacgaagattcccgggaccagatgcccgtccttgaaaaatgcattgacttaccgagcaaaagaggccagaaaccaagcctcagcccactggtgcttgaacctgccgcctcccaagataccatcatggcaaccatcgaagcggtaatccacatggcacgtgaggcccctccactgcctcccccccccccccctccgctcccgccgcctcccccgccacccttaccaccaccgccgccccttcctaagactcccagagggggaaagaggaaacacaaacctcaggcccctgctcaacctccccagcagtcccctccgcagcagcctctccctcaggaagaggaggtcaaagcgaagagacagcggaaatcccggggctctgagtcagaggtgctcccctag

SEQ ID NO: 134082 - DNA, 729 bp, Artificial Sequence
  Description of Artificial Sequence: Synthetic coding sequence
atggagagtagggaaactctgtcaagctcaaggcagagaggaggcgagtccgatttcctaccagtgtcttccgctaaacctccagccgctcccggctgcgcaggcgaaccgcttctgagtacaccaggccctgggaaaggcattcctgtgggcggcgaacgaatggaaccagaagaggaagatgagctgggctctgggagggatgtggattctaattccaatgcagatagtgaaaagtgggttgctggcgatggattggaggaacaagaattcagcattaaggaagcaaacttcaccgaaggttcacttaagctgaaaattcaaaccactaagagggccaagaagccgccaaaaaacctggagaattatatttgccctccagagatcaaaattacaatcaagcagagtggtgaccaaaaggtgtccagagccggcaaaaacagtaaggccaccaaggaggaagaaaggagccactccaagaagaaactcttgactgccagtgacctcgcggcttccgatctgaagggctttcagcctcagataaaggacagctccaaggaagaggtgtggaagaggcggggaggccagggaatcccgtttaaaaaacagttcttgagtcaggagcgtgcaatgtgcttctcctgtccacggaatccgttccccgcaaagcctgggtcactgaccctgccattccattccgagccagccgtatgggcacaagaagtgtag

SEQ ID NO: 134083 - DNA, 414 bp, Artificial Sequence
  Description of Artificial Sequence: Synthetic coding sequence
atggagagcagggaaaccctgtcctcttctcgccagagaggaggcgagtccgatttcctccctgtgtcaagcgcgaaacctccagcggctcctgggtgtgctggggagcccctcctcagtacgcctggccctggtaaggggattcccgtgggaggagaacgcatggaacctgaggaagaggacgaattaggctcgggccgggacgtcgactctaattcaaacgccgactccgagaaatgggtggccggagacggcttggaagaacaggaattctccatcaaggaggcgaatttcaccgaaggctcattgaagctgaagatccagactaccaaaagagctaaaaaaccccccaaaaacctggagaactacatctgccccccagagatcaaaattactattaaacagtctggatag

SEQ ID NO: 134084 - DNA, 2055 bp, Artificial Sequence
  Description of Artificial Sequence: Synthetic coding sequence
atgttcgcagaggccgccaagaccacccgtccctgcggcatggcggaattcaaggaaaaacctgaggcccctacagagcagctggatgtcgcatgcggccaggagaatctccctgtaggcgcgtggcctcctggagcagctccagccccattccagtacacccctgaccacgtggtaggaccaggagccgatatagacccaacacaaatcacttttcccggctgcatatgcgtaaagaccccatgcttgcccggcacatgctcttgtttgcgacatggagagaactacgacgataattcctgcctcagagatatcgggagtggcggaaagtacgccgaacctgtcttcgagtgtaatgtgctgtgcagatgctctgaccactgccggaaccgggtcgtgcagaagggactccagttccacttccaggtgtttaagacccacaaaaaagggtggggactcagaaccctggaatttatccctaagggccgtttcgtctgtgaatacgcaggtgaggtgctgggtttttcggaggttcaacgcaggattcacttacagaccaaaagcgactctaattacattattgccattcgagagcatgtttacaatggccaggtgatggagacgttcgttgatccaacatatattggcaacattggcagattcctcaaccattcttgcgagccaaatctgcttatgatccccgtgcgaattgacagcatggtcccaaagctcgccttattcgctgcgaaagacattgtacccgaggaggagttgtcctatgattactctggcaggtacctaaatctcactgtctccgaggacaaagaaagattagatcacggcaagctacggaagccctgttactgtggcgccaagtcatgtactgccttcctgccatttgattcaagcttatactgtcccgtggaaaaatcgaatatctcatgcggaaacgagaaggaaccctcaatgtgtgggtccgccccaagtgtcttcccaagttgcaagcgtctgacccttgaaaccatgaagatgatgttggacaagaaacagattcgggccatttttttatttgaatttaagatgggcaggaaggccgctgagactaccaggaatatcaacaacgccttcggccccgggaccgcgaacgagaggacagtccaatggtggtttaaaaaattttgtaaaggggacgagtctctggaagacgaggagaggagcggtagaccaagtgaggtggacaatgaccagttgcgcgccatcattgaggccgaccctctgactacaacgagggaagtagcggaagagctgaacgtcaaccactctactgtggtgcgtcacctgaagcagatcgggaaggttaaaaaacttgataagtgggtgccacatgaactaaccgaaaatcagaagaaccgaagattcgaagtgtcgagctccctgatcctccgcaatcataacgagcccttcctcgatcgcattgtaacttgcgatgaaaagtggatcttgtacgacaaccggagaagaagtgcccagtggctggaccaggaggaggctcccaaacatttccctaaaccgatcctgcatccaaagaaggtgatggtgacaatttggtggtcagccgccggtctgatccattacagtttcctgaatcccggagaaacaatcacttcagagaaatacgctcaagaaatcgatgagatgaaccaaaagcttcaacgcctgcagctcgcactggtaaaccggaaaggccccatcctcctgcacgataatgccaggcctcacgtggcacaacctaccctacagaaactgaatgagttaggatatgaggtgcttcctcacccaccctacagccccgatcttttgcccacaaattatcatgtatttaagcacctgaataactttctgcagggcaaacgatttcataaccagcaggacgccgagaacgccttccaggagttcgtagaaagccagtcaactgatttttacgctacaggcatcaaccaactgatttcacggtggcagaagtgtgtggactgtaacgggagctacttcgattag

SEQ ID NO: 134085 - DNA, 1098 bp, Artificial Sequence
  Description of Artificial Sequence: Synthetic coding sequence
atgtttgctgaagccgctaaaaccaccagaccgtgcggcatggccgagtttaaggagaagccagaggcaccaactgagcagctcgacgtggcctgcggccaggaaaatcttcccgtaggggcttggcctcccggagccgcacccgcccctttccaatatacgccagaccacgtcgtcggcccaggggcagatatagaccctactcagatcacgttccctgggtgcatttgcgtgaagacaccctgcctgccaggtacgtgttcttgcctcaggcacggagaaaattatgatgataatagttgcctgagagacatcggctccggaggcaaatatgctgaaccagtcttcgaatgtaacgttctttgtaggtgctccgatcactgcagaaaccgggtggttcagaagggactgcaattccacttccaggtcttcaaaactcataagaaaggctggggcctgagaactctggaattcatccctaaagggaggttcgtttgcgaatacgcgggcgaagtgctcgggttcagcgaggttcagaggcgcatccacctgcagacaaaatccgactctaattacatcattgctatccgggaacatgtgtataatgggcaggtaatggagacgttcgttgatcccacatatatcgggaacatcgggcgcttccttaaccatagctgcgaaccgaaccttctcatgattcccgtgaggattgattctatggtgcccaagttggcactctttgccgcaaaggatatcgtgcccgaagaagaactttcttacgattacagcggacggtacctaaatctcaccgtgagcgaggataaggagcgtctggatcacggcaaactcagaaagccgtgttactgcggagccaaatcgtgcactgccttcctgccattcgattcctctctctattgtcctgtggaaaagagtaacatctcatgcgggaatgaaaaggagccatccatgtgtggaagtgcaccctccgtattcccctcgtgtaaacgactcactttggaggtgtctctttttagtgacaaacagttggctcccccctattccggcaggcaatggctggcatcttttactagcgcatag

SEQ ID NO: 134086 - DNA, 516 bp, Artificial Sequence
  Description of Artificial Sequence: Synthetic coding sequence
atgttcgctgaggccgccaagacgacgaggccctgcggcatggccgagttcaaggaaaagcctgaggctccgactgaacagttggacgtggcatgcgggcaggagaacctccccgtcggtgcttggccacccggcgcagctcccgctcctttccagtataccccagaccacgtggtcgggcccggtgcagacatcgatcctacacagatcacttttcctggttgcatttgcgtgaaaaccccatgcctgcccggcacctgttcctgtttacgccatggagagaattacgatgataacagctgcttgcgggatatcggctcagggggtaaatatgcagagccggttttcgaatgtaacgttctatgtcgctgttccgatcactgccggaacagagtggtgcaaaagggtctgcagttccatttccaggtgtttaagactcacaagaaggggtggggcctcagaaccctggagttcattcctaagggccgcaaggtggaacaccagctatggaagtag

SEQ ID NO: 134087 - DNA, 1101 bp, Artificial Sequence
  Description of Artificial Sequence: Synthetic coding sequence
atggactcagatgacgaaatggtcgaagaggcagtcgaaggtcaccttgatgacgacggattgccccatgggttctgcaccgtgacatatagttcaacggatcggtttgaagggaattttgtgcacggcgaaaagaacggccgcgggaagttttttttctttgatgggtctaccctcgaaggatattatgttgacgatgccctccagggccaaggagtgtacacttatgaggatggcggcgtcctgcagggtacctatgtggatggcgagctgaatggccccgcacaggagtacgatactgacggacgattaatattcaagggtcagtataaagataatatcagacacggagtatgttggatttattatcccgatggcggatccttggtcggcgaggttaacgaggatggggaaatgacaggcgagaaaatcgcctacgtttatccagatgagcgcaccgcgttgtatgggaaatttatcgacggcgagatgatcgaggggaaactggcgaccctcatgtccacagaggaagggcggcctcatttcgaacttatgccgggtaacagtgtctaccactttgacaagagcacatcgtcctgcatctctactaatgccctgcttccagacccctacgagtcagagagagtgtatgtagcagagtctttaatctctagcgcaggcgaggggctattcagcaaggtggctgtgggtccgaacactgtcatgtctttttacaacggggtcagaattacacaccaagaagtggattccagggattgggcgcttaatggcaataccttgagcttagacgaagaaacagttattgacgtgccggagccgtataatcatgtctctaaatactgtgccagcctgggacataaagccaatcacagtttcacccccaactgcatctacgatatgtttgttcatcccagatttgggcccatcaaatgtatccgcactctacgggccgtggaggccgatgaagaactgacagtcgcctacgggtacgatcattcacctcctggcaaaagcgggccagaagccccggaatggtaccaagtggaactcaaagcctttcaagccacgcagcagaagtag

SEQ ID NO: 134088 - DNA, 5124 bp, Artificial Sequence
  Description of Artificial Sequence: Synthetic coding sequence
atggatcaggagggcggaggagatggacagaaagccccctcgttccagtggcgcaattataagctgatcgtggatcctgccctggatcctgctcttagacgtcccagccagaaagtctacagatacgatggagtgcactttagtgtgaatgacagcaagtatatcccagtggaggacttgcaggaccctcggtgccatgttcggagcaagaacagagacttttccttgcctgtccccaaattcaagcttgacgaattttatataggtcagattccactgaaagaagtgacgttcgcacgccttaatgacaacgttcgggaaacctttctgaaggacatgtgcaggaaatacggcgaggtcgaagaagtggagatcttgctccatccacgaacacggaaacacctgggactagctagagtcctgttcaccagtactaggggagccaaagagactgtgaagaatctacatttgacatctgtgatggggaatatcatccacgctcagctagacattaagggccagcaaagaatgaaatattatgaactgatcgtgaacggttcctatacaccacagactgttcctacagggggcaaggctctatctgaaaagtttcaaggatcaggggctgcgactgagaccgcagaaagtcggagaaggtcctcctccgacacagctgcttatccggcaggcacaacagcagtcggcactccgggaaacggcaccccttgtagccaggacacctcattctcctcatccagacaagacacaccctctagtttcgggcagtttaccccccagtcatcacagggtacaccttacaccagccgcgggagcacgccctactcacaggacagcgcttatagctcaagcactactagcacgtcttttaagccccgtaggtcggaaaattcttatcaagatgcattctcacgaaggcacttctcagcgagctccgcgagcactaccgccagtacagcaatagctgctacaaccgctgcaacagccagtagcagcgcctcttcatccagtctgagttcttctagtagctccagttcttcctcctctagctcccaatttagaagctcagacgcaaattacccggcgtattacgagtcttggaacagatatcagcggcacacctcttatccacccagacgggctactcgcgaggaaccacccggcgccccgttcgccgagaataccgctgaacgctttccaccctcatacacctcatatctgccgcctgaaccctcaaggcccaccgatcaggactatcgccctccggcttcagaggccccccctcctgaaccgccggaacctggaggcggtgggggcggagggggtccatccccggagcgagaagaggtcagaacatcgccaagaccagctagcccagcaagatccgggtccccagcccccgagacaactaacgaatccgtgcccttcgcgcagcactcttcattagatagccggatcgagatgctgctgaaggaacagcgctccaaatttagcttcttggcctctgatactgaagaggaagaagaaaacagctcaatggtgctcggggcacgcgacaccggttccgaagtgccatccggaagcgggcatgggccctgcacccccccaccggcaccggccaacttcgaagacgtggctcccaccggatctggagagcctggagctactagagagagtcctaaggcaaatggccagaaccaagcgtcaccttgttcatccggcgacgacatggaaatcagcgacgacgatcgcggcggcagccctccgcccgccccaacccctcctcagcagcctccgcccccacctccccctccacctcccccacctccttatctggcaagcttgccattgggatacccaccacaccagcctgcttacctgctgccgcccaggccagacggaccaccaccgccagaatacccccctcctcctccaccgcctccccacatttacgactttgttaacagtttggaactgatggatagactgggggcacaatggggcggcatgcccatgtccttccagatgcaaacccagatgctgaccagacttcaccaactgagacagggcaagggtctgatagcggccagtgccggacctccgggaggagcgttcggcgaggccttcctgccctttcctcctccccaggaggctgcatatggattgccctatgccctgtacgctcagggccaagaaggtcggggcgcctattcgcgcgaggcttatcacctgcccatgcctatggcggctgaaccccttccctcgagctcagttagcggggaggaggccaggctgcctccccgagaggaggcagaattggcagagggcaagacactgccaacggcaggcaccgtaggacgtgttcttgcgatgctggtgcaggagatgaagtccatcatgcaacgcgatttaaaccggaagatggttgaaaacgttgcatttggcgccttcgaccagtggtgggagtccaaagaggagaaggcaaaaccatttcagaacgctgcaaaacaacaagcaaaggaggaagataaggaaaagacgaaactcaaagaacctggcctcttatcattagtggactgggctaagtctggtggcactaccggaatcgaggcgtttgctttcggttctggtttacgcggcgctctacgacttccttccttcaaagtgaagcggaaagaaccctctgagatatcagaagcctcagaggagaagaggccccgacccagtactcctgccgaggaggacgaggatgatcctgagcaggagaaagaggctggcgagccgggccggcccggcaccaagccgccgaaaagagacgaggaacgcgggaagactcagggcaagcacaggaaatccttcgcgcttgacagcgagggcgaagaggcttcccaggaatcaagcagcgagaaggacgaggaggatgacgaggaagacgaagaggacgaggacagagaagaggctgtggatacaaccaagaaagaaactgaagtgtctgatggcgaggacgaggaatcggacagttctagcaagtgctcactctacgctgactcagatggcgagaacgactcaacatcggactccgagtcctcttcgtcttcatcatcttcctcatcaagttcgtcaagtagtagcagttcttcatcctcaagcagtagtgagtcaagtagcgaagatgaagaggaggaggagcggcccgcagccctgccatctgcctccccaccaccccgtgaagtgccagtgccaacaccggctcctgtcgaggtacctgtgcccgaaagagtcgccgggagccctgtgaccccattaccagagcaggaggccagtcctgcaaggccggctggcccaacggaagagtcccctccctcagcgccgctgcggccacccgagcctccggctggacccccagcccccgctcctcggcctgatgaacgcccctctagtcccatccctttgttgccaccccctaagaaacggagaaaaactgtcagtttttctgcgattgaggtagtgcctgctccggagcctccacccgccacaccacctcaggccaagttccccggacccgctagccgcaaagcgcctcggggggtcgagcgaacgatccgcaacctgccactggaccacgcctccctggttaaaagttggcctgaggaagtttctcggggtggcaggtctagagccgggggacggggccggctaacagaggaggaagaggcagaacctggcactgaagtggatttggctgttctcgcagacttagcactgactccagctcgccgcgggttacccgccttaccagccgtcgaggacagtgaggccacagaaacaagcgacgaggccgagaggccacggcctctgctgagccacatcctgttagaacacaattacgccctggcagtgaagcctactccgcctgcgcctgctctgcgcccccccgaacctgtgccagcccccgcggcattgttcagctcccccgcggacgaggtcttggaggcaccagaggtggtggttgctgaggccgaggagcccaaacctcaacagcttcagcagcaacgtgaggaaggtgaagaagagggggaagaggagggagaagaggaggaggaagagtctagcgatagctcatcttcctctgatggcgagggagcattgaggcgcagaagccttcgatcccacgcaaggaggcggaggccaccccctcctccaccgccccccccaccaagggcttacgagcccaggagcgagtttgagcagatgacaatcctttacgacatttggaattccggactcgactctgaggacatgtcctatcttagattaacgtacgagcgactgctgcaacagacctctggagcagactggctcaatgacacccattgggttcaccataccatcacaaatcttacaacccccaagagaaaaaggcggcctcaggacggccctcgagagcaccagactggaagcgcaaggagcgaagggtactacccgataagtaagaaggaaaaagacaagtatttggatgtctgccctgtgtcggcccgtcagctcgaaggagttgatacccaggggacaaatagggtcctgagcgaacggagatctgaacagagaaggctattatctgccattgggacgagtgccattatggactcagatctgttaaaactgaatcagctcaaatttcggaaaaaaaagctcagattcggccgttcccgaatccatgaatgggggctgttcgcgatggagcccatcgctgcagacgagatggtgattgagtatgtaggtcagaatatcagacagatggtcgcagacatgagagaaaagcgctacgtgcaggaaggcataggtagcagttatctgtttcgggtcgaccacgataccatcatcgatgcaactaagtgtgggaacctcgcgagatttattaatcattgttgcaccccgaattgctacgccaaggtgattacgatcgagagccagaagaagattgtaatctactccaaacaacctatcggggtcgatgaagagatcacctatgactacaaattccccttagaagacaataaaatcccttgtctgtgcggtacagagagttgtcgagggtccttgaactag

SEQ ID NO: 134089 - DNA, 213 bp, Artificial Sequence
  Description of Artificial Sequence: Synthetic coding sequence
atggaccaggaaggaggtggagacggacaaaaagcgccatctttccagtggcggaactacaaacttatcgtggacccagccttagatccagctttgcgcaggccctcccaaaaggtttaccgctatgatggagttcacttctccgtgaacgacagtaagtacattcctgtcgaagacctccaggaccctaggtgtcacgtgcggtccaagtag

SEQ ID NO: 134090 - DNA, 744 bp, Artificial Sequence
  Description of Artificial Sequence: Synthetic coding sequence
atggatcaggaaggcggaggagacggacagaaggccccttcttttcagtggagaaattataagctgatcgtggatcccgcattggacccagctctaaggcgcccatctcagaaagtttatagatacgacggagtgcacttcagcgtgaacgattccaaatacattcctgtcgaagacctgcaggatccaaggtgtcacgtgagatcaaaaaacagggatttctctctgcctgttccaaagttcaaattggacgaattttatattgggcaaattccgctgaaggaagtgacattcgctcggctgaacgacaatgtgagggagacattcctaaaagacatgtgtcgaaagtacggggaagtggaggaggttgagatcctcttgcaccctcggacacgaaaacatctcggcttggctcgagtactgttcaccagcacacggggcgcgaaagagaccgtgaaaaacctgcacctgaccagtgttatgggaaatataatccacgctcaactggatataaaaggtcaacaacgaatgaaatactacgagctcatcgttaacgggagttataccccccagactgtccctactggggggaaagcattgagcgagaaattccagggcagcggagctgccactgagaccgctgagagcagacgtcgcagctcttccgacactgcagcttatcctgctggaactactgcagtgggaacaccaggtaacggtaccccatgttctcaagacacgtag

SEQ ID NO: 134091 - DNA, 5772 bp, Artificial Sequence
  Description of Artificial Sequence: Synthetic coding sequence
atggagaattcccacccaccgcaccaccaccatcaacagccgcctccccagcccgggccctccggagagcggaggaatcaccattggagatcgtacaagctgatgatcgacccagccctcaagaaagggcatcacaaactttataggtacgacggccagcactttagccttgcgatgagcagcaacagaccagttgagatagtcgaggatccaagggtagttggaatctggaccaaaaataaggaacttgaactcagcgtcccgaaattcaagatcgatgaattctacgtgggaccagtgccaccaaaacaagtcacattcgcaaaactcaatgacaatatccgcgaaaacttcctgagagatatgtgcaaaaagtacggagaggttgaggaggtggaaattctgtacaaccctaagacaaaaaagcacctgggtattgctaaggtcgtgtttgctactgttagaggggcaaaggacgcggtgcagcatctgcactccacttccgtcatgggtaacatcatccacgtggagttggataccaagggtgagactaggatgcgcttttacgaacttttggtgaccggccgctatacaccacagaccttaccagtgggagagctcgacgctgtatctcctattgttaatgaaaccctgcaactctccgacgcactgaaacggcttaaagatggaggcctttccgccggatgtggatcagggagcagttccgtgacaccaaactccggcggtacacccttcagtcaggacacagcctactctagttgtcgactggatacgccgaattcctatggccagggaacccccttgaccccgcggctgggcacaccttttagccaagattcctcatattcatcgcggcaaccaaccccgagctacttattttctcaagatcccgccgtcacatttaaagcgagacggcacgaatcgaaatttactgacgcatacaaccggcggcatgaacatcactacgtgcacaattccccagccgtgaccgcagtcgcaggggcaaccgctgcattccggggaagttcagaccttccttttggcgccgtggggggtacgggagggagctcaggcccccctttcaaggcccagccccaggatagcgccacattcgctcacaccccacctccggcacaagcaaccccggcccctggatttaagtccgccttctctccatatcaaacaccagtggcccacttcccgcctccccccgaggagcctacagcaacggccgcctttggtgcacgtgactctggagaatttaggagggccccggctcccccaccgttgcctccggctgagccactggcgaaggaaaagcccgggactcctcccggcccccctcccccggatactaactccatggagctgggagggcgccccaccttcgggtggtctcccgaaccgtgtgattcccctgggacccccacgctcgagagcagcccagcaggacccgaaaagcctcacgactccctggacagccgaattgaaatgctgttgaaggaacagcgcacgaagttgctcttcctgagggaacccgactctgatacggagctacagatggagggaagtcctatctcctcttcctcctcacaattgagccccctggcaccttttggaactaacagccagccagggttcaggggccctactccaccgagcagccgcccatcatcaactggtctcgaggacatctcccccacccccctgccagactctgacgaggacgaggagctagacctaggcctgggcccacggcctccaccagaacctggaccgcctgatcctgcggggttactgtcccagaccgccgaagtggctctcgacctcgtgggagacaggacgcctacctcagagaagatggacgaagggcaacagtcttcgggcgaagacatggagatctcagatgacgaaatgcccagcgccccaattacttcagccgactgtcctaagcctatggtcgtaacacccggcgccgcagccgtggcagctccatcagttctggcaccaactttgcccttacccccaccccccggatttcccccattgcccccaccccctccaccccctccaccacagcctggatttcccatgcccccgcccctcccaccaccgccccccccacctccacccgctcaccccgcagttacggtacctccccctccactgccagctcctcctggtgtcccacctcccccaattctgcctcctttacctcccttccctccaggcctttttccagttatgcaggtagacatgagccacgtgctcggcggccaatggggcggtatgcccatgtcattccaaatgcagacccaggtgttgtctaggctaatgacgggacagggcgcttgcccctacccccccttcatggctgcggccgcagccgcggcctcagctggcttgcagtttgtgaatttacctccatatcgggggcccttttccctatcaaattctggaccgggacgcggtcagcactggcctcctctgcctaagttcgacccatctgtgcctccccctgggtacatgccccgtcaggaggaccctcacaaggcgaccgtcgatggcgtgttgctggtcgtcttgaaggagctcaaggccatcatgaaacgagacctcaaccgtaaaatggtcgaagtggttgcctttagggccttcgacgagtggtgggacaagaaagaacgcatggccaaagcctcccttacccctgtcaaaagtggggagcacaaggacgaggatcgaccgaaacccaaagaccgtatagcttcgtgcctcctcgagagttggggaaagggggaaggcctgggctacgagggtttagggctgggaatcggactgcggggagccataagactgcctagctttaaagtaaaaaggaaggaacctcctgacaccacgtcatccggtgaccaaaagaggttgcggccatctacctccgttgatgaggaagacgaggagtccgaacgtgagcgggatcgggacatggcggacaccccctgcgagctagccaaaagagatccaaagggggtgggcgttcgaaggcgccctgcccggcccttggaactggatagtggtggcgaagaagatgagaaagaatccctcagcgaagagcaagagagcactgaggaagaggaagaggccgaagaggaagaagaggaagaggacgacgacgacgacgatagtgatgatcgcgacgaaagcgaaaacgacgacgaggatacagctctgagtgaggcttccgaaaaggacgagggagattcggacgaagaagagaccgtgtccatcgtaaccagcaaggccgaggctacgagctctagtgagagcagcgagagtagcgaatttgaatcatcttctgaatcaagtccatcctcgagcgaagatgaagaggaggtggtggcacgggaggaagaggaagaagaggaggaagaagagatggtggcagaagaaagcatggctagtgcagggccagaagacttcgaacaggacggtgaagaggcggctctggccccaggagcccctgccgtggactctctgggaatggaagaagaggtggatatcgaaaccgaggccgttgctcctgaggaaagaccatctatgcttgatgagccacccctgcccgtgggagtagaagaacctgctgatagccgggaacctcctgaggagccgggactcagtcaggagggagcaatgctcttgtctccggagcccccagcaaaagaagtggaagctcgcccaccactgagccctgaacgtgccccagaacacgatttggaggtagagccggaaccacctatgatgctgccactgccccttcagccccctctgcccccccctagaccccctcgaccaccgtcgccaccccctgaaccagagactaccgatgcatcacacccctctgttcccccagagccactggccgaggatcaccctccccacacacctggcctgtgcggttctctcgctaagtctcagagcactgagacagtacccgcgactccgggcggcgagccccccttgtccggcggtagtagcggcctgtctttgagcagtcctcaggttcccgggtcaccattttcatatcctgcaccaagcccttctctgtcaagtggcgggctgccgcgaaccccagggcgggacttttcctttacccctacttttagtgaaccatcgggtcccctgcttttgcctgtgtgccccctgccaaccggcagacgagacgaaagaagtggtcctctagccagcccagtactgcttgagacagggctccccctgcctttgcctttgcccctgcccctccccttggcccttccggccgttcttcgcgcccaggctcgggctcctactccactgcccccactcctgccagcaccactcgcttcctgtccgccacccatgaagaggaaacccggtagaccacgacgctctccaccctcaatgttgtctctggacggtccactcgtcaggccacccgccggcgcagccttgggacgggagttgctgctcctgccaggacagccccagacgccagtctttccttcaacccatgacccccgaactgtgactttagacttccgcaacgccggtataccggccccaccgccacccttgcctccccaaccaccccccccacccccgccacctcccgtcgagcctaccaaactgccattcaaagagctggataatcagtggccttctgaggcgattcctcccgggcctcgcggcagggacgaagtgacagaggagtatatggagctcgctaaatctcgagggccgtggagaagacctcctaaaaagcgtcacgaggatctggtgcctccggccggctcaccagagctgagccccccccagcctctcttccgccctagatcggaatttgaggagatgaccatcctgtacgatatctggaacggcgggatagatgaggaggatatcaggtttttgtgtgtcacctatgaacggctgctccaacaggacaatggcatggattggttaaatgacactctgtgggtgtatcacccctctacttctctttcctccgcaaagaagaagaaacgggacgatgggatacgtgaacacgtcacgggttgcgcaaggagcgaagggttctacacaattgataaaaaggataagctgcggtatcttaacagttctagggcctccacagatgaaccacctgctgatacccagggaatgtccatacctgcccagcctcatgcttccacccgcgctggcagtgagagacggtccgaacaaagacgactcctgtcctctttcactgggtcttgcgacagcgatctgctgaaattcaatcagctgaaatttcggaagaagaaactgaaattttgtaaaagccacattcacgactggggcctttttgctatggagcccatcgccgcggacgaaatggtcatcgagtatgtggggcagaatattcgccaagtcatagccgacatgagggagaagcggtacgaggacgaaggaattggaagttcctacatgttcagagtagatcatgacaccattatagacgcaacaaagtgtggaaactttgcccgttttattaaccacagctgtaaccccaactgctatgcaaaggtgattaccgtggaatcccaaaagaaaatcgttatatactctaagcagcacattaacgtgaatgaggaaattacatacgactacaagttcccaattgaagatgtgaaaatcccctgcctgtgtggcagtgagaactgcagaggcacactgaattag

SEQ ID NO: 134092 - DNA, 5772 bp, Artificial Sequence
  Description of Artificial Sequence: Synthetic coding sequence
atggaaaatagccatcctccccaccatcaccatcagcagcccccccctcagccaggcccctctggagagagacgcaatcaccactggcgtagctataagctgatgattgatcctgctctcaagaagggacaccacaaactttatcgatatgatggtcagcacttttctctggccatgagtagcaaccgccctgtggaaatagttgaggacccaagagttgtcggaatctggactaagaataaagagttagagctgtctgtgcccaaatttaagatcgatgagttttatgtcggtcctgttccgccaaaacaagtcacattcgccaagttgaacgacaacatcagagaaaacttcctacgggacatgtgcaaaaaatacggtgaggtcgaggaagtagaaatcttgtacaaccccaaaactaagaagcacctaggaatcgccaaagttgtgtttgccacagttcggggagccaaggatgctgtgcagcacctgcactccacctccgtgatggggaacattatccatgtcgagctggacactaaaggcgagaccagaatgcgattttatgagctgttggtcacaggccgctataccccacaaacactgcctgtgggcgaactggatgccgtgtcaccaatcgtgaatgagacacttcagttgtccgatgccctaaagcgtctgaaagatggtggcctgagtgcaggatgtggctcaggatcctcctcagtgacacccaattctggcggaacaccattttcccaggataccgcatacagcagctgcagactcgatacacccaactcttatgggcaggggacccctctgaccccaagactgggtacccccttttcgcaggattcctcttacagttccaggcagcccacgccatcctatctgttctcccaggatcctgcagtgaccttcaaagcacgccggcacgagagtaagttcacagacgcttacaatcgaagacatgagcaccattacgttcacaacagtccagctgtcacagcagtggccggcgctaccgccgctttcagaggtagttcagatcttccattcggggctgtcggcggtacagggggatcaagcggccccccatttaaagcacagccacaagattccgccacctttgctcacaccccccctcccgcacaggctacaccggcgcccggattcaagtctgccttctccccttaccagacaccagtggcgcactttccgcccccccctgaagagcctacagccaccgcggctttcggcgctcgcgattcaggggagttccggcgcgccccggcacctcctccgcttccacctgccgaacctttggccaaggaaaaaccaggcactccccccggcccacccccccccgacacaaacagcatggagctggggggtcgcccgacatttggatggtccccagagccttgtgattcccctggcaccccaaccttggagagtagtcctgccggaccagaaaagccacacgatagtttagattctcgtattgagatgctcctgaaggaacagcggaccaaacttttgttcctgagagaacccgatagcgacacagagctacagatggaagggagtcctatttcctcaagcagcagccagctgagtccactggccccatttgggacgaactcccaacctggtttccgggggcccacacctccatcctcccgaccgtcatcaaccggactggaggatattagtccaacacccctgccagatagcgacgaggatgaggagctcgatctcggcttaggtccccggcctcccccggagccaggcccaccggaccccgcgggtctcctgtcacagactgctgaagtggcattagatctagttggagaccggactcctacgagcgagaagatggatgagggacagcaaagctcaggcgaagatatggagatcagcgatgacgaaatgcccagtgctccaatcaccagtgctgattgtccgaagcctatggtggtaacaccgggggctgcagctgttgctgctccatctgtcctggcacctactctgccactgccaccaccccccggattcccaccactgcctccaccaccaccccctccaccaccgcagcccgggttccccatgcctccgccactgcctcctccacccccgcctcccccccccgcacaccccgcagtcaccgtgccacccccccctcttcccgcccccccgggtgttcctccccctcccatcctgccccccctaccccccttccctcctggcctcttccctgttatgcaggtggacatgagtcatgtgctgggcggacaatggggggggatgccaatgtcgttccagatgcagacacaggtgctgagcaggttaatgacaggacagggcgcttgtccctatccaccattcatggcagcagccgcagccgccgcctctgcgggacttcaattcgttaatctcccgccttacagaggtcccttctcactgagcaacagcggacccggccgtgggcagcactggccacctctgccaaaatttgatcccagtgtcccccccccaggatatatgccccggcaggaagacccccacaaagctaccgtcgatggtgttctgctggtggttttaaaagagctgaaagcgataatgaagcgtgacttgaatagaaaaatggtggaggtcgtagcttttcgagccttcgatgaatggtgggataagaaagaacgaatggccaaggctagcttaacccccgtgaagagcggggaacataaggatgaggatagacctaaaccaaaagataggatcgcaagttgcctacttgagtcgtggggcaagggagaaggcttggggtatgagggcttagggttggggataggcctacggggcgcaattcggctcccaagtttcaaggtgaagcgtaaggaaccacccgacacaacctcatcaggtgaccagaagcgcctacgcccttccactagcgtggacgaggaagatgaagaaagcgagcgtgagagagatcgggacatggcggacactccatgtgagctggcaaagcgggatccaaagggcgtgggtgtgagacggaggcccgcaaggccactggaactggacagtgggggcgaagaagatgagaaggagagcctgtctgaagagcaagagtctactgaagaagaggaggaggccgaagaggaggaggaggaggaggatgacgacgatgatgactcagatgaccgcgatgaaagcgagaacgatgacgaggatacggctctttcagaggcatccgagaaagacgagggggactctgatgaggaggagaccgtatctatcgtgacatctaaggcagaagcaacctctagcagcgagagctccgagagcagcgaattcgaatcctcgtcggaaagtagcccctctagcagcgaagatgaggaggaagttgtggccagagaggaggaggaagaggaagaagaagaggaaatggttgccgaggagagcatggcctcagcagggcctgaagattttgaacaagatggtgaggaagccgcactggcacccggcgctcccgcagtcgatagtctggggatggaggaagaagttgatatcgagacagaggctgtggcacctgaggagaggccgagcatgcttgacgaacctcctctccccgtgggagtggaggagccggcggattccagagagcctcccgaagaacccggcctgagccaggagggtgccatgttactgtcacccgaaccccctgcaaaggaggttgaagcccgtccccctctgagtccagagcgggcccctgaacatgatttagaggtagagcccgagccgccaatgatgctgcctctgcctttgcagcctcctcttcctcctcctaggcccccccgcccaccatcacccccacctgaaccagagacaacggacgccagccacccttccgtgcctccagaacccctggcagaagatcaccccccacatacacctggtctatgcggaagcctggccaaaagccagtccaccgaaaccgtgcctgctacacctgggggcgagcctccactgagcggaggatcatccggactgtccttatcttcaccacaagtgccaggatcgccattttcctacccagccccatcccctagcctttccagcggcggattgcccaggacgcccggccgagacttctcattcactccgactttttcagaacccagcgggcctttgttgttacccgtctgcccgttgccaaccggacgccgtgacgagaggagcgggcccctcgcatcgcctgtgctactggagaccggcctgcccttgccgctccctctgccactccctctacctctcgcactgcccgccgtgctccgagctcaggcccgagctccaacccccctgccacccctcttacccgctcctctggcctcctgcccgccaccaatgaagcggaagcccgggcggcctcggcgcagccctccctccatgctgagtctcgatgggccccttgtcagaccccccgccggtgcagctctcggtcgcgaacttctgttgctcccaggccaaccccagacacccgttttcccatccacacatgacccacgtacggttactttggactttcgtaatgcagggatcccagcgccccctccccctcttccgcctcagcctcctccccccccacccccccctccagtggaaccgaccaaactcccttttaaagagttggataatcaatggcccagtgaagccatccccccaggccctagaggacgcgacgaagtcactgaggaatatatggaactcgcaaagagccgcgggccatggcgtcgaccaccaaaaaagcggcatgaagacctcgtcccgcctgccggcagccctgagctaagtcctcctcagcccctgttccgtccacggagcgagtttgaagagatgaccattctgtatgatatttggaatggaggcattgatgaggaggacattaggtttctctgcgtgacatacgagcgcctcctccagcaagataacggaatggactggctgaacgatacattgtgggtctatcatccttcgacatcactgtcgagtgcaaagaaaaagaaaagagacgatggcattcgcgagcatgtgacaggatgcgctcggtctgaaggcttttataccattgacaaaaaagataagctgcgctacttaaatagctctcgcgccagtactgatgaacccccagccgatacccaaggcatgtccatccctgcgcaaccacatgcttccacaagggctggctcagaacgccgaagcgaacagcggcgactcctgtccagttttaccggaagttgcgatagcgatctcctgaagttcaatcagctgaaatttaggaagaagaagctgaagttctgcaagagtcatatccacgactggggcctttttgccatggaaccaatcgcagcggacgaaatggtgattgaatatgtggggcagaacattcggcaggttatcgctgacatgcgtgagaagcgttacgaagatgaaggcatcggatctagctatatgttcagagttgatcatgacactatcatagacgccacaaaatgtggcaattttgctaggtttataaaccatagctgtaatccaaactgctacgcaaaggttattacggttgaaagccagaagaagatcgtgatttactcgaagcagcatatcaatgtgaatgaggagatcacctatgactataaattccccatcgaggatgtgaagattccctgtctgtgtggttctgagaactgcaggggcactctgaactag

SEQ ID NO: 134093 - DNA, 7695 bp, Artificial Sequence
  Description of Artificial Sequence: Synthetic coding sequence
atgaaacagcttcaaccccaacctccccctaaaatgggtgacttctacgaccccgaacaccccacccccgaagaggaggaaaacgaggccaagattgagaatgtgcagaagaccggtttcatcaaagggccaatgttcaagggggtagcatcttccagattccttcccaaggggacaaaaaccaaggtgaatctggaggagcaggggcggcagaaggtctcgttctctttttctctgactaaaaagacactgcaaaaccggtttctaacagctctgggcaatgaaaagcagtcagacaccccaaacccccctgccgtgcctctgcaggtggatagcacaccaaagatgaaaatggaaattggcgacaccttgagcactgcggaagaaagttcacctccgaaaagcagggtcgagttgggcaaaatccacttcaaaaagcatttacttcatgttaccagcaggcctctgttggccaccaccaccgccgtcgcctccccgcctacgcacgctgcccccctgccagctgtgatcgcggagtccactaccgtagactcccctcctagcagtccaccaccacccccgccaccggcccaagccacgacgctttcctcaccagctcccgtcacagagccagtggccttgcctcatacacccatcacagtgctgatggctgcacctgtgcccctcccagttgatgttgccgtgcgctccttaaaggagccaccaataatcattgtacccgaaagcttggaagccgacaccaaacaagacaccatcagtaatagccttgaggagcacgtcacccagatattaaatgaacaggcagacatctcctcgaagaaggaggattcacacattgggaaagatgaggagatccccgatagctccaaaatctctctgtcctgcaagaagaccgggtcaaagaaaaagtctagccagagcgagggaatcttcctcggctccgaatccgatgaagatagtgtgaggacaagtagcagtcagagatcccacgacctgaaattctccgcatctattgaaaaagaaagagacttcaagaaaagcagtgccccgctcaaaagtgaagatctcgggaaaccatcaaggagcaagacagacagagacgacaagtacttcagctatagtaaactggagagggatacaaggtacgttagctcgagatgtcgaagtgagcgtgaaaggcgccgaagtcgatcccactcacgatccgagaggggctcaagaacaaatttaagttactctcgctctgaacgcagtcactactacgactctgatcggcgttatcacaggtcatctccctatcgagaaagaacacgatactcaaggccctatacagataaccgcgcccgcgagagcagcgactccgaggaagagtacaagaagacatattctagacggacttcttctcattcttctagttaccgggacctgcgcacttctagctatagcaagagtgacagggattgtaaaactgaaaccagttacctggagatggagagaagagggaagtactcaagtaaactggagcgggagtctaagaggacgtctgagaacgaagcaatcaaacggtgttgttcaccgcctaacgagctggggtttagaagaggctcaagttactccaagcacgatagttcggcaagcaggtacaagtccacactttctaaacctattccaaaatccgacaaattcaagaactcattctgttgcactgagctgaacgaagagattaaacagagtcactccttctcgctccaaaccccttgttctaagggtagtgagctgagaatgattaataaaaacccagaaagggagaaggcaggctctccggccccttctaatcgcttgaatgacagccctacactcaaaaagcttgacgagctccctatttttaaatctgagttcatcacgcatgactcccacgactctattaaggagctggactctttgagtaaggtgaagaatgaccagttaaggagcttttgcccaatagagcttaacatcaacggcagccccggcgcagagtccgacctggctaccttttgcacttcgaagaccgacgcagtgcttatgacttccgacgacagcgttaccggcagcgagttgagccctttagttaaggcttgcatgctaagcagtaacggatttcaaaacatctcccgatgtaaagaaaaagatctagacgatacctgcatgttacacaagaaatccgagtctcctttcagggaaaccgaacctctggtgtctcctcaccaggataagcttatgagtatgcccgtcatgactgtggactacagcaagaccgtggtcaaggagccggtggatacaagagtgagttgttgtaaaactaaggacagcgacatttactgtaccctcaacgatagtaacccttccctgtgtaattcggaggcagagaacattgaaccaagtgttatgaagatcagcagcaattcctttatgaacgtgcacttagagtccaagcctgtcatctgtgattcacggaacttgaccgaccacagtaaattcgcctgtgaagaatacaagcaaagcatcgggagcacctcaagcgccagtgtgaaccactttgatgatctgtatcaacccattggctcgagcggcattgcctcaagtcttcaatcgctaccccctggcatcaaggtggattccttgacgctgctgaagtgtggtgagaacacttcacccgtgctcgacgcagtcctcaagtccaagaaaagtagcgagtttctcaagcatgcaggaaaggaaaccatagtggaggtgggctctgacctgcctgatagtggaaaaggattcgctagccgagaaaatcgtaggaataacgggctgagcgggaagtgcctgcaggaggcccaggaggagggaaactcaatactgccagagcggagggggcgccctgagataagcctagatgagcgcggcgagggaggtcacgttcacacaagcgacgacagtgaggtcgtcttttcatcctgcgatcttaatttgacaatggaggactcagacggagtcacatacgcccttaagtgtgactcatccggacacgcacctgagatcgtgagcacagttcacgaggactacagcggctcaagcgaatcctccaacgatgaatccgattcagaagatactgatagcgacgattcttctattcccaggaatcgcctccagtctgttgtggtagtcccaaagaacagcacgttgcctatggaggagaccagcccttgctcttcccgcagcagtcagagctacagacactacagcgatcactgggaggatgagcgcctggaatctagaagacatctttacgaggaaaaatttgagagcatcgcctctaaagcctgtccacagactgataaattctttctacacaaggggacagaaaagaacccggaaattagttttacccagtcatctcgtaagcagatcgacaatcgtctcccggagttgtctcaccctcagagcgatggggtagattctacttcacatacggatgtcaagtctgaccccctgggtcaccccaatagcgaggaaactgtgaaagccaaaattccttctaggcagcaggaggaactccccatctattcatctgacttcgaggatgttcctaataagtcgtggcagcagactacattccagaatcgtccagatagtaggctgggcaaaacagaactgagttttagcagcagctgcgagatccctcatgtggatggcctccactcctccgaggaacttaggaatttaggctgggattttagccaggagaagccgtcaacaacctatcaacagccagactcctcctacggtgcatgtggcggtcataagtatcagcagaacgccgagcaatacggcggcacccgggactactggcaggggaatgggtactgggaccctaggtccggacgcccaccaggtaccggggtggtgtacgaccgtacacagggtcaagtgccggatagcttgacggacgatagggaggaagaggagaactgggatcagcaggacggatcccatttttctgatcaaagcgataaattcctgctttcattacagaaagataaaggctccgtacaggctcctgagatcagcagcaacagcatcaaggacactctagccgtgaacgagaaaaaagattttagcaagaatctggagaaaaacgacattaaggaccgtggaccgttaaaaaagagacgacaggaaattgagtcagattcggagagcgatggggaactccaggatcggaaaaaggtgagagtggaggtggaacagggggagacctcagtgccaccaggaagcgcccttgtcggaccttcatgcgtcatggacgacttccgggacccgcaacgttggaaggagtgtgcgaaacaaggaaagatgccttgctacttcgacctgatagaggagaacgtgtacctcacagagagaaagaagaataagagccaccgagacatcaagcgcatgcaatgcgagtgcacgcctcttagcaaggatgagagggcccagggcgagatcgcctgcggggaagattgcctgaatcggttgctgatgatcgaatgttcgtctaggtgccctaacggcgactactgttcaaaccgtcggttccagagaaagcaacacgctgacgtcgaggtaatcctgaccgagaagaaggggtgggggctgagggcagccaaggacctgccatctaacacttttgtcttggagtattgtggagaagttctggatcacaaggaatttaaggcccgcgtgaaggaatatgcccgaaacaagaacatccattactacttcatggccttaaaaaatgacgaaatcatcgatgccacgcagaaaggtaattgttctcggtttatgaaccactcctgcgaacctaattgtgagacccagaaatggactgtaaatggtcagcttcgggtcggatttttcacgaccaaactggtgccttctgggtcagagctcaccttcgactatcagttccagaggtatgggaaggaggcgcaaaagtgcttctgcgggagcgccaactgtagagggtatctgggcggtgagaatagagtgtccattagggcggccggcgggaaaatgaagaaggaacgctctaggaaaaaagatagcgtggatggagaactcgaagcgctcatggagaatggagagggtctgtctgataaaaatcaggtattgtcgctgtctcgtttaatggtacgaatagagacactggagcaaaaactaacctgtctcgaattgatacagaacacccatagccaatcttgcctgaaaagcttcctcgagcgccatggtctgtcactgttgtggatttggatggccgaactgggcgacgggagggaatctaatcagaaactgcaggaagaaatcatcaaaaccctggagcatctgccaattcccacaaaaaacatgctggaggagagtaaggttttgcccattatccagaggtggtcccagacaaagaccgcagtaccccctctgtctgaaggtgatggatactcctccgaaaacaccagcagggcccacacgcccctgaacacccccgaccctagcacaaagctctctacagaagctgataccgataccccaaaaaagttgatgttccgccgcctcaaaatcatctccgagaatagtatggattccgccatttcagatgcaacctcagagctggaaggcaaggacggcaaagaagatctagatcagttggaaaatgttccagtcgaggaggaagaggagctgcagagccagcagctgctccctcagcagcttcccgaatgcaaggtcgatagcgaaacaaacatcgaggcctcgaagctaccaacttcagagcctgaagccgacgccgaaatcgaaccaaaagagtccaacggtaccaaactggaggaaccaatcaatgaagaaaccccatcacaggatgaggaggagggagtgtctgatgtggaaagcgagcgaagtcaagaacaaccggacaagacggtggacatctcagatttagcaactaagttgttggacagttggaaagacctgaaagaggtgtacagaattccaaagaaatcccaaacggagaaggagaacaccaccacggagcggggacgcgatgctgtgggtttcagggatcagacaccagctcccaagacccctaacaggtcacgagaaagggacccagacaaacagacccagaacaaggagaaaaggaagaggcgcagctcactcagccctccatcttccgcttacgagcgcggaaccaagaggcccgatgaccgctacgacacccctacttctaagaagaaggttaggatcaaggatcgcaacaaactctctacggaagaaagacgtaagttatttgagcaggaggtggcacaacgggaagctcagaagcaacagcagcaaatgcagaacctggggatgacaagccccttaccttacgactcgctgggctataacgcacctcaccacccgttcgcaggatatcctccgggctacccaatgcaagcttatgtggacccttctaatccaaacgcaggaaaggtcctgttacctacgcctagcatggatccagtctgtagtcccgcaccttacgaccacgctcaaccccttgtcgggcacagcaccgagccgctctcagcccctccacccgtacctgtcgtgccacatgtggccgcccctgtcgaagtttcaagctctcagtacgtcgctcagagcgacggagtagtgcatcaggactcctccgtcgcagtcctcccggtgccggcacccggacctgtgcagggccagaattacagcgtgtgggactcaaatcagcagagtgtttctgtgcagcagcagtactccccagcgcagagccaagccacaatctattaccaggggcagacctgccccactgtgtacggtgtgaccagcccgtacagtcagacaacgcctccaatcgtgcagtcttacgcccagccatctctccagtatattcagggccaacaaatttttactgcccacccccagggcgtggtcgtgcagcccgctgccgccgtcacgaccatcgtagcccccggccagcctcaacctctgcagcctagtgagatggttgtcactaataacttactggatttaccacctcccagcccacctaaaccgaagactatagtgttacctccaaactggaagacggcccgcgaccctgagggtaagatctattactatcatgtgatcactcgccaaactcagtgggacccccctacttgggagagcccaggagacgacgcttcacttgagcacgaagccgagatggatttggggacaccaacatacgacgagaatccaatgaaggcgtcgaaaaaacctaagactgctgaagccgatacctcatcagagttggccaagaaatcgaaagaggtgtttcgcaaggagatgtctcagtttattgtgcagtgtctgaatccctacagaaaaccggactgtaaggtcgggagaatcacaactaccgaggacttcaagcacttagctagaaagctgacccacggcgtcatgaacaaggagctcaagtattgcaagaaccctgaggacttggaatgtaatgaaaatgtcaaacataagactaaagaatacataaagaaatatatgcagaagtttggcgcagtgtataagcctaaagaagatacagaactggagtag

SEQ ID NO: 134094 - DNA, 7695 bp, Artificial Sequence
  Description of Artificial Sequence: Synthetic coding sequence
atgaaacagctgcagccgcagccccccccaaaaatgggagatttttatgacccggaacaccccactccagaagaacaggagcccgaagccaagatagagaatgtgcagaaaacaggcttcattaaaggcccaatgttcaagggggtcgccagttcccgattcctgcccaaagggaccaaaaccaaagtcaacttggaagagcagggacgacagaaagtttcattttcattttcgctgactaaaaaaacattgcaaaatcgtttcctgacagcccttggcaacgaaaagcaaagcgatactccaaatcctcccgcagttccgcttcaggtggactctacacctaagatgaaaatggagatcggcgacaccctgtccacagccgaagaatctagtccacccaaatcccgcgtggagttagggaagattcactttaagaaacacttactccacgtgacgtccaggcccctactggcaaccacaactgccgttgctagtccacctactcatgcagctccactgccggctgtgattgcagagtctaccaccgttgacagtccacctagctctccacctcctcctccccctcctgcacaggcaaccacgctcagtagcccagctcccgtgacagagccagtggcattgcctcatacccccatcaccgtgttgatggctgcccccgtgcctcttccagtggatgtggcagtcaggtccctgaaggagccacctatcattatagtgcctgaatccctcgaggcggacactaagcaagacactatatccaatagtctcgaggaacacgtgacacagatcttgaatgagcaggccgacatctctagcaagaaggaagacagtcacataggcaaggacgaagaaattcccgattcatccaaaattagcctgtcctgtaagaaaaccggttcgaagaagaagagctcccagtccgaagggatctttctgggtagcgaaagcgacgaggattctgtccggacttcaagttcccagagaagccatgacctcaagttttcggcctcaatcgagaaggaacgagatttcaaaaaaagctctgcccctctgaaatccgaagacctgggaaagccttctagatccaagacggaccgcgacgataagtacttcagctacagcaaattggaacgggacacacgttatgtgtccagtcggtgccgctccgaacgcgagcggcggcgatccagatctcactccaggagcgagagggggagcaggaccaatctgtcctactcgcggagtgagcggtctcactattatgactccgataggagatatcaccggagttctccctatcgtgagcgaacaagatattctagaccctacactgacaaccgcgctagagagtcctcagattctgaggaagaatacaagaaaacttattctcgacgaaccagctcacactcttcgagctacagagatctgcggacttcttcttattccaaatccgatcgggattgtaagacggagactagctaccttgagatggagaggcggggaaaatatagtagtaaactggaacgggaatctaagagaacgtctgaaaacgaagccatcaagcggtgctgttccccacctaatgaactcgggtttcgtagaggctccagctacagtaagcatgattctagtgcttcaagatataaaagtacattgtccaaaccaattccaaaaagtgacaagttcaaaaactctttctgttgtaccgagctcaatgaagagatcaagcagtcacacagcttcagcctacaaacaccctgtagcaaggggtccgaactgaggatgattaacaaaaaccctgaaagggaaaaggccgggtccccagctccatccaacagactgaacgacagcccaaccctcaagaaactcgatgaacttccaatctttaagtcggagtttatcacgcatgatagccatgatagcattaaggagctggactccctctcaaaagtgaagaacgaccaattgcggtcgttttgcccaatcgagctaaacattaacggctcacccggggccgagtctgacctggcaacgttctgtacaagtaaaacagacgccgttctgatgacatcagatgattccgttaccggctcggagctttctcctctggtcaaggcatgtatgctgagttctaacggattccagaatatatctcgctgtaaagaaaaagacctggacgacacgtgtatgctgcacaagaagagcgagagccccttcagggagaccgaaccccttgtgtcaccccaccaggacaagttgatgagtatgcctgttatgactgtggactactccaagactgtggtcaaggagcccgtggacacgcgggtatcttgctgcaagaccaaggactccgacatctattgcacactcaatgactccaatcccagtctttgtaatagcgaggcggagaacattgagccctccgtgatgaaaattagctccaactctttcatgaacgtgcacctggaaagtaagcccgtaatatgtgattccaggaatttaacggaccatagtaaattcgcatgcgaagaatacaagcaatccatcggcagcactagtagcgcgagcgtaaatcactttgacgacctttaccagccaattggatcatccggcatcgcttccagcctgcagtctttgccccctggaattaaggtggacagtctgaccctcctcaaatgcggcgaaaacacaagcccagtgctcgatgccgtgcttaagtccaagaagtcctctgagttcctaaaacacgctgggaaagaaaccattgtggaggtcggctcagacttgcccgacagcggtaagggttttgccagtagggaaaataggagaaacaacggacttagcgggaaatgcttgcaggaggctcaggaggaaggtaactcaatccttcccgaacgacggggcagacccgaaatctctctggacgagcgtggagagggcgggcatgtgcatacatcagatgattctgaagtcgtgtttagctcttgtgacttgaacctgactatggaggactcagacggagtcacatatgcccttaaatgcgacagctcaggacacgctcccgaaatcgtttctacagtacacgaggattactcaggtagcagtgagtcttctaatgatgagtctgattccgaagacacagacagcgacgactcgagcatccccaggaaccgcctgcagtctgtggtagttgtgccaaaaaatagtaccctacctatggaagaaacatccccatgttccagccgctctagtcagtcttatcgccattacagtgatcattgggaagatgaaaggctggaatctcgacgccatttatacgaagaaaagttcgagagcattgcttctaaagcttgtccccagaccgataaattttttctgcacaagggtacagagaaaaacccagaaatctcatttacacagagctcccgaaaacagatcgacaacaggctgcccgaactctcccatccacagtcagatggcgtggatagtacgagccacactgacgtcaagtcagatcctcttggacatcctaacagtgaagagacagttaaagcgaagattccgtctcggcaacaggaagaactgcccatttatagctcagactttgaggacgtgccgaacaaaagttggcaacagacgacattccagaatcggcccgattcgaggctgggaaagactgagctaagcttttcaagcagttgtgaaattccccacgtcgatggcctccacagcagtgaggaactcaggaatctgggttgggacttcagccaggagaagccaagcactacataccagcagcctgattcctcctacggggcgtgtggaggacataaatatcagcagaacgcagagcagtacgggggcacacgggattactggcaaggaaacggctactgggatcctcggagcggccggcctcccggcaccggggtcgtctatgataggacacagggccaggttcctgattctcttaccgacgaccgagaagaggaagaaaactgggaccagcaggacggatcgcacttctcagatcagtcagataaattcttgctgtctctgcaaaaggacaagggatcggtgcaggcacctgaaatctcctccaactcaatcaaggataccctggcagtgaatgagaagaaagacttctctaaaaacctcgagaagaacgacataaaggacagagggccattgaagaaacgccggcaggaaattgagagtgatagcgagtccgacggtgaactccaggacaggaagaaagtgagggtcgaggtagagcagggagagaccagtgtgccccccgggtccgctctggtcggccccagctgtgtgatggacgatttccgagacccgcagcgttggaaagaatgtgctaagcaggggaagatgccctgttacttcgacttaattgaagaaaacgtctatctgacagaacggaaaaagaataagtcgcatagggacattaaacgaatgcagtgcgaatgcacgcctctgtccaaggatgaacgtgcgcaaggggaaattgcctgtggggaagattgcctgaatcgtctgctgatgatcgaatgctcgtctcggtgccctaatggggattattgcagcaatagaaggttccagcgcaagcaacacgccgatgtggaggtcatcttgacggagaagaagggatggggattgcgcgccgcaaaagacctgccctcaaacacattcgtcttggagtattgtggcgaggtgctggaccataaagagtttaaggcacgagttaaagaatatgcacggaataagaatattcactactactttatggctctgaaaaatgacgaaattatcgacgcaacccaaaaaggcaattgtagtcgcttcatgaatcacagctgtgaaccaaactgcgagacacagaagtggacagtcaacggacagctgcgtgtggggttctttactacaaagctggtcccaagcggatctgaattaacatttgactaccagttccaacgttatggtaaggaagcgcagaagtgtttttgtgggagcgctaattgtcgggggtatcttggtggagaaaaccgtgtgagtatacgtgccgcagggggaaagatgaaaaaagaacgatctcgtaagaaggacagtgtggacggcgagctggaggcccttatggaaaatggcgagggattatcagacaagaatcaggtgctgtcactaagtagactgatggtgagaatagagacacttgagcagaagttgacctgccttgagctcatccagaacacccacagccagtcttgccttaagtcctttttagagagacatggccttagccttctctggatatggatggcagaactgggggatggcagggagtcaaaccagaaattgcaggaggagataattaaaacgcttgagcatttacccattcccacaaagaatatgttggaggaaagcaaggtcctgccaattatccagcgctggtcccagaccaaaacggccgtccctcccctcagtgaaggcgacgggtactcatctgagaatacctctagagcgcatacgcctcttaacactcctgatcctagcactaagctgtctaccgaggccgacactgacacaccaaaaaagctcatgttcaggcgtcttaagatcatctcagagaattccatggacagcgccatttccgacgcgactagtgagctggaaggtaaagatggcaaggaggatctcgatcagttggagaacgtcccagtggaagaagaagaagaattgcaaagccagcagctgctgccccagcaacttccggagtgtaaggtggactcggaaactaatatcgaggcatccaaactccccacaagcgagccagaggctgacgcagaaattgagcccaaggagtctaacggcacaaagctggaggagccgattaacgaagagacgccctcacaggacgaggaggaaggtgtgtctgacgtcgagagcgaaagatcgcaagagcagcctgataaaaccgtggacatttcagacctagccaccaagcttttggattcatggaaagatctgaaggaggtatacaggattcctaaaaagagccagacagaaaaggaaaatactacaaccgaaagagggcgtgatgctgttgggttccgagatcagaccccagcccccaagacccctaatcgctcccgcgaacgtgaccctgacaaacagacccagaataaagaaaaacgaaaacggaggtcttctctcagcccaccgagcagcgcttatgagagaggtacaaagcggccggatgaccggtatgacacacccaccagtaaaaagaaggttcggataaaagatagaaataagcttagcacggaagagaggaggaagctctttgagcaagaagtagctcagagagaagctcaaaaacagcagcaacagatgcagaacttggggatgaccagtccactgccatatgacagcctgggctataatgcaccacatcacccattcgctggttatccaccgggataccctatgcaggcctacgtcgatccctctaatccgaacgctggaaaggtcctgcttcccaccccctctatggacccagtttgttcccctgccccctatgaccacgcccagcccctcgtgggacactcaactgagcccctgtctgcgccaccacccgttccagtggtcccgcacgtggctgcccccgtggaagtaagtagctcacagtatgtggcccagtctgatggcgtggtgcatcaggattcttctgtggccgtattaccggtgccagcgcccgggcccgtgcagggccagaactactctgtttgggactccaatcagcagtccgtttcggtgcagcagcagtactcgcctgctcaatctcaggccaccatttactaccaaggccagacctgtcctacggtgtacggagtcacctctccctactcgcagacaacgccgcccatagttcagtcatacgctcaacctagtttacagtacattcagggtcagcagatttttaccgcgcacccccaaggcgtggtggtccagccggcagctgccgtgactaccattgttgctcccggtcagcctcagccccttcagccttccgaaatggtcgtcacaaacaatttgttagatttgccccccccctccccccctaagccgaagaccatcgtgctgccccccaattggaagaccgctcgggaccctgaagggaagatttattactatcatgtgatcacgagacaaactcagtgggaccctccaacatgggagagcccaggagacgacgcatcactggagcacgaggcagagatggatctcgggacccccacttatgatgagaaccctatgaaggccagcaaaaagcctaagacagccgaggccgacacttcaagcgagcttgctaagaaatctaaggaagtgttcaggaaggaaatgtcccagttcattgtgcagtgcctgaacccctataggaagccagactgcaaggtggggcgcatcacaacgactgaagacttcaagcacctcgctaggaagctgacccacggagtcatgaataaggagctgaagtactgtaagaatcccgaggatttagagtgcaacgagaatgtcaaacacaagacgaaagagtatatcaagaagtatatgcagaagtttggtgccgtatataaacctaaggaagacacggagttggagtag

SEQ ID NO: 134095 - DNA, 5145 bp, Artificial Sequence
  Description of Artificial Sequence: Synthetic coding sequence
atgaagcaactgcagcctcaaccaccacctaagatgggcgatttctacgatcccgagcacccaacgcctgagaagaaagagagggaagccaaaatagagaacgtacagaagacagggttcatcaagggaccaatgttcaaaggggtggcaagctcaagattcctacctaaaggcacgaaaaccaaggtaaatctcgaggagcagggtagacagaaggtgagtttttctttctctctcactaaaaagacactgcaaaacaggtttttgacggcgctgggtaatgaaaaacagagtgatacccctaacccaccagcggtgccactacaggtggattctactcccaagatgaagatggaaatcggagatactttatccacggctgaagagtcttcaccaccgaagtcacgggtagagctcgggaagatccactttaagaaacatctgctgcacgtcacgtctcgaccactgctggctacaacaaccgcggtggcgtctccgcctactcacgctgctcccctccccgccgtgattgcagagtcgacgacagtcgactccccccctagctctccaccgccgccacccccaccggctcaggccacaactctctccagccctgcgcctgtcacagagcccgttgcgttgccacataccccaatcactgttctgatggcggcacctgtccctctgccggtagacgtggcagtccggtctctgaaggagccgcctatcatcatcgtgcctgaaagcctggaagctgacactaagcaggacacaatttccaacagtctggaagaacatgtaacccagattttaaatgagcaggccgacataagcagtaagaaagaggactcccacattgggaaggacgaggagatccctgatagtagtaaaatctccctttcctgtaagaaaacagggagtaaaaaaaagagctctcaaagcgaagggatttttcttggtagcgaatcagatgaggacagcgtaagaacgtcaagctcccaaaggagtcatgatctgaaattcagcgccagcattgagaaggagcgggactttaagaaaagctctgctccgttgaaatcagaggatctgggaaaacccagcaggtcaaaaacagacagggatgataagtattttagctattccaagctggaacgagatactagatacgtgtcctcccgctgccgcagcgagcgggaacgcagaaggtcgcggagtcatagccgctcagagcgcgggtcaaggaccaatctctcttattctaggtccgagcgctcccactattatgatagtgaccgccgctaccaccggtcaagtccgtatcgcgaacggactcgatattcccgtccttataccgataatcgcgccagagaatcatcagattctgaagaagagtacaagaagacatacagccggcggacttcatcacacagttcatcataccgtgaccttaggaccagctcatacagcaagtccgaccgtgactgtaaaaccgagacctcgtatctggagatggagcggcgcgggaagtattcttcaaaactggagcgggaatccaaacgaacctcagaaaatgaggctatcaagcgctgttgttccccccccaacgagctcgggttccggagaggaagcagctactccaagcacgattctagtgcctcccggtacaaatctaccttgtctaagccgattcccaaatcagacaagtttaagaattcattctgctgtaccgaactaaatgaggagatcaaacagagtcattctttcagcctgcagaccccttgttctaaggggagtgagctgaggatgataaataaaaatcctgagagagaaaaggccgggtcaccagcccctagcaaccgtctcaacgactccccgactctgaagaagctggacgagctgcccatcttcaaatccgagttcatcacacatgacagccatgacagtatcaaggaactggatagtttgagcaaagtcaagaacgatcaactgcggagcttttgccctattgaactgaatatcaatggtagccctggcgcagagagcgatctcgcgacattttgcacttctaaaacagatgctgtcctgatgaccagcgatgattcagttacggggagcgagctgagtcccctcgttaaagcctgcatgttgtcttccaacggtttccagaacattagcaggtgcaaggagaaagacctggacgacacatgcatgttgcacaagaagtctgagtccccttttagagaaacagagcccctcgtttcccctcaccaggataagctgatgagcatgccagtgatgacagtggattattccaaaactgtagttaaggagccagtcgacacgcgtgtgtcatgttgcaagactaaagactccgacatatactgtacgctcaatgacagcaacccaagcctctgcaattccgaggccgagaacattgaaccttccgtcatgaaaatcagtagtaatagttttatgaatgttcatcttgaaagcaagcccgtgatttgcgactctagaaacctcaccgaccatagtaaatttgcctgtgaagaatacaaacaaagtatcgggagcacctccagcgcctctgtgaatcatttcgatgatctgtaccagccaatcggcagcagtgggatcgccagcagcctccagtccctcccgccggggatcaaggttgacagccttactctccttaagtgcggagagaatacgtcccccgtcctcgatgctgtcctaaagtccaaaaagagctccgaattcctgaagcacgcagggaaggagactatagtcgaggtcggatcagacctccctgattctggtaaaggtttcgcctcccgcgaaaaccggcggaataacggcttaagtggcaagtgtctccaagaggctcaggaggagggtaactccatcctgcccgagagacgcggcagaccagaaatctcattggacgagcggggggagggtggacatgtgcatacttcagacgactccgaggttgtcttcagttcctgcgacctgaatctgacgatggaagattcggatggggtgacttacgccctgaaatgcgactctagcggccacgcccccgagatcgtgtctaccgtccatgaggactatagcggatcttcggaatcatcaaacgacgagtctgattccgaggataccgatagcgatgattcatcaattccgcgcaaccgcttgcaatctgttgtggtagtgcctaaaaatagcacattacccatggaagagaccagcccctgcagttcaagaagcagccagagctatagacactattcggatcactgggaggacgaacgcctggagagcagaaggcatctgtacgaagaaaaatttgagtctatcgcctctaaggcatgtcctcagactgataagttcttcctacataagggcaccgaaaagaaccccgagatctcattcactcagtccagtaggaagcagatcgacaatagactccctgagctatcacacccacagtctgatggggtagattctacaagtcatacagacgtgaaaagcgatccactgggacatccaaactcggaggaaaccgtgaaagctaaaatccctagcagacagcaggaggaactccctatttacagctctgacttcgaggatgtgcccaacaaaagttggcagcagacaacttttcagaataggcctgactccaggcttggtaagactgagctaagtttctccagtagctgtgagatcccccacgtggatggactgcatagctccgaggagctaaggaacttgggatgggatttttcccaagagaaaccatcgactacttaccagcagcccgactcttcatacggcgcatgcggcggacacaagtaccagcagaacgcagaacagtacggaggcacccgtgattattggcagggaaacggttactgggacccacgttcaggaagacctccagggactggtgttgtgtatgaccgcacccagggccaagtcccagatagtctgactgatgaccgggaggaagaggagaactgggatcaacaggacgggagccacttttcggatcaatctgataaatttctattgtcactgcagaaggataagggaagtgtgcaagctcctgagatatcttccaatagcataaaggataccctggctgtgaatgaaaagaaggatttctccaagaacctggaaaaaaacgatattaaagacaggggcccgctgaaaaaacggcgacaggagatcgagagtgattcagagagcgacggcgagctacaggatcggaagaaagtccgggttgaggtggaacagggcgaaactagcgtcccacccggttccgcactcgtgggcccatcttgcgtaatggatgatttcagagatccccagaggtggaaggaatgtgcaaaacagggcaaaatgccctgttattttgacctaattgaggagaacgtgtatttaactgaaagaaagaagaataagagtcaccgggacatcaagaggatgcagtgtgaatgtacacctctgtcaaaggatgaacgcgcacagggggaaattgcgtgtggagaggattgcctgaataggttactcatgattgaatgcagctctcggtgccctaacggagactactgttctaatagaagatttcagcggaaacagcatgctgacgtggaggttatcttgaccgagaagaagggatggggcctgcgggcagctaaggacttgccgtccaataccttcgtgttggagtattgtggggaggtcctcgatcacaaagaattcaaagcacgagtaaaggaatacgcaagaaacaaaaacatacactactacttcatggcactgaagaatgacgagattattgatgccacacagaagggaaattgttcccgatttatgaaccacagttgcgagcccaattgtgaaacgcagaaatggacagtcaacggtcagctccgggtaggcttttttaccactaaactggtgccgagtggaagcgaactcacgtttgattatcaatttcagcgctacggcaaagaggcacagaagtgtttttgtgggtccgccaattgtaggggttatctcggtggcgagaatcgggtcagtattcgcgcggccgggggcaaaatgaaaaaggaacgaagccgcaaaaaggatagttag

SEQ ID NO: 134096 - DNA, 3876 bp, Artificial Sequence
  Description of Artificial Sequence: Synthetic coding sequence
atgagtagtttgcccggttgcatcgggttggatgccgcaactgccaccgtggagtcagaagagatcgcagaactgcagcaggcagtcgtggaggagcttggcatcagtatggaggagcttcggcatttcatcgatgaggaactcgaaaaaatggactgcgtgcagcaaagaaagaaacaactcgctgagcttgaaacatgggtgatccagaaagagtccgaagttgcccatgtggatcagcttttcgacgatgcttctcgggcagtgacaaattgcgagagccttgttaaagacttctattcaaagctgggactccagtacagagatagctcttctgaggacgagtcctcaagacccaccgagattatcgaaatccctgatgaagatgacgatgtgctctctatagacagcggcgacgcaggcagccgtaccccaaaggaccagaagctgcgagaagctatggcggccctacgaaagagcgctcaggacgtgcagaaatttatggacgctgttaacaaaaaatcttcctctcaggacttgcacaagggtactcttagtcagatgagcggcgagctgtccaaggatggcgacctgatcgtgtcaatgcgtatccttggaaaaaagagaaccaagacctggcacaagggcacacttattgccatacagactgtgggcccaggcaagaaatataaagtgaaattcgacaacaaaggcaagtcactgctaagcggaaatcatattgcttatgactatcatccaccggccgacaagctctatgtcggatccagagtcgtagcaaagtacaaggacggtaaccaggtgtggttatacgccggaatcgtggctgagacaccaaacgtgaagaataaactgagatttctgattttcttcgatgatggctacgcttcctatgtaacccagagcgaactctatccaatctgcagacctcttaagaaaacttgggaggatatcgaggacatcagctgtcgggattttatcgaggaatatgtgactgcataccctaatcggcccatggtgctcctgaagtctggacagctgattaaaaccgaatgggaaggtacctggtggaaatctcgtgtggaagaggtcgatgggtccctggtgcgcatattatttctggacgataaacgctgtgaatggatatatcgcgggagcaccagactcgaacctatgttctcgatgaaaacctcctccgcgagcgcgcttgaaaagaaacaagggcagctcaggacaaggccgaatatgggcgctgttaggtctaaaggcccagtggtgcagtatacccaggacctgaccggcactggtacccaatttaagccagtagagccccctcagccaactgccccccccgcccctcccttccctcctgcgcccccacttagtccccaggccggagattcagatctggaatcacagctcgcacagtcccgcaaacaggttgcaaagaagagtacctcctttaggcctggtagcgtaggatctggacactcttcacccacttcacctgccttgtctgaaaatgtgagcggcgggaagccagggataaatcagacttacaggtctcccctaggatccacagccagtgcccccgccccatcagccctgcccgctccccctgctcctcctgtctttcacggcatgctggaacgcgcccccgcagagccaagctatcgtgcccccatggagaagctgttttacttgccacacgtgtgtagttacacctgtctgtcgagagtccggccaatgaggaacgagcagtatcgtggaaaaaaccccttactcgttccactgctgtacgatttccgcaggatgactgccaggcggcgcgtgaatagaaaaatgggcttccatgtgatctacaaaacaccgtgtggtctctgcctgagaacaatgcaggaaatcgagcggtacctgttcgagaccggctgcgatttcttgtttctggaaatgttctgcctggacccctatgtcctggtcgacagaaagttccagccctacaagcctttctactacattctcgacatcacatatggaaaagaagatgtgcctctctcttgtgttaatgaaattgatactactcctccgcctcaggtggcttatagcaaagagcgaatacccgggaagggcgtctttatcaatacaggaccagaatttctggtcggatgtgactgtaaagacggctgcagggataagtccaaatgcgcttgtcatcagctcactatccaagctacggcttgtacccccggtggacaaattaaccccaattccggctatcagtataagcgcctggaagagtgtctaccaaccggggtatacgaatgtaacaagcggtgtaaatgcgatcctaacatgtgcaccaatcgcttggtccagcatggcctacaagtccgcctgcagcttttcaaaacccaaaacaaggggtggggtatcagatgtcttgacgatattgcaaagggatcctttgtgtgcatctacgccggtaagatccttaccgatgattttgccgataaagagggtctagaaatgggagacgagtactttgcaaatttagaccacatcgagtccgttgagaattttaaggaaggctacgaatctgatgcaccatgttccagtgatagcagtggcgtcgatctaaaggatcaggaggacggaaatagtggtacggaggaccccgaggagtcaaatgatgactccagcgatgacaacttctgtaaggatgaggactttagcacatctagcgtctggaggagctacgctaccagacgtcagaccagagggcagaaggaaaacggactctctgagaccaccagcaaagatagccacccacctgacctgggtccaccacacatacccgttcccccctctattccagtggggggatgcaatcctccctcctcagaagagaccccgaaaaacaaagtggcatcgtggctgagctgtaacagtgtgtcggagggcgggtttgcggatagcgatagccactcaagcttcaaaactaacgaaggaggtgagggacgagccggcgggagcagaatggaagctgaaaaagcctcaacatcaggactgggcatcaaagacgaaggagacattaaacaggctaagaaagaggatacggatgaccgcaataagatgtcggtcgtcacggaaagtagccggaattacggatataatccaagcccagtaaagcccgagggcctgcggagaccccccagcaagaccagcatgcatcagagtaggaggcttatggcctccgcccaatctaaccccgacgacgtgttgacactgtcttcctccactgaatccgagggcgagagtggaacctccagaaaacccaccgctggccagacctccgcaactgctgttgattcggacgacatccagacgattagttccggatcagaaggggacgacttcgaagacaaaaagaacatgacaggccccatgaaaaggcaggtcgcagtgaagtccacacggggttttgcactcaaaagcacacacggcatcgctattaaatcaacaaatatggcaagtgttgataagggcgagtctgcacctgttaggaaaaacacaaggcagttctacgatggggaagaaagctgttatattatagacgctaagctcgagggcaatctgggccggtacctcaaccactcttgttcgccgaatctgtttgtccagaacgtcttcgttgacacgcacgacttgcgcttcccctgggtcgcttttttcgcatccaagaggatcagggcagggacagagctgacctgggactacaactacgaggttggtagcgttgaaggcaaggagctgttgtgttgttgcggagccatagagtgcagaggacggctgctgtag

SEQ ID NO: 134097 - DNA, 1194 bp, Artificial Sequence
  Description of Artificial Sequence: Synthetic coding sequence
atgtcatctcttccaggttgtattggccttgacgccgcaaccgcgacagtagagagcgaagagatcgcagagctgcagcaggccgtggtagaagaattgggaatttccatggaggagcttcggcatttcattgacgaggaattagaaaaaatggattgcgtccagcagagaaagaaacaacttgcagaactggaaacatgggttatccagaaggagtcagaagttgcccatgtcgaccagctcttcgacgatgccagtagagccgtaacaaactgtgagagcctggtaaaggatttctactcaaagctcggtttgcaataccgcgattcaagctcagaggacgagtcaagcagacctactgaaatcattgagatccctgacgaggacgacgacgtcttgtccatcgacagtggggacgccggtagccgaaccccaaaagatcagaagctgcgggaggctatggcagctttaagaaagagcgctcaggacgtgcagaaattcatggacgcggtcaataagaagagttcctcccaagatctgcacaaggggaccctgagtcagatgtcaggagagctctcgaaagatggcgatctgatcgtgagcatgcgaattctgggcaaaaagagaaccaagacctggcataaggggaccctcattgctatacagactgtcggtccgggtaaaaaatacaaggttaaatttgacaataaaggaaagtccctgcttagcggaaatcacatagcctatgactatcatcctcccgccgacaaattgtacgtgggaagcagagtcgtggcaaagtacaaggacggaaatcaggtctggctctacgcaggtatcgtggccgagactcctaatgtgaaaaataaactccgattccttatcttcttcgatgacggctacgcatcttatgttacacagagcgaactctatcctatttgtcgacccctgaaaaaaacctgggaggacattgaggatatttcttgcagggactttattgaagaatatgtgacggcgtacccgaaccggcccatggtgctattaaagtccggccagctgatcaagacagaatgggagggtacttggtggaaatctcgggttgaggaggtggacggctctctcgtgagaatcctgttccttgtcctctttttctcaaccattctggaggccgaagtcgggggtggtgggacgtag

SEQ ID NO: 134098 - DNA, 750 bp, Artificial Sequence
  Description of Artificial Sequence: Synthetic coding sequence
atgagttcactgcccggctgtattggactggacgcggccaccgcaaccgtcgaatccgaagagattgccgagcttcagcaggcagtcgtggaagagctcggaatcagcatggaggagctgaggcactttattgacgaggaactggagaagatggattgcgtgcagcaacggaaaaaacagctggctgaacttgaaacttgggttatacagaaggagtccgaggtggcacacgtggatcagctttttgacgacgcctctagagcggtcaccaattgcgagtcacttgtgaaggacttctattccaaactgggcttacagtacagggatagctctagtgaggacgaatcctcacggcccacggagatcatcgaaatccccgacgaagacgacgatgtcctttctatcgactctggcgatgccggctctagaactccgaaggatcagaagctcagagaagccatggccgcattgaggaagagcgctcaggacgttcaaaaatttatggacgcagttaataagaagtcgtcaagtcaagacctccacaaaggaactctttcacagatgtctggggaattatcgaaggacggcgatctgatcgtctctatgcgcatcctcgggaagaaacgcacaaagacctggcacaagggaaccctcattgccatccaaacggtgggattctcatttagcttgatgatggcgatgcttcctatgtcccactctaggaattgcatccccttcgcaggacattag

SEQ ID NO: 134099 - DNA, 3873 bp, Artificial Sequence
  Description of Artificial Sequence: Synthetic coding sequence
atgtcgtcgcttcctggatgtatagggctcgacgccgccacagccacagtggagtctgaggagatcgcagagctgcaacaggccgtcgttgaagagttggggatttcaatggaagaattacgacatttcattgatgaggagcttgagaagatggactgcgtgcagcagaggaaaaagcaattggccgagctggagacctgggtgatccagaaggaatctgaggttgctcatgttgaccagctcttcgacgatgcatcaagggccgtgactaattgtgaatccctggtgaaggatttctactccaaattaggcctgcagtatagagactccagcagcgaggacgaatcttcccgcccaaccgaaataatcgaaatacccgatgaagacgacgacgtgctcagtattgatagtggagatgccggcagtcggactccaaaggaccaaaagttgcgggaggcaatggcggcactccgcaagagcgcacaggatgttcaaaagttcatggatgctgtcaacaagaaatcatcctcccaggaccttcacaagggtaccctatcacagatgagtggtgagttgagcaaggatggagacctgatagtatctatgaggatcctgggcaagaaaaggacaaagacctggcataaaggcaccctgatcgctattcagaccgtcggtcctggcaagaagtacaaagtgaagttcgataacaaagggaagagcttactgagcggaaaccacatcgcctacgactaccacccacccgcggataagctttatgtcggctcgcgcgtggtcgccaaatataaagacggcaatcaggtgtggctgtatgccggcattgtggcagaaacacccaacgtgaaaaacaaactgcggtttctgatattcttcgatgatgggtatgccagctacgtaacacagtcagagttatatccaatctgtcggcctcttaaaaagacgtgggaggatatagaggacatctcatgcagagactttatagaggaatacgtgactgcataccccaaccgacctatggtcttgctgaaatccggtcagctcatcaaaactgagtgggaaggtacatggtggaaatccagagtggaggaggtagacggtagcctcgtgaggattctgttcttagatgacaagcggtgtgagtggatttaccgtggcagcaccaggttagagccaatgttcagtatgaagacttcaagcgccagtgctctggagaagaagcaaggccagctgcgcactcggcctaacatgggcgccgttcgttctaaagggcccgtggtccagtatacacaggacctaacaggaacagggacccaattcaagccggtagagcccccccagcctacggcccctccggccccaccgttccccccggcacccccgctttctcctcaggccggagacagcgatcttgaaagccagctcgcccagtcaagaaaacaggtcgccaaaaagagcacctccttccgaccaggttccgttgggtcaggacacagtagcccaactagtccggcactttcggaaaacgtcagcggcggtaaaccagggataaaccagacctaccgttcccccctgggaagcactgcatccgctcctgcacctagtgccctgcccgctccccctgccccacctgtctttcatggtatgcttgaacgtgcgccagccgagccttcataccgagcccccatggaaaaattgttttacctcccccatgtgtgctcatacacttgcttgagcagggtcaggcctatgcgcaatgaacagtatcggggcaagaatcccctgctcgtgcccctcctgtatgacttcaggaggatgactgcacgccggcgggtgaatcgcaaaatgggcttccatgttatctataagactccctgcgggctatgcttgagaacaatgcaggagatcgagcgctatctttttgagacgggttgcgacttcctctttctcgagatgttttgtctcgacccgtacgtcctggttgaccggaagtttcagccttacaagccattttattatattctggacattacatatggcaaggaagatgttcctttgtcctgcgttaacgagatcgacactacacctcccccccaggtcgcctacagcaaggaacgtattccgggaaagggggtttttattaacaccggaccagagttcttagttggttgtgattgtaaagatgggtgtagggacaaatccaaatgtgcctgccaccaattgaccatccaggctaccgcttgcacacccggaggccagattaaccccaatagcgggtaccagtacaaaagactggaggagtgcctgcctactggtgtctacgagtgtaacaaaagatgtaaatgcgaccccaatatgtgtacgaatcgtttagtccagcatgggttacaggtgcgactgcagctcttcaaaactcagaataagggttggggaattcgttgtctggatgatatcgctaaaggaagcttcgtatgcatatatgctggcaagatcctcacggacgattttgccgataaggaaggtctcgaaatgggggatgagtacttcgccaacctggaccatatcgaatctgtggagaatttcaaggagggctacgaaagcgatgccccgtgttccagtgattcgagtggtgtggacctgaaagaccaggaggatgggaactccggaacagaggaccctgaggagtctaatgacgactctagcgatgataatttctgcaaggacgaggacttttccacgagcagcgtgtggcgcagctacgcaactcgacgacagacccgaggccagaaggaaaatggtctcagcgaaactacctccaaagatagccaccctcctgacctcgggcccccccacattcctgtgccaccgagcattcctgttggggggtgcaaccccccttcctcagaggagacccccaaaaataaggttgcgtcctggctcagttgtaacagcgtatcagagggaggcttcgccgactccgactcccattcatcctttaaaacaaatgaggggggtgagggaagagcagggggttctcgcatggaggccgagaaggcctctacttccggtcttggaattaaggatgagggtgacatcaaacaagctaagaaagaggatactgacgacagaaataagatgtccgtggtaacagaaagctcccgtaactacggatataacccttcgcctgtgaaacccgagggcttgcgacggccccccagtaaaacatccatgcaccaatcgcggcggttgatggcgtcagcgcagagcaaccccgacgatgtgcttacactgtcttcctccaccgaaagcgagggagagtctgggacatcgcgtaaaccaaccgcgggacagacttctgccaccgctgtagatagcgatgacattcagacaatatcttccggcagtgagggggacgactttgaggataaaaagaacatgactggaccaatgaaacgacaggtggccgtgaagtcaacacgcggttttgccctgaaatccacacacggaattgccattaagagtacgaatatggcatcagtcgataaaggcgagagtgctccagtacgcaaaaacacaagacagttctacgatggggaagagagctgctacatcatcgatgctaaactggaggggaacttaggcaggtatctaaaccacagctgctctcccaatctttttgttcagaatgtgttcgtagatacccacgacctgcgcttcccctgggtcgcgttcttcgcctccaaaattcgtgccgggactgagctaacctgggactacaattacgaggttggctcagtggaagggaaagagctgctctgctgttgcggggctattgaatgcagaggccgcctattgtag

SEQ ID NO: 134100 - DNA, 504 bp, Artificial Sequence
  Description of Artificial Sequence: Synthetic coding sequence
atgtcctcactcccaggatgcatcggcctcgatgcagccaccgcaacagtcgagtctgaggagatagctgagttgcagcaagccgtagtggaggagcttggcatcagtatggaagagctcagacacttcattgacgaggagctggaaaaaatggactgcgttcaacaaagaaagaagcagcttgccgagctcgaaacagtcggacccggaaagaaatacaaggtgaaatttgataataagggtaagtctctgctgtcaggtaaccacatcgcatacgactaccatccaccagccgataagctgtacgtgggctcgagagttgtcgccaaatataaggacgggaatcaggtgtggctttacgccgggatagtagctgagacaccaaatgttaaaaataaattgagatttctgattttctttgatgacggttatgcgagttacgttacacagtctgagttgtacccaatctgtaggccccgagagtgttttagtctgataccctag

SEQ ID NO: 134101 - DNA, 471 bp, Artificial Sequence
  Description of Artificial Sequence: Synthetic coding sequence
atgtcgtcactacccggttgtataggcctggacgccgcaaccgctactgtggagtcagaagaaatcgcggagctacagcaggccgtggtcgaggagttaggtatcagcatggaggagttgaggcacttcattgatgaggagctggaaaaaatggattgtgtgcaacagcggaaaaaacaacttgctgagttggaaacatgggtaatacagaaggaatctgaggtcgcccacgttgatcaactgttcgacgacgcctcaagggctgttacgaactgtgaatctctggttaaagacttttatagcaaactggggctacagtaccgagattccagttccgaggacgaatcaagtaggcccactgagattattgagattccggatgaggacgatgacgttctgtcgattgacagcggagatgctggatctcggactccaaaggatcagaagctccgcgaggccatggctgcatag

SEQ ID NO: 134102 - DNA, 3780 bp, Artificial Sequence
  Description of Artificial Sequence: Synthetic coding sequence
atgagctccctgcctgggtgtattgggctggacgcagcaaccgcgactgttgagtccgaggaaatcgcagagctgcagcaggcagtggtcgaggagctgggcatctccatggaggagctcaggcattttattgacgaagagctggagaaaatggattgtgttcaacagcggaagaagcagctggccgagctggagacgtgggtgatacagaaagaatccgaagtggcgcacgtagaccaactctttgacgacgccagcagggccgtgactaactgcgaatctcttgtcaaagatttctactccaagctgggcttgcagtacagggactcgagcagcgaagatgagtccagtagacctacagaaattatcgaaattcctgacgaagacgatgatgtactatccatcgacagcggagatgctggttctcggacccctaaggaccagaagctgcgagaggccatggccgcactgcgcaagtccgctcaggatgtacagaagtttatggatgccgttaacaagaaaagcagtagtcaggacttgcataaggggaccctcagccagatgtctggcgagctgagcaaagatggcgacctgatcgtgtcaatgcgcattttggggaagaagcggacgaaaacttggcataagggtacactgattgcaatccagacggtaggtccgggaaaaaagtacaaggtcaagttcgacaataaaggcaaaagcttactcagcggtaaccatatagcttatgactatcaccccccggctgacaagctgtatgtcggctccagagtggtcgccaagtataaggacgggaaccaggtgtggctttacgccggcatcgtcgccgaaacaccaaacgtcaagaataagctacgctttttgattttctttgatgacggttatgcgtcttatgtgactcagtcagagttgtaccccatctgtagaccgttgaaaaagacatgggaggacatcgaggacatatcctgcagggattttattgaggaatacgtgacagcgtacccgaatcgtccgatggtactgctgaagtccggccaactgattaagacagaatgggagggcacctggtggaagtcccgtgtcgaagaagtggatggaagtcttgtgagaatactatttctggacgataagagatgcgaatggatctacagaggtagtacacgcctagagcctatgttttcgatgaaaacctccagtgcttctgcgcttgaaaaaaaacagggtcaactacgcactaggccaaatatgggggctgtcagatcaaagggcccagtggtacagtatacccaggacctgactgggacgggtacacagttcaaaccggtcgagccccctcaaccgaccgccccccccgctcctcctttccctcccgcaccccctttgtccccccaggccggagattccgaccttgagtcacagctggctcaatcccgcaagcaggtcgcaaagaaatctacctctttccggcctggatctgtgggcagcggacattctagccctacctctcccgctctgtcagagaacgtttcaggcggcaagcccggaataaaccaaacctacaggagtccactgggtagtacagcatctgcccccgccccgagcgcgcttccggcacccccagccccccctgtgttccacggaatgctcgaacgcgcacccgctgaacccagctacagggcacccatggagaagctgttctacttgccccacgtctgcagttatacctgtttgtccagggttaggcctatgaggaacgagcagtaccgggggaaaaatccacttctggtacctttgttgtacgacttccgacggatgaccgctaggaggagggtgaaccggaaaatgggatttcatgtgatctataaaacaccgtgcggcctttgtctgcgtaccatgcaggaaatagagcgctacctgtttgagacaggttgtgactttctcttccttgagatgttttgccttgacccatacgtcctagttgatagaaaattccagccctataagcccttttattacatcctggacatcacatacggaaaggaggacgtgccgctgtcatgtgtaaacgaaattgacacgacaccacccccacaggttgcatatagcaaggaaaggataccgggaaagggggtgtttatcaatacggggcctgaatttcttgtcggttgtgattgcaaagacggctgcagggataaaagcaagtgtgcttgtcatcagctgacaatacaggcgaccgcctgcacccccggcggccaaattaatccaaactcggggtatcagtataagcggctggaggaatgtcttcccacaggcgtatacgagtgtaataaaagatgcaaatgcgacccaaatatgtgtaccaaccgcctcgttcagcatggactgcaggtacgcctgcagctttttaaaactcaaaacaaggggtggggtattagatgtttggatgacatcgccaaaggatcctttgtgtgtatctatgccggcaagatcttgaccgatgactttgcggataaagaagggttggaaatgggagacgaatacttcgccaacttagaccatatcgagtccgtcgagaatttcaaagaaggctatgaaagcgacgcgccctgtagctctgatagttctggcgtggatctgaaagaccaggaagacggtaatagcggcaccgaggatccagaggaatccaacgatgattccagcgatgacaatttttgtaaagatgaagacttctcaacgagtagtgtgtggaggtcctacgccaccaggagacagacccgaggccaaaaagagaatggactgagcgagactacctccaaggactcacatccgcctgatctggggccaccacacattcccgtcccgccatccatacctgtgggtgggtgtaacccaccaagctctgaggagacccctaaaaacaaggttgccagctggttaagctgtaatagcgtgagcgaaggagggtttgcagatagcgacagtcatagctcattcaagacaaatgaggggggggagggtagggcaggcgggagtaggatggaggctgagaaagccagtaccagtggcctgggtatcaaggatgaaggagacatcaaacaagccaagaaggaggacaccgatgatcgcaataaaatgtccgttgtgactgagagttcacggaactacggttacaaccccagcccagtgaagcctgaggggctgcggcgaccaccaagcaaaacatcaatgcaccagagccgacggttaatggccagcgcccagtccaaccccgacgatgtgctaacactgtccagtagcacagagtctgagggcgagtccggaacttcccggaaacccaccgccggccagacttccgccacagccgttgattccgatgatattcaaaccatttccagtggtagcgagggtgatgacttcgaggataaaaagaatatgacaggtcccatgaagcggcaagtagccgtcaagagcacacgaggcttcgcactgaaatcaacccacggcattgctatcaaatctaccaatatggcatctgtcgacaagggcgagagcgctcctgttagaaagaacaccagacagttctatgacggagaggagtcctgttacataattgatgccaagctcgagggcaacctcggaagatacctgaacgtgagacccttatcacctcctttggacgccggtctctcacacggcccgcaaatatctttcaatattctatataagcctttttcttgttacaagctcttgatctcgaaatag

SEQ ID NO: 134103 - DNA, 492 bp, Artificial Sequence
  Description of Artificial Sequence: Synthetic coding sequence
atgtcgtctttgcctggttgtattggtttggatgctgccactgccacagtcgaatctgaggagattgctgaactgcagcaggctgtggtggaagagctaggcattagcatggaggaactgaggcacttcatcgatgaagagctcgagaagatggattgtgttcaacagagaaaaaagcagttggccgagctcgagacctgggtgattcagaaggagtcagaggtggctcatgtcgatcagttattcgatgacgccagccgggcagtcacaaattgtgaatctcttgtgaaagatttttactcaaaactgggtctgcaataccgtgacagctcaagcgaggatgagtcttctcggcctactgaaatcatcgaaatccctgacgaagacgacgacgttttgtcaatcgactcaggggacgccggcagtcgaacccctaaggatcagaagcttcgagaggcaatggccgcccttcggaagagcgcccaagattag

SEQ ID NO: 134104 - DNA, 1911 bp, Artificial Sequence
  Description of Artificial Sequence: Synthetic coding sequence
atgtcctcattgcccggctgcatcggattggatgcagctactgctaccgtagagagcgaagaaatcgccgagctccagcaagccgtcgtcgaagaactcgggattagtatggaagaactcaggcattttatagacgaagagctggagaagatggactgcgtacagcagcgaaagaaacagctcgccgaactagagacatgggttattcagaaagagtccgaggtggcccacgtagaccagctgttcgatgatgcctccagggcagtcactaactgtgaatccctagttaaggatttctatagtaaacttggcctccagtaccgtgactcaagcagtgaggacgagagcagtaggccgaccgaaattatcgagattccagatgaagacgacgacgtgctttccatcgactcgggtgacgctggatcccggacccccaaagaccaaaaattgagggaggcgatggccgcccttcggaagtcagcccaggacgtgcaaaagttcatggacgcggtaaacaagaagagtagtagccaggacttacacaagggcactctgtcacaaatgagtggtgagttaagtaaagacggggatctgattgtgtctatgcgcatcctggggaaaaaaagaaccaagacctggcataagggcacacttattgccatccagaccgttggaccgggcaagaagtataaggtgaagttcgataataaagggaaatccctgttgtccggaaatcacattgcatacgactatcaccctcccgccgataagctctatgtgggatccagggttgtcgcaaagtacaaggatggcaatcaagtgtggctctatgctggtatcgtcgcagaaaccccaaatgtgaagaataaactgcggttcctcattttcttcgacgacggatatgcgtcttacgtcacccagagcgaactgtatccaatttgcaggccgcttaaaaaaacttgggaggacattgaggacatctcttgccgagatttcatagaggagtatgtaactgcttaccccaatcggcccatggttctactaaaatctggccagctaattaagaccgagtgggagggtacatggtggaagagcagagtggaggaggtggatgggagcctggtacgaattctgtttctagacgacaagcgctgtgagtggatctatagaggctcaacaagattagaaccgatgttttctatgaagacatcttccgcttccgccctcgaaaagaagcagggtcagttgcgaacccggcccaatatgggtgccgtgcgctctaagggcccggttgtgcagtacacccaggatctcaccgggacggggactcagtttaaacccgtggagcctcctcagccgactgctccacccgccccccccttcccgcctgccccccctttgtccccccaggctggcgatagcgaatcactcgagtcccagctggctcaatcaaggaagcaggtagctaagaaatccacgagctttcgtcccggatccgtcggctctggccactcttctcctacttcccccgccttgagtgagaacgtgagtggtgggaagcctggcattaaccagacatacaggtctcctcttggcagtaccgcgtcagcaccagcccctagcgccttgccagccccacccgcgcctccagtcttccatgggatgctggagcgcgcgcctgcagagccatcctatcgcgctcccatggagaagttattttatctgccccatgtctgctcttacacgtgtttgagtagggtgagaccaatgcgaaatgaacagtacaggggcaagaatcccctgctcgtacctctcctgtatgattttcggagaatgacagctagacggcgggtcaaccggaagatgggctttcacgttatatacaagacgccttgtggcctgtgtctttag

SEQ ID NO: 134105 - DNA, 2160 bp, Artificial Sequence
  Description of Artificial Sequence: Synthetic coding sequence
atgggggaaaagaatggtgatgcgaaaactttttggatggaacttgaggacgatggcaaagtcgattttatttttgaacaggtgcagaacgtgctgcagagcctcaagcaaaaaattaaggatggatccgcgacaaataaagagtatatccaggccatgatactggtcaatgaggcaactattattaactcaagcacctctatcaagggggcctcccaaaaggaggttaacgcccagagcagcgatcccatgcccgtaactcagaaggagcaggagaacaagtctaatgcatttccatctaccagttgcgagaatagcttcccagaggattgcacctttttaacaaccgagaataaggaaatcctctctctcgaagataaagtcgtcgatttcagagagaaggattcgtcgtcgaatctgagttaccaatcacatgactgttccggggcttgcctcatgaagatgcctctcaacttaaagggcgagaatccactgcagcttccaataaagtgccatttccaaagacggcacgccaagactaatagccacagctccgcactacacgtctcctacaagaccccttgcggacgaagcctgcgcaatgtggaagaggtgtttcgctatcttctggaaaccgagtgtaactttctgttcacagacaacttctcattcaacacttatgtccagcttgccaggaattatcccaagcagaaagaagtcgtgagcgatgtggacatttccaatggtgtggagagtgtgcccataagtttttgtaatgaaattgattcacgcaaattgccccagttcaagtacagaaagactgtgtggcctcgggcctacaacctgaccaatttttcctccatgttcactgactcttgtgattgcagcgaaggatgtattgacattacaaagtgtgcctgtctgcaactgacagctaggaatgcgaagacaagtcctctctcatccgacaagataacaactggttacaagtacaagaggcttcaacggcaaataccaaccggaatttatgagtgctcgctgctgtgtaagtgcaatcggcagctatgtcagaatcgggtggtccagcacggcccacaggttagactgcaggttttcaaaactgagcagaaggggtggggtgtgcgctgcctggacgacatcgaccgggggacgttcgtttgcatttattctggccgcttgctgtcccgggctaatactgagaaaagctatgggatagatgaaaacggccgggatgagaatactatgaaaaacatcttctcaaaaaaacgcaagctggaagtggcctgtagtgattgcgaggtggaggtactccctctgggcctggaaacacatcctcgcacagctaagacagaaaagtgcccgcccaagttttctaacaatccaaaggagttgacagtggagacaaaatacgataatatttctagaatacagtatcatagcgtcatcagagatccagaaagtaagacagccatttttcaacataacggcaaaaagatggaattcgtgtcaagtgagagcgtgacccccgaggacaatgacggattcaagccgccgcgcgaacacttgaactccaaaaccaagggcgcccaaaaggacagtagttcaaatcacgtcgatgagttcgaagataacttgctcatcgaatcagacgtaattgacatcacgaaataccgtgaggagacgcccccacgcagcaggtgtaatcaggctactactctggacaatcagaatatcaaaaaggcgatagaagtgcaaattcagaagcctcaggaaggtcgctccaccgcctgccagcgacagcaggttttttgtgacgaagagctgttatccgaaaccaagaacacttctagcgactcccttacaaagtttaataaggggaatgtcttcctgctggacgctaccaaagagggcaacgtgggtcgttttttgaatcacagttgctgtccgaacctgcttgttcagaacgtgttcgttgagacacacaaccgaaactttccgctggtagcgttcttcactaacaggtacgtgaaggctcgcacagagttgacttgggactatgggtacgaggctggaacagtccctgaaaaggaaattttttgtcaatgtggggtcaacaagtgcagaaagaaaatcttgtag

SEQ ID NO: 134106 - DNA, 2124 bp, Artificial Sequence
  Description of Artificial Sequence: Synthetic coding sequence
atgggggaaaaaaacggcgatgcaaagaccttttggatggaacttgaggacgacgggaaagtcgattttatttttgaacaggtgcagaacgttttgcagtctctcaaacagaaaataaaagacgggagcgccacaaacaaggagtatatacaggcaatgattctggtgaacgaagccaccataatcaattcttccacttcaatcaaggacccgatgccagtgacccagaaggaacaggaaaacaagtccaacgcttttccgtccacttcctgtgagaactcattcccagaggattgcacgtttctgacaacagaaaacaaggagatcctttctcttgaggataaggtagtggacttcagggaaaaggattcaagctctaacctgagttaccaaagccacgactgcagtggcgcctgcctgatgaagatgcccctgaacctcaagggcgaaaatccccttcagctccccattaaatgccactttcaacggagacacgcaaagactaactctcactcctccgccttacacgtgtcctacaaaacgccatgtgggaggtcactccggaatgttgaagaggtgttccggtatcttctggaaacagaatgcaactttttgttcaccgacaacttttcattcaacacctatgttcaattggccaggaactatccgaaacagaaagaggttgtctctgacgttgacattagcaatggcgtcgagagcgtgcctatctccttctgcaacgagatcgattccagaaagcttccccagttcaagtatcgcaagacagtgtggccaagagcctacaatttaacaaatttttcttcaatgtttaccgacagttgtgactgctctgaaggttgtatagatataacgaagtgcgcctgcctgcagctgactgcccggaatgctaaaacttcaccgttgtcgtccgacaagataacaactggatacaaatacaagcgcctccaaagacagatccccactggtatttatgagtgctcccttctatgtaagtgcaaccgccagctgtgtcagaacagagtggtccaacacggtccccaggtgcgacttcaggtcttcaaaactgagcagaaaggctggggcgtccgttgtttagacgatattgatcggggaaccttcgtgtgtatttactcaggtcggctgctctcgcgggccaacactgaaaagtcctatggaatcgatgagaacggcagggacgaaaacacgatgaaaaatatcttctcaaaaaagcgaaaactggaggtggcgtgttctgactgtgaagtggaggtgcttccgctcggcctggagactcacccacggaccgccaaaaccgaaaaatgcccccccaaatttagcaataaccctaaggagctgactgtggagacaaaatacgataacatctcccgaatccagtatcatagcgtgatccgcgaccccgagtctaagacagccattttccaacacaacggcaaaaagatggagtttgtgtcatctgaatcggtgacccctgaggataacgatgggttcaagcctcctagggaacatctgaattccaaaactaagggggctcagaaagacagctcatccaatcacgtagatgaattcgaagataacctcctgatcgagtccgatgtaatcgatatcacaaagtatcgggaggaaactccgccccgcagcagatgtaaccaggcaaccaccttggacaaccaaaatatcaagaaggccatagaggtgcaaatccagaaaccccaggagggtagatctacagcttgtcaacgccagcaggttttttgtgatgaggaactgctgagcgagactaaaaacacgagcagtgacagtctaaccaagttcaacaaaggtaacgtgttccttctcgacgcaactaaggaaggcaacgtcggcagattcctgaaccattcttgttgccccaacctgctggtccaaaacgtatttgtggaaacccacaaccgcaacttccccctcgtggccttttttacaaatagatatgtgaaggcacgcactgagttgacgtgggattacggctacgaggcagggacagtgcccgagaaggagatcttttgccagtgcggggtgaacaaatgtcgtaagaagattctttag

SEQ ID NO: 134107 - DNA, 975 bp, Artificial Sequence
  Description of Artificial Sequence: Synthetic coding sequence
atgtcacggcccagctctacaggaccttccgccaataagccttgtagcaagcagcctcccccacagcctcagcacaccccaagccccgccgctccacctgctgccgcaacaatcagcgccgcagggcctggcagctccgcagtgccggcagccgccgcggttattagtggacccgggggaggcggtggagccggacctgtttctccccaacatcacgaactgacctctctcttcgagtgccctgtgtgctttgactatgtcctcccccctatccttcagtgtcaggcaggacatctggtctgcaatcagtgtcggcagaaattaagctgctgcccaacgtgccgtggcgccctgacaccctcaattaggaatttggcaatggaaaaggtggcatcggcagtgctttttccatgcaaatatgctaccactgggtgttccctcacccttcatcataccgagaagcctgagcacgaagatatctgtgaatatcggccttactcctgcccttgcccaggcgcatcctgtaagtggcagggctcccttgaggccgtgatgtcccatctgatgcatgctcacaagagcattacaaccctacagggagaggacatcgtcttccttgccactgatatcaatttgcccggggcagtggattgggtcatgatgcagtcttgcttcggccatcatttcatgctggtgctcgagaaacaggaaaaatatgaggggcaccagcagttctttgcaatcgtacttctgatcgggacacgcaagcaagcagagaactttgcctatagactggaactgaatgggaacagaaggcgcctgacctgggaagcaacgccccggtctatccatgatggggtggccgcagcaatcatgaactccgattgtctggtattcgatactgccatcgcgcacctgttcgctgataacggcaatctggggattaacgtgactatttctacctgctgcccgtag

SEQ ID NO: 134108 - DNA, 990 bp, Artificial Sequence
  Description of Artificial Sequence: Synthetic coding sequence
atgatgtctaacagctcaagtgagatcgatgtcattaaaaccagaattccaacatacgatgaagacgataacaccatcctctacgcttacgaaacaaaaccggagtttgtaaacaaggaaccgaatatcgttagtgacgccagctgtaacactgaggagcaacttaaaacagtcgacgatgtactgatacactgtcaggtgatctatgacgccctccagaacttagataagaagatagacgtgattagacgtaaggtctcgaagattcagaggtttcacgcacgcagcttatggacaaaccacaaacgatatgggtacaaaaagcattcatataggctagtcaagaagcttaagctacagaagatgaaaaagaatgaggtttatgagacattttcataccccgagtcatactcaccgaccctgccagtttcccgacgggaaaacaatagtccttcgaacctgccccgacccagcttctgtatggaagagtatcagagggccgagctggaagaagaccctatcctatcccggaccccaagccccgtgcacccgtcagacttctccgagcacaactgccaaccttattacgctagcgatggtgccacctacggtagtagttccggattatgtctgggtaatcctcgggcagattctatccataacacttattctacagatcacgctagcgctgcacctccttctgttacacggagcccagtggaaaacgatgggtacatcgaggaggggagcatcaccaagcacccctctacatggtcggtagaggcagtcgttctcttcctgaaacagactgaccctctggcattgtgtccacttgtggaccttttccgatcacatgaaatcgacggcaaggccctgctgctcctgacatccgacgtgctgctcaagcaccttggggtcaagctgggcaccgccgtgaaactttgttactatatcgaccggctgaagcaaggcaagtgctttgaaaattag

SEQ ID NO: 134109 - DNA, 909 bp, Artificial Sequence
  Description of Artificial Sequence: Synthetic coding sequence
atgatgtccaacagttcctctgagatcgacgtgcaggaaccaaacatcgtttctgatgcaagctgcaataccgaggaacagctgaaaacagtggacgacgtcttgatacactgtcaagtgatctacgatgcccttcagaacctcgataagaagatagacgtcattcgcagaaaggtttctaagatccagaggttccatgctagatctctctggacaaatcataagagatacgggtacaaaaagcattcctacagattagtcaaaaaactcaagctgcagaaaatgaaaaaaaacgaggtgtatgaaacattcagttacccggagagctactctcccaccttgcccgtttcacgtagagagaacaatagtccgtccaacctgcctagaccctcattttgtatggaggagtaccagcgggcagagcttgaggaggatcccattctgagtcgcacacccagccccgtgcacccctccgactttagtgagcacaattgccagccttactatgcaagcgatggcgccacatacggaagctcgagcgggctctgcctcggcaaccctcgcgctgatagtattcataatacgtactctacggaccatgctagtgcggcaccaccctctgtgacacgatccccagtggagaatgatgggtacatcgaggaaggctctatcacgaagcacccctcaacatggtcagtggaggctgtcgttctctttttaaagcagacagacccattggctctctgtcccctggtggatctgttccgatcccacgagatagatggtaaagcgttgttacttcttacctctgatgtgctgcttaagcacctgggtgtaaagctcggcacggccgtgaagctctgctattatatagatagattaaagcagggaaaatgcttcgaaaattag

SEQ ID NO: 134110 - DNA, 627 bp, Artificial Sequence
  Description of Artificial Sequence: Synthetic coding sequence
atgaaaaagaacgaggtttatgaaacttttagctaccccgagtcttactcacccacattaccggtgtccaggagagagaataacagcccctctaatttgcctcgcccatctttctgcatggaagagtaccagagggccgaactggaggaggaccccatactgtcaaggacacccagccctgttcacccctctgatttctcggaacacaactgtcaaccttattacgcatccgatggggccacgtacgggtccagttcaggactctgcttgggaaacccaagagcggacagtatacacaacacgtattctacagaccacgcctccgctgcacctccttctgttactcgaagcccagtcgaaaacgacgggtatatcgaggaagggtctattacaaagcacccctcaacctggtcagtggaagccgtcgtgcttttcctcaagcagactgacccattggcactgtgtcccctagtggacttatttaggagtcacgagattgacggtaaagctctgctactgcttaccagcgatgtcctgctaaaacacctcggcgtgaagctcggcaccgcagtaaagctgtgttactacatcgacaggctcaagcagggtaaatgctttgagaactag

SEQ ID NO: 134111 - DNA, 627 bp, Artificial Sequence
  Description of Artificial Sequence: Synthetic coding sequence
atgaaaaagaatgaagtgtatgaaactttcagttaccctgaaagctactcccccacactgcccgtgtcaaggagggaaaacaattcacccagcaatcttccaaggccaagcttctgcatggaggagtaccagcgcgccgaattggaggaggaccccatcctttccagaacgccaagtcctgttcatcctagcgacttttcagaacacaactgccaaccttattacgctagcgacggagcgacctatggcagcagctcaggcctgtgtctcggcaacccccgagcagatagtatccacaatacatatagtaccgatcatgcaagcgccgctccaccgtctgtaactcggtctcccgtggagaacgacggctatatcgaagaaggttctatcacgaagcaccccagcacgtggagtgtagaagccgtagtcctgtttctgaagcagactgatccactcgcactctgtcccctggtggacttgttccgaagccacgaaatcgacgggaaggcactcctgttgctgacatcggacgttctcctgaagcacctgggtgtgaaattaggaactgccgtcaagctgtgttactatatcgaccggctgaaacagggtaaatgtttcgaaaattag

SEQ ID NO: 134112 - DNA, 447 bp, Artificial Sequence
  Description of Artificial Sequence: Synthetic coding sequence
atgatgtcaaactccagctcagaaatagatgttcaagagcccaacatcgtgtctgatgctagctgcaataccgaggaacaattaaaaaccgttgacgatgtactgatccactgtcaggtcatctatgacgccctacagaatctcgataaaaagatagatgtaatacgacgcaaggtcagcaagattcagagatttcatgctagatccctctggacaaaccacaagcgttacggctacaaaaagcattcctatcgactcgtgaagaaactgaagctgcagaaaatgaagaaaaatgaagtatacgaaacgtttagctaccctgagtcttatagccctactctgccggtctcccgaagggaaaacaacagcccgtcaaacctccctcggccatctttctgtatggaggaatatcagagagctgagctggaagaagatcctattctgtag

SEQ ID NO: 134113 - DNA, 2103 bp, Artificial Sequence
  Description of Artificial Sequence: Synthetic coding sequence
atgggacagaccgttaacgaagattcaatggacgtaaagaaggaaaatcaagaaaagaccccccagagctcaaccagctctgttcagagggatgatttccactgggaagagtatcttaaggagaccggctcaatttccgccccctcggagtgtttccggcagagtcagatacctccggtgaatgattttaaagtgggaatgaaattggaagcgcgagaccctcgcaatgccactagcgtttgcattgctacagtcatcggaatcactggggcaaggctgcggctgagactggacgggtctgacaacagaaacgacttctggcggttagtcgattctccggacatacaacccgtaggcacatgtgagaaagaaggtgacttgcttcaaccgcccctcgggtatcagatgaatacctcaagctggcctatgttcttgctgaagaccctaaacgggtcggagatggcaagtgccaccttgtttaagaaagaacccccaaagcctcccctgaacaacttcaaggttgggatgaagcttgaggctattgacaaaaaaaatccttatctgatttgcccagcgaccatcggtgatgtgaagggggacgaagtgcacattaccttcgacggctggtctggagcattcgattattggtgtaagtatgactcacgcgacatcttccctgccggctggtgccgcctgaccggtgatgtcctacagcctccgggaaccagcgtcccgattgtcaagaatattgctaaaacagagagttcaccctctgaggctagtcaacatagcatgcagtcccctcaaaaaacaacattgatcctccccacacagcaggtccgtcgttcaagtagaatcaagcctcccggacccactgctgttcccaagcggagcagttctgttaaaaatatcacaccgcgtaaaaaggggcctaattcagggaagaaggagaaaccacttcccgtaatctgctcaacgagcgccgcatcattgaaaagcctaacgcgcgatagagggatgctatacaaagacgtggctagcggcccttgcaagattgtgatgagtacagtttgcgtgtatgtcaacaaacacgggaattttggccctcatctggacccaaaacgcattcagcagttgcctgaccactttgggcctggtccagtgaacgtggtcctccgacgcattgtgcaggcttgcgtcgactgtgccctggaaacaaagacagtgttcgggtatctcaaaccggacaacagaggcggcgaggtgattactgccagtttcgatggagagacgcattctatccaactgcctccagtaaactccgcctcgtttgctctgaggttcctggaaaatttttgccattctctgcaatgtgacaatcttctcagctcgcagccattctcttcgtctaggggacacacccatagtagcgctgagcatgacaaaaatcagagtgctaaagaggatgtgaccgagcgccagagtactaagcgaagtccccagcagacagtgccatacgtcgtgcctctctcccccaagctcccgaaaacaaaagaatacgcatctgaaggagagcccctgtttgcaggtggcagcgccatcccaaaagaagagaatctgtcagaggactccaaaagtagcagtctaaactctggcaactatttgaaccctgcttgtaggaatcccatgtatatccacacaagcgtgtcccaggatttctcccggtccgtgcccggaactacctctagtcctttggtgggtgacataagcccaaagagcagtccgcacgaagttaaatttcagatgcagcgcaaatctgaagcaccgtcatacatcgcggttccagatccatctgtgctgaagcagggattcagcaaagacccttctacctggagtgtagatgaagtgatccaattcatgaagcataccgatcctcaaatatcgggaccgctcgccgatctgttcagacaacatgagattgacggcaaagctctgttcctgttgaaatccgatgtcatgatgaaatatatgggattaaagttgggccccgcactcaagctctgttactatatagaaaaactcaaggaggggaaatattcatag

SEQ ID NO: 134114 - DNA, 1038 bp, Artificial Sequence
  Description of Artificial Sequence: Synthetic coding sequence
atgcagtctccccagaaaactacgctgattctcccaacacagcaggtacgccggagtagtagaattaagccccccgggcccacagcggtgcccaaacgctccagctcggtgaaaaatataacgccaagaaagaaaggtccaaactcaggaaaaaaagagaagcctctccccgttatctgtagcacttccgccgcctcgttaaaatccttaaccagggaccgggggatgctgtacaaggacgtcgcatctggcccctgcaagatcgtgatgagcaccgtttgcgtgtatgttaacaaacatggtaatttcggaccccacttagaccccaagcggatccagcaactccccgaccattttggacctggtccagtcaacgttgtgctgaggcgcatcgtccaggcctgcgtagattgtgccctggagacaaagacggtgtttggctacctaaagccggataatcggggcggggaagtgatcaccgcttcctttgacggcgaaacgcactccatccaactgcctcccgtgaacagtgctagcttcgctctgagatttttagaaaatttctgtcacagtctccagtgtgacaaccttctctctagccagcccttctcgagctctcggggccacactcactcctcggcagagcacgataagaaccagagcgccaaggaggatgtcacggagcggcagtcaacaaagcgatctcctcagcagacggtgccgtacgtggtgcccttgtcacctaaattgcctaaaactaaggagtacgcttcggagggtgagccactatttgccggtgggagcgcgatcccaaaggaagaaaatctttccgaagattcaaaaagtagttctcttaattcaggcaattacctgaatcctgcctgccgtaaccctatgtatatccacacctcagtctctcaggactttagccgcagcgtgcctgggacaacgtcttcccctctagttggtgacatctcgcctaagtcatctccgcacgaagttaaatttcagatgcagagaaagagcgagggcaactag

SEQ ID NO: 134115 - DNA, 378 bp, Artificial Sequence
  Description of Artificial Sequence: Synthetic coding sequence
tgagcaaaggaagacgtgacagaacgtcagagcacgaagaggtctccccagcagactgtgccctatgtggttccattaagtcccaagttgcccaagaccaaggagtacgcttctgagggcgagccgctctttgcaggtggtagcgcgatccccaaagaagaaaatcttagtgaggactctaagtcttcaagcctgaattctgggaactatttaaaccccgcctgccggaatcctatgtacatccacacctcggttagtcaggacttttcacgctctgttccgggaaccacatcttctccacttgtcggagatatttctccgaaaagctcccctcatgaggtgaagttccagatgcagcggaagagcgagggcaactag

SEQ ID NO: 134116 - DNA, 1734 bp, Artificial Sequence
  Description of Artificial Sequence: Synthetic coding sequence
atgggccagactgtcaatgaagatagcatggatgttaaaaaggagaaccaggagaagacgcctcaatcccaaatcccacctgtaaacgacttcaaggtggggatgaagctggaggcccgggatccaaggaacgcaaccagtgtgtgcattgccacagttattggaattacgggcgcgcgcttgcgcctgcgcctggatggatccgacaatcggaacgatttttggcggctagttgactctcctgacatccaacccgtgggtacctgtgagaaagagggggatctccttcagccaccacttgggtaccagatgaatacttcttcatggcccatgttcctgctgaaaactcttaacggctcggaaatggcctctgcgactctgtttaagaaggaaccgccaaagccaccactgaacaactttaaggtgggcatgaaactggaggccattgacaaaaagaacccttacctaatttgtccggccactatcggggacgtcaagggcgacgaagttcatatcacattcgatgggtggagtggagcattcgattactggtgcaagtacgattccagagacatcttccctgcagggtggtgtcgactgacaggagatgtcctacagcccccaggaacatccgtgccaatcgttaagaacattgcaaaaactgaatcatcgcctagtgaagcatctcaacacagcatgcagtccccccagaaaaccaccctcatccttccaacccaacaagtgcgcaggagtagccgtatcaagccacccggaccaacagctgtgcctaaacgttcttcaagcgtaaagaatatcaccccaaggaagaaagggccaaattcaggtaagaaggaaaaaccactgcctgtcatctgctcaacgagtgctgcatccttaaagagtctgactagagatagaggaatgctctacaaagacgtcgcctcagggccttgtaagatagttatgagtaccgtgtgcgtttacgtgaataagcacggcaatttcggccctcacctcgatcctaagcggatacaacagcttcctgaccatttcggaccaggccctgtgaatgtggttttgcgtcgtatcgtgcaggcctgcgtggactgtgctctggaaacgaagacagtgtttggctatctgaaaccggacaatcgtggcggcgaggttatcacagcatcctttgacggggagactcatagtattcagttacccccggttaactccgcttcgtttgcccttcgcttcctggagaatttttgccacagcctgcagtgcgataacctgctgtctagccagccctttagttcttcacgaggtcatacccactctagcgctgaacatgacaagaatcaaagtgcaaaggaggatgtaactgagcggcagagtacaaagaggtcaccccagcaaacagtgccttatgttgtacccctgtctccaaaactacccaaaactaaagaatacgccagcgagggggagcccctgttcgctggcggctctgctatccctaaggaggaaaacctttccgaagactcgaaatctagttcccttaactcggggaattatctgaacccagcttgtcgcaatcctatgtatattcatacttcagtaagtcaggattttagccgttccgtgcccggaactacttcaagccccttagtgggggatatcagccccaagagctccccccacgaggttaaatttcagatgcagcggaagtctgaaggtaattag

SEQ ID NO: 134117 - DNA, 615 bp, Artificial Sequence
  Description of Artificial Sequence: Synthetic coding sequence
atgcagagctacgcctccgctatgctgtccgtcttcaattctgatgactattctcccgctgtgcaggaaaatataccagctctcaggcgcagctcttctttcctgtgcacggagtcatgtaatagcaagtatcagtgtgaaacaggggaaaattccaagggtaatgtgcaggaccgcgtgaaacgaccaatgaacgccttcatcgtgtggtcacgggaccagcgcaggaaaatggcattggagaatccccggatgcgtaactccgagatctctaagcagctgggttatcaatggaagatgctcacagaggctgagaaatggccgtttttccaggaagcgcaaaagctccaggctatgcatagagagaaatatccaaactacaaatatcgaccccgtcgcaaagcaaagatgcttcccaaaaattgctctctccttccagccgaccccgcttcagtgctgtgctctgaggttcagttagataatcgcctgtatcgggacgattgcactaaagccactcattctaggatggaacatcaattggggcatttacctcctatcaatgctgcctctagtccacagcagcgcgaccggtactctcattggaccaaattgtag

SEQ ID NO: 134118 - DNA, 594 bp, Artificial Sequence
  Description of Artificial Sequence: Synthetic coding sequence
atgcagagttacgcctcagccatgctgtccgtgttcaatagcgacgactattccccagccgtacaggagaatatcccagccctgcgaaggagctcgtctttcctgtgtacagagtcttgcaattccaaataccagtgcgaaactggggagaattccaaggggaacgttcaggacagggtcaagcgacccatgaatgccttcatagtgtggtcacgggatcagcgacggaagatggccctggagaatccccgaatgagaaacagcgagatcagcaagcagcttggctaccagtggaaaatgttaacagaggcggagaaatggccatttttccaggaggcacaaaagcttcaggctatgcacagggaaaagtacccaaactacaagtatcgacccagacgcaaagcgaaaatgctcccaaagaactgctcactgctgcccgccgacccagcttccgtgctctgctccgaggtccagctggataatagattgtatagggacgactgcactaaggctacccacagcaggatggagcaccaattgggccatttaccgccaatcaacgcggcatctgctgccaccggaccacttcaatag

SEQ ID NO: 134119 - DNA, 498 bp, Artificial Sequence
  Description of Artificial Sequence: Synthetic coding sequence
atgcagtcttacgcttccgccatgttgtccgttttcaattcggacgattactctccggccgtccaagagaatatcccagccctgagaaggagttcaagtttcttgtgtaccgaatcctgtaatagcaagtatcagtgtgagactggcgagaacagcaaaggcaatgtccaagatcgtgtgaaacggcccatgaatgcctttatcgtgtggtcccgtgaccaacgcagaaagatggctctcgagaatccacgcatgcggaactcggagatctcaaaacagctcggatatcagtggaaaatgctgaccgaagctgagaaatggcccttctttcaggaggctcagaaattgcaagccatgcaccgagagaagtatccaaattacaaatacaggccccggcgtaaggccaagatgctgccaaaaaactgctctttgctgcctgcagaccctgcttccgtgctctgcagcgaagtccaaggtcagcaggtagtgcaaggatag

SEQ ID NO: 134120 - DNA, 3729 bp, Artificial Sequence
  Description of Artificial Sequence: Synthetic coding sequence
atgaagaacctgcttaccgagaagtgcatttcatctcataattttcaccaaaaagtcatcaagcagcgaatggagaaaaaagtggactctcgttactttaaggatggtgctgtgaagaagccttactctgccaaaactctctccaacaagaaatcatcagcctcctttggaatacgcagagaactgccatctacctctcacctcgtccagtatcgcgggacgcacacctgtaccagacagggacggctcagggaactgaggatcagatgcgttgctcgtaaatttctctacctctggattcggatgacgttcggcagggtgttccccagcaaagctcggttttactacgaacagcggctactaagaaaagtatttgaagaatggaaagaagaatggtgggtcttccagcatgagtggaaactctgtgtcagggccgattgccactaccgttactacctgtataatctcatgttccagacttggaaaacctatgttcggcagcagcaagagatgcgcaataagtacattcgcgccgaagttcatgacgccaagcagaagatgaggcaggcctggaaatcctggctgatctacgttgtcgtgcgcaggacgaaactccagatgcagaccacggcactcgaatttagacagcgcattattttaagagtgtggtggagcacatggcgccagagactcggacaggtgagagttagtcgcgcacttcacgctagcgccttaaagcatagggccctttccctccaagtccaagcatggagccagtggagggagcagctcttgtatgttcagaaagaaaaacagaaggtggtgagtgccgtaaaacatcatcagcactggcagaaaagacgcttcctcaaagcatggctggagtacctgcaggtccggcgcgtgaagcggcagcagaacgaaatggccgagcggtttcatcatgtgacggtcttgcagatctacttctgcgattggcagcaggcctgggagcgccgagagtcactctacgcccaccacgcccaagtcgaaaagttagcacggaagatggcgctgagacgagcattcacccattggaagcattatatgctgctgtgtgcagaagaggccgcacaatttgagatggctgaggagcaccacaggcactcgcagctgtacttttgctttcgcgctttgaaagataatgtgacacacgcgcacctgcaacagattcggagaaatctcgcacaccagcagcatggcgttactcttctacatcgattttggaatctctggcgttcgcagatcgaacaaaagaaggagagagagctgttaccgcttttacacgccgcctgggaccactacagaatcgcgctgctgtgcaagtgtatcgagctgtggctgcagtatacccagaaacgaagatataaacaactgctccaagcacgcgccgacggccatttccagcagagagcactgccggccgctttccacacgtggaatagattatggcgatggcggcaccaggagaacgtgctgtcggcaagagcaacacgcttccatagagaaacactggaaaagcaagtgtttagcctgtggcgccaaaaaatgttccagcatagagaaaataggcttgcggagcgcatggcaattctgcatgcggaaaggcagttgctgtatcgcagttggtttatgtggcaccagcaggcagccgcaaggcaccaggagcaggagtggcagacagtcgcgtgcgcacatcataggcatggacgactaaagaaggcattctgcctgtggagagagtcagcccagggcctcaggaccgagcggacagggcgcgtgagagccgcagagttccacatggcccagctcctccgatgggcgtggtcacagtggagagagtgcctcgcattgagaggagctgaacgccaaaaactgatgagagcggacctgcaccaccagcatagcgtcctgcaccgcgccttgcaggcctgggttacctatcagggtagagtgaggtctatactacgagaggtcgcagccagggagtcccagcacaaccgccaactgctgaggggcgcattgcgaagatggaaggagaacaccatggcccgcgtcgacgaggcaaagaagacatttcaagcctcgactcactatcgcaggacgatttgctcaaaggtactcgttcaatggcgtgaggctgtcagcgtacagatgtactataggcaacaggaagattgtgctatttgggaggctcagaaagtgctagatcgaggctgcctgcgcacttggttccaacgttggtgggactgttctcgcagaagcgcccagcagcgattgcagctagaacgcgcagttcagcaccaccaccgccaactactgctggagggcctggcgcggtggaagacacatcacttgcagtgcgtacgaaaaagactcctccaccgtcagagcacccagctattggctcaaaggcttagtagaacttgttttcgccagtggaggcagcagctcgctgcaagacggcaggaacagcgggccaccgtacgagcactttggttttgggccttctctctccaggccaaggtatgggctacctggctggcatttgtgttggagcgtcggagaaaaaaagcaaggttgcaatgggccctacaagcctaccaagggcagctgttgcaagaaggcgccacgagattgctgcgattcgccgcctcaatgaaggcctctcgtcagcagctgcaagcccaacagcaggtacaggcggcgcactccctgcacagggctgttagacggtgcgctacactctggaagcagaaagtcctgggccggggagggaagccccaaccactggcggccattgcaccttcacgcaaggtcacctttgaagggcctctgttgaatagaattgccgcaggagcgggggatggaactctcgagaccaaacgcccacaggctagccggcccctcggcgcccttgggcggctcgctgcagaggagccacacgccctcgagctcaataccgcccactctgcacggaaacagcctcgtaggccccatttccttttggaaccagcacaaagccagagacctcagaaaccacaagagcacggacttggcatggctcagcctgcagcccctagcctcacaagacccttcttggctgaggcccctacggcgctggtcccacactctcctcttcccggcgcactgtcttcagcccctggtcccaagcagccaccgacggcctcaacgggtccagaactgttgctcctcccactgtctagttttatgccttgcggagcagctgccccggcccgcgtgagcgcacaaagagccaccccccgggacaaaccccccgttccttcgtctttggccagtgtacccgatccccacctgttgctgcccggggacttctcggctacaagagctggcccaggcttgtcaacagcagggagcttagacctggaggccgagctagaagaaatacagcagcagcttcttcactaccagactacaaagcagaacctctggagttgtaggagacaggccagttccttgcgtcgctggctggagctcaacagggaagagcccggtcccgaggatcaagaggtagagcagcaggtccagaaggagttggaacaggtcgaaatgcagatacagctgctggctgaagagttacaggctcaaaggcaaccaattggtgcctgcgtggcccggattcaagctctgcgccaggcactgtgctag

SEQ ID NO: 134121 - DNA, 3483 bp, Artificial Sequence
  Description of Artificial Sequence: Synthetic coding sequence
atgaagaatctgctaacagagaaatgtatctcctcccacaactttcaccagaaggtcattaagcagcgaatggaaaaaaaagtggacagccggttttactatgaacagcggctgctgcgtaaggtgtttgaagagtggaaggaagagtggtgggtatttcagcacgagtggaaactgtgcgttagggctgactgccattacagatactacctgtacaatctgatgtttcagacgtggaagacttatgtacggcagcagcaagagatgcggaacaagtacatacgagccgaggtacacgacgccaaacagaaaatgaggcaggcctggaagagttggcttatttatgtggtggtgaggaggaccaagttgcagatgcagacaaccgccctggaattccggcagcgcattattctgcgcgtgtggtggagcacctggcgccagcgacttgggcaggttagagtctcaagggcactgcatgcatccgccctaaaacacagagccctctcactgcaggtacaggcatggtcacagtggcgggagcagctcctgtacgtgcagaaggaaaaacagaaggtggtgagcgcagttaagcaccaccaacactggcagaagcgccggtttctgaaagcatggttagagtacttacaggtccggagggtcaaaagacagcagaacgagatggccgagaggttccaccatgtaaccgtgctccaaatctatttttgcgattggcaacaagcctgggagcgccgggaatctctctatgcccatcatgctcaggtggagaagcttgctcgcaaaatggcgctgcggagagcgtttacacattggaagcactacatgcttctctgtgccgaagaggcggctcagttcgagatggccgaagaacaccatcgccacagccaactttatttttgcttccgagccttgaaagacaatgtcacccatgctcatctgcagcagatacggcgaaatctggcccatcagcagcacggggtgacacttctgcacaggttttggaacctgtggcgctctcagatcgaacagaaaaaagagcgggaactcttacccttgctgcacgccgcctgggaccactacaggatagctttgttgtgtaaatgcattgaactgtggcttcaatatacacagaagcggcgatacaaacagctcctgcaggctcgggccgatggacattttcagcagagggcgcttccggctgctttccatacatggaatagactgtggcggtggagacatcaggagaatgtgctgtccgctcgggcgactagattccaccgtgagaccctggagaagcaggttttttcgctgtggaggcaaaagatgtttcaacaccgggagaacaggctggctgaaaggatggcaatcctccacgcagagcggcaactcctgtacagatcatggttcatgtggcatcagcaggcggccgcgcgtcatcaggaacaggagtggcagaccgtcgcctgtgcccaccaccggcacggaaggttgaagaaggccttctgcctgtggagggaaagtgcacaagggttgagaacagagcgcaccgggcgcgtacgcgcagctgaattccacatggcacagctcttgcgatgggcttggtctcaatggagggaatgcctggccctacggggtgctgaacgtcagaaactaatgagggccgacttgcaccaccaacatagtgtactacacagggcattacaggcatgggtcacctaccagggcagggtccgcagtattttgagagaagttgcagctagggaaagccagcacaatcgtcagcttttacgcggagcactccgaaggtggaaggagaatactatggctcgggtggacgaagcaaagaagacttttcaagcctcaacccactataggcgaactatctgttctaaagtgctggtccagtggagagaggctgtgtcggtgcagatgtactatcgccagcaggaggattgcgctatctgggaggctcagaaagtccttgatcgggggtgccttcgtacatggttccaacggtggtgggactgctctaggcgatcggcccagcagcgactgcagcttgagcgggctgtgcagcatcatcatcgacagctactcttagagggcttggcccggtggaagacgcaccatctacagtgcgtcagaaaaaggctcctgcacaggcagtccacccagttactggcccagcgtttatctcgcacgtgttttcgccaatggcgccagcagctggcggccaggcgacaggagcagagggccacagtgagagctctatggttttgggctttttctctgcaggccaaggtctgggccacctggcttgccttcgtcttggaacgcagacggaagaaagcgcgtctccagtgggccctccaggcttatcaaggtcagctgctgcaggaaggggctactaggctgctgcgctttgctgcatctatgaaagcctctcggcagcagctccaggctcagcagcaggtccaggctgcgcatagtcttcacagagccgtccggaggtgcgcaacactatggaagcagaaggtgctcggcaggggaggtaaacctcagccactcgcggccattgcacccagccgcaaagttaccttcgaggggccactgctgaaccgcattgccgccggggccggcgacggcacactcgagacaaagaggcctcaagcgtccaggccacttggcgctctgggacgattagccgctgaggagccacatgccctagagctgaacaccgcccactcagctcgtaaacaacccaggaggccccactttctgttagaacccgctcagagtcagcgcccccagaaaccccaagagcatgggctggggatggcgcagcccgcggccccctccctgaccaggcccttcctggcggaagcgcccaccgccttagtccctcattctccgctgcctggagccctgagctcagctcctggacccaagcagccacccaccgcctccaccggacctgaacttttgttgttgcccctgtcaagctttatgccttgtggcgccgccgcgcctgccagagttagtgcacagcgtgcaacccctcgtgataaaccaccagttccaagttctctggctagcgttcctgacccacacctcctgctgcctggggacttcagcgcgacgcgtgcagggccagggttgtctacagccggcagcttggatctggaagccgaactggaggagatccagcagcagctgctgcactaccaaaccaccaaacaaaacctgtggtcgtgccgtaggcaagcttcgtccctaaggcgctggttagaactgaaccgcgaagaacctggacccgaagaccaagaagtcgagcagcaagtccagaaagaattggagcaggtggagatgcagattcagctgttggccgaagagctgcaggctcaacgacaaccgatcggagcctgtgtagctcgaatccaggccctaagacaggctctatgctag

SEQ ID NO: 134122 - DNA, 3096 bp, Artificial Sequence
  Description of Artificial Sequence: Synthetic coding sequence
atgaagaacttgctgaccgagaaatgtattagctcacacaattttcatcaaaaagtcataaaacagcgcatggagaagaaggtcgatagcaggttttactatgagcagcgcctcctgagaaaagtgttcgaggaatggaaggaggagtggtgggtattccagcacgagtggaaactctgtgtccgagctgattgccactacagggtttggtggtccacctggaggcagcggctgggtcaggtgagagtgtctagggccttacacgcttcagcgttaaaacaccgggctttgtctctgcaggtccaggcttggtcgcagtggcgcgagcagttactgtatgtgcaaaaagaaaagcagaaggtggtgagtgcggttaagcatcaccagcactggcagaagaggaggttcctcaaagcttggctggaatatctgcaagtgagaagggtaaagcggcaacaaaatgagatggcggaacgattccaccatgttactgttctgcagatttatttttgtgattggcaacaggcctgggaacgccgggaatctttgtacgcacaccacgctcaggtcgagaaactcgcccgcaaaatggccctcagacgagcattcacccactggaagcactatatgttactctgtgccgaggaagccgctcagtttgaaatggctgaagaacaccatagacattcgcagctgtatttctgtttccgtgcacttaaagacaatgtgacccacgcccatcttcaacaaatcaggaggaatctagctcatcagcagcacggcgttacactcctccaccgattctggaatctgtggcggagtcagatagagcagaagaaagagcgggagctcctgccgctcctgcacgcagcctgggatcactacaggattgctctcttatgtaaatgcattgagctgtggttgcagtacacacagaaacgcaggtacaaacagctcctgcaggccagagcagacgggcactttcaacagcgagcacttcctgccgcgtttcatacctggaaccgcctctggcgctggcggcatcaagaaaacgtcctgtccgcaagagcaaccaggtttcatagagagacgctggagaagcaagtcttctcgctctggagacagaagatgtttcagcatcgggagaaccggttagctgagcgcatggccattctacatgctgaacgacagctcctgtatcgctcttggttcatgtggcaccagcaggcagccgcccgccatcaggagcaggagtggcagaccgtagcctgcgctcatcaccgtcacggacggctgaagaaggctttctgcttatggcgggagagtgcgcaggggctgcggactgaaagaactggccgagtcagagcagctgaattccacatggcccaactgctacgctgggcctggagtcagtggcgtgagtgcctcgccttacgcggtgcggaaagacagaaactcatgcgagccgacttgcaccatcagcacagtgttctacatcgggccctgcaagcatgggttacttatcagggccgcgtcagaagcattctgagggaggtggctgcccgagagagtcaacacaatcgtcaactactgagaggagctctcaggaggtggaaggagaacacaatggcccgggttgacgaggcgaagaaaacattccaagcatccacccattacagacgaactatctgtagcaaagtgcttgtgcagtggagggaagctgtgtcggtgcagatgtactatcgtcagcaggaagactgtgctatatgggaagcgcagaaggtcttagaccgcggttgcctacggacctggtttcagcgatggtgggattgttctaggcgctctgcgcagcaacgcttgcaactagagcgggccgtccaacaccaccatagacagctgcttctcgaaggcctggctcgctggaagacgcaccatttgcagtgcgtccgtaaaagactactgcacagacagtctacccagttactggcacaaaggctctcacgcacgtgttttagacaatggaggcagcagctggccgcccgtcgtcaggaacagagagccacggtgcgcgcactgtggttctgggccttcagtcttcaggctaaggtatgggcgacctggctcgcgttcgtcctggagcgccgcagaaagaaggccagacttcagtgggccctacaagcgtaccagggtcagctcttacaggaaggcgcaacacgtctcctcaggttcgccgctagcatgaaggcctctcggcagcagcttcaggctcaacagcaagtgcaggctgcccatagtctccatagagcggtccgccgctgtgcaaccttgtggaaacagaaggtcctggggaggggaggcaaaccccaaccattagctgccatcgccccttctcggaaagtcacctttgaagggcctctgctgaacaggatcgccgctggtgcgggcgatggtaccctcgaaactaagaggccacaagctagcaggccccttggggccctgggacggctggcagccgaggaacctcacgcattggaacttaacacggcccactcagcgcgtaagcagcctagacgaccacacttccttcttgagcccgcacagtcccagaggccccaaaaaccgcaggagcatggcttgggaatggcacagcctgccgccccctctttgacacggcctttcctggccgaggctcctacagcattagtcccacatagcccgttaccaggagcactcagtagcgctcccggacccaagcagccgccaacggcctcaaccggacctgaactgcttctgcttcccctgagttcatttatgccttgtggcgcggcggcacccgcaagagtgagcgcccagcgtgccaccccacgtgacaagcctccagtcccatcaagcctggcgagcgtcccagacccacacttacttctccccggggattttagcgccacaagggccggtccaggattgtctacggccgcttggacgcttaggctgaacttaagaaggtcatcatccaattactgcactacccgccctccatcgaggacatcaggtcctgtaggaggaaagcgagcagcgtgtgcaggtggatggtcttag

SEQ ID NO: 134123 - DNA, 2976 bp, Artificial Sequence
  Description of Artificial Sequence: Synthetic coding sequence
atgaagaatcttcttactgagaagtgcatttcctcccacaattttcaccaaaaagtaatcaagcagagaatggaaaagaaggtggacagccgctactttaaagatggggccgtcaaaaagccatatagcgccaaaacattatccaataagaagtctagcgcctcctttggaataagaagagaactccctagtaccagccatctggttcagtatcgcggaactcacacttgcacgagacaaggcaggctgcgagaactccgaatccgattctattacgagcagaggctgctgcgaaaggtgttcgaagagtggaaggaagaatggtgggtgtttcagcatgaatggaagctgtgtgtcagggccgactgccattatcgttattacctctataacctgatgtttcagacgtggaaaacctacgtgcggcagcagcaagaaatgcgaaataagtacattagagccgaagtccatgatgccaagcagaaaatgcgtcaggcctggaaaagctggctgatatacgtcgtggtgcgccgcacaaaactgcagatgcaaacaactgctttagagttccgccagagaattatccttcgcgtgtggtggtccacttggcggcaacgactgggccaggtccgcgttagcagggccctgcatgcctccgccctaaaacaccgagccctgagcctccaggtccaggcttggtcacagtggcgggaacaactgctgtacgttcagaaagaaaaacaaaaggtggtgagtgccgttaagcaccatcaacactggcagaagcggcgttttctgaaggcttggctggagtacttgcaggtgcggcgggtgaagcgccagcagaacgaaatggctgaacgatttcaccacgtcactgtcctgcagatctacttttgtgactggcagcaagcatgggagagacgggagtcactgtatgctcatcacgctcaggtcgaaaagcttgccagaaagatggcccttcggagggcatttacccactggaaacattacatgcttctctgcgcagaagaagccgcgcagtttgaaatggctgaagaacaccacagacactcccagttatatttttgtttccgagcactcaaggacaacgtcactcacgcacacctgcaacagatccggcgcaatctcgcccatcagcaacacggagtcacgctgctgcacaggttctggaacctctggaggtctcagatcgagcagaagaaggaacgcgagttgctccccttgctgcatgcggcctgggaccactatcgcattgctttgctgtgtaaatgtattgagctatggctccaatatacacagaaacggcgttataagcaactattgcaggcccgtgctgatggacacttccagcaacgcgctctcccagccgcattccatacctggaacagactatggcgctggaggcaccaggaaaacgtgctgtccgctagggccaccaggttccaccgtgagacgctggagaagcaagtattcagtctttggcgccagaagatgtttcagcacagggagaatcgtctcgcagagaggatggccattttgcatgccgaacggcagctgctgtacagaagctggtttatgtggcatcagcaggccgccgctagacaccaggaacaggagtggcagactgtcgcctgcgcacatcacaggcacggcaggctgaagaaagccttctgtctgtggcgcgagtctgctcaaggcctcaggaccgagcgtacagggcgtgtgagagcggccgagttccatatggctcaactcttacgctgggcttggtctcagtggagggaatgtttagcactgaggggtgcagaaagacagaaactcatgcgcgcagatctgcaccatcaacacagcgtgctccaccgagccctgcaagcgtgggtcacctatcaggggagagtccggagtatcctccgggaagtggcagccagggaaagccagcagttgcaggcccagcagcaggtacaagcggcccactcgctccatcgggccgtaaggaggtgtgccacgctgtggaagcaaaaagtactgggccgggggggtaagccccagccgttggctgctatagccccttctagaaaggtgacttttgagggtccactcctcaatcggattgcagctggcgctggcgacggaacccttgagacaaagagacctcaagcctcaagacctttgggagctttgggccggctagccgccgaagagccgcacgctctcgaacttaacaccgcacactctgctcgaaagcagcctcgccggccacacttcttgctggagcccgcccagagccagagaccccaaaaacctcaggagcacggcctggggatggcacagccagccgctcccagcctgactcgaccttttcttgctgaagccccgaccgccttggtgccacactcaccattgcccggcgcactcagcagcgcacctggccctaaacaaccacctactgcttctaccggacctgaacttctgctccttccattaagttctttcatgccatgcggagcagcggcccctgctcgtgtgagcgcacagagagccaccccacgcgataagcctccggtcccaagcagccttgctagcgttccagatcctcatcttctgctgcctggcgacttttcagcgaccagagccggccctggcctgtctacagcaggatctctggatcttgaggccgaactggaagagatccagcagcagctcctgcattatcaaactacaaagcagaatttatggtcatgtcgaagacaggccagctcactccgacggtggctggagttgaaccgtgaggaaccgggacccgaagatcaagaggtagagcaacaggtgcagaaggagcttgagcaggtggagatgcagatacagctgctcgccgaggagctgcaggcgcaacggcagcccattggtgcctgtgtggcccgcatccaggcgctccgtcaggctctttgttag

SEQ ID NO: 134124 - DNA, 3636 bp, Artificial Sequence
  Description of Artificial Sequence: Synthetic coding sequence
atgaagaatctcctgaccgagaaatgtataagttcacataatttccatcagaaagtgattaagcaaagaatggaaaaaaaggtagattctagatactttaaagatggagccgtcaagaagccctactcggccaagactctaagcaacaagaagtcatctgcctccttcggcatacgaagggaactcccctccacttctcatcttgttcagtacagaggtacccacacttgtacacggcaaggtcggctgcgcgagctgaggatccgctgcgttgctcgcaagttcctctacttgtggatccggatgacgttcggcagggtctttccctcaaaggcaaggttctactatgagcagaggctcctgcgcaaggtattcgaggagtggaaggaagagtggtgggtattccagcacgaatggaaactgtgtgtgcgagcagactgccactatagatactacttatacaacctgatgttccaaacttggaaaacctatgtcaggcagcaacaggagatgcgcaataaatacattagggccgaagtgcacgacgcaaaacagaagatgcgacaggcttggaaatcctggctgatatacgtggtggtgaggagaacgaagctacagatgcagactacggcgctagagttccggcagcggattattcttagggtgtggtggagcacttggcggcagaggctgggacaggtgagggtgtccagggcgctgcacgctagcgcactgaagcatcgcgctctgtccttacaggtgcaagcgtggtcacagtggcgtgagcagctgctgtatgtgcaaaaggaaaaacagaaagttgtttccgccgtcaaacaccaccagcattggcaaaaacggaggtttctcaaagcatggctggaatatcttcaggtgcgacgtgtgaagagacagcaaaatgagatggccgagagatttcaccacgtcaccgttctgcaaatttacttttgcgactggcagcaggcttgggaaagacgggagtccctctatgcacaccacgcacaggtggaaaagctggcccgcaaaatggccctaaggagggcctttacccactggaaacactatatgttgctgtgcgccgaggaagccgcccagtttgaaatggctgaagagcaccacaggcactcccagttgctgcttcacagattctggaacctgtggaggagccagatagaacagaagaaagagagagagctcttaccactgctgcacgcggcttgggatcactacaggatcgcgctgctgtgcaaatgtatagagttgtggctccagtatactcagaaaagacgctataaacagctccttcaagccagggccgatgggcatttccagcaacgcgcccttcccgctgccttccacacctggaatcgcctctggcgctggcgtcaccaagaaaatgtgctctctgcgagggcgaccagatttcacagagagacccttgagaagcaggtgtttagcctgtggcgtcagaagatgtttcagcatcgtgagaaccgcctggccgaacggatggccatcttgcacgcagaacgccagctgctgtatcgcagctggttcatgtggcatcaacaagcggctgctcgccaccaggagcaggagtggcagactgttgcctgtgctcaccaccgccatgggcgattaaagaaggcattttgcttgtggcgagagtccgcacagggactcagaacggagcgaacagggcgggtccgtgctgcagagttccatatggcccagttgctcagatgggcctggtcacagtggagagagtgtcttgctctcagaggggcagaacgccagaaactgatgagggctgaccttcatcaccagcatagtgtattgcacagagcccttcaagcttgggtgacctaccaggggcgggttaggagtatcctgcgcgaggtagccgcacgtgaaagtcagcacaacaggcaactcttacgcggcgccttgcggcgttggaaagagaacactatggccagagtagacgaggcgaagaagacattccaagcctccacccattaccgtaggacaatttgctctaaggtcctcgtgcaatggcgcgaagccgtgagtgtgcagatgtactatcgccagcaggaggactgcgccatatgggaggcccaaaaagtcctggatcgggggtgtctgcgcacttggtttcaacgatggtgggactgtagcaggcggagcgcacagcagaggttgcaactggagcgggccgtccagcatcaccaccgccaattgttattagaagggctggcaagatggaagacacatcacctccaatgcgtgaggaaaaggttgcttcataggcagtccacccagctcctcgcccagcgcttgtcacgaacatgctttcgacaatggcgccagcagctggcagccagaaggcaggaacagagggcaaccgttcgagccttatggttctgggcattttccctacaggccaaagtgtgggcgacttggctagcattcgtgttggaaaggcgacgcaagaaggctcgtctacaatgggcacttcaggcttatcaggggcaactcctgcaggaaggagcaacgcgcctgttacgattcgctgcttccatgaaggcttcacggcagcagctccaggcccagcagcaagttcaagccgcgcactcccttcaccgagctgtcaggcggtgcgctacactgtggaagcagaaggttctggggcggggcggtaagccccagcccctggccgcaatagccccatctcggaaagtaacatttgaaggccccctcttgaatagaatcgccgccggagccggcgacgggactctcgaaaccaaacgccctcaggcatcgcggccccttggcgctctgggacgtctggcagcagaggaacctcacgcactggaattgaacaccgcccactccgccagaaaacagccaaggaggcctcactttctccttgagcccgcgcagtctcagagaccacagaaaccccaggaacacgggctaggaatggcccaaccggctgcccctagtttaacaagacctttcctcgccgaggctcccaccgccctggtgcctcatagcccactccccggggctctgagcagtgccccaggacccaagcagcccccaactgcctccactggccccgagttgctcttattgcctctgtcatccttcatgccttgtggtgcggcagccccagctcgcgtgtccgcccagcgggctacccccagagacaagcccccagtccccagctcacttgcaagcgttccagaccctcatttactgctccccggagacttttccgcaacaagggctggccccgggctgagtacggctgggagcctggacctcgaggctgaactggaggagatccaacagcaactgctccattaccaaaccactaagcagaacctttggagttgccgccgtcaggcatcttcattgcgccgttggttggaactgaacagggaggagccaggcccggaggaccaggaggttgagcaacaagtccagaaagagttggagcaagtcgaaatgcaaattcagttattagctgaggaactgcaggcacagcgccagccaattggggcatgcgtggcgaggatccaagcgctccggcaggcactttgctag

SEQ ID NO: 134125 - DNA, 3483 bp, Artificial Sequence
  Description of Artificial Sequence: Synthetic coding sequence
atgaaaaatctgctgaccgagaagtgtatttccagccacaacttccaccagaaagtcatcaaacagcggatggaaaagaaggtagattcacgcttctactatgagcagcggctgctgcggaaagtcttcgaagagtggaaggaggagtggtgggtcttccagcacgagtggaagctgtgtgtccgggccgactgccattatcgatactacctgtataatctgatgttccagacatggaagacctacgttaggcagcagcaggagatgcgcaataagtacattcgggccgaggttcatgatgctaaacagaagatgaggcaggcctggaaatcttggctcatttacgtcgtcgttcgaaggacgaagctgcagatgcagacgacggcgctggagtttcggcagcgaataattctccgagtgtggtggtccacttggcgacagagacttggtcaggtgcgagtaagcagggcactccacgcctcagctctgaaacaccgggcattgtccctccaggttcaggcatggtcacagtggagagaacagttactgtatgtgcagaaggagaagcagaaagtcgttagcgcggtgaagcatcatcagcactggcaaaaacgaagatttctgaaggcgtggctagaatatctgcaagtgcgtagggtgaaaagacagcagaacgaaatggctgaacgcttccatcacgtaaccgtcctgcagatctatttctgcgattggcaacaggcttgggagcgaagggagagtttgtatgctcaccacgcccaggtggagaaactggcccggaagatggccctgcgtagggctttcactcattggaagcactatatgctgctctgtgcagaggaagccgctcagtttgagatggccgaggaacaccaccggcactcccaactctacttttgctttagagcacttaaggacaacgtcactcatgctcacctgcagcagatcaggcggaacctcgcacatcagcagcacggcgtaacactcctgcaccggttttggaatctatggagaagccagatcgaacagaagaaggagcgggaattattacctctcctacatgccgcatgggatcactacagaatcgccttactttgcaagtgtatcgaactttggctccagtatacacagaagaggaggtataagcagctcctacaggcccgcgctgatgggcactttcaacagagagctctccctgctgcgtttcatacgtggaataggctgtggaggtggaggcatcaggagaatgtactgtctgctagagccacaagatttcaccgcgagacactagaaaagcaggtgttttccctttggagacaaaaaatgttccaacaccgggagaacaggctggccgaacgcatggccatactgcatgccgagcgacagcttctttacaggagttggtttatgtggcaccagcaagctgccgcccgacaccaggagcaggagtggcaaaccgtcgcatgtgcccaccatcgtcacgggcggctcaagaaggccttctgcctatggcgcgaatcggctcaagggctcagaactgagagaactggccgagtcagggctgctgagttccacatggcccaattattacgttgggcgtggtcgcagtggcgcgagtgcttggcactcaggggggcagagcgacaaaaactcatgagggccgatctccatcaccagcacagcgttttacacagagccctgcaggcctgggtgacataccagggtcgcgtgcgcagcattctgagggaagtcgcggctagggagtctcagcacaatagacagctgttaagaggtgccctgaggcgctggaaggaaaatacgatggcccgtgtcgacgaggctaaaaagaccttccaggcaagtactcactacaggagaacgatatgttctaaggtgctcgtccaatggagggaagccgtgtctgtgcagatgtactatcgacagcaggaggattgcgccatctgggaagcacagaaagtgttagaccgcggctgcctgcgcacatggttccagaggtggtgggactgctcacgacgttccgctcagcagagattgcagctggagcgggctgtccagcaccaccatcgacagttattgctagaaggccttgctagatggaaaactcaccatctccagtgcgtgcgtaagagactcctgcacagacaaagtacccagctgctggcccagcggctgagccggacttgcttcagacagtggaggcagcagttggctgccagacggcaggaacagcgggctaccgtcagggccctctggttttgggccttctcacttcaggccaaggtgtgggccacctggttggcctttgtgctagaacgccgcagaaaaaaggcccgactgcagtgggctctgcaggcatatcaaggacaactgcttcaggagggtgcaaccaggttgctccggtttgccgcctccatgaaggcctctcgccaacagctgcaggcccagcaacaggtccaggcggcccatagcttgcatcgcgctgtccgcaggtgtgcaaccttgtggaagcagaaggtcttaggacgcggaggaaaaccccaacctctggccgctatcgccccttcacgtaaagtcactttcgagggaccgttgctgaaccggatcgcagcaggggccggtgatggcacactcgaaactaaacggcctcaagcctcgaggcctctgggggcgctgggcaggctggcagccgaggagccgcacgccttagaattaaacacagctcactccgcacgcaagcagcccagacgaccccatttcttgcttgagccagcacaaagccagcgtcctcagaagccacaggagcacgggctggggatggcgcagccagctgcaccatcactgacacgaccctttctggccgaagcaccaacagctttggtgcctcattcccccttgcccggtgctctctcatctgcgcccggaccaaagcagccacccaccgcttccacgggccctgagctgttacttctgccactgtctagttttatgccctgtggggcagccgccccggcccgtgtatcagcccagagggccacaccgcgcgacaaaccccctgtgcctagctctttggcatccgtgcccgacccccacctgttactccctggcgacttttccgctacccgggcgggtcccggcctgagcaccgctgggagcctggatttggaggctgaacttgaagagatccagcagcagctccttcattaccagacgacgaaacagaacctgtggagctgtcgtcgccaggccagcagcctcaggaggtggctggaacttaatcgggaagaacctggacccgaggatcaggaggtagagcagcaggtgcagaaggagcttgagcaggtggaaatgcagatccagctcttggccgaagaactccaggcgcaaaggcagcctatcggagcgtgcgtggcgcgtatccaggctctgagacaggccctgtgctag

SEQ ID NO: 134126 - DNA, 240 bp, Artificial Sequence
  Description of Artificial Sequence: Synthetic coding sequence
atgaagaacctgctgacagaaaagtgcatctcctcgcacaattttcatcagaaggttattaagcagcgcatggagaaaaaggtcgatagtcggtattttaaagatggggccgtgaagaagccatattcggctaaaaccttgtcaaacaagaagtccagcgcatccttcggcataaggagggagctccccagcacgagccacctcgtccagtaccgtggaacacacacatgcaccagatag

SEQ ID NO: 134127 - DNA, 3564 bp, Artificial Sequence
  Description of Artificial Sequence: Synthetic coding sequence
atgaaaaatctcctgacagagaagtgtatatccagtcacaatttccaccagaaggttatcaagcagaggatggagaaaaaggtcgatagccgctacttcaaagatggcgcggtgaagaaaccatattccgcgaaaacgctgtcaaacaagaagagctcggcttccttcgggatcaggcgcgagctgccttccacttcccatctggtccaataccggggcacccatacgtgcacccgtcaggggcgcctccgggaactacggattagattctactacgagcagcggttgctccggaaggtgtttgaggagtggaaggaggaatggtgggtgttccaacacgaatggaaactgtgtgttcgtgccgattgtcactacagatactacttgtacaaccttatgttccagacctggaagacatacgtgaggcagcagcaggagatgcggaataagtatatccgggccgaggtgcatgatgctaaacaaaaaatgagacaagcctggaaatcatggttgatctacgttgtggtcagacgaacgaagcttcagatgcagacaactgctttggaatttagacagcgtatcatactcagagtctggtggtctacatggagacagcgcctgggccaggtccgagtctccagagctctgcatgcgagtgcgctcaaacatagggcgctttccctccaggtccaggcttggagccaatggagggaacaacttctctacgttcagaaggaaaagcagaaggtcgtgagcgctgtgaaacaccaccagcattggcagaagcgaagattcctcaaagcctggctggaatacttgcaggtccgccgggtcaaaaggcaacagaatgaaatggccgaaaggttccaccacgttactgttctgcagatctacttttgtgattggcagcaggcctgggagcgccgagaatctctgtatgcccaccatgcccaggtcgaaaaactagctcgaaaaatggcacttcggcgcgcctttactcactggaaacactatatgctactgtgtgctgaggaggctgcacagttcgagatggccgaagagcaccacaggcattcccagcttttgctccatcggttctggaatttatggaggtcacagatcgaacagaagaaagaacgggagctgctgcccctcctacacgccgcctgggatcactacagaatcgccctgctctgcaaatgtatcgaactgtggcttcagtacacccaaaagcggcggtacaaacagctgctgcaggcccgcgctgacggacatttccagcagcgtgcactccctgctgcgttccatacatggaatcggctctggcggtggcggcatcaagagaatgtcctgagtgctcgggctactcgatttcaccgggaaactctcgaaaagcaggttttttctctctggcgccaaaagatgttccagcacagggaaaaccgcctagccgagcgaatggcaatcctacacgccgaacgccagcttctgtatcgctcttggtttatgtggcaccaacaagcggccgctcgccaccaggaacaggagtggcagaccgtcgcatgcgcccatcaccggcatggcaggctaaaaaaggcattctgtctgtggagggagtccgcccaaggactgcggacagaacgcacgggtagagtgagggcagcagagtttcacatggctcaactgttgcggtgggcatggagccaatggcgggaatgcctggccctgaggggcgcagagagacagaaattgatgagggccgatttgcaccatcagcattctgttcttcatcgagcactgcaggcctgggtgacataccagggaagggttcgctccattctgagagaggtggcagcacgtgagagccagcataataggcagctgttgcgtggggcactccgcaggtggaaggaaaatacaatggctcgagtagatgaagctaaaaaaacctttcaggcatctacccactacaggcggaccatatgttccaaagtgctcgtccagtggagggaggctgtcagcgtgcaaatgtattacaggcaacaagaggactgcgcaatttgggaggcacagaaggttctggataggggatgcctgcgtacctggttccagagatggtgggactgtagcagacggtccgcccagcagcggctccaacttgaacgggcggttcagcaccaccatcgccagttgctcctagagggccttgcccgctggaagacccaccatctgcagtgtgtgcgtaagcgcctcctccatcgtcaatctacccagctgctagcccagcggctgagtagaacatgttttcgacagtggaggcagcagttagccgctcgccgacaggagcaaagagccactgtgcgtgcactttggttttgggccttctctctacaagcaaaggtatgggctacctggttagcttttgtcttggagcgtcgcagaaagaaagcccggctccaatgggccctccaggcgtatcagggacagttgctgcaagaaggagcaactaggttgctgcgttttgccgccagcatgaaggcctccagacagcagctgcaagcacagcaacaggtccaggcagcccattctctgcaccgcgcagtgcgcagatgcgctacactgtggaaacagaaggtgctgggaaggggaggcaaaccccagccactggctgcaattgctccctccaggaaggttactttcgagggccccctattgaacaggattgccgccggggctggtgacggcactctggagactaaacgtccgcaagccagtagacccctgggggctctgggtagactggctgcggaagagccccacgctcttgaactgaacaccgctcacagcgcaagaaaacagccacgccgtccacacttcctgcttgagcccgctcagagtcagcgtcctcagaaacctcaggaacacgggcttggaatggcccagcctgcggcaccatccctgaccagacccttcttggccgaggctcccacggctctggtcccccattcacctttgcccggagcccttagttccgcccctggcccaaaacagcccccaaccgctagcaccggacctgagcttttacttttgccccttagttcatttatgccctgcggagcggctgcccctgcccgggttagcgcgcagagagcaacaccccgggacaaaccgccggtccccagctctctagccagtgtgcccgatccccacctcttgcttccaggagatttcagtgccactagggccggcccaggactgtcgacagccggcagcctggatctggaagccgagctcgaagaaattcagcaacaactcctacactaccagaccactaaacagaatctgtggtcatgccgacgacaagcctcgagtctgaggcgctggctggaactgaaccgggaggagcccggacccgaggatcaggaggtcgagcagcaagtgcagaaagaactggagcaggtagaaatgcagattcagttgctggctgaagaactgcaggcgcaacgccagcccataggggcatgcgttgctcgcatccaagccttacgacaggctctgtgttag

SEQ ID NO: 134128 - DNA, 378 bp, Artificial Sequence
  Description of Artificial Sequence: Synthetic coding sequence
atggacgctgtggcagtatatcacggaaagatttccagagagactggggagaagctgctactcgccacaggcctggatggctcttaccttttaagagactcagagtccgtccccggggtttactgcctgtgcgtgttgtaccacggctacatttacacctatcgggtgtctcagacagaaacaggaagctggagcgccgagaccgcacccggcgtgcacaagcgatactttcggaagatcaaaaatctgatttcagcctttcaaaagcctgatcaaggaattgttatccccttgcagtatccagtggaaaagaaaagcagcgccaggtccactcaaggcatccgggaagaccccgatgtgtgtctaaaagccccctag

SEQ ID NO: 134129 - DNA, 387 bp, Artificial Sequence
  Description of Artificial Sequence: Synthetic coding sequence
atggatgctgttgccgtctatcacggaaagatatcacgtgagacaggagaaaagttgctactggcaactggcctggatggttcttacctccttcgtgactccgagtccgtgccaggtgtgtattgcctgtgcgtcctttatcacgggtatatctatacgtatagggtgtctcagaccgagaccggatcatggagcgccgagactgcaccaggagtgcacaagcgctactttcggaagatcaagaatctcatctctgcttttcagaagccagaccaggggatagtgattcctcttcagtaccctgttgagaaaaagtcctccgcacgttctacgcaggggaccaccgggattagagaagatcctgatgtatgcctgaaggccccatag

SEQ ID NO: 134130 - DNA, 177 bp, Artificial Sequence
  Description of Artificial Sequence: Synthetic coding sequence
atggacgctgtggcagtttaccacggcaagatcagccgcgaaactggtgaaaaactgctcctggccacaggactggacggctcctatctcctgcgtgacagtgagagcgtccctggggtgtactgcttatgcgtgcttcaccactggggctatatcaaatttatcaataaactgtag

SEQ ID NO: 134131 - DNA, 234 bp, Artificial Sequence
  Description of Artificial Sequence: Synthetic coding sequence
atggatctcccttactatcacgggaggctcacaaaacaggattgcgaaacactcctcttaaaggagggcgtcgacggcaacttcctgcttcgggattccgagagtattcctggcgtcttgtgtctttgtgtcagcttcaaaaacatagtttacacatatcgtatttttagagaaaagcatggctactaccgtatacagaactctaatagcgactacgttgacgttctgccctag

SEQ ID NO: 134132 - DNA, 399 bp, Artificial Sequence
  Description of Artificial Sequence: Synthetic coding sequence
atggacttgccatactaccatggacggctgaccaagcaagattgtgagacactgctgcttaaggagggcgtggacggtaactttcttctgagagactccgaatcaataccaggggtgctttgtctatgcgtcagttttaagaatatagtatacacatacagaatcttcagggagaaacacggatattatcgaattcagactgcagagggatctccaaagcaggtcttcccgtccctgaaagagctgatctccaaatttgagaagcccaaccaaggaatggttgttcacctcctgaaacccatcaagcggaccagtccaagcctaaggtggagaggccttaaattagagttggagaccttcgtgaattcaaacagcgattatgtggacgtgctgccgtag

SEQ ID NO: 134133 - DNA, 2271 bp, Artificial Sequence
  Description of Artificial Sequence: Synthetic coding sequence
atgaatggcgctccctcgcccgaagatggcgcatccccaagctcacctccattgccacctcctcccccacctagttggcgcgagttctgcgagagccatgcacgcgctgcagcgcttgactttgctagacggtttagactgtacctagctagccaccctcagtacgccggtcctggcgccgaagcagcattctcccggaggttcgcagagctgtttctgcagcatttcgaggctgaggtggcaagagcaagcggaagtctaagcccccccatactggccccacttagcccgggagccgaaatctcacctcacgatctcagcctggaaagctgccgcgtcgggggcccactggccgtcctcggccctagtcggtcttctgaagatcttgctggacctctaccctcctccgtcagcagttcatctacaacgtcctccaaaccgaagctaaaaaagcggttttctctgaggagcgttgggagaagtgttcggggatctgtacgggggatactccagtggaggggcacggttgacccaccttcatctgccggcccactcgagacttcctcaggacctccagtcctgggaggaaacagtaattctaattcaagtggcggagcagggacagtcgggcgggggctcgtttcggatggaacctcacctggcgagcggtggacacacaggtttgagagattgagattgtcacgcggtggcggcgccttgaaggacggcgcaggcatggtccagcgagaggagctgctgagtttcatgggggccgaagaggccgctccagaccccgctggcgtggggagaggcggcggagtggctggtccaccctctggcggcggcggtcagccccagtggcaaaagtgtcggctattgctcagatccgaaggggagggaggcggcgggagccggctggagttcttcgtgccgccaaaggcttctagacctagactttccattccttgctcttccatcaccgatgttagaacaacaacagctctggagatgccggaccgggaaaacacctttgtcgtaaaagttgagggccccagcgagtacatcatggagacagtcgatgcccagcacgtgaaagcctgggtctccgatatccaggaatgcctctcccctgggccatgtcccgctactagtccccggcccatgacactgcctttggccccaggaactagctttctgacccgtgagaatactgactccttggaacttagttgtttgaaccactccgagtctttgcctagtcaggatttgttgctcggaccatccgagagtaatgatcgcttgtcccagggtgcttatggggggctgtctgatagaccttcagccagcatctctccttcctccgctagcattgccgctagtcacttcgattcaatggaactcctgccccccgagttgccacctaggatcccgatcgaagagggtccaccgaccggtactgtgcacccactcagcgcaccctaccctcctcttgatacaccagagacagcgacaggctcctttctcttccaaggggagccagaggggggggagggagatcaacccctgtctggctacccctggttccacggaatgctgtcaagattaaaggccgcccaacttgtcctgacaggaggaactggatctcacggcgtgttcctcgttcgccagtccgaaacccgccgcggcgaatatgtgctcacgtttaactttcagggcaaagcgaaacatctccgtctcagtctaaatgaagaagggcagtgtcgcgtacagcacctgtggtttcagtccattttcgacatgcttgagcattttcgagtccaccctatcccactggaatcaggtggcagctccgatgtggtactggtgagctatgtgccgagctcacagagacagcaagagccgacaaccagtcatgatcctccccaaccgcctgagcctccctcttggacagaccccccccagcctggagcagaagaggcatcacgcgcccccgaagtggctgcggctgcagctgctgctgcaaaggaacgccaagagaaagaaaaggccggtggaggcggtgtcccagaagagcttgttcccgtggtggagctggtgcctgttgtggaactggaggaggccattgccccagggtcagaagcccaaggggccggcagtgggggcgatgccggcgtgcccccaatggtccaacttcaacaatctcccttaggcggagatggggaggaggggggtcaccctcgtgctatcaataatcagtattcttttgtgtag

SEQ ID NO: 134134 - DNA, 2016 bp, Artificial Sequence
  Description of Artificial Sequence: Synthetic coding sequence
atgaacggtgctccatcgcccgaggatggcgccagtccatcatccccccccctcccaccccctcccccacctagttggagagagttctgcgagtcccacgcccgcgcggccgctctagattttgcacgtcgcttccgcctttatctagctagccacccacagtatgccggccctggagctgaggcagctttcagtcgccgctttgcggagttattcctgcagcacttcgaagccgaagttgcacgagcctccgggagtcttagtcctcctattctggctcctctgtccccaggcgccgaaatctcaccacacgacttgtccctggaaagctgtcgagtcggggggcccttggctgtactgggtccgtcaaggagcagtgaagatctggctggccccttaccctcttccgtgagcagttccagcaccacaagtagcaagcctaaactcaaaaagcgtttcagcctacgctcggttgggagatctgtgcgcggcagcgtccgggggatcctccagtggaggggaaccgttgaccctccaagcagcgccggaccactggagacatccagtggccctccagtgctcggaggcaacagcaactccaattccagtggaggagctggcaccgttggacgtgggctcgtgtccgacggtacgtcgccgggcgagagatggacccatcgattcgagcgtctgcgactgagtagaggggggggagctctcaaggatggggctggtatggtgcagagggaggagctgttgtcgtttatgggcgccgaggaggccgcgcccgatcccgccggcgtgggcagaggcggcggcgtggctggaccaccaagcggcggaggcggccagccgcaatggcagaagtgtagactgctgctgcgatcagaaggagaaggaggcggggggagtcggctggagttcttcgtccctcccaaggccagtagacctcgcctctcgataccctgttcatctataactgatgtcagaactacaacagcgctcgagatgcccgaccgcgagaacaccttcgtggtgaaggtggagggaccatctgagtacattatggaaacagtagacgcacagcatgtgaaggcctgggtttccgacatccaagaatgtttatcccctgggccttgtccggctacctcccctcgcccgatgactttgcctttagcacctgggacttcttttctgacccgtgagaacacagattccctcgagttgtcttgcctcaaccatagcgaatctctgccgagccaggacctgttattgggaccatctgaatcgaacgatcgactgagtcaaggtgcgtacggcggattaagcgacaggccttcagcctcaatctctccatcctccgccagtattgctgcctctcattttgattctatggaactccttccccccgagctgccaccccgtattcccattgaagaagggccccctacagggaccgttcatccgttgagcgccccctatccaccactggatacaccggaaaccgccactggatcctttctttttcaaggcgaaccagagggtggagaaggcgatcagcccctatctggctacccatggttccatgggatgctgtcccgactcaaggctgcgcagctcgtcctgactggagggaccggatcccacggcgtgtttttggtacgacaaagtgaaacaaggcgaggcgagtatgtgttaacatttaactttcaggggaaggctaagcatttgcgtcttagcttaaatgaggaagggcaatgccgggtgcagcacctgtggttccagtctatctttgacatgttagaacactttcgagtacatccaattcctctggagtctggaggttcgagcgacgtcgtgcttgtctcatacgtcccctcgagccagcggcagcagggcagagagcaggctggctctcatgcaggggtttgcgaaggtgacggctgtcatccagacgcctcctgtacgttgatgccttttggcgcgtccgactgtgtgaccgatcacctgccctag

SEQ ID NO: 134135 - DNA, 2052 bp, Artificial Sequence
  Description of Artificial Sequence: Synthetic coding sequence
atgaacggggccccaagccctgaagacggcgccagccccagcagtccacccttaccaccccctcctccacctagctggagagaattttgtgaatcacatgccagagcagcagcactggactttgctcggagatttcgcctgtatctcgcctcacacccacagtacgctggcccgggcgctgaagcggctttttcacggcgttttgcagagctatttctccagcacttcgaagctgaggtggcccgagcttctggatctctgagccccccgatactggctccactgtcccccggggcggaaatctccccccacgacttaagtctggaaagctgtcgcgtcggtggtcccctagcggtgcttgggccttccaggagtagtgaagaccttgccgggcccctgccatcaagcgtgtcgagcagtagcacgacaagctcaaagcccaaactgaaaaaaagatttagcttgcgttctgtcggacggtcggtgcgcggttccgtgagggggatcctccaatggagaggtactgtcgatcccccatcttcagcagggccacttgaaacctcatcgggcccacccgtgcttgggggaaattcaaatagcaattccagcggaggcgccgggaccgtgggcagggggctggtttctgatggtacttctcccggagagaggtggacacaccggttcgaacgcctgagattatccaggggggggggtgcgctgaaggacggggccgggatggtacaaagagaggagctcctgtcatttatgggggctgaggaggcagcccccgatcccgcaggggtgggtcgggggggcggcgtagctggcccaccatcaggtggcggcggacaacctcaatggcagaagtgccgactgctacttagatccgaaggcgagggtggtggaggctcacgcctcgagttcttcgtgccaccgaaagctagtcgtcccagactcagtattccatgttcaagcatcaccgacgtgcgaactacgaccgccctggagatgccagatagagaaaacactttcgtggtcaaagtcgaagggcccagcgagtatatcatggagacagttgatgctcagcacgtcaaggcttgggtttccgacatccaggaatgtctttcccctggcccttgcccagcaactagtccaagacccatgaccctgccattagctcccggaacgtccttcctgactagggagaatacagattcactggagctgtcgtgtctaaaccatagcgagagcctgccttctcaagaccttctactcggacctagcgagagcaacgatcgattatcccaaggagcctacgggggcctatctgaccgcccatccgcaagcatttccccatcctccgcatccattgccgcaagccacttcgattccatggagctactcccccccgaacttcctcccaggataccgatcgaggaggggccccctactgggaccgtgcaccccctctctgcaccttatccaccccttgacacacctgagactgctaccgggtctttcctttttcagggggagccagagggaggtgagggggatcagcctctgagtggatacccttggtttcacggcatgctatctcgattgaaggctgcacagctggtcctgacaggtgggaccggctcccatggcgtgttccttgtgagacagtccgaaacacggagaggagaatacgtattaacgtttaatttccagggaaaggcaaagcatttacgactgtcactgaacgaggagggtcagtgccgagtgcaacacctgtggtttcagagcatatttgatatgctggagcactttcgagtacatcccatcccccttgagagcggcggatccagcgatgtcgtgttggtatcttatgtaccgtcttctcagcggcagcagggcgaacagtctcggtccgctggggaggaggtccctgtgcatccaaggtccgaagcaggtagtcgattgggagccatgcgcggctgcgccagagagatggacgcaacccccatgcctccagccccaagttgtcctagcgaaagagtgaccgtgtag

SEQ ID NO: 134136 - DNA, 2016 bp, Artificial Sequence
  Description of Artificial Sequence: Synthetic coding sequence
atgaacggagcacctagcccagaagatggcgcttccccgtccagcccccctttgcctccccccccccccccatcctggagagagttctgcgagtctcatgcaagagcagcagctctcgactttgcaaggcggttccgattgtacctggcttcacacccccagtacgccgggcccggagcagaagccgctttctcccgacggttcgcagagttgtttctgcagcactttgaagcagaagtggctagggcttccgggtctctctctccacctatcctggccccattgagcccgggggctgaaatctctccccacgatttatctcttgaatcctgccgagtggggggccccctggctgtgctgggtcccagtaggtcgtccgaagatctggccggtcccctgcctagttctgtgtcttctagctccacaactagtagtaagcccaaactcaaaaagagattcagtctccgtagcgttggacgctctgtgcgcggctctgtccgggggattttgcagtggagaggtaccgtggatccgccgtccagtgccggcccccttgagacctcaagcggtcccccagtccttggcggaaacagcaactctaatagctctgggggagccggcaccgtgggcagggggctcgtgagcgacggaacatcccccggggagcggtggacgcatcggttcgagagattgcgcttgtcccggggcgggggggcacttaaggacggtgccggcatggtgcaaagggaagaactgctgagtttcatgggagcagaggaggccgctcccgatcccgccggagtgggccggggcggtggcgttgccggaccacctagcggcggcggtgggcagccgcagtggcaaaagtgcaggcttttgcttaggagtgagggcgaaggtgggggaggatccagactggagttttttgtgcccccgaaagctagcagaccgagattatctattccttgtagctctattacagatgttcgaactactacagcactcgaaatgccagacagggaaaatactttcgtggtgaaggttgaaggaccttcagagtatatcatggagactgtggatgcccagcatgtaaaggcctgggtaagtgatattcaggaatgtctttcccccggaccttgcccagccaccagcccacggccaatgacactgccacttgctccaggcacctcctttctcactcgggaaaataccgatagcctggagctatcttgtctgaatcattctgaaagcctccccagccaagacctgctgttgggaccgagcgaatccaacgaccggctgtctcagggggcatacggaggattatccgatcgcccctccgctagcatttccccatctagtgcgagcatcgcagctagtcattttgatagcatggagctgctgcctcctgagctgcctccgagaatcccaattgaggaaggaccacccaccggaaccgtgcacccacttagtgccccctatcctccactggacactccggagacggctactggcagctttctgtttcagggagagcccgaaggcggtgagggggatcaaccgctctccggctacccgtggtttcacgggatgttgtcaaggctgaaggcagcacagttagtcttgactgggggaaccggaagtcacggcgtgttcttggttaggcagtccgaaaccagacgtggggagtacgttctcacctttaacttccagggcaaggccaagcatctgcgactctccctgaacgaggaggggcagtgtcgagtgcaacatctgtggtttcagtctatctttgacatgcttgaacatttccgagtgcatcccatacccctagagagtggggggtctagtgacgtggtgttggtatcatatgttccgagcagccagcgccagcaggggagagaacaggcggggtcccatgcaggggtgtgcgaaggggatgggtgccacccggatgcaagctgtactctcatgccttttggggcttcagattgcgtgacagatcatcttccatag

SEQ ID NO: 134137 - DNA, 1008 bp, Artificial Sequence
  Description of Artificial Sequence: Synthetic coding sequence
atgcccgaccgcgaaaacacgttcgtggtgaaggtcgagggcccatcagaatatattatggagactgtggatgcccagcacgtcaaggcgtgggttagcgatatacaggaatgcctgtctcctggaccctgtcccgccactagcccgaggccaatgactctgcctctggctccagggacttctttcctgactagggaaaatactgactccttggagctgtcatgtcttaatcatagcgagagcctaccatctcaggatctcctgttgggaccaagcgagtctaacgataggttgagccagggggcgtacgggggcctctccgaccgtcctagcgcgagcattagtccttcttctgcttccattgcggcatcccacttcgactctatggagctactccctcctgagctccctccgagaattcctatcgaggaaggccccccgactggcaccgtacatcctctaagtgctccctatccaccacttgacactcccgagactgctacaggctcttttctctttcagggggaacccgaggggggggaaggggaccagcctctgtccggttacccatggttccacgggatgctaagtcgactgaaggcagcacaattggtgttaaccggaggtactggcagtcacggggtctttctcgtgagacagagcgagactagacgtggagaatacgtcctcacattcaactttcaggggaaggccaagcacctgcggctcagtcttaacgaggagggccagtgccgggtgcagcacttgtggttccagagtattttcgacatgctcgaacatttccgggttcatcccatacctctcgagagtggaggaagctctgatgtggtgctggttagctacgtgccttcaagccaaaggcagcagggccgtgaacaggctggctcacacgccggggtttgcgagggcgacgggtgccacccagatgcttcctgcactctcatgcctttcggggcaagcgactgtgtcacagaccatctgccgtag

SEQ ID NO: 134138 - DNA, 1122 bp, Artificial Sequence
  Description of Artificial Sequence: Synthetic coding sequence
atggccgaagcttccagaccacggctctccatcccctgcagttcaatcactgatgtcaggacaacaacggctctcgagatgcctgatcgggagaacacttttgtggtgaaggtcgagggcccatcggaatacatcatggaaaccgtagacgcccagcacgtcaaggcttgggtaagcgatattcaggaatgcctgtctcccggtccgtgccccgcaacttctcctcgccctatgaccctgccactggctcccgggactagcttcctgaccagggagaataccgactccctagaactgagttgcttaaatcactcagaatctctgccttcacaagatctccttctcgggccaagcgagagtaatgacaggttatctcagggtgcttacggcgggctgagcgataggccttccgcctcgatttctccctcctccgcaagtatcgccgccagccacttcgacagtatggagttgctccctcccgagctgccaccacgcattcctatcgaagagggcccgcctacgggcactgtgcatcccttgagtgccccttaccctcctttggatactccagaaaccgcaactggaagtttcctcttccaaggtgagcctgaaggaggggagggggatcagcccctgtctggttacccctggtttcatgggatgctgtcacggctgaaggcagcgcagctggtgcttacgggagggactgggtcccacggggtcttcctggtccgacagtccgaaaccagacggggggagtacgtcctgacctttaacttccagggcaaggccaagcacctgcgactgtctctgaatgaagaggggcagtgtcgcgtgcagcacctctggtttcagtccatctttgatatgttggagcatttccgtgtccatcccatccccctagagtcgggtggcagcagcgacgtggtcctcgttagctacgtcccatcctcccagagacagcagggtgaacagagcaggagcgcaggggaggaagtcccagtccaccctcgttctgaggcaggtagcaggctgggagcaatgcgaggttgcgctcgtgaaatggacgcaacgccaatgcctcctgctccttcctgtccctcagagcgtgtgaccgtgtag

SEQ ID NO: 134139 - DNA, 1728 bp, Artificial Sequence
  Description of Artificial Sequence: Synthetic coding sequence
atgaacgggccagctctgcagccgagctccccctcctccgccccaagcgccagtcctgctgccgcccccaggggatggagtgagttctgtgagctgcacgcagtcgccgctgcccgcgagcttgcccgacagtattggttgttcgccagggaacatccccagcatgcccccctgcgtgcagagttggtgtctttgcagttcacagacctatttcagcggtacttctgcagggaggtgagagatgggcgtgcaccaggccgcgactacagggacacaggaaggggccctccagctaaagccgaagcgagtccagaaccaggaccagggccggccgcccctgggttaccaaaggcacgcagcagcgaggaactggccccgccccgcccccccggcccgtgcagctttcagcacttccgacgatctcttagacacatctttagacggcgctctgcaggagaactccccgctgcacacacagccgctgccccgggaactccgggtgaggccgcggaaacaccagcacgcccggggttggccaaaaagtttctgccgtggtccctcgcccgggagcccccacccgaggccctgaaagaggctgtcttgcggtatagcctcgctgacgaagctagtatggattcaggggctcgttggcagcgcggccgactcgccctccgcagagcacccgggccggacggtcctgaccgagtcctggaactattcgacccccctaagtcatcgagacctaagctgcaggcggcctgtagctccattcaggaggtgcggtggtgcacgcggttggaaatgcccgataacctctatacattcgtgctgaaggttaaagacagaacggacatcatatttgaggtgggcgatgaacaacaattgaacagctggatggccgagttgagcgaatgtacagggaggggcctcgaaagcaccgaggctgagatgcatatcccatcagccctggaacccagtacatccagctcccccagaggcagtaccgactctctgaatcaaggagcaagtccaggtggacttctcgatcccgcatgccagaagaccgaccacttcctgtcctgctatccttggtttcatgggccaatttcacgtgtcaaggctgcccagctggttcagctgcaaggcccagatgcccacggagtgttcctggtccgacagtcagaaactagacgtggtgaatacgtgctcactttcaattttcagggtattgctaagcatctcaggttgagccttactgaacgtggtcagtgcagggtgcagcacctacactttccaagtgtcgtcgatatgctgcaccacttccagcgctcacccatacccttggaatgtggggcagcctgtgacgtgcggctatcgtcttatgtggtagtcgtgtctcaaccacccggctcctgcaatacagtgctgtttccgttctctctcccccattgggatagtgagtctttgccccattgggggtcagaattgggcctcccgcacttgtccagtagcggttgcccccggggactgtcacccgaggggctgccagggcggtcttcaccacccgagcagatcttccatctagtcccgtcacccgaagaactggccaacagtctacagcacctggaacatgagcctgtcaatcgggctagagactccgattacgagatggattcttcttctaggtcacatcttcgggccattgataatcagtatactcctctttag

SEQ ID NO: 134140 - DNA, 1122 bp, Artificial Sequence
  Description of Artificial Sequence: Synthetic coding sequence
atggggtttccagtgctgtgtcgcggatggcggcgcacctggccaggttgcgccagctggctcggcgctcccccgccacagaagcctcttctaagtcccctgctgttgaaccatcggagttccaaatctagtcggcctaaattgcaggcggcatgcagttctatccaagaggtcaggtggtgcacacggctcgaaatgcctgataatctctacacctttgtcctgaaagtgaaagacagaaccgatattatatttgaggtcggggacgagcaacagttgaatagttggatggccgaattgtctgagtgcaccggcagggggctcgagagcacggaggccgaaatgcatattccctcggctctggaacctagtaccagtagtagcccacggggctcaactgatagcctgaaccagggggcctctcccgggggtcttctggaccctgcctgtcagaagactgatcatttcctgtcctgctacccctggtttcacggccctattagtagagtgaaggccgctcagctggtgcagttacagggccctgacgcccacggcgtatttctggtacggcagagcgagaccagacgtggcgagtatgtccttacattcaacttccagggcatcgcaaaacacctgcggctgtcactaacagaaagggggcagtgcagagtacaacatcttcattttccttccgtagtagatatgctacaccacttccaaagatccccaataccactggagtgcggcgccgcctgcgatgtccgtctgtccagctacgtagtcgtggtgtctcagccccccggtagctgcaatactgtgttattccccttctcacttccccactgggactcagagagtcttccacattggggaagtgagctcggcctgccccacctgtcatcatccggctgtcctcgcggacttagtcctgaaggattgccggggcgttcatcccccccagagcaaatttttcacctggtgccgagcccagaggagctagcaaattctcttcagcacttggaacacgaaccggtaaatagggctcgggacagtgactacgaaatggactctagctcccgctcccacctccgagctatcgataaccaatatacccccctgtag

SEQ ID NO: 134141 - DNA, 1209 bp, Artificial Sequence
  Description of Artificial Sequence: Synthetic coding sequence
atgattccacccagttctcctcgcgaagatggcgtggacggattaccaaaggaggccgtgggagccgagcagcccccatccccggctagcacatcaagtcaggagtccaagttacagaaattaaagcgctccctgagctttaagaccaagagcctgagatcgaagtccgccgataacttctttcaacgcactaactctgaggacatgaagttgcaggcacatatggtggccgaaattagcccctccagctcacctctacccgctccggggtccctgaccagcactcctgcaagagctggcctgcatccaggcgggaaagcacacgctttccaggagtatatattcaagaagcctactttctgcgatgtctgtaaccatatgatcgtagggaccaatgccaaacacgggctgagatgtaaggcttgtaaaatgtccatccatcataagtgcactgacgggctggctccccagagatgcatgggtaaattgcctaaaggctttcggcgctactattcttcacctctgctgatccacgaacagttcggctgcataaaggaagtgatgcccattgcttgtggcaacaaggttgacccagtttatgagaccctgagatttgggacaagtctagctcagaggacaaaaaaaggctcctcaggttccgggtctgactccccccatcggaccagtactagtgatctggttgaagtgcccgaggaggctaacggacctggcggtggctacgacttacgtaagcgcagtaacagcgtctttacctatccagagaacgggacggatgatttccgggaccccgccaagaatattaatcaccagggctccctctctaaggaccccctgcagatgaacacttacgtggcactctacaagtttgtgcctcaggaaaatgaggacttggaaatgcgaccaggggacatcatcaccttactggaagactcgaacgaagattggtggaaaggcaaaatccaggaccgaattgggtttttccccgcaaacttcgtacagagactgcagcaaaatgaaaaaatatttagatgtgtcaggactttcattggctgtaaagagcagggccagatcactctaaaagagaatcaaatttgtgtttcttcagaagaggaacaggacggtttcatcagggtcctgagcggcaaaaagaaaggccttattccccttgacgtgttggagaacatctag

SEQ ID NO: 134142 - DNA, 1005 bp, Artificial Sequence
  Description of Artificial Sequence: Synthetic coding sequence
atgaaacttcaggcacacatggtcgcggaaattagcccatcaagttccccacttcccgctccaggctctctgacaagcaccccggcccgggcgggactgcaccctggcgggaaggcccacgcctttcaggaatatatatttaaaaaacctactttttgtgatgtttgtaaccatatgattgtaggaactaacgccaagcatggcctccgatgcaaggcgtgcaagatgtccatccatcacaaatgcacggatggactagcccctcagagatgtatgggaaagctaccaaaagggtttcggaggtattatagtagccccttattaatccatgagcagtttggatgtattaaggaggtgatgcccatagcatgcgggaacaaagtcgatcccgtgtatgaaacactccgcttcgggacgtcgctcgcacagcgtactaagaagggaagttcaggtagtggctcggattcaccccatcgcacttccacaagtgacctagttgaagtgcccgaagaggcaaatggacccggtggggggtacgacctccgaaaacggtccaactctgtatttacctatccagagaacgggactgatgactttagggacccagccaaaaatataaatcaccagggttcgctgtccaaagaccctcttcaaatgaatacctacgtggccttatacaagttcgtcccgcaggagaatgaggacctggagatgcggccaggggacatcattacgctgctcgaggattctaacgaagattggtggaagggaaaaattcaggatcggataggcttctttcccgccaattttgtacagagattgcagcaaaatgagaagatttttcgctgcgtcagaaccttcattgggtgtaaggagcagggccagatcactttaaaggagaatcagatctgtgtgagttcagaagaggagcaagacgggttcatcagagttttgagcggaaagaagaaagggttgatccctctcgacgtgcttgagaatatttag

SEQ ID NO: 134143 - DNA, 4422 bp, Artificial Sequence
  Description of Artificial Sequence: Synthetic coding sequence
gtagctattatcgcagggaatttcgaactggccgagtatataaaaaatcataaggaaactgacatagtgccatttagagaagcccccgcgtattccaataggcggagacgccccccgaacacccttgccgcaccacgcgtgctgttgcggtccaattcggacaataacctcaacgccagtgccccagactgggccgtttgctccaccgccacttcccatcgctccctgagcccccagctcctgcagcagatgcctagtaaaccggaaggcgccgccaagaccataggctcatatgtcccggggccccgctccagatcacctagcttaaaccggttgggtggagccggagaggatgggaaacggccccagcccctgtggcatgtcggctcaccatttgccctgggcgctaacaaggacagtctctctgccttcgagtatcccggtcctaagcgcaagctgtattccgcggtgcccggcaggctattcgtggcagttaagccatatcagcctcaagttgatggcgaaattcccctgcaccgtggcgatagagtgaaagtgctgagtatcggggaaggcgggttctgggagggatcagcccgcggacacattggctggttcccagcagagtgcgtcgaggaagtacagtgtaaacctcgcgattcccaggccgaaaccagagccgaccgtagcaaaaagcttttccggcactacacagtgggcagttatgacagttttgacacttctagtgattgcataattgaggagaagactgtggtactgcagaagaaggacaatgaagggttcggctttgtcttgcgtggggccaaagctgatactccaattgaagagtttactcccacccccgccttccccgccctgcagtatctagaatctgtcgatgaggggggagtagcctggcaggctgggttgcgcactggcgactttctcattgaagtgaataacgaaaacgttgtaaaggtagggcacagacaggtggtgaatatgatccggcagggcggcaatcatcttgtgcttaaggttgtgactgttacccggaatctcgacccagatgatactgccaggaaaaaagccccgcccccgcccaagcgcgccccgaccactgcattgacattaaggtcaaaatccatgacatccgagttggaggagctggttgacaaggacaagcccgaggagatcgtccccgcctcgaagccctcgagggcagcggagaatatggccgtggagccccgggtagctacaatcaagcagaggccctccagccggtgcttccctgccggaagtgacatgaactcggtatacgaaagacaagggatagcggtcatgacaccaacagtccctggcagcccaaaagcaccttttctgggcataccccgcgggaccatgcggcggcaaaaatctatcgactcccggattttcctgtcaggaatcacagaagaagagcggcagttcctggcgcctccaatgcttaaatttacgagatcattatctatgcccgacacgagtgaggacatcccacccccaccacagtcagtgccgccctccccccctcccccgtcccctaccacgtacaattgccccaagtccccgactccccgagtttacgggactataaagccagcgtttaatcagaactcagccgcaaaggttagtcctgcaactcggagtgatacagtagctaccatgatgcgggagaaaggcatgtactttcgcagggaactggaccgctatagcctcgatagtgaggatctgtattctaggaacgccggcccacaggcaaattttcggaataagcggggacagatgcctgagaatccttatagtgaggtgggcaagatcgcgtcaaaagcagtatatgtgccagccaaaccagccaggaggaaaggaatgctggtgaagcagtccaatgtagaggactcccctgagaaaacttgctctataccaataccaacaatcatagtgaaagagcctagcactagctcatcaggcaaatcttcccagggcagctcaatggagattgaccctcaggctcccgaacctccttcgcagcttcgtcctgatgaaagcctgacagtgagttctccttttgccgcagctatcgccggtgccgtccgcgatcgagaaaagaggctggaggcccgtcgcaatagtccagctttcctgagcactgatcttggagacgaggatgtggggctgggtcctcccgctccacgcacaaggccatcaatgttccctgaggaaggtgactttgccgacgaggatagcgccgagcaactgagctcaccaatgccatctgctacaccccgagaaccggaaaaccatttcgtcgggggcgccgaggctagcgctccgggagaagccggaagacccttgaattccacaagcaaagcgcagggccctgagagctcgcctgccgttcccagcgccagctctggcactgccgggccaggaaactatgtgcacccgctgaccggacgcctgctggacccctcttctcccctggcactggctctgagcgccagggatagagccatgaaagaatcacagcagggccccaagggtgaagcgcctaaggccgaccttaataaacctctttacattgacacgaagatgcgccccagcctggatgccgggttcccaacggtgactagacagaatactagaggaccattgcggaggcaggagacagaaaataaatatgagaccgaccttggccgcgatcgtaagggagacgacaagaaaaatatgctgattgacattatggatacttcccagcaaaagtccgctgggttactgatggtgcatacagtggatgctaccaaactcgataacgctctacaggaggaggacgagaaggcagaggttgaaatgaagcccgactccagcccatctgaggtaccagagggcgtctccgagaccgagggcgcactgcaaatttctgctgctccagaaccaaccacagttcctggccgcaccatcgtggcagtgggctcaatggaggaggccgttatcctgccatttaggatccccccacctcccctggcttctgtggacctggatgaggacttcatcttcaccgagcctctgccacctccgctggagttcgccaactcgtttgatattcctgacgacagggctgcaagcgtacctgctctgtccgacctggtcaaacagaagaaatccgacacacctcagtcgccatcacttaactcaagccaaccaacgaatagcgcagactctaagaaacccgcgagtctgagtaactgtttaccagccagttttttacctcctcctgaaagcttcgatgccgttgcagactccggcattgaagaagtggactccaggagctccagtgaccatcacttggaaaccacctctaccatttccacagtctcaagcatcagcaccctgtcctccgaaggaggcgagaatgtggacacttgtactgtgtatgcagacggacaggcatttatggttgataaaccccccgtccctcccaagcctaagatgaaacctatcatccataaatcaaatgctctctaccaggatgcgctggttgaagaagatgtcgattcgttcgttattccccctcctgctcctccacccccacctggtagcgcccagcccggcatggctaaggtcctgcagcctagaacatccaaactctggggagacgtaacagaaataaagtcaccgatactgtccgggcctaaagcgaatgtgatctctgagctgaacagtatccttcagcagatgaaccgagaaaaattggccaagcccggagaaggcttagactctcccatgggggcaaaaagtgctagccttgctcctcgctcccccgagattatgtccaccatcagcggcacaagatctaccaccgttaccttcactgtaaggcccgggaccagtcaaccgattaccctgcagtctaggcctcctgactatgagagtcgcacaagcggaaccaggagggctcctagccctgtggtgagccctacagagatgaataaagaaaccttgcctgccccactaagcgccgccactgccagtccaagtcccgccctcagcgacgtgtttagccttccttcccagccaccatctggcgatctgtttggattgaacccggcggggcgttccaggagcccatccccctccattctgcagcaacctatcagtaacaagcctttcacgaccaagccggtgcatctgtggaccaaacccgatgttgctgactggctggagagtcttaacctgggagagcacaaagaagccttcatggacaacgagatcgacgggagccacctgcccaatctgcagaaagaagacttgattgatttaggcgtgacccgggtcggacaccgaatgaacatcgaaagggccttgaaacagctccttgatagatag

SEQ ID NO: 134144 - DNA, 5553 bp, Artificial Sequence
  Description of Artificial Sequence: Synthetic coding sequence
atgccccgctcccccacatccagcgaagacgaaatggcccaaagctttagcgactatagcgttggctcggaaagtgattcatcaaaagaggaaaccatatacgataccatcagagctaccgctgagaagccaggcggcgccaggaccgaggaatcccagggaaacacactcgttataagagtcgtaatccacgacctgcagcagaccaagtgcatcagattcaaccctgacgctaccgtgtgggtggcaaagcagcgaatcctgtgcacattgactcaatctctgaaagacgtactcaactacggtctgtttcagcccgcaagcaacggcagagatgggaaatttctggacgaagagagactcctgagggagtatccacagcccgttggtgagggtgttccttccctggagtttcggtacaaaaagagagtttacaagcaggcttccctggatgaaaagcagttggccaagctgcacacaaagactaatttaaagaagtgcatggatcatattcagcataggctcgtagagaaaattactaagatgctggatagagggctcgatccgaacttccacgaccctgaaacaggagaaactccactgactctggcggctcagctcgatgactcagtggaagtgatcaaagcattaaagaatgggggggcgcaccttgactttagagccaaggatgggatgacagctcttcataaagccgctcgggcgcgcaaccaggttgccctgaaaacactcctggagctgggcgcgtcacctgactacaaagatagctacggcctcacccctttgtatcacaccgcaatcgtcggcggcgacccatactgctgtgaactgctccttcacgaacacgccacagtgtgctgcaaagatgagaacggctggcatgagatccatcagtcgcgatgctggggacatatatctgagcctcaccacaccctcctgagcggatcagcccgtagccagcagtctcgttccgcatcatctgccctccatgtctgtgccatgtactcttctttctcttgtgtgagaatctccctactgtttcacgggaggattacagaacttaagcagtacaagaagtctacgccgtttcaggtcgctatcatagccggtaatttcgagttagcagaatacatcaaaaatcacaaggaaactgacattgtgccctttcgcgaggcaccagcctactctaaccggcgcagaagaccacccaatactctcgccgcccccagggtactccttagaagcaactccgataataatctaaacgcgagcgctcccgactgggctgtgtgtagtaccgcgacatcccacaggtctcttagcccccagctgctgcagcagatgccaagcaaacctgagggagctgctaagaccatcgggtcttacgtgccgggacccagatctcgtagccctagcctgaacagactaggaggcgccggggaggacggtaagagacctcagcccttgtggcatgtgggatcccctttcgccttaggcgcaaacaaagactcactaagcgcattcgagtaccccggcccaaaaagaaaactctattcagcagtgccaggccgtctctttgtggccgtcaagccttatcagccccaggtggacggtgaaattcccttacacaggggggatcgggttaaggttctgagcatcggagagggggggttttgggaagggtccgcaaggggacatattggctggtttccagctgaatgtgtcgaagaggtgcaatgtaaaccgagggacagccaagccgaaactagagccgaccggagtaagaaactttttaggcactatactgtgggcagttacgattcattcgatacaagctctgattgtatcattgaagagaagactgtcgttctgcaaaagaaggacaacgagggattcggattcgtgttaaggggggcaaaggccgacacccctattgaggaatttacacccacccccgccttccctgccctgcaatatctggagtcggtggacgagggaggagtcgcttggcaagcgggcttacgtaccggagattttctgattgaggtcaataatgagaatgttgttaaagtgggacaccgacaagtggtgaatatgatccgccaggggggaaaccatctggtactcaaggttgtaaccgtgactaggaacctcgatccggacgataccgcgcgcaagaaggcaccccctccccctaagcgggcacctacaacggccctcacattacggtccaagtccatgacatctgaacttgaagaacttgttgataaaggtgtgatccggaaagtgtcagataagcctgaggaaatcgtgccagcttcgaagccgtcacgtgcagctgagaacatggcagtagagcctcgagtcgctactattaagcagagaccatccagccgatgcttcccggctggttctgatatgaattctgtttatgaaaggcagggaattgcagtcatgacaccaacagtacctgggagtcccaaggccccttttctgggaatccccaggggcacaatgaggcggcagaaatctattgactcccgtatttttctgtctggcatcacagaggaagagagacagtttcttgctccacccatgctgaaatttacccgcagcctgtcaatgcctgacacgtcagaagacatcccccccccgcctcaatcagtccctccatctccacctccaccttcacccaccacctataactgtccaaagtccccgactcctcgggtttatggcaccatcaaacccgcctttaaccaaaatagtgcagctaaagtatcccccgcgaccagatccgatactgtggcaacaatgatgagagaaaaggggatgtactttaggcgagagctggatcgttattctttagattccgaggatttgtactccagaaacgctggccctcaagccaactttagaaacaaacgcgggcaaatgccggaaaatccatattccgaagtgggaaagatcgcgtctaaagcggtctacgtcccggcaaagccagcccgcaggaagggaatgttggtgaaacagtcgaatgtggaagactctcccgagaagacttgtagtatcccaatcccaacaattatagttaaagagccgtccacatctagctctgggaagtctagccagggatcatcaatggagatcgaccctcaggctcccgagcctccctctcagttgcgaccagacgaatcactgacagtctctagccctttcgctgcagcgattgctggcgcagtgagagaccgggagaagaggttggaggctcgaaggaactccccagcattcctcagcactgatctaggcgatgaagatgtcggcctcggtcctccagccccacgcacgcgtcccagcatgtttcccgaagaaggcgacttcgcggatgaggatagtgccgaacaactgtcctcccctatgccttccgccacaccccgggaaccagaaaatcactttgtcgggggggcagaagcatctgccccaggtgaagctggccggcccctaaattctacgagcaaagcgcagggcccagaatcctcacctgctgtgccctccgctagctccggaaccgcaggccccggcaattacgttcatcccctgactggccgactcctggaccctagctccccactggctttagctctgagcgcccgcgacagggctatgaaagaaagtcagcagggaccaaagggagaggcccccaaagcagatcttaacaaaccgctttacattgacactaagatgagaccttcattggatgcagggttccctaccgtgactagacaaaacacaaggggacctttaagacgccaggagacggagaacaagtatgagacagaccttggcagagataggaaaggggacgataagaaaaacatgctcatagacattatggatacgtcccagcagaagagcgctggactgctgatggtccacaccgttgatgcaacaaaactggataacgccttacaggaggaggatgagaaggctgaggtcgagatgaaacccgatagttccccgagcgaggtgcctgagggcgtgagtgaaactgagggagccctccagatcagtgctgccccagagcctacaaccgttcctgggcgaaccatcgtagcagtgggcagcatggaggaggcagtcatactaccttttcgcattcccccaccccccctagcgtccgtcgatctcgacgaggacttcatttttacagagccattgcccccccccctagaattcgccaatagtttcgacattccagatgacagagccgcgagcgtccctgccttgagcgacctcgtgaagcagaaaaagagcgatacaccacaaagtccatcccttaattcttcccaaccaactaatagtgcagactccaagaagcccgcaagcctgtccaactgcctgcctgcctctttcctgcccccacctgagagctttgatgccgttgccgatagcggtatcgaggaggtggattctcgctcgtcctccgaccaccacctggagaccacctcgaccatctccacagtaagttcaattagcaccttgagtagcgagggcggggaaaatgtagacacttgtacggtgtacgccgacggccaagcctttatggtcgacaaaccacccgtaccccctaaaccaaaaatgaagcctattattcacaagagcaacgcactttatcaggacgcactggtagaagaggatgtggactcctttgtgataccccctcccgctcctccccccccacctggttcggctcagcccggaatggcaaaggttctgcaacctagaacatcaaaactgtggggggacgtaactgaaatcaagtctcctatcttgtcaggccccaaggccaacgtaataagtgaactcaactccattctacagcagatgaaccgggagaagctggctaaaccgggggaaggccttgattcaccaatgggagccaaaagcgcatctcttgcgcctaggagtcctgagatcatgtctaccatctctgggacccgcagcaccacagtaaccttcaccgtgcggccaggtacgtcccagccaatcactctgcagagtaggccccctgactatgagtctcggactagtggcacaaggcgcgcccctagtcccgtggttagcccaaccgagatgaataaagagaccttgcccgcgccactgtcagctgccactgcctcacctagccctgctctatctgacgtattttcgttgccaagccagccaccttctggagatctgttcggactgaatccggctggcagaagcaggagtccgtcacctagcattctccaacaacccatcagtaacaagccatttaccacaaagcccgtgcatctgtggaccaaacccgatgtggccgattggctcgagtcattgaacctcggggagcataaggaggccttcatggataacgagattgacgggagtcacctgccaaacctgcaaaaggaggatttaattgaccttggcgtcacgagagtcggccaccggatgaatattgaaagagcacttaagcaacttcttgaccgatag

SEQ ID NO: 134145 - DNA, 846 bp, Artificial Sequence
  Description of Artificial Sequence: Synthetic coding sequence
atgatgatgaacgttcccgggggcggagctgctgctgttatgatgaccggctacaacaacggtaggtgtccgcggaactccctgtattcagattgtatcattgaggagaaaacagtcgtgctgcagaagaaggataacgaaggattcggatttgtcttaagaggagccaaagccgacacaccaatcgaagagttcactccaaccccagcatttcccgctctccagtatctggagtcagtcgatgagggcggtgtcgcttggcaggccggacttcgcacgggtgactttcttattgaagtaaacaacgagaacgttgtgaaagtgggacaccggcaggtcgtgaatatgataaggcaaggtggcaaccatttggtgttgaaagttgtaaccgtgacgaggaatctcgatcctgatgatacagcacgaaagaaggccccgccgcctcctaagcgcgctcccacaacagcactgacattaagaagcaaatcgatgacaagtgagctggaggagctggtggataaaggggtcattaggaaaggcaaggacaagcccgaagaaattgtgccggcctctaagccatctcgggccgctgagaatatggcagtagaaccccgcgttgccacgataaaacagaggcccagctcccgatgctttcccgccgggtcagacatgaattctgtgtacgagcgacagggaatagcggtcatgacgcctacagtacccggctcgcctaaggcacctttcctgggaatcccccgaggtacaatgaggagacagaagtcaattggcaagaagtgcgggacgccgccccagaagctgcctctggggttccagacccagccctag

SEQ ID NO: 134146 - DNA, 3762 bp, Artificial Sequence
  Description of Artificial Sequence: Synthetic coding sequence
atgatgaatgtacctggtgggggcgccgctgccgtcatgatgactggatacaacaacggcaggtgtccacggaattccctgtactcagactgcatcatcgaagagaagaccgtggtgcttcagaagaaggataacgaaggcttcggcttcgttctgaggggggccaaagccgatactccgatcgaagagtttaccccaactcccgccttccccgcactacagtatctggagtctgtggatgaaggaggcgtggcatggcaggctgggctgcgcaccggcgatttcctgatcgaagtcaacaatgagaatgtggttaaggtggggcatcgtcaggtggttaacatgatccggcagggggggaaccacttggtgttgaaggttgtaactgtgacccgaaatctggacccagacgatactgcacgcaaaaaggcaccccctccccctaaacgtgccccaaccacagccctcactctccgctccaaaagcatgaccagtgaacttgaggaattggttgataaggacaaacccgaagaaattgttcccgctagcaagcctagccgtgccgcagaaaatatggctgttgaacctcgcgtggccacgattaagcagagaccgagtagccggtgctttcccgctgggagcgatatgaactcagtgtacgagcgtcaggggattgcggtaatgacacccactgtaccaggcagccctaaggccccatttctcggtattcctcgggggaccatgaggaggcagaagagcatcgacagccggatctttctgtcaggaatcacggaggaggagaggcaattcctggcaccaccgatgctcaaatttactaggtcattgtcgatgccagacacatcggaggacatacctccccctcctcaatccgttcccccatctccccctcctccaagcccaaccacatataattgtccgaaaagtcccacgccccgagtgtatgggactatcaagcctgcatttaaccagaattctgccgctaaggtctccccagccacaaggagcgataccgtcgcgactatgatgcgtgaaaagggtatgtattttcgacgcgagttggaccgttacagcttggatagcgaggatctgtacagcagaaacgccggaccccaggctaattttcggaacaagcgcggccagatgccagagaatccctatagtgaggtaggaaagatcgcctctaaagctgtgtatgtgcctgcaaaacctgctaggcggaaggggatgttggttaaacagagtaacgtcgaggattcgcctgagaagacatgcagtatccccattcccaccattattgtaaaggaaccgagtaccagctccagcggcaagagttctcaggggtctagcatggaaattgatccccaggcgccagagcctccctcccagctgagaccggatgaatccctcacagtctcctccccttttgccgcagctatagcgggggcagttcgtgatcgtgagaagcgcttggaagcgcgcagaaactcacccgcctttctgtcaactgacttaggagacgaggatgtgggcctcggcccccctgccccgaggacaaggccaagtatgtttcctgaggagggcgacttcgcagacgaggactccgccgaacagctgtcctcacctatgccctctgccactcctcgggagcccgagaatcactttgtgggaggtgctgaggcttccgccccgggggaagcagggagacccttaaacagcacctctaaagctcaggggcccgagagtagcccagccgtgcctagtgccagcagcggaacagcaggcccaggaaattatgtgcaccccctgaccggtcgcctgttggacccatcctctcctctcgcccttgcgctgtcagcaagggatcgggccatgaaggagtctcagcaggggccgaagggggaagctcctaaagctgacctaaacaaacctctatacatcgatactaaaatgcggccatctctggacgctggctttccgacagttactcggcagaacacgcgtggacctctccgcagacaggagacggagaacaagtacgaaacggacttaggccgggatagaaaaggcgatgacaagaagaacatgctcatagatattatggatacatcacagcaaaagtcagcaggtcttctaatggtacacacagtggacgcaacaaagctggataacgccctccaagaggaggatgaaaaggccgaggtggaaatgaaacccgactcaagcccctcagaggtgcccgagggggtgtccgagacagaaggcgcgctgcagataagcgccgccccagaaccaacaaccgtgcccgggagaactatagttgccgtgggatccatggaggaagctgtcatcctgccatttcggatccctccacctcctcttgcctcggtggatctagatgaagacttcatcttcaccgagcccttaccgccaccactcgagttcgccaatagttttgacatcccggatgatcgcgccgcctccgtacccgccctcagtgacctagtgaagcagaaaaaatcagacacacctcagtctccatccctaaattcgtcgcaaccaaccaactcagcagattccaagaagcccgccagcctatctaattgcctgccagcctccttcctgcctccccccgagtcgtttgacgcagtggctgattctggcatagaagaagtggattcaaggagttctagcgaccatcaccttgagactacaagcacaataagcaccgtttcaagtataagtactctgtcaagtgagggtggagaaaatgttgacacctgcaccgtgtatgctgacggtcaggcattcatggtggacaagccgcccgtgccacctaagccgaagatgaaacccatcatacacaagagtaatgccttataccaggatgccctggtggaagaggatgtagactcctttgttatcccgcctcctgccccacccccaccaccaggctccgctcagccaggaatggccaaggtgctccagccaagaacatcaaaactctggggcgatgtgacagagattaaatcacctattctgagcgggccaaaagccaatgtcatttcggaactgaactccatactacagcaaatgaatagagaaaagctggcaaagccaggagagggacttgacagtccgatgggggccaagtctgcttcactagcccctcgatcacccgaaatcatgagcaccatcagtggtacacggtccacaacggtgactttcacagtaaggccaggtacctcacaacccattacactgcagagccgtccacccgattatgagtctagaacaagcggtaccaggcgggctccatctccagtagtctcgcccacagaaatgaacaaggagacccttccggcccctctgagcgccgccactgcatcccctagccccgccctgagcgacgtattttccctgccaagccagcccccttccggggacttattcgggctgaatccagcgggacggtctagaagtcccagccctagcatcctgcagcaacctattagtaataagcccttcacaacaaaaccggtccacctgtggacaaagcctgatgtcgccgattggctggaaagtctgaatctgggcgaacacaaagaagccttcatggacaatgaaattgacggctctcatttgcccaacttacagaaggaagacctcatcgacctgggtgtgactcgcgtcggccatagaatgaatatcgagagagcactgaaacagcttctcgatcgctag

SEQ ID NO: 134147 - DNA, 843 bp, Artificial Sequence
  Description of Artificial Sequence: Synthetic coding sequence
atgatgaatgtgcccggtggcggcgcggccgccgtcatgatgactggttacaataatggcagatgccctcgaaacagtttatactcagattgcattatcgaggagaaaacagtcgttctgcagaaaaaggacaacgagggtttcggatttgttctgcgcggggccaaagcggacacccctatcgaggaattcacaccaactccagcattccctgctctgcagtacctggagagcgtcgacgaagggggagtcgcttggcaagccggactgagaaccggagactttctgatcgaagtgaataacgagaacgttgtgaaagtgggacacagacaggttgtgaacatgattcgacaaggaggcaatcatctagtgctgaaagtggttaccgttaccagaaaccttgatccagatgacactgccagaaaaaaggcccccccaccgcccaaacgggcccctaccaccgccttaactctcaggtctaagagcatgacctcggaactggaggagttagtggacaaagccagtgtccggaaaaagaaagataaaccagaggaaatcgttccggcttcaaagccttcaagggccgctgagaatatggcagtggagccacgggtggccacaatcaaacaacgccctagttctaggtgtttccccgcagggagcgacatgaactccgtctatgagcgccaggggatcgccgtcatgactcccacagtccctggatcgccgaaggccccattcttgggcatcccaagaggcaccatgagacgtcagaaatccatcggcaagaaatgtggaacacctcctcagaagcttcctcttggtttccaaactcagccgtag

SEQ ID NO: 134148 - DNA, 4413 bp, Artificial Sequence
  Description of Artificial Sequence: Synthetic coding sequence
atgaagagcctgctcaacgcgttcaccaagaaagaggtcccctttcgcgaggcgccagcttatagcaaccgccgccgcagacctcccaatacactggcggccccaagagttctcctcaggtccaacagcgacaataacttgaacgcctccgcacctgattgggccgtgtgctccaccgccacatcccatagatccttgagcccccagctcctgcagcagatgccttcaaagcctgagggagctgctaaaaccattggttcctacgtgcctggaccacgatccagaagcccatcgctgaaccgactggggggcgctggcgaggatggcaaacgtccacaacctctgtggcatgtgggaagccctttcgctctcggagcaaacaaagattccctgtcagcctttgaataccccgggcctaagcgtaagctgtacagcgctgttcccggcagactgtttgtggcagttaagccttaccaaccccaggtcgatggggaaatcccccttcatagaggtgacagggtgaaagttctgagcataggggaaggcggtttttgggaaggctctgcacggggccacatcggttggtttccagcagagtgcgttgaagaggtgcagtgcaaacctcgtgactctcaagctgagacgcgggctgatcggtcaaagaagctgtttcgacactatacggttggatcgtacgactcttttgatactagcagtgattgcataatagaggagaaaacagtggtactgcaaaagaaggacaacgaggggtttggattcgtgctcagaggagctaaagccgacacacccatcgaggagtttacccctactccagctttcccagccctgcaatacctcgagtctgtcgatgagggcggtgtcgcctggcaggccggcctgcgcaccggagatttcctgattgaagtcaacaacgagaacgtcgttaaggtgggacaccgtcaggtagttaacatgatcagacagggaggaaatcacctggtgctgaaggttgtcactgtgacaaggaatctcgaccccgacgacacggcccgcaagaaagccccaccccccccgaagagggccccgaccaccgccttaacattgaggtctaaatctatgacctctgagctcgaggagttggttgataaggcatcagtaaggaagaagaaggataagcccgaggagatcgtgcccgcatctaaacctagcagagctgcagaaaacatggccgtggaaccgcgcgtcgccaccatcaagcagcggcccagttcccggtgctttccggctggaagcgatatgaactcagtgtatgagagacagggtatcgcagtcatgactccaaccgtcccaggttccccaaaggcacccttccttggaatccctcgcggaaccatgcgacgacagaagtctatcgatagcagaatttttttaagtggcatcactgaagaagaaagacagttcctggctccaccgatgttgaagttcacacggtctctctctatgcccgacacatctgaggacattccaccgccaccacagagcgtgccccctagcccaccacccccgagcccaactacgtacaactgcccgaaatccccaacgcctagagtttacgggactatcaaacctgcttttaaccagaacagtgccgctaaggtctcgccagcgacacgttcagacacagttgccacaatgatgagggagaagggcatgtacttcaggcgcgagcttgatagatacagcctggactcggaggacttatacagtaggaacgctggccctcaagcaaatttccgcaacaaaagaggtcaaatgcccgaaaatccttactctgaggtaggcaaaatcgcctccaaggctgtttatgtccctgccaaaccagcaagaagaaaaggtatgctggtgaagcagtctaacgttgaggattcacccgagaagacatgtagcatccccatccccaccataatcgtgaaggagccaagtacatcgagctcaggcaagtcatctcagggaagcagtatggaaatcgaccctcaggcccccgagcccccatctcagctgcggccggacgagagcttaacagtcagctccccattcgctgctgccatcgcgggagccgtgcgcgatagggagaagagactggaagccagaaggaattccccagcctttttatcaaccgatctgggcgatgaggatgtcggactggggccacccgcaccccggactcgaccctcaatgttcccggaagagggcgatttcgccgacgaagacagcgctgagcagctgtcatcccctatgccctcagcaactcctagggaacctgagaaccactttgtcggcggagccgaggccagcgctccaggagaggcaggccggccactaaactctacttcaaaagcccagggccctgagtccagtccggccgtgccatctgcatcctctggaaccgccggtccagggaactacgtccaccctttgaccggccggctgctggatccttcatcgccgctagctctggccctatctgctcgggaccgcgcaatgaaggaatcacaacagggacctaagggggaagcccccaaagccgacctgaataaaccgctgtatattgacactaagatgcgaccctctttagacgcagggttccctaccgtaacccgccagaacaccagaggtcccttgcgccgacaggagactgagaacaaatacgagacagacttaggccgagatcgaaaaggcgacgacaaaaagaatatgctcatcgatatcatggacaccagtcagcagaagtctgccggcctcctgatggtgcacacagtagacgccacgaaactcgacaatgccctgcaggaggaggatgaaaaagcagaggtggaaatgaagccagattccagccctagcgaggtcccagaaggagtctccgagactgaaggagctcttcagatctccgctgccccagagccaaccactgtgcctgggcggacgatagttgcagtggggagcatggaggaggccgtgatcctgccatttagaatccccccccccccactggcttctgtggatctcgacgaggacttcatttttactgagcccctccctccccccctggagtttgctaactccttcgatatccctgacgaccgggcggcttccgtacccgctctgtcggacttggttaagcagaagaagagcgacacaccacagagcccctcactcaatagctcgcagcccaccaacagcgctgactcaaagaagccagcctccttgtccaactgcctccccgccagctttctcccacctcctgagtccttcgatgccgtcgcagactctggtatcgaggaagtcgattctcggtcgtcttccgatcaccacctagagaccacatccacgatcagtactgtatcttccatcagcacactgagctccgagggaggagagaatgtcgacacctgcacagtttacgcggacggtcaggccttcatggtggacaagcctcctgttcctcccaagccaaagatgaagcctatcattcataagtcgaacgccctgtatcaggacgcactggtggaagaggatgtagacagttttgtcatcccacctccagccccacccccccctcctggctctgcccagccaggaatggccaaagtgctgcagcctcggacctctaaactgtggggagatgttactgagattaaaagtcccatcctttcgggtcccaaggcaaatgtgattagtgagctgaatagcatcctacagcaaatgaaccgggagaaactggcgaaacccggcgagggccttgatagtccaatgggggcgaaatctgcttccctggcacctcggagcccggagattatgagtaccatctcaggtacacgttcaaccacagtcaccttcacagtccgtcccggaacttcgcagccaatcacactgcagtcccgcccccctgattatgagagtagaacaagcggcacgaggagggccccttcaccagtcgtgtcccctactgagatgaataaagagacactgccagctccgctttctgctgcaaccgcctcaccttcccctgctctcagcgatgttttcagtctcccctcccagcccccaagtggcgacctgttcggactgaacccggcggggagaagtaggagcccttcaccttctattttgcagcaacccataagtaataagccatttaccactaagcccgtccatctgtggacaaaaccggacgtggccgattggttggaaagtctgaatcttggggagcacaaagaggccttcatggataacgaaatcgatggcagccatctacctaatctgcaaaaagaggatctcatagacctcggggtaacacgcgtcggccatcggatgaatattgagagagccctgaagcaactactggacagatag

SEQ ID NO: 134149 - DNA, 816 bp, Artificial Sequence
  Description of Artificial Sequence: Synthetic coding sequence
atgatgatgaacgtgcctggcggcggtgcagctgctgtgatgatgactggctacaacaatggaaggtgtccccgcaattctctctattccgactgtatcattgaggagaaaactgtggtgcttcaaaaaaaagataacgaaggcttcggcttcgtgctccggggcgcaaaagcagatactcccattgaagaatttacgccaactccagcgttcccggccctgcagtacctggaaagtgtggacgagggaggagttgcctggcaggccggattgcgaacaggagattttctcatcgaagtgaacaatgaaaacgtagtgaaagtggggcacaggcaggtggtgaacatgatccggcagggtggtaaccaccttgtgttgaaagtggttacagtgacccggaacctcgatcctgacgacactgcccgcaaaaaggcacccccgccccctaagcgcgccccgacaacagcactgactctgagatccaaatcgatgacctcggagttagaggaactcgacaagcctgaggagattgtacccgcatctaagcccagccgggctgctgaaaatatggccgtggagcctcgggtggctacgattaagcaaagaccatccagcagatgcttccccgcgggaagcgacatgaactctgtatacgagagacagggtatcgctgttatgacacccaccgtgcccggttcacctaaggccccatttctgggtatcccccgaggtaccatgcgccgccagaaatcaattggcaagaagtgtggcaccccccctcaaaagctaccactgggattccaaacccagccgtag

SEQ ID NO: 134150 - DNA, 3765 bp, Artificial Sequence
  Description of Artificial Sequence: Synthetic coding sequence
atgatgatgaatgtgccaggtgggggggccgctgctgtgatgatgaccgggtataacaacggccggtgcccacggaatagtctctactccgattgcatcatcgaagagaaaacagttgtcctgcagaaaaaggacaacgagggatttggcttcgtgctgcgaggggctaaagctgatacacccattgaggagtttactccaactcctgcttttcccgctctacaatatttggaatctgttgacgagggtggagtcgcctggcaggccgggctccgtaccggagattttctgattgaagtgaataatgaaaacgtcgtaaaagtgggccatcgacaggttgtgaacatgattcgacagggaggcaatcatctagtgttaaaagtcgtgacagtgacccggaacttggatccagatgataccgcacggaaaaaggcaccccctcctcccaagagggcccctacgaccgcacttacactccgctctaaatccatgacgtccgagcttgaggagctcgtagataaagataaaccagaggaaattgtcccagcttccaagccatcaagagccgcagagaacatggctgtagagcctcgagtagccactatcaagcagcgcccatcatccaggtgtttcccggccgggagcgatatgaatagtgtgtacgaacggcaaggcatagctgtcatgaccccgacagtgcccggatccccaaaagcaccttttcttggcataccaagaggcactatgaggaggcagaagtctatagattccagaatcttcctgagcggaatcacggaggaggaaaggcagttcttggctccgcccatgctgaagtttacacgaagtttgagcatgcccgacacatctgaggatatccccccacctccacagtcggtgcccccctctccccctcctccttcacctaccacctataactgtcccaagagtcctactcccagggtctatggtacgataaaaccagcctttaaccaaaacagcgccgctaaggtgagtccagccacccgctccgataccgtcgctaccatgatgagggagaaaggtatgtattttcgcagagagcttgacagatatagtctcgacagtgaggacctgtatagccgaaatgccggacctcaggccaactttaggaataagcgaggccagatgcccgaaaacccatattccgaggtcggcaagattgccagtaaggccgtttacgtgccggccaaacctgctaggcgaaagggtatgctggtgaagcagagcaacgttgaggactcccccgaaaagacctgcagtattcctatcccaactattatagtgaaggagccttctacttcctcctctgggaagtctagccagggctcaagcatggagatcgatcctcaggccccagaacccccttctcagcttagaccagacgaatccctcaccgtgtctagcccttttgccgccgccattgccggggcggtacgtgatagagaaaaacggctcgaggctagacggaacagccctgcattcctatcaacggatttaggcgacgaggatgtggggctcgggcctcctgcccctcgtacacgcccttccatgtttcccgaagagggagacttcgctgacgaagattccgcagaacagctgagctctcctatgccgtccgcgactccaagagagcctgagaaccatttcgttggaggcgcagaagccagtgcacccggagaagcagggcgtccactaaatagtacctccaaagcccagggacccgaatcctcccctgcggtgccttcagcgtccagcggtactgcgggaccagggaattacgtgcaccccttgactgggcgcctcttggacccttcaagccccttggccctagcactatcggcacgcgatcgggctatgaaagaatcccagcagggcccaaaaggcgaggcaccaaaggccgacctgaataaacccctgtatatcgataccaagatgcgtccatctctcgacgccggatttcctacagtgaccagacagaatactcgcggacccctgagacggcaagaaactgagaacaaatatgaaactgaccttggtagagacagaaagggcgatgataaaaaaaacatgctcatcgacatcatggatacctcacaacagaagtctgcgggattgcttatggtccatactgtcgacgcaactaaactggataatgctctccaggaagaagatgagaaggccgaagttgagatgaagccagattccagccccagtgaggtacccgagggagttagcgagacggaaggcgccttgcagataagcgccgcgccagaacctaccacggtgccgggccgaacaatcgtcgcagtgggttccatggaagaggctgtgattctccccttccggattccaccgcctcctctcgcgagtgtagatttggacgaggattttattttcacagagcccctcccccccccattggaatttgcgaactccttcgatatcccagacgaccgggctgccagcgttccggccttatccgatctagttaagcagaaaaagagcgacactccccagagcccatcactgaacagttctcagcctactaactctgccgacagcaagaaaccagccagtcttagcaattgtctgccagcttcctttctccccccaccagagtccttcgatgctgtagcagactcaggcatcgaagaagtcgattcaaggtccagctcagatcaccatctcgaaactacgtcaacgattagcacggttagttctatatcaactctgagtagtgaaggcggggagaacgtggatacctgcactgtctatgcagatgggcaggctttcatggtagataagccacccgttccacccaaacccaaaatgaaacctatcattcataagtctaatgccctgtaccaggatgcgctggttgaagaggatgttgacagcttcgtgattccccctcccgcacctcccccacctcctgggtcagcccagccaggcatggcaaaagtcctccaaccccgaacatccaagctgtggggcgacgtgacagagataaagtctcccatcctgtccggccccaaagctaatgtaatatccgagctcaacagcatcctacagcagatgaatagggaaaagctcgcaaagcccggtgaaggactggattctccaatgggcgctaagtctgccagcctggcccctcggtctcccgagatcatgagtacaatctctggtaccaggagcaccaccgtgacttttacggtgcggccagggactagtcagcccataacattacagagcaggcctccggattatgagtcaagaacttctggaacccgccgggccccgtctccggtagtttctccaaccgagatgaacaaggagacactacccgcccctcttagcgcggcaacggcttctccatcccccgccctttccgacgtcttttctctgcctagtcagccaccctccggcgatttgtttggactgaatccggccgggcgatctcggtccccatccccatccatactccagcaacctatcagtaacaagccatttactacaaaaccggttcatctttggacgaagcctgatgtcgccgactggttagagagcctgaatctgggcgagcacaaggaagcttttatggataatgagatcgatggatcacatctgccgaacctgcagaaggaggacctgattgatctgggagtgaccagggtcgggcaccgtatgaacattgagagggcgctgaagcagctacttgaccgctag

SEQ ID NO: 134151 - DNA, 915 bp, Artificial Sequence
  Description of Artificial Sequence: Synthetic coding sequence
atgccccggagccctacgagttcagaagacgaaatggcccagagctttagtgattattccgttggatctgagagcgactcatccaaggaagaaaccatctacgacactatacgggccactgctgagaagccagggggcgcaagaacagaagaatcgcagggcaacaccctagttatccgggtagtaatccatgacctgcagcagaccaaatgtattaggttcaatcccgacgccaccgtctgggtcgcaaagcagcggattctgtgtactttgacgcagtctctcaaggatgtcctcaactacggccttttccagcccgcatcaaacgggcgggacggcaaattcctggatgaagagcgcttgctgagggagtacccccagcccgttggcgagggcgtccccagcttagaatttcgctataaaaagcgggtgtataaacaggcttcgctcgatgagaagcaactggctaagttacacactaaaactaatttaaagaagtgcatggaccacatccagcatcgcctggtggaaaaaattacaaaaatgctggaccggggcctggacccaaatttccacgaccccgagacaggcgaaacccccttgaccttggcagcccagctggacgactccgtagaagtcattaaggctcttaagaatggaggtgcacatctggatttcagggccaaagatggaatgaccgccctgcacaaggctgccagagccaggaatcaagtagccctgaagacgctgctggagcttggggccagtcccgactataaagactcgtacggcctaactcctttgtaccataccgcgattgtcgggggcgacccctattgttgcgaacttctgttgcatgaacacgccaccgtctgctgtaaagatgaaaatggatggcacgaaattcaccaatag

SEQ ID NO: 134152 - DNA, 5244 bp, Artificial Sequence
  Description of Artificial Sequence: Synthetic coding sequence
atggatggacctggagcctccgccgtcgttgtgagagtgggtataccagatctgcagcaaaccaagtgcttgcggcttgaccctgcagctcctgtctgggctgcgaagcaacgcgtcttgtgcgcattaaatcacagtctgcaggatgctctcaattacgggctgttccaaccaccatctcgaggcagggcagggaaattcttagatgaagagcgactgctccaggagtacccgcccaatctagatactccattgccctatctcgagttcagatataaacggagggtatatgcccagaacctgatagatgacaaacagttcgctaaattgcataccaaggccaatctgaagaagttcatggattacgtgcagcttcactccaccgacaaagtggcacgcctcttggataaggggctcgatcccaacttccatgacccagattcaggagagtgccccctcagtctcgccgcccagctggacaacgctacggatctgctgaaggttctgaagaacggtggagctcacctcgattttcgaactcgggatggccttaccgccgtccattgcgcaaccagacaacgcaatgctgcagcactcacaactctgctggacctcggtgcttccccggattacaaggactctcgcggtttgaccccactgtatcacagcgccctcggcggcggagacgccctgtgttgcgagttactcctgcatgaccatgcgcagctcggaatcactgatgagaacggttggcaggagattcatcaagcttgccgattcggccacgtccagcacttggagcatctgctgttttacggcgctgatatgggtgctcagaatgcctccgggaacacagcgctccacatctgtgctctgtataaccaggagagttgtgcccgtgttctactcttccgcggggcgaatagggacgtgcggaactacaactcccaaacagcttttcaggtggctattatcgccggcaactttgagctagcagaagtcatcaagacacataaggactctgatgtcgtgccttttcgggaaacaccttcttatgctaagcgacggcgcctggccggcccttcaggcctggcgtcgccacgtcctctccagagatccgccagcgacatcaaccttaagggcgaggctcaaccggccgctagccctggtccatctctgcggtcccttcctcaccagttgttattacagaggctccaggaggagaaggatcgtgacagagatgccgatcaagaatcgaacattagcggaccattagccggccgcgccggccagagtaagatttcagacccagggcctggacctggaggtgtcggaggagccccactcccgccaccaggagcgccacgttcttgtatccgtatccgggcacgcttcccagctccacctgctccccctgcgcctcctccaagagggcccaagaggaaattatactccgctgtgcccggtagaaagttcattgcagtgaaagcccattctccccaaggggaaggggaaatcccactgcaccggggcgaggcagtgaaagtgctgagcatcggcgagggcggcttctgggaaggcacagtgaaaggacggaccggatggttccccgccgattgtgtagaggaggtgcagatgagacagcatgacactcgtccggaaacgagagaggaccgaacaaaacggctcttcagacactacactgtgggatcctatgattcactcacatcacacagcgattacgtgatcgacgataaggtggccgtgctacagaagagggaccacgaaggctttggctttgtgctgcgcggtgcgaaggccgaaactccaattgaagaattcactccaacgccagcctttccagccttgcagtacctggagagcgtcgacgttgagggggtcgcgtggcgagctgggctgcggactggcgacttcctgatcgaggtgaatggggtgaacgtcgtgaaagttggacacaaacaggtcgtggcattgataaggcagggtggcaacagactcgtgatgaaggtagtcagcgttacaaggaagcctgaagaggacggagctcggcgtcgggcaccaccacctcccaaacgcgcaccttcaactacactgaccttgcggtcgaagtcaatgaccgcggagctggaagagttggcgagcatccgaaggcgtaaaggggagaaactggacgagatgctcgccgccgcggccgaaccaacattgcgcccggacatcgcagacgcagactcacgcgctgctacggtcaagcagcggcctacatctcgtaggataacacctgctgagataagtagtctgttcgagaggcagggactccccggaccagaaaagctcccaggaagcttacgtaagggaattcccagaactaagtctgtcggagaggatgagaagttagcatcccttctcgagggcagatttcccagatctacctcgatgcaggatcctgtccgggagggcagaggcatccccccccctccacagaccgcaccaccacctccaccggccccatattacttcgactccggacctccacctgcgttcagccctcctccccctcctgggcgggcatacgatactgtcagaagcagtttcaagcccggccttgaagcacgactgggggctggtgcagccgggctctacgaacctggcgccgcgttaggtcctcttccctaccccgagcgacagaagagagctaggtccatgataatattgcaggactcagcccccgagtccggagacgcgccgcggccccctcccgctgcgacccctccagaaaggcccaagagaagaccacgaccccccggtccagacagtccttacgccaatttaggggctttctcggccagtctattcgctccttccaaaccacagcgtcggaagtctccactggtgaagcaactgcaggtagaggacgcacaagaacgggcagcccttgccgtcggctcaccagggccaggtggaggatcatttgccagagagccaagtccaacccatcgcgggccaagacccggagggcttgactatggcgccggcgacggaccaggactcgctttcggcggtccaggtccggccaaagacaggcggcttgaagaacgcagaagatccaccgtgttcttaagcgtgggggccattgagggttctgcaccaggggcagacctgccttccctccagccctctcgcagcattgacgaacggttacttggaacgggtccaactgccgggagagacctgttgctgcccagcccagtgagcgcgctgaagcccctagtttccggaccttctctgggacctagtgggtccacgttcatccaccctctcaccggcaaacccctggacccttcctctcctctagccctggccctcgcggccagagagagagctctggcatcgcaggcaccctctcgctccccaacaccggtgcactcccccgacgccgatagacctggtcctctctttgtcgacgtgcaggccagagacccagaacgagggagtctggcctcacctgcattctctcctagaagcccagcctggatcccggtgcccgccaggcgggaagcagaaaaggtccccagggaggagagaaagtcaccagaagataagaaatcgatgatcctatccgtgcttgacaccagtctgcagcggccagcgggacttattgtggtccatgccacctctaatggccaagagcccagccggctgggtggggcagaggaggaacggcccggcacaccggaacttgcaccggcaccaatgcagtcagccgccgtcgccgaaccattgccttccccccgcgcccagccccccgggggaacaccagccgatgcagggccggggcagggtagttcagaggaggaacctgagctggtcttcgccgtgaacctccctcccgcccaattgagctcctccgacgaggagacaagggaagagttagcccgcattggccttgtgcctcctcccgaagaattcgcaaatggagtgttgttggctacacccctggctggacccggcccaagtcctaccacagttccaagtcccgccagcggaaaaccctcctctgagccccctccggcccctgagtctgccgctgactccggcgttgaagaggctgatacccggagttcatccgatccacacctggagactacttccacaattagcaccgttagctccatgtctaccctttcctccgaatctggcgagctgacagatacacataccagcttcgccgacggccatacatttctcctcgagaaaccccctgtccctcccaagcccaagctcaagtctccattagggaaaggcccggtcacttttagggatcctctcttaaaacagagctccgacagtgagctaatggcccagcagcatcacgccgcatccgcagggctggcatccgctgccgggcccgcccggccacgctacttgttccagcgccgctcaaaactgtggggggatcctgtggagtctcgaggccttccaggacctgaggacgataagcctaccgtgatttccgaactgagctctagactgcaacaactgaataaagatactcgcagccttggcgaggagcccgtggggggtttgggctcactcctggatcctgcaaagaagtcaccaattgcggcagcacggcttttttccagcttgggagaattgtcttccatatccgcacagaggagcccgggggggccaggtgggggcgcaagttattcagtgcggccgagtggcagatatcccgtcgctcgacgcgccccatcaccggtaaaacctgcaagcctagagcgcgtggaaggtctaggagcaggggccggcggggcgggacgccccttcggcctcacacccccaaccatcctgaaatcttcgagcctgtcgattccgcacgaaccgaaagaggttcgcttcgttgtgagaagtgtttccgctcgttcaagatccccaagcccctccccgcttccttcccctgcaagtggaccgggcccaggcgcaccaggaccgcggcgtccattccagcagaaacccttacagctgtggtctaagtttgatgtcggtgattggctggaaagtatccacctgggagagcaccgagatcgcttcgaagaccacgagatcgagggagcacatcttcccgcactgaccaaagatgactttgtcgagttgggcgtcacccgggtgggacatagaatgaatatcgagagggctctccggcagttggacggatcatag

SEQ ID NO: 134153 - DNA, 5229 bp, Artificial Sequence
  Description of Artificial Sequence: Synthetic coding sequence
atggacggaccaggcgctagcgccgtggtggtcagggtagggataccagacctgcagcaaactaaatgtttgcgcctggatcctgccgccccagtgtgggccgccaagcagcgggtgctttgcgcattgaatcacagtctccaggatgcactcaattatgggttattccagcctcctagtcgtgggcgggcaggtaagttcctcgacgaagaaaggctcctccaagagtatccccctaacctggacactcctctgccgtacctggaatttcggtataagcggagggtgtacgcccagaatttgattgacgacaagcaattcgcaaaacttcacaccaaggctaatctgaaaaagttcatggactacgtgcagctgcatagcacagacaaagttgcaagactactggacaagggactcgaccccaacttccatgaccccgattctggagagtgtccattaagcctcgctgctcaactggataatgctaccgaccttctgaaagtgttgaagaacggaggtgcacacctggattttcggaccagagacggccttaccgcggtgcactgcgcaacccggcagagaaatgcagcagccttgacaactctcttagacctgggagcctctccagactataaggactctcgaggcctcacccccctgtaccattcagccctgggtggcggcgacgcactgtgctgtgaattgctgctgcacgaccacgcccagctgggaatcacagatgagaatgggtggcaggaaatccatcaagcttgcaggtttggccatgttcagcatttggagcatctgctcttctacggcgctgatatgggcgcccagaacgcatccgggaataccgctctgcacatatgcgcactatacaatcaggagtcttgtgcccgcgtgctactctttagaggggccaacagagacgtccggaactataacagtcagacagcatttcaggtggctattatcgctgggaacttcgagctggccgaagttatcaagacccacaaggattctgacgtggttccgttcagagaaactcccagttacgccaaacgccgacgcttggccggcccatctgggttggcatcccctagaccactgcagagatccgcgagcgacatcaacctaaaaggagaagctcagccggctgcctctccgggcccaagtttaaggtcactgcctcaccaactccttctgcagaggctgcaagaggagaaggatagggaccgagacgccgatcaggaaagtaacatcagtggcccgctggctggccgcgccggccaaagcaagatttccgaaccaggagccccgcgatcatgtattcggataagggctcgctttcctgcaccccccgcacctcccgcgcctcctcccaggggtccgaaacgcaagctgtactccgccgtcccaggccggaagtttatcgcggttaaagcccattctccccagggcgaaggcgagatccctctccaccgaggagaggcggtcaaggttctgtcaatcggggagggcggcttctgggaggggaccgttaagggacggacgggttggttcccagctgattgcgttgaggaggttcaaatgaggcaacacgacacacgcccagagaccagagaagataggactaagagactgttcaggcattacaccgtggggtcatatgactcactcactagccactccgattacgtgatcgacgataaagtggcagtgctgcaaaagcgggaccatgagggcttcgggttcgtgctacgcggggcaaaggctgagaccccgatcgaagaatttactccaaccccggctttccccgccttacagtacctagaaagtgtggacgtggagggtgtggcctggcgggctgggttgaggactggtgattttctgattgaggtaaacggcgtgaatgtggtcaaggttggacacaaacaagtggtggcattaattaggcaaggaggaaaccggctcgtgatgaaggtcgtatcagtgacccggaaacccgaggaggacggggcaaggaggcgagccccacctccacccaaacgggctccaagtacaacgctgactctgcgctcaaaatctatgactgccgaacttgaggagctgggcgaatggcgtggtcgagagggaagcgagaagctagacgagatgctcgcagcagccgccgagcccactcttagacctgatatagcggatgccgacagccgtgctgctactgtaaagcagcgcccgacgtcaaggaggataacaccagcagagatatcgagcctgttcgaacgccagggcctccctggccccgagaaattgcctgggtcactgcggaaaggtataccgcgcactaaatcagttggtgaggatgagaagctggcatccctcttggaaggacgattccccaggagtacttccatgcaagaccccgtgcgcgaagggcgtggtattcctcccccaccccagactgctcccccccctccgccggccccttactatttcgattctggtcccccacctgccttcagcccccctccaccgcccggacgagcctatgacacggttcgatcctccttcaagcccggactcgaggcgcgactgggggcaggcgctgccgggctgtacgaacctggagctgcattgggccccctgccctatccagaacgccagaaacgtgcaagatccatgattattctccaggacagtgcaccagaatctggagacgccccacgccctccccccgccgctacccccccagaaagaccaaaacggagacctcggccccctggccctgacagtccatacgccaacctcggcgcgttcagtgcttcactatttgcaccctcaaaaccccagcgcaggaagtctcctcttgtaaagcagctgcaggtggaagatgcacaggagagagcggccctggcagtgggatccccaggacccggcggtggctcttttgccagagagcccagtcccacacatcggggcccacgtcccggggggttagactatggggccggagatggccctggactggctttcggcggacccggcccggcaaaggaccggagactggaagagaggcgcaggtccacagtgttcttgagtgtaggggcaatagaaggctcggcaccaggtgccgacctgccatccctgcaacccagtaggtctattgacgaacggcttctcggaactggacctaccgcaggaagggatctcttgctcccgagccccgtcagcgcactcaaacctctggttagcgggcccagtttaggtccctccggcagcaccttcattcaccccctaactggaaagcctctcgaccctagctcacctctggccttagccctcgcagccagggagcgagccctggctagccaagctccctccaggtcacccacacccgtccatagccctgacgccgatcgcccaggccccctcttcgttgacgtgcaggcccgggatccagagcgggggagcctggcatccccagccttttcacctcggagccctgcttggattccagttccagctagaagggaggccgagaaggtgccgcgcgaggaacggaaaagcccagaagacaaaaagtcaatgatcctttcagtccttgatacatccctacaacgccctgccggcttgatcgtcgtacacgcaactagtaatggccaagagccgtcccggctcggcggagcagaagaggaaagacctggcacaccagagctggcgcctgctcctatgcagtcagcagctgtagccgaacctctgccctctcctagggcccagccgcccggggggacaccagcggatgcgggccccggacagggctcttctgaggaagaacctgagctggtctttgctgtgaatttgcccccagcacagcttagttcaagtgacgaggagactcgcgaggagctggcacgaataggccttgtgccccctccagaagagttcgccaatggagtccttcttgctactccactcgcgggcccgggcccaagccctaccaccgtgccctccccggcctctggtaagcccagctcagaacctccccccgcacccgaaagcgcggccgattcaggcgtggaagaagccgacactcgaagcagtagtgacccacacctcgagaccactagtactatttccaccgtctcttccatgagtaccctgagcagcgagtctggcgagttgacagacactcacacttcctttgccgacggccacacttttctccttgaaaagcctcccgttcctcctaaacctaagctgaagagccctctgggcaagggtcccgtgaccttcagagatcctctgttgaagcaaagctccgattctgagctcatggcccaacaacaccatgccgcgtctgcaggcctggcaagcgcagcagggcccgcacgcccccgctatcttttccagagaaggagtaagctctggggggaccctgtcgaaagccgaggactgcccggccccgaggatgacaagccaacggttatatcagagctcagcagcaggcttcaacagctgaataaagatacaagatctctgggggaggagcctgtggggggactggggagcttactggacccagccaagaaaagccctatcgctgccgcacggtgccgaagccccatggtgggactcaggctattttctagtctcggtgagctcagttcaataagtgctcagagaagccctggcgggccaggaggtggcgctagttactcagtaaggcccagcgggaggtatcccgtcgcccggcgagcaccttcacctgtgaaacccgcatccctggaaagggtggaaggtctgggagccggcgcggggggtgcaggtcgtcccttcgggctgaccccacccactatattgaagtcctctagcctcagtatcccccacgagccaaaggaggtacgctttgtggtcaggagtgtttcagcccgcagcaggtcaccttctcccagccctttgccctctccagcctcaggccctggcccaggtgctcctgggccaagacgaccattccagcaaaagcccctgcagctgtggtccaaatttgacgttggcgattggctcgagtctatccacctgggcgaacatagggacaggtttgaagaccatgagattgagggagcccacctgccagcacttaccaaagatgacttcgtggaattgggagtgacacgggtgggtcataggatgaatattgaacgcgcgttgcgccagctggatggtagttag

SEQ ID NO: 134154 - DNA, 2736 bp, Artificial Sequence
  Description of Artificial Sequence: Synthetic coding sequence
atgcccccaaggcggagtatcgttgaagtaaaggtgctcgacgtccagaaacgccgcgtccctaacaaacattacgtttacatcataagagttacctggagcagcggttcaaccgaagccatttacagacgctattcaaaattcttcgacctccagatgcagatgcttgataagtttccgatggagggaggccagaaggatcccaagcagagaatcatcccttttctcccaggcaaaatcctgtttcggcggagccacatccgcgatgtagctgtaaaaagactgattcctattgatgaatactgtaaggctctgatacagttgccaccttatatcagccagtgcgatgaggtgttgcagttctttgagacccggcctgaagatctcaatccacctaaagaggaacatatcgggaaaaaaaagagcgggggggaccagacttctgttgaccctatggtactggagcagtacgtggtggtggctaattatcagaaacaagagtctagcgagatatcactgtccgttggccaagtggtggatattattgaaaaaaatgagtccggatggtggtttgtgagcacagcagaggaacagggttgggtgcctgccacttgtttggagggacaggacggcgtccaagacgagtttagcctgcagcccgaggaagaggagaaatataccgtgatttacccttataccgcacgtgatcaggatgagatgaatctggagcgaggcgccgtcgtcgaggtgatccagaagaatctggaaggttggtggaaaattcggtaccagggaaaggaaggctgggcccctgcttcttacctcaaaaagaattccggtgaaccgctccctcccaagcccggaccaggttctccctcccatcctggtgcactggacctcgatggggtgagccggcagcaaaatgccgtggggcgcgaaaaagaacttctatcctcccaaagagatggccgattcgagggccggccggttcctgatggcgacgccaaacaaagaagccctaaaatgaggcagaggccccctcccaggcgggatatgaccatcccacgggggctgaacctacccaaacccccaatcccaccccaagtggaagaagaatattacaccatcgccgaattccagacaaccattccggatggtattagcttccaggctggtctgaaggtggaggtaattgagaaaaacctgtctggctggtggtacatccaaatagaagacaaggagggatgggcccctgccactttcattgacaagtacaagaagacaagtaatgcttctaggcccaattttctcgctcccttgccccacgaagtgacccagttacggctcggagaagcggcagcattagagaataataccggctctgaagcaacaggccccagtagaccgctgccggacgctccccatggggttatggattctggtctgccctggtccaaggattggaaaggatctaaagacgttctgagaaaggcatcctcagatatgagtgcgtcggccgggtacgaagagatttccgatcccgatatggaagagaaaccctcactgcccccgcgcaaggaatccattatcaagagcgagggcgaattactggagcgggagcgagagaggcagaggaccgaacagctgaggggcccgacacctaaacccccaggggtaattttgccaatgatgccggccaagcacatcccacccgctcgagattccagaagaccggagccaaagcctgataagtccagactcttccagctcaagaatgatatggggcttgagtgcggccacaaggtgctagctaaagaggtgaaaaaacctaatctgcggcctatatccaagtctaaaactgatctgcccgaggaaaaaccagatgcgacccctcagaaccctttcctcaaatctaggccccaagtgagaccaaaaccagctccatcacctaagaccgagcctccacagggagaggatcaggtagacatatgcaacctccgtagcaaacttcgtcctgccaagtcccaggacaagagtctgcttgacggagaggggccacaggcagtgggcgggcaggacgtggccttttcgcgcagttttctgcctggcgaaggacctggcagagcccaggatcggactggcaaacaagatggcctttcacctaaagaaatttcctgccgcgcccctcctcgacctgccaaaactactgacccggtgagcaaatctgtcccggtgcctctgcaagaagctcctcaacagcgccctgtagtgccaccgaggcgcccgcctccacccaagaagacgagttcctcttcaagaccgctcccagaggtgcgaggaccccagtgtgaaggacacgagtctagggccgccccaacccctggacgtgccttgctcgtcccaccaaaagccaaaccatttttgagtaattccttgggcggtcaagacgatactcgggggaagggctctttggggccctgggggacaggcaaaattggcgaaaatagggaaaaagcggcagccgcatcggtgcctaacgctgatggcctgaaggatagcctgtatgtggccgtggcagacttcgagggcgacaaagatacatcatccttccaggagggcacggtctttgaagtccgagaaaagaatagcagcggctggtggttttgccaggtgctgtctggcgctcctagctgggaggggtggatcccttctaattacctgcgaaaaaaaccatag

SEQ ID NO: 134155 - DNA, 2805 bp, Artificial Sequence
  Description of Artificial Sequence: Synthetic coding sequence
atggaggagatctggaaattctccacctatctcaatctggggtatgtttcgatgtgccttgagcatctactgtttgatcacaaatactggctcaactgcattttagtcgaggacaccgaaattcaggtcagtgtcgatgataagcatctcgagaccatttatctgggtctattaatacaggaggggcacttcttctgtagagccctgtgttcggtaacgcccccagccgagaaagagggagaatgtctgaccctgtgtaagaacgagcttattagcgtaaaaatggctgaagctggctcggagttagaaggcgtctctctggttactggtcagcgagggctggtcttggtgtcagcactggagcctctccccctgccctttcaccaatggttcctgaaaaattatccaggtagttgtgggctatctcggaaacgggactggacgggcagctaccagatcgggcgcggtagatgcaaggctttgaccgggtacgagcccggggagaaagacgagctaaatttctaccaaggcgagtccatagaaataataggctttgtgatacccggattgcagtggtttattggaaagtccacctcaagtggccaggtgggatttgtccccacacgcaacatagaccctgactcctattctcccatgtcaagaaatagtgcctttcttagcgatgaggagcggtgcagtctgttggctctcggctcagataaacagactgagtgctcatcattcctgcatacattggcaaggaccgatattaccagcgtgtacagactttctggatttgagtcgatacagaaccccccaaatgacctaagcgctagccagcccgaggggttcaaggaggttagaccaggcagggcatgggaagaacatcaggccgttgggagtaggcaatcctcttcctccgaggactccagtttggaagaggaactcttgtccgctacttccgacagttataggttgcccgagccagacgaccttgatgatcctgaactgttgatggatctgtcaaccgggcaggaggaggaggcagaaaactttgcacctatcctcgcttttctcgatcatgaagggtacgctgatcattttaaaagcctttacgacttcagcttcagcttcctcacgtctagcttttattcattttccgaagaagatgaattcgtggcatacctggaggcaagccggaaatgggccaagaagtcacatatgacgtgggctcatgcccggctgtgtttcttgctcggccggttgagcatccggaaagtcaaactcagtcaggcacgggtgtattttgaagaggcgatccatatcctcaacggcgcatttgaagacttgtcccttgttgcaaccctctacataaacctggccgccatatacctgaaacagcgtctccgccataagggaagcgctctgctggagaaggcaggcgccctgttggcgtgtctgccggatagagagtccagcgcgaaacatgagctggacgtggtggcatacgttctgagacagggcattgtggtcggcagctcgcccctagaggcccgagcttgcttcctcgctataagactgctgctgagcctgggtcgccacgaagaagtgcttcccttcgccgaaagactacagctgctgtcagggcatcccccagcctccgaggcagtggcttctgtcctctcctttttatacgacaaaaagtatctgccacatttggctgtggcctctgtccagcagcacggaatccaatctgcacaggggatgtcattgcctatatggcaggtgcatttggtcttgcagaacaccactaaacttttgggctttcccagtcccggctggggcgaagtgtctgctctggcgtgccccatgctacggcaggccctggccgcctgtgaagagctcgctgacagatctacccagcgggctctctgcctcatcctctcaaaggtttacctagagcaccggtcaccagacggcgctatacactatctaagccaggctctggtgttgggacaattactcggagagcaggaaagctttgagtctagcctgtgcctcgcttgggcgtacctgctggcctcacaggcaaagaaagcccttgacgttctcgagccacttctgtgtagcctgaaagagaccgaatcactgactcagagaggtgtcatttacaatctgttgggccttgcgttacagggcgagggccgtgtcaaccgcgctgccaagagctatttgcgtgccctcaatagggctcaggaggtaggagacgtccacaaccaggctgttgccatggcaaatctggggcacctttccttgaagtcctgggcccagcaccccgccaggaactaccttttacaggcagtcagattgtactgtgaactacaggcaagcaaagaaacagacatggagctggtacaggtgttcctttggctggcacaggtgctggtgtctgggcaccagttgacgcatgggctcctgtgctacgaaatggcactcctgtttggactccggcacagacacttgaaatctaaatacgtcccgtgttgttgggaggcgatcgaaaaaagtgtcggatcttcctttattcatttcttaagccaggtcatttcatttatgtcactgctgtgcgtccaggtttcttttcgacctcccaacccctctgccattagtacggcactgtgcccacagactttgcgccatgctagtccaactatgtctaccgggtggccttggctgtccaactccgggaccggtagatggaaggggggctgttggtcaccatggggaagcttcatcggtacttag

SEQ ID NO: 134156 - DNA, 453 bp, Artificial Sequence
  Description of Artificial Sequence: Synthetic coding sequence
atgagtgaacagatgatgcagagcgtcgggtgcaggattagtctctccgtgtttcaatttctcggcgaccagaggcaggagttggtagcgttccatagactcgcaaccgtatactattctctgcacatgtacgagatggccgaagactgctacctcaaaactttgagtctgtgtcccccctggctccagtctcctaaagaggcactgtattatgctaaagtctactacaggctgggccgactgactttctgtcagcttaaggatgcgcatgacgctactgaatatttcctactggctcttgccgccgccgtattactgggtgacgaagaactgcaggatacgatccgcagccgcctagacaacatttgtcaatctcctctttggcacagtcgcccctccggctgtagctcagaaagagctaggtggttgagcggtggtggcttagcactgtag

SEQ ID NO: 134157 - DNA, 3867 bp, Artificial Sequence
  Description of Artificial Sequence: Synthetic coding sequence
atgggcggttgcttctgcattcctagggaaagaagtcttacacggggccccggcaaagagaccccgagcaaagaccctactgtgtcatccgaatgtattgcgtctagcgagtataaagagaagtgttttttgcctcagaatatcaatcctgatctcactctgtcattttgcgtgaaatcgagaagccggaggtgtgtgaacgggcctctgcaggaggccgctaggcgccgcctgtgggcacttgaaaatgaggatcaggaagtgagaatgctgtttaaggatttgtccgctcgtctagtgtctatccagtctcagcgggcccagttcctgattacttttaagaccatggaggaaatttggaagttctctacttacctcaacttgggatatgtgtctatgtgcctggagcacctgctgttcgatcataagtattggctgaattgcatcttggtggaggacacagaaatccaggtgtccgtggacgacaagcacctggagacaatctatctggggctgctcatccaagagggccatttcttttgtcgcgcactttgtagcgtcacaccacccgctgagaaggaaggggagtgtttgaccctctgtaagaacgagttaatctcagtgaaaatggctgaagcaggatctgaattagagggagtcagcctggtcacaggacagagggggctggtcctcgtatcggccctggaaccactccctcttccttttcatcagtggtttctgaaaaactacccgggtagctgtggcctttccaggaaaagggattggactggcagctaccagatcggccggggtaggtgtaaagccctgaccggctatgagccaggggagaaggatgaattaaatttttatcagggcgagtctattgagatcattggatttgtgatccccggcctccagtggtttatcggcaagtccaccagcagtggacaggtgggttttgtacctacacgaaatatagaccccgatagctattcccccatgtccagaaactcagccttcctcagtgatgaagagcgctgtagtctcctggcgctggggtccgataaacagactgaatgtagttccttcctccacacactagcccgcaccgacattacctccgtgtaccggttgtctggattcgaatccatccagaatcccccaaatgaccttagtgccagtcaacccgagggcttcaaggaagtgcgccccggtagagcctgggaggagcaccaggcagtggggtctaggcagagctctagcagtgaggacagctcgctggaggaggaactgctgtcggctacctccgacagctaccgactgcccgagcctgacgacttggatgacccagagttgttgatggatctgtcaaccgggcaggaagaagaggccgagaatttcgcccccatcctggccttcttggaccatgaggggtatgccgaccatttcaaaagtctttatgacttctctttcagctttttgacttcctcattctactctttttccgaagaagacgagttcgttgcctatctggaggcatctaggaagtgggcgaagaaaagtcatatgacctgggcacatgcgagactctgtttccttcttggccgattatcgattaggaaggtgaaactatctcaagctcgggtatattttgaggaggcaatccacattctcaacggtgcatttgaggacttaagcctggtggcaacactatacatcaacttagcagctatttacttgaaacagaggcttaggcataaaggaagtgctttgctggaaaaggcaggggctctgcttgcttgtctgcctgatcgggagtcttcagcaaaacacgaactggacgtggtcgcctatgttctcaggcagggtatagtcgtgggaagcagccccctcgaagctagggcgtgttttttagctatcaggctcctcctatctctgggcagacatgaagaggtgcttcccttcgcagagcggctgcagttgctctccgggcatccacccgctagtgaagctgtggcttctgtgctgtcattcctctatgataagaagtaccttccacatctggctgtcgcttctgtccaacagcacggaatccaatccgcccagggcatgtccttaccgatatggcaagtccacctggtgctgcagaacaccactaagctcttaggttttccatcacctgggtggggagaagtgtctgcgctagcctgccccatgctgcgccaggcactcgctgcatgcgaggagttagctgaccgctccacacaacgtgcgctctgtttgattctcagcaaggtttacctggaacatagatccccagacggggccattcactacttgagccaggccctggtcctggggcagttgctgggcgagcaggagtcatttgaaagtagcttatgcctggcctgggcctacctgctcgccagtcaagccaaaaaagctctggacgtgctggaaccgctgctgtgctctcttaaggaaaccgagtcccttactcagcgaggcgtcatttataatttgctcggactcgctctccagggggagggccgtgttaatcgtgcggctaagtcttatctgagagccctgaaccgggcccaggaggtcggcgacgtgcataatcaggccgtcgccatggcgaatttgggccacttgagcttgaaatcctgggctcaacaccctgcccggaattatctgttacaagccgtgaggctgtactgtgagttgcaggccagtaaggagactgacatggaactcgtgcaggtgtttctctggctcgcccaagttctggtgtctggccatcagctcactcacggcttgttgtgctatgaaatggcattgctgtttggtctgcggcaccggcacctgaagagtcagctccaggctacgaagagcctgtgccatttttatagcagcgtctcccccaaccccgaggcatgtattacttaccacgaacactggcttgccctagctcagcagctcagggacagggaaatggagggcaggttgttagagtctttagggcagctgtatcggaacctgaacacagcgagaagtctgcgcagaagtcttacttgtattaaggaatccctcagaatctttattgatctgggcgagacagacaaggcggcagaagcatggctgggggcgggacgtctccattacctgatgcaggaggacgaactggtcgaattgtgtctgcaggcggctatccagaccgcactgaagagcgaagaacctctgctggccctgaagctttacgaggaggcgggcgatgtgttctttaacggaaccaggcataggcaccacgccgtagagtattatcgcgcaggggccgtccccctcgcccgtcggttaaaagcagtcagaacagaattgcgtatctttaacaaactcacagaattgcagatttctctggaaggctacgagaaggctctcgagtttgcgactctggccgccagactatccactgtcactggggatcagaggcaggaactggtcgccttccacaggttggccaccgtgtactattcgcttcatatgtacgaaatggccgaagactgctatctgaagaccctgagcctgtgtcccccctggctgcagagtcccaaggaggccctgtattacgccaaggtgtattacaggctcggtcgccttactttttgtcagctgaaagacgcacacgatgccaccgagtacttcctcttggctttggccgcagcagtcttgctaggagatgaggagctgcaggacacaattagatcaaggctggacaacatttgtcagagtccactgtggcacagccgcccgtctggctgctcctccgagcgagccagatggctatcaggtggcggtctggcactgtag

SEQ ID NO: 134158 - DNA, 2181 bp, Artificial Sequence
  Description of Artificial Sequence: Synthetic coding sequence
atggatttgtccactggccaagaggaggaagcggagaacttcgccccaatcctggcttttctcgatcacgaaggatatgccgaccacttcaaaagcctgtacgatttcagtttttcatttctaactagctcattctactcttttagcgaggaagacgagttcgtagcctacctggaagccagccggaagtgggctaaaaaaagtcatatgacctgggcacatgctagactttgtttcctgcttgggagactctccatccgcaaggtaaagttgtcgcaggccagggtgtattttgaagaagcgatacacattctcaatggggcttttgaagatctgtcgctggtagcgacactgtatattaatttggccgccatttatctcaagcaaaggctcaggcacaaaggcagtgcccttttggagaaggccggtgccctactcgcttgtctgccagaccgagagtccagtgccaagcatgaactcgatgtggttgcctacgtcttgcggcaaggaattgtcgtgggttcaagtccactggaagcgcgagcatgtttcctggcgatccgacttctcctgagtctggggcgacatgaggaggtactgccattcgctgaacgcctccagctgctgtctggacatccccctgcaagcgaggccgtggcatcagtgctatcctttttatatgacaagaaatatcttccacacctggctgtagcaagtgtgcagcaacacgggattcagagtgcccaaggcatgtccttgccgatctggcaggtccatctggttctccagaacacgacaaaattacttggttttccctcccccggatggggcgaagtgagtgccctggcctgtccaatgttgaggcaagctcttgccgcatgcgaggagctggctgacaggtcgacacaacgggctctgtgtctgattctgagcaaggtttatctggagcacagatcgcccgatggtgccatccattatctgagtcaggcccttgtactcggccagctgctgggggagcaggaatccttcgaatccagtctgtgcttggcgtgggcctacctgcttgcgagccaggcaaagaaagcactagacgtcctagagccgctgctctgttcgctcaaggagaccgaatcactgactcaacgcggcgtaatttataatcttttgggcttagccctgcagggagaggggagagttaatagagcggcgaaaagttacctgagggccctgaatcgggcgcaggaggtgggcgatgtgcataaccaggcggtggccatggcaaacctcggccacctgtctctcaaatcctgggcgcaacatcctgccagaaactatctccttcaagcagttcgtctctactgcgagctgcaggcctccaaagagacagacatggaactggtacaggttttcctgtggctcgctcaagtcctcgtgtctgggcaccaattaacacatgggctgttatgttacgaaatggctttgctgttcggcctgcgacatagacatctcaagtctcagctccaggcaaccaagtccctgtgccacttctattctagtgttagccccaaccctgaggcgtgcataacttaccatgaacattggctcgcccttgcacagcagctgagagatcgtgagatggaaggccgccttttggagtctctcgggcaactgtaccggaacctgaacaccgctaggtccctgaggaggagcctgacatgtatcaaagagtcattgcgcattttcattgacctcggtgagaccgataaggcagcagaggcttggctgggcgcaggacggttgcactatcttatgcaagaggatgagcttgtagaactgtgccttcaggcagcgatacagaccgccctgaaaagcgaagaaccccttctcgcactgaagttgtatgaggaagccggagatgttttcttcaatgggacaaggcatcggcaccacgccgtggagtattaccgggctggcgccgtgcctctggctcgcaggcttaaagcagtgaggaccgaattacgcatttttaacaaacttaccgagctccagatttcacttgaagggtacgagaaagctttggaatttgctaccctagctgccaggctgtctactgtaacagaggcccgcgccggcggcctttctcctccgggttattccgtcctcttgccagcccatgtttag

SEQ ID NO: 134159 - DNA, 720 bp, Artificial Sequence
  Description of Artificial Sequence: Synthetic coding sequence
atgccgctgcttctgttgggagagacggagcccctgaagctcgaaagggactgcaggtcccccgtggatccttgggcggccgctagtcccgatcttgcccttgcttgcctttgtcattgtcaggacctgtcatctggagcctttcctgacaggggtgttttaggaggcgttctgtttccaacagttgaaatggtgattaaggtgttcgtcgcgactagctcaggcagcatcgctatcaggaagaagcagcaagaagttgtgggcttccttgaggccaacaaaatagatttcaaggagctggatatagctggtgacgaggataaccggcgatggatgagggagaatgttccgggagagaaaaaacctcagaatggaattcctctgccgcctcagatctttaacgaagagcagtattgcggagactttgactcatttttcagcgccaaggaagagaatatcatttactcattccttggattagcacccccacctgacagcaaaggcagcgaaaaagccgaggagggtggtgagacagaagcacagaaggaaggatctgaggatgtggggaacctgcctgaggcacaagagaagaatgaggaagagggtgaaacagccactgaggaaaccgaggaaatcgctatggaaggcgctgagggagaagccgaggaagaggaggagacagctgaaggcgaagagccaggtgaggacgaagatagttag

SEQ ID NO: 134160 - DNA, 387 bp, Artificial Sequence
  Description of Artificial Sequence: Synthetic coding sequence
atgcgggaaaacgtcccaggggaaaagaagccccagaacggcatccccctgcctccacaaattttcaacgaggaacaatactgcggtgacttcgacagttttttcagcgctaaggaggaaaacataatttactcctttctaggactcgcgcctccccctgatagcaaaggtagcgagaaggccgaggagggtggcgagaccgaagcacagaaagaaggctctgaggacgtgggcaaccttcctgaagcacaagagaagaacgaggaagagggggagaccgccacagaggaaaccgaggaaatcgctatggaaggggccgagggagaagccgaagaagaagaggaaactgcggagggtgaagaacccggcgaggacgaggactcttag

SEQ ID NO: 134161 - DNA, 387 bp, Artificial Sequence
  Description of Artificial Sequence: Synthetic coding sequence
atgagagagaatgtgccgggggagaagaaacctcagaatgggataccactccctcctcagatcttcaacgaagagcagtattgcggggatttcgatagcttcttcagtgccaaagaagaaaatattatttactcattccttggcctggcacccccaccggactccaaaggttctgagaaggccgaggagggaggcgagacggaggcccagaaagagggcagtgaagatgtgggcaatctgcctgaggctcaggagaagaacgaggaggaaggtgagactgctaccgaggagactgaggaaatagcaatggagggagctgagggcgaggctgaagaggaggaagagaccgccgaaggagaagagcctggagaagatgaagacagctag

SEQ ID NO: 134162 - DNA, 387 bp, Artificial Sequence
  Description of Artificial Sequence: Synthetic coding sequence
atgcgagaaaacgtccctggcgagaagaaaccacaaaacgggattcctttgccaccgcaaatctttaacgaggagcagtattgcggcgactttgacagcttcttttccgcgaaggaggagaacataatatattctttcctcgggctggctcctccccctgattccaaggggtctgagaaggctgaggaggggggtgagaccgaggctcagaaagaaggcagcgaggatgttggaaacctccccgaggctcaggagaagaacgaagaagaaggcgagactgcaacggaagagactgaggaaatcgccatggagggcgctgagggggaggcggaagaggaggaagagactgctgaaggcgaggaacctggcgaggacgaggactcctag

SEQ ID NO: 134163 - DNA, 321 bp, Artificial Sequence
  Description of Artificial Sequence: Synthetic coding sequence
atgcgagagaacgtccctggggaaaagaagccacaaaatggcatcccactccctccgcaaatatttaacgaagaacaatactgcggagacttcgactcctttttttccgccaaagaagagaacatcatctacagttttcttggcctggctcccccacctgatagtaaaggttctgaaaaagctgaagagggcggcgagacagaggcgcagaaagagggatcggaggacgttggaaatctccctgaggcacaggaaaaaaacgaggaggagggcgagactgcaactgaggagacggaggagatcgcgatggagggagcatag

SEQ ID NO: 134164 - DNA, 2373 bp, Artificial Sequence
  Description of Artificial Sequence: Synthetic coding sequence
atgaacattatgaatacagaacagtcgcagaacagcatagttagccgtatcaaggtattcgaagggcagaccaacatcgaaacttcaggtctaccaaagaaaccggagatcacgccaaggtctctccctccgaagcccactgtttcctcaggtaaaccctctgtggcccccaagcctgccgcgaaccgggcatctggggagtgggattctggaacagagaacaggctcaaagttactagcaaggagggcctgacaccctaccctccactgcaggaggccggcagcatccctgtgaccaagccggagctccccaaaaagcccaacccaggtctgataagatcagttaatcccgagattccaggtagggggccacttgccgaaagctccgactccgggaagaaagtgcctactcccgcacccagacctctgctcctcaaaaaatcggtgagctccgaaaatcccacatatccctctgccccgctgaagcctgtcacagttcctccccgcctggccggcgcctcccaggcaaaggcttacaagtccctcggcgaaggccccccggccaacccaccagtgccagtcctccagtcaaaaccgctcgtggacattgatttgatttcattcgatgatgatgttctcccaacccccagtggaaatctcgctgaggagtccgtggggagcgagatggttctggaccctttccagctgccagccaagactgagcctattaaggaacgggctgttcagccagctccaacgcgcaagccaaccgtcattagaattcctgcgaaaccaggaaaatgcttgcatgaagacccccagagtcccccgcctcttccggccgagaaacctatcggaaatacattttcgactgtcagcggtaagctgtctaacgtcgaacggacacgcaacctggaatctaatcacccgggtcagaccggcggctttgtccgcgtccccccccgcttacccccaagacccgtcaacggcaagacgatccctacccaacaacccccaactaaggtaccaccggaaagacccccccctcccaagctcagtgccacccggcgctctaacaaaaaattaccattcaaccggagcagttcggacatggacttgcagaagaagcagtccaacctggcgactggactgtctaaggccaaatctcaagtttttaagaatcaagatcctgtactgcccccgagacccaagcccggtcatcctctttattccaagtatatgttgtctgtgccccatggtattgcgaatgaggatatagtatctcagaacccgggtgaactgagctgtaagcgaggggatgttctggtcatgctgaagcaaactgaaaataattatctcgagtgccagaaaggtgaggacactgggagagttcacctgagtcagatgaagattatcacaccactagacgaacatctgaggagccgccctaacgaccccagtcatgctcagaagccagtggattctggagccccgcatgctgtggtacttcacgactttccagctgagcaggtggacgacctcaatttaaccagcggcgaaattgtatacctcctcgaaaagattgacaccgactggtacaggggcaactgtcggaaccagataggtattttccccgcaaattacgtgaaggtgatcatcgatattcccgaaggtggaaatgggaaacgcgagtgtgtgtcctcgcactgtgtgaaaggatcacgttgcgtcgcacgcttcgaatatatcggagaacaaaaggacgaactgtctttcagtgagggtgagatcataattctgaaggagtacgtgaacgaggagtgggctcgaggcgaagtgcgggggcgaactggtatattccccctgaactttgtagagccagtcgaagactatcccacttcaggcgccaacgttctgagtaccaaagtgcctctgaagaccaaaaaggaagatagcggctccaatagccaagtcaactccctacccgccgaatggtgcgaggcactgcatagcttcactgctgagacctcagatgatctgtcttttaagcggggggaccggatacaaatactcgagcgcctcgacagcgactggtgtagaggacgcctgcaggacagggagggcatctttcccgcagtgtttgtcaggccatgcccggccgaagccaaaagcatgctcgccattgtgccaaaaggcagaaaagctaaagctctgtacgactttagaggggagaacgaggatgagctctcctttaaagctggagatatcattactgagctggagtccgttgacgatgattggatgtccggcgagctgatgggcaagtctgggatttttcctaagaactacatacaatttctgcagatctcttag

SEQ ID NO: 134165 - DNA, 2373 bp, Artificial Sequence
  Description of Artificial Sequence: Synthetic coding sequence
atgaatataatgaataccgagcagagccagaactcaattgtgagccggataaaggtcttcgagggtcagacgaacatcgagacttccggccttcctaagaagccagaaatcactcctaggtccctgccacccaagcccaccgtgagctctggaaaaccgagcgtggcacccaaaccggcagcaaaccgagcatccggggaatgggattccggaaccgaaaacaggctgaaagttacatctaaggagggtctaaccccctacccacccctgcaggaggcgggcagtatacctgtgacaaaacctgagttgcccaagaaacctaatccgggcttaatacgtagtgtcaatccagagataccaggacggggacccctagctgagtcatccgattccggaaaaaaggtgcccacacccgccccacgaccgctgttattgaagaagtctgtttccagcgagaaccccacgtatccatccgcgcctctgaagcctgtgacagtccccccccggctggcaggcgcttcccaagccaaagcttacaaaagcctgggtgagggccctccagccaaccctcctgtgcccgtgctgcaatccaaacccttggtagacattgacctgatctcatttgacgatgatgttttaccgacaccatctgggaacctagctgaggagtctgtcggatcagagatggtgctggatcccttccagctgcccgccaagacagaacccattaaggaaagggcggtgcagcccgctccgacacgcaaacccaccgtgatcaggatccctgccaagcccggtaagtgcctgcatgaggaccctcagtcacccccaccactgcccgccgagaaaccaattggaaacacgttctcgacagtcagtggtaagctgagtaacgtcgagcgcacacgcaatctggagagtaatcacccaggacaaaccggaggtttcgtcagggttcctccacgcctgcctccacgcccggtcaacggaaaaactattcccactcagcagccacccaccaaggtgcctcctgaacggcctccacccccaaaactatcggcgacccggcggtctaataagaagttacctttcaataggagttcgtccgacatggatctccagaaaaagcagtcaaacctggccaccggcctgagcaaggccaagagccaggtgttcaagaatcaggaccctgtgcttccacctaggccaaaacccggccatcccttatatagcaaatacatgctgtccgttccacatggcattgctaacgaagacatcgtgtctcagaatcctggtgagttgagttgcaagcgaggcgacgtgctggtgatgttgaagcagacagagaataactacctcgaatgtcagaaaggagaggatacaggacgcgtgcatctgtcacagatgaagatcatcacaccactcgatgagcacttgcgcagcaggcctaatgatcctagccacgcccaaaagcctgtggatagcggagctcctcacgccgtagtgttacatgattttcccgctgagcaggtggatgatctcaacctcacaagtggggaaattgtttatctgctcgagaaaattgatactgactggtaccgcggcaactgcaggaaccagattggaatattccccgccaattacgtgaaggtgataattgatatccccgagggaggtaacggaaagagggagtgcgtgagcagtcattgcgtgaaaggttcgcggtgcgtggcgcgttttgagtacataggtgagcaaaaggatgagctttccttttcagaaggcgagatcatcatccttaaagagtacgtgaacgaggaatgggcccgcggagaggtgcggggcaggacaggcatctttccacttaacttcgtggagccagtcgaagactaccccacaagtggtgcaaacgtgctttccaccaaagtgcccctgaagactaaaaaagaagacagcggctccaactcacaggtcaattctctccccgcagagtggtgcgaagccctccactcatttaccgctgagacaagtgatgacttgtcctttaaaaggggcgaccgtatccaaatcctcgagaggcttgacagcgactggtgtaggggaaggctccaagatagggagggcatattcccagcagttttcgtacgcccatgtcccgcagaggcaaagtcgatgctcgccatcgttcccaaaggacgaaaggccaaagcattgtacgacttcaggggagaaaatgaggacgaactgtccttcaaggctggggacatcattacggagctagagagtgttgatgatgactggatgtctggggagctgatggggaagtcagggatttttcccaaaaattacatccagttcttgcagatcagttag

SEQ ID NO: 134166 - DNA, 2304 bp, Artificial Sequence
  Description of Artificial Sequence: Synthetic coding sequence
atgaatatcatgaatactgaacagagccagaattctatagtgtctcgtatcaaggtgtttgagggacaaaccaatatcgaaacctcgggtctccccaaaaaaccagagatcaccccccgaagcctaccccctaagcccactgtctcctcaggaaagccgagcgtggctcccaagcctgccgccaacagggcatctggagaatgggactcaggaaccgagaatcggctaaaggtaacaagtaaggaaggtctcacaccctacccccccctccaggaagcgggaagtattccggtgaccaagcccgagctccctaagaagccaaacccaggcctcatccgtagtgtgaatcccgaaatacctggccgcgggccccttgctgaatccagtgattcaggcaagaaggtacccacgcctgctcccaggccattactccttaagaagtctgtaagctctgaaaaccctacatatcctagtgctccactgaagccagtgactgtgccacccaggctggctggagcaagccaggccaaagcatacaaaagcctaggtgaaggaccacccgccaatcctcccgtacctgtgctgcagtccaaacccctcgttgacatcgatctcattagtttcgatgacgacgtcctccccacgccttcaggaaatttagcagaggaatccgtggggtctgagatggttctggatccttttcaactgcctgctaagaccgagccaatcaaggagagagctgtccagccagcccccacccgcaagcctacagtgattcgcatacctgctaagccaggcaaatgtctgcacgaggacccccagtcccctccccctctgccagcagaaaaacccattggaaacacgttctcaacggtttcgggcaagctcagtaacgtggagcgtacccggaacctcgaatccaaccaccccggccagacagggggctttgtgagggtcccccccaggttgcctccaagacctgtgaacggtaagacgataccgacccaacagcctcccaccaaggtcccccccgagaggccaccgccgcctaaactttctgcaaccaggcggagcaacaaaaagctgccttttaacaggtctagctctgatatggacctgcaaaaaaaacaatctaatctggctactggactctctaaagctaaatcccaggtgttcaagaatcaggatccagtactccccccacggcctaagccaggccatccattgtacagcaaatacatgcgaggtgatgtgctggtgatgttgaaacagaccgagaataactacctggagtgtcagaagggagaggataccgggcgtgtccacctttctcagatgaaaatcatcactcctttggatgaacacttgagaagcaggcctaatgacccatcccatgcccagaaacccgtggatagtggggctccccacgccgtcgtgctgcacgactttcccgccgagcaggttgacgatctgaatctgacgagcggcgaaattgtgtacctcctggaaaaaatagataccgattggtaccgaggcaattgcaggaaccagattggcatcttcccagctaactacgttaaagtgattattgatattcctgagggcggcaatggcaagcgtgaatgcgtctcttctcactgtgtcaaaggatcacgatgcgtggcccggtttgagtatataggggaacagaaggacgagctctcatttagcgaaggcgaaatcatcattctgaaagaatacgtgaacgaggaatgggcccggggcgaagtgaggggtagaacggggattttccctctgaacttcgtggagccagtcgaggactaccctacctctggagctaacgtactgtcaacaaaggtccctttgaaaaccaagaaagaagactctggatcaaactcacaagtcaactctctgcccgcggaatggtgtgaagctctacactcgttcaccgctgaaacaagtgatgacttatcattcaaaaggggcgatcggatccagatactggagcgcctagattcggactggtgtcgaggaagactccaggaccgggaaggaatatttccagctgtgtttgtaaggccctgtccagccgaggccaagtcaatgctcgccatagtgcccaaaggacgaaaggccaaggctctatacgattttcgaggggagaatgaagatgaactgtctttcaaagcaggtgatattattaccgagctggagtccgtcgatgacgattggatgtcaggggaactcatgggcaagtccgggatctttccaaagaattacatacagttcctgcagatttcatag

SEQ ID NO: 134167 - DNA, 2196 bp, Artificial Sequence
  Description of Artificial Sequence: Synthetic coding sequence
atgaacataatgaacactgaacagagccagaactcgattgtatctcgaattaaggtgttcgaggggcaaaccaatatagagacctccggattgcctaagaagcctgaaatcaccccacggtccctgcctcctaagccaaccgtgagcagcgggaagccctctgtggccccgaaacctgcagcgaacagagcttcaggtgaatgggactcaggaaccgaaaataggttgaaggttaccagcaaggaagggttaaccccttacccgcctctccaggaggcaggttctatcccagtgaccaaacctgagcttccaaaaaaaccaaatcctggcctgatccgcagcgttaacccggagatccctgggcggggaccactggcagaatcctctgatagtggcaagaaagttcctactcccgccccccggccattgcttttgaaaaagagtgtgtcgagcgagaaccccacttacccgagcgctccactgaaaccagttaccgtgccccccaggcttgccggcgcttctcaagccaaggcttacaagagcctcggggagggacccccagcgaatccgccggtaccagttctccagtccaagcctctcgtagatatcgacctcattagctttgatgacgacgttctgcccactccatcaggcaatctggctgaagaatccgtgggctccgagatggttctgggtctgcacgaggaccctcaaagtccccccccactccccgccgagaagcccattgggaatactttctctacagtatcagggaaactgtctaatgtggagaggaccagaaatcttgaatcaaatcatcccggccaaacaggcgggttcgtgagggtgccgccacggctccccccaaggcccgtgaacggcaagaccatcccgactcagcaacctccaaccaaggtgccccccgaaagaccaccgcctcctaaactgagcgccacgcgtcgatctaacaaaaagctcccgtttaatcgctcctcaagtgacatggatctgcaaaaaaagcagtcaaatctagccacggggttgtcaaaagccaagagtcaggtgttcaaaaaccaggatccggtgcttcctcctagacctaaacctggccacccattgtactctaaatatatgaggggggatgtgctggtgatgctgaagcaaacggagaacaactacctggagtgccagaaaggagaggacacggggagggtccacctgtcccagatgaaaataatcacgcctctcgatgaacacctccgctcccggcctaatgatccctctcatgctcagaagccagttgactccggggcacctcatgccgtcgtgctgcacgacttcccagctgagcaagtcgatgatctgaaccttaccagcggcgagatcgtgtatctccttgagaaaatcgatactgattggtacagaggcaactgtcggaaccagattggcatatttccagccaactatgtcaaggtgatcatcgatatacctgaaggcggtaacggcaagcgggaatgtgtgtccagccactgcgtgaaaggatctcgctgtgtggcaaggtttgagtacatcggcgaacagaaggatgagctctcattttctgaaggagagattattattctcaaggagtacgtgaacgaggagtgggccaggggagaggtaaggggccggaccggtatctttcctctgaatttcgtggaaccagtagaggattaccccacctctggcgcaaatgtgctctctactaaggtcccacttaaaacgaagaaagaggacagtgggtccaattctcaggtgaacagtctgcctgcggagtggtgcgaagccttgcattctttcacagccgagacatcggatgacctgtcctttaaacgcggagatcgaatccaaattttagagaggttggacagtgactggtgtcgcggccggcttcaggatcgcgagggaatattccccgcggtgtttgtccgaccctgtcccgccgaggctaaatcaatgcttgctatcgtgcctaagggtaggaaggctaaggctttgtacgatttcagaggagagaatgaggacgagttatcattcaaagcgggtgacattatcactgagctggagagtgttgatgacgactggatgagtggcgagctcatggggaaaagcgggatcttccctaaaaactacatacagttccttcagatctcatag

SEQ ID NO: 134168 - DNA, 2196 bp, Artificial Sequence
  Description of Artificial Sequence: Synthetic coding sequence
atgaacataatgaacactgaacagtctcagaactccatcgtgtcacgaatcaaggtttttgaaggacagactaacatagaaacctccggcctgcctaaaaaacctgagataactccgcgatctttgccgcctaagcctacagtaagctccgggaagccttctgtggccccaaagcccgctgcaaaccgggcttccggcgagtgggacagcggcactgaaaatcgattgaaggtaacttctaaggaaggattgaccccttatcccccattgcaagaagccggctctattcccgtaactaaaccggaattaccgaaaaagcccaaccccggactgatccgctctgtcaacccagagatccctggcaggggaccactggctgaatcaagtgatagtggaaagaaagtgcccaccccggctccgagaccgttgctcttgaaaaagtcagtttcaagcgaaaaccccacgtatccaagcgcccccctgaagcccgtgacggttcctcctcgcttagctggggcttctcaggcaaaagcttacaaatcactaggagaaggtcctcccgctaacccacccgtacccgtcctccagagcaagccactcgtagacatcgatctcatttcattcgacgatgatgtgttgccaactcctagcggaaacctcgctgaagagagtgttggttctgagatggtactgggactccacgaagacccccagtctccaccaccgctgccagcagagaagccaattgggaacactttcagtacggtgtccggcaaactcagtaacgtggaacggacccgcaatctggagagcaaccacccaggccagacgggcggttttgtccgggtgcccccccgtcttccacccagacctgtgaatggtaagaccattcctacccaacagccccccaccaaagtgcccccagaacggcccccaccccctaaattgagtgccacacggagaagcaacaagaaactgccattcaatcggagctccagtgacatggatctgcagaaaaagcaaagcaacctagccaccggcctgtccaaggcaaagagtcaagtgtttaagaatcaggacccggttttgcctcctagacccaagcctgggcacccactctacagcaaatacatgcgtggcgatgtactagtgatgcttaagcaaacagagaacaactatctggagtgccaaaagggcgaggacactggtcgtgtccacctatcacaaatgaagattattactccgctggatgaacatttacgctctagacccaatgacccctctcacgctcaaaagcccgttgattccggcgcacctcacgccgtggtgctccacgactttcctgcagagcaggttgacgacctcaatctcactagtggcgagatcgtgtacctcctggagaagattgacacagattggtatcgtggtaactgtcgcaaccagatcgggatctttcccgccaactacgttaaggtgatcatcgacatccctgagggcggtaatgggaagcgggagtgtgtgagctctcattgtgtaaagggcagccggtgtgtggccaggttcgagtacattggagaacagaaagatgagctgtccttcagtgagggcgagattatcattctgaaagagtatgttaacgaggaatgggcccgaggtgaggtcagaggaaggaccggaatttttccgctcaactttgtggagcccgtcgaggactaccctacctctggagctaatgtgttgtctacgaaagtgccactgaaaactaagaaagaagattccgggagtaatagccaggtgaacagcttgccagccgaatggtgcgaggcactgcattcattcacggccgagacatccgacgatctgagcttcaagcgcggtgaccgcatacagattctggagaggctggatagtgactggtgtaggggcagactgcaagatcgcgaggggatctttcccgcggtgtttgttcgaccctgccccgccgaagccaaaagcatgttagccatagtccctaaaggccggaaggcaaaggccttgtatgactttcggggagagaacgaggacgaactgtccttcaaggctggggacattatcacggaacttgaatccgtcgacgacgactggatgtctggcgagctgatgggaaaaagcgggattttccccaagaactatatccagttcctccaaatctcgtag

SEQ ID NO: 134169 - DNA, 2304 bp, Artificial Sequence
  Description of Artificial Sequence: Synthetic coding sequence
atgaatattatgaacaccgagcaatcccagaactccatcgtgtccaggataaaagtgtttgagggacagaccaatatcgaaactagcgggttgcccaagaagccagagatcactccccgctccctgcctccaaagccaacagtcagctctgggaagcccagcgtggcgccaaaaccggcagccaaccgggcctcaggggaatgggactccggcacagagaaccgtctcaaggtgacttctaaggaaggtctcacgccttaccctcccctgcaggaagctggatcaatccctgtcaccaaacccgagctgccgaagaagcctaaccctggactcatcaggagtgtgaaccccgagatccccgggagaggtcctttagccgagagtagcgatagtggaaagaaagtacctacacctgcccctagacccctgctgctgaagaaaagcgtaagcagcgagaatcctacgtatccatctgcgcccttaaagccagtgacggttccacccagattggccggtgcgagccaagccaaggcctataagtctctgggtgaaggccctccagcaaacccccctgtaccagtcctccagtctaaacccctcgtggatatcgacctcattagtttcgacgatgacgtgttgcccacaccatccgggaacctggctgaggagtccgtggggtcagagatggtgcttgatccgtttcaactcccagccaagactgagcctattaaagaaagagctgtgcagcccgcgcccacccgaaaaccgacggtcatccgcatccccgccaaaccagggaagtgcctgcacgaagacccccagagcccaccacctttgcctgctgagaaaccaatcgggaatacattctcaaccgtctcaggcaaactgtccaatgtggagcggacgcgcaacttggagtctaatcaccccgggcagacgggagggtttgtgagagtgccacctaggctgccaccaagacctgttaatggcaaaaccattcctacccagcaaccccctaccaaggtccctccggaaagacctccacctccgaagctgtccgccacccggcggtctaataagaagctgcctttcaatagaagttccagcgacatggatctgcagaagaaacaaagcaacctggccacaggtctcagtaaggctaaatcgcaggtgtttaaaaatcaggaccccgtgctgccccctcgccccaaaccagggcacccattatacagtaaatatatgaggggcgatgtgctcgttatgctgaagcaaactgaaaacaactacctggaatgtcagaagggggaagacaccggacgggtgcatctgtcgcagatgaagatcattacacctctggacgagcatttgaggtctaggcccaatgacccatctcacgcccagaaacctgtggattccggagctccgcacgcggtggtgttgcacgacttcccggctgagcaagttgacgatcttaacctgacctcaggagaaatagtctatctgctggagaagatcgatacggactggtacagagggaattgtaggaatcagatcgggatatttcccgccaattacgtgaaggtcattatcgacattccagaaggcgggaatggcaaacgggagtgcgtgtcttcacattgcgtgaaaggttctcgctgtgtcgcgcgattcgagtacatcggggaacagaaggatgagctgtctttttcagaaggggagatcataatcttgaaggagtatgtgaatgaggagtgggcgcgcggcgaagtgcggggccggacaggcattttcccattgaatttcgtggaaccagtggaggattaccccacctccggagcgaacgtcttatccactaaagtgccattaaaaactaagaaggaagactctggcagtaattcccaagtgaacagtcttccggccgagtggtgcgaggccctgcactcgttcacggccgaaacatccgacgatctttccttcaagaggggtgacagaatacaaatcctggagcgactggactctgactggtgccgaggcaggcttcaagatcgcgaaggcatcttcccagccgttttcgtacggccctgtccagcagaagcgaagtctatgctagctatcgtgccaaagggccgaaaagcaaaagccttatatgactttcggggggaaaacgaagacgaactgtcattcaaggccggcgacatcatcacagagttggagtcagtagatgatgactggatgtccggggagttaatgggaaagagtggaatatttccaaagaactacattcaattccttcagataagctag

SEQ ID NO: 134170 - DNA, 2304 bp, Artificial Sequence
  Description of Artificial Sequence: Synthetic coding sequence
atgaatatcatgaataccgaacagtcacagaactctattgtatctcggatcaaggtgttcgagggccagactaacatcgagaccagtggacttcccaagaagcctgagatcactcctaggagtttgccaccaaagccaacagtttccagtgggaagccatccgtggcccctaaacctgctgcaaaccgcgctagtggcgaatgggattcggggaccgagaatcgtttgaaggttaccagcaaagagggcctcacaccctaccctccactgcaggaggctgggtcgattcccgtcaccaagccggagttgcccaaaaagcccaatccaggactcatcagatctgtgaaccccgagatccctggaagaggacctctcgctgaaagttccgatagtgggaaaaaggtgcccactcctgcgcctcgccccctgctgctaaaaaaatcagtttccagcgaaaatcctacgtatccgtcggcaccgttaaaaccagtgacggtcccaccacggctcgccggggccagccaggccaaagcatataagtcacttggagagggaccgccggcaaatcccccagtcccagttctgcagtctaagcctctcgtagacattgacctgattagcttcgatgatgacgtactgcctacaccatccggcaacttagccgaggagtctgtaggttcagagatggttctggatccttttcagctgcccgccaaaactgagcctatcaaagagagagcggtacaacccgcaccaacgagaaagcctaccgtgatccgaattcccgccaagcccggtaaatgcctgcatgaagatcctcaatcgcccccacctctccccgctgagaaacctatcgggaataccttctcaaccgtgtcaggcaaactatccaacgttgaacgcaccagaaacctggaatcaaaccatccagggcagacagggggcttcgtacgtgtcccccctaggctgcctccaaggcctgtgaacggcaagactattccgacacagcagccaccaacaaaagtcccacccgaaagacccccacccccaaaactctcggccacacggcggagcaacaagaagctgccattcaaccgctcctcctcagacatggacctccagaaaaaacaatccaatctggcgacggggctctctaaagccaagtctcaggtgttcaagaatcaagatccagtcctccctccgcgtccaaagcctggacacccgctgtacagcaaatacatgcgcggcgatgtgcttgtgatgctcaagcagactgaaaacaactacttggagtgccaaaagggagaggataccgggcgcgtccatcttagtcagatgaagataattacaccactcgatgaacatctgaggagcagacctaatgatccgtcccatgcccagaaacccgtcgactcaggcgccccacatgctgtcgtgttacacgatttccccgctgaacaggtggatgatctgaatctgacttcgggggaaattgtgtacctcctggagaaaatcgacaccgattggtatcgcggtaactgtcgtaaccaaatcggtatattcccagcaaactacgtaaaggttatcatagatattccagaaggtgggaatggcaaaagggagtgcgtttcctctcattgcgtaaagggctcacggtgtgtcgcacgctttgagtacattggagagcaaaaggacgaactatctttttccgagggggagatcattattttgaaggagtacgtgaacgaggagtgggctcgtggcgaggtacgaggccgaacaggaatctttcccctcaacttcgtcgaaccggtcgaggattaccctacctcaggcgctaatgtgctatctaccaaagtgcctctgaagacaaaaaaggaggacagtgggagtaattctcaagttaactccctacctgcagaatggtgtgaagctttgcactcgttcacagccgaaaccagcgacgacctttcattcaagaggggagacagaattcagatcctcgagcgcttggacagcgattggtgccgcggtcggctgcaggaccgggaggggatttttcctgctgtgttcgttagaccatgtccggctgaagctaagtctatgctagccattgtgcccaaaggacggaaagccaaggcactgtatgactttcgtggtgaaaatgaagacgaactctcgtttaaggccggggatatcatcacagagctggaatctgtggatgacgattggatgtcaggcgagttgatgggcaagagtgggatctttcctaagaactacatccagttcctgcagatcagttag

SEQ ID NO: 134171 - DNA, 2190 bp, Artificial Sequence
  Description of Artificial Sequence: Synthetic coding sequence
atggatgacctgactctcctggatctgctggaatgcccagtttgtttcgaaaagctggatgtaaccgccaaggtactgccgtgccaacataccttctgtaagccttgcttgcagcgcgttttcaaagctcataaagagctcagatgcccagagtgtcgaacacccgttttctctaacatagaggcgctgcccgccaacctcctgctggtgaggttgttggacggcgtgcggagcggccagtcatctggacggggcggttcctttcgaaggccaggaactatgacactgcaggatggcagaaaatccagaactaaccctagacggcttcaggcctcaccgtttcgactggttcccaatgtacgcattcatatggacggagtccccagggcgaaggctctctgtaattaccgcggacagaatcccggcgacctccgctttaacaaaggagacatcatcttgctgagacgacagcttgatgagaattggtatcagggggagattaatggcataagcggcaattttcccgcctcgtccgtggaggtcattaaacagctgcctcagcctccaccactgtgccgggccttgtataacttcgacttgcggggtaaggacaagtctgagaaccaggattgtctgaccttccttaaggacgatattataaccgtcatcagccgcgtcgacgagaattgggcggaggggaagctcggcgataaggtgggcatttttcccatcctgttcgttgagcccaacctgacagcacgacacttgctggagaaaaacaaagggcggcagtcttcccggactaagaacctctctctggtgtcttctagtagcaggggcaacacatctacactgcggagaggccctggttctagacgaaaagtgcccgggcagttcagcatcaccaccgccctgaacactctaaacagaatggtgcattctccttccggccgacacatggtagaaataagtacacccgtcctcatcagcagcagcaatccatcagtgattactcagccaatggaaaaggcagatgttccctcctcatgcgtgggacaggttagcacttatcaccccgcacctgtgagtcccggccactctactgccgtggtgagccttcccggatcccagcaacatctgagtgccaatatgttcgtggcactccactcctacagtgcccacggacctgacgagctcgatctacaaaagggggagggcgtccgagtcttaggcaaatgtcaggacggttggctgcgtggggttagcttggtgacaggcagggtcggcatttttcccaacaactacgtgatccccatattccggaagaccagtagttttccggatagccgatctcccggtctgtataccacttggaccctgagcacctccagtgtctcctcacagggatcaatatctgagggagatccccgccaaagcaggcccttcaagagcgtgttcgtcccaactgcaattgtcaacccggtgagaagtaccgcagggccaggcactttaggacaaggtagcttgaggaaagggcgatccagtatgcgcaaaaacgggagcttgcagcgccccttgcagtccgggattcctactttagtggtgggctcgctgcggcggtcccccaccatggtcctacgcccacagcagttccaattttaccaaccccaggggattccctcctctcccagcgccgtggttgtagaaatgggttcaaagcccgcattgacaggcgagccagccctgacttgtatctcaaggggatctgaagcctggatccattctgccgctagttctctaatcatggaggacaaggagatcccgattaagtctgagcccctgcccaagccacccgcgagtgcacccccatcgattcttgttaagccagaaaatagcagaaatggaatagaaaagcaggtgaaaactgtgaggtttcagaactacagcccgccccccacaaagcactataccagtcatccaactagcggaaaacccgaacagccagctacgcttaaagcatctcagccagaggccgcaagcttgggccccgagatgaccgtcctgtttgcccaccgttcggggtgccacagcgggcagcaaaccgatctgcggaggaagtccgcactggggaaggccacgaccctggtgtccaccgcgtccggtacacagactgtctttccatccaagtag

SEQ ID NO: 134172 - DNA, 2190 bp, Artificial Sequence
  Description of Artificial Sequence: Synthetic coding sequence
atggacgacctgacactcctggacttgctggagtgccctgtgtgttttgagaagctagatgtgaccgccaaagttcttccttgccaacacaccttttgtaaaccgtgcctgcagcgcgtctttaaggcacacaaggaactgcgatgccccgaatgccggacacctgttttctccaacatcgaggccctgccagctaatctcttactggtgcgccttctggatggcgtcagaagtgggcagtcgtctggccgagggggcagctttcgaagacccggcaccatgacactgcaagacggacggaagagccgcaccaatccccggaggttgcaggctagtccgttccgtctcgtgcctaacgttagaatccacatggacggagttccacgtgcaaaggccctgtgtaattatcgggggcagaatcctggtgacttgagatttaacaaaggagatatcattctacttcggcgtcaactggatgagaattggtatcagggcgaaatcaatggaatttccggaaacttcccggcatcctccgtcgaagtcattaagcagttgccgcagcctcctcccttgtgccgggccctatacaattttgatctcagaggtaaggataaatcagagaatcaggactgcctgacattcctcaaggacgatatcatcaccgtgatatccagagttgacgaaaactgggcagaggggaaactgggggacaaagtgggcatatttcctatactctttgtggaacctaatctgacggcaagacatctcttggaaaagaacaaggggaggcaatcatccaggaccaagaacttgagcctggtcagcagctcatctagggggaacacatccactctgcgaaggggacctggttctagacgcaaagtccccggacaattctctattaccaccgctctgaacacactgaaccggatggtgcattcacccagcgggcgccatatggtggagatcagtaccccggtcctcatcagtagttccaatccatctgtgattacccagcccatggagaaggcggacgtgccaagctcttgcgtggggcaggtttctacctaccacccagccccagtgtcacccggacactctacggccgtggtgagcctgcccgggtcccagcagcacttgtctgccaacatgtttgtcgcgttacacagctatagtgcacatggccccgacgaactagatttgcagaaaggtgaaggcgtacgcgtcttgggaaagtgccaggatggatggctgaggggagtcagcctggtgacagggcgcgtcgggatttttcccaacaattatgtcatacccatttttaggaaaacgtcctcatttcctgattcacgttctccaggactgtacactacttggacactttcaacaagttctgtttcctcccagggctctatcagcgagggggacccacgccaatccaggccctttaaatctgtgtttgttccaacagccattgttaatccagtccgatccaccgccggacctggcactcttgggcagggatccttacgtaaaggccggtccagtatgcgtaagaacggctctctgcagcgccctctacagtccggcataccaacattggtggttggttcacttcgacggtcaccgacaatggtgctgcggccccagcagttccagttctaccagccacaaggcatcccctcatcaccatctgctgtggttgtggagatgggatccaaacctgctcttacgggcgagcctgcactgacttgcatcagccgcggttctgaggcttggatccactctgccgctagcagcctcatcatggaggacaaggaaattccgataaaatccgagcctctgcccaaaccaccggcttcagcccccccaagtatccttgtgaagcctgaaaactcacgcaatggcatcgaaaagcaggttaaaaccgtcaggtttcagaactactctcctccccccacaaagcattacacctcccaccctaccagtgggaagcccgagcaaccggctaccttgaaggcaagtcagccagaggcagcgtctttgggcccggagatgacggtattgttcgcacatcggtccggctgccactctggacagcagactgaccttagacgcaagagtgctctgggcaaggccaccacactcgtgtccacggcttccggcacccagactgttttcccttctaaatag

SEQ ID NO: 134173 - DNA, 387 bp, Artificial Sequence
  Description of Artificial Sequence: Synthetic coding sequence
atggaggataaggaaattcctattaaaagcgaacccctccccaagccccctgcgtccgctccaccgtccatactggtcaagcccgagaattcgcgaaatggaattgagaaacaggttaaaaccgtcaggtttcaaaattacagtcccccacccaccaaacattatacgtcgcaccctacttcagggaagcccgagcagccagccacacttaaagcgtcccagcctgaggccgcatctcttggtcccgagatgacggttctgtttgcccacagatctggttgtcattccggccagcaaactgaccttagaagaaagtctgccctggggaaagccactacgctggtgtcgactgcgtctgggactcagactgtgttcccaagtaaatag

SEQ ID NO: 134174 - DNA, 1686 bp, Artificial Sequence
  Description of Artificial Sequence: Synthetic coding sequence
atggccgctgaggagatgcactggccagttcctatgaaggcgattggggcacaaaatctcctgaccatgcccgggggggtggccaaggccgggtacctgcataaaaagggcggaacgcaattgcaattgttaaagtggcccttacgctttgtgatcatccataagcggtgtgtttactacttcaagtcctccacctcagcttctcctcaaggcgccttttcccttagcggatataaccgtgtgatgcgagccgctgaagagacaaccagtaacaatgtattcccctttaagattattcacatcagcaagaaacatcggacttggttcttctcagcttcctccgaagaagaaaggaaaagctggatggcactactgcgacgggagattggccactttcatgaaaaaaaggatctccccctggatacctccgacagctcttcagacacagattccttttacggagccgtggagaggccagtggacatctctctgtctccttaccccactgataatgaagactacgaacacgacgatgaggatgactcttatctggagcctgatagccctgagccaggccgcctggaagatgctttaatgcacccgccggcatatccaccgccccccgtgcctacccctcgcaaacctgcctttagcgatatgccgcgtgctcattcattcacttcaaagggcccgggcccgctgctgccacctcctcctccaaagcacggcctgcctgacgtgggcctggctgcggaagattcaaagagagaccctctctgtcctcgccgggcggagccatgtccaagggtcccagccaccccccgccgcatgagcgaccctcccttgtcaactatgccaacagcaccagggcttagaaaacctccctgcttccgcgaaagcgcgagtccttcaccagagccatggacccctggccatggcgcttgttccacctctagtgccgccattatggccaccgccacctcccgcaattgcgataagctgaagagctttcacctctccccacgaggaccgcctaccagtgaacctcctcctgtcccggccaataagcccaagttcctgaagatcgcggaagaggacccacctcgcgaagccgctatgccgggcctgttcgttccacctgtggcacctagacctcccgcgcttaagctccctgtgcctgaggccatggcccggccagccgtgttgccaaggccagagaagccccagctgccgcatctccagcgaagtcctcctgatggtcagagttttcgctcttttagtttcgagaagccccgccagccctcccaggctgatactggcggggatgattcagacgaagattacgaaaaggttccccttccaaattcagtttttgtcaacaccacggagtcctgtgaagtcgagagactcttcaaggcgacatccccccgcggagagccacaggacggactgtactgtattagaaactcctcaacaaagtccgggaaggtcctagtggtgtgggatgagaccagcaataaggtaagaaactatagaatttttgagaaggattctaagttttatcttgaaggggaggtgctgttcgtatcagtcggctcaatggttgagcactatcacacacacgtactgccgtctcatcagagtctgcttctgaggcatccctacggatatacagggccccgatag

SEQ ID NO: 134175 - DNA, 294 bp, Artificial Sequence
  Description of Artificial Sequence: Synthetic coding sequence
atggcagccgaggagatgcattggcctgtgccaatgaaagccatcggggctcaaaatctactaaccatgccagggggcgttgcaaaggcagggtacctacataaaaaaggcggaacccagttacaactactgaagtggccgcttaggttcgtgatcatccataagagatgcgtctactacttcaagtcgtcgacgagcgcatccccccagggcgctttctctttgagtgggtacaatcgccagccgcggccccagccagcccaggccctttcccagacagaagcaggaccatag

SEQ ID NO: 134176 - DNA, 1686 bp, Artificial Sequence
  Description of Artificial Sequence: Synthetic coding sequence
atggcggcggaggaaatgcattggcccgtgcccatgaaagctattggtgcccagaacctgttaaccatgcctggtggagtggcaaaggccgggtacttgcataaaaaagggggtacccaactgcagcttctaaaatggcctttgcgctttgtgataatccataaacgctgtgtgtattattttaagagcagcactagtgcttctcctcagggtgctttctccctgtcaggctacaaccgtgtgatgcgggccgctgaagagactacctccaacaacgtcttccccttcaaaataattcatatatctaaaaaacataggacatggttttttagcgcttcaagcgaagaagagcgtaagtcttggatggcccttttaagaagagagattggtcacttccatgaaaaaaaggatttgcctctcgacacctctgacagttcatctgacacggactccttttacggagcagtcgaaaggccggtggacatctctctctcaccataccccacagacaatgaggattatgaacacgacgatgaggacgactcttacctggaacctgactcccccgaaccaggccgtctcgaagatgcactgatgcatccccccgcctatccgcccccacccgtgccaacccctaggaaacccgccttcagtgacatgcctcgggcacatagcttcacttcaaagggccctgggcctcttctgcctccaccgccccctaagcatggcctaccggatgtgggattagctgcggaggactccaagcgtgacccactctgtccgcggcgtgcggagccgtgtccccgggtgccggcaacaccaaggagaatgagcgaccctcctctttcaacgatgcctacagcacccgggttacgcaagcctccctgctttagggaatccgccagccctagtcccgagccatggaccccaggccacggcgcttgcagcacgagctcagccgctataatggccaccgccacatccagaaattgtgacaagctgaaatcgttccacctgtctcctaggggcccgcccaccagcgaaccaccccctgtgccggccaataaacctaagtttttgaagatcgctgaagaagacccgcctagggaggcggcgatgcccggattattcgtgcctcccgttgcaccgagaccccccgctctcaaattacctgtgcccgaggcaatggcccggccggccgtgctgccccggcccgagaagcctcagttaccacacctgcagagatcacctcccgacggccaatctttcaggagtttcagcttcgagaagccaaggcagccatcgcaagccgatacaggaggcgacgactccgacgaggattacgagaaagtgcctctccctaacagcgttttcgtgaatactacggagtcttgtgaggtcgaaagattatttaaggccacaagtccccggggagaaccccaggatggtctgtactgcatcaggaactcttccacgaagtctggcaaagtgctggtggtttgggacgagacatctaataaggttcggaattacagaattttcgagaaggatagcaagttctatcttgaaggcgaggtgttgtttgtgagcgtaggatcaatggttgaacactatcacacacacgttctgcccagccaccagtcactgctgcttcggcacccttatgggtacaccgggccacggtag

SEQ ID NO: 134177 - DNA, 1770 bp, Artificial Sequence
  Description of Artificial Sequence: Synthetic coding sequence
atggcctctctcggtcctcgcacccctgccccgagcaggtctagaggacgccgtgctatgtgttgggttagtacaatatctttcatggctgctgaggagatgcactggccagtgcccatgaaggcaatcggcgctcagaacttattgacaatgcctggcggtgtggctaaggcagggtacctacacaaaaaaggcggaacacagttacagcttctgaagtggcctctccgcttcgtcatcatacataagcgatgcgtctattactttaagagctccacctctgcaagcccacaaggcgccttctctttgtctggatacaatcgcgttatgagagctgctgaggaaactacctctaacaatgtgttcccgttcaaaatcatccatatctccaagaagcacagaacttggttcttctctgctagctcagaagaagagaggaaatcgtggatggccctgcttcggagagaaataggccacttccacgaaaagaaggatctccccctggatacaagcgactcatcaagcgacactgattctttctatggcgccgtagaacgcccagtggacatctccctgtcaccctatccaacagacaacgaggactatgaacacgatgacgaggatgactcttatctcgaacccgatagtccagaaccaggccgccttgaggacgctctgatgcaccccccagcatatccacccccacccgtgcccacgccccggaagccagccttcagcgatatgccacgcgcacatagcttcacaagcaaaggccccggcccactcctgcctccacctccccctaaacacggattaccagatgtcgggctggctgccgaagattcgaagagagatccactgtgcccacgcagggccgaaccatgtccacgcgttcctgcgaccccgcggaggatgagcgaccccccactttctactatgcccacggccccagggttgcggaaacccccgtgtttcagagagagcgcttcgccctcacctgaaccttggacacctggtcacggcgcgtgtagcacctcatcagctgcgatcatggctaccgcgacttctaggaattgtgacaagctgaagtctttccacctgagccccagaggtccgcccaccagcgagccaccccccgtgccagcaaacaagcccaaatttctgaaaattgccgaggaagatcctcctagggaggctgctatgccaggtttgttcgtcccacctgtggcccctcggcctcctgccctcaagctgcctgtacccgaggcgatggctcgtccagctgtactaccgcggccagagaagccccagctgccccacctgcagcggagccctcccgacgggcagagtttcagatcattttcattcgaaaaacctcgccagccttcacaagcagacaccggcggcgacgactccgacgaggactacgaaaaggtgccactacccaactccgtatttgtcaacactactgagtcttgtgaggtggagaggctatttaaagctacttctccccggggcgaacctcaagacggactttattgcatacggaatagtagcaccaagtccgggaaggtcctagtggtttgggacgagacatcaaataaggttaggaattaccggatctttgagaaggactcgaagttctacctggaaggcgaggttctgtttgtcagtgtagggtccatggtggagcactatcacacacacgtgctccccagccaccagtccctgttgcttaggcacccctacgggtataccggtccccgctag

SEQ ID NO: 134178 - DNA, 1686 bp, Artificial Sequence
  Description of Artificial Sequence: Synthetic coding sequence
atggctgctgaggagatgcattggccagtgccaatgaaagccataggggcccagaacttactcactatgccgggcggtgtggcaaaggccggctatctgcacaagaagggagggacgcagctccagctgctcaagtggcccctcagatttgttatcatccacaaaaggtgcgtttactatttcaagagtagcactagtgccagcccccagggggcatttagtttgagtggatataaccgggtaatgcgggccgccgaagagaccacctccaataatgtatttccgtttaagattatccacatctctaagaaacatcgtacctggttcttctctgcgtcaagcgaagaggaaagaaaatcctggatggccctgctcagacgggagatcggccactttcacgagaagaaagacctaccacttgacacctcagattcctcatccgacaccgattctttttatggagctgtggaaagacccgtggatataagtctatccccctatcccaccgacaacgaggattacgagcacgatgacgaagatgactcctacctagaacctgattcccctgaacccggcagactggaagacgctctgatgcacccccctgcttacccccctcctcctgtgcccacacccagaaagccggccttcagtgacatgcctcgtgcacactccttcaccagcaagggtccgggtccactgcttcccccccctccccccaagcacggactcccagacgtaggtttagccgctgaggactcaaagcgcgaccccctgtgtcctagaagggccgagccttgtcccagggttcccgctacacccagacggatgtccgatccaccgctgagcaccatgcccactgccccaggcctcagaaagccgccatgtttcagagagtccgcctctccatcacccgaaccatggactccggggcacggagcctgttcaacctcttccgcagcgataatggctactgcaaccagcagaaattgcgacaaactgaagtccttccacctgagcccacgtggaccccctacaagcgaaccccctcccgtgccagcaaacaagccaaagttcctgaagattgccgaagaggatcctcccagggaggcagccatgccaggcctgttcgtgcctcctgtggcaccccggcctcccgcgttgaagcttcctgttccagaggctatggccagaccggccgtcttgccgcggcccgagaaacctcagctgccacatctgcagaggtccccaccagacgggcagtcattccgcagtttcagtttcgagaaacctagacagccttctcaggcagacaccggaggggacgattcggacgaagattatgagaaagtgccactgcctaacagcgttttcgtcaatacaaccgaaagttgtgaagtggagaggctgtttaaggcgacgtcgcctaggggcgaacctcaggatggcctgtactgcatccgcaactctagtacaaagtccggaaaggtgttggtagtttgggacgaaacatccaacaaggtgcggaactacagaatattcgaaaaggatagcaagttttacttggagggggaggttctctttgtgtccgttggctctatggtcgagcattaccacactcatgtgttgccctcccaccagtcgctgcttctgcgccacccttatggatacactggtcctcgctag

SEQ ID NO: 134179 - DNA, 429 bp, Artificial Sequence
  Description of Artificial Sequence: Synthetic coding sequence
atggccgcagaggagatgcactggccggtacctatgaaagctatcggagcccaaaacctcctaaccatgcctggtggggtcgccaaagccggctacctacacaaaaagggcggcacacagcttcaattattaaaatggcctctgagattcgtgatcatccacaagcgctgcgtctattacttcaaatcctcaaccagcgcttcccctcagggcgccttcagcctgagtggatataaccgggtcatgcgggcggccgaggagactacctccaacaatgtctttccctttaaaatcattcatatcagcaagaaacaccgtacatggtttttctctgcatctagcgaagaagagaggaagagctggatggccctgctaagacgagaaattggccactttcacgaaaagaaggatttacctctggatacctag

SEQ ID NO: 134180 - DNA, 429 bp, Artificial Sequence
  Description of Artificial Sequence: Synthetic coding sequence
atggctgccgaggaaatgcactggccggtccccatgaaagccatcggggctcagaatttgttaacaatgcccggaggggtggcaaaagccggttacctgcataaaaaggggggtactcagctccagctgctcaaatggccactgagatttgtgatcatccacaagcgctgtgtgtattatttcaagagttcaacttcagctagtccacagggagcattctcactttctgggtataacagagtgatgcgggccgcggaagagaccacaagcaataatgtatttcctttcaaaatcattcatatctctaaaaagcaccgcacgtggttcttctccgcctcttccgaggaagagagaaagtcatggatggctctcctgaggcgagagattggacacttccacgaaaagaaagacctgcccctagacacctag

SEQ ID NO: 134181 - DNA, 1857 bp, Artificial Sequence
  Description of Artificial Sequence: Synthetic coding sequence
atggcaggctctgggccaagaccaaggtcctggggaagaagggaggccggagcacgcgacgaggcagcggcagctggaggaagaggcccaggcccgtgccgatgcagccaggggcggcgggcatggatagcccccggtaaaccagctatgccggctgcatggacacctttcatggctgctgaagagatgcattggccagtccccatgaaggctatcggtgctcaaaatctgttaactatgccgggcggcgtggctaaggcgggttacctgcacaaaaagggcggcactcagcttcaattgctcaagtggccactcagattcgttatcatccataagaggtgtgtctattatttcaagagttctacatccgcatcaccccagggtgccttttctctttccggctataatagggtgatgagggcagccgaagagacaactagcaacaatgtttttcctttcaagataattcatatctcgaaaaaacacaggacgtggtttttttcagcgagctctgaggaagagagaaagtcttggatggctcttttgagaagagagatcgggcatttccatgagaaaaaggacctgcctctggacacgagcgactcctcctcagatactgactcattttatggagctgtggaacggcctgtggatattagcctgagcccgtaccccacggacaacgaggattatgagcacgacgacgaggacgacagctacctcgaacccgactctcctgaacctggccgactggaggacgccctgatgcaccccccagcttatccaccccctcccgtaccgactcccaggaaacccgcgttcagtgatatgcccagggcccactcatttacctctaaaggtcctggacctttgctgcccccccccccacctaagcatgggttgcccgacgtcggcttggctgccgaggatagcaaacgggatcctctctgtcctagacgggctgagccctgccctagggtacccgcaacacctaggagaatgagtgatccacccttaagcactatgcccaccgcccctggtttgcgaaaacctccttgtttccgcgagagtgcttcaccatcccctgagccatggacgcctggccacggcgcctgctccacctcttctgcagcgattatggctacggccacctcgagaaattgcgataagctgaaatcctttcacctgagtccccgcggtccacctacatccgagccaccacctgtgccggctaacaaacctaaattcctaaagatagccgaagaggaccccccgcgcgaggcggccatgcctgggctcttcgttccacccgtagcaccacgacccccagcactcaagctacccgtgccggaggccatggctcgacctgccgtcctgcctaggcccgaaaagcctcagctgccgcatttacagcgtagcccacctgacggccagtcattccgttcgtttagtttcgagaagccgcgccagccttcccaggccgacaccggaggcgacgactctgacgaggactacgagaaggtgcccctgcctaacagcgtgtttgtaaacactacggagtcatgtgaggtggagagactcttcaaagctacaagcccacgaggcgagccacaagatggcctttattgcatcaggaattcctctaccaagtcaggaaaagtgttggtggtgtgggacgagacatctaataaagttcgaaactatcggatctttgagaaggactccaaattctaccttgagggagaagtactcttcgtgtccgttggctctatggttgagcattaccatacacacgtgctgcctagccaccaaagcctcctgctaagacatccctacggttacaccggcccaagatag

SEQ ID NO: 134182 - DNA, 519 bp, Artificial Sequence
  Description of Artificial Sequence: Synthetic coding sequence
atggctgccgaggagatgcactggccagtgcctatgaaggcaattggagctcagaatctgctgactatgccagggggagtcgctaaggcagggtatcttcacaagaaaggaggtacacagttgcaactgctgaaatggcctttgcgctttgtgatcatccacaaacgttgtgtgtattactttaagagctctacctccgcaagcccacagggtgctttcagcctatctggatacaatagggttatgagggcggccgaggagaccacttctaacaacgttttcccatttaagattatccacatcagcaaaaaacaccgaacatggttctttagtgccagttcagaggaagagcgcaagtcatggatggccttacttcgtcgtgagattgggcactttcatgaaaagaaggaccttcctctggacacaagtgactccagcagcgatacagatagcttctacggagctgtggaacggccagtggatatttccttaagtccctatcccactgacaacgagtag

SEQ ID NO: 134183 - DNA, 567 bp, Artificial Sequence
  Description of Artificial Sequence: Synthetic coding sequence
atggcagctgaagaaatgcattggcctgtacccatgaaggccattggagcccagaatctgctcaccatgcccggcggagtcgctaaagcgggttacctacataaaaaggggggcacacagttgcagctgctgaaatggcccctcagattcgtgatcattcataaacggtgcgtgtactactttaagtcatcaacatccgcttccccacagggcgccttcagcctcagcggctacaatcgggtcatgcgagccgccgaagagacgacctcgaataatgtgttcccttttaaaattattcatatatcaaaaaaacacagaacatggttcttctctgcaagctcagaggaggagagaaaaagctggatggctttattacgccgcgaaataggccatttccatgaaaagaaggacctaccattggacacatctgactctagctccgacaccgacagcttttatggcgccgtggaaagaccggtagatatatctctgtccccatatcccactgataatgaggattacgagcacgatgatgaggatgattcctacttggagcccgatagttag

SEQ ID NO: 134184 - DNA, 1686 bp, Artificial Sequence
  Description of Artificial Sequence: Synthetic coding sequence
atggctgctgaggagatgcactggccagtcccaatgaaggccatcggggctcagaacttgctcacaatgcctggcggggttgccaaggcaggttacctgcataaaaagggcggcacgcagctccagctcctgaagtggcctctgcgcttcgtgataatccataagcgatgtgtgtactacttcaagtcgagcacctccgctagcccgcaaggggccttctctctgtcaggatacaacagggtgatgagggctgccgaggagaccacctccaacaacgtctttccttttaagatcatccatataagtaagaagcacagaacgtggtttttcagcgcctcctcagaagaagagagaaaatcctggatggctttactgaggagagagatcggacacttccacgagaaaaaggacctgcccctggatactagcgattccagctctgacaccgattcgttctacggagcagtggaacgcccagtggacatatccttgtcgccataccctacagacaacgaggactatgagcatgatgacgaggatgattcatacctggaaccagattctcccgagccaggacggttggaagacgctcttatgcaccctcccgcgtacccgcctcctccggtacccactcctcgaaagccagcgtttagcgatatgccacgagctcactctttcacttccaaaggtcctggccctctgctgccaccgcccccaccaaagcatggcctcccagatgttggtctggccgccgaggactccaagagggatccactctgccctaggagggctgaaccatgccccagggtaccggcaacacctcgcagaatgtccgacccaccactgagtacaatgccaactgcccccggcttacgcaagcccccgtgctttagggaatccgcatctccatccccagagccttggacacccggacacggagcatgttcgacctcctctgccgctatcatggccacagctacctcacgaaattgcgacaagctgaagagcttccacctgtcaccccggggccctccaacaagcgaaccaccgcctgtgcccgccaataagccgaaatttctcaaaattgctgaggaggatcccccccgagaggcggccatgcctggtcttttcgttccccccgtcgcccccaggcctccagcactaaaactgcccgtcccagaagcaatggcgaggcctgccgtcttgccccggccagaaaaaccacagctcccacacctgcagagaagccccccggacggtcagagttttagatccttctctttcgaaaaaccccggcagcctagccaggccgacactggaggtgatgatagtgatgaagactacgaaaaggtgccactgcccaacagcgtgtttgtaaataccactgaaagctgtgaggtcgagaggctgtttaaggccacttctccccgtggcgaaccgcaagacggcctgtactgtattcggaacagttctaccaagtccgggaaggtactggtcgtctgggacgagacgtccaacaaagtgagaaattacaggatctttgagaaagacagtaagttttacctagagggcgaggtgctgttcgtgagcgtgggatcaatggtggaacactaccacacacatgttctgccctctcaccaatcacttctcctgcgacacccttatggttacactggtccgcgctag

SEQ ID NO: 134185 - DNA, 585 bp, Artificial Sequence
  Description of Artificial Sequence: Synthetic coding sequence
atggctgctgaggagatgcattggcctgtgcctatgaaagccatcggagcccaaaacctgctgaccatgcccggaggggtggccaaggcgggctatctgcacaagaaggggggcactcaactccagctgctcaagtggcccttacgcttcgtgattatacataagcgttgcgtttattacttcaaaagttccacctcagccagccctcagggcgcattcagtctcagtgggtacaacagagtaatgagggctgcagaagaaacaaccagtaataacgttttcccattcaagattattcacatctctaaaaagcaccgaacttggttcttttccgcatcaagcgaggaggagcgcaagtcgtggatggctttattaaggagagagatcggccatttccatgaaaagaaggatttacccctggacacctcagattcttcttccgatacagacagtttttatggcgccgtggaacgccctgtggacatctctttgtcaccttaccctacggataacgaagattacgagcacgatgacgaagatgactcatatctcgaacccgactctcctgagccaggccggctgtag

SEQ ID NO: 134186 - DNA, 411 bp, Artificial Sequence
  Description of Artificial Sequence: Synthetic coding sequence
atggcagccgaagaaatgcactggcccgtgcctatgaaggccatcggggctcagaatctgctcaccatgcccggcggtgtggcgaaggctggctatcttcacaagaaagggggaacccagctgcaactcttaaaatggccgctgaggtttgtgatcatacacaagaggtgtgtttactatttcaaatcaagtacttctgcaagtccacagggggctttctctctgagtgggtacaaccgcgttatgagggcagccgaggagaccacctctaataacgtgtttccattcaagatcattcatattagcaagaagcatcgaacctggtttttctcggcatcaagtgaggaggagcggaaatcctggatggcactgctcagaagggagattggacatttccacgagaaaaagtag

SEQ ID NO: 134187 - DNA, 2892 bp, Artificial Sequence
  Description of Artificial Sequence: Synthetic coding sequence
atggcagcacagcggattcgtgcggcgaattccaatggactccccagatgcaagtccgagggtacgctgatcgacctgagcgagggctttagcgaaacgtccttcaatgacattaaggtgccttctcccagtgcattactggtggataaccctacgccctttgggaatgccaaagaggtcatcgcaattaaagattactgcccaactaattttacaactctcaagtttagtaaaggagaccatctgtatgtcttagatacctccgggggcgagtggtggtacgctcataatactaccgagatgggctatatcccctcctcttacgtgcagccgctcaattataggaactcaacattgtccgacagcgggatgattgacaatctaccagactccccggacgaagtcgctaaagaactggagcttcttggtggctggaccgatgacaagaaagtgccagggaggatgtatagcaataatcctttctggaatggagttcagaccaatccctttttgaacggtaatgtaccagtcatgccctcgctggacgagttgaaccccaagtctacagttgacctactgttgttcgacgcgggcacatctagttttaccgaatcctcctccgctactaccaatagcaccggaaacatttttgacgagctccctgtaacaaatggactgcacgccgagcctccggtccgccgcgacaatccgttctttagatccaagcggtcttacagtttaagcgagctcagcgttcttcaggccaaatctgacgcacccaccagcagtagctttttcaccgggctcaagtctcccgcccctgaacagtttcagtcgcgcgaggattttcggacagcctggctcaaccatcggaagctcgcccgttcatgccacgatcttgatctcctggggcagtcacccggatggggccaaacgcaggccgttgaaaccaatatcgtatgcaaattggactcctccgggggagccgtccagctccccgatacctccatctcgatccatgtcccagaagggcatgtggcccccggcgaaacacagcaaatctcaatgaaagctctgttagacccccctctggagttgaactctgaccggtcctgttccataagccctgtgctggaggtgaagctctccaacctagaggtgaaaactagcattatactggaaatgaaggtctccgccgaaatcaagaacgacctattctccaaaagtaccgtgggcctgcagtgcctcaggtctgattccaaggagggtccctacgtgtctgtgcctttgaattgttcatgtggcgacactgttcaggctcagcttcataacctggagccgtgcatgtacgtggccgtggttgcccatggtccttctatcctctacccctccactgtttgggattttataaacaagaaggttacagttgggctgtacggaccaaagcatatccatccatctttcaaaaccgtggtaactatttttggccacgactgcgccccgaagacacttctcgtctccgaggtaacccgccaggcgcctaaccctgcccccgttgctctgcagctgtggggcaaacatcagttcgttctctcccggccccaggatttgaaggtttgcatgtttagcaacatgactaactatgaggtcaaagcctcggaacaagcaaaggtggtccgaggctttcagctcaaactcggcaaggtgtctcggttgatatttccaataacctcacaaaatccaaatgaactatcagacttcactttgagggttcaggtcaaggacgaccaggaagcaatcctgactcagttctgtgttcagaccccacagcctcctcccaagtccgctattaagccatcgggccagcgccgatttttaaagaaaaacgaggtcggcaagattatcctgtccccctttgctacaacaacaaagtacccaaccttccaggatcgacctgtgtcttccctgaaatttggtaaactgctgaaaaccgtcgtccggcagaataagaaccattacctcttggaatataagaaaggcgacggtatcgcgctcttgagtgaggagcgcgtcagacttcggggacaactctggacaaaagagtggtacatcggatactatcaaggccgcgttggattggttcatactaagaatgtgctggtcgtggggagagcccgcccctctctctgttctggccccgaattgagcacttccgttctgctcgaacagattctgaggccgtgtaaatttctgacctacatctatgcctctgtacgaacactgctgatggaaaacatttcatcttggcgatctttcgctgacgctttgggctacgtgaaccttccgctaaccttcttctgcagagctgagctggattccgagccagagcgggtggcgtcagtgctggagaagctgaaggaagattgtaataacactgaaaacaaagagagaaaatcattccagaaagaactagtgatggctttgctgaagatggactgtcaaggcctggtcgtgcgcctgattcaagattttgtgctactaacgaccgctgttgaggtggctcagcgatggagagaattggcggagaaacttgccaaagtaagcaagcagcagatggatgcctacgaatcccctcaccgggaccgaaatggggtcgtcgattccgaggccatgtggaaaccagcctacgacttcctgctcacctggtcgcaccaaatcggcgacagctaccgtgatgttattcaggagttacatttgggcctggacaagatgaaaaatcccataacaaagagatggaaacatctgacaggtaccctgatcctcgttaactccctggatgtgctccgggcagcagcattctcaccagcagatcaggatgatttcgtcatctag

SEQ ID NO: 134188 - DNA, 2892 bp, Artificial Sequence
  Description of Artificial Sequence: Synthetic coding sequence
atggctgcccagagaatcagagctgctaacagcaatggtctcccacgttgtaagtcagagggtactctaatagacctgagtgaaggattctccgaaacctcattcaatgacatcaaagtgccttccccctctgcccttctggtggacaacccgaccccatttggcaacgctaaagaggtgatagcgatcaaggattactgtccaactaattttacaacacttaagttttctaaaggagaccacctttacgtgctggatacttctggcggagaatggtggtatgctcataatacgaccgaaatgggctacattccgagctcatacgtccagcccctgaactataggaacagtactctgtccgattccgggatgatcgataacctgccagactcacccgacgaggtggctaaagagctggaactgcttggtgggtggaccgacgacaagaaggttccaggtaggatgtattctaataatccattttggaatggggtccagacaaacccctttctcaacggaaacgtgcctgttatgccgagcctggatgagctgaaccctaaaagcactgtcgacttgctcttatttgacgctggtacaagctctttcaccgaaagtagttctgccacaacaaactccacaggaaatatcttcgacgagctaccggtaacgaatgggctacacgccgaaccaccggtaagacgcgataaccctttttttaggtctaagcgctcctactctctgtccgaactctctgtgcttcaggcaaaatccgatgccccgacttccagctcctttttcaccggtctaaagagcccagccccggagcagtttcagtctcgggaagacttccgcacagcatggctcaatcataggaaactcgcaagatcatgccacgatctggaccttctaggacaatcccctggttggggtcagactcaggcagttgaaaccaacattgtctgcaaactcgattcctcagggggtgcagtgcagctccccgacaccagcatctccatccatgtccccgaaggccacgttgctcctggcgaaacccagcagatcagcatgaaggccctcctcgatcccccattagaactgaatagtgataggagttgctccatctcgcccgtgctggaagtgaaactttccaatctggaggtgaaaactagcatcatactggagatgaaggtttctgccgagataaagaatgacttgtttagcaagagtactgtggggcttcagtgcctgagaagtgattctaaagaggggccatacgtttcagtcccacttaattgctcttgcggtgatactgtgcaagcccagctccacaacctcgagccttgtatgtatgtcgcagtggtagctcacggaccctctattctgtatccctcgactgtgtgggacttcataaacaagaaagtgacagtcggcctgtacggtcctaagcatatccacccctctttcaagactgttgtcaccattttcgggcacgactgtgcccctaagactctcctggtctcagaggtgacccggcaagcccccaaccctgccccagttgccctgcaattatggggcaaacaccagttcgtgttgagcaggccacaggacttaaaggtctgtatgttctctaacatgactaattatgaagtcaaggcgtctgagcaggccaaggttgttagaggttttcagctcaagctcggaaaggtgtcaaggttgatattccctattacatcccaaaaccccaacgaactgtccgatttcacattgagagtccaggtcaaagatgaccaggaggctatcctaactcagttttgcgtccagactcctcagcctccgccaaaaagcgccattaaacctagcggacaacgccgtttcctaaagaaaaatgaggttggaaaaattattcttagccctttcgccacaactacaaagtaccccaccttccaagatcggccagttagtagtctgaaattcgggaaattattaaaaaccgtcgtaaggcagaacaagaatcactacttattggagtacaaaaaaggcgatggtatcgctcttctttcagaagaacgcgtgcggctcagaggccaactgtggaccaaggagtggtatatcgggtactaccaggggcgggtcggtctggtgcatacaaagaacgtgctcgtagtcggaagggcccgtcctagtctgtgcagcggcccagagttatccacatcagtgctcctggaacagatcctaaggccatgtaaattcctgacctatatctatgcgagcgtaagaacgctgctgatggaaaacatttcttcatggcgttctttcgcagacgcactcgggtacgtgaacctgcccctcacctttttctgtagggccgagctggatagcgaaccggagcgtgtcgcatccgttctcgagaagctgaaggaggactgcaataatactgagaacaaagaaagaaagagttttcaaaaggagctggttatggcgctgctgaaaatggattgccaagggctcgtcgtgcggctgatccaggatttcgtcctacttaccacagctgtcgaagtggcccagcggtggcgggagttagcagaaaagttagccaaagtctcaaaacaacagatggacgcctatgagagcccccacagagaccggaatggcgttgtggactctgaagcgatgtggaaacccgcctacgacttcctccttacatggagtcaccagataggcgacagctaccgcgatgtgatacaagaactgcacctggggctggataagatgaagaatcctatcacaaagcggtggaaacacctcactgggacgctcatcctggtcaatagcctcgatgtactcagagctgctgcctttagccctgctgatcaggacgactttgtaatctag

SEQ ID NO: 134189 - DNA, 2892 bp, Artificial Sequence
  Description of Artificial Sequence: Synthetic coding sequence
atggcagcacagcggataagagctgccaattcaaacggtctaccacgctgcaaatctgaggggacccttatcgacctgtccgagggtttctctgagacaagtttcaacgatatcaaggtaccaagcccctccgcgctactggtggataatcccaccccgtttggcaatgccaaagaggtgattgccataaaagactattgccctactaacttcacaacgttgaaattcagcaagggagaccacttgtatgtgctggatacatcaggaggagaatggtggtacgcccataatacaaccgaaatgggctacattccctccagctatgttcaaccgctaaattaccggaactcgaccctgtcagattccggtatgatagataacttgcccgattcaccagatgaagtggcgaaggagctggagctgctgggaggctggaccgacgataagaaagtacctgggcgtatgtattcgaataaccctttttggaatggtgtgcaaactaatccattcctgaatggcaatgtgcccgtcatgccaagcctagatgagctgaacccgaaaagcaccgttgacctccttttgttcgatgcaggcaccagttcattcactgaaagctcttctgcaactaccaattcaacgggcaacatcttcgacgagctgccagtaaccaatggcctacacgccgagcccccagttaggcgggacaaccctttctttcggtccaaacgctcctacagcctcagtgagctatcggtgctccaggccaagagcgacgccccgaccagtagttctttttttacaggcctcaaatctccagctccggaacagttccaatcaagagaagactttagaaccgcctggctgaaccaccgtaagctggctagaagttgtcatgacctggacctgttgggtcagtccccagggtggggacagacacaagccgtggaaacaaatatcgtttgtaaactagacagctcaggaggagccgtgcagctgcctgacacctccatttccatacatgtgcctgaagggcacgtagcccctggtgaaacacaacagatctcaatgaaagcactgctggacccacccttggagctgaacagcgacagatcgtgcagcatcagccctgtcttagaggtcaaactgagcaacctggaagtgaaaacgtccatcattctggagatgaaagtctctgcagagatcaagaacgatttattctccaaatccactgtgggcctgcagtgcctgcgcagtgactccaaagagggcccctacgtttctgttcctctgaattgcagctgcggcgacaccgtgcaagcgcaactgcacaatctggaaccctgtatgtatgtggctgtcgtggcccacggaccgtccatcctctatccatctactgtgtgggacttcattaataaaaaagtcacagtcggcctctacgggcctaagcatattcatccttcgtttaagaccgtggtgaccatcttcggacacgactgtgcaccgaagaccctcctggtttccgaagtgacaaggcaggctcccaaccctgctcccgttgccctccagctgtgggggaagcaccagttcgtgctgtcaagacctcaggacctaaaggtttgcatgttttccaacatgacaaactatgaggtcaaagcaagcgagcaggcaaaagtggtccgaggcttccagctgaagctgggaaaagtgtcaagactgatcttccccatcacttcccaaaatcctaatgagctgtctgacttcacactcagagtgcaggtgaaagatgatcaagaagcaatcttaacacagttttgtgtccaaaccccccagccgccgccaaagagcgcaatcaagcctagtgggcagcgccgtttcctcaagaagaacgaggtgggaaagatcatactctcaccttttgccactaccaccaagtatccaacctttcaggaccgccctgtgtctagcctcaaattcggaaagctgctgaaaacagtggtcagacagaacaaaaaccattacttattggagtacaagaagggggatggtatagctttactcagtgaggagagagtgcgtctccgcggccagctgtggacaaaagaatggtatattggctattatcagggaagagtggggcttgtgcataccaaaaatgtgttagtcgtggggcgggccagaccatctctttgctccgggcccgaactgagcacctctgtgctgctggagcagatcctgagaccttgtaagttcctaacctatatttacgcaagcgtgcggaccttgctgatggagaacatctcatcatggcggagtttcgccgatgccctggggtatgtgaatttgcctcttacattcttctgccgggctgagttagatagtgaaccagaacgtgtcgcctccgttctggagaaattgaaagaagattgtaacaacaccgagaacaaggagcgcaagtcgtttcagaaagagctcgtaatggcgttactcaaaatggactgccaagggctggttgtgagactcatccaggacttcgtgctcttgacgacggctgtggaagtggcccagaggtggcgcgagttagccgagaaactcgccaaggtgagtaagcagcaaatggatgcatatgagtctccgcacagggacagaaacggcgtggtcgattcggaagccatgtggaagccagcgtatgattttttacttacctggagtcatcagatcggcgactcatatcgggatgtcatccaagagctccatctggggttggacaagatgaagaaccccattacaaaacgctggaagcatctcaccggtaccctaattctcgttaatagcctagatgtactgcgagccgccgctttcagcccagccgatcaggatgacttcgtgatttag

SEQ ID NO: 134190 - DNA, 369 bp, Artificial Sequence
  Description of Artificial Sequence: Synthetic coding sequence
atggcagctcagagaattcgcgctgctaattcaaatgggctacctcggtgtaaaagcgagggcactctgatcgatttatccgagggcttttcagaaacttcattcaatgatattaaagtcccctcaccttcagctctgctggtggacaaccccacccctttcgggaacgctaaggaagttatcgcaatcaaggactattgtccgaccaacttcaccactctcaagttctccaaaggcgatcacctttacgtattagatacatctggaggggagtggtggtacgcccataacaccacagagatgggatacatcccatcaagttacgttcagccattaaactacaggaactccactctaagcgacagctag

SEQ ID NO: 134191 - DNA, 1662 bp, Artificial Sequence
  Description of Artificial Sequence: Synthetic coding sequence
atggctgcacagaggatcagagctgccaattcgaatggcctgccaagatgcaagtcagagggaacacttatcgacctaagtgaggggttttcggagacttcttttaatgatatcaaagtgcccagcccatccgccctgctcgttgacaacccaacaccattcgggaatgccaaagaggtcattgccataaaagattactgccctacaaactttactaccctaaaattcagcaagggggaccacttgtacgttctggacacaagcggcggcgagtggtggtacgctcataacaccaccgagatgggctatatccctagctcctacgttcagccgttgaactaccgtaactctacactcagtgactcaggaatgatcgacaatctgcccgacagtccagacgaggtggcaaaggagcttgaactgctgggcggttggacggatgataagaaagttcccggcagaatgtacagcaataatcctttttggaatggagtccagacaaatccattcctcaacggaaatgtgcctgtgatgccctcgctagacgagctgaatccgaagtctaccgtggatttgctgctcttcgacgccggcacctcttcatttaccgaatcttccagcgcgacaacaaattcaacagggaacatttttgatgagctgccagtgaccaacggccttcacgccgagcctcctgtgagaagggacaaccctttcttccgttcaaagagatcttattccctgtccgaactgagcgtactgcaggccaagtccgatgcaccaacttcttcaagcttcttcacgggccttaagtctccagcccctgagcagtttcagtcccgagaagacttcagaaccgcttggctcaaccataggaaattggctcggagctgtcatgatttagatcttcttggccagagccccgggtggggacagactcaggcagtagaaacgaatattgtgtgtaaactggatagctcagggggagcagtgcagcttccagatacaagcatctctattcacgtgcctgagggccatgtcgcgcccggggaaacacaacagatcagtatgaaggcgctgctagatcctcccctcgagctgaatagcgatcgcagttgcagcatctcccccgttctggaggtgaagctcagcaatctggaagtaaaaactagcatcatcttagaaatgaaggtgagcgccgagatcaaaaacgatctcttctccaagtcgaccgtgggtctccaatgcctcaggagtgactccaaagaagggccctatgtgtccgtgcccctgaactgtagctgcggtgatacagtccaggctcaactccataatttggaaccttgcatgtacgtcgctgtggttgcccacggcccgtccatcctttaccctagcaccgtttgggatttcattaacaagaaggtgacagtcggcctgtatggcccaaaacacattcaccccagtttcaaaacagtagtaaccattttcggacatgactgcgcgccaaaaacactgctggttagcgaagtgacccgccaagcccccaaccccccaattactaagcgctggaaacacttaactggtacgctcatactggttaacagcctcgacgtgctccgcgcagccgcattctccccagccgaccaggacgatttcgtcatctag

SEQ ID NO: 134192 - DNA, 171 bp, Artificial Sequence
  Description of Artificial Sequence: Synthetic coding sequence
atggcagctcagcgcatcagggcggccaactcaaacggcttgccacgatgtaaatccgaaggaactctgattgatctttctgagggattcagcgaaacttcttttaacgacataaaagtaccgagtcccagcgcactgcttgttgataaccccacccctttcggcaattag

SEQ ID NO: 134193 - DNA, 522 bp, Artificial Sequence
  Description of Artificial Sequence: Synthetic coding sequence
atggctgcccaacggataagagccgccaacagcaacggtctccctcgatgcaagtcagaaggcaccctcattgatttatccgagggattcagcgagacaagctttaacgatatcaaggtgcccagcccctccgcactacttgtcgacaaccccacccctttcggtaacgctaaggaggtcatagccattaaagactactgccccaccaatttcacaacacttaagtttagcaagggggaccacttatatgtgctggatactagtggcggcgagtggtggtacgcacataatactacagaaatgggctatatacctagcagctacgtgcagccgcttaattaccgaaacagtactttatcagactcaggtatgatagataatctgcctgacagcccagacgaagtagccaaagagttggagcttctgggggggtggaccgatgataaaaaggtgccagggcgaatgtacagcaacaaccccttctggaacggagtgcaaactaatcccttcctgaatggctag

SEQ ID NO: 134194 - DNA, 174 bp, Artificial Sequence
  Description of Artificial Sequence: Synthetic coding sequence
atggccgctcagcgaataagagcggctaacagtaatggtcttcctaggtgtaagtcagaaggcaccctgatcgacctgtcagagggtttttccgaaacatcctttaatgacatcaaggtgcccagcccctctgccctgctggtggataatccaactcctttcgggaacgcctag

SEQ ID NO: 134195 - DNA, 606 bp, Artificial Sequence
  Description of Artificial Sequence: Synthetic coding sequence
atggagaacattagttcatggcggtcctttgcagacgccttaggttacgtcaaccttcccctcacattcttttgccgagcagagctggatagtgagcccgaaagggtcgccagtgtgctcgaaaaacttaaggaagattgcaacaatacagaaaataaagagcggaagtccttccaaaaagaactggtgatggcccttcttaagatggattgtcaggggctggttgtgagactgatacaggacttcgtactgttaaccactgccgtcgaggtcgctcagagatggcgcgaactagccgaaaagctggccaaggtgagcaaacagcagatggatgcctatgagtctccccatagggaccggaacggagtggtcgactcagaagccatgtggaaaccggcttatgatttcctattgacatggtcacaccagatcggggactcgtaccgggacgtgatccaagaattgcacctcggtctcgacaaaatgaaaaatcctattacgaagaggtggaagcacctcaccggtacgctgattctggtcaacagtctggacgtcctgagggctgccgcattttccccagccgatcaggatgacttcgtgatctag

SEQ ID NO: 134196 - DNA, 897 bp, Artificial Sequence
  Description of Artificial Sequence: Synthetic coding sequence
atgctgaatcacgccacccaacgcgttatggaagctgaacagaccaaaactcggagtgagctcgtacacaaagagacagccgcacgctataatgctgccatgggccgtatgcgccaactagaaaagaagctgaaacgcgccattaataagagcaagccatatttcgagctcaaagctaaatactacgttcagctggagcaattgaagaaaacggtcgacgatctccaggccaaacttaccctcgccaaaggagaatataaaatggcccttaagaatttagaaatgatctcagatgagatccacgagcggaggagatcctccgccatgggcccccgaggttgtggggtgggcgcagaagggagttctacttcagttgaagatctacccgggagtaaaccagagccagacgctataagcgtagcctcggaggctttcgaggatgattcttgctccaacttcgttagtgaagatgactccgagacccagagcgtgtcttctttttcatcaggacccacttcgccttcagagatgccagatcaattcccagctgtggtgcggccaggctccctcgatttgccctctcctgtgtcactgagcgaatttgggatgatgtttccagtgctaggcccccgtagtgaatgctcaggtgcgtcatccccggagtgcgaggtggagcggggtgaccgtgcggaaggtgcagagaataagacctccgacaaagccaacaacaacaggggcctcagttcctctagcggtagtggaggctccagcaaatcccagtcctccacctcacctgaaggccaggccttagagaatagaatgaagcagttgtctttacagtgttctaagggccgggacggaatcattgctgacatcaagatggtccagataggatag

SEQ ID NO: 134197 - DNA, 387 bp, Artificial Sequence
  Description of Artificial Sequence: Synthetic coding sequence
atgcttaatcacgctacccagcgcgttatggaagccgagcagactaaaaccagatccgagctagtccataaggaaacagctgcacgctacaacgccgctatggggcgaatgaggcagcttgaaaaaaagctgaaacgcgcgatcaacaaaagtaaaccctacttcgaactaaaagctaagtattacgtgcaactcgagcagttgaagaagaccgtcgatgaccttcaggccaagctgactttggcgaaaggagaatataagatggccctgaaaaatctcgagatgatatctgatgaaatacacgaacgtcggcggtcttccgctatgggtccccggggatgcggggtgggggcagaggggagctccactagcgtggaagacctatag

SEQ ID NO: 134198 - DNA, 1368 bp, Artificial Sequence
  Description of Artificial Sequence: Synthetic coding sequence
atggatgccgcactcaaaagaagtagaagcgaagaaccagctgagatattaccccctgcccgggacgaggaggaggaagaagaggaggggatggaacagggtcttgaagaagaagaggaggttgatccgaggattcagggagaactggagaagctgaatcaatctaccgacgatattaacaggcgggaaaccgagctggaggacgcaaggcagaagtttcgcagtgtgctggttgaggcaacggtgaagctggatgagttggtaaagaaaattggaaaggccgttgaagacagtaagccatactgggaggccaggcgagtcgctaggcaagctcagcttgaggcgcagaaggccacccaggactttcaacgggctactgaggtactgagagccgcaaaagaaacaattagtctagccgaacagcggctgctcgaggacgacaagcgccagttcgacagcgcatggcaggagatgctgaaccacgccacccagcgggtgatggaagctgaacagaccaagacaagaagtgagctggtacacaaggaaacagcagctcggtataatgccgccatgggtaggatgagacaactggaaaaaaaattaaagagggctatcaacaagtctaagccctacttcgagctgaaggccaaatactatgtgcagctggagcagctgaagaagacggtggacgacctgcaggctaagctgaccttagctaaaggcgagtacaaaatggccctcaagaatttagagatgatctcggacgagatccacgagcggaggcgttcgtcggcgatgggcccacgtggctgcggggtgggagcggagggctcctccactagcgtggaagaccttcctggatccaaacctgaacctgatgctatctccgtcgcctcagaggctttcgaagacgattcctgcagtaattttgtttcagaagacgacagtgaaactcagtccgtgtcttccttctcaagcggaccaacctcccccagcgaaatgcctgaccagtttcccgccgtggttcgacccggttctctcgacctcccctccccggtgagcttgtcggaatttgggatgatgttcccagtgctcgggcccagaagcgagtgctccggcgcttcttcacctgagtgtgaggtggaaagaggcgaccgggccgagggggccgaaaataaaacctccgacaaagccaataacaacagaggactctcctccagctcagggtccggagggagttctaaaagtcagtctagtacgtcacctgaagggcaggccctcgagaatcggatgaaacaattgtcccttcagtgctccaaggggcgggacggcattatagcggatatcaagatggtgcagattgggtag

SEQ ID NO: 134199 - DNA, 897 bp, Artificial Sequence
  Description of Artificial Sequence: Synthetic coding sequence
atgctcaatcacgcaactcaacgggtgatggaggccgaacagacgaagactaggtcggagctggtccataaagaaaccgcggcccgatacaatgccgcaatggggagaatgcgtcagttggagaagaagctgaaaagagccatcaataaaagtaagccatatttcgaacttaaggccaagtactatgtgcagttggaacagcttaaaaagaccgttgatgacctgcaggccaagctcacactcgccaagggggaatacaaaatggctttgaaaaatctggaaatgatctctgatgagatccacgagcgacgcaggtcttctgccatggggccacgggggtgtggcgtgggtgcagaagggtccagcactagtgtggaggatctccctggcagcaagcctgagcctgatgccatttctgtcgcatcagaagcatttgaggacgatagctgctccaacttcgtgagcgaggatgacagcgaaacacagtcggtctccagtttctcctcagggcccacctcccctagcgagatgcccgaccaattccccgccgtagttcgacccggttctttagaccttccgtctccagtcagcttatcggaattcggtatgatgtttcccgtgttgggtccgcgatccgaatgtagcggagcgagcagccctgaatgcgaggtggagcgaggagaccgggccgagggggcggagaacaaaacatcagacaaggctaataacaatagaggtctttcctcctcgtccggttccggtggctcttcaaagagccagtcgtcgacgagccccgagggacaggctctcgagaatcgaatgaagcagttatctctacagtgtagcaagggaagagatggcattattgcagatatcaaaatggtgcagattgggtag

SEQ ID NO: 134200 - DNA, 156 bp, Artificial Sequence
  Description of Artificial Sequence: Synthetic coding sequence
atgctgaaccacgctacccagcgggtgatggaagctgaacaaacaaaaaccagaagcgagctagtccataaggaaacggcagccaggtataatgcggccatgggcaggatgaggcaacttgaaaagaaactgaaacgggccattaacaagtcctag

SEQ ID NO: 134201 - DNA, 897 bp, Artificial Sequence
  Description of Artificial Sequence: Synthetic coding sequence
atgctgaatcacgcgacccaacgcgttatggaagcggaacagacgaaaaccagaagtgagctcgtgcataaagaaaccgccgccagatataatgcagccatgggtaggatgagacagttagaaaagaaactgaaaagggcaatcaacaaatccaagccctacttcgagctcaaggccaagtattacgtccagctggaacagcttaaaaaaacagtggacgacctgcaggccaagttgactctggctaaaggggaatacaaaatggccttaaagaatttggaaatgattagcgatgagatccacgaacgccggcgcagtagtgccatggggcctcgtgggtgtggggtaggagcggagggctccagcacaagcgtggaagatctgcctggaagcaagccggagcccgacgctatcagcgtggcgtccgaagccttcgaggatgactcctgctcgaatttcgtgagtgaagacgattccgagactcagagtgtgtctagctttagcagcggccccacctctccaagcgaaatgcctgatcaattccctgccgtggtgagacctggttcactggacctaccttctcccgtgtccttatctgaattcggaatgatgttcccagttctgggccctcggagtgaatgcagcggagctagtagccccgagtgcgaggttgaacgtggagatagagccgaaggcgccgagaataaaacatcagataaagctaataacaacagaggactgagtagtagttctggctccggagggtcatctaagagtcagtcctccaccagtcccgaggggcaggccctggagaaccgcatgaagcagctgagtctgcagtgcagcaaaggccgtgatggtataatcgctgatatcaaaatggtgcagataggttag

SEQ ID NO: 134202 - DNA, 2580 bp, Artificial Sequence
  Description of Artificial Sequence: Synthetic coding sequence
atgatggagggcctcaaaaagcgcacgaggaaggcatttggcatccgtaagaaggaaaaggatactgacagcacaggtagtccagatagagacggcattcaaggtaaaaagaagacccaaaagacccagttgctgcttaccagctgtttctggttacgcgctctgtccctcacactgtcgcagaaaaaaagcaacggagctcccaacgggttctatgccgagatcgactgggagcgatacaacagtcctgaattagacgaagaaggatactcaatcagaccagaggagcccgggtcgactaaggggaagcacttctacagctcaagtgaaagcgaagaggaagaggagtcccacaagaaatttaatatcaaaatcaagccccttcagtccaaggatattctgaaaaacgctgccacggtggatgagctgaaagcatccattggcaacattgccctgtcaccttccccagtccggaaatctccacgccgctctccaggcgccatcaagcggaatctctccagcgaggaggtagccaggccacgccgatctacaccaaccccagagctcatctctaagaaacctccggatgacacaacggctcttgctcctctgttcggaccccctctggagtccgcctttgacgagcagaaaactgaggtcctgcttgatcagccagaaatttggggctctggacagcctattaacccaagcatggagtcacccaaactgactaggccatttcccacagggacacccccaccgctgcctcccaaaaatgtcccagcgactccaccgcgcactggaagccctctgaccattggccctgggaatgaccagagcgccaccgaggtgaagatcgagaagctgccctccatcaatgacttagatagtatcttcggaccagttctctctcctaaatcggtggcagtgaacgccgaggagaagtgggtccacttttctgacaccagccctgaacacgtcactccagagctaaccccccgggaaaaagtggtctcgccacccgctacgccagacaatcccgcagatagccctgcccccggccctctgggcccgccgggtcctaccggccccccaggaccaccaggcccaccgcgaaacgtgctctcgccactgaatcttgaggaagttcagaagaaggtggccgaacagaccttcattaaagacgattacttagaaaccatttcctcaccaaaggattttggcctcggccagcgcgccaccccaccaccaccgccgccccctacctacaggactgttgtgtcctccccgggtccagggtctggcccgggtcccgggacgacctccgatgggaagaccgaggcccagcgctatcaagttatctgccccagcctgcaggctggcggcaacgagctggacagctacagcggtgcatcttcaccggcacgccccgcgacccctttagtaccctgccgatcaacaacgcctcccccaccacctccaaggcctccttcaagacctaagttaccccccggaaagccgggagtgggtgacgtgtccaggccttttagcccacccatccattcctcttccccaccacctatcgcacctctcgccagagccgaatctacaagcagcatatcatccactaactctttgagcgctgcgactacccctacagtggaaaatgaacagccttcactggtttggtttgatcggggaaagttttatctgacttttgagggcagttcgcggggaccctcccccctaactatgggagctcaggataccttacctgtggctgcagcctttacggagaccgtcaatgcatatttcaagggcgccgacccctcaaaatgcattgttaaaataaccggagaaatggtgttgtcttttcctgctggtattactagacatttcgccaataatccaagtcccgccgctctgacattccgcgtgattaattttagccggctggaacatgtgctcccgaatccacagctgttatgctgtgacaacactcagaatgatgctaacacaaaggagttctgggtgaacatgcctaatctgatgacccacctgaagaaagtatccgaacagaagccccaggccacctactacaacgtcgatatgcttaagtatcaagtttccgcacagggcattcagtccacccctctcaacttggccgtaaactggaggtgcgagccctcaagtacagatctgagaatcgactataagtataataccgacgccatgacaacagccgttgcccttaacaacgttcagttcttagtgccgattgatgggggcgtgacgaagctgcaggccgtgctgcctcccgccgtgtggaatgcggaacagcagcggatcctgtggaaaattccggacattagccaaaagtctgaaaacggtggggttggaagcttactggccagattccaactctctgaaggtccatccaagcccagtccattggttgtgcaattcacatctgaggggtccacgctgtctggctgcgatatcgagttagtgggggctgggtaccgcttctcgctcataaaaaagcggttcgccgccggaaagtacctggcggataactag

SEQ ID NO: 134203 - DNA, 1857 bp, Artificial Sequence
  Description of Artificial Sequence: Synthetic coding sequence
atgatggaggggctcaaaaaaaggactcgtaaggcttttggaatacgcaagaaagagaaagataccgacagcaccggaagtcccgacagggatggtatcaactcacccgaactggatgaagaggggtacagtattcgcccagaagagcccggctcaacaaagggcaaacatttctattcttcaagtgaatccgaagaggaagaggaatcccataagaagttcaatattaaaattaagccccttcaatccaaagacatcctcaaaaatgcagccacagttgatgagttgaaggccagtatcggtaatatagcccttagtccatcaccggtcaggaagtctccgagaaggagccctggggcaataaaacggaacctaagcagtgaggaagtcgcccggccccgccgctcaactcctacacccgaactgattagtaaaaagccacctgatgacacaaccgcactggccccactgtttggtccacccctggaatcagcgttcgacgaacagaagactgaggttttgctggatcaacctgaaatctgggggtcgggccagcccatcaacccatccatggaaagtccaaagctgactaggccctttcctaccggaactcctccacctctcccgccaaagaatgtccccgccacgccacccagaaccggctcacccctgacaatcgggcctggagcttcttcccctgctcgtcctgctacccccctggtaccatgccgaagtacgaccccccctcctccaccacctcgccctccgtccaggcctaagctgcctcctgggaaacctggagttggcgacgtaagtaggcctttcagtccacccatccactcctcttctcctcctccaattgcccctctggcccgcgctgaaagcacaagcagcatctcttcaaccaacagtctgtcagctgcaaccaccccaaccgttgagaacgaacagccctccctagtgtggtttgacagaggtaagttctacttgaccttcgaaggatcatcacggggccctagccccttaactatgggggcacaggatactcttcctgttgctgcagcatttacagagaccgtaaacgcttacttcaaaggagctgacccgtccaagtgcatcgtgaagattaccggggagatggttctctcgtttcccgccgggataacaaggcacttcgcgaacaatccatcgccagcagccctgacattcagagttataaacttttcaaggctggaacatgtcctcccaaaccctcagctcctgtgctgcgataatacccagaacgatgccaacacgaaagagttttgggttaatatgccaaatctgatgactcatcttaaaaaggtttccgaacagaagccacaggcgacctactacaacgtcgacatgttgaagtatcaggtatccgctcagggaatccagagcacccctctcaacttggcagtcaattggaggtgtgagccctcctcaaccgacctgagaatcgattacaagtataataccgacgccatgaccaccgctgttgccctgaataatgtgcagtttttggtacctatcgacggcggagtgacaaaactgcaggccgtgctgcctcccgcggtgtggaacgcagagcagcaacgcatactttggaagattccagacattagccagaagagcgaaaacggcggggtgggttccctcctggcacgatttcagctgtctgaaggacccagcaagccaagtcctctcgtcgtccaatttacttccgaggggagtactctgtcgggctgcgatattgaactggtgggcgcaggctatcggtttagtctcatcaaaaagcgcttcgccgctgggaagtacctggcagacaactag

SEQ ID NO: 134204 - DNA, 1893 bp, Artificial Sequence
  Description of Artificial Sequence: Synthetic coding sequence
atggagggattaaaaaagcggacacggaaagctttcggtatcagaaagaaggaaaaagatactgactctacagggtcccccgatcgtgacggtattaagaagtctaacggcgcacctaatggcttctatgcagaaatagactgggagcggtacaattctcctgagcttgacgaagaaggatattctatcaggcccgaagagcccgggtccaccaaaggtaagcatttttacagtagcagtgaaagcgaggaagaagaagaatcacataaaaagttcaacattaaaattaagcccctgcagtcaaaagacatcttgaaaaacgcggctacggtggatgagctgaaggcttctatcggtaacatagccctaagtcctagccctgtgggggcaatcaaaagaaatctgtcttccgaagaggtggcgaggccacggcgttcaacacccacacccgaactgatttcaaagaaaccaccagacgatacaaccgccttagcccccctgtttgggccgcctttggaaagcgctttcgacgagcaaaaaactgaagtactactggaccagcctgagatttggggcagtggacagcctatcaaccccagtatggagtcccctaaactgacaagaccattccccaccgggacgccaccccctctgccccctaaaaatgtgcctgccacacctcctcgcactggcagtcccctgaccattgggccaggtgcttcctcccctgcgaggcccgccaccccccttgtcccctgtaggagcaccacacctcctccccccccacctaggcccccaagtcgccccaagttaccacccggaaagcccggagtgggagatgtttcaaggccattctccccaccaatccactcttcttctcccccaccgatagcgcccctggctagggctgaaagcacttcatccatcagctccactaactcactatcagccgcaacaactcctaccgtagttagtgaagacgatgtcttctacgacaagttgcccagtttcgagaggcggtgcgaaactcccgccggatccagtcggggcccatcaccactgactatgggggcccaggacactttgcctgttgcggcagcctttacagagaccgttaatgcatacttcaaaggcgccgacccatctaagtgtatcgtgaagatcacgggtgagatggttctcagttttcccgcaggaattactaggcatttcgctaataacccatctcctgccgctctgacctttcgcgtcataaatttctcacgacttgaacatgtgctacccaacccccagttgctgtgttgtgacaacacccagaatgatgcaaataccaaggagttctgggtaaacatgccaaacctaatgacacacctgaaaaaggtgtcggaacagaagccgcaagcaacttattataatgtggatatgcttaaatatcaagtgtctgcccaggggatccagtccacgcctctgaatttagccgtcaattggaggtgcgagcccagctcaactgatctgaggatcgactataagtacaacacggatgccatgaccacagccgttgctctgaataacgtccagttcctggtccctattgacggcggagtcactaagctccaggctgtgctgccacctgccgtgtggaacgccgagcagcagagaatcctgtggaaaattccagacatctcacaaaagagtgagaacggcggggtaggatcccttctggccagatttcaattatctgaaggcccctcaaagcctagtcctctcgtcgtgcagttcacaagcgaaggaagcaccctgtctggatgtgacatcgagttggtaggcgccgggtaccggttttctttgataaaaaaacgcttcgcggctggcaagtatcttgcagataattag

SEQ ID NO: 134205 - DNA, 2487 bp, Artificial Sequence
  Description of Artificial Sequence: Synthetic coding sequence
atgatggaaggtctgaagaaacgcactcgtaaggcctttggcattagaaaaaaagagaaagacaccgactcaactggcagcccggatcgggatgggatccaaccttccccccacgagccaccgtataactcaaaggccgagtgtgctagggaagggggaaaaaaagtcagcaagaaatcaaacggtgcccccaacggcttctatgccgaaattgactgggaaaggtacaattctcccgagctggacgaggaagggtactctatccggccagaggaaccaggatcaacaaaggggaagcatttttatagttcttccgagtctgaagaagaggaggagtcccataagaagtttaacattaaaatcaaacccttgcaaagtaaggatattctgaaaaacgcagccacagtggacgaacttaaggccagcatcggcaacattgctctgtctccaagcccggtgcgaaagtcccccaggcggtctccgggggccattaaaagaaatctgtcttctgaagaggttgccaggcctcgcaggtccactcccacacctgaacttatttccaaaaaaccgccagatgatactactgccctggcaccactgttcggccctccactggaaagcgcattcgacgagcagaagaccgaggtgcttctggatcagccagaaatctggggatctggtcagcctattaacccaagtatggaatcacctaagttgacccggcccttccctaccggtaccccgcctcctctgcctccaaaaaatgtcccggcaaccccgcccaggaccggctcccctctcactatcggaccaggaaatgaccagtccgccacagaagtgaaaatcgagaagttgcccagtataaacgacctggactcaatttttggaccagtcctgtctccgaagagtgtggccgtgaatgctgaggagaagtgggtgcacttcagcgacaccagccccgagcacgtaacccccgaattgactccaagggaaaaggtcgtaagccccccggcaacacccgataaccccgccgattcaccggcccccgggcccctcggcccccccggcccgactggtcctccagggccccctggcccacctcgcaatgtgctgtccccccttaacttggaggaggtccagaaaaaagtggccgagcagacctttatcaaggatgactatctggagacaatatcctcccctaaagattttggactcggccaacgggccacaccacctccaccccctcccccaacataccggaccgtcgtcagctcccctgggcccggctctgggccaggaccgggcacaacctctggcgcttccagtccggcgcggcctgctacccccctcgtcccttgtcggagcaccacgcccccccccccccctccccggcctccctcgcgccccaagcttccgcctggcaaacccggtgtgggtgacgtttcacgccctttttccccccctatccactcctctagtccacctcctatcgccccattggcgcgcgcagagtctactagctccataagcagcaccaacagcctgagcgctgctactacgcccaccgtagagaacgaacagcccagcctggtttggtttgatcgaggcaaattctatctgacattcgaaggttcctcgaggggcccttctcccctgactatgggtgctcaggacacactccccgtcgcagccgctttcacagaaacagtgaacgcgtacttcaaaggcgccgacccaagtaagtgcatcgtcaagataacaggcgagatggtgttgtctttcccagcaggcattactaggcatttcgcaaacaacccgtcacccgccgctctcacattccgggtgatcaatttttcccgcctagagcatgttcttcctaatccacagctcctctgctgcgacaacacacagaacgacgcaaacacaaaggaattctgggttaacatgcctaatcttatgacccatctcaaaaaggtctctgagcaaaaaccccaagcaacttactataacgttgatatgctgaaataccaggtctccgcacagggtattcagtctactccgctcaacctggctgtgaactggcggtgtgagccgtccagcaccgatctccggatagactacaagtacaataccgacgctatgacaactgccgtcgctctaaacaatgtgcagttcctggtccctatcgacggtggagtcaccaaattgcaagccgtccttcctcctgctgtttggaacgcagaacagcagcgcattctctggaagattccggatatttcacagaagagtgaaaacggcggcgttgggtctctgctcgctaggtttcagttatcagagggacctagcaaaccttcccccctggtggtccagtttacgagcgaaggcagcacactaagtggatgcgatatagagctagtgggggctggctataggttcagcctgatcaaaaaacgatttgccgctggaaaatatttagccgacaactag

SEQ ID NO: 134206 - DNA, 2577 bp, Artificial Sequence
  Description of Artificial Sequence: Synthetic coding sequence
atggaagggctgaaaaaacgcacgagaaaagctttcggcattcggaagaaggaaaaagataccgattcaacgggctccccggatcgggatggcatacagggcaagaaaaagactcagaaaacgcagcttttactaacctcatgcttctggctccgcgctctgagtctgaccctctcccagaaaaaatctaatggcgcacccaatggcttttacgcggaaattgactgggagcgttacaattcacctgaactggacgaggaaggctattcaattagaccagaagaacccggatctacaaaggggaagcatttctattcatcctcagaatccgaagaagaggaagaatcacacaaaaagtttaacataaagatcaaacccctacagagtaaggatattctaaaaaacgcagccacggtggacgaattgaaagccagtattggcaatattgctctctccccaagccctgtacgcaagaaggaacggcgcgagaaaggtgcaataaagcggaacttgagctccgaggaggtggcgcgccccagaagatccacccccacccctgaactaatatcgaagaaaccacctgacgatacaaccgctctagcaccactgtttggccctcccttggagtctgctttcgacgaacaaaaaacggaggtgctgctcgatcagcccgaaatttggggcagcgggcaaccgatcaatccgagtatggaaagcccaaaactcaccaggccctttcccactgggacaccaccgcctcttccgcctaaaaacgtccctgctacgcccccacgcactggcagcccgctgacaattgggccaggcaatgaccagtccgccaccgaggtaaaaattgaaaagctgcccagcattaacgatttggactctatttttggacctgtgctctcacccaagagcgtagccgtaaacgctgaagaaaagtgggtgcacttctctgatacctctcccgaacatgtaacccccgagctgaccccacgggagaaggtggtgagtcccccggcaaccccagacaatcctgcggactcgcccgcacccggacccctgggcccacctgggcctacaggcccacccggtccacctggtccccctaggaatgtgctttcgcctttaaatctcgaggaggttcagaaaaaagtagctgagcagactttcattaaggatgactacttggagactatatcttccccaaaggacttcggccttggtcagagagccacaccaccacctccacctccacccacatatcggactgttgtttccagtcctggacccggtagcggccccgggcctggaaccacatctgatggaaagactgaagcccagaggtaccaagtaatttgtcccagccttcaggccggtgggaacgaactggacagttacagtggagcctctagtcccgctcgtccagctacacccctcgtgccatgcaggtcaactacccctccacctcctccaccacggcctccctccagacctaaattgccaccaggaaagcctggtgtgggagacgtctctaggcctttctcaccgcccatacactctagctcgccccctccaattgcccccctggcgcgtgccgagagcacctcttcaatttcgagtaccaactcattaagcgccgctacaaccccgacagtggaaaacgagcaaccaagcctggtctggttcgataggggcaaattctacttgaccttcgaaggttcctctagaggtccgagcccactcactatgggagcacaggatactttgccagtcgcggcagcattcacagaaacggttaatgcctatttcaaaggcgctgaccccagcaagtgcatagttaaaatcactggcgaaatggtattgtcctttccagctggcataacccggcacttcgctaacaatccaagccctgcagcgttgacctttcgcgttatcaatttctcccgcttggagcatgttctgccaaaccctcaactgttgtgttgtgacaatacccagaacgatgctaataccaaagaattttgggtgaacatgcccaatctcatgactcatttgaagaaagtgtctgagcagaagccgcaggctacctactataacgtggacatgctcaaataccaggtgtcagctcaggggattcaatctactccgctgaacctggccgtgaattggagatgtgagcctagctcaactgatctcaggatagattacaaatataatactgatgccatgactacagccgtggccttgaataatgttcagtttctggtgcccattgacggtggggtgacgaagttgcaggccgtcctgccccctgcggtttggaatgcagaacagcagcgtatcttatggaagatacccgatatatctcagaagtccgaaaatggtggcgtggggagcctgctggctaggtttcagctgtcagaaggtcctagcaaaccgtcacccttggtggtgcagttcacctcagaagggagtacactttccgggtgcgacattgagctggttggcgcaggctatagattttccttgataaaaaagaggttcgccgccggaaagtacttggccgacaattag

SEQ ID NO: 134207 - DNA, 1896 bp, Artificial Sequence
  Description of Artificial Sequence: Synthetic coding sequence
atgatggaaggcttgaaaaagagaactaggaaggcttttggcattagaaagaaggaaaaggatacggactcaaccggatcccccgatagagacggtataaaaaagagcaatggagctcctaacggcttttatgcggaaatcgactgggaacgatataattcccccgaacttgacgaggaggggtattccattcgccccgaggaacctgggagcactaaggggaagcatttctactcctcgtcagagagcgaagaagaagaggagtcccacaaaaagttcaatatcaaaattaaacctctgcagtccaaggatatactgaaaaacgcagctaccgtggatgagttgaaggccagtatcggcaacattgcacttagtcccagccccgtgggcgcaattaagcgtaacctcagttctgaagaggtggcaagaccacgaagatctaccccaacaccagagctcatttccaagaaaccaccagacgataccacggcactggctccactctttgggcctccgctcgaatcagcatttgacgagcagaagactgaagttctccttgaccagcccgaaatttggggttctggtcagcccatcaatccaagtatggaaagcccgaaactgacacgcccgtttcccaccggaaccccccctcccttaccaccaaagaatgtgcccgccacccctcctcgcactggctctcctctaacgattgggcctggggcctccagtcctgctcgacccgccacgccactcgtgccatgcagatccaccacacccccgccccccccaccaagacctccctcgagaccaaagctgccaccaggcaagccaggcgttggtgatgtgtcacggccattctcgcctcctatacatagctctagcccgcctcctatcgctcccctagcgagagctgagtccacaagtagcatctcctctacgaattccctttcagccgccacaacgccaaccgtcgtgagcgaagatgacgtcttttacgacaagctgccatccttcgagagacgatgtgagactcccgcagggagcagccgcgggccatctccgcttacgatgggtgcccaagacacactacctgtggctgctgcctttacggaaaccgtgaatgcttattttaagggagcagatccaagcaaatgcatagtgaagattaccggtgagatggtcctgtccttccctgctggaatcacgaggcactttgccaataacccttctcctgcagccttaacattccgagtgattaacttctccagattggagcatgttctccctaaccctcagctcctctgctgtgataatacgcaaaatgatgcaaacacaaaagagttctgggttaacatgccaaacctgatgacacacctgaaaaaagtgagtgagcagaaaccccaagccacatattacaacgtcgatatgctgaaatatcaggtgtcggcacagggcatccagagcacacccttgaacctggctgtgaactggcgctgcgaaccgagttctactgatcttaggatcgactataagtacaataccgatgctatgaccaccgccgtggccctcaacaacgtccagttcctggtcccgatcgacggaggtgttacaaaactgcaggccgtgctaccccccgccgtgtggaacgcagagcagcagagaattctgtggaagatcccagacatctcccagaaaagcgagaacggtggcgtgggaagcttgctcgctcgatttcagctgtccgagggaccttccaagccctctccgctcgtcgtgcagtttacgagcgagggaagtacgcttagcgggtgcgacatcgaactcgttggggcagggtacagattttccctgatcaagaagagattcgccgcggggaagtatttggccgataattag

SEQ ID NO: 134208 - DNA, 2496 bp, Artificial Sequence
  Description of Artificial Sequence: Synthetic coding sequence
atggaggggctgaagaaacggacaaggaaggcattcggcatcagaaaaaaggaaaaagacactgacagcacagggtctccagacagagatgggatccaagggaagaaaaaaactcagaagactcaactcttactcacaagctgcttttggctgagagcactgtccttaactttgagccagaaaaaaagcaacggcgcacctaatggcttctacgcggaaattgactgggaaagatacaattctccggaactggatgaggagggatatagcatcaggccggaggagcctggcagcaccaagggcaagcatttctactcatcgagtgagtctgaagaggaggaggaaagccacaagaagttcaacattaagataaaacctttgcagagcaaggatattctgaaaaatgccgccactgttgatgagctgaaagcatcgataggcaatattgcactgagcccaagtccggtgaggaagaaagagagacgtgagaagggtgctattaagcgcaacctatcaagcgaggaagtcgcccggccacgtcgcagcacaccaacaccagaactgattagcaagaaaccaccagacgatacgactgcacttgcccctctctttggacccccactggaaagtgcatttgacgaacaaaagaccgaggtgctgctcgatcaacctgagatctggggcagcgggcaaccgatcaatccctccatggaatcaccgaagctgacccgtccattccccacggggacacctcctcctctgccacccaagaacgtaccggccaccccacctcggaccggctccccacttaccatcggtcccggaaacgaccagagcgcaacggaggtgaagattgagaagctcccatctatcaacgacttggattctatattcgggccagttttgagcccaaagtcggttgccgttaatgcagaagagaagtgggtgcatttttcggatacctcacccgaacatgtgacgcctgagttaacacctcgggagaaagtcgtctcaccccctgccacacccgacaacccagccgacagtcccgcgcctggcccactaggacccccaggaccaacaggcccccccgggccgcctgggccacccaggaacgtgctgtcccccttaaatttggaagaggtacagaagaaggttgctgagcagacctttataaaggatgattacttggagactatcagcagtcccaaagattttggactaggacaacgggccactccaccccctcctcccccccctacatacagaactgtggtgtctagcccaggtccaggcagtggcccgggtcctggaacaacttcgggcgcttccagcccagcccgaccagctacccctctggtaccttgcagatctacgacaccaccccccccaccacccagaccccctagtagacccaagctgccacccgggaagccgggggttggtgacgtgtccagaccctttagcccaccgatccatagttctagcccgcctcccatagctcctttggcacgggccgaaagtacctctagtatctccagcactaactcactttccgccgcgactaccccaaccgtggagaatgagcagccttccctggtgtggttcgacaggggtaagttctacctgacatttgaaggttccagccgcggcccttcacccctgaccatgggagcgcaggatactctccccgtcgctgccgcgtttacggagaccgtgaatgcctatttcaagggtgcagacccaagcaaatgcatagtgaaaattacgggtgagatggtgctgtcgtttcccgccgggattacccggcattttgctaacaacccatctcccgccgcgctcacctttagagtaattaattttagccggctggagcatgtgcttcccaacccacagttgctgtgctgtgataatacccagaacgacgcaaacacaaaggagttctgggtgaacatgccgaacctgatgacccacttgaagaaggtgtcagaacaaaagccccaggctacttactataatgtcgacatgcttaagtatcaagtgtcagcgcagggcatccagagtactccgctgaacctagccgtaaattggagatgcgagccttcgtcaactgatcttcgaatagactacaagtataacaccgacgctatgacgaccgccgtcgccctgaataacgtgcaattcttagtacccattgacgggggcgtgaccaaactgcaggccgtgctccctcccgccgtatggaatgccgagcagcagaggatcctttggaagattcccgatatcagccagaagtcggagaatgggggtgtagggtcacttttggcacggtttcagttaagcgagggcccaagcaagcccagtccactcgtcgtgcagtttacaagtgaaggatctacgcttagcggatgcgatattgaacttgtgggggcagggtacagattcagtctgataaaaaaaaggttcgcggctggaaagtatttagccgataattag

SEQ ID NO: 134209 - DNA, 783 bp, Artificial Sequence
  Description of Artificial Sequence: Synthetic coding sequence
atgatggagggattaaaaaaacggactaggaaagccttcggaatcaggaaaaaggaaaaggacactgatagtacggggtctcctgatagggatggaattcaaccaagtcctcatgaacctccctacaacagtaaagccgagtgcgcaagagaaggagggaagaaggtgtccaaaaagtctaatggggcaccaaacggattctacgctgagatcgattgggagaggtacaatagcccagagctggacgaggaaggctattccatcaggcccgaagaacccgggagtactaaggggaaacacttctacagctccagcgaaagcgaggaagaggaagagagccataagaagttcaatattaagattaaaccccttcagagtaaggatatccttaaaaatgcagcgaccgtggacgaacttaaagcttctatcggtaatatagccctgagtcccagtccggtgggtgctatcaagcgtaatctgagctccgaggaggttgcgcgcccgagaagatctacaccgaccccagaattgataagtaagaaaccccccgatgacaccactgccctggcgcccctcttcggcccccctttagagtccgcttttgatgagcagaaaacagaagtccttttggaccagccagagatttggggatctggacagcctatcaatccttcaatggaaagccccaagttaacccggccgtttccgacggggacccctccacccctcccccccaaaaacgtacctgctacaccacctagaaccgggtcccctcttacttag

SEQ ID NO: 134210 - DNA, 1002 bp, Artificial Sequence
  Description of Artificial Sequence: Synthetic coding sequence
atgacatgctccgtgacccacatcgtgagttttagcctcccctttctgaatccctcccaccccgcatctaccccgggccacaccgaaaacgagcaacccagtctcgtgtggttcgaccgaggtaaattctatctgacatttgagggttctagcagaggccctagccccctgactatgggtgcacaggacacgcttcccgttgcagcagctttcacagagaccgtgaacgcttattttaagggtgccgaccctagtaagtgcattgttaaaattacaggagagatggttctgtcattccccgcaggtattacccggcactttgctaacaacccgtctcctgccgccctcactttccgtgtgataaatttctcgcgtctagaacatgtgctgcctaacccacagctcctgtgctgtgacaacacccagaatgacgccaacaccaaagaattctgggtaaatatgcccaacctgatgacccatcttaagaaagtgagcgaacagaagcctcaggcgacgtactataacgtcgatatgctcaagtaccaggtgtcagctcagggcatccagtctaccccactaaatctcgctgtgaactggcgatgcgagccgtcctctaccgacctgcgaatcgattacaaatacaacactgacgccatgactaccgccgtagccctgaacaacgttcaatttttagtgcccattgatggcggagttacaaagctgcaggccgtactgccacccgccgtttggaacgccgaacagcagcggattctatggaagataccagacatcagtcagaaaagcgagaatggtggtgtaggaagccttctggcccgttttcagctcagcgagggtcctagtaaaccctctcctctggtggtccaattcacttcagaagggtctaccctgtcaggatgcgatattgaactcgtcggagctgggtatagattctccttgatcaagaagagattcgccgctggcaaatatctggcagataactag

SEQ ID NO: 134211 - DNA, 1107 bp, Artificial Sequence
  Description of Artificial Sequence: Synthetic coding sequence
atgtctgtggcaggtcttaagaagcaattttataaagcatcccagctggtgtcagagaaggtgggaggagccgagggcacaaagctggacgacgacttcaaggagatggaaaaaaaagtggacgtgaccagcaaagcagtaactgaagtcttagctaggaccatcgagtacctgcagcccaaccctgcatccagggcaaaacttacaatgctgaacaccgtaagcaagatcagagggcaagtcaaaaatcctggctacccccaatcagaaggcctgcttggggaatgtatgatacggcacggaaaggagttgggcggcgaatccaactttggtgacgcgctcctcgatgcaggcgagagcatgaaacgcttggctgaggtgaaggattcccttgatatagaggtcaaacaaaacttcatcgaccctctccagaacctttgcgaaaaggatttaaaagagatacagcaccatttaaagaaacttgaaggcaggcgtcttgactttgactataaaaagaagagacagggaaagattcctgatgaggagctccgacaggccctggagaagtttgaagaaagcaaggaagtagcagaaacatccatgcacaacttactagaaaccgatattgagcaggtctctcagctgagtgccctagtggatgctcaactcgattatcatcgccaagctgtgcaaattcttgacgaattggctgagaagctgaagcgaaggatgagagaggccagctctcggcctaaaagggaatataagccgaaaccacgagagccgttcgacctcggggaacccgagcagtccaatgggggcttcccctgcacgactgcaccaaagatagcagcgtcttcttcctttaggtcctccgacaagcctatccggacgccgagtagatcaatgcctccattagatcagccttcttgtaaggccctctatgatttcgaaccagagaacgatggtgagctggggttccacgaaggggatgtcataaccttgacgaatcagatcgacgagaactggtatgagggaatgcttgatggacagagcggatttttccccctgagctacgtggaggtgcttgttcctcttccacaatag

SEQ ID NO: 134212 - DNA, 963 bp, Artificial Sequence
  Description of Artificial Sequence: Synthetic coding sequence
atgagcgtcgccggcctcaaaaagcaattctacaaggccagtcagctggtgagtgaaaaagtcggcggggccgagggaacaaagctggatgacgatttcaaagaaatggagaaaaaagtggatgtgacttctaaagccgtgactgaagtgctggcgagaactatcgagtacttgcagccgaatccaggtgatgccctcctggatgccggagagtctatgaagaggttggccgaggttaaggactcattagatatcgaagttaaacagaacttcatcgacccactccagaatttatgtgagaaggatctgaaggagatccagcaccacctcaaaaaacttgagggacgacgtctagattttgactacaaaaagaaacgacagggcaaaatccctgatgaagagctaaggcaggcactcgagaagttcgaagagtcaaaagaagtagctgaaaccagcatgcacaacttactggagaccgatatcgaacaagtgtcccagctctctgcacttgtggacgcgcagctggactaccacaggcaggctgtgcaaatcctcgatgagctggccgaaaagcttaaaagacggatgcgcgaggcctcatcacgcccaaaacgggagtacaagcctaaacctcgtgaacccttcgatttaggcgagccggaacagtctaatggcggcttcccctgcacaacagcccccaaaatagcagcatctagcagctttcgtagctccgataagccaatcaggactccctcacgttcaatgcccccactagatcaacctagctgcaaggccctctacgatttcgagcccgaaaacgatggggagctgggctttcatgaaggcgacgtgatcacactgactaaccagatagacgagaactggtatgaaggaatgctggacgggcagtcgggcttcttcccactgagttatgtggaagtgctggtgcccttaccacagtag

SEQ ID NO: 134213 - DNA, 915 bp, Artificial Sequence
  Description of Artificial Sequence: Synthetic coding sequence
atgtccgttgcaggactcaaaaagcagttttacaaggccagtcagctcgtctccgagaaagtggggggagctgagggaacaaagctcgatgacgatttcaaggagatggaaaagaaggtcgatgtgacatcgaaagccgtcacagaggtgctggcacgcaccatcgaatacctgcaaccaaaccccgcatcccgggctaaattgaccatgctgaacaccgtaagtaagatccgcggccaaaatttgtgtgagaaagatctgaaggagatccagcaccatctcaaaaagctggaggggcggcggctggattttgattacaagaagaagcggcaaggcaaaattccagatgaggaacttagacaggcactcgagaagttcgaagaatctaaggaagtggcagagaccagcatgcataaccttttggaaaccgacatagaacaggtatcccagctgagtgccttggtagacgcacagttggattatcaccgccaggctgtgcagatcctggacgagctggctgaaaagcttaagaggcgcatgagggaggcatctagtcggccaaaacgagagtacaagcccaaaccccgggagccctttgaccttggggagcccgagcagtccaacggcggatttccctgcacaacagccccaaagatagctgccagctcgagcttccgatcttccgataagccaattcgcacaccgtcaaggagtatgccacctctggatcagccctcttgtaaggccctgtatgattttgagcctgagaacgatggcgaattggggttccacgaaggagatgtgattacactcaccaaccagatcgatgagaactggtatgagggtatgctggacggccagagcggcttttttcccctgtcttatgtcgaagtgctagtcccactgccccagtag

SEQ ID NO: 134214 - DNA, 1059 bp, Artificial Sequence
  Description of Artificial Sequence: Synthetic coding sequence
atgtccgtggctgggctcaaaaaacagttccacaaagcaacccaaaaagtttcggaaaaggtgggcggagcggaaggaacaaagttggacgacgatttcaaagagatggaacgtaaagtggatgtgacctcccgggcggtaatggaaattatgactaaaactattgagtatctgcaacccaaccccgcttccagagccaagctcagcatgataaatacaatgtcgaagattagaggacaggagaaagggccgggttacccccaggccgaggccttacttgccgaggccatgctgaaatttggaagagagctgggagacgactgcaactttgggcctgcccttggggaggtgggagaggccatgagagagttaagcgaagtcaaagacagtctagacattgaagtcaagcagaacttcatcgatcctctccagaatctccatgacaaggaccttcgtgagattcagcatcacctgaaaaagctggaggggaggcggctggatttcgactataaaaagaagaggcaggggaagattcccgatgaggaactccggcaagctttggagaaattcgatgagagcaaagagattgccgagagctcaatgtttaatttattggagatggacatcgaacaggtgtcccagcttagcgccctcgtgcaagcgcaactggaataccacaagcaagctgtgcagatcctccagcaagttacagtccggctggaagagcggatcagacaggcctcctcccagcctcgtagagagtatcaaccgaaaccccggatgagcctggaatttccaaccggcgactccactcagccaaacggcggtctaagtcacacaggcacccctaaacccagcggtgtgcagatggaccaaccctgttgtagggctctctatgatttcgagcctgagaacgagggcgagctcggttttaaagaaggcgacatcattactctgaccaatcagatagacgagaattggtacgaggggatgctccacgggcactccgggtttttcccgatcaactacgtcgaaattctggtcgcactcccccattag

SEQ ID NO: 134215 - DNA, 678 bp, Artificial Sequence
  Description of Artificial Sequence: Synthetic coding sequence
atgagcgtggcgggtctgaagaagcagttccacaaagccacccaaaaggtcagcgagaaagttgggggcgcagagggaacaaagctggacgacgactttaaggaaatggaaaggaaggtcgatgtgaccagtcgggcagtaatggagattatgacaaagacgattgaataccttcagcctaaccccgggtccctcgaggcggaggccctcctagcagaagccatgctcaaatttggccgcgaactcggagatgattgcaatttcggccccgccctgggggaagtgggggaagctatgagggaattgagcgaagtgaaagatagcctggatatcgaggtaaaacagaacttcatcgatcccctgcagaatctccacgataaagatctgagggaaatacagcatcatcttaaaaagctggaggggcgccgcttagacttcgattataaaaaaaaacggcagggaaagattcccgatgaggaactcagacaggctttagaaaagttcgatgaaagcaaagaaattgctgagagtagcatgtttaatctgttggagatggatatcgagcaagtatctcagctgagtgccctagtacaagcccagctcgaataccataaacaggccgtgcaaatcttgcagcaggttaccgtgcgtttggaggagcgcatcaggcaggcctag

SEQ ID NO: 134216 - DNA, 918 bp, Artificial Sequence
  Description of Artificial Sequence: Synthetic coding sequence
atggagatcatgacgaagactattgagtatttacagcccaaccccgcatctcgtgccaaattatctatgattaacacaatgagcaagattcgcgggcaggagaagggtcccggctacccacaggcagaggccttactggccgaagccatgcttaaattcggccgcgaactgggggacgattgcaacttcgggcctgctctgggcgaagtcggagaggctatgcgtgagctgagcgaggtgaaagacagccttgacattgaggttaaacagaatttcatcgatcccctccaaaacctccatgacaaagatcttcgggaaattcagcaccacctgaagaaattggaaggccggcggcttgatttcgactataagaagaaaagacagggtaagattcccgacgaagagctccggcaggctctggaaaagttcgacgaaagcaaagagatcgctgaatcaagcatgttcaatctgttagagatggacattgagcaggtctctcaacttagtgccctggttcaggcgcagctggaataccacaaacaagccgtgcagattctgcagcaggttacagttcgtctcgaagaacgtatccgacaggcttcctcacagcctagacgggaatatcagcccaaaccacgcatgtctctagagtttcctacgggcgatagtacacagcccaatggaggactgagccatacgggcacaccgaagccctcaggagtgcagatggaccagccatgttgtagagccttgtatgacttcgagcccgaaaacgagggagagctggggttcaaggaaggcgacattatcacgctgactaaccagatagacgagaattggtatgagggaatgctacatggacacagcggtttctttcccatcaactatgtggaaatcctcgtggcactgcctcactag

SEQ ID NO: 134217 - DNA, 546 bp, Artificial Sequence
  Description of Artificial Sequence: Synthetic coding sequence
atgagcgtggcgggcctgaagaaacagtttcacaaagccacccaaaaagtttcagaaaaggttggcggtgcagagggaaccaagctagatgatgacttcaaggaaatggagatcgagcaggtgagccagctctcagctctggtacaagctcagttggaatatcacaagcaggccgtgcagatccttcaacaggttaccgtacggcttgaagaacgaattcgtcaggcctcctcacagcctcgtcgtgagtatcagcccaagccccgcatgtctctggaatttcctactggagattctacacagcctaacgggggcttaagccacacaggcaccccgaagcccagcggtgtgcagatggaccaaccttgctgtagagcactttatgatttcgagcctgagaacgagggagagctcgggtttaaggagggagatatcataacacttaccaaccaaatcgacgagaactggtatgagggtatgttacacggccatagtggcttctttccaattaactatgtggagatactggtcgctttgccacactag

SEQ ID NO: 134218 - DNA, 1068 bp, Artificial Sequence
  Description of Artificial Sequence: Synthetic coding sequence
atggacggtattttcgccggaattatctgcaaccaggcgaatcgctgtctgacttggacatctcagcagctgttcagcgagaaaataagtggggcagagggaaccaagctggacgacgagtttttagatatggagcggaagatagatgtgaccaacaaagtagtggctgagatcctctctaaaactaccgagtatcttcaacctaatcctgcctacagagccaagctcggcatgctcaatacagttagtaaaattcgaggtcaggttaagacaaccgggtatcctcagacagagggactgctcggggattgcatgctgaagtacggcaaggaacttggagaggatagcacctttgggaacgcactgatcgaagttggggagagcatgaaactgatggcagaggtgaaggatagcttagatataaacgtcaagcagaccttcatagatccccttcagctgttgcaggataaggacctaaaagagattgggcaccacctgaaaaagctcgaaggcagaagactggactatgactacaaaaaaaagcgagtcggcaagatccccgatgaagaggtgcgtcaggcggtcgagaagttcgaggaatccaaagaattggccgagcgctcaatgttcaacttcctcgagaatgacgtggaacaagtgagccagcttgccgtcttcatcgaggccgccctagattaccacagacagtcaacagagattttacaggagctgcagagcaaactgcaaatgcggatttctgccgccagcagcgtgcctagaagggagtataagcctaggcccgtgaaaaggagttcgagtgaacttaatggcgtttcaacaacctctgttgtgaagacaaccggttctaacattcctatggaccagccgtgttgtcgaggcttgtacgacttcgagccagaaaaccagggcgagctggggttcaaggaaggggacattatcacgctgactaaccagatcgacgagaactggtacgagggcatgatccacggggaaagcgggttttttccaataaattacgttgaggtgatcgtgcctctgccacagtag

SEQ ID NO: 134219 - DNA, 1044 bp, Artificial Sequence
  Description of Artificial Sequence: Synthetic coding sequence
atgtcagtggccggcctgaagaagcaattccataaggcctcgcagctgttctctgagaaaatctccggcgctgaaggtaccaagctggatgatgagttcctcgatatggaacgaaaaatcgatgtcaccaataaagttgtggcagaaatactctcaaagaccactgaatacctgcagccaaacccggcttacagagctaagttgggcatgcttaatacagtgagtaagatcagagggcaggtcaaaacgaccggataccctcagaccgagggccttttgggcgattgtatgctgaaatacggcaaggagctaggcgaggactctacctttggcaatgcacttatcgaagtgggggagagcatgaaactgatggctgaggtcaaagattccctggacattaatgtaaagcagaccttcatcgacccactgcaactgctgcaagacaaggaccttaaggaaattggtcaccacttaaagaaactggaggggcgtcgtctagactacgactacaagaaaaaacgagtaggaaagatcccagatgaagaggtacgtcaggctgtggaaaagtttgaggaatcaaaggagttggccgaaagatccatgtttaacttcctcgaaaacgacgtagagcaggtctcccagctggccgtattcatcgaggctgccctggactatcatagacagtcaaccgaaatactgcaggagttgcagagtaagctgcaaatgcggatatccgccgctagctccgtgcctagaagagaatacaaacctcgcccagtgaagagatcctcttccgaattgaatggggtgtcaacgacctctgtggtaaagactactggttccaatatacccatggatcaaccatgttgtcgcggtctgtacgacttcgaacccgagaatcagggagaactcggtttcaaggagggggacataatcacgttaactaatcagatcgacgagaattggtatgagggaatgattcacggcgagtcaggatttttcccaatcaattatgtcgaggttatcgttccactgccacaatag

SEQ ID NO: 134220 - DNA, 1068 bp, Artificial Sequence
  Description of Artificial Sequence: Synthetic coding sequence
atggacggcatctttgcagggatcatctgcaatcaggcaaacagatgtcttacctggacttcccagcagttgttttctgagaaaattagcggtgctgagggcaccaaattagacgacgagttcttagatatggaaagaaagattgacgtcaccaacaaggtcgtcgcggagattctgtcaaagacaacagagtatctgcagccgaatccagcataccgggctaagcttgggatgttgaacacagtctcgaaaatccgagggcaggtgaagactactggctaccctcaaaccgagggtttgcttggagactgcatgctgaagtatggtaaagagcttggtgaggattccacatttggcaacgccctgattgaagtgggggagagtatgaagcttatggctgaggtcaaagactcactggatatcaatgttaagcagacttttattgatcctctgcagctattgcaggacaaagacttgaaggaaataggccatcacctaaagaagttggaggggcggcggttggactatgactacaaaaagaaacgcgtgggaaagatcccagatgaggaggtcaggcaggccgtcgaaaagttcgaggaaagcaaggagctcgccgaaagatccatgttcaactttctggagaatgatgtcgaacaggtaagccagctggctgtgtttatcgaagcagcactggactaccatcgtcagtccactgagatcttacaggagctacagtccaagctgcagatgcgaatcagtgccgcttcctcagtacctagaagggaatacaagcctcgcccggtcaagagaagttcgtccgaactgaacggggttagcacaacatctgtggtgaaaactacaggaagtaacatcccgatggaccagccctgttgcaggggcctttatgattttgagcccgaaaaccagggcgaactgggcttcaaagagggtgatattatcactctcaccaaccagatagacgaaaactggtatgaggggatgattcacggcgagtctggattcttccccattaattacgtcgaagtcatcgttcccctgcctcagtag

SEQ ID NO: 134221 - DNA, 867 bp, Artificial Sequence
  Description of Artificial Sequence: Synthetic coding sequence
atgagcgtggccggactgaagaaacagttccacaaggcctctcagctgttcagtgaaaaaatcagcggggctgagggcaccaagctggatgatgagttcctcgatatggagcgtaaaatcgacgtgaccaacaaagttgtggcggaaatcttatccaagactaccgaatacctccaacctaaccccgcctatagggcaaaactgggaatgttgaacactgtgagcaagattaggggtcaggtgaaaacaacgggctacccgcagaccgaggggttgctcggagactgcatgttgaagtatggcaaggagctcggagaggattcaacattcggaaacgcactgatcgaggtaggagagtccatgaaactgatggcagaggtgaaagatagcctcgacatcaacgtgaagcagactttcattgacccactccagctgctacaagacaaggatctgaaggagattggccaccacctaaaaaagcttgaaggcagacgactggactatgattataagaaaaaaagggttgggaagattccagacgaggaagtgcgccaagcagtcgagaaatttgaagagtccaaagaactggccgagagatccatgttcaattttttggagaatgacgtggaacaagtatcccagctcgctgtattcatcgaagctgcccttgactatcaccggcagtcaaccgaaattctgcaggaactgcagagcaagctccagatgcggatctctgccgctagctccgtacccaggagggaatataaacctcgaccagtcaagagaagcagctccgagttaaatggcgtctcaactacatccgttgtcaagaccactgcttatagcaggttggaacctgctgattag

SEQ ID NO: 134222 - DNA, 1662 bp, Artificial Sequence
  Description of Artificial Sequence: Synthetic coding sequence
atggtggaagccatagttgaatttgactaccaggcacaacatgacgacgaactgacgatctctgtgggggaaatcattacgaacatccgaaaggaagacggaggttggtgggagggtcagattaatggtcgccgaggcctctttccggataacttcgttcgcgaaattaaaaaggaaatgaagaaggatccccttaccaacaaggcacccgaaaagcccctacatgaggtacctagcggcaattctctgttgagctctgagacaatcctgcggacgaataagcgtggcgagcgtcgtcgcagacggtgccaggtggcattttcctacctcccgcagaacgatgacgagctggaacttaaagtgggcgacatcattgaagtggtgggcgaggtcgaagagggatggtgggagggcgtcctcaacggaaagaccggaatgtttccttccaacttcattaaagagttgtccggggagagtgatgaactgggtatcagtcaggatgagcagctgagcaaatctagacctgaaggcttaccccccgctagtcttctccccttccccgctcatggcgcgaagggaaagactacctttgagggaaccattctgtaccgggctgctcctggcaaaacggaagggcatcgaaggtactactccctcagagagactacaggtagcgaatctgacggaggggacagttcatccaccaagagcgagggggcaaatgggacagtcgccactgccgccatccaacctaagaaggtgaagggcgttggcttcggggacatctttaaggacaaacctattaaactgagacccagatctattgaggtcgaaaatgatttcctgcccgtggaaaagacaattggcaagaagcttccggcaactacagctacccccgactctagcaagaccgagatggactcccgtacaaagtcgaaggattactgcaaggtcatctttccgtatgaggcgcaaaatgatgatgaacttactataaaagaaggagacatcgtgacacttatcaacaaggactgcattgatgtaggatggtgggaaggagagctcaacggccgacggggagtatttccggataactttgtgaagctgctgcctccggattttgagaaggaagggaaccggccgaaaaaaccaccccctcccagtgcccctgtcatcaagcagggggcaggcactacagagagaaagcacgaaatcaagaaaatcccccctgaaagacctgaaatgctccccaatcgcaccgaagaaaaggagcgccccgaacgcgagccgaaacttgatctgcagaaaccgagtgtgccggccatcccgcccaagaagcctcgccctccgaaaaccaattctttgtcccgtcccggggcactgcctccgcgccggcctgaaagaccagttgggcctctcactcacactcgatactgttgcgccttgacttcgggggcaggggtgggctggttatggaaagaacacagaagagggactgactgccaccggccctgggaggagggaaggggagagggtggagcacaagcctcacttctgcaccccccggccaagctgagcgaggacaccggacatttttgcccatgcagctgtacccaagccggcgtctctgtcagattgagaggtgcggtatgggtcagctag

SEQ ID NO: 134223 - DNA, 1887 bp, Artificial Sequence
  Description of Artificial Sequence: Synthetic coding sequence
atggaagtaagtgcggcgaaagctccaagtgctgctgacctgtcggagattgaaattaaaaaagaaatgaagaaggatcccctgacgaacaaagctccagaaaaaccactgcacgaggtgccctctggtaattcactcctgtcctccgaaaccattctccgcaccaataagcgaggggaacgacgtagacggcggtgccaggttgccttctcttacctgccccagaacgacgacgaactggaacttaaggttggtgatatcatagaagtggtgggggaggtggaagaaggctggtgggagggagttctgaacggcaagactggtatgtttccaagtaatttcatcaaggagctgagcggcgagtccgatgaactgggaatctcccaagacgaacagctttccaagagctcactacgggaaactactggttctgagtcagatggcggcgacagcagcagcaccaaaagtgaaggagccaacggtacggtggccaccgccgctatccagccgaagaaagtcaaaggtgtggggttcggagacatctttaaagataaaccaattaagttgcggccaagaagcattgaggttgagaacgacttcctcccagttgaaaagacaatagggaaaaagcttccagcaacaacggctactcctgactcctccaagactgaaatggactcacggacaaaaagtaaggattattgcaaggtgatatttccttacgaggcccagaacgatgatgagctcacaataaaggagggcgacatcgtaacacttattaacaaggattgtatcgatgtgggttggtgggagggggaactcaatggacgcaggggggtgttccccgataatttcgtaaaactgctgcccccagacttcgagaaggaaggtaataggcctaaaaaaccaccacctccaagtgcgccggttataaaacagggggccggcaccactgaacgaaagcatgaaatcaagaagatccctcctgaaaggcctgaaatgttgccaaatcgaaccgaagagaaggagaggccagaacgagagcccaaattggacctgcagaagccttctgtccccgctattcccccaaaaaagcccagaccccctaaaacaaactctctaagccggcctggtgctctgcctccaaggaggccggagagacccgtaggcccgctcacccatacacgtggggattctccaaaaatcgacctcgctgggtccagtctgtctggaatcctcgacaaggacctgtctgatcgaagtaacgacattgacctggaggggttcgacagtgtggtctcgtctacagagaaactgtcccaccccactacatcaagacctaaggctaccggacggcgaccacctagccagtcactgacctcaagctctctgagctcccctgatatctttgacagtccaagccccgaagaagacaaggaggagcatatctccctcgcacataggggcgtcgacgcctcaaagaagacgagcaaaacagtcactatctcacaggtctccgataacaaagcatctttgcctcctaaacctggaactatggccgccggaggcggaggaccagcaccactgtcttcggccgcaccatctccactgtccagttccctgggtacagccggccaccgcgcaaattcacctagcctttttggtaccgagggaaagccgaaaatggagccagcagcctcttctcaagctgcagtggaagagctgcgcacacaggtcagagaactgaggagtatcatcgaaacgatgaaggatcaacaaaagagagagatcaagcagctgctctcagaactggacgaggaaaaaaaaatcaggcttagactacagatggaggtgaacgacattaaaaaggctctgcagtcaaagtag

SEQ ID NO: 134224 - DNA, 1953 bp, Artificial Sequence
  Description of Artificial Sequence: Synthetic coding sequence
atgaaaaaagatcctctgactaataaagcaccggagaagcccctgcatgaggtcccttcaggcaatagcctgctctctagcgagaccattctgagaacaaataagaggggcgaacggaggcgcagaagatgccaggttgccttttcttatctgccccagaacgatgacgagctggagctgaaagtgggcgatatcattgaagtggtgggcgaggttgaggagggatggtgggaaggcgtcctgaacggtaagacaggaatgtttccgagcaattttattaaggagctcagcggcgagtctgatgagttgggaatttcccaggatgagcagctgagcaaaagcaggcccgagggtctcccacctgcttccttactgcccttcccggcacatggagccaaaggcaagaccacatttgagggaactattctatacagagccgccccgggcaaaacagaaggacaccgcaggtactatagtctgagagagactacaggctctgagtccgatggaggcgatagcagctcaaccaagtccgagggggccaatggcacggttgctaccgctgcaatacagcccaagaaagtgaagggcgttggcttcggtgacatatttaaagacaaacctatcaagctccggccacgcagcattgaggtggaaaatgatttcctaccagtcgagaagacaatcgggaagaagctgcccgccacaacggcgactccagatagctctaaaacagagatggacagcagaacgaaaagtaaggactattgcaaggtgattttcccttatgaggcccagaatgatgatgaacttacaattaaagaaggagatatcgtcaccctgatcaacaaggattgtatagacgtgggatggtgggaaggcgagctgaatggtcgaagaggcgtgttccccgataactttgtgaagctgcttcccccagattttgaaaaggaggggaaccggcccaaaaagcctccgcctccttcagcccccgtgattaaacaaggggccggaaccactgagcggaagcatgaaatcaaaaaaatcccacccgagcgtccagaaatgctcccaaaccggaccgaagagaaagaacggcctgagcgagagcctaaacttgatcttcagaagcccagcgtacccgccatccctcctaaaaaaccccggccgcccaaaaccaactccctatctaggcctggagcattaccaccaagacggccggaacgcccggtgggtcccctgacacacacacggggagacagccccaagatcgatcttgctggttctagcctttctggaatattagacaaagatctctctgatcggtccaatgatatcgatctggaaggattcgacagcgtggtgagctccacggaaaagctctctcatccgacgacttctagaccaaaagcgaccggtcgtaggccacctagccagtctctcaccagcagctctctgtcaagccccgatattttcgattctccatcccccgaggaggataaggaggaacatatttcactagcccaccgaggagtggacgcaagcaagaagacgtcaaagaccgtcaccattagccaggttagcgacaataaagccagcctacccccgaaacccggcactatggcggctggcggcggcgggcccgccccactgagctcggccgcaccatcgcccctatctagctctctgggaacagccggccatcgggcaaacagcccatctttgttcggaaccgaggggaagcccaagatggagcccgcggctagctcccaagccgccgtggaggaactgagaacgcaggttcgggaactgagaagcatcatcgagaccatgaaggatcaacaaaagagggagatcaagcagcttctcagcgaactggacgaggaaaagaaaatccgccttagactgcagatggaggtgaacgatattaaaaaggccttacagtccaaatag

SEQ ID NO: 134225 - DNA, 1284 bp, Artificial Sequence
  Description of Artificial Sequence: Synthetic coding sequence
atgggcgaggagacaattggcaaaaagcttcctgccaccaccgccacacccgactcctcaaaaactgagatggattcacggaccaaatctaaggattactgtaaggtaatctttccttacgaggcccagaacgatgatgagctgacgattaaggaaggggacatcgtaacgctgatcaataaggactgcatagacgtgggctggtgggagggagagctgaacggcaggcgcggtgtatttcccgacaattttgtgaagctcctacctcccgatttcgagaaggaaggaaatcgaccaaagaaaccacccccccctagcgcacctgtaatcaaacaaggagccggcacgacagagcgaaagcacgaaatcaagaaaatcccacccgagcgtcctgagatgctgccaaatcgaactgaagagaaagagagaccagagcgtgaacccaagctggatctgcagaagcccagcgtccctgccatccccccaaagaagccgaggcctcctaagaccaactcgctgagccgtcccggagcgctgcctccacgccgacctgaaagacctgtgggccccctcacccatacgcgaggcgactcgccgaaaattgacctcgcaggctcgtctctatctggtattcttgacaaggacctgtccgaccggagtaatgatattgacctggaaggttttgattccgtggtgtcttcgacagaaaaactgtctcaccccactacctccaggccaaaagcaaccggcaggcgtccgccatctcagtccctaacatctagttcgctgagcagccccgatatcttcgacagccctagtcctgaagaagataaagaagaacacattagcttggcccaccggggggtcgatgcatccaagaaaacatcaaagaccgtcaccatttctcaagttagtgataacaaagcctctctgccccccaagccagggaccatggctgctggtggcggcgggcccgctcctctaagcagtgccgctccttcgccactgtcctcgagcctggggacagccgggcaccgcgcaaacagcccaagtctcttcgggacagaggggaaacccaaaatggaacctgcggccagttcccaggctgcagttgaggaactgcgaacacaggtgcgtgaattacgctctatcattgagacgatgaaggatcaacagaaacgagagataaaacaactgctgagcgaactggatgaagagaagaaaatccgcctgagactgcagatggaggtgaacgacattaaaaaggccctccagagcaagtag

SEQ ID NO: 134226 - DNA, 1938 bp, Artificial Sequence
  Description of Artificial Sequence: Synthetic coding sequence
ctgacaaacaaggccccggagaaaccgctgcacgaggtgccgtctggcaactcccttcttagcagtgaaaccattctgagaacgaataaacggggcgagcgtcggcgtaggagatgtcaggtcgctttttcctacttgccccagaatgatgatgagctagagctgaaagtgggcgacatcattgaagtcgtgggcgaagtcgaggagggttggtgggagggagtgctaaacgggaagacaggcatgttcccgtcaaacttcattaaagagctaagtggcgagtctgacgagcttggcatcagccaggacgagcaactttcaaagtcacggccagagggtctcccccccgcttctcttctgccctttccagcccacggtgccaaggggaagaccacattcgaaggcactatcttatatcgcgccgccccaggaaaaaccgagggtcatagacggtattactccctccgtgaaaccaccggatctgaatccgatggaggggattctagtagcacaaagagcgaaggcgccaatggcactgtcgcaacagctgccattcagcccaagaaagtgaagggcgttggcttcggggatatattcaaggataaaccaatcaagctgcgccccaggtcaatcgaggtcgaaaacgacttcttgcctgttgaaaagaccatcgggaagaagctgcctgcaacgacagccactccggattccagtaaaacagaaatggattcacgtacaaagtccaaggattattgtaaggtgatctttccatacgaggcgcagaacgacgatgaactgaccattaaggagggagatattgtaaccttgattaataaggattgcattgacgtggggtggtgggagggcgagctcaacggccgcagaggcgtattcccagacaactttgtgaagctgctgccacccgattttgaaaaggagggaaataggcccaaaaaacccccgcccccgagcgcacccgtaatcaagcagggcgcaggcactactgagcgcaaacacgaaatcaaaaagataccacccgaacgacccgaaatgctcccgaatagaaccgaggaaaaggagaggcctgaacgggaaccaaagctggatctgcagaaaccttcagtccccgccattccacctaaaaagccccggccccccaaaacgaattccctttcccgcccaggagccttaccaccaagacggccagaacgccccgtgggccctcttacccacacccgaggcgattcacctaagatcgacctggctggtagtagtctgtcaggcattttggataaagacctgagcgatcgctccaatgacatcgatctagagggtttcgacagcgtggtgtcttcgactgagaagctctctcacccaacaacatcaaggcccaaagccaccggtcgaaggcccccttcccagtctcttaccagttccagcttgtcgtcgccagatatttttgactctccatcaccagaggaagataaggaggagcatattagtctcgcccatagaggtgttgacgcatctaaaaaaactagtaagaccgtcactatttctcaggtgtccgacaataaggcttccctgcctccaaagcccggcactatggccgcaggaggggggggcccggctccactgagttctgcagctccctcaccactatcttctagcctgggcacagccggtcaccgggcaaactcgcccagcttgttcgggaccgaagggaagcctaagatggaacctgctgcatcatcccaagccgcagtggaggagttgagaacccaagtgcgcgaactgcgaagcatcatcgagactatgaaagaccagcagaagagggagattaaacagctgttgtcagagctcgacgaggaaaagaagattcgtttgcggttgcaaatggaagtgaatgacattaaaaaagcactacagagcaagtag

SEQ ID NO: 134227 - DNA, 450 bp, Artificial Sequence
  Description of Artificial Sequence: Synthetic coding sequence
ttcgagacatccgaacgtcgtagacgcagatgccaagtggccttttcttatttaccacagaacgatgatgagctcgaactgaaagtgggagatataatcgaggtggtcggggaggtagaagagggttggtgggagggtgtcctgaatggcaagaccggcatgtttccgagcaacttcatcaaggagctgagcggcgaatcggatgagctcggaataagtcaggacgaacagctgtcaaagtcatcccttagggagaccacaggaagtgagtctgatggcggagactcctcatctactaagtctgagggcgctaacggcaccgtagccactgccgcaattcagcccaaaaaagtcaaaggcgttggattcggggacatcttcaaggacaaaccaattaaactccgccctcgctctattgaggtggagaatgattttttacccgttgaatag

SEQ ID NO: 134228 - DNA, 1998 bp, Artificial Sequence
  Description of Artificial Sequence: Synthetic coding sequence
atggtagaggcaatagtcgaattcgactaccaagctcagcacgacgatgaattgactatttcagtcggagagattattaccaacataagaaaggaagacggcggatggtgggaaggccagattaatggaaggaggggcctttttcctgataattttgtgagggagatcaaaaaagaaatgaaaaaagacccccttactaataaggcaccggaaaaaccattacatgaggtgccctctggtaactctttattgtctagcgagactatcctgcgcacaaacaaacgaggggagaggaggagacgccgttgccaggtggcttttagttatctgccccaaaatgatgacgagctggaactgaaggtgggggacatcattgaagttgtgggagaagtggaagaaggatggtgggaaggcgtcttaaatgggaagacaggcatgttcccctctaatttcataaaggagctaagcggcgaaagcgacgaactgggcatttcccaggatgagcaactgagtaaatcctccttaagggagacgactggctctgaatccgatggaggggactcctccagcaccaagagtgagggggccaacggtacggtcgcaactgcagccattcagccaaagaaggtcaaaggggtgggttttggcgatatctttaaggacaagcccatcaagttaagaccaagaagcattgaggtcgagaatgatttcctccctgttgagaaaaccattggcaagaagctcccagcaactaccgctacccccgactcctccaagaccgaaatggactcccgcacaaagtccaaggactattgcaaagtaatattcccctacgaggctcagaatgacgacgagctgactataaaagagggcgatatcgtaaccctgattaataaggactgtatcgacgtcgggtggtgggaaggcgagctaaatggaagacggggcgtgttccctgacaattttgtgaagctgctgccacccgattttgagaaggaagggaatcgacctaaaaaaccaccacccccctctgctcccgtaattaaacagggcgctggcacaaccgagcgcaaacacgagataaagaagattccccccgagaggcccgagatgctacctaatcgaaccgaagagaaagaacgacctgagcgcgagcccaagcttgatctccagaagccctcagtgcctgcaattccccctaaaaagcctagacctcccaaaacgaatagtctgtctagacccggagcactgccacctagaaggcctgaacgtccagtcgggccgcttacccacacacgtggcgacagtcctaagatcgaccttgccggtagctccctgagtggcatactggacaaagatctctcagatcggtccaacgacatcgacctagagggattcgacagcgtcgtcagcagcaccgagaagctttcccaccctaccactagtagacccaaggctaccggccgacgccctccctcccagagtcttacatccagcagtttgtctagcccagacattttcgacagtcccagccctgaggaggacaaagaagagcatatctctttggcccaccgtggggtagatgcatcaaagaaaacttcaaaaacagtcactatcagtcaagtcagcgacaacaaggctagtctgccacccaagccgggaaccatggctgctggcggaggcggacccgctcccttatcttcagccgcccctagccccctgagttcctcactgggcacggccggccatcgtgccaattccccttccctcttcggaactgagggcaagccaaaaatggaacccgccgccagttcacaggctgcagtagaggagctgcggacgcaggttcgcgagttaagatccatcatcgaaaccatgaaagaccagcagaagcgcgaaataaagcagctgctgagcgaactcgacgaagagaaaaagattcgtctgcgtctccagatggaggtgaacgatatcaaaaaagccttacagtccaagtag

SEQ ID NO: 134229 - DNA, 450 bp, Artificial Sequence
  Description of Artificial Sequence: Synthetic coding sequence
atggagcggtcagagaggagaaggagaaggtgccaagtagcctttagctatcttcctcagaacgacgatgagctggagctaaaagtgggggatatcatagaggtagtgggcgaggtcgaggaggggtggtgggaaggagttctgaacggtaagacaggcatgtttccatccaatttcataaaggaactgtccggggagtcggatgagcttggaatatcccaggacgagcagctctctaagtcgtctctaagggagactaccggcagcgaaagcgatggcggggactcttcatccaccaaatctgaaggggctaacgggacggtggccaccgccgccatccaacctaagaaggttaaaggagttggttttggggatattttcaaggacaaaccaattaagctgcggcctaggagcatagaagtcgaaaacgactttcttccagtggaatag

SEQ ID NO: 134230 - DNA, 627 bp, Artificial Sequence
  Description of Artificial Sequence: Synthetic coding sequence
atggagataaaaaaggaaatgaaaaaagatcctttgactaataaggctcctgagaagcccttacacgaagtgccgtcaggcaatagccttctgagctccgaaacaattctgagaacgaacaagagaggtgagaggaggcggcggagatgtcaggtggccttttcgtacctaccccagaatgacgatgagctcgagctgaaagtgggggacatcatcgaggtggtgggcgaggtcgaggagggttggtgggaaggtgtgctcaatgggaagacagggatgtttcctagtaacttcataaaagagttgtccggcgagtccgacgagctgggcattagtcaagatgagcaactttccaagtccagtcttagggagactactggttccgagagcgacggcggtgacagctcatcaactaaatcagagggcgctaatgggactgtagctactgctgccattcagccgaaaaaagttaagggcgtgggtttcggggatatcttcaaggacaaaccgattaaactacgcccgcggtccattgaggttgagaacgacttcctccccgtggagaagaccatcggcaagaagttgccggctaccaccgcgaccccagactcatctaaaaccgaatag

SEQ ID NO: 134231 - DNA, 1215 bp, Artificial Sequence
  Description of Artificial Sequence: Synthetic coding sequence
atggatagtcgcacgaagtccaaggattactgcaaagtgatcttcccatatgaagcccagaacgacgatgaattaactataaaagagggcgacatagttaccctgatcaacaaggattgtattgatgtgggatggtgggagggtgaacttaatggacggcgtggggttttccctgataactttgtgaaattgctgccgcctgacttcgagaaagaaggaaacagacccaagaagcctcctccaccgtcagccccagtcataaagcaaggggccggcacgactgagcgcaagcatgaaatcaaaaagatccccccagaacgcccggagatgctgcctaaccggacggaggagaaggaacgcccagaacgggagcccaagctggatcttcagaaacccagtgttccagccatcccacccaagaagccacgacccccaaaaaccaatagcctctcccgtcccggggccttgcctccccgccggccagagaggcctgtggggcctcttacccatacacgaggggacagtccaaagatagacctggccggttcgtcactctccggcattctggataaagatttgtcagataggagtaacgatatcgatctggaaggtttcgatagtgtggtttcgtcgaccgaaaagctgagtcatcctacgacctctcggcccaaggctacaggacggcgacccccctcacagtcactcacctcatccagtctgtccagccctgacatctttgatagccccagcccagaggaagacaaagaggagcacatctccctagcgcataggggggtggacgccagcaaaaaaacctctaagactgtgaccatctcacaggtcagcgacaacaaagccagtctgccacccaagcctggtacaatggctgcaggcggtgggggcccagctcctctgtcaagcgctgccccgtcacctttgtctagttctcttgggacggctggccaccgggccaattcccccagcctttttggcacagaggggaaacctaaaatggagccagcagccagtagtcaggcagcggtcgaggagctgaggactcaagttagagaactccgcagtatcatcgagaccatgaaggaccagcaaaaaagagagattaaacaactgctgtcagagcttgacgaggagaagaaaatccgtttacgtctgcaaatggaggtgaatgacataaaaaaggcgttgcagagcaagtag

SEQ ID NO: 134232 - DNA, 456 bp, Artificial Sequence
  Description of Artificial Sequence: Synthetic coding sequence
atgaactgggcccctgcaacctgctgggccctcctgctggccgctgccttcctgtgcgactcaggggccgcaaaaggtggccgcggtggggcccgaggctcagctcggggcggtgtcagagggggagctcggggagcaagccgggtgcgtgtcaggccagcacagagatacggggcccctggcagcagtctgcgggtggccgccgctggggcggctgccggtgcggcagcaggtgccgccgccgggctcgccgcgggcagcgggtggcgaagagctgccggtcccggcgagcgaggcctcgaggacgaggaagacggcgtccctggcggaaacggcacgggtcccggtatttacagttaccgggcttggacctcaggcgcgggtcctacacgaggccctagactctgtttggtgctaggaggtgcccttggggctttgggactactccgaccctag

SEQ ID NO: 134233 - DNA, 456 bp, Artificial Sequence
  Description of Artificial Sequence: Synthetic coding sequence
atgaactgggctccagccacatgctgggctttgctattggcggccgcttttttatgcgatagcggtgcagccaagggaggacgcggaggggctcggggctccgccaggggcggtgtgcggggaggggcccggggcgcttctagggtcagagttagacctgcacaacggtatggtgcccctggttccagcctgcgagtagcagcagccggcgctgccgctggggcagctgcgggggcggcagctggcctggcagccggttctgggtggcgcagagccgccgggccaggcgaaagaggtctcgaagatgaggaggatggggttcccgggggtaacggaaccggcccaggaatctactcctatagagcatggacgtccggcgctgggccgactagaggccctcgcctatgcctcgtattgggtggcgctttaggcgcgctgggcctgctgcggccttag

SEQ ID NO: 134234 - DNA, 981 bp, Artificial Sequence
  Description of Artificial Sequence: Synthetic coding sequence
atggcaccacctgcgggtggagctgcagcggccgctagcgatctgggctcagccgcggtgctgctagctgtgcacgccgcggtgaggccgctaggcgccggccctgatgccgaggcacagctgaggcgtctccagctctccgccgatcccgaacgcccagggaggttccgactggagctgcttggcgcaggccctggtgccgtgaatttggagtggcctttagaaagcgtcagctacacaataagggggcccacccaacatgaattgcagcctcctcctggaggaccggggacactatctctgcacttcttgaatccccaggaggctcaacggtgggccgtgcttgtccgcggagctaccgtagaaggtcagaacggctccaaatccaactcccctcccgccttaggacccgaagcttgtcccgtgtcactgccaagcccccccgaggcttccactctgaagggcccaccccctgaagccgacctgccgcggagcccaggtaacctgacggagagagaagagttggccggtagccttgccagggccatcgccggcggtgacgagaagggggccgcgcaagtagctgctgtgctcgcacagcacagagtggcactgtccgtgcagctacaggaagcttgtttccccccaggaccaatccgcctgcaggtgacgcttgaggacgccgccagcgctgccagtgcggcgtcctccgcccatgtggctctccaggtgcatccccactgcaccgtggctgccttgcaggaacaggtatttagcgagctcggattccccccggccgtacagcgctgggtcatcggtaggtgtttgtgtgtgccagaaagatcactggccagctatggggttaggcaggatggagatccagcttttctgtaccttctctccgccccaagggaggccccggcccaacttgtgctcagcttcctgcacctgcaccaatgtcccagaccgccttggctgtag

SEQ ID NO: 134235 - DNA, 1164 bp, Artificial Sequence
  Description of Artificial Sequence: Synthetic coding sequence
atggccccgcccgcaggaggtgctgctgcggctgccagtgatctaggtagcgccgcagtgcttctggctgtccacgcagccgttcgccctctgggggccggccccgacgcggaagcccaactgaggcggctgcagttgtccgcggaccccgagcggccgggcaggttccgtcttgagctgctgggagccggacccggggccgtgaacctggagtggccgctggagagcgtttcttacacaattcgaggcccaacccaacacgaactccaacctccaccagggggcccgggaacccttagcttgcattttctgaacccccaggaggcccaacggtgggcagttctggttcggggtgccactgtggaggggcagaacggttctaagtctaacagcccacccgccctgggccctgaggcttgccccgtgtccctccccagtccccccgaggcctctaccctaaagggccccccccccgaggccgaccttccaaggagcccagggaacttgaccgagagggaagaactcgcaggctcactggctagggcaatagctggtggcgacgaaaagggcgccgcgcaagtagctgcagtgctggcccaacatcgcgttgcactctccgttcagctgcaggaggcctgttttcccccggggcctataaggctacaagtgaccctcgaggacgcggcctctgcggctagcgctgcatccagcgctcatgtcgccctccaggtgcacccacattgcaccgttgctgcactgcaggagcaagtcttcagtgaattgggttttccgccggccgtgcagcggtgggtgatcggtcggtgtctttgcgtacctgaacgctccctggccagctatggagttcggcaggatggcgaccccgcatttctgtacctgctcagtgcccctagagaagcccctgcaacaggcccctcccctcagcacccccaaaagatggatggcgaactcggaagacttttcccaccctcattggggctgccccctggtccacagcccgcggccagcagcctgcccagccccttacagccctcttggtcctgtccctcgtgcactttcatcaatgcccccgaccgaccgggttgcgagatgtgcagcacgcagcgcccttgtacatgggatccccttgccgctgccagcacctag

SEQ ID NO: 134236 - DNA, 2019 bp, Artificial Sequence
  Description of Artificial Sequence: Synthetic coding sequence
atggcagacgggtccctgacaggcggtggtctggaagccgctgcaatggcacccgagagaatgggctgggcagtggagcaggaactcgcttctttagaaaaagggctgtttcaggacgaagacagctgctcagattgttcttatcgagacaaacctggcagcagcctgcagtctttcatgccagagggcaagacattcttcccggaaatctttcagaccaatcagctcctgttttacgagcgctttagagcctatcaggattatatcctggctgactgcaaggccagcgaggttcaagaatttacagccgagttcttagagaaagtcctagaacccagcggatggagagctgtgtggcatacaaacgtgttcaaagtccttgttgagattacagacgtggacttcgctgctctgaaggccgtcgttagactcgcggagccatacctctgcgacagtcaggtaagcacgtttaccatggagtgcatgaaggaattgctggacttaaaagagcatcgattaccgctgcaagagctgtgggtcgtgtttgacgatagtggggtgtttgaccaaacggcactggctatcgaacacgtgcggttcttttatcagaacatatggaggtcctgggacgaggaagaggaggacgaatacgattattttgtgcggtgcgtggaaccacgtctgagacttcattacgacattctggaggacagggtcccttctggtctgatcgttgactaccataaccttcttagtcaatgcgaggaatcctatcgcaagttcctgaacctgagatccagccttagcaattgtaactcagactctgaacaagagaatatctctatggtggagggtctaaaattgtatagtgagatggagcaattgaaacagaagctcaagctcatcgagaaccctctgctccgctacgtgtttggctatcagaagaactctaatatacaggctaagggtgtgcgaagctccggtcagaaaatcacacacgttgtctctagtaccatgatggctggtctgctgcggagccttcttaccgacagactgtgccaggagcccggtgaggaggaaagggaaattcagtttcattctgaccccttgagcgcgattaacgcctgtttcgaaggggataccgtgattgtgtgccccgggcattacgtggtccacggcacattcagtatcgccgacagtatcgaactggaaggttacggcctgcccgatgacatagttatagagaagaggggaaagggagacacgttcgtggattgtaccggagccgatataaagatctccggaattaagtttgtacagcatgacgcggttgagggaattctgatcgttcacagaggcaagacaaccctggagaactgtgtgttgcagtgcgagactacaggcgtaacagtgcgcacatcagccgagtttctgatgaagaactcagatctgtatggcgctaaaggcgcaggtatcgagatatacccaggaagccagtgcacactctctgataacggtatacaccactgcaaagagggcatccttatcaaggacttcctggatgaacactacgacatcccaaaaatatcaatggtaaacaacatcatccataacaacgaaggctacggagtggtattggtcaagccaacaatctttagcgatcttcaggagaatgcagaagatggaacagaggaaaataaagccctcaaaattcagactagtggcgaacccgacgttgctgaacgggtagatttggaagaactgattgaatgcgccacaggcaagatggagctgtgcgcccgtaccgaccccagcgagcaggttgaggggaattgtgaaattgtgaatgaacttattgctgctagcactcagaaaggccaaattaaaaagaagaggctgtcggaactgggaatcactcaggccgacgacaacctgatgtcacaagagatgtttgtgggaatcgttggcaaccaatttaagtggaacggaaaaggatcattcgggacgttcctgttctag

SEQ ID NO: 134237 - DNA, 723 bp, Artificial Sequence
  Description of Artificial Sequence: Synthetic coding sequence
atgaccgctcccgtgcccgcgccacgaatcctcctcccgctcctcctgctgcttctgctgactccacccccaggggcccgtggcgaggtctgcatggcctcgagaggcttgtccttgttcccggaatcttgtcccgatttctgttgtgggacctgcgacgatcagtactgctgttctgacgtgctaaaaaaattcgtgtggagcgaggagcgctgtgccgtgcctgaggcatccgttcccgccagtgtcgagccagtggagcagctggggagtgcattacgattccggcccggatacaatgatccgatgagtgggttcggggctactttggctgtaggtctgacaatcttcgtcttatccgtggtcacgattatcatctgcttcacctgcagctgttgttgcctgtataagacttgccgacggccccgccccgtcgtcaccacaaccacctccaccaccgtggtacacgctccatacccccaaccaccatcagtccccccctcctaccccggaccatcttaccaggggtaccatacaatgcccccccaaccagggatgcctgctgcaccatatccaatgcagtatccccctccctaccctgcccagcccatggggcctcctgcatatcacgagacactggcaggcggcgctgccgctccttaccccgctagccagcccccctacaacccagcatacatggatgcccccaaggcagcactctag

SEQ ID NO: 134238 - DNA, 339 bp, Artificial Sequence
  Description of Artificial Sequence: Synthetic coding sequence
atggcgagccggggtctctctctctttccggaaagctgtccagacttttgctgcggcacctgcgatgatcagtattgctgctcagatgtgctgaaaaaattcgtctggagcgaggagcgttgtgcagtcccagaggcatcagtccctgcttccgtggagcccgtagagcagctaggatccgctctgaggtttagaccaggatataacgatccaatgtccgggtttggtgctaccctggccgtgggtttgaccatcttcgtcctctccgttgtgacaatcattatctgcttcacctgctcctgctgctgcctgtacaaaacgtgtaggcggccaaggtag

SEQ ID NO: 134239 - DNA, 414 bp, Artificial Sequence
  Description of Artificial Sequence: Synthetic coding sequence
atgggatttggggccaccctggctgtagggctgacgatattcgttctgagcgtggtgactattattatctgtttcacatgtagctgctgctgcctgtacaaaacatgccgcagacccaggcctgtggtgacaaccaccacgagtaccacagtggttcacgctccttacccgcagccaccgtccgtacctccttcctacccaggacctagctatcaggggtatcacaccatgcctccccaacccgggatgcctgccgccccctaccccatgcagtacccccccccatacccagctcaacctatgggaccacctgcttaccatgagacactcgcgggcggagcagccgctccgtaccccgccagtcaacccccctataatcccgcgtacatggatgctccaaaggcagctctctag

SEQ ID NO: 134240 - DNA, 630 bp, Artificial Sequence
  Description of Artificial Sequence: Synthetic coding sequence
atggcctcacgcgggctgtctttgtttcctgagtcttgcccagacttttgttgcggaacctgcgacgatcagtactgctgctccgatgtattgaagaaattcgtctggtcggaggagcgctgcgccgtcccggaagcctctgttcccgccagtgtggagccagtcgagcagctgggaagtgcattgagattccgccctggatacaatgatcccatgagtggcttcggtgctaccctggctgtgggtctgactatcttcgtgctgagcgtggtgaccattattatttgtttcacgtgttcctgttgttgcctgtacaagacctgtaggagacctaggcccgtcgtcactacgaccacctccaccacggtggtgcacgcaccttacccacagcctccttcggtgcccccatcttaccccggccctagctatcaaggctaccatactatgcctccccagcctggtatgcccgctgcgccctatccaatgcagtatccgcccccatacccggctcagccaatgggcccacccgcataccatgaaacactcgcgggaggtgccgcagccccataccctgccagccaacctccttacaacccggcctacatggacgcacccaaggctgccctgtag

SEQ ID NO: 134241 - DNA, 630 bp, Artificial Sequence
  Description of Artificial Sequence: Synthetic coding sequence
atggcctcacgaggcctgtccctcttccctgagtcctgtccagacttttgctgcggtacctgcgatgaccagtattgctgctctgacgtactgaagaagttcgtctggagtgaagagcgctgtgctgtcccagaggcaagcgttccggcgagcgtggaacctgtggagcagctggggtcagcgctgcgttttagacctggatacaacgacccaatgtctgggttcggcgctacactcgccgtcggcctcactattttcgttctgagtgtggtgacaatcattatctgctttacgtgtagctgttgttgcctgtataagacttgccgtcgccccagacccgtcgtgactacaactacttccactacagttgtgcatgcaccctacccacagcctccaagcgtgcccccctcatatccgggaccatcttaccagggatatcacactatgccaccacagcctggaatgccagctgccccttatcccatgcagtaccctccaccatatccagcccaacctatgggaccacccgcttaccacgaaaccttggcgggtggtgcagctgccccgtatccggcatcccagccaccttacaatcccgcctatatggacgccccaaaagctgccctttag

SEQ ID NO: 134242 - DNA, 513 bp, Artificial Sequence
  Description of Artificial Sequence: Synthetic coding sequence
atgcctccacagccaggctgccagcaacaccctacacagtgctctactcatcatcttacacagccctcaccctgggctcatcggcccactaccaggccctggcttgaagagcaaccccggcccacgccgcccgctagcctgcttaccacaagaccaacctggatgccgcgagggggccccctttcgatcccatggccgctctggctgccactgggttacgtcgtgtgtgtcagagagtggtgtgctggagccgtgccctatgcgccgtgtgtgctgtgcgtttcctgcctctacatgtggctgccactcatgttgaccagatgggggaccatccttgcccgggtgggctgggaccaaacacttttttcttcttcaccagaaatcatgctgcccaagatatcttctcagacccagcgaatgggatggtggggagccccctgcgaggtcgccccagaaagatggggacctttacagggtacaagtggcgtgcttctgcagcttaccctcggctag

SEQ ID NO: 134243 - DNA, 666 bp, Artificial Sequence
  Description of Artificial Sequence: Synthetic coding sequence
atgcgccgggttttgagacttttgttgggttgcttcctcaccgagctgtgcgctcgagtgtgccgcgctcaggagcgcgcgggccatggacaattggctcagctaggaggagtgctgctcttggccggaggtaatcggagcggagcggcgtctggcgaggcttctgagggggctgaggcttcagatgcaccccccactcgtgcccccacacctgatttttgtcgcggttacttcgacgttatgggccaatgggacccaccattcaactgttcttcaggcgatttcattttctgttgcgggacctgtggatttcgcttctgctgcacgttcaaaaaaaggcggcttaatcaatcaacatgtaccaactatgacactccgctatggctaaacacgggtaagccacctgcgcggaaagacgatccacttcatgatcccactaaagataaaaccaacctgatcgtgtacatcatttgcggcgtggttgccgtgatggtacttgtgggtattttcaccaaactcggacttgaaaaggctcatcgccctcagcgggagcatatgtcaaggctctacgacaacttattgtttatggaagctcaaatttcttttcaggaggacgaacctgcccccggcgagtggtcagtgggcttgcagacatggacggtgtag

SEQ ID NO: 134244 - DNA, 1275 bp, Artificial Sequence
  Description of Artificial Sequence: Synthetic coding sequence
atgcggcgagtgctgaggctcctactcgggtgctttctgacagaactttgcgctcgggtctgcagagcacaggaaagggccggccacggtcaattagcgcagctgggtggggtgttattgttagcaggagggaatcggtcaggagcagccagcggtgaggcatcagagggagccgaggcgagtgatgcccctcccactcgggcccccacacccgatttctgtcgcggctatttcgacgtaatgggacagtgggaccctcctttcaactgcagcagcggagacttcatcttctgctgcgggacctgcggattcaggttttgttgtaccttcaaaaagaggaggctcaaccaaagtacatgcaccaactatgatactccgttgtggctcaatacaggaaaaccaccggcacgtaaggatgaccctctgcacgatcctaccaaggacaagaccaacctcatcgtttatatcatctgcggcgtggtcgccgtgatggtgttagtgggtattttcacaaaactgggactggagaaggcccaccggccccagagagagcatatgagtagggccctcgcggacgtgatgagaccccagggtcactgtaacacagatcatatggaaagagacttgaatatagtcgtgcatgttcaacattatgaaaacatggacacaaggacaccgatcaacaacctccatgccacgcagatgaataacgcagtacctacaagcccccttttacagcagatggggcacccccattcttatcccaacctgggacaaatcagtaatccatatgagcagcagccacctggcaaggaattaaacaagtatgcgtcgctgaaggctgtgggcagctctgatggcgactgggctgtgtctaccctgaagagtccgaaggccgacaaagtgaacgacgacttttatactaagcggcggcacctggccgaattggctgcaaagggtaatcttcccctccatcccgtgcgtgtagaagatgagccccgggctttctctcctgagcacgggcccgccaagcagaatggccagaagtccagaactaacaaaatgccccctcatccactggcatatacctcaactacgaacttcaagggctgggatccaaatgagcagtcgctgcggaggcaggcttactccaataaaggcaaattgggaacagctgaaaccggttcttctgacccgctggggacccgcccccagcactatcctccccctcagccctatttcattacaaattccaagaccgaggtgactgtctag

SEQ ID NO: 134245 - DNA, 789 bp, Artificial Sequence
  Description of Artificial Sequence: Synthetic coding sequence
atgtgcggccctcgccggctcgctgctccaggaagtagcctcggttcattcggacgggcatcccgaggtggacggaggggaagcagcggcggcagggcggccgagcctggcctgggagacactatgcgccgggttcttcggctgctactgggatgctttctcactgagctctgtgctcgtgtgtgtagggcccaggagagggccggccatggacagctggctcaactcgggggtgtcctgctgcttgcgggtggcaacagatctggcgccgcgtctggcgaagcctctgagggcgctgaggcgtcagatgctcctccaacaagagctccaacccccgatttctgtcgtggatatttcgatgtcatggggcagtgggacccccctttcaactgtagcagcggggacttcatcttctgttgtggcacctgcggcttccgtttctgctgtacctttaaaaagcgccgtctgaaccagtctacatgcactaactatgacacccctctttggctgaataccggaaaacccccggcccgcaaggatgaccctttgcatgatcccactaaggacaagacaaatctgatcgtgtatatcatctgtggagtggtggctgtcatggtcctggtggggatcttcacgaagctggggcttgagaaagcgcaccgcccccaacgcgaacacatgtcaagactctacgacaaccttctttttatggaagcccagattagtttccaagaagacgagccagcccctggcgaatggagcgtgggtttgcagacctggacagtgtag

SEQ ID NO: 134246 - DNA, 1398 bp, Artificial Sequence
  Description of Artificial Sequence: Synthetic coding sequence
atgtgcggccctcggcgtttggccgcgcccggaagtagtctgggctcgtttgggcgagccagtagggggggccgccgcggctcctccgggggccgggcagcagagcccggcctaggtgatacaatgcgtcgagtgctccggctgctattggggtgtttcctgactgaactgtgtgcccgagtttgtcgggcacaggaacgcgccgggcatggacaattggcccaactggggggcgtactgttgctggcaggcggaaatcggagcggcgctgcatccggggaagccagtgaaggcgcagaggcctccgatgcgcctccaaccagggctcctacacccgatttttgtcgggggtatttcgatgtgatggggcaatgggaccctccatttaactgcagcagtggagattttattttttgttgcggcacctgtggtttcagattttgttgtacatttaaaaagcgacggcttaaccagagcacttgcacaaactatgacacgcctctctggctgaatacaggcaagccgcctgcaagaaaagatgaccccctgcatgacccaactaaagacaagactaacctgatagtctacattatctgcggagttgtggccgttatggttctcgtggggatctttactaaacttgggctggagaaagcacataggccccagcgggagcacatgtcacgcgccttagccgatgtcatgcgccctcagggccattgtaatactgatcacatggaacgagatttgaacatcgtcgtccatgtccaacattacgagaacatggacaccaggactcctatcaataacctgcacgccactcagatgaacaatgccgtgccgaccagcccccttttgcaacagatgggacatccacactcctatccaaatctgggtcagattagcaatccctacgaacagcagccacctggaaaggagctcaataagtatgcttcactcaaagccgtgggctctagcgatggggactgggcagtctcgaccttgaaaagtccaaaagccgacaaggtgaacgacgatttctacacaaagagaaggcacttagctgaactggcagctaaaggcaacctccctctacatcctgtaagggtggaagacgagcctagggcattttcccctgaacacggacctgcaaaacaaaacggtcagaaaagccgcaccaataaaatgcctccccatccattggcttacaccagcacaaccaactttaaaggatgggatcccaatgagcaaagtctgcgtagacaagcctactccaacaagggcaagttagggacagccgaaacgggctccagtgacccactcggcacgcgaccacagcactaccccccaccccagccctatttcatcacgaattccaaaactgaagttaccgtttag

SEQ ID NO: 134247 - DNA, 678 bp, Artificial Sequence
  Description of Artificial Sequence: Synthetic coding sequence
atggaggaactcaccgcatttgtgagcaagtcgttcgaccagaagtccaaggacggaaatggcggcggaggtggtggaggaggtaagaaggatagcattacataccgggaggtgttagaatcaggcctcgcaaggagtagagagctggggactagcgacagctccctccaggacataacagagggtggtggccattgtccagttcacttatttaaagaccacgtggacaacgataaggagaagctcaaggagtttggtaccgccagggttgcggaggggatttacgagtgtaaggaaaagagggaggacgtgaaatctgaggatgaggatggtcagacaaaattgaaacagcgtaggagcagaacaaactttactctggagcagctcaacgaactggaacggctgttcgacgaaacccactatcctgacgcattcatgagagaagagctgagccaaaggctcggcctgtcagaggcgcgagtgcaggtttggtttcagaaccggcgcgcgaagtgtagaaaacaggagaatcaaatgcacaagggggtcatactcgggactgctaatcatttggatgcttgccgggtggccccatacgtgaacatgggtgctctccgaatgccattccagcagatggagttttgtagctgccgaccaggctggagcattatggcatag

SEQ ID NO: 134248 - DNA, 678 bp, Artificial Sequence
  Description of Artificial Sequence: Synthetic coding sequence
atggaggagttgaccgcctttgtttcaaagtcctttgatcagaagtctaaggacggaaacggcgggggcggtggcggcgggggaaagaaagactctataacctatcgcgaggtcctggaaagcggactagcccgcagcagagagctcggaacttccgattcctccctccaagacatcacagagggtgggggccactgcccagtccatcttttcaaagatcatgtagataacgataaggagaagctaaaggaattcggcaccgctcgcgttgccgaggggatctacgagtgtaaagaaaagcgcgaagacgtgaagtctgaagacgaggacggccagacgaagcttaagcaacggcggagtcgaacaaacttcacccttgaacagttaaacgagcttgaacgactgtttgatgagacacactatcctgacgctttcatgcgtgaggagttgagccaacgcttgggtctgagcgaggcgagggttcaggtatggtttcaaaaccgacgtgccaaatgccggaagcaggaaaaccagatgcataagggcgtaatcctgggaacagcgaaccacctcgacgcttgcagagtcgcaccatatgtcaatatgggtgcgctgcgaatgcccttccagcagatggagttttgctcctgcaggcccggatggtctataatggcctag

SEQ ID NO: 134249 - DNA, 879 bp, Artificial Sequence
  Description of Artificial Sequence: Synthetic coding sequence
atggaggagttaacagcattcgtgtcaaagtcctttgaccagaaatccaaggatggcaacgggggcggcgggggcgggggaggcaagaaagattccatcacatatcgcgaagttctggagtcaggcctggccaggagccgcgagcttggcacctctgacagttccctgcaggatataacggaggggggcggccattgtccagtgcacctcttcaaggaccacgtggacaatgacaaggagaaactgaaggagtttggaactgcccgcgtggctgagggcatttatgaatgtaaagagaaaagagaggatgtaaagtcagaggacgaagacggccaaactaagctgaagcagaggcgctcccggacaaatttcaccttagagcagcttaacgagctagagcgactttttgatgaaactcattatcctgatgcctttatgcgagaagagctctcacagaggctcggcctgtccgaagctcgtgtccaggtgtggttccagaacagacgcgcgaagtgtcgtaaacaggaaaaccagatgcacaaaggagtgatattagggaccgctaatcacctggacgcctgtagagtggccccttacgtgaatatgggcgctctccggatgccgttccaacaggtacaggcgcaactccagcttgagggagttgctcacgcacaccctcaccttcacccccacctggccgctcacgctccatacctgatgttcccaccgccgccctttggcctacctatagcctccctagctgagtcagccagtgccgccgccgtcgtagccgcagcggcaaagagcaattccaagaactcttctattgcagacctgcgcctcaaggcccggaagcacgcggaggccttaggattatag

SEQ ID NO: 134250 - DNA, 879 bp, Artificial Sequence
  Description of Artificial Sequence: Synthetic coding sequence
atggaagagctaacagctttcgttagtaagtcgttcgaccagaaaagtaaggacggtaatggaggtgggggcggtggtggagggaaaaaggactcaataacatatcgcgaggtgctggaatccggcctcgcgcgaagcagggagctgggaacatccgattcctcactgcaagatatcactgaaggaggcgggcactgtcctgtccacttgttcaaagaccacgtggataatgataaggagaagctcaaagagtttggcactgcacgtgtagcggagggcatttacgaatgtaaagaaaagcgggaagacgtcaagtctgaggatgaggacgggcagactaagttgaagcaacggcgttcccgaaccaacttcactttggagcaactgaatgagttagagagactgttcgacgagacccactatcctgacgcctttatgcgggaggagcttagtcagaggctgggactgagcgaggctagagtgcaggtttggttccagaatcggcgggcaaaatgcagaaaacaggaaaatcaaatgcacaagggggtaatactcgggacagctaatcacctcgacgcttgtcgcgtggcaccttacgtgaacatgggtgcattgagaatgccgttccagcaggtgcaggctcagttacaactggaaggtgtggctcacgcccacccccacctgcacccacacctggccgctcatgcaccttatctgatgtttcctccgcctccctttggacttcctatcgcatccttggccgaatccgcctccgccgcagccgtggtggccgccgcagccaagtcaaactcaaagaactcttctatcgctgacctgaggctgaaggctcggaagcatgcagaggcactaggtctttag

SEQ ID NO: 134251 - DNA, 573 bp, Artificial Sequence
  Description of Artificial Sequence: Synthetic coding sequence
atggaagatgagggccagaccaagatcaagcagagacggtccagaactaacttcactctagagcagcttaatgaattggaacggctctttgacgaaacccactatcccgacgcttttatgcgggaggagctttctcagcgcctagggctgtccgaggcacgcgtgcaagtgtggtttcagaatcggcgcgccaagtgtaggaagcaggaaaaccagctgcacaagggagttttgatcggcgctgcatcccagttcgaagcctgtagggtggcaccttacgtgaacgttggcgccctgcggatgccctttcaacaggtgcaggcacagctgcagctggatagtgccgttgcccacgcccatcatcatcttcatccacatttggctgctcacgccccttacatgatgtttcctgcccccccgttcggactgcccctggcaactctggctgccgattctgcttcagctgccagcgtcgttgctgctgccgccgcagccaagactacatccaagaatagttccatcgcagatctacggctgaaggcaaaaaaacacgctgcggcattggggctgtag

SEQ ID NO: 134252 - DNA, 996 bp, Artificial Sequence
  Description of Artificial Sequence: Synthetic coding sequence
atggaggaattgaccgcattcgtgtcaaaatcctttgaccaaaaagttaaagagaagaaggaggccatcacttaccgtgaagtgctggagagcggccccctgcgaggcgcgaaggaaccaactggatgtaccgaagccggacgcgacgatcgcagtagcccagcggtgagagccgcgggcggcggcggcgggggaggcggcggcggcggcggtgggggggggggaggaggggtgggcggagggggagcaggcggtggtgcgggcggagggaggtcccctgttcgcgaactggatatgggtgcagcggagcggagcagggagcccggctctccacgcctgacggaggtcagcccggagctgaaggacagaaaggaggacgctaagggaatggaagatgaagggcagaccaagatcaaacaacgcagatcccgaaccaattttaccctcgaacagctgaacgagctggaaaggctattcgacgagacccattatcccgatgcctttatgcgcgaggagctgtcccagcggctcggccttagtgaggccagagtacaggtctggtttcagaatcggcgggcaaagtgccgtaaacaggagaaccaacttcataagggagtactcatcggcgctgcctcacaattcgaggcctgccgcgtggccccgtatgtgaacgtgggcgcactccgcatgccctttcagcaggattctcattgcaatgtgacgcccttaagctttcaggtacaagcgcagctgcagctggacagcgcagtggcacacgctcaccaccatttacacccacacctggcagctcacgcaccttatatgatgttccccgcaccgcccttcggactgcccctggcaactttggccgccgattcggcctcagctgcctccgtagtagcagctgcggcggcagctaaaacaacatccaagaattcctcaatcgcagacctgcgcctcaaggcaaagaaacatgcagcagcgcttgggctgtag

SEQ ID NO: 134253 - DNA, 1068 bp, Artificial Sequence
  Description of Artificial Sequence: Synthetic coding sequence
atggaagaactaaccgcttttgtatcaaagagcttcgatcagaaggtcaaggaaaagaaggaggcaattacttatcgggaagtgttggaatccgggcccttgaggggagccaaagagcctacgggatgtacggaggcagggcgagacgaccgatcaagccctgccgtcagggcggccggtggcggtggcggtgggggtggcggtggtggtggcgggggcggcggcgggggggttggcggcgggggggctggagggggggcgggcggggggcgttcgccggtgcgggagttggatatgggggccgcagaaaggagccgggagcctggatctccaaggttgacagaaggtagacgaaagccaacaaaggccgaggtgcaagctaccctgctgctgccaggtgaagcgttcaggttcctcgtttctcctgaactcaaggacagaaaagaggatgcgaagggaatggaggacgaggggcagaccaaaatcaagcaacgcagaagccgcactaactttacgcttgagcagcttaacgaattggaaaggctgttcgatgaaacccactatccagacgccttcatgagagaagagctcagccaaagactgggtctttctgaggctagagtgcaggtgtggttccagaatcgaagagccaagtgccgcaaacaggagaatcagctgcacaagggcgtgttgatcggagctgcgagccagtttgaagcctgtagggtggcaccgtatgtaaacgttggcgcacttcgcatgccctttcagcaggactctcactgcaatgtaacccccctgagttttcaggtccaggcacagctgcagctagattctgctgtggcccatgcccaccaccacctgcatccccatttagcggcccatgcgccttatatgatgttcccagcgcccccgttcggcctgcctttggcaacactggccgccgacagcgcgtccgcagcctcagttgtggctgcagcagccgccgccaaaaccacgtctaagaattcatctatagctgatctacgcctgaaggctaagaagcatgctgctgcgctggggttatag

SEQ ID NO: 134254 - DNA, 573 bp, Artificial Sequence
  Description of Artificial Sequence: Synthetic coding sequence
atggaggacgaaggccagactaaaattaagcagcgacgctcacgtactaacttcaccctggagcaactaaatgagctggagagactgtttgatgaaactcattatccagatgcttttatgcgagaggaactatctcagcgcttggggctcagcgaagctcgagtgcaggtgtggttccaaaacagacgagccaagtgtagaaagcaggaaaaccagctgcataaaggtgtgttgatcggcgcagccagtcagttcgaggcctgtcgcgtggccccttacgtgaacgtcggtgctctgcggatgcccttccaacaagttcaggctcagctgcagctcgactctgccgtggcacatgcccaccatcatcttcaccctcatctggctgctcatgcaccatacatgatgtttcctgctcccccattcggactgcccctcgccaccctggcggccgactccgccagcgcagcatctgtagtagcagctgctgcagccgctaaaaccacctcaaagaacagctcaattgccgatctgaggctgaaggccaaaaagcacgccgccgctctcgggctttag

SEQ ID NO: 134255 - DNA, 573 bp, Artificial Sequence
  Description of Artificial Sequence: Synthetic coding sequence
atggaggatgaaggtcagactaagattaaacagagaagaagccgcaccaacttcactctggagcagttgaatgaactcgaacgcctcttcgatgagactcattaccctgatgccttcatgagagaggaactgtcacagcgcctagggctgtctgaggcgagggtgcaggtttggttccaaaacagacgcgcaaagtgtagaaagcaggaaaatcagcttcacaaaggagtgctcatcggcgctgcctcccagtttgaggcatgcagggtggctccttatgtcaacgtgggtgccctcaggatgccattccagcaggttcaggctcagctccaactggatagtgccgttgcacacgctcaccatcacctgcatccccatctcgcagctcatgctccctacatgatgtttcccgctcctccctttggtctacctctcgctacccttgctgccgattccgcctcggctgcatccgtggttgctgccgctgccgctgctaagactaccagtaagaacagctccattgccgacctcaggctgaaagcaaagaagcatgccgcagcacttggcctatag

SEQ ID NO: 134256 - DNA, 1734 bp, Artificial Sequence
  Description of Artificial Sequence: Synthetic coding sequence
atgcttactcccgcattcgacttaagtcaagatcccgatttcctgacgatcgcgatccgtgttccgtatgccagggtcagtgagttcgatgtttacttcgagggctctgacttcaagttttatgcaaagccctatttcctgaggttaacactccctggtcgcatcgtggaaaatgggtctgaacagggttcttatgacgcagataaaggaatctttaccattagactgcctaaggagacacctggtcaacattttgagggtctcaacatgctaacggcacttttagcgccaaggaagtccagaaccgcaaagcccctggtagaggagattggagcttccgaaattccggaggaggtcgtggacgatgaggagtttgattgggaaatcgagcagactccctgcgaggaagtcagcgaatccgccctgaaccctcagtgccactacgggttcggcaaccttcgctctggtgtgctccaacgccttcaggatgaattatctgatgttatcgatatcaaagatcccgatttcacccctgctgccgaaagacgccagaagcggctcgcggctgaactagccaaatttgaccccgatcattatttggcagacttcttcgaggacgaagctattgagcaaatcctcaaatacaacccctggtggaccgataaatactcgaagatgatggccttcctagaaaaaagtcaggagcaggaaaaccatgccaccctcgtgagctttagcgaggaagagaaataccagttgcggaaattcgtgaataaatcttacctgctagacaagagagcttgtcgacaggtctgttatagcctgatcgatattctgctggcttattgttacgaaacccgcgtcacggagggggagaagaacgttgagtctgcctggaatatacggaagttatcaccgacgctctgctggtttgagacctggactaacgtacacgatatcatggtatcttttgggcgaagggtgctttgctaccccctctaccgacactttaagttggtgatgaaagcttacagagacaccatcaaaatcctccagctcggtaagtcagccgtccttaagtgtttgttggacatccacaagatctttcaagagaacgaccccgcttatatactgaacgatctatacatctcggattattgcgtctggatccaaaaagttaagtctaaaaagttggcagcactggcggaagccctgaaagaggtgagtctgacaaaggcccagcttggactagagctggaggagctggaggcagctgccctgcttgttcaggaagaggagactgcgcttaaagccgcgcatagcgtctcgggccagcagacactgtgtagcagtagcgaggcatcagactcggaagactcagactcttccgtgtcgtccggtaacgaggactccggtagtgactctgagcaggatgagctgaaagacagtccctccgagacggtcagttctcttcaaggaccgttcttagaagagtccagtgccttcctcatagtggacggaggtgttcgccggaatactgcgatccaggaaagcgacgcgtcgcaggggaagcctttagctagttcctggcccctaggcgtgtcaggacccctgattgaagaactaggagagcaattaaaaacaaccgtgcaggtgagtgagccaaagggcacaaccgcggttaatagatcaaatatccaagagagagatggatgtcagactcctaataactag

SEQ ID NO: 134257 - DNA, 4851 bp, Artificial Sequence
  Description of Artificial Sequence: Synthetic coding sequence
atggagggggcggaacctagggcacggcctgagagactcgctgaagccgaaaccagggccgcagacggcggccgtctggtggaagtgcagctgagcggaggcgcaccctggggctttacactgaaaggaggtagagagcacggtgaaccgctcgtgataacaaagatcgaggagggaagcaaggcagcagcggtggacaaacttttagcgggggatgaaatcgtgggaatcaatgacatcggtctatcaggttttagacaggaagctatatgtttggtcaaaggaagccataagactctgaagttagtagtgaagagaaggtcagaacttgggtggcggccccactcttggcatgctaccaagtttagcgattcccaccctgagcttgctgcctctcctttcacatcaacctccggctgcccctcctggtctggacgacatcacgcatcgtcatcatcccatgacctcagcagctcttgggaacaaactaacctgcaacgcactttggaccacttttcctctttgggatccgtcgacagcttggaccatccttccagcaggctgagcgtcgcaaaatccaatagctccatagatcatctgggttcacactccaaacgtgattccgcatacggaagtttttctaccagctcaagcacacccgaccacaccctgtcaaaggccgacacaagttccgccgagaatatcttatacactgtggggttatgggaggcaccacggcaagggggcagacaagctcaggctgcaggcgacccacaggggtcagaagaaaagctttcctgcttcccacctcgggtaccgggtgactcgggaaagggcccacgtccagagtacaacgctgagcctaaacttgctgcaccgggacgcagcaacttcggccccgtctggtacgtgcccgataagaaaaaagctccttccagtccaccccccccgcctcccccgctgagatctgacagcttcgccgctaccaagtcccacgaaaaggcccaaggcccggtgttcagcgaagctgcagctgctcagcattttactgcactagcccaagcgcagccacgaggagaccgacgtccagaactcacagataggccttggcgcagtgcgcatcctgggagcctagggaaagggtcaggaggccctggatgcccacaggaggcgcatgctgacggatcgtggcctcccagcaaagacggtgcttcctcgcggctgcaggcttcattgtccagctctgacgtgagattccctcaatctccacacagcgggaggcatccccccctgtattctgatcactcaccactgtgtgcggactctctggggcaggaacccggcgcagcttccttccaaaacgatagtccccctcaggtaagagggctgagctcctgcgatcagaaactggggtctggatggcaggggccgcggccatgtgtccagggggatctgcaggccgcacagctgtgggcaggttgttggccctccgacacagcgttaggtgccctggaaagtctgccccctcctacggtcggccagtctcctaggcatcacctccctcaaccggaagggccccccgacgctcgcgagacgggccgatgctatcccctggacaaaggtgcagagggctgtagcgctggagcccaggagccacccagagcgagcagggctgagaaagcctctcagcgactggccgcgagtattacttgggccgatggtgaaagtagccgaatctgcccgcaggagacgcccttactgcattccctcacccaagagggcaagagacgccccgaatcatctccagaagattccgcaacacgtccccccccttttgatgcccacgtgggaaaaccaacgcgacggagcgatagattcgcaaccaccctccgaaacgaaattcagatgcatcgtgcaaagctacagaagtctcgttctactgttgctttaacggccgctggtgaggccgaagacggcacagggcgctggcgcgccgggctgggaggaggtacccaagaagggccccttgccggcacatataaggatcacctcaaggaagcccaagcacgcgtacttcgggccaccagcttcaagcgtcgagacctggatcctaaccctggagatctgtatcctgagagcctggaacacaggatgggtgaccccgatactgtgcctcatttttgggaagcaggtcttgcgcaaccacccagcagtactagtggtggtccacacccccccaggattggggggaggcgccgctttacagccgaacagaaactcaaatcctacagcgaaccagaaaagatgaacgaggttggtctgacccgtggctattctcctcatcaacaccccagaacaagtgaagatacggtcgggactttcgctgaccgctggaaatttttcgaagagacttcaaagccggtccctcaacggccagcccagaagcaggccctgcatggcattccacgagacaagcctgagaggcccaggaccgctggccgcacgtgtgagggaacggaaccttggagccggaccacttctcttggtgatagcctcaatgcccactcagcggctgagaaggctgggacaagcgatttgccacgccggctgggtacatttgctgagtatcaggcctcgtggaaggaacaacgaaaacccctggaggccaggtcttctggacggtgtcactcagcagatgatattctggatgtcagcttggacccacaggagcggcctcagcacgtacacggccgatcaagaagtagtcctagtacagaccactataagcaagaagcaagcgtggaactgcgtagacaggctggagaccccggggagccaagagaagagcttcccagtgcggtgagagccgaggaagggcagtccaccccacggcaggccgacgctcaatgccgcgaggggtctcctgggtcccagcagcatcctccaagccaaaaagcccctaaccctccaaccttctcagagctgtctcactgcaggggggctcccgagctgccgcgggaggggcgcgggagggcggggaccctgcctagggactacagatattctgaggaaagcactcctgccgacctgggccccagagcacagagcccggggagccctctgcatgcgcgcgggcaggactcctggccagtctcaagtgcactcttatctaagagaccggcccctcagcggccgcctcccccaaagcgggagccacggagatacagagccacagatggcgcccctgctgacgcccctgtgggagtgctagggcgtcctttccctaccccctcacctgccagtctcgacgtttacgtagctcgtctgtcgctaagccacagccctagcgtcttttccagtgctcagccgcaagacactcccaaggctactgtatgtgagcgcggcagtcagcacgttagcggtgacgccagccggcccttgcctgaggctctgcttcctcctaagcagcagcatctgaggctgcagaccgctaccatggaaaccagccggtcccccagccctcagttcgctcctcagaaactcactgataagccaccattactgattcaagacgaggatagtactcggatagaacgtgtgatggataacaacaccactgttaagatggtccccattaagattgtccacagtgaatctcaaccagaaaaagaatccagacaaagcttagcatgccccgcagaacccccagcactgccacacgggctggaaaaggaccagataaaaacgctaagtacctcagaacagttctactcgaggttttgtctgtacacccgccagggcgctgaacctgaggcgccccacagagctcaacccgcggaaccccaacctttgggcactcaggtccccccagagaaagaccgttgcacatccccccccggactgagttacatgaaggccaaagagaagactgttgaggacttaaagtccgaggagcttgccagagagattgtcggtaaagacaaatcactcgcagacattttggacccaagcgtcaagattaaaacaacgatggacctcatggaaggaatcttccctaaagacgagcatttgctggaggaagcccaacagagacggaagctgctgccaaagatcccttctcccaggagtacagaggaacggaaggaagagccaagtgtgccggctgcggtaagcctcgccaccaattcaacttactactccacttctgcgcctaaagcagaacttctcattaaaatgaaagatttgcaggaacagcaggagcatgaggaggatagcgggagcgatttggatcacgatcttagcgtgaagaaacaggagctaatagagtccatttcgcgaaagctgcaggtcctgagagaggcccgggagtccctcctagaggatgtgcaagccaataccgtgcttggggcagaggtggaagcgattgttaaaggcgtttgcaagccctccgagttcgataagtttcggatgtttatcggcgacctcgataaggtcgtgaacctgctgctgagcctcagtggtaggctcgcacgggtggagaacgctcttaacaacctggatgacggggcatcccctggcgacaggcaatcactccttgaaaagcaacgagtgctgatccagcagcacgaggacgctaaggaactgaaagaaaatctggacagaagggagagaatcgttttcgacattctggccaattacctgtcagaggaatctcttgccgactatgaacacttcgttaaaatgaagtctgccctgatcattgaacaaagagaactagaggacaaaattcacttaggggaagaacagctgaagtgcttactggatagtctccagcctgagagaggcaagtag

SEQ ID NO: 134258 - DNA, 1356 bp, Artificial Sequence
  Description of Artificial Sequence: Synthetic coding sequence
atggagacctctaggagtcccagtcctcagtttgccccgcaaaagctcaccgataaacctcccttgctgatccaggatgaggacagtacgagaatcgaaagggtgatggataataatacaacagtgaagatggtgcccatcaaaatcgtgcattccgaatcacaaccagagaaggaaagccggcaaagccttgcttgccccgcagagccccccgccctgcctcacggcctcgagaaggatcaaattaagactctcagtacttcagaacaattctatagtcggttttgtctgtatacacgtcagggggcagaaccagaagctccacatcgggcccaacctgccgagccccaaccgctaggcacccaggtccctcccgaaaaagaccgatgtacatctccacctggactgtcctacatgaaggcaaaggagaagacagtggaggacttgaagagcgaggagctcgcccgggagatcgtaggtaaagataagtctctcgccgacattctcgacccgagcgtcaagattaaaacaactatggatctgatggagggaatcttccctaaagatgaacacttgttggaggaagcccagcaacggagaaagctgctcccaaagatcccatctccccgttccacagaggagcgcaaggaggaaccatctgttcccgctgccgtgtctcttgccactaacagcacctactacagcacatctgcgccaaaagccgaactcctgatcaaaatgaaagatctgcaagagcaacaggagcacgaggaagatagcggctcagatctcgatcacgatttgtcagtgaaaaagcaggagctgatcgagagtatttcccggaagctacaagtactccgcgaagcgcgcgagagcttgcttgaagatgtccaggcgaatacagtattgggcgccgaggttgaagcgatcgtgaaaggagtctgtaaaccatccgaattcgataagtttcggatgtttatcggcgatctagacaaggtggtgaatctgctgctatcactgtccggcagactcgccagggttgaaaatgccctgaataacctagatgacggcgcctcccctggcgacagacagagcctgctggagaagcagagggtgctgatacagcagcatgaagacgccaaggaactgaaagagaacctggaccgcagggagcgaatcgtgttcgacatccttgctaattacctgtcagaggaaagcctggccgactacgagcactttgtcaagatgaagagtgccctaataatcgagcagagggaacttgaagataaaattcaccttggagaggaacaattgaaatgccttctcgattccctccagcccgagagaggcaagtag

SEQ ID NO: 134259 - DNA, 1128 bp, Artificial Sequence
  Description of Artificial Sequence: Synthetic coding sequence
atggagacctctcggagtccatcgccccagtttgctccgcagaagctgacggataagcccccactgctcatccaggacgaggacagtacacgtatcgaaagggtgatggacaataacaccaccgtgaagatggtccccattaaaatagtccatagcgagtcccagcctgaaaaggaatcccggcagagcctggcgtgccccgcagaaccgccagctctgccccatggattggaaaaggaccagattaagacgctttcaacgtccgaacagttctacagcaggttttgtctgtacacccggcagggagccgaacctgaggcacctcatagggcacagcccgcggaaccccagcccctgggaacacaggtgccccccgaaaaggatcgatgcacctctcctcccggtctgtcatatatgaaagccaaagaaaaaactgttgaggatctgaaatctgaggagctcgctcgggagatcgttgggaaagacaagtctttggccgacatcctggacccaagtgttaagataaagacgaccatggatctgatggagggcatcttcccgaaggacgagcatctgctggaagaggcacagcagaggaggaagctgcttcctaagattccaagccccagatcaacagaagagcggaaggaggagccaagtgtccctgcagccgtgagcctggccacaaattctacgtactattccacttccgccccgaaggcagagttgctgattaagatgaaagatttgcaagagcagcaggagcacgaagaggactccggcagcgatttagaccatgacctgtccgtgaagaaacaggagctgatcgagtctatcagcaggaaactgcaggtgctgcgcgaggctcgagagtcattactcgaggatgtgcaagccaatacggtcctgggtgccgaagtggaggccatcgttaagggcgtctgcaagccttctgagtttgataagtttcgaatgttcattggagatctggataaggttgtcaacctgctattatctctatcagggaggttagctagagtagaaaatgcactcaacaatttagatgatggcgcctcaccgggggatcgtcagtcccttttggaaaaacagcgagtcctcatacagtag

SEQ ID NO: 134260 - DNA, 1203 bp, Artificial Sequence
  Description of Artificial Sequence: Synthetic coding sequence
atggaaacctcacggtcaccaagcccccagtttgcaccccagaaactgaccgacaagccacctttgctcattcaggatgaagactctactagaattgagcgggtgatggacaacaacacgaccgtaaaaatggtacctatcaagatcgtacatagcgaatcgcaaccagagaaggaaagccggcaaagcctggcttgtcctgccgagcctcccgccctgccacatggcttggagaaagaccagattaaaaccctgtctaccagcgaacagttttactcccggttctgcctctatacccgacagggtgccgagcctgaagcccctcacagagcgcaaccagcggagccgcagccacttggaacacaggtccctcccgagaaggaccggtgtacaagtccccctggcttgagctatatgaaggccaaagagaaaacagtggaagaccttaagtctgaagaactagccagagagatcgtaggaaaggacaaatctctcgcagatatcctcgacccgtctgttaaaatcaaaacaaccatggatctaatggagggaattttcccaaaggacgagcacctattggaagaggctcagcagaggcgcaagcttctccctaaaataccatccccaagatcaaccgaggagaggaaggaggaaccctcagtaccagcagctgtgtcgctggcgaccaattcaacctactatagtacaagcgcccctaaggctgagctgctgatcaaaatgaaggacctacaggagcagcaggaacacgaggaagactctggaagcgatctggaccacgacctctcggtgaaaaagcaggaactcatcgaatccataagtaggaagttgcaggtcttacgggaggccagagagagcctgttggaggacgtgcaagcaaacacagtcctcggggctgaagtggaagcaatcgtaaagggagtttgtaagccaagcgagttcgataaatttcgcatgttcattggcgacctggacaaggtagtcaatctgctgttatccctctcggggcgcctggctcgcgtggaaaatgctctcaacaacctggacgatggggcgtcgcccggtgatagacaaagtcttctggaaaaacagagggtacttattcagcagatgtgcgtcgatttcatgctggacacctaccattcccccatcaatagaagttcgtgccttacagtcaccaagtag

SEQ ID NO: 134261 - DNA, 777 bp, Artificial Sequence
  Description of Artificial Sequence: Synthetic coding sequence
atgagggaacgagcccctcccccaccaccccctagccaagagactcctgtttatagcatggacgacttccctcctccgcctcctcatacagtctgcgaagcacagttagacagtgaggacccagaaggcccccgtccatctttcaataagctctcgaaggtgactatcgcccgcgaacggcacatgccgggcgcggcgcatgtcgtgggaagtcagacactggctagcaggctgcagacatcaattaaaggtagcgaagctgaaagcaccccaccaagctttatgagtgtacacgcccagctggctgggtcgttgggtgggcagcccgcaccaattcaaacgcaatctctgtctcatgatcctgtcagcggcacccagggcctggaaaagaaggtcagccccgacccccagaaaagttctgaagacattcgcaccgaggcgttggcgaaagaaatcgttcaccaggacaaatctctcgccgacatcctcgatcccgatagccgcctcaaaacaactatggatctgatggaggggctgtttcctcgggacgtaaacctcctcaaagaaaactccgtaaaaaggaaggccatacaacgaaccgtgtcttcatcggggtgcgagggcaagcgtaatgaggataaggaggccgtatcaatgctcgtcaattgtccacaaatctcctttcctagactgggcccatggctatgccctcagaccagcagagtctccccttttctgctcggtgccgtcctttcagttgtcttttcacagcactag

SEQ ID NO: 134262 - DNA, 5991 bp, Artificial Sequence
  Description of Artificial Sequence: Synthetic coding sequence
atgatgcggaccacggaggattttcacaagccttctgccacgctgaacagcaacacagccaccaaaggccgctacatctatctggaagcctttctggagggaggggccccatggggcttcaccctgaaaggggggcttgagcacggggaacccctgatcatcagcaaggtggaggagggggggaaagccgacactctttctagtaaactgcaggccggggacgaagtcgtccacatcaacgaggtgaccctgtcatctagtcgaaaggaggctgttagcttggtcaaaggatcatataaaactctgcgactggtggttcgccgggacgtttgtaccgatcccggccacgccgataccggcgcttccaactttgtctctcccgagcacttaacttcaggcccccagcatagaaaggcggcgtggtctggaggtgtcaagctccgcctgaaacatcgcaggtcagagccagcaggccgcccccatagctggcacaccactaaaagtggagagaaacagcccgacgccagtatgatgcaaatatcccagggaatgataggacccccttggcaccagagttaccacagtagctccagcaccagcgatttgtccaattacgaccacgcgtatctccgcagatcacccgaccagtgctcttcgcagggctcaatggagtctttggagccctcaggggcctaccctccatgtcacctgtctccggcaaagagtactggatccatcgatcagttatcccattttcataacaaaagagacagcgcatactcatctttcagtacaagctcctcaattctggaataccctcacccagggatctccggaagggagcggtcaggaagcatggataatactagtgcccgaggtggactgcttgagggcatgaggcaggccgatattagatacgtcaaaacagtgtacgacaccagaaggggcgttagtgccgaatacgaagtgaactcatctgctctgcttttacaaggacgtgaggccagagcttctgcgaatggacaaggatacgataaatggtcgaacatcccacgcggcaagggagtccctcccccctcttggagtcagcaatgtccttcgtcgctggaaacggcaacagacaatctgccacctaaggtgggcgcacctcttccgcctgcgcggtcagacagttacgccgcctttaggcacagggaaagacccagtagctggtcatcactggaccagaagcggctgtgcaggccccaggcaaactcactgggatctcttaaaagcccctttatagaggaacagctgcataccgtgctagagaaatcgcccgaaaatagtcctccagtgaaaccgaagcataattatactcagaaggctcagcccggccaacccctactgcccacctcaatctaccccgttccttcccttgaacctcactttgcacaagtaccgcagccaagtgtcagctccaacggaatgttataccccgccctggctaaggagagtggatatatcgcaccacagggagcatgcaacaagatggccacaattgatgagaatggcaaccaaaacgggagcgggcgccccggatttgcattctgccagcccctagaacacgatttgctgagtcccgtggaaaagaagcccgaggctactgcgaagtatgtccccagtaaggtacacttctgttcagtacccgaaaacgaggaggacgcttcactgaagcgccatctcacaccgccacagggtaatagccctcactccaacgaacgtaagagcacccatagcaacaagccttctagccacccacacagcctgaaatgtcctcaggctcaagcctggcaggccggggaggacaaacgatcttccaggcttagtgagccgtgggagggggactttcaagaagaccataacgcaaatttgtggaggcgcctggaacgggaaggcctgggccagtccctttctggaaacttcggcaaaaccaagagcgccttcagctcacttcagaacatcccagagtccctcagaaggcattcatcccttgagctgggcagaggaactcaagaggggtacccaggtggcagaccaacttgcgctgtaaacacaaaggccgaagaccctggcagaaaagctgccccagatctggggtcacacttggatcggcaggtgagctaccctcggcccgaaggacgtactggggccagcgcttcatttaactcaaccgacccgtctccagaagagcctcctgccccttcacacccccacacttcaagtttgggtaggcgtggaccaggtccaggtagcgcttccgcattgcagggtttccagtacggcaagcctcattgtagtgttttagagaaggtgagtaaattcgagcagagggagcagggctcccagcgacctagcgtgggaggatccggcttcggtcacaattacaggcctcaccggacagtatctacgtccagcacttccggcaatgatttcgaggaaactaaggcccacatccgtttctccgagagtgcagagccactgggcaatggcgagcagcatttcaagaatggggagctgaaactggaggaagcgagtcgccagccatgtgggcagcagttaagcggaggcgcctctgactctggccggggcccccagcggccggacgcgcgcctgctccggtcccaaagcaccttccagttgtcttcagagcctgagcgcgagccagagtggcgggatcgccccggatccccagagagtccattactagatgcacccttttccagagcctacagaaacagcatcaaagacgcccaatcaagagtgctgggggcaaccagctttcgccgacgtgaccttgaacttggagcacccgtagccagtaggtcgtggagaccacggcctagctctgctcatgtgggcttacgaagccctgaggccagcgcgtctgcttccccacacacgccccgggagaggcatagtgtaacccctgccgaaggagatctagctaggccagttccacctgctgccagacgaggcgccagaaggcgtctcacacctgagcagaagaaaagaagctacagcgagcctgagaaaatgaacgaggtcggtatcgttgaagaagccgaacctgctccgctgggtcctcagcggaacggaatgcgcttcccagagtcgtccgtggcagacagacgtcgtctgttcgaacgcgacggcaaggcttgcagcaccctcagtttatcgggacccgaactcaaacagtttcaacagagtgccctcgccgattatattcagaggaagacaggaaagcgccccacttccgccgctggctgctctctacaggaacctggtcccttgcgagagcgggcccagtctgcatatcttcagcccggacccgccgctctggaggggagcggtttagcttccgcctcatcactgtcctcactgagagaacccagtctgcaaccgcgccgtgaagccaccttactgcccgcaacagttgccgaaacacagcaggcaccgcgggaccgctcctctagttttgccggaggaaggcggctcggagagcggagaagaggcgacctactctccggagccaacggtggaactagggggacacagaggggagacgagaccccaagggaacccagtagttggggcgctcgcgctgggaagagcatgtcagctgaggatctcctagaacgcagtgacgtgcttgctggtcctgttcacgtgcgtagcagaagttctcctgctactgctgataaacgtcaggacgtgttgctgggacaggacagtggcttcggattagtgaaggatccctgctatcttgcaggtccaggttcccgtagcctgagttgcagcgagagaggacaggaggagatgcttcctctctttcaccacctcacaccgcggtggggtgggtcagggtgcaaggcgattggggactcgagcgtaccatcagaatgtccgggtactctcgatcaccagcgacaggctagtaggaccccctgcccaaggccccccctggctggcactcagggactggtgaccgacacacgcgccgcaccgctcaccccaatcgggaccccccttccgagcgcaatcccttccgggtactgcagtcaggatggacaaactggccgccagcctctacctccttatacaccagcgatgatgcatcggagcaatggccataccctgacccaacctcctggccctcgaggatgtgaaggggatggccctgagcacggcgttgaggagggaacgcgtaaaagggttagtctgccacaatggcctcccccatctcgagctaagtgggcccatgctgcaagggaggattccctgcccgaagagtccagcgccccggacttcgccaatcttaaacattatcagaaacagcagagcctgccgagcctgtgttctacaagcgaccctgatacacccctgggtgctccctccactccaggaagaatctccttgcgcatatcagaatccgtgcttagagactcaccacctcctcatgaggattacgaggatgaagtgtttgtgcgcgaccctcacccaaaggcgaccagctcgcctactttcgagcctttacccccccccccaccgcctccaccctcacaggagacgcctgtctactccatggatgactttcctcccccccctccccacacagtctgtgaggcccaattggattctgaagacccagaaggacctagaccttcctttaacaaattgagcaaagttactatagcaagggaacgccacatgccaggagctgcacacgtagtcggctcccagaccctggcctccagattgcagacctctattaagggctcagaggcagaatcaactccaccctcctttatgtcagtgcacgctcaactcgccggctctctgggaggacagcccgcaccaattcaaacccagtcattgagccatgaccctgtctccggaacccaagggttggaaaaaaaggtaagtcctgatccccaaaaatcaagtgaggacattcgtaccgaagcccttgccaaggaaattgtgcaccaggacaagtcattagccgacattttggaccctgattccaggcttaagactacaatggatttgatggagggactgttcccacgcgatgtcaacctgctgaaggagaactccgtgaaaaggaaggctatccagaggactgtaagctccagtggatgcgagggcaagcgcaacgaggacaaagaagctgtttccatgctcgtcaactgtccagcttactatagcgtgtccgcgcccaaggctgagttgctcaacaaaatcaaagagatgcccgccgaagtgaatgaggaggaagagcaggctgacgtcaatgaaaagaaagccgagcttattggtagtctgactcacaagcttgaaacactccaggaggccaagggatcattgcttacagacatcaaactcaacaacgctctcggggaagaagtcgaggcattgatctcggagctgtgtaagcccaacgaatttgataagtaccgtatgtttatcggcgacctggacaaggtggtgaacctgctgcttagcctgtccggccgtctagcccgagtcgaaaatgtgctttctggactcggtgaggatgcatccaacgaggaaagaagctccctgtatgagaaaagaaagattctggccggccagcatgaagacgctcgcgagctgaaagaaaatttagaccgccgcgaacgggtggtcctggggatcctggccaattatctgtccgaggagcagttacaggactaccagcatttcgtgaagatgaagagcacactcctaatcgagcagagaaagttagatgataaaatcaagttaggtcaggagcaagtaaaatgcttgttagagtctctgccctccgatttcatccccaaggccggtgccctggccttgcccccaaacctcacttccgagccaattcctgcggggggatgcactttcagcgggatttttcctacactaacctcacctttatag

SEQ ID NO: 134263 - DNA, 561 bp, Artificial Sequence
  Description of Artificial Sequence: Synthetic coding sequence
atggcattctacagtactactgaatatgatatccagcttgcgcgcggcctgctgtctggcatgttcttgtttgccacaaggcgctccgagccagccgggcggcctcattcttggcacacaacaaaatctggtgaaaaacagccggatgcctccatgatgcagatcagccaggggatgatcggccctccatggcatcaaagctatcactcctccagctccacctctgatctgagcaattatgaccacgcttatttacgccggagccctgatcagtgcagcagccaaggaagcatggaaagtctggaacctagcggagcctatcccccttgccacctctccccggcaaaatctaccggatccatcgatcagttatcccactttcacaacaagagagactctgcctactcgtcgttcagcacttccagctccattctggagtatccccatcctggaaaacgcgtcaagactcgtgacctccctggctctcagagccctgggagggccatctcaaggaagacgacgatgccaacctccggtggcggctggagagagaaagcctag

SEQ ID NO: 134264 - DNA, 4482 bp, Artificial Sequence
  Description of Artificial Sequence: Synthetic coding sequence
atggaaaaccggcctggaagctttcagtacgtgccggtgcaactgcagggcggtgctccatggggatttacactgaaaggcggtctggagcactgtgagccactcacggttagcaagatcgaggatgggggaaaggctgcgcttagtcaaaagatgaggactggcgacgaactcgtcaatatcaacggaacccctctgtatggatcaagacaagaggccctgatcttgatcaaaggttctttccgtatcctcaaactaatcgtcaggaggcgcaacgccccggtgtcacgaccccatagttggcatgtggctaagctcctcgagggctgccctgaggcggccaccaccatgcattttccctccgaagctttttcactgtcttggcattcagggtgtaacacgagcgacgtgtgtgttcagtggtgcccactgtcacgccattgctcgactgagaagtcatccagtattggctcaatggagtcactagagcagcctggacaagctacttacgaatcccaccttttgcctatcgaccagaacatgtaccctaatcagcgggatagtgcttacagctctttttccgcgagttctaacgcttctgattgcgctttgagcctccgtcccgaggagcctgcaagcacagattgtatcatgcagggcccagggcccacaaaagcacctagcggacggcctaatgtcgccgaaacctcaggaggtagcagacggaccaatgggggccaccttacaccctcaagtcagatgtcctcccgtccccaggaaggctatcagagcggcccggcaaaggccgtccgcggcccacctcagccccctgtaagacgcgactccttgcaagcctcacgggcccagcttctcaacggcgagcaacgtagagccagcgagccggtggttcccctgccccagaaagaaaagctctctttggaaccggtgttacccgcaaggaaccctaatcggttctgctgcctgtctggacatgatcaagttactagtgagggacatcagaattgtgaattttcccagccgcccgaatctagccaacaagggtccgagcacctactcatgcaggcttccaccaaggctgtgggatcccccaaggcatgcgaccgcgcttcatcggttgacagcaatccccttaatgaagcctccgcagaactcgctaaagccagcttcggcaggccaccacacctaatcggccctactggacatagacattctgctcctgaacagttactggccagccatctccagcatgtccacctggatacacgcggatctaaagggatggaactgccccccgttcaagatggccatcagtggactctgagccctctgcactcttctcacaagggaaagaagagtccgtgcccccccaccggaggaacgcatgatcagtcatccaaggagaggaagacaagacaggtggacgacaggagccttgtgctaggtcaccagagtcagagctcacctcctcacggagaggctgacggacaccccagcgagaagggctttcttgacccgaaccggacctcgcgcgctgcgagcgagctggcaaaccagcagccatccgcttctgggagtttggttcagcaggccaccgactgctcaagcaccacaaaagctgcatcgggcacagaggcaggagaggagggggatagcgagccaaaggaatgcagccgtatgggaggacgccgtagcggaggtaccaggggaagaagtatacaaaatcgccggaaaagcgagaggttcgcaacaaatctacggaacgagatacagcggcggaaggcccagctgcagaaatctaaggggcccctgtcccagctctgtgataccaaggagccagtggaggagacacaagaaccgcccgaatctccccctctaacggcaagcaatacttctttgctttcatcatgtaagaagcctccttctccccgcgataagctattcaacaaatctatgatgctcagagcaaggtcatcagaatgtctctcacaggcccctgaatcccacgaatccaggaccggcttagagggcaggatttcacctgggcagagacctggccagtcttctctgggcctgaacacttggtggaaggccccggaccccagctcatctgatcccgaaaaggcacatgcacattgtggagtgagggggggccactggagatggtctcccgagcacaattcacaacccctcgtggccgcagcgatggaggggccatcaaatccaggtgacaacaaagaactgaaggcgtccaccgcccaggctggagaggatgcaattcttcttccattcgctgatcggagaaaattcttcgaggaaagctccaagtctctgagtacttcacacctccccggactgacaacccacagcaataaaaccttcacccagagacccaaacctatcgatcagaattttcagccaatgtcaagcagctgccgggagctccgtcggcaccccatggatcaaagctaccatagcgccgaccaaccttaccatgccactgaccaaagctaccatagcatgtcccctcttcagagcgagacaccaacctactctgaatgtttcgcttctaagggacttgagaattctatgtgctgtaagccattacattgcggggactttgactaccatagaacttgtagttatagctgcagcgtccaaggcgcactcgtgcatgacccatgcatctactgttctggggagatttgccctgcccttctcaaaaggaacatgatgcctaattgttacaattgtcggtgccaccatcatcagtgcattagatgctctgtttgctatcacaacccgcagcattctgcactggaagactcatctctggctccgggcaacacttggaagccaagaaaactgaccgttcaggaatttccaggggacaagtggaaccctataacagggaatcgcaagacctcccagtctggcagggaaatggctcacagcaagacgtctttctcttgggctacaccattccacccctgtcttgaaaatccagcacttgatctatctagttacagggcaatctcatcattggatctgctaggcgacttcaagcatgctctgaaaaagtccgaagagactagcgtttacgaggaagggagcagcctggcctcaatgcctcacccattgaggtctcgtgctttttctgaatctcacattagcttggccccccagagcactcgcgcatggggccaacataggagggaactcttcagcaagggagacgaaacacagtctgacctgctcggcgctaggaaaaaagcattcccacccccgcggcctcccccacccaactgggagaagtatcgcttgtttcgtgctgcacagcagcaaaaacagcagcagcaacagcaaaagcagcaggaggaggaggaggaagaagaagaggaagaagaagaagaagaagaggaggaagaggaggaagcggaagaagaagaagaggagctaccgccccagtatttctccagcgagacatctggttcctgcgccctgaaccccgaagaggtgctagagcagccccagccactaagcttcggacatctcgaaggttcacgccaagggagtcagtccgtgccggcagagcaggaatctttcgcactgcatagctcagacttcctaccccccatcagagggcacctcggatcacagccagaacaggctcagcctccctgttattatggcattggtggtctgtggcgaacaagcggccaggaagcaaccgagtcagctaaacaggagtttcagcacttctcccctccctcaggcgcccccggtatccctacaagctattctgcgtattacaacattagcgtggcaaaggctgaactgctgaacaaactgaaggaccaacctgagatggctgagatcggtttgggggaggaggaggtggatcacgagctggctcagaaaaagattcagctcattgagtccatcagccgcaagctttccgttctgcgcgaagctcagcgcggactcctggaagacattaatgcgaatagtgctctgggagaagaggtcgaggccaacctgaaggcagtttgcaaaagcaatgaattcgagaagtatcatctattcgtgggcgaccttgataaggttgtaaatctcctgctgtccctgtccggtaggctggctagggttgaaaacgctctcaatagcatagattcggaagctaaccaggagaaactggttctgatcgagaagaaacaacagcttacaggacagctggccgacgccaaggagctgaaagagcacgtggacagacgggagaaactggtctttggaatggtgagcagataccttccccaggaccagctccaggattatcagcacttcgttaagatgaagtctgctctgataatcgaacagagggagctggaagagaaaatcaagctcggcgaagagcagctcaagtgtctgcgcgagtccctgttactgggcccttctaacttttag

SEQ ID NO: 134265 - DNA, 4482 bp, Artificial Sequence
  Description of Artificial Sequence: Synthetic coding sequence
atggaaaaccggcccgggtctttccagtacgttccggttcagctccagggaggcgcaccatggggattcacgctgaaaggaggccttgagcactgtgaacccttgaccgtttcaaagattgaggatggaggtaaagccgctttatcgcagaagatgcggaccggcgacgagttggtgaacatcaacggcaccccgctgtacggcagtcgtcaagaagccctgatcctgatcaaggggtccttccgaatccttaaattgatagtcagaaggagaaacgcccccgtgagccgaccacattcgtggcatgtagctaaactgctggagggttgcccagaggctgccacgactatgcatttccctagcgaagctttttctctctcttggcacagcggttgtaacaccagtgacgtctgtgtacagtggtgcccgctgagcagacattgttcaaccgagaagagctcgtccatcgggtccatggagagcctcgagcagcctgggcaagcgacgtatgagagtcacctgctgcctattgaccaaaacatgtatcctaaccagcgcgactccgcatactcatctttcagcgcatcctctaatgcaagcgactgtgctctctcactgaggccagaggaaccagcaagcactgattgtatcatgcagggtcctgggcctaccaaagcgccgagcggtcgacctaacgtggctgagaccagcggagggtccaggaggactaacggagggcacttaacaccgtcaagccagatgtctagccgcccgcaagagggctaccagtctggccctgcaaaggccgtgaggggtccaccccagccccctgtccgcagggacagtctccaggcatctcgtgcgcagctactgaacggagaacaacgcagggcttctgaaccggtggtgcccctgccgcagaaagagaaactctccctcgagccagtgttgccggctcggaatccaaacagattttgttgtctcagtggacatgatcaggtgacctctgaaggtcaccagaattgtgagttttcccagcctcccgagtcttctcaacagggctccgagcatctgctgatgcaggcctccaccaaagcagtgggcagccctaaggcttgtgatagggccagctcggtggattctaatccgctgaacgaggcctcggcggagctggcaaaggccagcttcggacgccccccccatcttattgggccaaccggccaccggcactcagcaccagaacagcttcttgcgagccatctacagcacgtacaccttgacactagaggtagcaagggcatggagctgccccctgtgcaggatggacaccagtggactctttccccactccattcgtctcacaagggcaaaaaaagtccctgtcccccaacaggtggaacgcatgatcagtctagtaaggaaagaaagaccaggcaggtcgacgaccgatcgctggttctcggtcatcagtcccaaagtagcccaccgcacggggaggctgatgggcatcccagtgagaaaggatttctggatccgaatcgaacatctagggctgcctcagagcttgctaaccagcaaccctcggccagcggctcactggtgcagcaggccacagactgctcttctactactaaggctgcctctggcaccgaggctggagaggaaggcgattcagagcccaaggagtgtagtcgaatggggggccggcgaagcgggggaacacgcggcaggagtattcagaatcgtcgcaaatccgagcgcttcgccactaatcttcgcaatgagatccagcggcggaaagcccagctccagaagtctaagggaccattatctcagctttgtgacacaaaggaaccggttgaggaaactcaggagccgcccgagtcgcctccactgactgccagcaacacatctctgttgtcctcttgtaagaaaccaccctctcccagagacaagttatttaacaagagtatgatgctgcgcgccagaagttcagaatgcctttctcaggcccctgagtcccacgagagtcgaacagggctggagggccgcattagtcccgggcagaggcctgggcagtctagtctggggctgaacacgtggtggaaagccccggacccgagctcctcggaccccgagaaagcacacgcacactgtggcgtgcggggaggacattggcgctggagtccggagcataattcacagcccctcgtcgccgcggcaatggaggggccatctaatccgggggacaataaagagctcaaagcgagcactgctcaggctggtgaagatgccatcctcctgccgtttgccgataggcgtaaattctttgaagagagcagcaagtctctgtcgacgagccatctacctggactcaccactcactctaacaaaaccttcacccaacggcccaagccaattgaccagaactttcagccaatgagttcaagttgccgcgagctccgtagacacccaatggaccagagctaccactctgctgatcaaccctaccacgctactgaccagtcataccactctatgtcacccctacagtcagaaactcctacgtattccgagtgctttgcctcaaaaggccttgagaacagtatgtgttgcaaaccgttgcactgcggcgactttgactaccacagaacgtgttcatactcatgtagcgtgcagggggcacttgttcacgatccttgcatctactgttccggagagatttgccctgcattgctcaagaggaatatgatgccaaattgctacaattgtaggtgtcaccatcaccaatgtataagatgttccgtgtgctatcacaatccccagcacagtgcgctggaggatagctcactcgcccctggaaatacctggaaaccgaggaagctcaccgttcaagagttccccggagataagtggaacccgattactgggaacaggaagacgagtcagagcgggagggagatggcacactcgaaaacatccttttcatgggccacccctttccacccatgtctggaaaatcctgctttggacctttcctcctatcgtgctatctcgtccctggacctgctgggcgatttcaaacacgccctgaaaaaatccgaggaaacttccgtttacgaggaggggagttccttggctagcatgcctcatccgctgagaagtcgtgccttcagtgaatcccacataagcttggccccccagtccacccgtgcctggggacagcacagaagagaactgttctcaaagggggacgagacgcaatctgacctgctcggagccagaaaaaaggcgtttccccccccccggcctccccctcctaactgggaaaaatatcggctgttccgggccgctcaacaacaaaaacaacagcagcaacagcagaagcagcaggaggaggaggaggaggaagaggaggaggaggaggaggaagaagaagaggaagaggaagaagcagaggaggaggaagaggaactaccacctcagtacttttcgagcgaaactagcggatcgtgtgctcttaacccagaagaggtgctcgagcagccacagccactgtctttcggacatcttgaagggtcacgacagggctcccagtccgttcccgcagagcaggagagctttgctctgcattcatccgatttcttaccaccaattcgcggacatttgggctctcagccagagcaggctcaaccgccttgctattatggcatcgggggattgtggcgcacatcaggccaagaagctaccgaatcagccaagcaggagttccagcatttctcccccccatctggggcccccgggatccccacctcctatagcgcttattataacatcagcgtggccaaggcggaacttctcaataagctcaaggatcaacccgagatggcagagattggacttggagaggaggaggtcgaccacgagctggcacagaagaagatccagctgatagaatctatcagccggaaactcagcgtgctgcgtgaagctcagcgcggtttgctggaggacatcaatgccaattcggccttaggcgaagaggtcgaagctaatctcaaagcagtctgtaagagcaacgagtttgaaaaataccacttgtttgtgggcgacctcgacaaggtggtcaatctgctgctgagcctcagtggccgactggctagagtcgaaaacgctctaaattccatagattccgaggccaatcaagaaaagctggtactcattgagaaaaaacagcagctgactgggcagctggcagatgccaaagagctgaaggagcacgttgataggagggaaaagctggtctttggtatggtctcacgctatctaccccaggatcaactacaggattatcagcattttgtgaagatgaaaagtgctctaattatcgagcagcgggagctggaggaaaaaattaagctgggtgaggagcagctcaagtgtctgagagagtcccttctgctgggccccagcaacttttag

SEQ ID NO: 134266 - DNA, 4134 bp, Artificial Sequence
  Description of Artificial Sequence: Synthetic coding sequence
atgcactttcctagcgaagcctttagtcttagctggcactccgggtgcaatacttccgatgtgtgtgtccagtggtgccccttatctcgccactgttctaccgagaagagcagtagcattgggtccatggaatccctcgagcagcctggtcaagccacctatgaatcccacttactcccgatcgaccaaaacatgtaccctaatcaaagggatagcgcctacagtagtttctccgctagtagcaatgccagtgattgcgctctgtcccttagacccgaagaacctgctagtaccgattgcattatgcagggccccgggccaacaaaagctccaagtggacggccaaacgttgcggaaacttctggaggcagtagaaggacaaatggtggccacctcactccaagttcacagatgtcctcacggccacaagagggctaccaatccggccccgccaaggcagtaaggggacctccccagccgcctgtccgacgagacagcctacaggcatcgagggcccagctgctgaacggtgagcagagacgcgcttccgagccggttgtgcctttaccacaaaaggagaagctttccctggagcctgtgctgccagccaggaatcctaataggttttgttgcctgtcaggccacgatcaagtaacaagtgaaggccatcagaattgcgaattttcccagccgcccgaatcaagccagcaaggcagcgagcacttgctgatgcaggcctctaccaaagcagtgggcagcccgaaagcctgcgaccgggcgtcctctgtggattccaaccctctgaatgaagctagcgcggaactggccaaggcttcctttggccggccaccccacttgattggccccaccggtcacagacatagtgcacccgagcaattgctcgcgagccacctgcagcatgtacatctggacacccgcggctcaaaggggatggagctaccccccgtccaagacggtcaccaatggacgttgtcccctttacactcttcccataaggggaaaaaatctccgtgccccccaactggggggacccacgaccagagctctaaagagagaaaaactcggcaggtcgatgacagaagcctggtgctcggccatcagagtcaaagctcccctccccacggagaggctgatggacatccatctgagaaggggtttctggatccgaatcgaactagcagggcagccagcgagttagctaatcagcaaccctcagcttctgggtccctggtccaacaggccacggactgttcatccaccaccaaagccgccagcggcacagaggctggcgaggagggcgacagcgaacctaaggaatgcagccgcatgggaggaagaagaagcggcggtaccagaggtcgttctatacagaacagacggaaatccgagcgtttcgccacaaatctacgcaatgagattcagcgccgaaaggctcagttacaaaaatctaagggccctctcagccagctttgtgatacaaaagagcctgtcgaggagacccaagagcctccagaatcccccccactcaccgcaagcaatacttctctgctttcgagctgtaagaagcctccatctccaagagacaaactcttcaataagagcatgatgctgcgtgcacgttcatctgaatgcctgtcccaggcacctgaatcacatgagtctcgcacaggcctggaaggccgaattagcccagggcagcgccccggacagtcatcgctcggactgaatacttggtggaaagctcctgacccttcatccagcgacccagagaaggctcacgcgcattgcggagtgcgcggaggccactggcggtggagtccagagcataacagccagcccctcgtggcggctgcgatggaaggtccatccaaccccggtgataataaggaattgaaagccagtacagcacaggccggcgaggatgccattctcctacccttcgccgatcgccggaaattttttgaggagtcttccaagtctctgtctacctctcatctgcccggcctcactacccacagcaacaagaccttcacacagagacctaagcccatcgaccagaacttccagccaatgtcgtccagctgccgtgagctgcgccgtcaccccatggatcagtcctaccacagtgctgaccagccataccatgccacggaccagtcttaccattcgatgagccctctgcaatccgaaaccccgacttacagcgagtgctttgccagtaaggggctggaaaacagtatgtgttgtaaacccctgcattgcggcgatttcgattaccatcggacgtgctcctacagctgttctgttcagggcgccctcgtccacgacccttgcatctattgctccggagagatctgtccggctctgctgaagcgcaatatgatgccgaactgttacaactgccggtgccaccaccaccaatgcattcggtgctctgtttgttatcacaacccccagcacagcgctctagaagattcctcactcgcccccgggaatacatggaaaccacgtaaattgactgttcaggagttccctggtgataaatggaaccctatcactggaaaccgtaaaactagtcaatccggacgtgagatggcacactccaagacgtccttctcctgggccaccccttttcatccctgcctggaaaatcccgccttggacctgtcaagctatagagcaatatccagcctcgacctattaggggactttaagcatgcgctaaaaaagtccgaagaaacctctgtttacgaagagggctcaagcctggcaagtatgccccacccactgagaagcagggccttttctgagtctcacatctcccttgccccgcagagtacgcgggcctgggggcagcacagacgagagctcttcagcaagggagatgagacccagtcagatctgttgggtgcgcggaaaaaagctttccctcctccccggcctcccccccccaattgggaaaaataccggctgttccgagccgcacagcaacagaagcagcaacagcagcaacagaagcagcaggaagaagaagaggaggaggaggaggaggaggaagaggaagaggaagaggaggaagaggaggctgaagaggaagaagaggagctgccccctcaatacttcagctcagaaacttctggttcttgtgccctaaatcctgaggaagtcctggagcaaccccagcctcttagtttcgggcatcttgagggctctaggcagggtagccagtcagtgcccgcggagcaggaaagctttgcactacattcctcagatttcttgccaccaatccgcggtcatctgggctcacagccagagcaggcccaaccaccttgctattatgggataggaggcctgtggagaacgtccgggcaggaagccaccgaatcagcaaaacaggaatttcagcactttagtccaccatcaggagccccagggatccccacctcctacagcgcctattacaacatctctgttgccaaggccgagctcttgaacaaactgaaagaccagcccgagatggcagaaatcggtttaggcgaagaggaggtggatcacgaactcgcccagaagaagatccagctgatcgaaagtatcagcaggaagctctccgtgctgcgggaggctcagcggggactgcttgaggatatcaatgctaattcagcgctcggagaggaggtagaagcaaacttaaaagctgtatgcaagtcaaacgagttcgagaaataccacctgttcgtgggcgatctggataaggtggtgaatctcctgctgagcctatctgggaggttggcaagagtggagaatgccctgaattctattgattctgaagctaaccaggaaaagctggtgttaatcgagaagaagcaacagctgaccggtcagctcgccgatgctaaggaacttaaggagcatgtcgaccggcgggaaaagcttgttttcggcatggtttctcggtacttaccacaagatcagttacaggattaccagcacttcgttaagatgaaaagcgccctcatcatcgaacaacgtgagctcgaggaaaagattaagcttggcgaggagcagctgaagtgtctcagagagagccttctattgggtccctccaacttctag

SEQ ID NO: 134267 - DNA, 1686 bp, Artificial Sequence
  Description of Artificial Sequence: Synthetic coding sequence
atggcgaaggagaggtgcctaaaaaaatcctttcaggactccttggaggatataaaaaaaagaatgaaagaaaaacggaacaagaacctggcagaaataggtaagagaaggtctttcatcgccgcaccatgccagattatcaccaacactagcactctgctgaaaaactatcaggacaataacaagatgctcgtgttagctcttgaaaacgaaaagtcaaaggtgaaagaggcccaggatattatccttcagctgcgcaaggaatgttattacctgacctgtcagctgtatgctctgaagggaaaattgacctcacagcagacagttgaaccagcgcaaaatcaggagatatgttcgagcggaatggatcccaactctgacgactcctctaggaacctcttcgtcaaagacttaccccagatcccactggaagaaacagagctgccagggcagggggaatctttccagattgaggaccagatccccactatacctcaagacacactaggcgtggacttcgactctggggaggcaaagtctacagacaacgtgctgcctaggaccgtgtccgtgcgctccagcttgaagaaacactgcaattcgatctgtcagttcgatagcctggacgacttcgagacaagccacctcgccggaaaaagctttgagtttgagcgggtaggatttctagaccccctagtgaacatgcatattcccgaaaacgtccaacataacgcctgccagtggagtaaagatcaggtgaatttgagccccaagctgattcagccaggcacgttcacaaaaacaaaggaggacattcttgagagtaagtctgaacagaccaaatccaaacagagagacacccaggagcggaaaagggaggagaaaagaaaggcgaatagaagaaaatcaaaacgtatgagcaaatataaagaaaataagagtgaaaataaaaagaccgtcccccagaagaaaatgcacaagagcgttagcagtaatgatgcctataactttaacctcgaggagggcgtgcacctcacccccttcaggcagaaggtgagcaacgactccaatcgcgaggaaaacaatgaaagtgaggtgagcctctgcgagtccagtggcagcggggatgactccgacgacctgtacctgccaacatgtaaatacatccagaacccgacatccaatagtgaccgtcctgtaaccaggcccctagccaaacgagcactcaagtacaccgacgagaaggagactgaaggcagtaaacccacaaaaaccccgacaaccacacccccagagacacagcagtcgccacatttatctctcaaagatattacgaacgtgagcctgtaccccgttgtaaagatacggcgactgtccctatccccaaaaaaaaacaaggccagccccgccgtcgcattgcctaagaggcgttgcacagcgtctgtgaactacaaagagcctaccttggcctctaagttgcggagaggggatcccttcactgacctgtgcttcctgaatagtccaatcttcaaacaaaaaaaggatctgaggcggtcgaaaaaaagagctctcgaggtatcccccgccaaagaggctatattcatactgtactatgtaagagagttcgtctcacggttccctgactgccgaaagtgtaaactggaaacgcatatttgcctgcgatag

SEQ ID NO: 134268 - DNA, 879 bp, Artificial Sequence
  Description of Artificial Sequence: Synthetic coding sequence
atggctaaggagagatgtttaaaaaagtctttccaggactctctggaggacattaaaaagaggatgaaagagaaaagaaacaaaaatctggccgagattggtaagcgaaggagctttatagccgctccatgccaaatcataaccaacacatctacacttttgaagaactaccaggacaataacaagatgctggtactggctctggaaaacgagaagagtaaagtcaaggaagcccaagatataattctacagcttcgaaaagagtgttactacctcacctgtcagctgtatgcactgaagggcaagttgacttcccaacagaccgtggagccagcccagaaccaggaaatatgttcttccgggatggaccccaactccgatgattcatccagaaacctgttcgtgaaagacctgccgcaaattcccctcgaagaaaccgagttgcctggacagggcgaatccttccagattgaggccaccccccccgaaacccagcagtctccacaccttagcctcaaagacatcaccaacgtcagtttgtacccagtcgtgaagatcaggaggctctccctgtcccctaagaagaacaaggcaagccccgcagtggcactccccaagcgccgctgcacagcctctgtaaactacaaggagcccacccttgcttcaaagctcagacgcggcgatcccttcaccgacctgtgctttctgaactcacctatcttcaagcaaaagaaagatctgcgccgctcaaagaaacgcgctctcgaagtgtctccagctaaagaagccattttcatcctttattacgtacgggaatttgtatcccgtttccctgactgcagaaagtgcaagctggagactcatatttgtctgagatag

SEQ ID NO: 134269 - DNA, 648 bp, Artificial Sequence
  Description of Artificial Sequence: Synthetic coding sequence
atggcaaaggagagatgcctgaagaaaagttttcaggacagtctggaagatatcaagaagcgaatgaaggaaaaacgcaataaaaatctagcagaaattgggaagcgcaggagctttatcgctgccccatgccagatcattacgaacacatccacgctgctgaagaactatcaggacaacaataagatgctagtgctggccttggagaatgagaaatcgaaggtcaaggaggcccaagacatcatcctgcagctcagaaaagaatgttattacttgacctgtcagctttacgccttgaaggggaagctgacgagtcaacaaactgtggaaccggctcaaaaccaagaaatctgttcttcaggcatggacccaaactccgatgactcttctcgcaatctgttcgttaaagaccttccacagattccactcgaggagactgagcttccagggcaaggggaatcattccaaatcgaggatcagatcccaacaattccccaggacacactcggggtggattttgacagtggcgccctggaggtgtctcctgctaaggaggctatatttattctctactacgtgcgcgagtttgtaagccggttccccgattgcagaaagtgcaagctggagacacacatttgtctcagatag

SEQ ID NO: 134270 - DNA, 1584 bp, Artificial Sequence
  Description of Artificial Sequence: Synthetic coding sequence
atggcaaaagagaggtgtctgaagaaatccttccaggattccctggaggatataaagaaaaggatgaaagagaagaggaataaaaatctggcagagatcggaaagcggcggagctttatagccgctccatgtcaaataataactaacacttcgacactgttgaaaaactatcaggataacaataaaatgctggttctcgctctggagaatgaaaagtcaaaagtcaaggaggctcaggatatcattttgcagctgcgtaaggagtgctactaccttacatgccagctttatgccctgaaaggaaagctaacatcccaacagaccgtagaacccgctcagaatcaagaaatctgtagctcgggtatggatcccaacagcgacgactccagcaggaatctgttcgtcaaagacctgccacagatccctctggaggagacagaactgccagggcagggcgagtcattccagatcgaagaccagatccctacaatcccacaggatacactcggagttgacttcgatagtggtgaggctaagtcaactgataatgtcttgcctcgaactgtttcagtgagatcctccctgaaaaaacattgtaattcaatttgtcagttcgattcattggacgatttcgaaacttcccatttggcaggaaaaagcttcgagtttgagcgggtggggtttttagatccacttgttaacatgcatattccagagaatgttcaacacaatgcttgccaatggtccaaggaccaggtgaacttgagccccaagctcatccaacccggaacatttacaaaaactaaggaagacatccttgagtcaaagtcggagcagacaaaatccaaacaacgggacacccaggaaaggaaacgcgaggagaaaagaaaggccaaccgaaggaagagcaagcgaatgtctaaatacaaggaaaataaatctgaaaacaagaagaccgtcccccagaagaaaatgcacaagagtgtgtcctccaacgatgcatataactttaacttagaggaaggtgtacacctcactcccttccggcaaaaagtgtccaatgacagtaaccgggaggagaacaacgaaagcgaggtctctctgtgcgagagctccggttctggcgatgattctgatgacctgtacctcccaacgtgtaagtacatccaaaatcctaccagcaactccgacagacctgtcacgcgccccctggccaagcgcgccctgaaatacacagatgagaaggagaccgaggggagcaagccaaccaagactccaactaccaccccccctgagacccagcagtcaccacatctgtctttgaaggatatcactaacgtgagcctttacccagtggttaaaattaggagactatcactctctcccaagaagaataaggcctcacccgcagtcgccttgccgaaacgtcgctgcactgccagtgtgaactataaggaacccacccttgcctcaaagctgagaagaggtgaccctttcaccgatctttgttttctgaactcaccgatttttaaacaaaaaaaagaccttcgtcgttccaagaaaagcatgaagcagatacagtag

SEQ ID NO: 134271 - DNA, 1584 bp, Artificial Sequence
  Description of Artificial Sequence: Synthetic coding sequence
atggcgaaggaacgctgtctgaagaagtccttccaggactccctagaagatattaaaaagaggatgaaagaaaagcgcaacaaaaatctggctgaaatcggcaaacggaggtcatttatcgcagccccttgccaaatcattacaaatacctctactctcctgaagaactatcaggacaacaataaaatgctggtgctcgcactggaaaacgaaaaatccaaagtgaaagaggcacaggacattatccttcagctcaggaaagagtgctattacctcacctgtcaactttacgccttaaaagggaagcttacttctcagcagacggtggaacctgcccagaatcaggaaatctgctcttctggtatggacccgaactccgatgatagctcacgtaatcttttcgtgaaagatctgccacagattcccctagaagagaccgaattacctgggcagggggagtcctttcagattgaggaccaaattccaaccatcccacaggataccctcggcgtggactttgattctggggaggcgaaaagcacggacaacgtactacctaggacagtgtctgtacgctcgagtctcaagaagcactgtaactctatatgtcagtttgacagccttgacgactttgaaacttcccacctggctgggaaaagctttgagttcgagcgtgtcgggttcctcgatcccctggtaaacatgcacattcctgagaacgtgcagcataacgcatgtcaatggagtaaagaccaggtgaacctctcccctaaacttattcagcccggtacattcactaaaaccaaggaagatattctagagagtaagagcgagcaaactaagtcaaaacagagagatactcaggagagaaaacgcgaggaaaagaggaaggccaaccgccgcaagtctaagagaatgtctaaatacaaggaaaacaaaagcgagaacaaaaagaccgtgccgcagaagaagatgcataaatcggtgagttcgaatgacgcatacaattttaatctggaggaaggcgttcatcttactccattccgacaaaaagttagcaatgactcaaacagggaggagaacaatgagagcgaagtgtccctgtgcgaatcttcaggttctggcgacgattccgacgacttatatctccccacctgcaagtatatccagaaccccacatcaaatagcgaccgacctgtgacaagacccctagctaagcgagccttgaagtacacagacgaaaaagagaccgaaggttccaaaccaactaagacccccaccacaacccccccagagacccagcaatcccctcatctgtcacttaaggacataactaacgtgagtctgtaccccgtcgtgaaaataagaagactgagcttgtctcccaagaaaaataaagccagccctgctgtggccctccctaagaggcggtgtactgccagcgtgaactataaagaacccactctggccagcaaactcagacggggcgacccattcacagatctctgttttcttaactctccaatatttaaacagaaaaaggacctgcgcagatcaaaaaaatccatgaagcagattcagtag

SEQ ID NO: 134272 - DNA, 828 bp, Artificial Sequence
  Description of Artificial Sequence: Synthetic coding sequence
atggctaaggaacgttgcctcaaaaagagctttcaggattctttagaggacatcaagaagcggatgaaagagaaaagaaataagaatctggcggagattgggaaacgacgatcatttatagccgcgccttgccagatcattactaacacgagcacgctcctcaagaattatcaagataacaataaaatgctcgtgctggcactcgaaaatgagaaatccaaggtaaaagaagctcaggacatcatcttacagcttagaaaagaatgttattatttgacctgtcagctctatgcccttaagggaaagctcaccagccagcagacagtagagcctgcccagaatcaggaaatctgctcgtcaggcatggatcccaactccgacgactcctcacggaacttgttcgtgaaggacttgccgcaaattccactagaagagaccgaactccctggacagggcgagtccttccagatcgaagatcagataccgaccatccctcaggacacactgggcgtagatttcgatagcgctacccctcctgaaacacaacagagccctcacctatctctcaaagacatcacgaacgtatctctctaccctgtcgtcaaaattcgccgcctcagcctttcccccaagaagaacaaggcaagcccagccgtcgccttaccgaagagaaggtgtactgctagtgtcaactataaggaacctactctcgcctccaagttgcgccgaggcgaccccttcaccgacctttgttttcttaactcacccattttcaagcaaaagaaggacttgaggaggtcaaaaaagtctatgaaacagatacagtag

SEQ ID NO: 134273 - DNA, 930 bp, Artificial Sequence
  Description of Artificial Sequence: Synthetic coding sequence
atggccaaagagcggtgtctaaagaagtcattccaggattcattagaggatatcaagaagcgcatgaaagaaaaaaggaataagaatttggcagagataggcaagaggcggagctttattgcagcgccttgccaaattattacaaatacatcaactctcctaaagaattatcaggacaacaacaaaatgctggttctggcactggaaaatgagaagagtaaagtgaaggaagcacaagatataattctgcagctcagaaaagaatgctactatcttacctgtcaactctatgccctgaaaggaaaactgacatcccaacaaacagtagagcccgcacagaaccaggagatctgttcttccggaatggaccccaactccgacgattcttccagaaacttattcgttaaggacttgccccaaatccctctggaagaaaccgaactgccagggcaaggggagtcattccagattgaagatcagatccccaccattcctcaggacactctgggggtcgattttgacagtgctaccccccctgaaactcagcagtcgcctcacctctctctaaaggacattacaaatgtttcactctaccctgtggtcaagattagaagacttagcctgtctccgaagaaaaataaggccagcccagcagtggctttgccaaaaagacgatgtacagcatctgtcaattataaggaaccgacactggcgtctaaacttcgacgcggagatcctttcaccgatctgtgttttttgaattccccaatctttaagcagaaaaaggaccttaggagatctaagaaacgggcacttgaagttagccccgcaaaagaagctatttttatcctctactatgtccgggaattcgtgagccggttccccgactgccgtaagtgtaagcttgagacacacatctgcctgaggtag

SEQ ID NO: 134274 - DNA, 1686 bp, Artificial Sequence
  Description of Artificial Sequence: Synthetic coding sequence
atggcgaaagagcgatgtctgaaaaagagctttcaagatagcctggaagatattaagaaacgcatgaaggagaaaagaaacaagaatctcgccgagattgggaagcggaggtctttcatcgctgccccctgtcaaatcattaccaataccagtactctattaaagaactatcaggataacaacaagatgttggtattagcattagagaacgaaaagagcaaagtcaaggaggcccaagacatcattcttcagctgaggaaagagtgctactatcttacctgccaactctatgccctgaagggaaagctaacttctcagcagactgttgaaccagcgcagaatcaggagatttgttcctcaggaatggaccctaatagcgacgactcgtctaggaaccttttcgtcaaggacctgcctcagatcccactagaagagactgagcttccaggtcagggggagtcttttcagatagaagaccagatcccgactataccgcaagataccctgggcgtggacttcgacagcggggaggccaaatctacagacaatgtcctaccccgaaccgtgagtgtgcggagctcactcaagaaacattgcaattctatctgccaatttgactccttggatgacttcgagacatcgcatctagccgggaagtcgttcgagtttgaacgtgttggttttctcgaccctttagtgaacatgcatattcctgagaatgtgcagcacaatgcctgccaatggtcaaaggaccaggtgaacttgtcccccaaattaatacaacccggtacttttaccaagacaaaggaggacatcctcgagagcaaaagcgagcagaccaaatcaaaacaacgtgatacacaggagagaaaaagggaagagaagcgcaaggctaaccgccgcaaatcaaaacggatgtctaaatacaaagaaaacaaatcagagaacaaaaagactgtcccacagaaaaagatgcataagtctgtgagctctaacgacgcctataattttaatctggaagagggagttcacctcactccattccgccagaaggtctctaacgactccaaccgcgaggagaataacgagagcgaggtgtccttgtgcgagagctccggcagcggcgacgacagcgacgacctgtacttacctacttgtaagtatatccagaatcctacaagtaattcagaccgacctgtgacgagaccgttggctaaacgcgccctgaagtataccgatgaaaaagagacagaagggtccaagcctaccaagaccccgaccacgacgcccccagaaactcagcagtccccacacctctcgttaaaggacatcacaaatgtgagtttgtacccagtagtgaagatcaggaggctcagcctttcccctaagaaaaacaaagcgtcccctgccgtggctctgcctaagagaagatgtacagcgtcggtgaattacaaggaaccgacactcgctagtaagctgcgccgaggcgaccccttcaccgatctgtgcttcctgaacagcccaattttcaagcagaagaaggacctaagacgcagtaagaagcgagcgctggaagtctccccagccaaggaggcaatctttatactctactacgtacgtgagttcgtctcccgctttccggattgtagaaagtgcaagctcgagactcatatttgtctgagatag

SEQ ID NO: 134275 - DNA, 930 bp, Artificial Sequence
  Description of Artificial Sequence: Synthetic coding sequence
atggcaaaagaaaggtgtctaaaaaaatcttttcaagactccttggaggatataaagaaaagaatgaaagagaagcggaacaaaaatcttgccgaaataggtaagcggcgaagcttcattgctgcaccttgtcagattatcaccaatacatcgactctgctgaaaaactatcaggataacaacaaaatgctggtcctggcgttggaaaatgaaaagtccaaggtcaaagaagctcaggacattattcttcaactccgcaaggagtgctattatctgacctgtcagctatatgccctcaaaggcaagctgacatctcagcagaccgtggagccggctcaaaatcaggaaatttgcagttcaggcatggatccaaactctgatgacagttccagaaatctgttcgtgaaggacttaccccagatcccgctggaagagacagagttgcccggccagggcgaatccttccagatcgaagaccagatccctaccatcccacaagacacattgggagtagacttcgacagcgccaccccacctgaaacccagcagtcccctcacctctccctcaaggacatcaccaacgtgagcctttatcctgtagttaaaatccgaaggctgtccttgagtcctaagaagaacaaggccagtcccgccgtggcactgccaaagcgccggtgcacggccagtgtcaactacaaggagcctacgcttgcctcaaaactgaggcgcggcgatccttttaccgatctctgttttttaaactctccaatctttaagcagaaaaaagacctgcggcgctccaagaagagagcgctggaggtctcccccgccaaagaggcgatatttatcctatactatgtgcgggaattcgtgtctaggttccctgactgccggaaatgcaagctcgaaactcacatctgcctccggtag

SEQ ID NO: 134276 - DNA, 777 bp, Artificial Sequence
  Description of Artificial Sequence: Synthetic coding sequence
atggcaaaggaacggtgtctcaagaaatctttccaggacagccttgaggatattaaaaaaagaatgaaggaaaagcgtaacaagaacctggccgaaatcggaaagcgccggtcttttatcgcagccccctgtcagatcataacaaatacaagcacgctgttgaagaactaccaggataataacaagatgttggtgctcgctctggaaaacgagaaaagtaaggtaaaggaagcacaggacattattctccagctccgcaaagaatgttattaccttacctgccagctgtacgccctcaagggaaaactcaccagtcaacaaacagttgaacctgcccaaaaccaggagatctgcagtagcgggatggatccaaatagcgacgactcctccaggaacctgttcgttaaagatctgcctcagattcccctcgaagaaaccgagttgcctgggcaaggagagagtttccagattgaggctaccccacctgagactcaacaaagccctcatttatccctgaaagatattacaaacgtctcactttacccagtagtcaagatcaggcgcctgtcactgtccccgaagaaaaacaaggcctcaccagcggtggccctgcctaagcggaggtgtacagccagcgtcaactacaaggaacctacactggcttctaaattaagaagaggcgacccatttacggatctttgctttctgaatagtcccatcttcaagcagaaaaaagacctgcgcaggtccaagaagtcaatgaagcagattcaatag

SEQ ID NO: 134277 - DNA, 828 bp, Artificial Sequence
  Description of Artificial Sequence: Synthetic coding sequence
atggcgaaagagcggtgcctgaaaaaaagctttcaggattctttggaagacattaagaaaagaatgaaagagaaaagaaataagaacctggccgagattggcaagcggcggagctttatcgcggccccatgccagataatcacgaacacaagtacactcttgaaaaactatcaggataataacaagatgctggtactggcgttggagaacgagaaatcaaaggtcaaagaggcacaagacattatccttcagttaaggaaggaatgctactacctcacctgccagctgtatgccctcaagggaaaattaacatcccaacagaccgtcgagccggcacagaaccaggagatctgtagctccggcatggatccaaactccgatgatagcagtcgcaatctattcgtgaaagatctcccccagatcccgctcgaggagaccgaactgccagggcaaggcgagagcttccagatcgaagatcagatacctacaataccccaggataccttaggcgtggactttgactccgctactcccccggagacccaacagtctcctcaccttagcctgaaggatataactaacgtaagcctgtaccctgtggtcaaaattaggcgattgtctctgagtccgaaaaaaaacaaggcaagcccggctgtggcactgccaaaacgacgctgcacagcctccgtaaactataaggagcccacactcgcatcgaagctaagaaggggggacccctttacggacttatgttttctgaatagccctatcttcaagcaaaagaaagatttgcggcgtagtaagaaatcaatgaagcagatccagtag

SEQ ID NO: 134278 - DNA, 777 bp, Artificial Sequence
  Description of Artificial Sequence: Synthetic coding sequence
atggcaaaggagagatgccttaaaaaatcgtttcaggactcactggaggatataaagaagcggatgaaggaaaaaagaaataaaaaccttgcggagattggcaaacgtcgttcttttatcgcagccccctgtcagatcattactaataccagcaccttactgaagaactaccaggataataacaaaatgcttgttctcgccttagagaatgaaaaatcaaaagtaaaagaggcccaagatattatacttcagttgcgtaaagaatgctattatctaacatgccaactgtatgccctgaagggaaagttgactagtcaacagaccgttgagcctgcgcagaatcaggagatctgttccagcgggatggatccgaactcggatgatagctctcgcaacttgttcgtgaaagatctacctcagatacctctagaagaaactgagctccctgggcagggagagtcgttccagatcgaggcaaccccaccagagacccagcagagccctcacctgtccttgaaagacatcactaatgtctctttgtatcctgtggttaagatcagacgcctgagcctgtccccgaaaaagaacaaggcgtccccagctgttgctttacccaaacggcgatgtactgcatcggtgaactacaaggaaccaactctggccagcaaacttaggaggggggacccatttaccgacctgtgtttcctcaattccccaatatttaagcagaaaaaggatctgaggaggagcaaaaagtctatgaagcagattcaatag

SEQ ID NO: 134279 - DNA, 879 bp, Artificial Sequence
  Description of Artificial Sequence: Synthetic coding sequence
atggcgaaagagcggtgtctcaagaaaagttttcaggactctctggaagacatcaaaaaacgcatgaaagagaagcgaaacaaaaatctggctgagatcggcaagagacgctcctttattgcggccccgtgtcaaataattacaaacacctctactcttctgaaaaactaccaggataacaacaaaatgctggttctggccctggaaaatgagaaatcgaaagtcaaagaggcccaagacatcatcctgcaactgcgcaaggaatgctattatttgacatgtcagctgtatgctctgaaaggcaagctgacatcccagcagactgtggagcccgcccagaaccaggagatatgtagctcaggtatggaccctaattcagatgactctagtcgcaatctatttgttaaggatcttccacagattccactcgaagagactgagttgccaggccaaggcgaatctttccagattgaggcaaccccccctgaaactcagcaatctccacatctctctctgaaggatataacaaacgtcagcctctatccagtggtcaaaatccgacgactgtctctgtccccaaagaaaaacaaagcctcccctgcggttgctctccccaaacgacggtgtacggcctcagtcaattataaggaaccaacactggccagtaagctgagacgcggggatcctttcactgacctgtgttttctaaattccccgattttcaaacaaaagaaagacctgcgcagaagtaaaaagcgggccctcgaggtgagccccgccaaggaagccatctttatcctctactatgtgcgcgagtttgttagtaggtttccggattgccgcaaatgtaagctggaaacccatatatgtctacgttag

SEQ ID NO: 134280 - DNA, 3798 bp, Artificial Sequence
  Description of Artificial Sequence: Synthetic coding sequence
atggagtgccctgtaatggaaactgggtcactctttactagtgggatcaaacgacacctgaaggacaagcggatcagtaaaacaaccaagcttaacgtgagtctcgcatcaaagattaaaacgaaaattctgaacaatagcagcattttcaagatctcacttaagcacaataaccgagctctcgcccaggcgctgagccgggaaaaggagaactcaaggcggatcacaacggaaaaaatgttgctgcagaaagaagtggagaagctgaatttcgagaacacatttttgagactcaagctaaacaacttgaataagaaactcatcgacattgaggccctaatgaacaacaacctgatcacagctatagagatgagctccctttccgaattccaccaaagtagtttcctgttgagtgctagcaagaagaagaggataagtaagcaatgtaaacttatgagacttccttttgcccgcgttcccctgacatcgaatgacgacgaggatgaagataaagagaagatgcagtgtgacaataatattaagtccaaaacccttccggacatccccagttcaggtagtactactcagcccctcagtacgcaggataattccgaggttctgtttttgaaggagaacaaccaaaacgtctacggactggatgacagtgagcacatctctagtatagtggatgttcccccaagagaaagccatagccatagtgaccaatcctcaaagacttccctcatgagcgaaatgaggaacgcccagtccataggacgacggtgggaaaagccgagtccctccaatgtgacagaacgaaaaaagcgggggtccagctgggagagtaataacctctccgcagatactccgtgtgccaccgtcctcgacaagcaacatatcagttcacccgaactgaactgtaataatgagatcaacggccatacaaatgaaaccaataccgagatgcagcgcaacaagcaggacctgcccgggttgtctagcgagtccgcgcgggagccgaatgccgaatgtatgaaccagatcgaagataatgacgactttcagctccagaagacagtctatgacgcagacatggacctgactgcgtccgaggtgtctaagattgttacggtatccactggaatcaaaaagaaaagcaataagaaaacaaatgagcatgggatgaaaaccttcagaaaggtgaaggactcctcctccgaaaagaagcgggaaaggtctaagaggcagtttaaaaattcttctgatgtggatattggagaaaaaatcgagaatcgcacagagagatcggatgtcctcgacggcaagcggggggcagaagatccgggttttatcttcaacaacgagcagcttgcccagatgaacgagcaactcgcccaggttaatgaactcaaaaagatgacgcttcagacaggttttgagcaaggcgaccgggagaatgtgctctgcaacaagaaagaaaagcggattaccaacgaacaagaggaaacatactctctctctcagtcctccggaaaattccaccaggagtcaaaatttgacaagggacagaattcactcacatgtaacaaatctaaggcaagtaggcaaacttttgttatccataaactggaaaaggacaacctccttcccaaccagaaggataaagtgaccatatatgagaaccttgatgttaccaatgaattccataccgcaaacctgtccaccaaggataacgggaatttatgcgattatggcactcataacatcttagacctaaagaagtacgtaacagacatccaacctagcgaacagaatgagagtaacattaacaagcttagaaaaaaggtgaataggaaaacagaaatcatcagcgggatgaatcacatgtatgaggataacgacaaggacgtggttcatggcctaaagaagggaaattttttctttaaaacccaggaggacaaagagccaatcagcgaaaacatcgaagtgtcaaaggagctccagatccctgcactctctaccagggataacgaaaatcagtgtgactacagaacccagaacgtgctcgggcttcagaaacagattacgaatatgtatcccgtgcaacaaaatgagtcaaaagttaataagaagctgcgccagaaagtgaatcgaaagacagaaatcatcagtgaggtgaatcatctggacaatgataaaagcatcgaatacacggtaaagtcccatagcctgtttttgactcagaaagacaaagagataattcccggaaatttggaggatccctccgagttcgagactcccgccctgagcaccaaagactccggaaatctttacgattctgaaatacagaatgtgctgggggtaaagcatggccatgacatgcagccagcttgtcagaacgacagcaagattgggaaaaagcctaggttaaatgtctgccagaaaagcgaaatcatacctgagactaaccagatctacgaaaacgataacaaaggtgtgcacgatctcgagaaggataacttcttctcactgaccccaaaggacaaagagacaatctctgaaaacttacaggttaccaacgagtttcagacggtagacttgttaattaaagacaatgggaacctgtgcgactacgacacccaaaatatactggagctgaagaagtatgtcacagaccggaagtccgctgagcaaaacgagtcaaagataaataagctgcggaataaggtcaattggaaaaccgaaattatctcagaaatgaatcagatttacgaagacaatgataaggatgcccacgtccaggagagctacacaaaggacctggatttcaaggtcaataaatctaagcagaagttggagtgtcaggatatcattaataaacattatatggaggttaactctaacgagaaagagagctgcgaccagatccttgatagctataaagtggttaagaagagaaaaaaggagagctcttgcaaggctaagaacattctaacaaaagcaaaaaataaacttgcttcccagcttacggagtcctcccagacctctatatccctggaatctgacctcaagcacatcacgtcagaggctgacagcgaccccgggaatcccgttgagctgtgcaaaacccagaaacagagtacgacaaccctgaacaagaaggatttaccatttgtcgaggagatcaaggagggggagtgtcaagttaagaaagttaacaagatgacaagcaagtctaaaaaacgtaagacttcaattgaccctagcccggagagccacgaagtcatggagaggatattagacagtgtgcagggcaaatctactgtcagcgagcaggcggataaggaaaacaaccttgagaacgagaaaatggtcaagaacaaacccgatttttataccaaggccttcagaagcttaagcgagatccacagccccaacattcaagacagtagctttgatagtgtgagggagggactggtgcctttgtcggtctctagcggcaaaaacgttatcataaaagaaaatttcgcacttgaatgctcgcctgctttccaggtttctgatgatgaacatgagaagatgaataaaatgaagttcaaggtcaacaggaggacacagaagtctgggattggcgatagacccctgcaggacttgagtaacacaagcttcgtctccaacaatacagccgagtccgagaataaatcagaagacttgtcaagcgagcgcacatctagacgacgacgctgcaccccattctactttaaagaaccatcactgcgcgacaagatgcgaagatag

SEQ ID NO: 134281 - DNA, 744 bp, Artificial Sequence
  Description of Artificial Sequence: Synthetic coding sequence
atggagtgccctgtcatggagacagggagtctttttacttccgggattaagcgtcacttaaaagataaacgcatctctaagacaacgaagttgaatgtgtccctcgccagtaaaataaaaaccaagatactgaacaacagtagtatttttaagatatccctgaagcataataaccgagcactggcacaggctctgtccagggaaaaggagaactctaggcgcatcactacagagaaaatgctgctgcagaaggaggttgagaagctcaactttgaaaataccttcttgcgtctgaaactgaataacctgaataagaagctgatcgatatcgaagcactcatgaacaacaatctgatcacagccatcgagatgagttcactgagcgagttccatcagagcagctttctgctgtccgcaagtaaaaaaaaaagaataagcaaacagtgcaagctcatgcgcctaccattcgcccgcgttcccctcacctctaatgacgatgaggatgaggacaaggaaaagatgcagtgtgacaacaatatcaagagcaaaacactcccggacataccttcctccgggagcaccacacagcctttgtcaacgcaggataattccgaagtgctgtttcttaaggaaaacaaccagaacgtatatgggctggatgactcagagcacattagctcaatcgtcgatgttccgccacgcggcgaaatcgtcctcaagatccattttgaatacctgtactag

SEQ ID NO: 134282 - DNA, 264 bp, Artificial Sequence
  Description of Artificial Sequence: Synthetic coding sequence
atggagtgtccggtgatggagacgggtagtcttttcacgagtggcattaagcggcatctgaaagacaagagaatttctaagaccaccaagctaaacgtgtctctggcatcaaaaattaagactaagattttgaacaattcttccatattcaagatctcattaaaacacaataatagagctctagctcaggctctgtccagggaaaaagagaacagccgccggatcacaactgaaaagatgttactgcagaaggaggtggagtag

SEQ ID NO: 134283 - DNA, 753 bp, Artificial Sequence
  Description of Artificial Sequence: Synthetic coding sequence
atgagtatctttacacccaccaaccagatcagattgaccaacgtcgcggtggtacgtatgaagcgtgccggcaaacggttcgaaattgcctgctacaagaacaaagtggtggggtggaggtcaggtgtggaaaaggacctagacgaggtgctgcaaacacactccgtattcgtcaacgtcagtaaaggccaggtggccaagaaggaagacctgatctctgcgtttggaacagatgatcagacagaaatttgcaagcagattttgaccaagggcgaggtacaggtgtcagacaaagagcgacacacacagcttgagcagatgtttagggatattgcaacaatcgtggccgacaaatgcgtcaatccagagacaaagcgcccctacacggtgatcctgatcgaacgagcaatgaaagatatccactattccgtcaaaacaaacaaatctacaaagcagcaggccttggaggtgattaagcagctgaaggagaagatgaagatagagcgcgcccatatgaggctgcgctttatcctaccagtgaatgagggaaagaagctcaaggaaaaactcaaacccttgatcaaagtaatcgagtccgaagattatggacagcaactggaaattgtctgcctgattgatccgggatgctttcgggagattgatgagctgatcaagaaggagacaaaagggaagggatctctggaagtgctcaatctgaaggacgtggaagagggtgacgaaaaatttgagtag

SEQ ID NO: 134284 - DNA, 1572 bp, Artificial Sequence
  Description of Artificial Sequence: Synthetic coding sequence
atggtagcaccagggctggtactcggtctggtactcccattgattctgtgggccgacagatctgcgggcattggttttcgatttgcatcgtatattaataatgatatggtgctgcaaaaggaaccagctggcgcggtgatttggggctttggaacccctggcgcgacagtaactgtgacattaaggcagggccaggagactatcatgaaaaaggtgaccagtgttaaggcgcacagcgacacctggatggttgtgttggatccaatgaagcctggcggtccatttgaagtgatggcacagcaaacacttgaaaagatcaatttcacactacgggtacatgacgtcctgttcggcgacgtctggctgtgctctggtcaatccaatatgcagatgaccgtgttacagattttcaatgctacgagggagctttctaataccgcagcctatcaaagcgtccgcatactgtccgtaagccctatccaggccgagcaagaacttgaggatttagtagctgtggacttgcaatggagcaaaccaacctccgaaaatctgggccacggctactttaagtatatgagtgcagtatgctggcttttcggacgtcatctgtatgatactctccaatatccaatcggactgatcgcatctagctggggaggtacgccaattgaagcttggagctccggaagaagtctaaaggcctgcggcgtgcccaagcagggttcaattccctatgattcagttacagggccctccaaacactctgtgctttggaatgccatgattcatccgttatgtaatatgaccctgaaaggcgtagtctggtatcagggagagtcaaatatcaactacaataccgatctgtacaattgtacctttcccgccctgattgaagactggagggagacctttcataggggcagccagggacaaacagagagattctttcccttcggactggtgcagctatccagcgatctgagcaaaaagtcatcagatgatggctttcctcagattaggtggcaccagacagccgactttggctatgttcccaaccctaaaatgcccaatactttcatggcagtcgccatggacctttgcgatagggactccccgttcggttcgatccacccaagagacaagcagaccgttgcctatcggcttcacctcggcgctagagcactggcctacggcgagaaaaatctcaccttcgagggtccattgcccgagaagattgagctgctggcccataagggtttgttgaacctgacatactaccagcaaattcaagtgcaaaagaaagataataagatattcgagatctcttgctgcagtgatcacagatgcaaatggctgcctgcctctatgaacactgtcagtacccaaagcctgaccctggcgattgactcctgccacggcacagtagtggctcttagatacgcctggacaacctggccatgtgaatacaaacagtgtccgctgtatcacccgagctctgcactgcctgcccctccctttattgccttcataaccgatcaggggcctggccatcagtcaaatgtggctaagtag

SEQ ID NO: 134285 - DNA, 1467 bp, Artificial Sequence
  Description of Artificial Sequence: Synthetic coding sequence
atggtactgcagaaagaacctgcaggtgcagtgatctgggggttcgggacgccaggcgctacagtcaccgtgaccctcagacagggccaggagaccattatgaagaaagtgacctctgtgaaggcccactcagatacctggatggtggtgctggaccccatgaagcccgggggtcctttcgaggtcatggcccagcagactcttgagaagatcaatttcaccctgagggtgcatgatgtgttgtttggcgatgtgtggctgtgctctggacaatcaaacatgcagatgacagtgctgcaaattttcaacgccaccagagaactgagcaacacagcagcgtatcagagcgtgaggattctctcagtgagccctatccaggccgagcaggagctggaagatctagttgctgtcgatctgcagtggtcgaaacccaccagcgaaaacctgggacatgggtactttaaatatatgagcgccgtctgctggttgtttggccggcacctgtacgatactctgcagtatccaattggtctaattgcttccagctggggcgggactcccatcgaggcttggtcttcagggaggagcctaaaggcttgtggagtccctaagcagggttccatcccatacgacagtgtgacagggccctcaaagcattccgttctctggaatgctatgatccatcccctgtgcaacatgaccttgaagggggtggtatggtatcagggcgagtcgaacatcaattataacaccgacctgtacaattgcaccttcccggcgctaatcgaggattggcgcgagacctttcacagagggtcccagggtcagactgaaagattttttccattcggcctagtgcagctgagcagtgatctatccaaaaagtcttccgatgatggcttccctcagattagatggcatcaaaccgccgatttcggctacgtgcccaatcctaaaatgccaaacacctttatggccgtcgccatggatctatgtgatcgggattcacccttcggctctatccacccccgcgataagcagactgtcgcctaccggctgcacctgggtgcacgcgccctggcctacggggaaaaaaatttaacttttgagggccctctcccagaaaagatcgagctgctggcacacaaagggctgttgaacttaacttattaccagcagatccaggtgcaaaagaaggataacaaaattttcgaaatctcttgttgttccgatcaccgctgcaaatggctgcccgcttcgatgaacacagtgtccacacagtccctcaccctggctatcgactcatgtcatggtactgtagtggccctgcggtatgcgtggaccacatggccttgcgagtataagcagtgcccattataccacccttcatccgcacttcctgctcccccattcatcgcttttatcactgatcaggggccgggacatcaatctaatgtggcaaagtag

SEQ ID NO: 134286 - DNA, 2094 bp, Artificial Sequence
  Description of Artificial Sequence: Synthetic coding sequence
atgttattaccgctcctcctgagcagtctcctcggcggtagccaggctatggatggcaggttttggatccgcgttcaggaaagtgtcatggttcctgagggactatgcatctctgttccgtgctctttctcttacccacggcaagattggaccgggagtacgcccgcctacggttactggtttaaagccgttacagagacaactaagggcgcacccgttgcaaccaatcatcagagcagagaagtcgagatgtcaacgcgcggcagattccagcttaccggcgatccggccaaaggcaattgctcacttgttattcgagacgctcagatgcaggatgaatctcagtacttcttccgagtggaaaggggatcctatgtgcgttataattttatgaatgatggattcttcctcaaagtgacagctctcactcagaaacccgatgtttacattccggagactctggaaccgggccagcccgttacagtgatctgcgtgtttaattgggccttcgaagaatgccccccaccctcctttagctggaccggcgccgctttgtcttctcagggcaccaagccaactaccagtcatttttccgtgctatcctttacgccccggccacaggaccacaataccgacctgacatgccacgtggacttctctcggaaaggcgtgtcagcacagcgaaccgtaaggctgcgagtggcttatgcccctagagacctcgtaatcagcatatcccgtgataatactccagccctagagccacaaccccagggcaacgtgccctacttggaggcccagaaagggcaatttctccggctcctgtgtgccgctgacagccagccccccgccactctcagctgggtgttacagaatcgagtgctgtcatccagccacccttgggggcctcgtcccttgggcctggagctgcctggggtaaaggcgggagacagtggacggtatacttgcagagctgaaaaccgcctcggaagccagcaacgggctctcgacctaagcgtccagtaccccccagagaacttgcgggttatggtatctcaggctaatagaacggtgttggagaacctcggcaatggcacctcactgccggtgctggagggccaatccctgtgcttggtttgtgtgactcatagctcaccgccggctagattatcatggacacaacggggtcaagtgctctcccccagccagccctctgaccctggagtcctagagctcccgcgcgtccaggtcgagcacgagggcgagtttacttgccacgcccggcaccccctgggtagccagcatgtaagcctgagccttagcgtacattattcgcctaagcttttaggtccgagctgttcttgggaggccgaggggttgcactgttcctgcagctcccaagcctcgcctgcccctagtctgaggtggtggctcggcgaggaactgttggaaggcaacagcagtcaagattcatttgaggtgacaccttcatccgctggtccatgggcgaactcatcgctatctctgcatggtgggctgtccagcggactgcgcttgcggtgcgaagcatggaatgttcacggcgcacagtctggatccattctccagctcccagacaagaaaggactaatttccacggcattctccaatggagcctttctggggattgggatcacggcgctactcttcttgtgcttagctcttattataatgaagatactgccaaaacgtcggacccagaccgaaactccacggccgagattttctagacactcaacgatcctggactacataaatgtcgtgcccacagctggtccactggcccaaaagcgtaatcagaaagctactccaaactctcccagaacccccctccctccaggcgctccttcacccgaatcaaaaaagaaccagaaaaaacaatatcagttgccttccttcccagagccgaagtccagtactcaagccccggaatcacaagaatctcaggaagaactgcactacgccacactgaatttccccggggttcgacccagaccagaggccagaatgccgaaagggacgcaggctgattacgcagaggtgaagttccagtag

SEQ ID NO: 134287 - DNA, 1809 bp, Artificial Sequence
  Description of Artificial Sequence: Synthetic coding sequence
atgctgttacccctcctgctgtctagcctccttggcgggtcgcaggctatggatggcagattctggatccgcgtgcaggaatctgtaatggtgcccgaaggcctttgtatctccgtcccgtgcagtttttcttatccgagacaggattggactggctccacacctgcctatgggtactggttcaaagctgttactgaaactacaaaaggagcacccgtggccacaaaccaccaatctcgagaggtggagatgagtacgagaggtcgcttccagttaacaggcgaccccgccaaagggaattgttctttggtcattcgcgatgctcagatgcaagacgaaagtcagtattttttccgggtcgaacgcggctcttacgtgaggtataattttatgaatgatgggtttttcctcaaagtgacagctttgacacaaaaacctgacgtatatattccagagaccctggagccaggacagcccgtcacagtgatttgcgtcttcaattgggctttcgaagagtgtcccccgccctcattcagttggacaggcgctgcacttagctctcagggcactaaacctacaacatcccacttcagtgtcttatcctttactcccaggccacaggatcataacaccgatttgacttgccacgtcgatttctctagaaaaggcgtgtccgcgcaacgaactgtgcgtctgagggtagcctacgctccccgggatctagtgatcagcatcagtcgcgacaacacccccgccctcgagccccaacctcagggaaacgtcccttacctggaagctcagaagggccagtttctgcgcctgctctgcgctgccgattcccagccacctgctactctgtcttgggttctccagaaccgggtgctatcatcttctcacccatggggcccacgcccactgggccttgagcttccaggtgtaaaggctggagacagcggacggtacacctgccgggccgagaacagactgggtagccagcagcgtgctctggacctctctgtgcagtatccaccagaaaacttaagagtaatggtctctcaggccaatagaacagtgttagaaaacctagggaatggcacatcactgccagtgctggaggggcaatcactgtgcctggtatgcgtgacccactccagtccaccagcccggttgtcttggacccagagaggccaggtcctgagtccttctcagccctcagaccctggcgtgctggaacttccccgcgtgcaggtcgagcacgagggtgagtttacttgccacgcgcgacaccccttaggctcccagcacgtgtccctcagccttagcgtgcactacaaaaaagggctcatttccaccgctttttcaaacggcgcttttttaggtatcggcattaccgcactgctcttcttatgtctcgctctgataattatgaagatcttacccaaacgaagaacgcagacggaaactcccaggcctaggttcagcagacatagcacaatcctcgattacatcaacgtggtccccaccgctggccccctggcccagaaacggaatcagaaagcaacgcccaatagccctagaacccccctccctccaggagcccctagccctgaatctaaaaagaaccagaaaaaacagtatcaactgccctcatttcctgagcccaagtcgagcacgcaagctcctgagtcacaggagagtcaggaggagcttcattatgccacattaaactttccaggtgtaagaccaagacctgaggcccgaatgcccaagggaacacaggccgactacgctgaggtgaagttccaatag

SEQ ID NO: 134288 - DNA, 2094 bp, Artificial Sequence
  Description of Artificial Sequence: Synthetic coding sequence
atgctactgccactgcttctctcaagtctgctgggtggatctcaggccatggatggacggttttggatcagggtgcaggagagcgttatggtcccagagggactctgcatcagcgtgccatgtagtttctcctacccgaggcaggattggacaggctccaccccagcctatggctattggttcaaggccgtaactgagacaaccaaaggcgctcctgtggccaccaatcatcagtcccgtgaagttgagatgtccactagagggcgtttccagttgactggagacccagcaaagggtaattgtagcctggtcatccgggacgcccaaatgcaggacgaatcacaatacttttttagggttgagcgcggctcttatgtgcggtacaatttcatgaatgacggcttcttcctcaaagttaccgctttaacacagaaaccagacgtctacatcccagaaaccctggaaccaggtcaacccgtgactgtgatctgcgtctttaactgggccttcgaagaatgcccccctccctcctttagctggactggagcagcgctgagcagccagggaactaagccaaccacgagtcacttttcggttcttagctttacacctagaccacaagaccacaacaccgatctcacctgccacgtggacttcagccggaaaggagtttcagcgcagcgcacagtgagacttcgtgtcgcctacgctccaagggatctggttatctccatttccagagataacaccccagcactagaaccccagccgcagggcaatgtcccatacctcgaagcccagaagggacagttcctgcgcctcctgtgcgcagccgacagtcaaccgcccgccacactgagctgggtgctgcagaacagggttttgagcagttcacatccctggggcccaaggcctctcggactcgaactaccgggcgtcaaagccggagacagcgggaggtatacttgtagagccgaaaacaggctaggatctcagcagagggctttggatctaagtgtgcaatacccacccgagaatctcagagtcatggtgtcccaggctaacaggaccgtattagaaaacttaggaaatggcacgtcactccctgttttggaaggacaaagcttatgccttgtttgcgtaactcactctagtcccccagcacggctctcttggacccagagaggccaggtcctgtctccctcccaaccctctgatccgggagtcttagaattgcctcgcgtgcaggtcgagcatgagggcgaatttacctgccacgctagacacccacttggaagtcaacacgtgagtctctccctgtctgtgcattattcccccaagcttctggggccctcctgcagctgggaggctgaaggtctgcattgttcctgttcctctcaagcttcgcctgccccttctctgcggtggtggctcggcgaggaactgctggaggggaactcttcccaggacagctttgaagtcaccccatctagtgccggcccgtgggctaattcctctctctcccttcacggtgggctgtccagcggcctgcgactcaggtgtgaagcctggaacgtgcatggggcacagtctggatctattctgcagctgcccgacaaaaagggacttattagtaccgctttctctaacggggctttcctgggtataggaattactgctctgctttttctttgcctagccttgattattatgaaaatcctgcccaagcggcgcacacagaccgagaccccccggccacgtttctcccggcattccaccatcctggattatattaatgttgttcccaccgccggcccactggctcagaaaagaaatcagaaagccacacccaactcccctcgcacgcctcttccacctggggccccatctccagagtccaaaaaaaaccagaaaaagcagtatcagctcccctcctttcctgagccaaagtcgagtacccaggccccggagtcccaggagagtcaggaggaactccattacgccaccctaaatttcccgggcgtccgcccccgtcctgaggcccggatgccaaagggcacccaagccgattacgctgaggtaaagttccagtag

SEQ ID NO: 134289 - DNA, 1560 bp, Artificial Sequence
  Description of Artificial Sequence: Synthetic coding sequence
atgctcctgcctctactccttagttccctattgggaggtagccaggctatggacgggaggttctggattagggtacaggaatctgtaatggtgccagagggcctctgtatttccgtgccatgtagtttcagttatcccaggcaggattggaccggctccacccccgcttatggctactggtttaaggccgtaacagaaaccacgaaaggggcccccgtggctactaaccatcagtcccgggaagtcgaaatgagtactaggggccggttccagctcaccggcgatccagccaagggaaactgtagtctggtgatacgagacgcacaaatgcaggacgaaagtcagtattttttccgtgtcgagaggggctcctatgtccggtataattttatgaacgacggcttttttctgaaagtgacagccttgacccagaagacagtccgcttgagagtggcatatgcaccccgcgatctagtgattagcattagtagggacaacactccagctcttgagccccagcctcaagggaacgtgccatatctggaggcccagaaagggcagttcctccggctgctctgcgctgccgactctcagccacccgcaacactgtcgtgggtcttacagaaccgcgtcctgtccagctctcatccatggggtcctcgaccactcggcttggagttgccaggcgtgaaagcaggagattccgggcgatatacctgtagagccgagaaccgtttaggttcccagcagcgcgcacttgacctgtccgtccagtatccacctgagaatctgcgcgtgatggtgtcacaggccaaccgaaccgtcctcgagaatctcggaaatgggacttccctgcctgtgctggaaggacagagcctttgcctcgtttgcgtgacacactcctcgcctccggcaaggctgtcctggactcagcgcggacaggttctttcgcctagtcagcccagcgatccaggcgtcctcgaactccctagagtccaggtcgagcacgagggagagttcacctgccacgctcgccatcctctcggaagtcagcacgttagtctgtccctgagtgtccactacaagaagggcctcattagcaccgccttctcaaatggcgccttcctcgggatcggaatcaccgctctgctgttcctttgcctggcccttatcatcatgaagatcctgcctaagaggcgcacccagacagagacaccaaggccgaggttttcgaggcactccactattctagactatatcaatgtcgtgccaacagcaggaccattggcccagaagcgtaaccagaaggctacacccaactcaccccgcacgcctctgccccccggggctccctcacctgaatccaaaaagaatcagaaaaaacagtaccagttgccctccttcccggagccaaagtcatctacgcaagccccggagtcacaggaaagccaagaggagctgcactatgctaccctgaattttcccggcgttcgcccacgtcccgaggccaggatgccaaaggggacccaggccgactatgctgaagtcaagtttcaatag

SEQ ID NO: 134290 - DNA, 1920 bp, Artificial Sequence
  Description of Artificial Sequence: Synthetic coding sequence
atgttgctgcctttgcttctctctagtcttttaggtggtagtcaagccatggatggccgcttctggattcgcgtgcaagagagcgtcatggttcccgaaggtctgtgtatcagcgtgccctgtagttttagttatccccgacaggactggacaggatctacgcccgcctatggctattggttcaaggccgtgactgagactacgaagggggcccccgtggcaactaatcaccagtccagagaggtagaaatgtctactcgggggaggttccagttaaccggtgatcctgccaagggaaactgttcacttgtgatccgcgatgcccagatgcaggacgaaagtcagtacttcttccgtgtcgagagaggatcctacgttcgctacaactttatgaatgatggatttttcttgaaagtgacagtcctgagtttcacacctagacctcaggatcacaatactgacctaacatgccacgtggacttctctcgtaaaggggtgagcgctcaaagaacagttaggctccgagtggcctatgcaccacgggacctagtcatatccatcagccgggacaacacacccgcccttgaacctcagccgcaaggcaatgtaccctatttggaggctcagaaggggcagttcctcaggctcctgtgcgccgcagactctcagcccccagccaccctaagttgggttctccagaaccgagtgctgtcctccagccacccctggggcccacgccctttggggctcgagttgccaggggtgaaggcaggggactccgggagatatacttgtcgggccgagaacagactgggcagtcaacagcgcgctctcgacctgtccgtgcagtaccctcccgagaacctcagggttatggtttctcaggcgaacagaaccgtgctggagaatcttggcaacgggacgtccctgccggtgctggagggccagtccctgtgcctcgtgtgtgtcacacattcctccccacctgccaggttgagctggacccaacgtggacaggtgctgtcgccctcgcagccatcagatccgggcgttctcgagttgccccgcgtacaggttgagcacgaaggagagttcacgtgccacgctcgtcatcctctggggtcacagcacgtatcactttccctgtcagtacattattccccaaagctcttagggccaagctgttcatgggaggctgaagggctgcattgtagttgtagctcacaggcgtcccctgcaccttccctccggtggtggctgggcgaggagctcttggaaggtaacagttcccaggattcgttcgaggtgacaccctcgtccgccgggccctgggcgaattctagcctttctctacacggcggcctgtctagcggactgagactgcgatgcgaggcgtggaatgtgcacggcgcacaaagtggatctatcctccaactcccagataagaaaggcctcattagcaccgccttctcaaacggggcattcttagggattggtattactgctcttctgtttctttgcctggcactgatcattatgaaaattcttccaaagcggaggactcagaccgagacccctcgccccaggttctcacggcacagtactatcttggactatatcaatgtcgttccaacggctggccctcttgcacagaaacgcaatcagaaggcgacgcccaatagccccaggacccccttaccacctggcgctcccagcccagaatcaaaaaagaaccagaagaaacagtatcaactgcctagtttccctgagcccaagtcctccacccaggcccctgagagccaggaaagccaggaggagcttcactacgccacattaaatttccctggtgtcagaccccggccggaagctagaatgcctaagggaacccaggcagattacgccgaagtgaagttccaatag

SEQ ID NO: 134291 - DNA, 1635 bp, Artificial Sequence
  Description of Artificial Sequence: Synthetic coding sequence
atgctgctgccactcttactgagctccctgcttggtgggtcccaggccatggacggcaggttctggatccgcgtgcaggagtcagtcatggtcccagaggggctttgtatttcagttccatgttccttctcatatcctaggcaagattggacaggaagtacgccagcttatgggtactggtttaaggctgtaactgaaaccacaaaaggggctccagtcgctaccaaccatcagagcagggaagttgagatgtctacccgcgggagatttcagttaacaggtgacccagccaagggtaattgttccctcgtcatacgcgatgcccagatgcaagatgaaagccagtatttctttcgtgtggaaagaggctcctacgtccggtacaatttcatgaatgacggattttttctgaaggtcacagtgctgtcttttacacccagaccgcaggatcataacacggacctgacatgccacgtagacttcagccggaaaggcgtttcagctcagcgaacagtacgactcagagtcgcttacgccccccgggatcttgtcatcagtatctcccgggacaacacacccgcccttgagccccaaccacagggtaatgtgccttatcttgaggcacagaaaggtcagttcttacgcctgttatgtgcagcagatagccagccgcctgccacgctgtcatgggtgttgcagaatcgcgtgctgtcgagcagtcacccctggggccctagacctctgggcctggaactgcctggagtgaaagccggcgattcagggcggtacacctgccgcgctgagaatcgcttgggatcacagcagagggctctggatctgtcggtgcagtaccctcccgaaaatttacgggtcatggtgtcccaggcaaataggaccgtgctggaaaacctgggcaacggtacctccctccctgttctagaaggccagtccttatgtctggtgtgcgtgacccattctagcccgcccgctaggctctcatggactcagcggggtcaagtgctgtctccttcccagcctagtgatccaggcgtacttgaacttcctagggtgcaggtcgagcatgagggggaattcacatgtcatgctcgccatcctctgggctcgcaacacgtaagtttatccctgagtgttcactacaaaaaagggctgatcagcaccgccttttctaatggcgctttcctcggaatcggaattacagctctccttttcttgtgcctggccctgataatcatgaaaattctgccgaagaggcgaactcagactgagacacctagaccgcggttctcgcgccatagcacgattttggactatattaatgttgtgccaaccgccggtccgctggcacagaaaaggaatcagaaagctacgccgaactcccctcggactcctctgccacccggcgccccaagccctgaaagcaaaaaaaatcagaagaaacagtaccaacttccatcttttccagaacccaaatccagtacccaggccccagagagccaagagtcccaggaagagctgcactacgctactctcaattttcctggcgtccggcccagacctgaggcccggatgcctaaaggcacacaggccgactacgccgaggtaaagttccagtag

SEQ ID NO: 134292 - DNA, 1365 bp, Artificial Sequence
  Description of Artificial Sequence: Synthetic coding sequence
atgctgctgcctctgctgctgtcgtctcttctgggtggctcacaagccatggacgggcgattttggatcagggttcaagaatctgttatggtgcctgagggactgtgtattagtgtcccttgcagctttagctacccaaggcaggattggacgggctctacacccgcctatggctattggtttaaagctgtcacagagacgacaaagggggcacctgttgccacaaaccatcaatcccgcgaagtcgaaatgtctacacgcggccggttccagttgactggtgacccagctaagggcaactgcagcttagtaattagagatgctcagatgcaggatgagagccagtattttttccgcgtagagagaggatcttacgtgaggtataacttcatgaatgacggtttcttcctaaaggtgacggtcttgtcatttacaccacgcccccaagaccataatactgacttgacctgccacgtggatttttcccggaaaggggtgagtgcacagcgcaccgtcaggctgcgcgttgcgtacgcccctagagatctggtgatcagtatctcacgggataatacccccgatcccccagagaacctcagggtgatggtgagccaggccaatcggactgtgctagagaacctggggaatggaacaagtcttcccgttttagaagggcaatcactttgcctcgtctgcgtgacccactcctctccacccgctcgattaagttggacccaacgcggacaggtgctttcccccagccagccatccgatcctggggtgctcgagctgccccgcgtccaggtggaacacgagggtgaatttacttgccatgcacgccatccgctcggttcccagcacgtgtccctgtctctgtcggtgcattataagaagggtttaatctctacggccttcagtaatggcgcctttttgggaatcggaatcacagcattgctgtttctgtgcctggctttgataatcatgaagatcctgcccaaaagacgcacgcagacggaaacaccaaggcccagatttagccgtcattccacaattctagattacattaacgtggttccaaccgcaggaccgctagctcagaagagaaatcagaaagccaccccgaatagccctcggacccctctccccccaggagccccaagccccgagagtaagaaaaatcagaagaagcaatatcagctcccctcttttcccgagccaaagtcgtcaactcaggcgccagagtctcaggagtcccaggaggagttacactacgcaaccctcaatttcccaggcgtccggccgcggccagaggctaggatgccaaaggggactcaagctgactacgctgaagtaaagtttcagtag

SEQ ID NO: 134293 - DNA, 1665 bp, Artificial Sequence
  Description of Artificial Sequence: Synthetic coding sequence
atgctcctgcccctgctgctgtcgtctctcttggggggcagtcaagccatggatggtaggttctggattagagtccaggagagcgtaatggtcccagaaggtctttgtatatcagttccttgcagcttcagctatccaagacaggattggacaggctcaactccggcctatggttactggtttaaggcagtaacagagaccaccaaaggcgccccggtggccactaaccatcagtccagggaagttgagatgtctacaagagggagattccagctaactggtgatcctgcaaaggggaactgctcactggtaatcagagatgcccaaatgcaagatgagtctcagtacttcttcagagttgaacgtggaagttacgtgcgatataatttcatgaacgacggtttttttctcaaagtgacgggtactaaaccgacaacaagtcatttctctgttctgagttttactcctaggccacaggatcataacactgacctgacatgccatgtcgacttctcccgcaagggcgtgagtgcacaacggaccgttcgccttcgtgtcgcttatgcccccagggacctggtgatttcaatcagccgagacaatactccagccctcgagccgcagccacagggcaatgttccatatcttgaagctcagaaggggcagttcttgaggttgctctgcgctgccgatagccaacctcccgctacgctgagttgggtgctgcagaaccgcgtgttatcctcatcacatccttggggccctaggcctcttggactcgagctgccaggcgtgaaggctggtgacagcggacgctacacctgtagagcagaaaataggttagggagccagcagcgggcgctcgatttatctgtacagtacccccctgagaacctgagggtgatggtgagccaggccaaccggaccgtgcttgaaaatcttggcaacggtacctcgctgcccgtgcttgagggacaatctctttgcttggtttgcgtgacacactcttctccccctgctcgtttgtcatggacacagcggggccaagtactcagcccctctcagccgagcgacccaggcgtcctcgaattacctcgggtacaggtggagcatgagggcgagtttacttgtcacgcccggcaccccctagggagccaacacgttagcctgtctttatccgtccactacaagaagggactgatctccactgcattttctaatggcgcctttctggggatcggtattacggccctgcttttcctgtgtctggccctgatcatcatgaagatcctgcccaaaaggaggacccaaacagagaccccacgtccccgattcagccggcactccaccatcttagactatataaacgtggttcctactgcggggcctctcgcccagaagcggaaccaaaaggccaccccaaacagccccaggacgccccttcctcccggggcgccgtccccagagagtaagaagaatcagaaaaagcagtaccagctgcctagctttcccgagcccaagtcttccactcaggcccctgaatcccaagaaagccaagaggagttacactacgcaacgttaaactttcccggtgtgcggccacgcccggaggctcggatgccaaaaggcacccaggccgactacgctgaagtcaaattccaatag

SEQ ID NO: 134294 - DNA, 2097 bp, Artificial Sequence
  Description of Artificial Sequence: Synthetic coding sequence
atggtgccaggacaggcccagcctcagtcacctgaaatgctgctcttacctcttctgttacccgtgctgggcgctgggagtctgaacaaagatccctcttactctctccaggtccagcgacaagtgcccgtgcccgaaggactgtgcgtgatcgtgtcctgcaacctgtcttatccccgcgacggctgggatgagtccacagctgcttacggttattggtttaagggacgcacatcacccaagaccggcgcgcccgtggctaccaacaatcagtcgcgagaggttgagatgagtacacgggaccgctttcagctgaccggcgacccgggtaagggatcctgctcactcgtgatacgcgatgcacagagagaggatgaggcatggtactttttcagggttgagcgtggttcacgtgtccggcacagctttctgagtaacgccttctttctcaaggtgactgccttaacaaaaaaacccgatgtttacattccagagactctggagcctggacagcctgtcaccgtgatctgtgtttttaactgggcgttcaaaaaatgtccggccccgtccttttcctggactggcgccgccctcagcccaagacgtacccggccatccacttcccatttcagcgttttgtccttcacgccgtcccctcaggatcatgacaccgacctgacctgccatgtggattttagccggaaaggagtatccgctcagcggaccgtgcgtctgcgggtagcttatgcccctaaagaccttattatctctatttcacatgacaatacctctgcactcgaactgcagggcaatgtgatttacctagaagttcagaagggccaattcctgcgcctcctatgcgctgcagacagccagccacctgctaccctatcttgggtcttgcaggatcgggtcctttcctcttctcatccatggggccctaggacccttggcctggaactgaggggcgtgagggcaggtgattctggacgctacacatgtcgagccgagaatagactgggctcacagcaacaggcactggacctgagtgtacaataccctccagagaaccttcgtgtcatggttagccaggccaacagaactgtgctggaaaaccttggcaacggaacatccctccccgtgctggaaggacagtcactcaggcttgtgtgcgttactcactcctcccctcccgctcgactgtcttggacaaggtgggggcagaccgtcggaccatcccagccaagcgacccgggcgtcctggagctgccgccaatccagatggaacatgaaggggaattcacatgccacgcacagcatccattgggaagccaacacgtgtcactcagcctgtcagtgcattaccctcctcagctgttgggcccgtcctgttcttgggaggccgaaggactgcactgtagttgttcttcacaggcgtctcccgcgcccagtctgcggtggtggctcggagaagagctgctcgaaggtaatagctcccagggcagcttcgaggttacgccctcctctgctgggccgtgggcaaattcaagcctctctctccacggtggcctctcctccggtttgagacttaggtgtaaggcatggaacgtgcatggcgcccaatccgggtctgtgtttcaacttcttcctgggaaactcgagcatggcggcggcctaggcctcggtgctgctctgggcgctggcgtcgccgcactcctcgctttctgctcctgtctggtggtattcagagtcaagatttgtaggaaagaagcccggaaaagagctgccgccgagcaggatgtgccctcaaccttggggcctattagccaaggacatcagcacgagtgttctgcaggtagcagtcaggatcaccctcctccaggggcagcaacatataccccaggaaagggcgaagagcaggaactccactacgcttccctctcctttcagggattacgcctttgggagcctgcagatcaggaggcaccttccaccaccgaatactcggaaataaaaattcacactggtcagcccctccggggcccaggcttcggactgcagttagaacgagagatgagcggcatggtgcctaaatag

SEQ ID NO: 134295 - DNA, 1809 bp, Artificial Sequence
  Description of Artificial Sequence: Synthetic coding sequence
atggtgcctggtcaagcccaacctcaatctccagaaatgctcttgttgcccctccttctgcccgtactcggcgctggaagcctgaacaaagatccctcttatagtctgcaggtccagaggcaagtccccgtacccgagggattatgtgttatagttagttgcaaccttagttaccctcgagacggctgggatgagtccaccgccgcttatggctactggtttaaggggcgaacaagccccaagacgggggctcccgtggccacaaataaccagtccagagaggttgagatgtcaacccgtgaccggttccaacttacaggagaccccggtaagggatcctgcagccttgtcattcgagatgcacagagggaggacgaggcatggtatttcttcagagttgagaggggcagtcgggtgcggcactctttcctgtcgaacgcgttctttctgaaagtaacagcactcaccaagaagcccgacgtatatataccggagactctcgagcccggacagcctgtcaccgtcatttgcgtgttcaattgggccttcaagaagtgtccagcaccaagcttttcctggacaggcgcagcgctgtcacctcgccgaactaggccctcaacgtcccacttctcggttctaagttttacaccttccccccaggaccacgacactgacctgacatgccacgtagacttcagtcgcaaaggcgtgtctgctcaacgtaccgttcggcttcgtgtggcttatgcccccaaggatctcatcatctcgatctctcatgacaacacgtcagccctggaactgcagggcaatgtaatatacctcgaggtgcagaaggggcaatttctgcgcctactatgtgctgctgactctcaaccccccgccaccctgtcgtgggtgcttcaggatcgcgtcctgtcctcatcacacccatggggacctaggacgttggggttggagttgcggggcgtgcgggcaggagactccggcagatatacttgtagagctgaaaacagactaggctcccagcagcaggccctggatctttctgtccagtacccccctgaaaacctgcgtgtgatggtgtcacaggctaaccggacagtgttggagaaccttggaaatggcactagccttcctgtgttggaagggcagtcgctaaggttggtatgcgtgactcattcctcccctcctgcacggttgagctggaccagatggggtcagactgtggggccttcacaaccgtctgatccaggcgtgcttgaactgccaccaatccaaatggaacacgagggcgagttcacatgtcatgctcagcatccgctgggaagccaacacgtatctctgagcctgtccgtgcactggaaattagagcacggtggcggcttgggcttgggggctgccttaggggcgggagtggcagccctcctggctttttgtagttgccttgttgtgttcagggttaaaatctgccgaaaagaagcccgaaaacgtgctgccgccgagcaggacgtgccgtcaacactgggccccatatcacagggccatcagcacgagtgctccgccggatcctcccaagatcatccccccccaggagctgccacttacacgcctggaaagggagaagaacaagagctccactacgcaagtctcagttttcagggactcagactttgggagcctgcggatcaggaagctccctccaccactgaatattccgaaattaagatccacactgggcagcccctccgtggaccaggttttgggctccagctggagcgtgagatgtccggaatggtgcctaagtag

SEQ ID NO: 134296 - DNA, 1809 bp, Artificial Sequence
  Description of Artificial Sequence: Synthetic coding sequence
atggtacccggacaggcacaaccccagtcgcccgagatgcttctccttccactgctgttgccggtcctgggggccggctccttaaacaaagatcctagctactctctgcaggttcagagacaggtgcccgtgcctgagggactgtgcgtcatcgtgtcttgtaatcttagctatcccagagatggctgggatgagtcgactgccgcttatggctattggttcaaagggcggacctctcccaaaaccggcgctcctgtcgccacaaataaccagtctagagaagtcgagatgagcacccgcgatcggttccagctgaccggcgaccctggaaaaggtagctgtagcttggtgatcagggatgcgcagagagaagacgaagcatggtacttctttagggttgagaggggtagccgagtaagacatagcttcttatccaacgccttctttctaaaagtcaccgcactgactaagaaacccgacgtgtatattcccgagacactggagcccggccaacccgtaaccgttatctgtgtgtttaactgggcctttaagaagtgccccgcaccaagcttttcctggaccggggcagcccttagccctcgaaggacacggccctccacctcccatttctcagtcttgagtttcaccccctctcctcaggaccatgacactgacctaacatgccacgtcgacttttcccgcaagggcgtgtccgcccaaagaacagtgcggctccgggttgcctatgcacctaaggatttaattattagcatctcccatgacaatacaagtgccctggagctccagggaaacgtgatttatctcgaggtgcagaaaggacagttcttaagacttctgtgcgctgcagatagccagccacctgccactctctcatgggtcctgcaagaccgtgttctcagctcttctcatccctgggggccaaggacactgggactggagttaaggggagtcagggccggcgactccggcaggtatacatgccgagctgagaacaggctcggttcacagcagcaagcactggatctttcagtccagtacccccccgaaaatctgcgcgtaatggtgtctcaggccaataggaccgtcctggagaaccttggcaatggaacctccttgcctgttcttgaagggcaatccctccgcttggtctgcgttacccacagcagtccgcccgcccgattatcatggacccggtggggccagacagtaggaccctcccagccgtctgatccaggagtgctggaacttccccctatccagatggagcacgagggggagttcacctgtcacgcgcaacacccactgggatctcaacatgtcagcctgtcactctcagtacactggaagctggagcatggagggggcctagggctgggggcagctctcggggcaggcgtcgctgcactcctcgcattctgttcctgtttggtcgtctttcgcgtgaagatttgccggaaggaggccagaaagagagccgccgcagaacaggatgtgccttctactctaggccctatcagccagggtcatcagcacgaatgttccgccgggtcatcccaggaccatcctcctccgggggcagcaacctacaccccgggtaaaggcgaggaacaggaacttcattacgctagtttgtcctttcagggactgcggctctgggagcccgctgaccaagaggctccctcaactacagagtactccgaaattaaaatccatactggccagcccttgcgcggtcctggattcggactgcagctagaacgtgagatgtccggtatggtgccaaagtag

SEQ ID NO: 134297 - DNA, 1788 bp, Artificial Sequence
  Description of Artificial Sequence: Synthetic coding sequence
atgcttttgttacttctcctgcttcctcccttattatgcggacgagtgggtgcgaaagagcagaaagattatttgttaacaatgcagaagagcgtgacagtgcaagagggattgtgtgtctcggttctgtgttcgttcagctacccccagaacgggtggaccgcctccgatccagtacatggctattggtttagggcaggagaccacgtgtcccgtaatatccccgtcgctacaaataatccagcccgcgcggtgcaggaggaaaccagagaccgctttcatctgctgggtgacccccagaacaaggactgtaccctgagtatcagagacacccgggagtctgatgccggaacttatgttttttgcgtagagcggggcaatatgaagtggaactacaagtatgatcagctcagtgtgaacgtcacagcaagccaggacctgctcagtcggtacagactggaagtcccagagagcgtgaccgtgcaggaaggcctttgtgtttccgtgccttgttctgtgttgtatccccactataactggacggccagttcacccgtatatggtagttggtttaaggagggcgcggatattccttgggacatacctgtcgctactaatacgccctctggaaaggttcaggaggatacacacgggcggttcctgctgctcggtgaccctcagactaataactgcagcctatctattcgcgacgcaaggaagggggactccggcaaatactacttccaggtggagcgcgggtctcgcaaatggaactacatttacgacaagcttagtgtccacgtgacagctcttacgcacatgcctacattttctatcccaggcacattggaaagcggccacccccggaatcttacatgcagcgtcccctgggcctgcgagcagggtacccctcctaccatcacatggatgggggcatcagtcagtagtctagacccaactattactaggtccagtatgttgagcttgatcccccagcctcaagatcatggcacaagcctcacctgccaggtgacactgcctggcgccggggtcactatgacccgggcagtgagactcaacataagctacccaccgcagaacctgacaatgaccgtgttccaaggcgatggcactgccagtaccacgttgcggaatggaagcgccttgagtgtactggagggacagagcctgcatcttgtgtgtgcagtcgactctaatcctcccgctcggctgtcatggacttgggggtctttgacactctcacccagccagtccagtaacttaggagttctggagctgcctcgggtacacgtgaaggacgaaggcgaatttacatgtcgcgcccagaatcccctcggaagccagcacatttccctgagcctctccctccagaacgaatatactgggaagatgaggccaatctcgggggtgacgctaggcgccttcggcggcgcaggcgcgactgcattggtattcctgtacttctgtatcattttcgtggtggtccgcagttgccggaagaaatccgcccggcctgccgtcggtgtcggcgacaccggaatggaagacgctaacgccgttcgtgggagcgcgtcccaaggtcccttgattgagtccccggcagacgattctccaccccaccatgctcccccagcactagccaccccatcacccgaagaaggtgagatacagtatgccagcttgtctttccacaaggcaagaccccagtacccccaggagcaggaggctataggctacgagtatagcgagataaatatcccaaaatag

SEQ ID NO: 134298 - DNA, 1290 bp, Artificial Sequence
  Description of Artificial Sequence: Synthetic coding sequence
atgcctctgtgcagacctgagcacctgatgccacgagctagccgcgtaccagtcgcagcatctttgcccttgagccatgcagtgattcctactcaactgccgagcaggccaggccaccgcccccccggaaggcctcggcgatgcccgaaggccagctgcctgccacctcctgtggggccatcatcgacccaaacagcgaagcgggttactatgggatggccgcgccccgggcgcgccctggtcgccgtgaaggcactgcttgttttgagcctgttgcaggtacctgcccaggccgtcgtgagggccgtcctcgaggacaattcgtcaagcgtagacttcgctgaccttcccgcactattcggagtgcctctggcaccggagggcattcgaggttatctgatggaagttaaaccagctaatgcctgccatccaatagaggccccccgcctaggaaatcgctccctgggcgcaattgtgctgattagacgttatgattgtacatttgatctgaaagtgctgaacgcccaacgcgcaggtttcgaagccgccatcgtgcacaatgtgcatagtgacgatctggtgtccatgacacacgtgtacgaagaccttcgcggtcagatcgcaatcccttcggtgttcgtttcggaagctgcgtcgcaggatctgagagtcatcttaggctgcaataagtctgcccatgcgttgctgttgccagacgacccaccatgccacgatttaggatgtcaccctgttttgaccgtatcatgggtactcggttgcactctagcgctcgtggtaagcgctttctttgtattgaaccacctatggctctgggcgcaggcttgttgttctcacaggaggcccgtcaagactagcacgtgccaaaaggcccaagttcgcaccttcacatggcataacgatttatgcgcgatttgtttagacgaatacgaggagggcgaccagctgaagatcctgccctgttcacatacttaccattgtaaatgcatcgacccatggttctctcaagcgcctcggcgcagctgccccgtatgtaaacagtctgtagccgccacagaagacagttttgatagcacgacgtactcattcagggacgaggatccgagcctgccggggcataggccgccaatctgggccattcaggtacagctcaggtctcgacggctcgaactcctgggccgggccagccctcactgtcactgctccaccacttccctggaggccgaatacactacagtgagtagcgcaccaccagaagcccctgggcagtag

SEQ ID NO: 134299 - DNA, 1656 bp, Artificial Sequence
  Description of Artificial Sequence: Synthetic coding sequence
atgctgcccttgctgctcctcccactgctgtgggggggcagcctgcaagagaagccagtctatgaacttcaggtgcagaagagtgtgaccgtccaggaaggcctttgtgtcctagtcccttgcagttttagctatccatggagaagctggtattctagcccccccctatatgtgtactggtttcgagacggagaaatcccctattatgctgaagtagtggccactaacaatccagatcgcagggttaagcctgaaactcagggacgctttaggctgctgggtgacgttcagaagaaaaattgctctctgtcaattggcgatgctcgaatggaagacaccggctcctatttttttagggtggagagggggcgggacgtgaagtattcataccagcagaataaattaaacctggaagttaccgccctgatcgagaaaccagatatccattttctcgagccactggaaagtggccggccaacccggttatcatgctcactccccgggtcctgcgaggcgggcccaccgctgacattctcctggaccggtaacgccctctcccctctggatcccgaaaccacccgcagctctgagctgaccctgacgccgcgacctgaagaccacgggacaaaccttacgtgccaaatgaaacggcagggcgctcaagtgaccaccgagcgcactgtgcagctgaatgtgtcatacgcgcctcagaccattaccatcttcagaaatggcatcgcactggaaattctacagaacacgtcctatcttcccgtcttagaggggcaagctctcaggttattatgtgatgcgcctagcaacccacctgcgcatctttcctggtttcaaggttcccctgccctcaacgctacaccaattagcaatactggaatactggaactccgacgcgtgcggagcgccgaggagggagggtttacgtgccgagcgcaacatccattaggctttctgcagatcttcttgaacctaagtgtgtacagcctgccgcagctgttgggcccttcctgcagctgggaggcagaaggactgcactgtagatgtagctttcgggcccgtccagccccatctctttgttggaggctggaggaaaagcccttggaaggcaactcttcacagggttctttcaaggtgaacagttcttccgcggggccctgggccaatagcagcctgatactgcatggcggccttagttctgacctgaaggtttcctgcaaagcttggaacatttatggctctcagtccgggtcggtactgcttttgcagggcagatcaaaccttggaactggggtggttcccgccgctctggggggggcaggggtgatggcgctgttgtgcatttgtctgtgccttattttttttctgatcgttaaagcccgacgcaagcaggccgccggacggcccgaaaaaatggatgatgaggatccaattatgggcaccattacctccggcagcaggaaaaaaccttggccggactcccctggcgatcaggcctctcctccgggggatgcccccccactggaagagcagaaggagcttcactacgcatctctttctttctctgaaatgaagagccgggagcccaaagatcaagaggctccctctaccactgagtacagtgagataaagacctcaaaatag

SEQ ID NO: 134300 - DNA, 1062 bp, Artificial Sequence
  Description of Artificial Sequence: Synthetic coding sequence
atgcagggcgcccaggaggctagcgccagcgagatgcttcccctgttgcttccgttactctgggccggcgctctggcccaggaacgacgctttcagctggagggaccggagtcactcacagtccaggaagggttgtgtgtgctggtcccctgtcgcctccccaccacactccccgcctcctattatggctatggttactggtttctagagggagcggatgttccggtcgctacaaacgaccccgacgaagaagtgcaggaggagactagggggcgcttccatctcctatgggatccacgccgtaaaaactgctccctatctatcagagacgcacgtagacgcgataacgcggcctacttctttcgccttaaatctaagtggatgaagtatgggtataccagcagtaaactctcagtgcgtgtgatggccctgacacatcggccaaacatctctatccctggaactttagagagtggccatccttccaatcttacctgctcagtcccatgggtctgcgagcagggaactcctccaatcttcagctggatgtccgccgcgcccacttccctcgggcctcgcacaacccaatcttccgtgctgaccattacaccacggccccaagatcactccacaaacctcacatgtcaggtgactttccctggcgcgggagttaccatggaacggaccatccaactcaatgtcagttacgcccctcagaaggtggctatctctatcttccagggtaattctgccgctttcaaaatcctgcagaatacaagctccctgcccgtgctcgaggggcaggccttaaggcttctgtgtgatgccgatgggaaccctcccgctcatttgtcttggttccaaggcttcccagccttgaacgctacacccattagtaataccggagtcctggaactgccacaagtcggtagtgctgaggagggcgatttcacctgtcgggcccagcacccgttggggtccttacagataagtctgagcctgttcgtgcattggtccagcgccccagtccctgacaggcattctttcaggccaccatgctag

SEQ ID NO: 134301 - DNA, 1281 bp, Artificial Sequence
  Description of Artificial Sequence: Synthetic coding sequence
atgctacccctcctgctaccattactgtgggctggggccctcgcccaggaacgtcggtttcagctggagggacctgagagcctcactgtgcaagagggactgtgcgtgttggtgccatgtaggctgcccactacactccccgccagctactacggatatgggtactggtttctcgagggggccgatgtgcccgtggcaactaacgatccagatgaagaggtccaggaggagacccgcggtcgttttcatttactctgggaccccagacgcaaaaattgttctttaagtatccgagatgcccgcaggcgagacaatgcagcttacttcttccgcctgaaaagcaaatggatgaaatatggatacacctctagcaaactgtccgttagggtgatggcactgactcataggcccaatattagtatcccaggaacgttggagtccgggcatccctcaaatttgacctgctccgtaccctgggtgtgcgaacagggcactcctccaatcttcagttggatgagcgcagctcccacaagtctgggccctcgcactacccaaagttcagtgcttactattacgcctcggcctcaggatcactccacgaatctgacttgccaggtcacctttcccggagcaggtgtcacaatggaaagaactatccaacttaacgtatcgagcttcaaaattttgcagaatacttccagcttaccggttctggagggacaagcccttcgtctgttgtgcgatgcggacggtaatccacccgcacatctgtcgtggtttcaagggtttcctgctttaaacgctacacccatctctaacaccggcgttcttgagttgccacaggtggggagcgctgaggaaggtgacttcacatgcagagcgcaacaccctctgggatctctccagattagcctgtccctctttgtacattggaaaccggagggcagggccgggggggtccttggcgccgtgtggggcgccagcattaccactttggtgttcctgtgcgtgtgtttcatatttcgcgtgaaaaccaggcgcaagaaggccgctcagcccgtccagaatacagatgacgttaacccagtgatggtaagcggcagcagaggtcatcagcatcagtttcagaccgggattgtaagcgaccaccccgcagaggccggcccaatctcagaggatgagcaggagctccactacgcagtgctgcattttcacaaggtgcagccacaggaaccgaaagttactgacacagagtactccgaaatcaaaattcacaagtag

SEQ ID NO: 134302 - DNA, 1314 bp, Artificial Sequence
  Description of Artificial Sequence: Synthetic coding sequence
atgcagggagcacaggaggccagtgctagtgagatgctgcctttgctgctgccattgctctgggctggtgcgctcgcccaagaaaggcgattccaactggaagggccagagagcttaactgtgcaggagggtttatgcgttcttgtgccctgtagattaccaaccacccttcccgcgtcatattatgggtacgggtactggttcttggagggcgccgacgtgcctgtagctaccaatgatccagatgaagaggtccaggaagagacaaggggccggtttcacttactttgggaccccaggagaaaaaactgtagcctctcaatcagagatgctcgaagacgtgacaacgctgcatacttttttcgcttgaagagcaaatggatgaagtatgggtacacttctagtaaactatctgtcagagtgatggccttaacccacaggcctaacattagcatcccggggactctagaatccggacacccctccaacctcacctgctctgtgccatgggtttgcgaacaaggaacaccccctattttttcatggatgtccgccgcccctactagcctggggcctcgcaccactcagagcagcgtgttgacaatcacacctaggcctcaagaccacagcactaatttgacttgtcaggtaacgtttcccggagctggggttaccatggaacgcaccattcagctgaacgtgagctcctttaagattctccagaataccagctccctaccagtgctggagggccaggcattgcggctgctatgtgacgccgatggcaacccccctgcccacctctcttggttccagggattccctgctctgaatgctacacccatctccaataccggagtactggagttgccccaggttggctctgccgaggaaggagactttacctgccgggcacagcatcccctgggcagcttgcaaatcagtctcagcctcttcgttcattggaaacctgagggtcgggccgggggggtactgggggccgtgtggggagccagcataaccaccttagtgttcctctgcgtctgttttatctttcgtgtcaagaccagacgcaaaaaggccgctcagccagtgcagaacactgatgacgtgaaccctgtgatggtatccggctccagaggtcaccagcatcagtttcaaactggcattgtgagcgaccaccctgcggaggccggacctataagcgaggatgaacaggaacttcattacgccgttctgcatttccacaaggttcagccacaagagcctaaggtgactgacaccgagtactctgagattaagatccataaatag

SEQ ID NO: 134303 - DNA, 1362 bp, Artificial Sequence
  Description of Artificial Sequence: Synthetic coding sequence
atgcagggcgctcaagaagcgtccgccagcgaaatgctcccactcttgcttcctctcctgtgggccggcgcccttgcacaggagcgcagatttcagctggaaggaccagagagcttgactgtgcaagagggcctctgcgtactggtcccttgtcgcctaccaacaacgcttccagcctcgtactatggatatggttactggtttctggagggagctgacgtcccagtggcgaccaacgatccagatgaggaggtgcaggaggaaacacgaggccggttccatctcctgtgggatccaaggcgcaagaattgctcccttagtatccgtgatgctcgacgccgggataacgcagcatacttttttcgcctcaagtctaaatggatgaagtacggatacaccagctctaaactgtcagtcagagtgatggcactcactcatcgtcccaacatttccatccccggaactctagagtcgggacatccatcaaatttgacatgcagtgttccatgggtgtgcgagcagggtacaccacccatcttcagctggatgtctgccgcccccacctctttggggcctcgcaccacccagtccagcgtccttacaattaccccccggccgcaggatcactctactaatctgacctgtcaggtgacttttcccggggcaggggtgaccatggagaggacaattcagctgaatgtctcttacgcaccccagaaagtggccatcagtatattccaaggcaacagcgcagcctttaagatcctacaaaacaccagctccctacccgtactggaggggcaggcattgcgcctattgtgcgacgctgacgggaatcctccagcacatctttcgtggttccagggattccctgcactgaatgctaccccgatcagcaatacgggcgtgctcgaactcccccaggtggggagcgctgaggagggcgacttcacttgccgtgcccaacaccccctggggagcctacaaatttccctgagtctcttcgtgcactggaagcctgaagggcgcgcagggggcgtactgggcgccgtatggggagcctccatcaccaccctagtcttcctctgcgtctgttttatattcagagtgaagacaaggcgaaagaaggccgcccagcctgtgcagaacaccgatgatgtaaaccctgtcatggtctctggtagtagaggacaccagcatcagttccaaaccggtatcgtgtcagatcatcctgccgaagcaggcccaatcagcgaggatgagcaggagctgcattatgccgttctgcacttccacaaagttcagccccaggagcccaaggtgaccgatacagagtattccgaaatcaaaattcacaaatag

SEQ ID NO: 134304 - DNA, 1170 bp, Artificial Sequence
  Description of Artificial Sequence: Synthetic coding sequence
atgcagggggcccaggaggcctctgcttctgaaatgctccccctcctgctgccactgctgtgggcaggcgcgcttgcacaggagcgtcgtttccagcttgaggggcccgagtccctgactgtgcaagaaggtctctgtgtcttggttccgtgcaggctcccaaccacactgcccgctagctactacggctacggatactggttcctcgagggcgctgacgtgccagtggctacaaatgatccagatgaggaagttcaggaggaaaccagggggagatttcatctgctgtgggacccccggcgcaagaattgtagcttatcaattcgagacgccaggcggcgtgataatgcagcctacttctttcgattgaagtccaagtggatgaaatacggctacacatcttctaagctctccgtccgcgtgatggctctgacccaccggcctaacattagtatcccaggaaccctcgaaagcggacacccatctaaccttacgtgtagtgtcccctgggtctgcgagcagggtacgcccccgatctttagctggatgtccgctgctccaacatcattaggtccgaggactacccagtcctccgttttaacgataacacctagaccccaagatcattcgacaaatctcacctgccaggtcacctttcctggcgccggtgtcaccatggagcggacgatacaactcaatgtgtcatggatgctccgtcgacccccactgagcacccccgacgccccacagaaggtggccatttctattttccaggggaattcagctgcttttaagatcttgcagaacacaagctccctgccagtgctagagggccaggctctgcggctgctgtgcgatgcagacggtaaccctcccgcgcacctgtcctggttccaaggtttccctgcccttaacgcaacacccatcagtaacacaggggtcctggagctcccccaagtagggagcgccgaagaaggggactttacatgtagggcccagcatcccctcggcagccttcagatctccctctcactgttcgtacactggaagccagagggaagggccggcggggtcctgggcgcagtctggggtgccagcatcactactctggtgttcctgtgtgtctgtttcatttttcgcgtcataagcacctctagcagacaggcttag

SEQ ID NO: 134305 - DNA, 1206 bp, Artificial Sequence
  Description of Artificial Sequence: Synthetic coding sequence
atgcaaggtgcccaagaggcttcagccagtgagatgctgcctctcctgctgcctttgctgtgggctgcaagctactatggatacggctattggttcctcgaaggagccgatgtcccggtggccaccaacgaccctgacgaggaggttcaggaggagactcgcgggcggttccatctactttgggacccccgaaggaaaaattgtagcttgtccataagggacgctaggaggcgagacaatgccgcctactttttcaggttaaagtcaaaatggatgaagtatgggtatacaagttccaaattgtctgtaagagtgatggctctgacacaccggccaaatatatccattcccggaacattggaatccggccacccttccaacctgacttgctccgttccctgggtctgcgaacagggcacccctcctattttcagctggatgagcgccgcgccgacttccttggggcctcgaacaacccagagctccgttctgacaattacaccaaggccccaggaccactccacaaacttgacttgtcaggttacctttcccggtgcaggagtgactatggagaggacaatccagcttaatgttagcagtttcaaaatactccagaatacttccagtctgccggtgctcgagggccaggctcttcggctgctgtgcgatgctgacggcaatccacccgcccacttgtcctggtttcaggggttcccagcactcaatgctacccccatcagcaatacaggagtcttagagctccctcaggttggcagcgctgaggagggagattttacatgcagggcacagcaccccttgggctcactccagatctcactctctttgttcgtgcactggaagccagaggggagagccggtggtgtgctgggggccgtctggggagcatccataacaacactcgtgtttctgtgtgtgtgttttattttccgggtcaagactcggagaaaaaaagctgcccaacccgtgcaaaatacagacgacgttaatccggtgatggtgtccggatctcggggccatcagcaccagttccaaactgggatcgtgagtgatcaccctgctgaggcgggacctatctccgaggatgagcaagagttacactacgctgtgctgcactttcacaaggtgcagcctcaagagcctaaagtgaccgacacagagtactccgagataaagatacacaagtag

SEQ ID NO: 134306 - DNA, 1125 bp, Artificial Sequence
  Description of Artificial Sequence: Synthetic coding sequence
atgctgcttctcctgctcttgccactcctctggggacgagagcgtgtggaaggccagaagtccaatcgaaaggattattcgctgactatgcagtcatccgtgacagttcaagaaggcatgtgcgttcacgtgaggtgtagtttctcctaccctgtagattcccagacagattcagacccagtgcatggctattggttccgagccgggaacgacatctcctggaaggcccctgtggcaacaaataatccagcatgggcagtgcaagaagagacccgcgacaggtttcacctgctgggtgatccacagactaaaaattgcaccctgtctattagagacgcccgcatgtccgatgccggtaggtatttctttaggatggagaaggggaacattaagtggaactataagtatgatcaactgagtgtgaatgttaccgaccctcctcagaacttgactgtaaccgtgttccagggggaaggaactgcgtccaccgccctcggcaactcttccagcctatctgttctagagggccagtctttaagattagtttgtgccgtcgattccaatccgccagcacgactgtcttggacctggagaagtctcactctataccccagtcagccctctaaccccctggtattggagctccaagtgcatctgggcgacgagggggaattcacctgtcgggcgcagaactccctgggttcacagcatgtatcccttaacctctcgctacagcaggagtacaccggaaaaatgcgccccgtgagtggagttctgttgggggcagtcgggggcgctggagcaacagccttggtattcctgtctttttgcgtgattttcatcgtggtgagaagctgtcggaagaagtccgcacgacccgccgcagacgtgggcgacattggtatgaaggacgccaatacaataagaggaagcgcctcccagggcaacctaaccgagagctgggctgatgacaacccgcgccaccacgggctggccgcacactccagtggggaggagagagagatccagtacgctccactgtccttccacaagggggaaccacaagacctgagcgggcaggaggcaaccaacaacgagtactccgagatcaaaatccccaagtag

SEQ ID NO: 134307 - DNA, 1404 bp, Artificial Sequence
  Description of Artificial Sequence: Synthetic coding sequence
atgctactccttctgctgttacccctgctgtggggaagggaacgggtagaggggcagaagtctaatagaaaggattacagccttaccatgcagagcagcgtcaccgttcaggagggaatgtgcgtacacgttaggtgttctttctcctaccccgtcgatagccagaccgattcagatccagtgcacggctactggttcagggccggtaacgacattagttggaaggctcctgtggctacaaataatcccgcatgggcagtgcaggaggaaacacgggatagattccacttattgggggaccctcaaacgaagaactgtaccctgagcatccgcgatgctcgaatgtctgatgcagggagatacttttttcgtatggagaaaggaaacatcaagtggaattacaagtacgatcaactgtctgtcaacgtgaccgcgttgacacatagacctaatatcctgatccctgggacactcgaatccggctgttttcaaaacctgacatgttccgtgccttgggcctgtgagcagggcactcccccaatgatctcctggatggggaccagtgtgtctcctcttcacccgtctaccacacgttccagtgtgctaactctaattccccagccccagcaccatgggacatcccttacgtgtcaagtgactctcccaggggccggtgtcaccacgaatcggacaattcagttaaacgtctcttacccaccacagaatttgaccgtgacagtctttcaaggggaagggactgcctcaacggctctaggcaactccagctctctcagcgtgctggagggtcagagcctacggctcgtatgtgctgtggacagtaatcctcccgcccggctatcctggacatggagaagtcttaccctgtatccgagtcagcccagtaacccccttgtccttgaacttcaggtccacctcggtgacgagggagaattcacttgcagagctcaaaactcactggggtctcagcacgttagcttgaatttaagcctgcaacaggagtataccgggaagatgaggcccgtcagcggagtgctacttggcgccgtcggcggagctggagcgaccgcactcgtctttctcagcttttgcgtgattttcatcgtcgtgaggagctgcagaaaaaaaagcgcaagacctgccgccgacgtaggcgatatcgggatgaaagatgcaaacactattagaggttcggcaagccagggcaacctgaccgagagctgggcggacgacaatccccggcaccacgggctagccgcacattcaagtggtgaggaacgagaaattcaatacgcacccctctcctttcacaaaggtgaaccccaagatctgtccggccaagaagctacgaataatgagtacagcgagattaagatcccaaaatag

SEQ ID NO: 134308 - DNA, 438 bp, Artificial Sequence
  Description of Artificial Sequence: Synthetic coding sequence
atgttacttcttctactgctgcccttactttggggcagggagagagttgagggccagaagagtaaccgaaaagattattcactgaccatgcagagttccgtcacagttcaggaaggaatgtgcgtgcatgtgaggtgttcatttagttaccccgtggattcccagaccgatagcgaccccgtgcacggttactggttcagagctggaaacgacatctcttggaaagctcctgtggcaaccaataaccctgcctgggccgttcaggaggaaactcgagaccgcttccatcttttgggcgacccacaaaccaagaattgcacgcttagtatcagagacgctagaatgagcgacgccggaagatatttttttagaatggagaagggcaatataaagtggaactataagtacgaccagttgtccgtgaacgtgaccgaatag

SEQ ID NO: 134309 - DNA, 1500 bp, Artificial Sequence
  Description of Artificial Sequence: Synthetic coding sequence
atgctcctcctcctcttgctattgcccctgttatggggcactaaaggtatggagggtgatcgacaatatggcgatggctacctgctgcaagtgcaagaattagtgacagtgcaggagggcctgtgcgttcatgtcccgtgctcctttagttacccacaggacggttggaccgattccgatcccgttcatggctattggttccgagccggtgaccggccttatcaggacgctccagttgcaacaaataaccctgatagagaggtgcaggccgagacgcagggaagatttcagctcctgggtgacatctggagcaacgactgttcattgagcatccgtgacgcacggaagcgtgataaagggagctacttctttcggttggaaagaggttccatgaagtggagctataaatcccagctgaattacaaaacaaagcagctcagcgtcttcgtgaccgcactcactcaccggcccgacatcctgatattagggactttggagtcaggacacagtagaaatctcacatgcagcgtaccatgggcgtgtaaacaaggtacgcctccaatgatatcttggattggtgcttctgtgagctctcccggccccactactgccagaagttcagtgcttactttgaccccaaaaccacaggaccatggaaccagcctcacctgtcaggtgacattgcccgggacaggagtgactactacaagtacggttagacttgacgtgtcttatcctccctggaacctgaccatgaccgtgtttcagggcgatgctacagccagcacggcccttggtaatggaagttcgctgtctgtcctggagggacagagtctcagacttgtttgcgccgtgaatagtaacccaccagcgcgcttgtcttggacacgaggcagcctgacattgtgtccttccaggagcagtaatcccggtctcctggagctgccaagggttcatgtgagagacgaaggagagttcacctgccgggcccagaatgcccagggctcccagcacatatctcttagtctcagtttgcagaacgagggaacagggacaagcagacctgtgtctcaagtgacactggccgctgtgggcggggctggagccaccgcattggcctttctgtctttttgtattatcttcattattgtacggtcctgtaggaaaaaatctgctcggcctgccgctggtgttggagatacaggaatggaagacgccaaggcaatcagaggctctgccagtcaaggtcctctgactgaatcgtggaaagatgggaatccactgaagaagccacccccagctgtcgcccccagctcaggagaagaaggagagctgcattatgcgacgctgtccttccataaagtcaagccacaagatcctcagggccaggaggctaccgacagcgagtactcagagattaagattcacaagcgtgagacggccgagacacaagcgtgtctccggaaccacaaccctagttctaaggaagtgcgcggatag

SEQ ID NO: 134310 - DNA, 1221 bp, Artificial Sequence
  Description of Artificial Sequence: Synthetic coding sequence
atgttactgctcctgctcctgctccccctgctttggggcacaaaaggaatggagggagaccgccagtacggagacgggtatctgctccaagtacaggagttggtgaccgtgcaggaaggcctgtgcgtccatgtcccttgcagtttttcctacccacaggatggatggactgacagtgatccggtccatggctattggtttcgcgctggcgaccgaccttaccaggatgcccccgtcgccaccaataacccagaccgagaagtgcaggccgagacccagggccggtttcagctgctgggcgatatctggtctaatgattgctcgctgagtatcagggatgcaaggaagcgggacaagggctcttactttttcagattagaacgcggctcaatgaagtggtcttataagagccagctaaattacaaaacaaaacagttatccgttttcgtcactgatcctccttggaacctgaccatgaccgtctttcagggggatgccacggcttccaccgctctgggtaatggctccagcctgtccgtactcgaggggcagtccctcaggctggtgtgcgctgtgaatagcaatccccctgcccgactctcctggaccagaggcagtctgacgctgtgtccttcccgatcgtcaaatcctggcttgctggagttaccacgggtccacgtaagagacgagggcgagtttacctgcagagcccagaatgcacaaggaagccagcatatttccctgtccctttcacttcagaacgagggaactggcaccagccgccccgtctctcaggtgactcttgcggcggtcggcggggctggagccacagccctcgcattcctgagcttctgcataatcttcatcattgtgcgctcctgccgaaaaaaatctgctcgccccgccgctggggtcggggacacaggaatggaggatgctaaagcaattagaggtagcgcttctcaaggccccctgaccgagagctggaaggatggaaatccgcttaagaagcctccaccagcggtggctccaagcagcggggaagaaggggagttgcactacgcaaccttaagcttccataaggtgaagcctcaggacccccaggggcaggaggcgactgactcagaatacagcgagatcaagattcacaagcgcgaaacagctgaaacacaggcctgcctgagaaaccacaacccttcttcaaaagaggtgcgtggatag

SEQ ID NO: 134311 - DNA, 1173 bp, Artificial Sequence
  Description of Artificial Sequence: Synthetic coding sequence
atgctgctgttgctgctgttactgccattgttgtggggtactaaaggcatggagggagacaggcagtacggagacgggtacttactccaggttcaagaactggtgaccgtccaggaagggttgtgcgtccacgtgccctgttccttctcctatccccaggatgggtggacagatagcgaccctgtccatggatattggttcagggccggggatcggccctatcaggacgccccagtcgccactaacaatcccgacagagaggtacaagccgagacccaggggcgctttcagctactgggagatatctggagcaatgactgttctctcagtattagggacgcacgcaagagagacaaggggtcatatttctttcggctggaacggggcagcatgaagtggtcctacaaatcacagctgaactacaaaaccaagcagctgagcgtcttcgtgacagcatcgacggcattagggaacgggtcttcgttgtcagtgttggagggtcagtccctcagactggtgtgtgctgtaaattcgaacccccctgcgaggctgtcctggacaagaggctccctcaccctctgcccgtcaagatcctctaatcccgggctgcttgagctgcctcgcgtgcacgtccgggacgaaggggaatttacatgtcgagcccagaatgctcagggaagccagcacataagcctgtccctgagtctccaaaacgagggcaccggcacctctagacctgtgagccaggtaacgctggccgctgtgggcggagcaggcgccactgctcttgcgtttcttagtttttgtatcatttttatcatcgtcaggtcctgtaggaagaaaagcgcgcgcccggctgcgggagtcggtgatactggtatggaggatgcgaaagcaatacgggggagtgcaagccagggccctctgaccgagtcctggaaggacgggaatccactgaagaaacccccaccagccgtagctcccagcagcggagaggagggggaactccactacgctacactgtcgtttcataaagtcaaaccccaggacccccagggtcaggaggccaccgactctgaatattcagagattaaaatccacaagcgtgaaaccgctgagacccaggcctgcttgaggaatcataacccgtcctccaaagaagtacgcggctag

SEQ ID NO: 134312 - DNA, 1392 bp, Artificial Sequence
  Description of Artificial Sequence: Synthetic coding sequence
atgctgcttttactcttaccccttctatggggccgggagcgcgccgagggccagacctcaaaactcctcacaatgcaaagtagtgttacagtgcaggagggcttgtgtgtgcatgtaccttgctctttcagctaccctagtcatggctggatatatccaggtccggtggttcatgggtactggtttcgtgagggcgccaacacggaccaggacgcccccgtcgccacaaataatcccgctagagcagtttgggaggaaacccgcgacagatttcacctgctcggggacccgcacactaagaattgtactttaagtatcagagatgcacggcgttcggatgccggcaggtatttctttagaatggagaaggggtcaattaaatggaactataagcaccacaggttgtcggtgaacgttaccgcactgacccatcggcccaacatcttaattcctggaacccttgagagcgggtgccctcagaacctgacctgctcagtaccatgggcgtgcgaacaggggacaccaccaatgatctcatggatcgggacttctgtgagtcccctcgaccccagcacaacaagatctagtgttcttactctgataccgcagcctcaggatcacggcacatccctgacgtgtcaagtgaccttccctggggcctctgtgacaactaacaagaccgttcacctcaacgtctcttacccaccacagaatcttacgatgaccgtctttcagggagacggcaccgtgtccacggtcctcggtaacgggtcctccttgtctcttcctgaggggcaatcccttaggctcgtatgcgcagttgacgctgttgattctaaccccccagcccgcctgtctttaagttggagggggctcactctttgtccatctcagcccagcaaccccggagttctcgaactgccatgggtgcacctgcgcgacgcggcggaatttacgtgtagggcccagaatccgcttggatcccagcaggtatacctgaatgtgagtctgcagtctaaggctacatcgggcgtgacccaaggagtggtgggcggcgctggtgctaccgctctggttttcttgtcattttgtgtcatttttgtggtggtcaggtcctgccggaaaaaatctgcacgtcccgccgccggcgtcggcgacacaggtatagaggatgctaacgctgtgcgcggttctgcttctcaagggcctctgaccgagccctgggccgaggacagcccgcctgaccagccgccccccgccagcgccaggagctcggtcggtgagggcgagcttcaatacgcctcactctcattccagatggtcaagccttgggactcccgcggccaagaagccactgacaccgaatattccgagattaagatccacaggtag

SEQ ID NO: 134313 - DNA, 1440 bp, Artificial Sequence
  Description of Artificial Sequence: Synthetic coding sequence
atgctcctgcttttgctgccccttttatggggcagagagcgagccgagggccagacgtccaagcttctcacgatgcagtccagcgttaccgttcaggagggtctctgtgtgcatgttccttgttctttttcttacccttcacacggctggatctaccctggacccgtcgttcacgggtactggttccgggaaggcgcaaacacagatcaggatgctccagtcgcaactaacaatcccgccagagctgtttgggaagagactcgggatcgctttcatctgctgggggatcctcataccaaaaattgcaccctgagcatcagggatgcaagacgcagcgacgcaggacgctacttcttccgcatggaaaagggtagcattaaatggaactacaagcaccaccggctgagcgtcaacgtgaccgctctgacgcatcgccccaacatactgattcctggcaccctggaatcaggatgtccccaaaacctaacgtgctctgttccctgggcttgcgaacagggtactccccccatgatctcatggatcggaacaagtgtcagtccccttgatcctagcaccactaggtcaagcgtgcttacactaatcccccaaccacaggaccacgggacttcgctcacctgtcaggtgacttttccaggagccagtgtgactaccaacaagacagtgcatctcaatgtgtcttacccaccccaaaatctgacaatgaccgtatttcagggcgatggcacggtttctactgtgcttgggaacggttcaagcctgagtttgcctgaaggacagtccttacgactggtatgcgccgtcgatgccgtggatagcaaccctccggcccgactaagcttgtcatggagaggcctgacattgtgcccaagccagccttcaaacccgggggtcctggagctgccctgggtgcaccttcgcgatgcggcggagtttacttgccgcgcacagaaccccctgggaagccagcaggtctacctcaatgtctccctgcagtctaaggcgaccagcggggtgacgcaaggtgtggtgggaggcgccggagccactgctttagtgtttttgagtttctgcgtgatcttcgtggtagtgcgatcctgtaggaaaaagagtgcgcgtccagctgccggtgttggcgacacaggaatcgaggacgctaacgccgttaggggctcagccagtcaaatcctcaaccatttcatcggcttcccgacgttcctcgggttgggattcgagtttctgctcaatctacgcgatctgtgctgtcatcctgattcagaattttacgtgtatcacttcagccatttccgtctcattaaaaacatagctggagagatcgtttggagtcttgagggcaaaattctatggttactagacgtcagtgacttcttccactggttttttctaatttgcgtcggatag

SEQ ID NO: 134314 - DNA, 735 bp, Artificial Sequence
  Description of Artificial Sequence: Synthetic coding sequence
atggccgccgccgcatcacctgcctttctgctgtgcctgccactgctccatttgctatccggctggagcagggccggctgggtcgacacgcattgcctgtgctatgactttatcatcacacctaaatcgcgacccgagccacagtggtgcgaggtgcagggtctcgtcgacgagcggccgttcttacattacgactgcgtgaaccacaaggccaaggccttcgcatcactgggaaagaaggtaaatgtgactaaaacgtgggaagagcagactgagacactccgtgacgttgtggactttttgaagggtcaactcttggacattcaggttgaaaaccttattcccatcgaacccttaacgcttcaggctcgcatgagctgtgagcatgaagcgcacggccacgggcggggctcttggcagttcctgtttaatggccagaagttcctgctgtttgactcgaacaatagaaagtggacagctctgcacccgggcgcaaaaaaaatgacggaaaagtgggaaaagaacagagatgtcactatgttcttccaaaaaatttctctgggcgactgtaagatgtggcttgaagagttccttatgtactgggagcagatgttggatcccacaaagcccccaagccttgcacccggcacaacgcagcctaaggctatggctaccacccttagcccttggtccctccttattatcttcctgtgcttcatcttggccggccgctag

SEQ ID NO: 134315 - DNA, 1248 bp, Artificial Sequence
  Description of Artificial Sequence: Synthetic coding sequence
atgaccggggagaggccctctactgccttgcctgatcgcaggtggggaccgcggatcctgggtttctggggcggatgtcgcgtgtgggtctttgctgctattttcctgctcttgtccctcgcagcatcgtggtctaaagctgagaatgactttggcttagtgcagcccctggtaacgatggagcagctgctgtgggtttcgggccggcagattggctctgtcgacactttccggattcccttgatcaccgccacaccccgggggaccctgctcgcattcgctgaggcccggaaaatgagtagctcagatgagggggcaaaatttatcgctctgcgccgttcaatggaccaaggaagcacctggtccccaactgcattcatagttaacgacggcgatgtccccgacggtttgaatcttggggctgtggtttcagacgtagagacgggcgtggtgtttttattttactctctgtgcgcccataaggctgggtgtcaagtggcttccacaatgctagtgtggtccaaggacgatggagtgagctggtccacccctcgcaacctctcgcttgacataggcactgaggtcttcgcccctgggcccggatcaggtatccagaagcagcgcgagccgcgtaagggacgtctgattgtttgcggccatggtacactggaaagagacggggttttctgtctactgtcagacgaccacggcgcctcatggcgctatggatctggggtgagtggcattccctatggacagccaaagcaggagaatgactttaatcctgatgagtgccagccatacgagcttcctgatgggtccgtggtcatcaacgcgcgaaatcagaacaactaccactgccactgcaggatagtcctgcggtcgtatgacgcttgcgacacactccggccaagagacgttacctttgatcccgagcttgtggacccagtggtagctgctggcgcagtggtgaccagctcaggcatcgtgttctttagtaatcctgcgcaccccgaattcagagtcaatctcaccctcaggtggtccttctctaacggaacttcttggcggaaggagactgtccagctgtggccaggtccgagcggctactcctccttagcaacattggaaggttctatggatggtgaagagcaggcaccccagctgtatgtcctatacgaaaagggaaggaaccactacacggaatcaatctctgttgctaaaatatcagtttatggtacactatag

SEQ ID NO: 134316 - DNA, 1248 bp, Artificial Sequence
  Description of Artificial Sequence: Synthetic coding sequence
atgaccggggaacgtccctctactgctctgcctgaccgccggtggggaccaagaatcctgggtttctggggcggctgccgcgtctgggtctttgccgccatcttcctgctcctcagccttgcggcgagctggagcaaagcagagaatgacttcggtctggtgcagccacttgtgaccatggaacagcttctgtgggtatctggccgacaaattggttctgtggatacattcagaatacccctgatcacggccaccccacggggcacactgctagccttcgcagaggctaggaagatgtcctccagcgacgaaggtgccaaatttatagctctcagaaggagcatggatcagggctcaacctggagtccaacggccttcatcgtgaacgatggcgatgtacccgatgggctgaatctcggcgcagtcgtgtccgacgtcgagaccggcgtcgtgttccttttttattccttatgtgcccataaggctggatgccaggtggccagcacaatgttggtatggagcaaggatgatggtgtatcgtggagtactccacggaacctgtcacttgatatagggaccgaagtctttgcaccgggacccggttccgggatccagaaacagcgcgagcctaggaaggggaggctcattgtgtgcggccatggcacattagagcgggacggagtcttctgcctgctttcagacgaccacggggccagctggaggtatggctccggggtgtcaggcatcccttatggacagcccaagcaggaaaacgatttcaaccctgatgagtgccagccctatgaactgccagacggatccgtggtgattaacgccaggaatcagaacaattaccactgtcattgtaggattgtgttgcgctcttatgatgcctgtgacaccctcagacctagggacgtaacctttgaccctgagcttgtcgaccccgtggtggctgccggggcggtcgtcaccagctccggaatcgttttcttttccaatcctgcccatccagagttccgcgtgaatctgacactcaggtggagcttctctaacggaacctcatggagaaaagaaaccgtccagctgtggcccggcccaagcggatattcgtccttggctactcttgaaggcagtatggatggggaggaacaagcacctcagctgtatgtcctctatgagaaaggccggaatcattatacagaatcgatcagtgtggctaagattagcgtctacgggaccctgtag

SEQ ID NO: 134317 - DNA, 1248 bp, Artificial Sequence
  Description of Artificial Sequence: Synthetic coding sequence
atgacaggggaacgtccctcaactgccctccctgataggagatggggtcccaggatactcggcttttggggcgggtgtcgggtatgggtctttgctgccatttttcttctcctttccctggccgcctcttggtctaaagctgaaaacgattttggactggtgcagcctcttgtgaccatggagcagctcttatgggtatccggcaggcaaatcggttccgtcgacacatttcggattcccttgataacggcaacacccagagggacgctgctcgcctttgctgaagcgcgaaaaatgtcttctagcgacgaaggagccaaatttattgctctccgccggtcgatggaccaggggtcaacatggtctcccacagctttcatagtgaatgacggtgacgtgcctgatgggctgaatctcggggccgtagtcagtgacgttgaaaccggagtcgtcttcctgttctacagcctctgcgcacataaggcggggtgccaagtcgcatccaccatgcttgtctggtctaaagatgatggggtgtcatggtccacccctcggaaccttagtcttgatattgggacagaagtgtttgcacccggtcctgggagcggtatccagaagcaacgcgagccacgcaaggggcggcttatcgtttgcggacatggtacactcgaacgggatggcgtgttctgcctgcttagtgacgaccatggtgcttcttggcgttatggtagcggcgtctctgggatcccatacggccagccaaagcaagaaaatgacttcaaccctgatgaatgccagccatatgagttacccgatggctctgtggtcattaacgccaggaatcaaaacaattatcattgccactgcaggatcgtcctccggtcatacgacgcctgcgataccctgaggcccagagacgtaacgttcgaccccgaattggtagatcccgttgtcgcagccggcgctgtggtgacctccagtggtattgtattctttagtaatcctgcccatcccgagtttagggtaaatctgactctgcgttggtctttttcgaacggtacaagctggcgcaaagagactgtgcaactgtggcccggaccgtccggctattcttccctggcaacactcgaaggcagcatggacggcgaggagcaagccccacaactgtatgtcctctacgagaagggcaggaaccactacacagagtccatctctgtggccaaaatctctgtgtacggcaccctctag

SEQ ID NO: 134318 - DNA, 1248 bp, Artificial Sequence
  Description of Artificial Sequence: Synthetic coding sequence
atgaccggggaacgaccaagcacggctcttccagacaggcggtggggacccaggatccttggcttctggggcggatgtcgcgtctgggttttcgctgcaattttcctgcttctgtctctggccgccagctggagcaaagctgagaatgatttcggtctggtgcagccactcgtcacaatggagcagttgctctgggtcagcggtaggcagatcgggtcagtggacaccttcagaatccctctgattacggccacaccccgcggcacgctcctggcgttcgccgaggcacgaaagatgtccagtagcgacgagggagcaaaattcattgcacttaggcggagcatggatcaaggctctacctggtccccaactgcttttatagtcaacgacggggacgtgcctgatgggctgaatctgggcgcagtcgtgtctgacgtggagactggcgttgttttccttttctacagtctatgcgcccataaggcagggtgtcaagtcgcttccaccatgttggtgtggtccaaggacgatggcgtatcctggtcgactccaaggaacttatccttggacatcggcactgaggtgtttgcccctgggccaggtagcggcatccagaagcagcgggagccacgcaagggtaggctgattgtctgtggccacgggactcttgagagagacggtgttttctgtctgttgtccgacgaccacggcgccagctggaggtacggctctggagtctccgggattccatacggccagccaaaacaggagaatgactttaatccagatgagtgtcagccttacgaacttccggatggttccgtcgtgataaacgcaagaaaccaaaataattatcattgccattgtcggatagtacttcgctcttacgatgcttgcgatacactgagaccccgagacgtgacctttgatcccgaattggttgatccagtggtggctgccggtgccgtagtgacaagttctgggattgtgttcttttcaaaccccgcacatcccgagttcagagtgaatttgacattgcgctggtccttcagtaatggaactagttggcggaaggaaaccgtgcaattgtggcctggaccatctggatatagcagcctggccactctcgagggatctatggatggcgaggaacaggcaccccaactttatgttctctacgaaaagggtagaaaccactataccgagagtatttccgtggctaagatctctgtatatggaactctgtag

SEQ ID NO: 134319 - DNA, 1248 bp, Artificial Sequence
  Description of Artificial Sequence: Synthetic coding sequence
atgacgggagagaggccttcaaccgctctccctgatcgcagatggggacccagaatcctcgggttttgggggggctgcagagtatgggtattcgcggctattttccttcttctgagtctggctgcgagttggtctaaggctgagaacgattttgggttagtgcagccattagtcacgatggaacagttgctgtgggtttccgggcggcagataggatccgtggatactttccgtatccccttgattacagccacaccccgagggaccctgctagcctttgcagaagcaaggaaaatgagtagctctgatgagggcgcaaaattcatcgcactccggaggtccatggatcaggggtctacatggtccccaacagcattcatcgtgaatgacggcgacgtgccagatggactaaatctcggagccgtagtctctgacgtggaaactggagtcgtctttctcttctactccttgtgtgcccataaggctggatgccaagtcgcgagtacaatgctagtgtggtcaaaggacgacggcgtctcctggagcacaccccggaatctgagcctggatattggtaccgaggttttcgcgcccgggcccggatccgggattcagaagcagagagagccccgcaaaggaaggctgattgtctgtggccacggtaccttggaacgcgacggcgtgttctgtctcctgtccgacgatcacggcgcttcttggcgctacggcagcggcgtgtctggtatcccttacgggcaacccaagcaggaaaacgatttcaatcctgacgagtgtcagccctacgaactgcccgatggcagcgtggtcattaacgcccggaatcaaaataactaccattgccactgcagaatcgtcctgcgctcctatgacgcctgtgataccctgagacctagggatgtgactttcgaccctgaacttgttgaccccgttgtggccgccggagccgttgtgactagctcaggtatagttttctttagtaatccagctcacccggagttccgtgtcaatctgacccttaggtggtctttcagcaatgggactagctggagaaaggagactgtccagttatggcccggcccatccgggtatagcagccttgctaccctggagggcagcatggacggggaagaacaagcaccccagctctacgtgctctacgagaaaggaagaaatcattatactgagtctatatccgtcgctaaaataagtgtctacggcacattgtag

SEQ ID NO: 134320 - DNA, 1248 bp, Artificial Sequence
  Description of Artificial Sequence: Synthetic coding sequence
atgacaggtgaaagaccctccactgctctgcctgacagaaggtggggacccaggattctcggcttctggggcggttgtagggtttgggtctttgcggccatcttcttacttctgtcgctcgccgccagttggtcaaaagctgagaatgacttcggtctggtacagcccctggtcactatggaacagctgttatgggtatctggccgtcagatcggctctgtggatacattccggattcccctcataacagcgacaccgcgaggcaccctcctggcgttcgctgaggcgcgaaaaatgtcctcaagcgacgagggggccaagtttatagctctgcgacggagtatggatcaaggcagcacctggagccctacagcgtttatagttaatgacggagatgttccagacgggcttaatctcggggccgtcgttagcgatgtggaaacaggagttgtttttcttttctacagtctttgcgcacacaaagccgggtgtcaggtggcgagtactatgttggtgtggtctaaagacgacggcgtgtcatggtcgacaccgcgaaacttatctctagatatcggaaccgaagtgttcgcgccaggcccaggttcaggcatacaaaaacagagagagccaagaaaagggcggctgatcgtctgcgggcacggaactctcgaacgtgatggggtgttttgtttactgtccgatgatcatggcgccagttggagatatgggagcggagtatcagggataccttacgggcagcctaagcaggagaacgattttaatcccgatgagtgtcagccttatgaattaccggacggttctgtggtgatcaacgctcgcaatcagaataactaccactgccattgtcggatcgtgttgcggtcctatgatgcatgcgacactttgcgccctcgggacgtgacatttgacccagagctggtcgacccagtagttgccgccggcgccgttgttacatcctccggaattgttttcttttcaaatccagctcaccccgagttccgcgtgaaccttacattgaggtggagcttcagtaatgggacatcctggcgcaaggaaacagtgcagctgtggccaggcccatccgggtactcctctcttgctacacttgaaggctctatggatggcgaggagcaggctccacaattgtatgttctatacgaaaagggcagaaaccattacaccgaatctatatctgtggcaaagatctccgtatatgggaccttatag

SEQ ID NO: 134321 - DNA, 1248 bp, Artificial Sequence
  Description of Artificial Sequence: Synthetic coding sequence
atgacaggggagaggcctagtacagcattgccggataggcggtggggcccacggattctgggattctggggggggtgtcgggtctgggtgtttgccgctatctttcttcttttaagcctcgcagccagctggtcaaaagcggagaacgatttcggactggttcagccactggtgactatggagcagctgctgtgggtgtcaggaaggcagatcggctccgttgatacttttaggatacctctgatcaccgccaccccacgcggaactctgctggcgtttgccgaggcacgaaaaatgagcagttctgacgaaggggccaaattcatcgccctccgtaggtccatggatcagggctccacatggtcacccactgcatttatcgttaacgacggcgatgtcccagatggcctgaacctgggcgcggtagtcagcgacgtagaaactggggtggttttcctattttatagcctttgtgctcataaagctggttgccaggtggccagtactatgctggtgtggagcaaagacgatggcgtgagttggtctacaccaagaaatctttccctggacatcggcactgaggttttcgcccccggacccggaagcggaatccagaagcaaagagagccccgtaaaggacgcttaattgtctgcggccacggtacgctggagcgcgacggcgtgttttgtctcctctccgacgatcatggagcctcctggcgttatggcagtggtgtctccggtattccttacgggcaacccaagcaggaaaatgattttaaccctgatgagtgccagccatatgagctgcctgatggttccgtagttattaatgcccgtaatcagaacaattaccactgccactgccggattgtgctgcgctcctacgatgcatgtgacactcttcgccctcgagacgtgactttcgatccagagctggtggaccccgtggtggccgccggcgccgtcgtcacatcctctggtattgtgttcttttcaaatcccgctcatccagagttccgcgtcaatctcactctccggtggagcttttccaatggtacttcatggcgaaaagaaacagtccaattgtggccgggcccttcaggttacagtagcctggctacgctggaaggtagcatggatggagaagagcaggcccctcagttgtacgttctttacgagaaaggccgcaaccactatactgagtccatatcagtggcaaagataagcgtgtacgggactttgtag

SEQ ID NO: 134322 - DNA, 2277 bp, Artificial Sequence
  Description of Artificial Sequence: Synthetic coding sequence
atggccgttagtgcagggtccgctaggacgagcccgagcagcgataaagtgcagaaagataaggcggagctcatttcagggccgcggcaggacagccgcattgggaaactccttgggtttgagtggacagacctttcctcctggagaagactcgtaacactgctgaatcgtcccacggaccctgcatccctggccgtgtttcgcttcctctttggtttcctgatggtcctggatatcccccaagaacgggggctcagctcccttgatcgcaaatatctggacggactggatgtctgcagattcccgcttctggatgccttacgcccactaccactggattggatgtacctcgtctatacaattatgtttctcggcgcccttggcatgatgctcggcctatgctataggatttcctgcgtgctgttcctcctcccctactggtatgtattcctcctcgataaaaccagctggaacaaccacagttatctgtatggccttctcgctttccagctaactttcatggatgccaatcactattggagtgttgatggactgttgaatgctcaccggcggaatgctcacgtcccattatggaattatgctgtgctacggggtcagatcttcattgtatatttcatcgctggagttaagaaattggacgctgattgggttgaaggatactctatggaatatctgtccagacactggttattctctccgttcaaacttctgttgtcggaggagctcacatccctacttgtggtgcactgggggggactcctccttgatctgtcggctggcttcctgctgttctttgatgtctcccgatcaataggcttgttcttcgtatcctatttccactgcatgaacagccagctgttttctattggtatgttttcgtacgtgatgctggccagcagtcccctgttttgtagtcccgagtggccccgtaagttagtttcttactgtccacgaagactacagcagttgcttcctctgaaagccgcccctcaaccctctgtgtcatgcgtctacaaacggtcacgcggcaagtctggacagaagccgggactgagacaccaattgggagccgctttcactctgttgtacctcctggagcagttattcctgccctactcacatttcctgacccagggttataacaactggaccaacggtctgtacggttacagctgggatatgatggtgcacagcagaagccaccagcacgtcaaaattacataccgagacgggcgcaccggagaactcgggtacctcaacccaggggtcttcacgcagagcagacggtggaaggaccatgctgatatgctcaaacagtacgcgacatgcctgagccgactcctccctaagtataatgtgacagaaccccaaatctattttgatatctgggtttccatcaacgatcgattccagcaacgcattttcgatcctcgggtagacatcgtgcaggccgcttggtcccctttccagcgaacctcctgggtacagcccctccttatggacctctcaccgtggcgcgccaaactgcaagagattaagagttcattagataaccacaccgaggtcgtttttatcgcagatttccccgggctgcatctggaaaacttcgttagtgaagatttggggaatacttccattcaattgctgcagggcgaggttactgtagagctcgttgcagagcaaaaaaaccagaccctgcgggagggtgagaagatgcagctcccagccggtgaataccataaggtctacacaacgagtcctagcccttcctgctatatgtacgtatatgtcaacaccaccgagcttgccctggaacaggatcttgcttaccttcaggagctcaaagaaaaagtggaaaatggatctgagactggccccttgcctccagagctccaaccacttcttgaaggagaggtaaagggcgggcctgagcccacaccattagttcagactttccttagaagacaacagcggctgcaggaaatcgagagaaggagaaatacgcctttccacgaacgcttctttcgtttcttgctgagaaaactctacgtgtttcgccgcagtttcctgatgacctgtatttcacttcggaacctgattctcgggcgtcccagtctggagcagctagcccaggaggtaacatacgccaacctgcgacccttcgaagctgtgggggaactgaaccctagtaatactgattcatcccattccaatccacccgaatctaacccggatcccgtccactcagaattctag

SEQ ID NO: 134323 - DNA, 1386 bp, Artificial Sequence
  Description of Artificial Sequence: Synthetic coding sequence
atgaggcctgctgaccttccccccagaccgatggaggaatcgcctgccagcagtagtgcacctactgaaaccgaagaacccgggtcttccgccgaggttatggaggaggtgactacatgctcattcaatagccccctcttcagacaagaggacgaccggggcatcacctacagaatcccggctctgctgtacatacctcccacccacacctttctggcctttgctgagaagagatctactagacgtgatgaagatgccctccacttagtgttgcggcgcggactaagaatcggacagttggtccagtggggaccactgaaacccctgatggaagccacactaccagggcacaggacgatgaacccctgtccggtttgggaacagaaatctggttgtgtgtttctgttttttatctgtgttcgcgggcatgttaccgagagacagcagattgtttctggccgcaacgcagccaggctgtgttttatttactctcaggacgctgggtgcagctggtcagaagtccgcgacctcaccgaggaggtgatcggttctgaactgaaacactgggcgacatttgcagtgggacctggccacgggattcagcttcagtctggcaggctggtgattccggcgtatacgtattacattccctcctggtttttttgtttccagttgccgtgcaagacacggcctcactcccttatgatttacagcgatgatttgggagtaacatggcaccatgggagactcataagacctatggtcaccgtggaatgtgaggtagccgaggtcacaggccgcgctggccatccggtcctgtattgctctgcccgcactcccaaccgctgtagagccgaagctttaagcaccgaccatggtgaaggtttccagcgcctggctctcagccggcaactttgcgagccaccacacgggtgccagggctcagtagtgagctttcggccactggagattccccatcgctgccaagatagctccagcaaggacgccccgaccattcagcaatcctcacccggttctagtctgcggctggaggaagaggcaggaacaccttcggagagctggcttctctattcccatcccaccagcaggaaacagagggtggacctcggcatctatttgaaccagacacccctcgaggcagcatgctggtcacgtccctggatcctgcactgcgggccatgcggctactcggacctggcagcgctggaggaagaggggctttttggatgtctgttcgaatgtggaactaaacaggaatgcgagcagatcgcctttagactcttcacacatagagagatcctcagccacctgcagggtgactgtacctctccggggcggaatccctctcagttcaaaagcaattag

SEQ ID NO: 134324 - DNA, 1386 bp, Artificial Sequence
  Description of Artificial Sequence: Synthetic coding sequence
atgaggccggctgacctgccgcctaggccaatggaggaatctcctgcaagtagtagcgccccaacggagacagaggaaccgggttcgtcggcggaagtgatggaagaagtgacaacgtgtagcttcaattcgccccttttccgtcaagaagacgatcgcggaatcacctacaggattcccgcccttctgtatattccgcccacacatacattcctcgcctttgccgagaaaaggagtactcggagagatgaggatgcactgcatctggtgttgaggcgcggcctcagaattggtcagctggttcagtgggggccattaaagccactgatggaagctactctgccgggtcacaggacaatgaacccttgcccagtgtgggagcaaaagagtgggtgtgtgttcctgttctttatctgcgtgagaggccatgtgaccgagaggcagcagatcgtttctggacgcaacgctgctcgactgtgcttcatttattcacaagatgctggctgttcttggtccgaagtccgggacttgactgaggaagtaatcggttctgagctgaaacactgggcaacatttgcagtggggcccgggcacggtatacaacttcagagtggcaggctcgtaatcccagcttacacctactatattccctcttggttcttttgtttccagcttccatgcaaaacccgcccacactctctgatgatctattcggacgacctgggagtcacttggcaccacggaagactgattcgtccaatggtgactgtggagtgtgaggttgcagaagttacggggcgggccggacacccagtcctgtattgctccgcacggacccccaatcgctgtagggctgaagctctttccactgaccacggtgagggatttcagcgtctggccctgagtcggcagctgtgtgagcctcctcacggatgccaaggcagcgtggtgtcttttcggcctctcgaaatcccgcataggtgtcaggactctagcagcaaggacgcccctaccattcaacagagtagcccgggctcttccctgagactggaagaggaagccggcacaccgagcgagagctggttgttgtactcccatcctacctctaggaaacagagggtggacctgggaatttacctgaatcagacaccactcgaagctgcctgctggagtcgcccatggatattgcactgcggcccttgcggttatagtgatctggcagcactggaagaggagggcttatttgggtgcttgtttgaatgtggcaccaaacaggagtgcgagcagattgcctttaggctctttacccatcgtgagattctgtcccatttgcagggagattgcacatctcctgggaggaatccttctcagtttaagagcaattag

SEQ ID NO: 134325 - DNA, 1287 bp, Artificial Sequence
  Description of Artificial Sequence: Synthetic coding sequence
atggaggaagtgaccacttgtagtttcaactcaccactgtttcgacaggaggacgatcgggggattacttaccgcattcctgctctgctctatattccacccacccataccttcctcgcgtttgctgagaaaaggtccacacgaagagacgaggacgccctccatctagtgttacgccgcggccttcgcatcgggcaactagtgcagtggggcccgcttaaacctcttatggaagcgacccttccaggtcaccgcacaatgaacccatgccctgtttgggaacagaaatccggctgcgtcttcctgttttttatttgcgtgagagggcacgtaacagaaaggcagcaaattgtctctggtcgaaatgctgctcgattatgttttatctattcacaagacgcaggctgtagttggagtgaagtgcgcgacctgactgaagaggtgatcggaagtgagttgaaacattgggctaccttcgccgtgggtccagggcacggcattcagctgcaatctgggcgcttggttatccccgcctacacgtactatatcccctcctggttcttttgcttccagctaccttgcaaaacgcggccccactctctgatgatatattccgacgaccttggcgttacatggcaccacgggaggctgatacggcccatggtcacggtggagtgcgaagttgccgaggtgacgggtagagcaggacatcctgtgctgtactgctctgccagaacaccaaataggtgtagagcggaagctctgtcaaccgatcatggcgaaggattccaacgcttagctctgagccggcagctttgcgaaccacctcatggatgtcagggatctgtggtgagcttcagacccctcgagatccctcaccgctgtcaggacagctcctcaaaggatgcaccgacaatccaacaatcttccccaggctcttccttgcgcctggaagaagaggccggtacaccgtccgagtcctggctgctttactcccaccctaccagtagaaagcaacgggtggacctaggcatctacctgaatcagactccgctggaggcagcatgttggagccgcccgtggatcctgcactgtggcccctgcggatatagcgaccttgcggcactggaagaggagggactgtttggttgtttatttgagtgtgggaccaagcaggaatgcgaacagattgcctttcgactgttcacccaccgtgagatcctgtcacacttgcagggagattgcactagccctggaagaaatccgtcccagtttaaatccaattag

SEQ ID NO: 134326 - DNA, 1059 bp, Artificial Sequence
  Description of Artificial Sequence: Synthetic coding sequence
atggaagccaccctgcccgggcatcgcaccatgaacccatgcccagtctgggagcagaagtctggctgtgtgtttctgttctttatctgtgtgcgaggacatgtcacggagcgtcagcagattgtgagcggccgtaacgcagccagactatgctttatctattctcaggacgctggctgttcttggtcggaggttcgagatcttacggaagaggtaattggatcagagctcaaacactgggccacattcgccgtggggcctggacacggcatccagttacagtccgggcgtctcgtgatccccgcttatacatattacatcccaagctggtttttttgtttccagttaccatgtaaaacccggcctcattccttgatgatctatagcgacgacttaggagttacatggcaccacggacgattgatccgtcccatggtgaccgtagaatgcgaggtggcagaagtcacaggccgagcgggtcatcccgtcctttattgttccgctcgcactccgaatagatgtagagcagaagccctgtccaccgatcatggcgaaggcttccaacgcctcgccttgtcgcggcagctctgcgaacccccacacggatgccaggggtccgtcgtctcttttcgcccactggaaatcccacatcgttgccaggactcctccagcaaagacgcaccaaccatccagcagtcttcccctggctcctctctgcgcctcgaggaggaggcgggaacccctagcgagtcatggttactctacagccaccccacctctagaaagcagagggtcgacctcggtatctatttgaatcagactcctctggaagcagcatgctggtctcggccttggattctccactgtggcccgtgtggatacagcgacctcgcggcacttgaagaggagggattatttgggtgcctgtttgaatgcggcaccaaacaggaatgcgaacagatcgcattcaggctgttcacacatagggagatcttgagccacttacaaggtgactgcacaagtccaggccgcaatcccagccagtttaagagtaattag

SEQ ID NO: 134327 - DNA, 1203 bp, Artificial Sequence
  Description of Artificial Sequence: Synthetic coding sequence
atggctactctgttactgctgttaggtgtgcttgtggtctctccagatgcactcggttctaccaccgctgtacagacccccacctcgggtgagcccctggtgtcaacctccgaacctctctcctccaagatgtatactacatcgataacatcagatccaaaggctgatagcaccggcgatcaaactagcgcgctgccaccttcaacaagcatcaacgagggaagccctctgtggacttctatcggtgctagcaccgggagtccgctgcccgagcccaccacgtaccaggaagtcagcattaaaatgagttccgtcccgcaagagaccccccacgctacttcacaccctgctgtacctattaccgctaactctcttggctctcacaccgtcacaggaggtacgatcaccacaaattctccggaaacctcgtccagaacctccggagctcctgtgactaccgcagccagttcactggaaaccagcagaggaacctcagggcctcctcttaccatggcgacagtatctctagagacttcaaagggcactagcggaccgccagtcacaatggcaaccgactctctggaaacaagtacgggcactaccggtccacctgtcacaatgaccacaggctctctagaaccgagtagcggtgcctctggaccacaggtgtcgtctgtgaaactgtctacgatgatgtctcccacaactagtactaacgcatcgacggtccccttccggaacccagatgaaaacagcagaggcatgctgcctgtggccgtcttggttgcactccttgcagtcatcgttctcgtagcattgcttctgctttggcgacggcgacagaagagacgcacgggtgccctggtgctcagccgaggaggcaagcggaacggcgtcgttgacgcctgggcgggacccgcccaggtcccagaggagggagcagtgactgtgaccgtgggcgggtctggcggggacaagggctcgggatttccggatggagagggatctagtcgacgccccacgctgacaacttttttcggccggcggaagtctcgccagggctcactggcgatggaggaacttaagtccggtagcggcccatcgcttaagggggaggaagaaccgttggtcgcaagcgaagatggggccgtcgacgcgcccgccccagacgagccagaaggcggggatggagcggctccctag

SEQ ID NO: 134328 - DNA, 1203 bp, Artificial Sequence
  Description of Artificial Sequence: Synthetic coding sequence
atggccaccctgctcttgctactgggcgtcctcgtcgtaagtcctgacgccctagggtccacaactgcagtacagactcctacttcaggggaacccctcgtctcaacctcggaacccctatcttcaaagatgtataccacatccatcacatcagacccaaaagccgatagtaccggcgatcagacatctgccctccctccaagcactagcatcaacgaaggttcacccctgtggactagtataggagcctcaaccggaagcccgttaccagagcccactacctaccaagaggtctccatcaaaatgtcaagtgtgcctcaggaaacccctcacgcgacatcccacccagcggtgccgattacagcgaattctcttggcagtcacaccgtaacaggcggcaccatcacaacaaattcccctgaaactagctcacgtacctccggcgctccagtgacaactgccgcctcatccctagaaacatccagaggaacctctgggccgccattaaccatggctacagttagcttggaaaccagcaagggaacctcagggccccccgtcaccatggctactgattctctcgagactagtaccggaactaccggaccacctgtcactatgactacgggaagcctggaaccttcatccggcgcttctggcccgcaggtttccagtgtgaaactcagcactatgatgtcacctaccacttccacaaatgccagcactgttcctttccgcaatcctgacgaaaactctcgtgggatgctacccgtggcagtgcttgtcgcccttctggctgttattgttttggtggccttgcttctgctttggcgacggcgccagaaacggcgcacaggcgcactagtcctgtcccgtggcggcaagcggaatggggtggttgacgcctgggccggcccggctcaggtaccggaagagggcgccgtgaccgtgacagtcggggggtcggggggtgacaaggggtccggttttcccgatggagagggttcgagccggaggccgactctcacgacattttttggaagaagaaagagtagacagggatccctcgccatggaagagctcaaatcaggctcgggcccctcgctcaaaggcgaggaagaacccctcgtggcctccgaagatggcgctgtggacgctcctgcacccgacgagcccgaggggggggatggggctgcgccttag

SEQ ID NO: 134329 - DNA, 1068 bp, Artificial Sequence
  Description of Artificial Sequence: Synthetic coding sequence
atggctacacttctcctgctcctgggggtcctggttgtgtcccctgacgctctcgggtcaaccacagcagtgcagacaccaactagcggtgagcccctggtgagcaccagtgagccgttgtcctccaagatgtataccacatctatcaccagcgaccccaaagctgacagcaccggtgatcagacgagcgcactgcctccgagcacttccataaatgaaggatcgcccttatggactagcattggagcctccaccggttcccctctgccggagcccacaacataccaagaagtctctattaagatgagctccgtccctcaggagaccccccacgctacctcacaccctgcagttcccattacagccaatagcctggggagccataccgtcacaggggggaccatcactactaactctccagagacttcatctagaacgtctggcgctcccgtcacgaccgccgctagcagcctagagacatctcgcgggacgagcggcccccccctcacaatggctaccgtgtctttggagacctctaagggaacatccggcccccccgtgactatggccacggactccctcgagacctcaacaggtacaactggacccccggtcactatgactaccggaagtctcgaaccctctagcggggcgagcggcccacaggtttcctcggtgaagctgtccacgatgatgtcccccaccaccagcacaaatgccagcacagtgcccttcagaaatccagatgagaactcccgggggatgctccccgtggcagtgttagtcgctctgctcgcggtgatcgtgctggtagcattgctgttgctgtggcgaagaaggcaaaagcgtcgaactggggccctggtgcttagtaggggaggcaagcgcaatggagtggtggatgcctgggctggccctgcacaggttcccgaggaaggagccgtaaccgttacggtggggggctctggaggagataagggttcaggatttcccgatggagagggctccagccggcgaccaactctcacaacgttctttggcagaaggaaaagcaggcagggctcatag

SEQ ID NO: 134330 - DNA, 672 bp, Artificial Sequence
  Description of Artificial Sequence: Synthetic coding sequence
atgcagtgggctgtcggacgccgctgggcctgggcggcactgcttttggcagtggcagccgtcctgacacaggtggtctggctctggcttggtacacagtcctttgtgtttcagcgggaagagatcgcccagctagccaggcaatacgcaggcctcgatcacgagctcgctttctcgcgccttatagtggaactgaggcggctacaccccggccatgtattgcctgacgaagagctgcagtgggtgtttgtgaacgccggcggctggatgggagcaatgtgtttgctgcacgcttcgctgtccgagtatgtgttactatttggaactgctttaggttcccgcggacactctgggcggtattgggccgagatatccgacactataatcagcggtacattccatcagtggcgggagggtactacaaaaagtgaggtgttttatcccggggagactgtggtgcatggacctggcgaggctaccgccgtggaatggggaccgaacacctggatggttgagtatggccgtggagtgatcccttctactcttgcctttgctcttgccgacacggtgttttccacccaggactttctcactttgttctacactctgcgttcttacgctagggggttacggctggagctgactacatacctcttcgggcaggatccatag

SEQ ID NO: 134331 - DNA, 570 bp, Artificial Sequence
  Description of Artificial Sequence: Synthetic coding sequence
atgcagtgggcggtgggacgcagatgggcctgggctgcccttctgctcgctgtcgcagccgtcctcactcaggtggtctggctctggctgggtttggatcacgaacttgccttttcacggctgatcgaggagcttcaatgggtctttgtaaacgctggcggatggatgggggcgatgtgtctgctgcatgcatcgttgagcgaatatgttcttctgtttggtacagcactgggcagtcgcggccacagcggccggtattgggccgagatctccgatacaatcatctccggcactttccaccagtggagggagggaaccacgaaatcagaagtcttttatcctggagagaccgtcgttcacggtcccggggaggctaccgccgtggagtggggaccaaacacctggatggtggaatatggtcgtggcgtgattccctcaacactggcgttcgccctggctgataccgtgttcagcactcaagattttctgacgctgttttatacattaagaagctatgctcgtggcttgcgactggagctcactacctatctttttgggcaggacccctag

SEQ ID NO: 134332 - DNA, 405 bp, Artificial Sequence
  Description of Artificial Sequence: Synthetic coding sequence
atgggtgcaatgtgccttctgcacgcgtctctctccgagtatgtgctgctttttggaactgccctgggctctagaggacacagcgggcgatattgggcagaaatcagcgataccatcatatcgggcacattccaccagtggcgggagggcaccacgaagtctgaggtgttctaccctggagagacggttgtccacgggcccggagaagctacagctgtggagtgggggcccaacacttggatggttgagtatgggaggggggtcattccttccacccttgcctttgcactcgccgacactgtattttcaacacaggatttcctcaccctattttacaccttgcgctcttatgctagggggcttaggcttgagctcaccacctacctcttcgggcaggatccctag

SEQ ID NO: 134333 - DNA, 579 bp, Artificial Sequence
  Description of Artificial Sequence: Synthetic coding sequence
atgcagtgggcagtgggacgtcgctgggcctgggccgccctgctgctcgctgtggctgctgtgcttactcaagtcgtttggctgtggctgggcacacagagctttgtgttccaaagggaggagattgcacaactcgctcgccagtacgcaggcctcgaccacgaactagctttttccaggctaatagtcgagttgagaagactgcatccgggccacgtgctccctgacgaagaactgcagtgggtttttgtgaacgctggtggctggatgggtgcgatgtgcctgctgcatgcgtcgctttccgagtacgtactcctgttcggtaccgcccttggctcccgcgggcactcaggcgagaccgtagtgcacggacctggtgaggcaaccgccgtcgaatggggtcccaacacatggatggtcgaatatggaaggggagtgattcctagtacccttgcctttgcccttgctgacactgtcttttcaacacaggactttctcacactcttttataccctccggtcttacgcccgtgggttgcgccttgagcttactacttacctgtttggccaagatccctag

SEQ ID NO: 134334 - DNA, 2916 bp, Artificial Sequence
  Description of Artificial Sequence: Synthetic coding sequence
atgggggtggcaggccgtaataggccaggtgcagcatgggcagtgttattactcctccttctgctacccccccttttactgctggcaggggcagttcctccgggaagaggccgagccgcgggtccccaggaggacgtagatgaatgcgctcaagggctagacgactgtcacgccgacgcattgtgccaaaatactcccacgtcttacaaatgctcatgtaaaccagggtaccagggcgagggccggcagtgcgaggatattgacgaatgcggtaacgagttaaatggcgggtgcgtgcatgattgcctgaatattcctgggaattaccgatgcacatgttttgatgggtttatgcttgcacacgacgggcataattgtttggacgtggatgaatgtctggagaacaacggagggtgccaacatacatgtgtcaacgttatggggagctacgagtgttgttgcaaggaggggtttttcttgagcgataaccaacacacttgcattcaccggtccgaggagggactgagttgcatgaataaagaccacggatgcagccatatctgcaaagaagccccccggggaagtgttgcatgtgagtgcaggccgggattcgaacttgctaaaaatcagagggattgcattctcacatgtaaccatgggaacggcggctgccagcatagttgtgatgacactgcggacggccccgaatgttcctgccatcctcaatataagatgcacactgatgggaggagttgcctcgagcgagaggacactgtgttggaggtcactgaatcaaatacaacaagtgtcgtcgacggcgacaagcgagttaagagaaggctacttatggaaacatgtgccgtgaataacggtgggtgcgatcgcacctgcaaagacacatccactggcgtgcactgttcatgtcctgtgggtttcacgctacagctggacggtaaaacctgcaaggatatagacgagtgtcagactcgcaacggcggctgcgaccatttctgcaagaatattgtaggatctttcgattgcggttgcaagaaaggcttcaaactgctgaccgacgagaagtcctgccaggatgtggatgaatgcagtctagacagaacctgtgatcactcttgtatcaatcaccccgggaccttcgcctgtgcctgcaacagaggttatacactctacgggtttacacattgcggggatacaaacgagtgttcaataaataacggtgggtgccagcaggtttgcgtaaataccgtgggaagctatgagtgccagtgtcaccccgggtataagctgcattggaacaaaaaggactgcgtggaagtgaagggtctgctccccacttctgtcagccccagggtgtcgctccactgtgggaagagcggcggaggcgacggttgtttcctacgttgtcattctggaattcacctgtcttccgggctgcagggagcatattcagtgacatgcggatcctcgtcaccacttcgtaacaagcagcagaaaagcaacgattctgccttcggagacgttacgaccatacggacttccgtcactttcaaattgaacgaggggaagtgctctctgaagaacgcagaactattccctgaaggactgcgccctgcactgccggagaaacacagtagcgtgaaagagagtttccggtacgttaatcttacttgctcatccggcaaacaggtgcctggtgcccctgggcggccgtcaacacccaaggagatgttcatcacagtggagtttgaactagagaccaaccagaaagaggttactgcatcttgtgatcttagctgtattgtcaaacggacagagaagcgactgcgcaaagctatccgcaccctgcgcaaggcagttcatagagaacaattccacctccagctctctggaatgaacctggatgttgccaaaaaaccgccccgcaccagcgagcggcaggccgagtcctgcggagtcggccagggacatgccgagaaccagtgcggattgtgtcagccaggcgagtacagtgccgacggatttgctccatgccatctgtgcgccctcggaacctttcagcccgaggcaggccggacatcttgcttcccgtgcggtggggggcttgccactaagcatcagggtgccacctcctttcaggactgcgagacaagggtccagtgttccccaggccatttctacaatactactacccacaggtgcattcgctgtcctgtggggacttatcaaccagaatttggcaagaacaactgcgtatcttgtccaggtaatacaaccactgactttgacggctcaaccaatatcacccagtgcaaaaaccgtagatgcggtggtgagctcggcgattttacagggtatatcgagtctcctaattacccaggcaattaccctgcaaatactgagtgcacctggaccatcaacccccctccaaagaggagaatcttgattgtggtaccagagatctttctgcccatagaggacgactgtggggattacttagttatgcgtaaaacaagctcctccaattctgtcacaacgtacgaaacttgtcaaacatatgaacgacccatagcctttacatctcgaagcaagaagctgtggatacagtttaaatcaaatgaagggaatagcgcccggggattccaggttccatatgttacatatgacgaggattaccaggagctaattgaggacatcgtccgcgatggcaggctgtacgctagcgaaaaccaccaggaaatactgaaggacaagaagctcattaaagcactctttgatgtgctcgctcatcctcagaattacttcaaatatactgctcaggagagccgcgaaatgttcccacggtccttcattagactcctccgcagcaaggtcagccgattcttacgcccttacaagtag

SEQ ID NO: 134335 - DNA, 1044 bp, Artificial Sequence
  Description of Artificial Sequence: Synthetic coding sequence
atgggtgcagctgctgtgaggtggcacctgtgcgtcctgctggcattagggacgcgagggcgtttagcaggtggctccggattgcccggatcagtcgacgtggatgaatgctctgagggaactgacgattgtcatatcgacgccatctgccaaaatacacctaagagctacaagtgcctttgtaaacccgggtacaagggcgaaggcaaacagtgcgaagacatcgatgaatgcgagaacgattactacaatggaggctgcgtccatgagtgcattaacatacccgggaactaccgttgtacatgcttcgacggctttatgctcgcccatgacggccacaactgcctggatgtggatgagtgccaggataataacgggggctgtcagcagatctgtgtaaatgcaatggggtcatacgagtgccaatgtcattccggttttttcctgtctgataaccaacatacatgtatccaccgctcgaacgagggaatgaactgcatgaacaaagatcacggttgcgcccacatttgccgcgagacccctaagggcggggtagcctgtgattgccgacccgggttcgacctcgcacagaatcagaaagattgtaccttgacatgtaactacggtaacggaggctgtcagcattcctgcgaggataccgatacggggccaacctgcggctgtcaccaaaagtatgctcttcatagcgatggtcgtacatgtatagagaaagatgaggccgccattgaaaggtcccagttcaacgctacatctgttgccgacgtagacaagagagttaagaggaggctcttgatggagacgtgcgcggtaaacaacggcggctgcgaccgcacatgtaaggacacagcaaccggagtccggtgtagttgtcctgtgggattcactctccaaccagatgggaagacatgcaagggacaacacgtggagttatgcggctgtccctgtctgtactggcccggacaagaacccccctgtgcatgtattgctggccccagggctggattgaacgggggccatgtctag

SEQ ID NO: 134336 - DNA, 2967 bp, Artificial Sequence
  Description of Artificial Sequence: Synthetic coding sequence
atgggtgccgcagccgtgcgctggcatctgtgcgtacttttggccctgggcacacggggcagactagctggcggtagtgggctgcccggctctgtggacgttgatgaatgctccgagggaacagatgactgtcatattgacgcaatttgtcagaacaccccaaaatcctataaatgcctgtgtaaacccggttacaaaggagaagggaagcagtgcgaggacatagatgaatgcgaaaatgattattataacggtgggtgcgtgcatgagtgtattaacatccccgggaactatcgctgcacgtgcttcgatgggtttatgttggcgcacgatggccacaactgtttggacgttgacgagtgccaggacaacaatggcggctgccagcaaatctgtgtcaatgctatggggagctacgaatgccagtgccatagcggcttctttctcagcgacaaccagcatacttgtattcacaggagcaatgagggtatgaactgcatgaacaaagaccatggctgcgctcatatttgtcgcgagactcctaaggggggcgtggcctgtgattgtcggccaggattcgacctggcacagaatcagaaagactgcacccttacctgtaactacggaaacggtggttgccagcacagttgtgaggatactgatactggccctacatgtggatgccaccagaagtacgcattacactccgacggccgcacctgcatcgaaacctgcgccgtcaataacggaggttgcgaccggacctgcaaagatactgctaccggtgtgcgctgctcgtgtcctgttgggttcaccctgcagcccgacggtaaaacctgcaaagacatcaatgagtgtctagtgaacaacggcggctgcgatcacttttgcagaaacacggtcggttcgttcgaatgtgggtgtagaaaaggctataagttgctcactgatgaacggacctgccaggatattgatgagtgctctttcgagcggacctgtgatcacatttgcatcaacagccccgggtcttttcaatgcctgtgtcaccgcggttatatcctgtatggcacaacacactgtggagatgtggacgagtgctccatgtcgaatggttcctgtgaccagggatgcgtcaacaccaagggctcgtacgaatgtgtatgcccccctggccgccggctgcattggaatggcaaagactgcgtcgaaacaggaaaatgcctgagtagagctaaaactagtccccgggcccagctcagctgttccaaggcaggcggcgtggaaagttgctttctgagctgtcccgcccacacattgttcgtgcccgatagcgagaactcatacgtactttcatgtggagttcccggaccccaggggaaggctcttcagaagcggaacgggacctcgagcgggctgggaccatcgtgctccgatgctccaactacccccatcaaacaaaaagcgaggtttaagatacgggatgctaaatgccatctgaggccacacagtcaggcccgtgctaaagagacagctaggcaacctctcttggatcactgccacgttacctttgtcaccctgaaatgtgactcatccaagaaaagaaggaggggacgtaaatcaccctcaaaagaggtgtcacacataacggccgaatttgagatcgaaaccaagatggaagaggcatccgacacctgcgaagccgattgtctccgcaagcgcgccgagcagtccctccaggcggctattaagacactaagaaaatccattggaagacaacagttctatgtgcaagtatccgggacagagtacgaagtcgcccagcgccccgcaaaagctctggagggacagggggcatgcggagcaggccaggtccttcaagatagcaaatgcgttgcctgtggacctggcactcactttggcggagagctcggccagtgcgtatcttgtatgcccggcacctatcaggacatggagggccagttgagctgtactccttgcccctccagcgacggcctgggactgcccggtgccagaaatgtgagtgaatgtggcggtcagtgctcacctggctttttttcagccgatggatttaagccctgccaggcttgccctgtgggcacctatcagcccgaacccggccggaccggctgctttccttgcggcggcggactgttaacaaaacacgagggcaccacctcttttcaggactgtgaagccaaggtacactgttcgccgggacatcactacaatacgaccactcacagatgtatccggtgcccagtgggcacataccagccggaatttggtcagaatcactgcataacctgtcctgggaacactagcacggatttcgatgggtccactaacgtgactcactgcaagaaccagcactgcgggggcgaactcggggattatacgggctatattgaaagtccaaattaccccggtgactatcccgctaacgccgagtgcgtttggcatatagcgccaccgcctaagcgccgcattcttatcgtggtgccagagatattcctgcccatcgaggacgagtgtggcgatgttctggttatgaggaagagcgcctcacctactagcataacaacttacgagacgtgccagacgtatgagcgccccattgcctttacgtctcgctcacgtaagctgtggattcagttcaaatcaaatgaaggaaattcgggtaaggggttccaggtcccgtacgtcacctacgatgaggattatcagcagctgatcgaggacatagttagagatggacgcctctacgcgagtgaaaaccaccaggagattctgaaggataaaaaactcatcaaggctctgtttgatgttctcgcccacccacaaaactactttaagtacaccgctcaggagagtaaagaaatgtttcccaggagttttatcaagctgctgagatccaaagtgagtcggtttctcagaccctataagtag

SEQ ID NO: 134337 - DNA, 1857 bp, Artificial Sequence
  Description of Artificial Sequence: Synthetic coding sequence
atggaaactgaggccgcctcgactgccgtgcgcacccagacacaggcaccccgcgtagtggctacacggtccacccccagcacccagactgtggccagggccagcaggcgggcccaaagtattactgaggccgccactgggcatgctcgcacccaaccactcgcctgtgatgctgcagcaccattggatagtcattgttctcggacggggagacacgccaaaacatccacctcagcatggtccacaacagaagccgccacaacttctgccgccactccgtgggcagctagctcagcagccgccgggcgcgctaccagttgcagcccaacctctgcacctgctagaactagcactagtgccccctcatcaggccccgtgactacgagtgcaagcactccccaagcaagggcaaaggaaaccgcacggcagccgctgctggaccactgtcatgtgacatttgtgacgctcaagtgcgatagttcaaaaaaaaggaggcgtggcaggaaatcacctagtaaggaagtgtctcatattactgctgagtttgaaatcgaaacaaagatggaagaagccagcgacacctgcgaagcagattgcctaaggaaacgagcagagcaatctctccaggccgccattaagacccttcgtaaaagtatcggaaggcagcagttctatgttcaagtgtccgggacagagtatgaggtagcccaacgccccgcaaaagctctcgaaggccagggcgcctgcggggccgggcaggtgttgcaagatagcaaatgcgtggcatgcgggcccggaactcacttcgggggcgagctgggccagtgcgtttcttgtatgccaggcacctaccaggacatggaaggacagttgtcctgtactccctgtccaagcagtgacgggctgggactgcctggtgcccgaaatgtgagcgagtgcggaggccagtgcagtcccggattcttctccgcagatggattcaaaccttgtcaggcatgcccggtaggaacctatcagccagagccagggcgtaccggctgcttcccttgtggtggcggcctgctgaccaaacatgaggggacaacctcctttcaggattgtgaggctaaggtgcactgttcacctggtcaccactataatacaactactcacaggtgcatccggtgcccagttgggacatatcagccagagttcggccagaaccactgcataacatgccctggcaatacaagtacagattttgacggaagtacgaacgttacacactgcaagaaccagcactgtggtggtgaactaggggactatacaggatacattgagagcccaaattaccccggggattatcctgccaacgctgagtgtgtgtggcatatcgctcccccacccaaacggcggattctgattgtcgtgcccgagatttttctgccgatcgaagatgagtgtggggacgtgctggtgatgcgcaaatcagcgagccccacatcgattaccacttacgagacgtgtcagacctatgaacgaccgatagcgtttacctctcgaagcaggaaactctggatccaattcaaatctaatgaaggaaatagcggcaaggggttccaggtaccatatgtcacttatgatgaggactaccagcagctaatcgaagacattgtgcgggacggccgcctctatgcaagcgaaaaccatcaagagatcttgaaggataaaaagctcataaaggcactcttcgatgtgctcgcccacccccagaattacttcaaatatacagcacaagaaagcaaagagatgtttccccggtcttttataaaactgctaaggtcaaaagtgtctcggtttctccggccttacaagtag

SEQ ID NO: 134338 - DNA, 1092 bp, Artificial Sequence
  Description of Artificial Sequence: Synthetic coding sequence
atgggcgccgcagccgtgaggtggcacttgtgtgtgctgttggcgttgggcactcggggcaggctcgccgggggaagcggcttgcccggttcagtcgatgtcgacgagtgcagcgagggcaccgatgactgccacattgatgctatttgccagaatacccctaagagctataagtgcttgtgtaagccaggctacaagggagagggaaaacaatgtgaggatatcgacgaatgcgagaacgattactacaacggcggttgcgtgcacgagtgtatcaacattccaggcaactatagatgtacttgtttcgacggattcatgctcgcccatgatggtcacaactgtttagatgttgacgagtgccaggacaacaatggaggatgccagcagatctgcgtgaatgcaatgggatcttatgaatgccagtgtcactccggtttctttctctcagacaatcagcacacctgcatacacaggtccaatgaggggatgaattgtatgaataaggatcacgggtgtgcacatatctgccgggagacgccaaaaggcggagtggcttgcgactgtcggcccggatttgatctcgcccaaaaccagaaggattgtacactgacatgtaattacggtaatggtgggtgccagcactcttgcgaagatacagatactgggcctacctgcggctgccaccagaagtacgccctacactccgatggacgtacatgcatcgaaacctgtgccgtgaataatgggggatgcgaccggacgtgtaaagacactgccactggggtccggtgtagctgtcctgtgggatttaccctgcagcccgacggcaaaacgtgtaaagatatcaatgaatgtctcgttaacaatggagggtgtgatcatttctgccgcaataccgtggggagcttcgagtgcggctgtcgcaaggggtataagctgcttaccgacgaacgcacctgccaagatattgatgaatgctcgttcgagcgcacctgcgaccatatttgcataaattcccccggatcatttcagtgtctgatcaaactattgagatccaaggtatcaaggttcctgagaccttacaaatag

SEQ ID NO: 134339 - DNA, 528 bp, Artificial Sequence
  Description of Artificial Sequence: Synthetic coding sequence
tagagagagactcctaaaggtggggtggcctgcgattgtcgtcctggcttcgacttggctcaaaaccaaaaggactgtacgcttacgtgtaattacggcaatggaggctgtcaacacagttgcgaagacacagacactggcccgacttgtggctgtcatcagaaatatgcccttcacagtgatggaaggacctgcatcgagaaggacgaggcagctatcgagaggtcccaatttaatgctacatcagtcgcagatgtggataagcgagtcaagagaaggctccttatggaaacctgtgcagtaaacaatgggggctgcgaccgaacctgtaaagacacagccactggcgtgagatgcagctgccccgtgggtttcactctacagcccgacggcaagacctgcaaagatatcaacgagtgcctcgtgaacaatgggggctgtgaccatttctgtaggaacaccgtaggctcatttgagtgtggatgccgcaagggatataagcttctaaccgacgagcggacctgctag

SEQ ID NO: 134340 - DNA, 3000 bp, Artificial Sequence
  Description of Artificial Sequence: Synthetic coding sequence
atgggcgtggctggacgtaaccgaccaggggctgcctgggcagtgctgctgctgctgctgctcctgccaccacttcttctcctcgcgggcgcagtccccccaggccgcggacgagctgctgggccgcaagaagatgtagacgagtgcgcacagggtctggatgactgccacgctgatgccctgtgtcaaaatactcctactagttataaatgttcctgcaaacctgggtaccaaggggagggcagacagtgtgaagacatcgacgagtgtggaaacgagctgaacggtggatgtgtccatgattgtctcaatattcccggtaactatcggtgcacgtgtttcgatggtttcatgctggctcatgacggccacaactgcctggatgtggatgaatgcctggaaaacaatggaggttgccagcacacctgtgtgaacgtgatgggctcgtacgagtgttgctgtaaggaggggttttttctgtccgacaatcagcacacctgtattcatagatccgaggaaggcctcagctgtatgaataaggatcacggctgctcccatatatgcaaagaagcccccagaggatcggtcgcttgcgagtgtcgacctggttttgagctagccaagaatcagagggattgcatcttaacttgcaaccacggcaatggcggctgccagcatagctgtgacgataccgcggacggccctgagtgcagttgtcacccacagtataagatgcacacagatggccgatcctgtctcgaacgcgaggacaccgtgttggaggttacagagagcaatacaacctccgtcgtggatggggacaagcgcgtaaaaagacgcctcctgatggagacttgcgcggtaaataatgggggatgcgatcggacatgtaaggacacgtcaaccggtgtgcattgctcttgccccgtcgggtttaccctccagctggatggtaaaacatgtaaagatatcgacgagtgccaaaccagaaacggaggctgtgaccacttttgtaagaatatcgtaggcagctttgactgcggctgtaagaaagggtttaaactgttgacggatgagaagagctgtcaggatgtggacgagtgttccctagataggacctgtgatcactcatgcattaaccatcctggcacatttgcctgcgcatgtaatcgcggctacaccctatacggctttacccattgtggcgacaccaacgagtgctccatcaataacggtggctgtcagcaggtgtgcgtgaacaccgtagggagctatgagtgtcagtgccaccccggctataagctgcactggaacaaaaaggattgcgtcgaggtcaagggtcttttgcccaccagcgtcagccccagagtgtcgctgcattgtggcaagtcaggtggtggcgacgggtgtttcctgcgctgtcactccgggatccatttatcctccgacgtgactaccatcaggacctctgtcaccttcaaactcaatgagggcaagtgttctttgaaaaatgccgaattatttccggagggtcttaggcctgcccttcccgagaagcatagttcagttaaggaaagctttcgctacgtgaacctaacttgcagttctggtaagcaggtacccggagcccctgggaggcccagcacgccaaaagaaatgtttatcacagtagagtttgagcttgaaacaaaccagaaagaggtaaccgcatcttgcgacctgtcctgcatcgtcaagcggaccgaaaagaggctgaggaaagcaatccggaccctgagaaaagccgtgcatcgcgagcagttccacttacagctttctggaatgaatctcgatgtcgcaaagaagccccctagaacgtcagagcgacaggctgagtcatgcggcgtgggacagggacatgccgaaaatcagtgcgtttcttgccgggccggaacttattatgacggggcccgcgagaggtgtatcctttgccctaatggtacttttcagaacgaagaaggccagatgacctgtgagccgtgccccaggcctggtaattctggggccttaaaaactcctgaggcatggaacatgtccgagtgcgggggcctctgccagccaggcgagtacagcgccgacggcttcgctccatgtcacctgtgtgccctggggacctttcagcctgaggccgggcggacatcatgctttccatgtggtggggggttagccacaaagcatcaaggagccacctcatttcaggactgcgagacacgagtgcagtgttcgccaggacacttctacaacactaccacacatcgttgcattagatgtccagtcggaacctatcagcccgagtttggaaagaacaactgcgtgagttgtccggggaatacaacgactgacttcgacggcagcactaatattacacaatgtaaaaacaggcgctgcggcggcgaactgggtgatttcaccggttatatcgagtccccaaactacccgggcaattaccccgccaatacagagtgtacatggaccattaaccccccacccaaaagaaggattttgatagtcgtacccgagatcttcctgccgatcgaggacgactgcggtgattacctggtgatgaggaaaaccagttcttccaactcagtgaccacgtacgagacttgtcagacgtacgagcgcccaatcgctttcacgtctagatctaagaagctgtggatccagttcaagagtaatgaggggaactctgcccgcggatttcaggtaccctacgtgacatatgatgaggactatcaggaactgatcgaggacattgtgcgcgacggtagattgtatgcatcagagaaccatcaagaaatcctgaaagataaaaagctaataaaggcactgttcgatgtgttggctcacccacagaattatttcaaatacactgctcaggaatcccgcgaaatgtttccaaggtcttttatccggttactgcggtcaaaagtctccaggttcctacgcccctacaaatag

SEQ ID NO: 134341 - DNA, 2424 bp, Artificial Sequence
  Description of Artificial Sequence: Synthetic coding sequence
atgggcgtggcagggcggaataggcctggcgccgcttgggctgtcctgctgttgttgttgctgctgccgcctttactgctgctagcgggagcagtacctccaggcaggggacgggcagctggcccccaggaggacgtagacgagtgcgcccagggtctggatgattgccacgctgacgccctttgccagaatacccccacgagttacaagtgctcctgtaaacctgggtatcagggggagggtcgtcagtgtgaggacatagacgaatgtggaaacgaacttaatgggggttgtgtccacgattgcctgaatattccagggaattatcggtgcacctgctttgacggcttcatgctggctcatgacggccacaattgtcttgatgtggacgaatgtctggagaacaatggtgggtgtcagcacacctgtgttaatgtgatgggcagctacgaatgctgttgcaaagaaggtttttttctgtccgacaaccagcacacctgtattcacagatctgaagaaggactgtcttgtatgaataaagatcacggctgtagccatatctgcaaagaggccccccgcgggagtgtggcatgcgagtgtcgccctggatttgagcttgcaaaaaaccagcgcgactgtatcctgacatgcaaccatgggaatggtggctgccagcatagctgcgatgacaccgctgacggaccagagtgcagttgccacccacagtataaaatgcacacagacggacgaagttgcctggagcgggaagacaccgtgcttgaggtcactgagtctaacaccacatccgtggtggatggagacaagagagtcaaacgacgtctcctgatggagacctgtgctgtcaacaatggtggttgtgataggacctgcaaggacacaagtactggggtccactgctcctgtcctgtaggatttacactgcagctagacggcaagacttgtaaagacattgacgaatgtcaaaccaggaatggcggctgtgaccacttttgcaagaatatagtgggttcctttgattgcggctgcaaaaaggggttcaaacttttaactgatgagaagtcttgtcaagacgtcgatgagtgttccctagaccggacctgcgatcactcttgcattaaccaccccgggacattcgcatgcgcatgcaaccggggatatactttatatggttttacgcattgtggcgacacaaatgaatgcagcattaataacggagggtgtcagcaggtatgcgtcaatactgtcgggtcctacgaatgccaatgccatcctggatataaactgcactggaacaaaaaggattgtgtggcctcttgcgatctctcctgtattgtcaagaggacggaaaagcgcctgagaaaggctatccggacgctgcgcaaagcagtccatcgcgagcagttccaccttcaacttagcggaatgaacctggacgttgcaaagaaaccaccaagaacgtctgaacgccaggctgagtcctgcggagttgggcagggacatgcagaaaaccagtgcgtaagctgtagagcgggcacatactacgacggcgcaagagagcggtgtatcctttgccctaacggcactttccagaacgaagaagggcagatgacatgcgaaccttgcccccgccccggcaacagcggtgcactgaagacgccggaagcctggaacatgtctgaatgcggaggattgtgccaacccggagagtattcagcagacggtttcgctccgtgccacctttgcgcacttggtacattccagcctgaggccggaaggacttcttgcttcccctgtggtggtggattagcaactaaacaccagggggccacaagttttcaggactgcgaaactagggttcagtgttctcccgggcacttttacaatacaaccacacatcgctgcattcgttgtcctgtgggtacataccagcctgagttcggtaaaaacaactgcgtctcatgccctgggaatactactacggacttcgacgggtctacaaatatcacgcagtgcaaaacaagtagcaactcagtaaccacttacgaaacttgtcaaacatacgaacgtcctatcgcattcacatctcgcagtaaaaagttgtggatccaattcaagagcaacgagggtaattctgcacgcggattccaggtgccatatgtgacatatgatgaggactatcaggagctgatcgaggacattgtgcgagatggacggttgtatgcgtctgagaatcatcaggaaattcttaaagataagaagttgattaaagccctgttcgatgttctcgcccacccgcagaattattttaagtataccgcccaggagtcaagagagatgtttccacgatccttcatcagattacttcggagcaaggtgtcaagattccttcgtccatataagtag

SEQ ID NO: 134342 - DNA, 3087 bp, Artificial Sequence
  Description of Artificial Sequence: Synthetic coding sequence
atgggagttgcgggcaggaaccggcctggcgcggcctgggcagtcttactgctccttcttcttctgcccccacttctgctactcgccggcgccgtgccccccggaagggggcgcgcagccggcccccaggaggacgtggacgagtgcgctcagggcttggatgactgtcatgctgatgcactatgccagaacacacctaccagttataaatgtagctgcaagcctggctatcagggggaagggagacagtgtgaagacattgacgagtgcggcaacgagctcaacggaggctgtgtccatgattgtttgaacatccccggtaactatcgctgtacttgttttgacggattcatgctcgcgcacgacggccataactgtctcgacgttgatgagtgccttgagaacaatgggggctgccagcatacctgtgtgaacgtgatggggagctatgagtgctgctgcaaggagggattcttcctgtcagataatcagcacacctgtatccatcgatcagaagaaggactgagttgcatgaacaaagaccatgggtgttcgcacatttgtaaagaagctccaaggggctctgtggcctgcgaatgccgaccaggattcgagctcgcaaaaaatcagcgcgattgtatcttgacatgcaaccacgggaacggtgggtgccagcatagctgcgatgatacagcagacggacctgaatgctcttgccacccccagtacaaaatgcacactgatggccggtcctgcttggagagggaggacactgtcctggaagttactgagtccaatacaacaagcgtggtggacggagacaaacgtgtgaagcggagacttctgatggagacgtgtgctgtgaacaatggggggtgtgaccggacgtgtaaggatacctctacaggcgttcactgctcttgtccagtggggttcaccctccagctagatggaaagacttgtaaagacatcgatgaatgccagacgcggaatggcggctgtgaccacttctgcaagaacattgtgggttcatttgactgcggctgtaaaaaaggttttaagctgttaactgatgagaagagctgtcaggacgtagacgaatgctctctggacaggacctgtgatcactcctgcattaatcacccagggactttcgcatgtgcctgcaatagaggctatacgctgtacggctttactcactgtggggacacaaacgaatgttctatcaacaacggcggctgtcaacaagtgtgcgttaacacggtcggcagctacgaatgccagtgtcaccccggctataaactgcattggaataagaaagactgtgtagaggtgaagggcctcctgcccacttctgtctcccctcgcgtctcacttcactgtggcaaatcggggggcggcgatggttgcttcctgaggtgccactctggcatccacctcagtagtggactgcagggtgcttactccgtgacatgcgggtcttccagcccacttaggaacaaacagcaaaagtccaatgactcggcgttcggtgacgtgactacaatcagaacgtcagttacctttaaattgaatgaaggaaagtgctccttaaaaaacgctgaactgtttccagagggactaaggcctgctttacccgagaagcattcctccgtcaaggagtcatttcgttacgtgaatctgacgtgttcttcagggaaacaggtgcccggcgcgcctgggcgcccaagtacccccaaggagatgttcatcacagttgaatttgagctcgagaccaatcagaaggaagttacagcttcttgcgacctctcttgtatcgtaaagcggactgagaagagactccgcaaggctatccgcaccttgcggaaagcagtccatcgggaacaattccatctgcagctgtcaggaatgaacctggatgttgcgaagaaacctcccagaacctccgaacggcaagcagagtcttgcggagtaggacagggccatgccgaaaaccaatgtgtctcctgtcgggcaggaacctactatgacggcgctagagaacggtgtattctgtgtccaaacggcacattccagaacgaggaaggacaaatgacctgcgaaccatgtccccggcctggaaactctggtgctctcaagactccagaggcgtggaatatgtccgagtgtgggggactctgtcaacccggcgagtacagtgccgatgggttcgcaccttgccatctctgcgccttaggaacattccagcctgaggccggccggacaagctgttttccatgtggtggcggcctggccaccaaacatcagggagctactagtttccaagactgtgaaactcgggtgcagtgcagtcccggccatttttacaataccaccactcacagatgtatcaggtgccccgtgggcacttaccagcccgagttcggcaaaaacaactgcgtttcatgccccgggaacacaactacggatttcgatggctcaacaaacattacccagtgcaagaaccgcaggtgcggcggcgagctaggggatttcactggatacatcgaaagtcccaactatccaggaaattatcccgccaacacagagtgcacttggactattaatccccctcccaagcgtaggattctgattgtggttcctgagatctttctcccgatcgaggatgactgcggcgattacttagttatgcggaaaacctcttcctcgaactcggtaactacctatgagacgtgccagacctatgaaagacccattgcttttacaagtcggagcaaaaagctgtggattcaattcaaatcaaacgaaggcaatagcgcccgagggtttcaggttccttacgtcacttacgacgaagactatcaggagcttatagaggacattgttcgtgatggtcgcctgtatgcttccgaaaaccaccaggagattttgaaggataaaaaactgattaaggctctttttgacgtccttgcccacccccagaactatttcaaatatacagcacaggaatccagagagatgttcccgcggtcttttatacgattgctgaggtccaaagtgagcagatttttaaggccttacaaatag

SEQ ID NO: 134343 - DNA, 411 bp, Artificial Sequence
  Description of Artificial Sequence: Synthetic coding sequence
atggtcctcctggaatccgagcagtttctcacagagttaacaagactctttcaaaaatgccgcacgagtggctcagtgtatattaccctcaagaaatacgacggacgaaccaaaccaatacctaagaagggaactgtggaaggattcgagcctgccgataacaaatgcctgctgcgcgctacagatggcaaaaaaaaaatctccacagtagtgagttcaaaggaggtaaataaattccagatggcttattccaacctgctgagagctaacatggatggcttgaagaagagggacaaaaagaacaagacgaagaagaccaaggcggctgcagctgccgcggcagcggctcctgccgccgcagccaccgcgcctacaacagccgctactaccgcggccaccgctgcccagtag

SEQ ID NO: 134344 - DNA, 333 bp, Artificial Sequence
  Description of Artificial Sequence: Synthetic coding sequence
atggcatgtgcggctgccaggagtccagcagaccaggatagattcatctgcatttaccctgcttatctgaataacaaaaaaacaatcgccgaaggtagacgcatccccattagtaaggccgtggaaaaccccactgcgacggaaattcaggacgtctgttccgcggtaggcctgaatgttttcctcgaaaaaaacaaaatgtattctagagagtggaatagggacgttcagtaccgtggtcgtgttcgagtacagctaaaacaagaggacgggagcctgtgcctggtgcagttcccatcacactacacactctctttaactagcggctcatag

SEQ ID NO: 134345 - DNA, 435 bp, Artificial Sequence
  Description of Artificial Sequence: Synthetic coding sequence
atggcttgcgccgcagcacgcagtcccgcagaccaagacagattcatctgtatttaccctgcttacttgaataataaaaaaacaatcgctgagggccggagaatcccgatctcaaaagccgtggagaatccaacggcgaccgaaatacaagacgtgtgctctgccgtagggttaaatgtatttctggaaaaaaacaaaatgtattcacgcgagtggaatcgcgatgtgcaatatcgtgggagggtgcgcgtgcaacttaaacaggaggacgggtccctttgtctcgtgcagtttccaagcaggaaaagcgtgatgctctacgccgccgaaatgatacccaagctgaaaacacgcacacagaagactggcggcgccgatcagtcactgcagcagggtgaggggtctaagaaggggaaggggaagaagaagaaatag

SEQ ID NO: 134346 - DNA, 237 bp, Artificial Sequence
  Description of Artificial Sequence: Synthetic coding sequence
atggcctgtgcagcagcacggtctccagcggatcaagatcggctgctgaagatcctgcaattacaacgctttaaaatgtatgtccagcaactcgatttgacctactttctgcggaaaataaaatgcaccctcgagaatggcatcgtaatgtctaacacggaagctgaaagcggctcatccagcaacaggaagatgggcgcatccgcattatattcatctcaccacgtgagccaatag

SEQ ID NO: 134347 - DNA, 639 bp, Artificial Sequence
  Description of Artificial Sequence: Synthetic coding sequence
atggaagcaaagaccctggggacagtgacgccaagaaagccggtcctcagtgtcagcgcccgaaagattaaggataatgccgccgactggcataatctgatactcaaatgggagaccttaaacgacgctgggttcaccaccgccaacaatatcgccaacttgaaaatttcattactcaacaaagataaaatcgaactcgactcctcatcacctgcgtccaaggagaacgaagaaaaggtttgcctcgagtataatgaagaactggaaaagctgtgtgaggaactccaggctacactggacggtctcaccaaaatccaggtgaaaatggagaaactgagctccactaccaaaggtatttgtgaactcgaaaattaccattacggcgaggagagcaagcggcctcctcttttccacacatggccaacaacgcacttttacgaggtttctcacaagctgctcgagatgtatcgcaaggaactattgttgaaacgcactgtcgcaaaagaactggcacatacgggtgatcccgatctgactctgtcgtaccttagcatgtggctccatcaaccctatgttgagtcagattctcgattacacttggaatccatgcttttggagaccgggcacagggcgctgtag

SEQ ID NO: 134348 - DNA, 1368 bp, Artificial Sequence
  Description of Artificial Sequence: Synthetic coding sequence
atgcctcccctgtcaatgaagcggtctgctatcgatctagaggaaatggccagcggtcttaacaaaagaaagatgatccaacacgctgtatttaaagagttggtcaagctggtggaccccggggttaaagcatggaccccaactaaaggtaagcagaacgtgattatgttcgtggggctgcagggatccgggaaaactacgacgtgctccaagctggcctattactatcagcgcaaaggatggaagacctgcttgatttgtgcagacacttttagggctggtgcctttgatcagctcaaacaaaatgccaccaaagctaggatccccttttatggttcatatacagagatggaccctgtcatcatcgctagcgagggcgtggagaagttcaagaatgagaacttcgagattatcatcgtggacaccagcgggcggcacaagcaggaggatagccttttcgaggaaatgctgcaagttgcaaatgcaatacagcctgacaatatagtctatgtgatggacgcaagtattggtcaggcctgtgaagcacaggctaaggcatttaaagacaaagtggacgtggcatctgtgatagttaccaaactggatggacacgcgaaaggaggcggggccctgagtgctgtggcagccaccaaatccccaataatattcataggtactggggagcacatcgacgacttcgagccgtttaagacccaaccattcattagtaaattgctgggtatgggcgatatagagggactgatcgataaggtgaatgaactgaagttagacgacaacgaggctctgatcgaaaaactaaagcatggacagttcacgctcagagacatgtatgaacagtttcagaacataatgaaaatgggtcccttttcccagattcttggcatgatccccggatttgggaccgatttcatgagtaaagggaatgaacaggaaagtatggctaggctcaaaaagctgatgactattatggacagcatgaatgaccaggagcttgactccaccgatggcgccaaagtgttctctaagcagccagggcggatccagcgggtggctagggggtccggcgtgagcacacgcgatgtgcaggagctgctgacacagtatactaagtttgcacaaatggtcaaaaaaatgggcggcatcaagggtctttttaagggcggtgacatgtccaagaatgttagtcaatcacagatggccaagctgaatcagcagatggctaaaatgatggatccccgtgtcttacaccatatgggaggaatggcagggctgcaatcgatgatgagacaatttcagcagggggctgccgggaacatgaaggggatgatgggttttaacaatatgtag

SEQ ID NO: 134349 - DNA, 135 bp, Artificial Sequence
  Description of Artificial Sequence: Synthetic coding sequence
atggtactggccgacctggggcgcaaaatcaccagcgcgctgagaagtctgtcaaacgccacgattattaatgaagaagtgctgaacgcgatgctgaaggaggtgtgcactgctttgctggaagcagatgtgtag

SEQ ID NO: 134350 - DNA, 225 bp, Artificial Sequence
  Description of Artificial Sequence: Synthetic coding sequence
atggttttggcagatcttggacgcaaaatcacatccgcactgagatcactctctaacgccacgatcattaacgaagaggtgctgaacgctatgctgaaggaagtatgcaccgctctgctagaggccgatgtgaatataaaattggttaagcagttaagagagaacgtaaaatctgcaattgacctggaagagatggccagcggcctgaacaagcggaagatgtag

SEQ ID NO: 134351 - DNA, 1515 bp, Artificial Sequence
  Description of Artificial Sequence: Synthetic coding sequence
atggttctagctgatcttggcagaaagattacatccgcgctgcgctctctttcaaatgccacaattattaacgaggaagtcctgaatgccatgcttaaggaggtctgtaccgccctgttggaagccgacgtgaacataaaactggtcaaacagctgagggaaaacgtcaagtctgcaatcgacctggaagaaatggcctcggggctgaataaaaggaagatgattcagcacgctgtttttaaggaactggttaaactggtggatcctggggtcaaagcctggacaccaacaaagggaaagcagaacgttattatgttcgtgggactccagggatcaggcaagactactacttgttcaaagctagcctattattatcagcgaaagggctggaagacttgcctgatctgtgcagacacatttagagctggcgccttcgaccagttgaaacagaatgccaccaaagcgcgcatccctttttacggatcctatactgagatggaccccgttattatcgcctctgaaggagtggagaagtttaaaaacgaaaactttgagattatcattgtagacaccagcggcaggcataagcaagaggattcactgttcgaggagatgctgcaggtggctaatgctatacaacccgataatattgtttatgtcatggacgcctccattgggcaggcttgtgaagctcaggctaaagctttcaaagataaggtggatgtggccagcgtaattgtgaccaaactggatggccacgctaagggcggcggcgctcttagcgctgtggctgctaccaagtctcctataatctttatcggaaccggcgagcatattgacgattttgaaccattcaagacccaaccattcatcagcaagttgttgggaatgggcgatattgaagggctaattgataaggtgaacgagctgaagctggatgataacgaagcacttatcgagaaattaaaacacggccagtttacccttcgggatatgtacgaacaatttcagaatatcatgaaaatggggcctttctcccagatacttgggatgattcctggctttggaacagactttatgtcaaagggtaacgaacaggaatcaatggcaaggctgaaaaaattgatgactattatggatagcatgaatgaccaggagctggacagcacagacggggcgaaggtgttctcaaagcagccaggccggatccagcgggtggcacggggctcaggcgtctcaaccagggacgtgcaggaacttctaactcagtacacgaagtttgcccaaatggtgaagaagatgggcgggatcaagggactgtttaagggcggtgatatgtcaaaaaatgtaagccagagtcaaatggcgaaactgaatcagcagatggccaaaatgatggaccccagggttcttcatcacatgggaggcatggccgggctccagtccatgatgagacagttccagcaaggagcagctggaaacatgaaaggcatgatggggttcaataacatgtag

SEQ ID NO: 134352 - DNA, 1791 bp, Artificial Sequence
  Description of Artificial Sequence: Synthetic coding sequence
atggcggccgaaaaacaagtgcccggaggaggcggcggaggtggttcaggaggcggaggaggaagcgggggaggcggaagtggcgggggacgtggcgccggaggtgaggaaaacaaggagaacgagaggcctagcgctggcagtaaagctaataaagagttcggcgattcactgagtttagaaattctacagataattaaggagtcgcaacagcagcatggcttgaggcatggagacttccagcgttacagaggatattgtagcagacggcagaggagactgcggaagaccttgaactttaagatgggaaaccgtcataagttcacaggaaaaaaagtgacagaagagctgttgaccgataaccgttatttgctgcttgtgctgatggacgctgagcgtgcctggtcatacgccatgcagttgaaacaagaagcaaatactgagccgcgaaagagattccatctgctgtcaagattacgtaaggcagtgaagcacgcggaagaattggaaaggttgtgtgagagtaacagggtggatgcaaaaacgaaattagaggctcaagcctataccgcctatctgtccggtatgcttcgttttgaacatcaggagtggaaagcagctatcgaagcgttcaataaatgtaaaacaatttatgagaaactggcgagcgcgttcaccgaggaacaggctgtcctgtacaaccagcgcgttgaagagatctcccctaacatacgatactgcgcctacaacatcggagagactcgtgccaagcaggcagccactatgagtgaagtggagtggcggggccggaccgtgcctgtcaaaatagataaagtgaggatatttctgctgggactggctgacaatgaggctgcaattgtgcaggccgagtccgaggagactaaagaacgactctttgaatcaatgttatccgagtgtcgagatgccattcaggtagtcagagaagaactgaaaccagaccagaaacagcgtgactatatacttgagggtgagcctgggaaggttagcaacttgcaatatctgcatagttatctgacttatatcaaactatcgactgcaataaaaagaaacgagaacatggccaagggattgcaacgggccctgctgcagcagcagcccgaggatgattctaagcgcagtcctagacctcaggacctaatccggctatatgacatcatcctacaaaaccttgtcgaactgctgcaattgcccggcctggaggaggacaaggcattccagaaggagatcggcttgaagaccctggtcttcaaggcttataggtgcttcttcattgcacagtcctatgtgctcgtgaagaaatggtccgaggctctggtcctttacgatagagttctcaaatacgctaatgaagtgaattctgatgccggtgcatttaaaaatagcttgaaggatctgcccgatgtccaagagctcataactcaagtacgctccgaaaaatgcagccttcaggccgccgccatcctggatgccaacgatgcccaccagactgaaacaagctccagccaggttaaggacaataaacctctggtcgaaagatttgaaacgttttgtctggatccatctttggtgaccaagcaagccaacctagtgcattttccacccggtttccagcctatcccttgcaagccgctcttcttcgacctcgcgctgaatcacgttgccttccctcctcttgaggacaagctagagcagaaaactaaatccggattgaccggttacataaagggaatctttgggttccgcagttag

SEQ ID NO: 134353 - DNA, 1884 bp, Artificial Sequence
  Description of Artificial Sequence: Synthetic coding sequence
atggccgccgagaaacaggtccctggtggtggcgggggtggcggttccggtgggggtgggggcagcggcggtggcggttccggcggcggtaggggcgctggcggggaggaaaataaggagaatgagcgtcccagtgcaggatccaaggccaacaaagagtttggcgactctctgtccctggagattctgcagatcatcaaggagagccagcagcagcatggtctgaggcatggagacttccagcgctacagaggatattgcagccgtagacagcgccgcctccgaaaaaccctgaactttaagatgggcaacagacataaattcacaggaaagaaggtgacagaagagctgctgactgataatcgatacttgctgctggttctgatggatgcggaaagggcttggtcttacgccatgcagctgaaacaggaagcaaataccgaacctagaaagcgtttccacttgctatcgcgcttgcggaaggctgtcaagcatgcagaggagttggagcggctctgtgaaagcaacagggtcgacgctaaaaccaagttggaagctcaagcttatacagcctacctctcagggatgctccgctttgagcatcaagaatggaaggcggctattgaggcgttcaacaagtgcaagaccatatacgaaaagcttgcctcagctttcacagaggagcaggctgtgctgtacaatcaaagggtggaggagatttccccaaacattcggtattgtgcttataacattggagaccagtcagcaatcaacgagctgatgcaaatgcggctcaggtcgggaggtactgagggcctgctggccgagaaacttgaagccctgattacacaaacgcgcgccaagcaagctgccacaatgagcgaagttgaatggcgcggacggacagtacctgtgaagattgacaaggtgcggatcttcctcctgggtctggctgacaacgaagcagccattgttcaggcggaatcagaggaaacaaaggagcggttatttgaatctatgctttccgagtgccgagacgccatacaggtggtgagagaggagcttaagcccgaccagaagcagcgagattacatcctcgagggcgagccgggaaaagtgtccaatctgcagtatttacatagttacctcacctatatcaagctgtctacggcaatcaagagaaacgaaaatatggcaaagggtctgcagagggctttactccagcagcaacctgaggacgacagcaaacgaagtcccaggccccaggacctgattagactgtatgacataatcctgcagaacttggtggagctcctccagttgcctggcctagaagaggacaaagccttccaaaaggagattgggctgaagactctggtgttcaaggcgtatcgctgcttctttattgcccagagctatgtgttagttaagaaatggtccgaggcccttgtgctatatgacagggtgctgaagtacgctaacgaggtgaattctgatgcaggggcgttcaagaatagccttaaagacttacccgacgtgcaggagcttattactcaggtgcgtagcgagaagtgttctctccaagctgcagcaattctcgacgccaacgacgcccatcagaccgagacaagttcgtctcaagtgaaagataacaagccattagtcgaacgcttcgaaactttctgtctggatccttccctcgtaacaaaacaagctaatttggtccactttcctccagggttccaaccaattccatgcaaacctctgtttttcgatctcgctctgaatcacgtggcatttccccctctggaagacaagctggaacagaaaacaaaatcggggttgaccggctacatcaagggaatcttcggatttcgctcatag

SEQ ID NO: 134354 - DNA, 1581 bp, Artificial Sequence
  Description of Artificial Sequence: Synthetic coding sequence
atgggcaaccgacataagtttacaggaaagaaagttaccgaggagctcctgacagataatcgctacctgctgttggttctgatggatgccgagagagcatggagctacgcaatgcagctgaaacaggaagctaacaccgagcccagaaaacggtttcatctgctctcccggttaaggaaggctgtcaagcatgccgaggaactggaacgtttatgcgaatctaatcgagtggatgcgaagactaagttggaggcacaggcctacacagcctatctgagtggaatgctgaggtttgagcaccaagaatggaaagcagctattgaagcatttaacaaatgcaaaacgatttacgaaaagctggctagcgcattcacagaggagcaggctgtgctgtataaccagagagttgaggaaataagccccaacatccgttattgtgcctacaacattggggatcaaagcgcaataaatgaactgatgcagatgcgtctacgatctggcggcaccgaggggctgttagccgagaagttagaagcattaatcacacagacacgggctaaacaggccgcaactatgtctgaagtggagtggcgcggcagaacagttcccgtcaaaatcgacaaggtgaggatatttctgctcggactggctgacaatgaggcagcaattgtccaggcagaatccgaagaaaccaaggaaaggttgttcgagtccatgttgagtgaatgccgcgatgccatacaggttgttagagaggaattgaaacccgatcagaaacagcgggattacatcctcgagggtgagccaggcaaagtaagtaatttacagtacctacactcatatttgacctatataaagttgagcactgcgataaaacggaatgaaaatatggcaaagggcctgcaaagggccttgcttcaacagcagcccgaagatgacagtaagcggtcaccccgccctcaggacttgatcagactttacgacatcattttacagaatctcgtcgagctgctgcaactccctggtctggaggaggacaaggccttccaaaaggagatcggccttaaaactttggtgttcaaggcctacaggtgcttcttcatcgctcagagttacgtacttgtcaagaaatggagcgaggccctggtgctttacgatcgtgtgcttaagtacgctaacgaagttaactccgacgctggcgctttcaagaattctctgaaagacttgccagacgttcaggaactgatcacccaggttcggtcagagaaatgttcattacaagccgccgctatcctcgacgctaatgacgcccaccagacggagacctcctcctcacaagtgaaagacaacaaacccctggttgagcgcttcgagaccttttgtcttgacccctctctcgtcaccaagcaggcgaacctggtgcactttccgcccggatttcagcctatcccatgtaaaccactgttctttgacctcgctcttaatcacgtcgcctttccccccctagaagacaagctggagcagaagactaagagcggactaaccggctacattaaggggatttttggctttcgcagctag

SEQ ID NO: 134355 - DNA, 984 bp, Artificial Sequence
  Description of Artificial Sequence: Synthetic coding sequence
atgcagatgcggctgcgcagcggtgggactgaaggactgctggctgaaaagcttgaagcccttatcacacaaacaagagccaagcaagctgcgacgatgtctgaggtggagtggcgcggccgtacagtacctgttaagatcgataaggttcggatctttcttctaggactcgcagacaatgaggcggctatagtgcaggccgagtccgaagagacaaaggagcgcctcttcgagagtatgttgtctgaatgtagggacgctattcaagttgtccgagaagagctaaaacccgaccagaaacaacgagactatatcctcgagggagagcccgggaaagtctcaaatctacagtacctgcactcttacttaacctacatcaaattgtccaccgccatcaagcggaacgaaaatatggcgaaggggctccaacgggcgctgttacagcagcaacccgaggatgattccaaaagatcaccaagaccacaggacctcatcagactgtacgacatcatacttcagaaccttgttgagctgctgcaacttcctggtctcgaggaggacaaggcatttcagaaggagatcggattgaagacattggtgttcaaagcctatcgctgttttttcattgctcagagctatgtgctggtcaagaaatggtccgaagctctggtgctgtacgatcgggtccttaaatacgccaacgaggtgaactcggatgccggagcctttaaaaattcgctgaaagacctgccagacgtgcaagagctgataactcaggtgagatcagaaaaatgttctcttcaggcggccgcaattctggatgcaaatgacgcccatcagacagaaacaagctctagccaggtcaaggacaacaaacctttagtcgagaggttcgagtctactccaggcacagacggagccctgaagcgatttgtgatgctgctgcaatatcacggatttgaaatgaacagcagcctcctgtag

SEQ ID NO: 134356 - DNA, 1770 bp, Artificial Sequence
  Description of Artificial Sequence: Synthetic coding sequence
atggctgcggagaaacaggtgcccggaggaggcggcggcggcggctccggcggcggcggtgggtctggaggaggaggatccggtggaggaaggggggctggaggcgaggagaataaagagaacgaaaggccttctgctgggagtaaagccaacaaggagtttggagactcactttcactcgagatcctccagatcattaaggagagtcagcagcaacatgggctgaggcatggggattttcagcgctacagatacctgctcctggtcctgatggacgctgagcgtgcctggtcctacgctatgcagctgaagcaggaagccaacaccgaaccgagaaagagattccacctcttgtcacgactccgaaaagctgtgaagcatgcagaagagctcgaacgactgtgtgagtcgaacagagtcgacgctaagacaaagcttgaagcgcaagcttatactgcatacctttccggaatgttgcggttcgaacatcaggaatggaaggctgctatcgaggcctttaacaaatgtaaaaccatttacgaaaaacttgcttccgccttcaccgaagagcaggccgtgctttataaccagagagtcgaggagataagccccaacatacggtactgtgcttacaatatcggtgatcagtccgccattaatgagctcatgcaaatgcggcttcgctccggcggcactgaaggattgctcgccgagaaactcgaggcactgattactcagactcgcgccaaacaggctgctactatgtctgaagtggagtggcgaggaaggacggttcctgttaaaatcgataaggtgcgaatcttcctcctgggtctggctgataacgaggccgcaatcgtgcaggccgagtcagaagaaactaaggaacggttgtttgaatccatgctctccgagtgcagagacgcaatccaggtggtacgggaggagcttaagcctgatcagaaacagcgcgactatatcctggagggggaaccaggcaaggtttctaatctccagtacttgcattcttatttgacatacataaagctcagcaccgccatcaaacgaaacgagaacatggcaaaaggtctccaacgtgccctcctgcagcagcagcccgaggatgacagcaaacggtctccacgaccccaggacttaatcagattgtatgacataatccttcaaaacctggtagaactgctccagctgcctgggctggaagaggacaaagccttccagaaggaaatcggactcaagaccttggtttttaaagcatatcggtgcttcttcattgctcagtcttacgttttggtgaaaaagtggtctgaggccctcgtattatacgaccgagttctgaaatatgccaacgaggtgaattccgacgctggagcttttaagaatagtctaaaagacctcccagatgtacaggagctcattacccaggtgcgaagtgaaaaatgtagcttacaagcagctgcgattctagacgctaatgacgcacatcagaccgagacaagctcgagccaggtcaaggacaataaacctttggtagaaagattcgagaccttctgcctggacccttccctggtgactaaacaggccaatttggtacactttccccccggctttcagcctataccgtgcaaaccactcttcttcgacctggcattgaaccatgttgcctttccccccctggaggacaaactggagcagaagaccaagtccggcctcaccggctatatcaaaggcatctttgggtttcgctcctag

SEQ ID NO: 134357 - DNA, 1110 bp, Artificial Sequence
  Description of Artificial Sequence: Synthetic coding sequence
atggccgctgagaagcaggtgcccggtgggggtgggggcggcggctctgggggcggaggggggagcggcggtgggggctcaggaggtggcagaggagccggtggcgaggaaaataaagagaacgagcggccatccgccgggtcaaaagctaacaaggagttcggtgacagcctgtcactcgaaatcctgcagatcatcaaggagagtcaacagcagcacggactgagacacggcgactttcagcggtaccgaggttactgttcaaggcgacagcgccgtctgcgtaaaacactgaacttcaagatgggaaatcgacacaaattcactggcaagaaggtgaccgaggaattactaactgataatcgctatctgctgctagtcctaatggatgccgaaagggcatggagctacgctatgcagctaaaacaggaggcaaacaccgaaccacgcaagcgctttcatctcctctcgagactgagaaaggccgtcaaacacgctgaggagctggaaaggctgtgcgagtccaatagggtggatgccaaaaccaaactggaagcccaggcatacacagcatacctgtccggcatgcttcggtttgagcatcaggagtggaaggccgcaattgaggcgttcaataagtgtaagacaatctacgaaaagcttgcatctgcatttacagaagaacaagcagtgctctacaatcagagggtcgaggaaatttcccctaatatcaggtattgtgcgtataacataggcgatcagagtgcaattaatgaactcatgcagatgcgtttgaggagcggagggacagaagggctgttggctgagaagcttgaagccctgatcacacagactcgggccaaacaagctgctactatgtccgaggttgagtggcgaggcagaactgtcccagtcaagatagataaagtccgcatctttctgttagggctggccgacaatgaagcagctattgttcaggccgagagcgaggaaacaaaggaaaggcttttcgaatccatgttaagtgagtgtcgggatgcgatccaggtcgtgcgcgaggaactgaaacccgatcaaagggatctgctgttgccttcacaagggcagtag

SEQ ID NO: 134358 - DNA, 867 bp, Artificial Sequence
  Description of Artificial Sequence: Synthetic coding sequence
atgctttccgagtgcagggacgccattcaggtagtccgggaggagttgaaacccgatcaaaagcagcgagactatatactcgagggggagcccggcaaagtgtctaacctgcagtatctgcactcctacctgacctacatcaaactctccacagccattaaacgcaacgaaaacatggctaagggactgcagcgggcgttgctgcagcaacagccagaagatgactccaaacgttcaccgaggccacaggatctgattagattgtacgatattattttgcaaaacctagtggagctgctgcagctgcctggattagaagaggataaggccttccagaaggaaatagggcttaaaacgctcgtcttcaaagcttatcggtgcttcttcatcgctcaatcttacgtacttgtcaagaaatggtccgaagccctcgtcctgtacgatcgagtgctcaagtatgctaatgaggtgaattcagacgctggagctttcaagaacagcctgaaggatctacctgatgtgcaggagctaattacccaagtaaggtccgagaagtgttctctccaggcagccgctatccttgacgctaatgacgcccatcagacagagacttcctcgagtcaggtcaaggataacaaaccgctggtggaacgcttcgaaactttctgcctagacccctctctggtgaccaaacaggctaatctcgtccatttccctccaggctttcagccaatcccatgtaagcctctcttcttcgacctggctcttaaccatgtggcttttccacccctggaggataaactggagcagaagacgaagtcaggactgacggggtacataaaaggcatttttggctttcgctcttag

SEQ ID NO: 134359 - DNA, 2016 bp, Artificial Sequence
  Description of Artificial Sequence: Synthetic coding sequence
atggccagcggaggctctggcggcgtgagcgttccagcattgtggagcgaggttaatagatacggccaaaacggtgatttcacacgggcgctcaagaccgtgaacaagatcctacagatcaataaagacgatgtgacagccctgcattgcaaggttgtttgcctgatccagaacgggagcttcaaagaggccctgaatgtgatcaacacccacaccaaggtcctggctaataacagtttatcattcgagaaggcgtattgtgagtaccgactgaatagaattgagaacgcactgaaaactatcgagtccgccaaccagcagactgacaaacttaaagaactgtacggccaagtgctctacaggctggaacgatatgatgagtgtctggctgtataccgcgatctcgtgcgcaatagccaagacgattatgacgaagagaggaagacgaatttgtctgcggtggtcgcggctcagagcaattgggaaaaagtggtccctgaaaatctgggcttacaggagggtacccatgagttgtgctataacacggcatgtgccctgatagggcaagggcaacttaaccaggccatgaagatactccagaaggcagaagatctgtgtcgcaggtctctgagcgaggacacagacggaactgaggaggatccacaggcagaacttgccattattcacggccagatggcctacattctccagctgcaaggcaggacagaagaggcactgcagttatataatcagatcattaagctgaaacctaccgacgttggactgctcgccgttatcgctaataatataatcaccattaacaaggaccagaacgtgttcgatagcaagaagaaagtaaagcttaccaatgctgaaggggtggaattcaaactgtctaagaagcagttgcaggccatcgaattcaacaaggccttgctggcaatgtacaccaaccaggcagaacaatgcagaaagatttccgcatctctgcaatctcagagccctgagcacttgcttccagttttgatccaggccgcccagttatgccgggaaaaacagcatactaaggctatcgagctcctacaggaattttccgaccagcatcctgagaatgccgctgagataaaactgaccatggcccagctgaaaattagccaagggaatatctctaaagcgtgtctcatcctgaggtctatcgaggaactgaagcataagccagggatggttagcgctctggtcaccatgtatagtcacgaggaggatattgatagcgcaattgaggtattcacgcaggccatccagtggtaccagaaccatcagcctaagagtcctgcgcacctgagcctgattcgtgaagccgccaacttcaagcttaaatacggacgaaaaaaagaagctatatctgacctgcagcaactctggaaacagaatcctaaagacattcacactctcgcgcaactaatttccgcctattcattggtggatccggaaaaggccaaagctctgagcaaacacttgccctcatctgatagtatgtccctgaaagttgacgtagaggccctcgagaactctgctggcgctacctacatccgaaaaaagggcggtaaggttactggcgattctcagccaaaggaacagggacagggggacctaaagaagaaaaagaagaaaaagaaaggcaagctgcccaagaattacgaccccaaagtgacccccgatcccgaacgctggctgccaatgcgtgagaggtcttactacagagggagaaaaaaaggaaaaaagaaagaccagattggaaaaggaacgcagggcgctacagcgggcgcatcctccgaactggatgccagtaaaactgtgtcgagtccgcctacgtctcccagacctggtagcgcggcaaccgtgagcgccagtaccagtaacatcatcccaccacggcatcaaaagcccgcgggagcccccgccactaagaaaaaacagcagcagaaaaaaaagaagggcgggaaaggcggttggtag

SEQ ID NO: 134360 - DNA, 1878 bp, Artificial Sequence
  Description of Artificial Sequence: Synthetic coding sequence
cccctcgtcagcagcaagatggcctccggcgggtcaggcggcgtgtctgtcccagcactatggtccgaggtgaataggtacggacaaaacggcgacttcacccgggcacttaagacagtgaacaaaatcctgcagatcaacaaggacgacgtgaccgccctgcattgtaaggttgtgtgcctaattcagaatgggagctttaaggaggctctcaacgtaatcaacacccataccaaggtgctcgctaataacagtctttctttcgaaaaggcgtattgcgaatacagactgaacagaatcgagaatgcactaaaaacgatagagtccgcgaatcagcaaacggataagcttaaggaactgtacgggcaggtgctgtaccggctggaaagatacgatgaatgtctcgcagtgtacagagatttggtgcgcaacagtcaagacgactacgacgaggagcggaaaaccaaccttagcgccgtagtggcggctcagagcaactgggagaaggtggtgccagaaaacctgggcctgcaggaaggtacccatgagttgtgttacaatacagcctgtgcacttatcggccaggggcagctgaatcaagctatgaaaatcctgcagaaggctgaggacctgtgcagaagatcactgtcagaagataccgaccaaaatgttttcgattccaagaagaaggtgaagcttaccaatgccgaaggagtagaatttaaactgagtaagaaacaactccaagcaattgagtttaacaaagctctgctggcaatgtacactaatcaagcggagcaatgtcggaagataagcgcaagcctgcagtcccagtcccccgagcatctcttgccagtcctgatccaggcggctcagctctgcagggaaaaacaacacaccaaggcgatagaactgctgcaggaattctcggatcagcaccctgagaacgctgccgaaattaagttgaccatggcccagctgaaaatcagtcagggcaatatctccaaagcttgccttatcttacggtccattgaagaactgaagcataaacccggtatggtgagtgcccttgtaactatgtattcccacgaggaggacatagattccgctatcgaggtgttcactcaagctatccagtggtaccagaatcaccaacccaagtcgcccgctcatctgtccctaatcagagaagccgctaatttcaagctcaagtacggtagaaaaaaagaagccatctccgatctccagcaactgtggaagcagaatccaaaggacattcacacattggcgcagctgatatctgcttactcactggttgatcccgagaaagcaaaggctctgtctaaacacctcccctcctccgacagtatgtctctcaaagttgacgtggaggcgttggagaacagtgccggggcgacctacatacgcaaaaagggcgggaaggtaacgggtgacagtcagcctaaagagcagggccagggagacctcaagaaaaagaagaaaaagaagaaaggaaaactgccaaaaaactacgaccctaaagtgacgcctgatccagagagatggctgcctatgcgagagagatcctactatcgggggcggaagaaagggaaaaagaaggatcagataggaaagggcactcaaggggccacagctggtgcttcctctgagctagatgcctccaaaacagtaagtagcccacctacacaggatctagccgttcttcagcagtatttgcctctgcaagtgacctcctacccccaggacacgcgaaacttgcaggggctccaacagcagaagcggaactccaatcggaagcggcggaaagtcgaaaaggtggcaggcgacgagaatatattagtagctgggtgcttctag

SEQ ID NO: 134361 - DNA, 1833 bp, Artificial Sequence
  Description of Artificial Sequence: Synthetic coding sequence
atggccagcgggggttccggtggagtgtctgtgccggctctatggagcgaggtgaatcggtacggccagaacggggatttcactagagccttaaaaaccgttaataaaatcctgcagataaacaaggacgacgtgacagcactccattgtaaggtggtttgtctgattcagaatggatcttttaaggaagccctgaacgtgataaacacacatacgaaggtccttgctaataacagccttagctttgagaaggcttactgcgagtataggctgaacaggatcgaaaatgctctgaagaccattgaatcagcaaaccagcagactgacaagctgaaggaattgtatggtcaggttttgtatcgcctcgagcggtatgacgaatgtttagccgtgtaccgggaccttgtgcggaactcccaagatgactacgacgaagaacgcaaaaccaacctctctgcagtggttgccgcacaatccaactgggaaaaagtggtccctgaaaacctcggccttcaggagggtacgcacgagctgtgttacaacacagcttgcgctctcatcggtcaggggcagttaaatcaggcgatgaaaatcctccagaaggccgaggacttatgtcgccgctcgctctccgaagatacagaccagaacgtgtttgattccaaaaaaaaagtgaagttaactaatgcagaaggcgtcgagttcaagctcagcaagaagcagctgcaggctatcgagtttaacaaggctctactcgctatgtatacaaatcaggccgaacagtgtcgtaagatttcagcttcgttacaatcccagtcgcctgagcatctgttgcccgtcctgattcaggccgcgcagctttgtagggagaagcagcatacgaaggcaattgagcttctccaagaattctctgaccagcaccctgaaaacgccgcggagataaagctgactatggcacagctcaagattagtcagggtaatatcagtaaagcatgtctaatattacggtctatcgaggaactcaagcacaaaccaggaatggtttcagccctggttaccatgtacagtcatgaggaagacattgacagcgctatcgaagtgtttacccaagctattcagtggtaccagaaccatcagcctaaaagcccagctcatctctccctgattcgtgaggctgctaactttaagttaaaatacggccgcaagaaagaggcgattagcgatctgcagcagctgtggaagcagaaccctaaggacattcataccttggctcaacttatatctgcttactccctggtggatcctgaaaaggctaaagcactcagcaaacacctgccttcaagtgactcaatgtccttgaaagtcgatgtggaagccttggaaaattccgcaggtgcgacatacatacgaaaaaaaggaggcaaggtcaccggggactctcagcccaaagagcaggggcagggagatcttaaaaagaaaaaaaagaagaagaaaggaaagctgccaaaaaactacgatcctaaggtcacacctgatcccgaacggtggctgcctatgagggaaagaagttattaccgagggagaaagaaggggaagaagaaggaccagataggaaaggggacccagggagctaccgccggcgcatcttctgaattggacgcatcaaaaaccgtgtcctcccctccaacgtccccaagaccaggttcagctgccacagtgagcgctagcactagcaatataataccccctcgtcatcagaaaccagcaggtgcgcctgccacaaagaaaaaacagcaacaaaagaagaagaaagggggtaaaggcgggtggtag

SEQ ID NO: 134362 - DNA, 1917 bp, Artificial Sequence
  Description of Artificial Sequence: Synthetic coding sequence
atgctcgacttttttaccatcttcagcaaaggcggcctcgttctgtggtgcttccaaggcgtgtcagactcctgcaccggtcctgtcaacgccctaatccggtctgtgctgttgcaggagcggggcggcaacaacagctttactcatgaggccttaaccctcaagtataagctcgacaatcagtttgaactcgtgttcgtggtgggcttccagaagattctgacacttacttacgtcgacaaactgatcgacgacgtgcaccggctttttcgggacaagtaccgtaccgaaatccagcaacaatccgcactaagtctgcttaacggcaccttcgactttcagaacgacttcctcagactcttacgagaagctgaggagtcgagcaagatccgcgcccctaccaccatgaagaaattcgaggacagcgagaaggcaaaaaagccagtccggtcaatgatcgaaacccgaggagaaaagcccaaggagaaagcaaagaatagtaagaagaagggagccaagaaagaagggtcagacggaccgttggcaacttccaagcccgtgcccgccgaaaaaagcggcttgccagtggggcctgaaaatggggtcgagctgagtaaagaggagctgatccggcgaaagagagaggagttcattcagaaacatggtcggggaatggaaaaatccaataaatccactaagtctgacgccccaaaggaaaagggcaagaaagcaccacgtgtgtgggaattgggtggatgcgctaacaaggaggtgctggattactctacgccaaccactaatggcacacctgaagcagctctgagcgaggatattaatctgatacgcggtactgggtctggaggtcagctacaggatctggattgctctagtagcgatgatgaaggtgctgctcagaactcaacaaagccctccgcaactaaagggaccttaggcggtatgtttggcatgcttaagggcctggtggggtcgaagagcctctcccgggaggacatggagtcagtcctggacaagatgagggatcacttaatcgcaaaaaatgtcgccgccgatatcgctgtgcaactgtgtgagtccgtggctaataagctagaaggaaaagtcatgggaaccttctctaccgtgacaagcacagtgaaacaggctttgcaggagtcactcgtccaaattctgcagcctcagcgtcgggtagacatgttacgggacatcatggacgctcagcgacgccaaagaccatatgtagtaacattttgcggtgtcaatggagttggcaagtcaacaaacctagctaagatcagtttttggctgctggaaaacgggttcagtgtgctgatcgcagcttgcgataccttcagagccggtgccgtcgagcagctgaggacccacactcgtcggctcagtgctttgcacccgccagagaagcacggagggcgcacgatggtgcagctctttgagaaaggatatgggaaggatgcggccggtattgccatggaagccattgcctttgcccgcaatcaaggattcgacgtagtgttagtggatacagccggtaggatgcaggataatgccccactgatgacagcactcgctaagttgattaccgtgaacactccggacctggtattgtttgttggcgaggccctcgtgggcaacgaagccgtcgatcaattggttaaatttaaccgggccttggcagaccacagcatggcccaaacgccacggctgatcgacggtatagttcttactaaattcgacaccattgacgacaaggtgggcgcagctattagtatgacctacatcacctcaaaacccattgtcttcgtaggcaccggtcagacttattgcgacctgcggagccttaatgcgaaggcagtcgtggccgctctaatgaaggcctag

SEQ ID NO: 134363 - DNA, 552 bp, Artificial Sequence
  Description of Artificial Sequence: Synthetic coding sequence
atgagactactgagcttcgttgtacttgctctattcgcagtgacacaggccgaggagggggcacggttgctggcctctaaaagcctcctgaatagatatgccgtggagggaagagatctgaccctgcaatataatatttacaacgtgggatcctccgcggccctggacgtggaactgtcggacgatagctttcctcccgaggatttcggcattgttagcggcatgctgaacgtcaaatgggataggatcgcgccagcttccaatgtttcccacaccgttgtgctcagacccctgaaggctggctattttaacttcacaagcgccactatcacatatttggcccaagaggacgggcctgtggtaatcgggagtacctccgctcccggtcaaggaggcattctggcacaaagggagttcgataggaggttttctcctcacttcctcgactgggctgcgtttggcgtgatgacactgcctagtatagggatccctctcctcctttggtattcaagcaaacgaaagtacgacacaccaaaaaccaagaaaaattag

SEQ ID NO: 134364 - DNA, 552 bp, Artificial Sequence
  Description of Artificial Sequence: Synthetic coding sequence
atgcgactgttgtcttttgtggtccttgcactgtttgcagttactcaggctgaagaaggcgcaagactcctggcctccaaatcgctgctcaacagatacgccgtggagggccgcgacctgacccttcagtataacatttacaacgtggggtcatcagccgcactcgatgtagaactgagcgatgactcttttcctcccgaagacttcggaatcgttagtggaatgctcaacgtaaagtgggatcgaatagccccagctagtaatgtgtcacatactgtcgtacttcggccactgaaagccggatacttcaatttcacctctgccacaattacctacttggcccaagaggacgggcccgtggttataggttccacatctgctccaggccaaggaggcattctcgcacagagggagttcgatcgcagattttcaccacatttcctcgattgggctgcgttcggtgtgatgaccctaccaagtatcggaattccgctactgttgtggtatagttcaaaacggaagtacgatacccccaaaacaaagaagaactag

SEQ ID NO: 134365 - DNA, 258 bp, Artificial Sequence
  Description of Artificial Sequence: Synthetic coding sequence
atgcgcctattatcattcgttgttctcgcactgtttgcagtcactcaggccgaggagggagctcggctccttgccagcaagtcacttctgaatcgatacgctgtagagggacgcgaccttacattacagtataacatctacaatgtaggctctagtgctgctcttgacgtcgagctttccgatgattcattcccccccgaggacttcggaattgtcagcggcatgctgaatgttaagtgggacagaatcgccccctag

SEQ ID NO: 134366 - DNA, 444 bp, Artificial Sequence
  Description of Artificial Sequence: Synthetic coding sequence
atgcgattgttgtcttttgtagttctggcactgttcgccgtgacacaagctgaggagggagctcgactcttggcaagtaaatctctgctcaaccgatatgccgttgaagggagagacctgacgctgcaatataatatttacaatgtggggtcaagtgcagctctggatgtggaattaagcgatgattcattcccaccggaggatttcggcattgtgtctggcatgttaaatgtgaagtgggataggatcgcgcctgcaagtaacgtgtcccatacggtggttttacgcccattaaaagcaggttatttcaacttcaccagtgccaccatcacgtaccttgctcaggaagacggcccggtcgtcatcgggtctacatctgcgccgggtcagggtggcattctcgcccagagagaatttgatcgtagattttcaccccatttttag

SEQ ID NO: 134367 - DNA, 522 bp, Artificial Sequence
  Description of Artificial Sequence: Synthetic coding sequence
atggcggcaatggccagtcttggggctctggctttgctgctcctcagcagcctgagtcgctgctccgccgaggcctgcttggagccccagatcaccccgtcctattatactacctccgacgctgttatttctacagagactgtgttcatcgtcgaaatcagtctgacttgtaagaatcgggtgcagaatatggcgctctacgcagacgtggggggcaaacagttcccagtcacgagaggccaagatgtgggaaggtaccaggtctcctggtcactggatcataaatccgcacatgccggaacatacgaggtgcgatttttcgacgaggagagctattctctgctccgaaaggctcagcgaaacaatgaagatataagtatcattcccccactgtttacagtcagcgtggaccaccgggggacctggaatggcccctgggtgtctacagaggttctggccgctgcgatcggactggtgatatattatctagccttctccgcgaaatctcatattcaggcctag

SEQ ID NO: 134368 - DNA, 447 bp, Artificial Sequence
  Description of Artificial Sequence: Synthetic coding sequence
atggcagcaatggcctcactgggggccctggccctcttgctactaagttcattatcccggtgtagtgctgaggcatgcctggaaccacagataacgccatcgtactatactacctctgacgctgttattagcaccgagaccgtttttatcgtagagatttctctgacctgtaagaaccgcgttcaagtatcctggagcctggaccacaagagcgctcacgccggtacatacgaagtaaggttctttgatgaggaatcttatagcctgttaaggaaagctcagcggaacaatgaggatatttctataatcccacccctgtttaccgtgtccgttgatcaccggggcacttggaacggcccttgggtttctaccgaagtgcttgccgccgcaatagggcttgtcatatactacctagctttcagtgccaagtctcatatccaagcctag

SEQ ID NO: 134369 - DNA, 522 bp, Artificial Sequence
  Description of Artificial Sequence: Synthetic coding sequence
atggccgcaatggccagcctcggggctctcgctctactattactcagcagcctcagccgctgcagcgctgaggcctgcttagaaccgcagatcactcctagttactatactactagcgacgccgtgattagcaccgagaccgtgttcatagtcgaaatctccttaacctgcaagaatagagttcagaacatggcactttacgccgatgtcggcggcaaacagttcccagtgactcggggacaagatgtcggtcggtatcaggtgtcatggagcctggatcacaagagcgctcacgccggaacttatgaggtgaggttttttgacgaagagagctactcccttctgcgtaaggcccaacgcaataacgaagacatttctatcattcccccattgttcactgtgtcagtcgaccacagagggacctggaacggaccttgggtgtccactgaagtgctggccgccgccatcgggctcgttatttactatctggcgtttagcgcaaagtcccacattcaggcttag

SEQ ID NO: 134370 - DNA, 522 bp, Artificial Sequence
  Description of Artificial Sequence: Synthetic coding sequence
atggcggccatggcatctctgggtgccctcgccctgctgctgctctctagcctatccaggtgttcggccgaagcctgtctggaaccccagataactccatcctattacaccacttcagacgccgttattagcacagagacagtttttattgtggagattagtcttacatgcaagaaccgagttcaaaacatggctctgtacgcggatgtgggtggcaaacagttcccagttacgcggggacaggacgtcggcaggtaccaggtttcctggagcctggatcataaaagcgcccatgctggcacctacgaagtcaggtttttcgacgaggaatcctacagccttctgagaaaggcacagaggaacaacgaagacatcagcatcattccaccactgtttacagtttctgttgaccacagaggtacctggaacggcccatgggtgagcactgaggtgttggccgccgcaatcggactcgtgatctactacctcgcatttagcgctaagtctcacatccaggcctag

SEQ ID NO: 134371 - DNA, 363 bp, Artificial Sequence
  Description of Artificial Sequence: Synthetic coding sequence
taggtggggtctgggtgccgtagcgcagcagtcagcgcactggtcgtgagggtggcaccaccatgccccctctgtccccactccgcccagcatcccacacaggtcagctggtctctggatcacaaaagtgctcatgcgggtacgtacgaggtccggttttttgacgaagaatcatacagtctcttgaggaaggcccagcgcaacaatgaggacatctcaattattccccccctctttactgtctccgtggatcatcgcggcacttggaatggaccgtgggtatcgacagaggtgctcgctgcggctattggtctggtgatttactacctcgccttctcagcaaagtctcacattcaggcatag

SEQ ID NO: 134372 - DNA, 2544 bp, Artificial Sequence
  Description of Artificial Sequence: Synthetic coding sequence
atgagcctgtgggggttagtttccaaaatgccccccgagaaagtacagagactgtacgtggatttccctcagcatctgagacaccttctaggcgactggcttgagagccagccgtgggaattcctagtgggcagtgatgccttttgttgcaatctcgccagcgccctgctcagcgacacggtccagcacttacaagccagtgttggcgagcagggagagggctctaccatcttacaacacatctccacactggagagtatataccagcgcgatcctctgaagctcgtggctacattcagacagatactacaaggagaaaaaaaggccgttatggagcagtttagacatttacctatgcccttccactggaagcaagaagagcttaagttcaagaccgggctgagaagattgcagcaccgcgtgggggagattcacctcctgagagaggcactccaaaaaggagccgaggctggccaggtcagcctgcacagcctgatagaaacacctgccaacggcaccggcccaagcgaggcgctggctatgcttttacaagaaaccactggcgaactggaagccgccaaggcactggtactgaagaggatacagatttggaaaaggcagcagcagctggctggtaatggagcccctttcgaggagagcctggcccccctgcaggagaggtgtgagagtctggtggatatctactcgcaacttcaacaggaggtgggcgctgccggtggcgaactggaacctaagacaagggctagcttaacagggcgactggatgaagtactgagaaccctggtgacttcatgttttctggtggaaaagcagccccctcaagtcctgaagacacagaccaaattccaggccggagtaaggtttcttctggggctccgttttctcggcgccccagccaaaccccccttggtgcgggctgatatggtaaccgagaagcaagcccgcgaactttccgtaccacaggggccaggagccggtgcagagtccacaggcgaaatcatcaataatacagtgcccctggagaacagtatccctgggaactgttgttccgccctctttaagaacttactgctcaaaaagatcaaaagatgcgaacggaaaggcaccgaatctgtgaccgaagagaagtgtgcagtcctgttcagcgcgtcattcacgttgggacctgggaagctgccaattcaactccaggccctgtctctcccactggtagtgattgtgcacggtaaccaggacaataatgcaaaggcgacaatactgtgggataatgccttttccgagatggaccgtgttccctttgtggtggcagagcgcgtcccgtgggagaagatgtgcgagaccctgaatctgaagtttatggccgaggttggaacaaacagaggcctgctgcccgagcatttcctgttcttggcccagaagatctttaatgacaactctttgtccatggaggcttttcagcaccgcagtgtctcgtggtcacaattcaataaagagattctgctgggtaggggattcacattctggcaatggtttgatggtgttctggatctcaccaaacgctgtctaaggtcttactggtctgaccgcctgattatcggattcatttctaagcaatatgtgacctctcttttactcaatgaaccagatggaactttcctgttgcgcttctctgacagcgagatcgggggtatcacaattgctcacgtgatcagggggcaagatggctcccctcagatcgaaaacattcagccattttccgctaaagatctgtcaataagatcgttgggcgaccgcataagagacctggctcagctgaagaacctgtaccccaaaaaacctaaagacgaggcctttaggtcacattataaacccgagcagatgggaaaagacggtcgcggctacgtgccggccacgatcaagatgacagtggagagggaccaaccgctaccaaccccggaactacagatgcccacaatggtccctagttacgacctgggaatggctccagacagctccatgtcaatgcaactgggacccgatatggtcccacaggtgtatcccccccactcgcattcgattccaccttatcagggactcagtcctgaagagagcgttaatgtgctctccgcctttcaggagccccaccttcaaatgcctccgtcacttgggcagatgtcacttcctttcgatcaaccccatccacaggggctgctgccttgccaaccccaagagcatgcagtttcatcccctgaccccttgctatgcagtgatgtcacgatggtagaagattcatgtcttagtcagcctgtcaccgcctttccccagggtacgtggatcggagaggatattttccctccgctgctgcccccaaccgaacaggacctcacgaaattgctactggaaggccagggagagagcggtggcggctccctgggcgctcaaccgctgctgcagcctagccattacgggcagtctgggatcagtatgtcccacatggacctcagagccaacccatcatggtag

SEQ ID NO: 134373 - DNA, 2544 bp, Artificial Sequence
  Description of Artificial Sequence: Synthetic coding sequence
atgagcctgtggggactggtgtcgaaaatgccacctgaaaaggttcagcggctatatgttgactttccacagcaccttagacatttattgggcgattggctggagtcccagccgtgggagttcctcgtcggaagcgacgccttttgttgtaacctggcttccgcgctcctgagcgacaccgtgcagcacctgcaggcaagcgtaggagagcagggggagggtagtactatactgcagcatataagcaccttggaaagtatctaccagcgcgaccccttgaagctggtggcgacattccggcagattctgcaaggagagaagaaggcagttatggagcagttccgccatctgccgatgccatttcactggaagcaagaggagctgaagttcaagacaggtctccgccggctgcagcatagagtgggggagatacacctcctccgagaggcgttacaaaaaggcgccgaggcaggtcaggtctccttacacagtctgatcgagaccccggccaacggcaccggaccttcggaggccctggccatgctgttacaggaaaccacaggggagctagaagcagccaaagcactagtccttaaacgcatccagatctggaaacgacagcagcaattggcgggtaacggagctcctttcgaggaaagtctggcccccctgcaggagcgttgtgagtccctggtcgacatatacagccaactccagcaagaggttggagcggcagggggcgagcttgagcccaagacccgggcctccttaaccggccgcctggatgaagtcctgaggactctggtgacctcttgtttcctggtggagaagcagcccccgcaggtgctcaagacgcaaaccaaatttcaggccggtgtgcgatttctgctgggacttaggttcttaggggcacctgcaaagccccccttagtgagagccgacatggtaactgaaaaacaagcacgggaactctcagtgccccaaggccccggcgccggcgcagagtctactggggagataataaacaacactgtgcccctggaaaattccatccctggcaattgttgttctgccttatttaagaacttgctgctaaaaaagatcaaacgctgtgagagaaaaggaacggagtccgtgactgaggaaaaatgtgctgtacttttttctgcatcattcaccctgggccccggcaaactgccgatccagttgcaggccctgagtctgcccctggttgttattgtgcatggcaaccaggacaataatgccaaggcaactatactctgggataatgccttttccgaaatggatcgagtcccttttgtagttgctgaacgggtcccatgggaaaagatgtgtgagactctgaacctcaagtttatggccgaagtcggtacaaacagaggactgttgcccgagcactttttatttctggcgcagaaaatctttaatgacaatagcctgtctatggaggctttccagcacaggagcgtaagttggagccaatttaacaaggaaatcctcctcggtaggggattcacgttttggcagtggttcgacggcgttctcgatctgacaaagcgctgtctgcgctcctactggagcgatagactgattatcggcttcatttctaaacaatacgtgacatcattactgctaaacgagcccgatggtacattcctgcttcggtttagtgattcagagattggcggtataaccattgcccatgtaatcagggggcaggacggcagcccgcagattgaaaacattcagccatttagcgcaaaggacctgagcatacgaagcctgggtgacaggattcgcgacctcgcccagctcaagaatttataccctaaaaagccaaaagacgaggctttccgctcgcattacaaacctgaacaaatgggcaaagatggtaggggatacgtaccggccacaattaaaatgactgtggagcgggatcagcctctgccaaccccggaactgcagatgcctaccatggttcccagttacgaccttggcatggctcccgattcatctatgagtatgcagttggggcccgatatggtgccacaggtttatccgcctcactcacacagcatccccccttatcagggtctgtctccagaagagtctgtgaacgtgctgagtgcttttcaagagcctcatcttcagatgcccccgtctctgggtcaaatgagcctacccttcgaccagccacacccgcaagggctgttgccttgtcagcctcaagaacatgcggtcagtagccctgaccctcttctgtgcagtgatgtgacaatggtggaagactcatgcttatcacagcctgtgacagcatttccgcaagggacttggatcggagaagacatcttcccccctcttctcccccctactgagcaagatcttactaaattactgctcgagggacagggcgaatccggtggagggtcattgggtgcccagcctttgttgcagccctcacattacggacagtccgggatcagcatgtcacatatggatcttcgggcaaacccttcttggtag

SEQ ID NO: 134374 - DNA, 2214 bp, Artificial Sequence
  Description of Artificial Sequence: Synthetic coding sequence
atggagcagttcaggcatctccctatgccctttcactggaagcaggaagagcttaagtttaaaacaggattaaggcgtctccagcatagggtaggcgaaattcatctcctccgggaggctttacagaagggagcggaggccggtcaggtgtcactccattccctgattgagactcctgccaatggaacaggccccagcgaggcattggcgatgttactacaggaaacaacaggcgaactcgaggccgcgaaagcattggtgctgaagcgcatccagatctggaaacgacaacagcagctcgctggcaatggcgctcccttcgaggagagcttggcccctctccaggagaggtgcgagagcctggtcgacatttatagccagttgcagcaggaggtgggagcagctggcggggagctggaaccaaaaacacgagccagtctgacaggaagactcgatgaagttcttagaactctcgtgacttcctgttttcttgttgagaagcagccaccacaggtacttaaaacccagacgaaattccaggcaggtgttagattcctcctaggcctcaggtttctcggggccccagccaagccacctctggtgcgtgctgatatggtgacagaaaaacaagccagagagctgagtgttccacagggaccaggcgctggcgcggaatcgacaggagagattatcaacaacaccgtacctcttgagaacagcatcccagggaactgctgctccgctttattcaagaatctgctgttaaagaaaatcaaacggtgtgaacggaaaggtacagagagcgtgaccgaggagaaatgtgcagttctgttttcggcaagctttacacttggtccaggaaagctgccaatccaactgcaagccctcagtcttcccctcgtcgtgattgtgcacgggaatcaggataacaatgctaaggccacaatactgtgggataacgctttcagtgagatggaccgggttccatttgtcgtggctgagagagtcccttgggaaaagatgtgtgagactcttaacctgaaatttatggccgaggtcggaacgaataggggcctcctgcctgaacatttcctcttcctggcccagaagatcttcaatgacaactccttgtccatggaggcctttcagcatcggagcgtctcatggtctcaatttaacaaggagatcctgcttggtcgcggattcacattctggcagtggtttgatggtgtacttgacctgacgaaaaggtgtctccgaagttattggtctgacaggctgattatcggttttatctcaaaacaatacgttacatcattattacttaacgagcctgacggtactttccttctacgcttcagtgactccgaaatcggggggataaccatcgcccacgtgatccgaggccaggacggtagcccccaaatcgagaatatccagcccttctctgcaaaggacctgtctatccggtcactaggcgataggatacgcgacttagctcagctgaaaaacctatatcctaaaaagcctaaggatgaggccttcagatctcactacaaaccagaacagatgggaaaggatggccgggggtacgtcccagccaccatcaagatgacagtggaacgggaccagcccctgcctaccccggagctacagatgccaaccatggtgccctcttatgacttgggtatggcccccgatagctccatgagcatgcagctgggcccagatatggtgccccaggtgtacccgccccattctcactcaatccccccgtaccagggactgtctcccgaagagtccgtgaatgtgttaagtgctttccaagaaccacatctgcagatgcctccaagtcttggacagatgtctctgcccttcgaccagccacaccctcaaggcctgcttccttgtcaacctcaggagcatgccgtgagcagccctgaccccctcctgtgttctgatgtgactatggtcgaggactcttgtcttagtcagccagtgacggccttcccccagggcacctggataggcgaagacatattcccccccctgctacccccgacggagcaggacttaaccaaattgctcttggaaggacagggcgaatcgggtgggggatctctgggagcacagccactgctacaaccttcacactatggacagtccggcatctcgatgagtcacatggacctacgggccaatcctagttggtag

SEQ ID NO: 134375 - DNA, 2214 bp, Artificial Sequence
  Description of Artificial Sequence: Synthetic coding sequence
atggaacagtttaggcacctccctatgcctttccattggaagcaggaagagcttaaattcaagacagggcttcggcggctgcaacatcgagtaggagagatccacctgttgcgtgaagcacttcagaagggagcggaggccggccaggtgagcctgcacagtctgattgagacccctgcgaacggtacgggaccgagtgaagctctggcaatgctattgcaagaaacaacaggggagctggaggcagccaaagccttggtcctgaaaagaatccagatctggaagcggcaacagcagctggctggtaatggagccccatttgaggagagccttgcgccgctacaggaacggtgtgaatcgctggttgatatctattcccagctgcaacaggaagtcggggctgcaggaggagagctggaaccaaagaccagggcctcactcaccggccgcttggacgaagtgctgcggaccctggttacatcttgcttcctggtcgagaagcagccaccgcaagtgttaaaaacacaaaccaaattccaagccggcgtgagatttttgctgggattaagattcctgggagcccctgccaaaccccccctcgtgcgtgctgacatggtcacggaaaaacaggctcgggaactgtctgtaccccagggaccaggcgcgggagctgaaagcaccggcgagattatcaacaacacggtgcctctggaaaactctattccgggtaattgttgctcagccctttttaagaacctcctgctgaagaaaattaagcggtgcgagagaaaggggacagaaagtgtgacagaagagaagtgcgctgtgctgttctccgcttcttttaccttggggccgggcaaactgccaatacaattacaggcattaagcttaccactggtcgttattgtgcacggcaaccaggataacaatgctaaggccaccatcttgtgggacaacgcgttcagtgaaatggatagagtacccttcgtggtggcagagcgggtcccatgggagaagatgtgtgaaacactgaacctgaagtttatggcagaggtgggaaccaatagaggtcttcttcccgagcacttcctgtttctggcacagaaaatcttcaacgacaattcgctgagcatggaggcttttcagcatcggtccgtcagctggtcccagttcaacaaagagatcttattgggaagaggcttcaccttctggcagtggttcgatggagttctggatcttaccaagcgatgtttgcgaagttattggagcgacaggctgatcatcgggtttattagcaaacagtatgtgacttccctgctgctgaacgaacccgatggtacgttcttactaagattttccgactctgagattggcggtatcactatcgcccacgtcattcgggggcaggacgggagtcctcagatagagaatatacaaccgttttccgctaaagacctgagcattaggagtcttggtgatcgcataagagatctcgcacagctgaagaacctctatcccaaaaagcccaaggatgaagcctttagaagccactataagcccgaacagatgggtaaggacggccgggggtacgtccctgctactataaagatgacggttgagagggatcagcctctgccaactcctgaactccagatgccaactatggtccccagttacgacctcggaatggcccccgatagttccatgagcatgcagcttggcccagacatggtaccgcaggtataccccccccattcacacagcatccccccctaccagggcttgtctcctgaggaaagtgtgaatgtcctgtcagcttttcaggagccccatctccaaatgccccctagtttagggcagatgagtctgcccttcgatcagcctcaccctcagggcctcttaccatgtcagcctcaagagcatgccgtgagcagcccagatccactcctttgctccgacgtcaccatggttgaggactcatgcctgtctcagccagtgaccgcctttccccagggtacttggattggcgaagatatcttccccccgcttcttccacctacggaacaggatcttaccaaacttctgttagagggccagggagaatcaggagggggatccctgggagctcagccgctcctgcaaccttcacattacggccagagtggcatatccatgtcccacatggaccttagggccaatccaagctggtag

SEQ ID NO: 134376 - DNA, 2214 bp, Artificial Sequence
  Description of Artificial Sequence: Synthetic coding sequence
atggagcagtttcgccacctcccaatgccctttcattggaagcaagaagagctgaagtttaagaccggtttaagaaggctacaacaccgtgtgggcgagatacacctccttcgagaagccttgcagaagggagccgaagcaggccaggtaagcctccactctctgatcgaaacccctgcaaacgggactggtccttcagaagccttggcaatgcttctgcaggaaaccacaggagaactggaagcagctaaggccttagtgctgaagcggattcaaatttggaagcgacagcagcagcttgccggtaatggtgccccgttcgaagaaagcctggcccccctccaagagcgctgtgaaagcttggtggacatttattcccaactacagcaggaagtcggggccgcaggaggcgagctcgagcctaagacgcgggcctctctcactggcaggttggatgaagtgctgaggaccctggtgacatcctgtttcttggtggagaagcagccccctcaggttttgaagactcagacaaagtttcaggccggtgtgcggtttttgctgggcctgaggttcctcggcgctccagctaaacctcctctcgtgcgggctgacatggttacagaaaagcaggctagggagttatccgtgccacaggggccaggcgccggtgctgagtctaccggggagatcatcaacaacaccgtgccactggaaaattcaatcccgggaaattgctgctcagccctgtttaagaatctgctacttaaaaagataaaacgctgtgaacggaaaggaacagagtccgtgacagaggagaagtgcgctgttctatttagtgcatctttcacactgggacctggcaagttgccgattcagctgcaagctttgagccttcccctggtggtcatcgtgcacggcaatcaggacaacaatgctaaggctactatactttgggataatgcattcagcgagatggaccgagtgcccttcgttgtggccgagcgagtgccttgggaaaagatgtgcgagacactgaacctcaaatttatggccgaggtcggtaccaacagagggttactacctgagcattttctcttcctggcccaaaagatctttaatgataattccttatccatggaggcctttcagcaccgatccgtgagctggtctcagttcaacaaagaaatcctcttagggagggggttcactttctggcagtggttcgacggcgtgttagatctgactaaacgctgcttgcgatcctattggtcagaccgcctcatcatcggatttatcagtaagcagtacgttaccagcttactcctgaatgagccagatggaacttttttattacgtttctccgattccgagatcggtgggattacaattgcccacgtcatacggggtcaagatggatcaccccagatagaaaatatacaacccttctctgccaaagacctgtccataaggtccctgggcgaccgaatccgcgatttggcccagttgaaaaatttatatccaaagaagccgaaggatgaggccttccggtctcactataagcctgagcagatgggtaaagacggtcgtggttatgtcccagctactatcaaaatgacagtggaacgcgatcagcctttaccgacccctgagctccaaatgccaacgatggtgccgagctacgacctggggatggcccccgatagttcgatgtccatgcagcttggcccagatatggtaccacaggtgtaccccccgcatagccactcgattcctccttaccagggcctgagtcccgaagagagcgtcaatgtgctgagcgctttccaggaacctcacctccagatgcccccaagtctaggacagatgtcattaccctttgaccagcctcacccacaggggctgctgccctgccagccacaggagcacgccgtcagctctcccgatcccctgctctgctccgacgtcacgatggttgaggattcctgtttgagtcagccagtgactgccttcccacagggcacctggataggcgaggacatcttcccaccactcctgccccctacagaacaggatcttactaagctactcttagaaggacaaggagagagcggcggaggttctttgggcgctcagcctttactccagcccagccattacggtcagagcggaatctcaatgtcccatatggatctccgggcaaacccgagctggtag

SEQ ID NO: 134377 - DNA, 2040 bp, Artificial Sequence
  Description of Artificial Sequence: Synthetic coding sequence
atgagtctttggggcctggtctccaagatgcctcctgagaaagtacagaggctctacgtggatttccctcagcatctgagacacctcttgggcgattggctcgaatcccagccatgggagttccttgtggggtccgacgctttctgttgcaaccttgctagtgccctgctgtctgatacagtgcaacacctgcaagctagcgtgggggagcaaggcgaaggcagtactatcctgcagcatatctccacactggaatcaatctatcagagggaccccctgaaattggtggcaacgttcaggcaaatactgcaaggagaaaagaaggccgtcatggagcagtttaggcatctgcctatgcccttccattggaagcaggaggagctgaagttcaagaccggactacggaggcttcaacaccgtgttggcgagatacatttgcttcgcgaggctttgcagaaaggagccgaggcaggccaggtaagtcttcatagcctcattgagaccccagccaatggaacgggaccctctgaggcactggcaatgctgctgcaggaaacgacgggcgaactggaggcagccaaagcgctagttttaaagcgcatccagatttggaagcgccagcagcagctggctggaaacggcgcaccattcgaagagtctttagctcccctgcaggagcgatgcgaaagtttggtcgacatctacagtcagttacaacaggaggtaggggcagccgggggagagttggaacctaagacgagagcctctttgacaggtagactcgacgaagtactgcgcactttagtgacatcctgcttcttggtagagaagcagcccccgcaggtgctcaagacacaaacaaagttccaggctggggtaaggttcctcttggggctaaggtttctcggcgctcctgccaaaccacccctggtgcgagctgacatggtgacagagaaacaagcccgcgaactctctgtgccccagggtccaggtgcaggtgccgagagtacgggggaaattatcaacaacacagtgccacttgagaattccattccaggtaattgttgttccgcgcttttcaagaatctgctgctcaaaaagataaagcggtgcgaacggaaaggcaccgaatcagtgacagaagagaagtgcgccgttctgttctccgcgtccttcacactcgggcctggcaaactgcctattcagctccaggctctcagcctgccactcgtggtcatagtccatggcaaccaggataacaatgcaaaagccacaatactctgggataacgcttttagcgagatggaccgcgtcccatttgtggtcgctgaaagagtaccatgggagaagatgtgtgagactctgaatctgaagtttatggctgaagtgggtacaaaccgggggctgttgcctgaacacttcctcttcctggcccagaagatttttaatgacaactccctgagcatggaagctttccagcatcggagtgtctcctggagccagttcaacaaagagatcttgctaggccgcgggtttacattttggcaatggtttgacggtgtcctggatctaaccaaacgatgcctcagatcctattggtccgataggcttatcataggtttcatatctaagcagtatgtaactagtctgctcctcaacgaaccagacgggaccttcctgctgcggttctccgactccgagatcggaggcattaccattgcccatgtcattaggggccaggatggtagccctcagatagagaatatccagcccttttccgccaaggacttatctataagaagcttaggcgatcgtatacgggatctcgcccagctgaagaacctgtaccccaagaaacctaaagatgaagcttttcgctcccattataagcccgaacagatggggaaagatggtcgaggatatgtgcctgcgactattaaaatgaccgtggagagggatcaacctcttcccacgcccgaattgcaaatgcctaccatggtcccatcctatgacctgggtatggctctgatccccccttag

SEQ ID NO: 134378 - DNA, 2193 bp, Artificial Sequence
  Description of Artificial Sequence: Synthetic coding sequence
atggagcagttccgacatctgccaatgcctttccattggaaacaggaagagttgaagttcaaaaccggactcaggaggctacagcacagagtgggagaaattcaccttcttcgagaggctcttcagaagggcgccgaggctggccaggtctctctccacagtctaatcgagactcctgccaatgggacggggccttccgaagctctggccatgctgctgcaagaaaccacgggagagctggaagctgcaaaggctctggtgttaaagaggattcagatatggaaaagacagcagcaactggccggcaatggcgcaccattcgaagagtcattggccccattgcaagagcgctgcgaatccctagtggacatctactcacagttgcagcaggaggtgggggcagccggcggagaactggagccaaagacgagagcgtctttaaccgggaggcttgacgaggtactccggacactcgtgacaagctgtttcttggtggaaaagcagcctccacaggtgttgaagactcaaactaaattccaggctggtgtgcggttccttctcggcttgcgtttcctgggggcacctgcgaagccaccactggtgagggccgatatggtgacagaaaagcaggctagggagctaagcgtcccgcagggacctggggccggggcggaaagtacaggggagataattaacaacacggtccctttggagaactctatacctggcaactgctgctcagccctgttcaaaaatttgctgctaaagaagatcaaacggtgcgagcgcaaaggcactgagagcgttactgaggagaaatgcgctgttctcttctccgcttctttcactctcgggcccggaaagcttccgatccagctgcaggccttgagtctacctctcgtggtcatagtacacggtaaccaggacaacaacgccaaagccacaatcctgtgggacaatgctttcagtgagatggatagggtgcccttcgtggtggccgagcgggtgccttgggagaaaatgtgtgagacgctgaacctcaagttcatggccgaagttggcacgaaccggggactgctgccagagcattttctgttcctggcacagaaaatcttcaatgataatagcctgtcaatggaggcttttcagcaccggtcagtgtcatggtcccagttcaataaagagatcctcctgggaagaggtttcacattctggcagtggttcgacggtgtcttagatctgacaaagcgttgtctccgttcctattggtcggacagattaattatcggcttcatctcaaagcagtacgtgacatcactcctgttaaacgaaccagacggcacttttctcctccgtttttcagattcagaaattggaggcatcaccatcgcacatgtgataaggggccaggacggctctcctcaaatcgaaaacattcagcccttctctgccaaagatttgagtattagaagcctcggggatagaattagagatctcgctcagcttaagaatttataccccaagaagcctaaagatgaagccttccgcagtcactataagcctgagcagatggggaaggatgggcgggggtatgtgccagccaccattaaaatgactgttgaaagagaccagcccctgcctaccccagaactgcagatgcccacaatggtcccttcctacgatctgggaatggctcctgattctagtatgtcaatgcaactcggacctgacatggtaccgcaggtgtatcctccccatagccactcaatccctccctatcagggactctcaccagaagaaagcgtaaacgttctgtccgccttccaggagcctcatttgcagatgccccccagtctaggtcagatgtcactccccttcgaccagccccatccccagggacttctgccatgtcagcctcaggagcacgcagtgagtagtccagaccccctgttgtgttcagatgttaccatggtggaagacagttgccttagccagcccgttactgcttttccccaaggaacctggattggcgaagacatttttccacctttactcccccccacagaacaggaccttacgaagttactgttggaaggacagggtgaaagcgggggcgggtctctgggtcactcacctagttgttcaccaccgactatgggaaatttggggtctcaatgtcccacatggacttag

SEQ ID NO: 134379 - DNA, 2544 bp, Artificial Sequence
  Description of Artificial Sequence: Synthetic coding sequence
atgagcctgtggggtctggtttctaagatgccacccgagaaggtacaaagactatatgtcgactttccccagcacttgagacacctgttaggagattggttagaatcccagccctgggagtttttggtgggttctgatgccttctgctgcaatctggcctctgctctgctttcggataccgttcagcatctccaggcttcagtgggagaacagggggaaggcagcaccatattgcaacatattagtacactcgagagcatctaccaaagagaccccctcaaactggtagctacttttcgccaaattctccaaggggagaaaaaggccgtgatggaacaattccgccatctgcctatgcccttccattggaaacaggaagaacttaaattcaagactgggctgaggaggctgcagcatagagtgggggagatacatttgctgcgtgaagccttacagaaaggcgctgaggctgggcaggtgtctttacattctctcattgagacgcctgctaatggcactggcccctccgaggcactggccatgctgctgcaggagacaaccggagagcttgaagcggctaaggcactagtgttgaagcggatccagatctggaaacggcagcagcagctcgcagggaacggggctccttttgaagaaagtctagcaccattacaggagaggtgtgagtcactcgttgatatttactcccaactccagcaagaagtcggcgcggccgggggagagctcgaacccaaaacccgggcctccctcactggacgactggacgaggtactccgcacgctcgtgacttcgtgcttcctggtcgagaagcagccaccccaggtgttaaagacacagaccaagttccaggccggagttaggtttttgctgggactcagattcctgggcgcaccagcaaagccgccattagttcgcgctgatatggttacagaaaagcaggcacgggaacttagcgtgccccaagggcccggggccggcgccgagtctacaggcgagataattaacaacactgtccctctcgagaattcaatccccgggaattgttgctctgctctgttcaagaacctcctgctcaagaaaattaaacgttgcgaacgcaaggggactgaatctgttactgaggaaaaatgcgctgtgctcttttctgcgagctttacgttaggacccgggaaactacccattcagttgcaggcactcagtctgccccttgtggtgatcgttcacggaaatcaggataataatgccaaggctaccattctatgggacaacgctttctcagaaatggatagggtgcctttcgttgtcgcagagcgcgtgccatgggagaaaatgtgcgaaacccttaacttgaagttcatggctgaagttggaactaatcgggggctccttccggaacactttttgttccttgcgcagaaaattttcaacgacaatagcctcagcatggaggcgtttcagcataggagtgttagctggtctcagttcaacaaggaaatcctcctcggtagaggctttacattctggcagtggttcgacggagttctggacctgaccaagagatgccttaggtcctactggtcagatcgcctgatcattggctttatctccaagcagtatgtcacttctcttctcctcaatgagccggatggcaccttccttctgaggtttagcgactcagagatcggcggaattactattgctcacgttattaggggtcaggacgggtctcctcagatcgagaatatccaaccatttagtgctaaagatctgtccattcggagcctcggagaccgtattagggacctagcccagctgaagaatctgtaccctaagaagcccaaagatgaggcattcagaagccattacaagccggagcaaatgggaaaggacggacgaggttatgtgccggcaaccataaagatgaccgtggagcgggaccagcctttaccaacccctgaactgcagatgcccacgatggtgccatcctacgacctgggaatggcccccgactcatctatgagcatgcagctaggacctgacatggttccacaagtgtacccaccccacagtcattctattcccccctatcagggcctctctccagaagagtccgttaatgttctgagtgccttccaagagcctcacttacagatgcccccatccctcgggcagatgagcctcccttttgaccagccacacccacaggggcttctgccctgccaacctcaggagcacgcagtgtcctcccccgaccctctgttatgcagcgacgtcacaatggttgaagattcctgtctctcacagccggtgactgccttcccccagggcacttggatcggtgaagacatatttccccccctgctacccccaacagagcaagatctgaccaaactgctcctggaaggccagggcgagagcgggggaggatctctcggtgcacagcctttgctgcaaccaagtcattacggccagtctggcatctccatgtcacatatggatcttagggctaacccgagttggtag

SEQ ID NO: 134380 - DNA, 195 bp, Artificial Sequence
  Description of Artificial Sequence: Synthetic coding sequence
atgagcctctggggcctagtttcaaaaatgccacctgaaaaggtgcagcgcctttatgtcgattttccccaacacctcaggcacctgcttggtgattggctagagtcacaaccatgggaattcttggttggtagtgacgccttttgctgcaatctcgcaagtgccctattgagcgacacggtccaacatctgtag

SEQ ID NO: 134381 - DNA, 435 bp, Artificial Sequence
  Description of Artificial Sequence: Synthetic coding sequence
atgtctctctgggggctggtgtcaaaaatgcctccagagaaggtgcaacgcctctacgttgacttcccgcagcaccttcgccatctactgggcgactggctggagagccagccctgggaattcctggttggtagcgacgccttctgctgcaacctcgcttccgccttattaagcgacacagtgcagcatctccaggcttcagttggggaacagggggagggttccactattctgcagcacatcagcaccctggagagcatctaccagcgagacccattaaaactggttgctacctttaggcagatccttcaaggagaaaagaaagctgttatggaacagtttcgacatctaccaatgccattccactggaaacaggaggagctgaagtttaaaacaggactccggagacttcagcacagagtgggagaaatttag

SEQ ID NO: 134382 - DNA, 465 bp, Artificial Sequence
  Description of Artificial Sequence: Synthetic coding sequence
atgtccctttggggactggtgagcaaaatgccccccgagaaagttcagcgtctttacgtagacttcccccagcacctgagacatttactgggagactggctagaaagtcagccatgggaattcctagttgggagtgacgcattttgctgcaacctcgcctcagctctgctgagtgacacggttcagcatctccaagccagtgtgggtgagcagggagaaggtagcacaatcctccagcacataagcacgctcgaatctatttaccagcgcgatcctctgaaactagtggccacctttcggcagattttacagggcgagaaaaaagccgtgatggaacaattccggcatttacctatgcctttccactggaagcaggaggaactaaaattcaaaacaggcctgcgtagacttcagcatcgagtgggcgaaatccatctcctgagggaagctctgcaaaaaggatag

SEQ ID NO: 134383 - DNA, 318 bp, Artificial Sequence
  Description of Artificial Sequence: Synthetic coding sequence
atgagcctgtggggccttgtctccaagatgccccccgagaaggtccagcgcctctatgtcgattttccacagcatctcagacacctgttaggggattggctggagagccaaccctgggagttcctcgttggatcagacgctttctgctgcaacttagccagcgcactactctcagataccgtccagcatctgcaggcctcggttggtgaacagggagaaggctccaccatcctgcagcacatcagcaccttggaatccatctatcagagggacccactcaaacttgtagccacgtttcgccagattctccaggggtag

SEQ ID NO: 134384 - DNA, 312 bp, Artificial Sequence
  Description of Artificial Sequence: Synthetic coding sequence
atgtccctttggggtttagtgtctaaaatgccccctgagaaagtgcagcgattgtatgtagacttcccgcagcacctgcgacacctactgggagactggctcgagtcccagccctgggagtttctggtaggctctgacgcattttgctgcaacctggcgagtgccctgctctccgacaccgtacagcatctgcaagccagcgtgggcgagcaaggtgagggctctactatcctgcagcatatttctaccttggagagcatctatcagagggaccctctgaagctggtggccacgttccggcagatcctgtag

SEQ ID NO: 134385 - DNA, 480 bp, Artificial Sequence
  Description of Artificial Sequence: Synthetic coding sequence
atgtctctgtggggcttggtgagtaaaatgccaccagaaaaggtgcagcgtctctacgtcgacttcccacagcaccttcggcatcttctgggcgactggctagagtcccagccatgggagttcctggtggggtctgatgcattttgctgcaatctggcatcagcactgttgtctgatacagtacagcacttacaggctagtgtgggcgaacagggagaaggatccaccatcctccagcacatctctacactggagtctatctaccagcgcgacccactgaagctggttgctacctttagacaaatattacagggcgaaaaaaaggcagtgatggagcagttcaggcacttgccgatgccttttcactggaagcaggaagaattgaagtttaaaaccggcctacggaggctgcagcaccgtgtcggggagattcacctgctacgggaggctctgcagaaaggggctgaggcggggcagtag

SEQ ID NO: 134386 - DNA, 2544 bp, Artificial Sequence
  Description of Artificial Sequence: Synthetic coding sequence
atgagcctgtggggcctcgtatctaaaatgcctcccgagaaggtgcagcgcctgtacgtggactttccccaacacttaagacatctcttgggggattggctcgagagccaaccttgggagtttctggtgggctccgacgcattttgctgcaacttggcaagcgctctgctatcagacactgtgcagcatctgcaggccagcgttggcgagcagggggaaggtagtaccatccttcagcacatctccactctggagtctatatatcagagagaccctctcaagctagtggccacatttaggcaaatcctgcagggggaaaaaaaggcagtcatggagcagttccggcaccttcccatgccattccattggaagcaggaggagctgaagttcaagactggactaagacggctgcagcacagggtgggagaaatccatttgcttagggaggccctacaaaagggagccgaagctggccaggtctccctgcacagcctaattgaaacccccgccaatggcaccggaccatccgaggcactggccatgctgctccaggagacaacaggggaactggaagccgcaaaggccttggtgctgaaacgaattcagatttggaaaaggcaacagcaactcgctggaaacggcgctccatttgaagaaagcctggccccactgcaggagagatgcgaatctctggtcgatatctatagccaactgcaacaagaggtgggcgccgctggcggcgagttggaaccaaagacccgggccagtctgaccggcagactggacgaggtccttcgaactctcgtcacttcttgtttcctggtggagaagcagccgccacaggtgctgaaaacccagacgaaattccaggcaggagtcagattcctgctcggccttagattcttaggagcccccgccaagccacctctggtacgcgccgatatggtcaccgagaagcaagcccgcgagctatcagttccccagggcccaggcgctggtgccgaaagtacaggcgaaattattaacaacaccgtcccccttgagaatagtattcctggaaattgttgctccgctctgttcaagaatctcctgttgaaaaagatcaaaaggtgcgagaggaagggaactgaaagcgtaacagaagagaagtgtgccgtcctgttcagtgcaagtttcactctgggccctggaaaactcccaatccagctacaggccctttctctccctttagtcgttattgttcacggcaaccaggacaacaatgccaaagcaaccatcttgtgggacaacgcattttcagaaatggatcgcgtgccctttgttgtggctgaaagggtgccctgggagaagatgtgcgagactttgaatttaaaatttatggctgaggtgggaacgaaccgcgggctgctccccgaacactttctctttttggctcagaagattttcaacgataatagtctgtccatggaagcttttcagcatcgctctgttagctggagccagtttaataaggaaattctgctgggccgcggcttcacgttctggcagtggttcgatggtgtgctggatcttaccaaaagatgcctccggtcttattggtcagacaggctcataatcgggtttatctccaagcagtatgtgacatctctcctcctaaatgaaccagacggaacttttctgctgcgtttctctgacagcgagatagggggcatcaccatagcccacgttatcagaggccaggatggaagccctcagatagaaaatatacagcctttttctgccaaggaccttagcatcaggagcctgggggatcgcatccgggacttggcccagttaaaaaatttgtatccaaagaaacctaaagatgaggctttcaggtcccactacaagcctgagcagatgggcaaagacggccggggttacgttcctgccactatcaaaatgacggtggaaagggatcagcccctgccgactccagagctgcagatgcccacaatggtaccaagctatgatttggggatggcgccggactccagtatgtccatgcagcttggccctgatatggttccccaggtgtaccccccacactctcactcaattcctccttaccagggactgtcgcctgaagaaagtgttaatgtgctgtccgccttccaggagccccatcttcagatgcctccttctctgggccagatgtctttaccattcgaccaacctcaccctcaaggtctgctgccttgtcagcctcaggaacacgccgtcagctctccggaccccttgttgtgttcagacgtgactatggtggaggattcttgcttgagtcaaccggtgaccgcctttccacagggcacgtggataggtgaggacatcttcccacccctgctaccaccaacagagcaggatctaacaaagttactgctggaggggcagggcgagtccggcgggggcagtcttggagctcagccactgctgcagccctcccattacggtcagtcagggatcagcatgagccacatggacctgcgggctaatccgtcttggtag

SEQ ID NO: 134387 - DNA, 225 bp, Artificial Sequence
  Description of Artificial Sequence: Synthetic coding sequence
atgagcttatggggtctcgtgtcaaaaatgcctcccgaaaaggtccagcggctctacgtggactttcctcaacatcttagacatctgctgggggactggcttgaatcccagccatgggaattcctcgtcgggtccgatgccttctgctgtaacttagcctcagcattgctgtcagacacagtccagcatctccaggctagcgtcggagagcagggcgagggctag

SEQ ID NO: 134388 - DNA, 564 bp, Artificial Sequence
  Description of Artificial Sequence: Synthetic coding sequence
atgctggggcaccccaaggtgtgcgagaagctgaaagccttaatggtcgagtggacagatgaatttaagaatgaccctcagctgtcgctgatcagtgccatgatcaaaaatcttaaagaacaaggtgtgacctttcccgccattgggagccaagccgccgagcaagccaaggcatctcccgccctggtagctaaggaccctggaacagtcgccaataagaaggaggaggaggatctcgcgaaggctatcgaattatccctgaaagaacaaagacagcagtccacaacattaagcactctgtacccttccacctcaagtttactgaccaaccaccagcatgaaggtcgcaaggtgcgagccatttatgattttgaggcggcagaagacaatgaactaactttcaaggccggcgagataatcactgtgctcgatgactccgaccctaactggtggaaaggcgagacgcaccagggtattgggctgtttccttccaattttgtgaccgcggatctgaccgccgagcctgagatgataaaaaccgagaaaaagaccgtgcagttttag

SEQ ID NO: 134389 - DNA, 1623 bp, Artificial Sequence
  Description of Artificial Sequence: Synthetic coding sequence
atgcctctcttcgctactaaccccttcgatcaggatgtagaaaaagccaccagcgagatgaacaccgcagaggactggggtctgattctcgacatttgtgacaaggtcgggcagagcaggacaggccccaaggactgtctgcgctccataatgcggcgagtaaaccataaggatccccatgtcgcaatgcaagccctgaccctgctgggcgcgtgtgtctccaattgtggaaagatctttcacttggaagtctgctcaagggacttcgctagcgaagtgtccaacgtgctcaataagggacaccctaaagtgtgcgaaaagttgaaagctctaatggtggagtggacagatgaattcaaaaatgacccccagctgtcattaatctcggccatgataaaaaacctgaaggagcaaggagtcacattccctgcaatcggaagccaagccgccgaacaagctaaggcgagccccgcactggttgctaaagatccaggaaccgtcgctaataagaaggaggaggaagatctcgccaaagcgatagaactgagcctgaaggaacaaaggcagcaatccacaaccttaagcactctgtatccgagtaccagttccttgctgactaaccatcagcatgagggaagaaaagtcagggcaatctacgatttcgaagcagctgaggacaatgagttaacgttcaaagccggcgagataatcaccgtgctggacgattcggaccccaattggtggaaaggcgaaacacaccaggggataggcctgttccccagcaactttgtgaccgccgacctgacggcagaacctgaaatgattaagacagaaaagaagaccgtgcaattctcagatgacgttcaagtggagaccatcgaacctgagccagaaccagcattcatagatgaggacaagatggaccaattgctgcagatgctccagagcacggatccctcagatgatcagcctgacctgcctgagcttctgcaccttgaagccatgtgccaccagatgggccctctgattgatgagaaacttgaagacatcgataggaaacattctgagctctcggagctaaatgtgaaggtaatggaggcgctttctctgtatactaaacttatgaacgaggatcctatgtacagtatgtacgccaagctccagaaccaaccatactacatgcagtcatccggcgtttccggctcccaagtgtacgctggaccacccccgagtggggcttacctggtggccggcaacgctcagatgtcccacctgcagtcctacagcctacccccagaacaactgtcgagcttgagccaggcagttgttccgccttccgctaaccccgcactgccgagccaacagactcaagccgcctatcctaataccatggtgagctccgtgcagggaaatacataccccagccaggctcccgtctactccccaccgccagccgccacagctgcggcggccaccgcagacgtgacactgtatcagaatgccggtcctaacatgccccaagtgccgaattacaatttgacgagctccactttaccccaacctggagggtcccagcagcctccacagcctcagcagccctatagtcagaaggcactactctag

SEQ ID NO: 134390 - DNA, 357 bp, Artificial Sequence
  Description of Artificial Sequence: Synthetic coding sequence
atgcggagggtaaatcacaaagacccccacgtggccatgcaggcgctgactttacttggtgcttgtgtgtcgaactgtggcaagatcttccacctagaggtatgcagtcgggactttgcctcagaagtttccaacgtccttaataagggccatcccaaggtctgcgagaagttgaaggcgctcatggtggaatggactgatgagtttaagaatgatccgcaactctcccttatttccgccatgatcaagaacttgaaggaacagggcgtgacattccctgcaatcggttctcaagcagcagaacaggcaaaggcaagccccgccctggtagctaaagatccgggcaccgtggcctag

SEQ ID NO: 134391 - DNA, 1290 bp, Artificial Sequence
  Description of Artificial Sequence: Synthetic coding sequence
atggtggaatggacagacgagttcaaaaacgatcctcagctgtcactcatttccgcgatgattaagaatttaaaggaacaaggggtgaccttccccgcaataggcagtcaggccgctgagcaggccaaggctagtccagccttggttgccaaggacccgggaaccgtcgcaaataagaaagaagaagaggaccttgctaaggccatcgagctgagtcttaaggaacaaagacagcaatccactactctatcaacactttatccatccactagcagcctcctgaccaaccatcagcacgagggtaggaaagtacgggctatttacgatttcgaggctgctgaagacaacgagctaaccttcaaggctggagaaatcattacagtgctggacgactcagaccctaactggtggaagggcgaaactcatcaggggatcggcctcttccccagcaattttgttacggcggatttgaccgccgagcctgaaatgattaaaactgaaaaaaagaccgtgcagttttcggatgatgtgcaggtcgaaacaatagaacccgagcctgagcctgcgttcatcgatgaggacaaaatggaccaactgttgcaaatgctgcaaagcaccgaccctagcgacgatcagcccgatctccccgaattacttcacctggaagcaatgtgtcaccagatgggacccctgatcgacgagaagctcgaggacattgatcgtaagcattcagagcttagtgagctgaatgttaaggtgatggaggctctgtcactctacacgaagttgatgaatgaggatccaatgtattcaatgtacgctaagttacaaaaccagccttattacatgcaaagctccggggttagtggatcgcaggtgtatgcaggtccaccgccaagcggtgcctatctcgtagcaggaaatgcacagatgtcccatctacagtcctacagcctcccgccagagcagctatcttcacttagccaggctgtggttcccccatccgccaacccggctctgcccagtcagcaaacacaggctgcttaccctaacactatggtgtccagcgttcaaggtaacacatacccatctcaggcaccggtttattctccccctccggcggctaccgccgcggcagccaccgccgacgtgaccctctatcagaacgcaggtccaaatatgcctcaggtcccgaactataacctcacatcaagcacattgccccagccaggcggcagccagcagcccccccaacctcagcagccttacagccagaaggctctgctgtag

SEQ ID NO: 134392 - DNA, 1578 bp, Artificial Sequence
  Description of Artificial Sequence: Synthetic coding sequence
atgcctctctttaccgctaacccctttgaacaagatgttgagaaggctactaacgaatacaacacaactgaagattggagcctgatcatggacatctgtgataaggtgggctccacaccgaacggcgcaaaagattgcctaaaggcaattatgaagcgagtcaaccataaggtgccccatgtcgccctgcaagccctaaccctgctcggcgcttgtgttgctaattgcggaaaaatttttcacctggaggtgtgttccagagatttcgctacggaagttagagctgtgattaaaaacaaagctcatcctaaggtgtgcgaaaaactaaaatcactcatggtggagtggtctgaagaattccaaaaagacccccagttcagcctcattagtgccacaattaagagtatgaaggaggaaggcatcacgttcccgccagccggctctcagaccgtttctgccgcagccaagaacggaaccagctctaacaaaaacaaggaagatgaggatattgcaaaagctatcgagctttccctccaggaacaaaaacagcagcacacggagacaaagagtctgtacccctcttccgagatccagttgaacaacaaggttgcaaggaaggtcagagccctatatgactttgaggctgttgaggacaacgagctcacattcaaacatggcgagatcattattgtgctggatgactccgacgctaattggtggaaaggggagaaccatcggggcattggtctttttccaagcaatttcgtgacgactaacctgaatattgagacagaggcagccgctgttgacaagctgaacgtaatagacgacgacgtggaggaaattaaaaagtcggagcccgagccagtgtatatagatgaggataagatggatcgcgcactgcaagtgttacagtccattgatcctacagattccaagccagacagccaggatttgctagaccttgaggacatttgtcaacagatgggacccatgattgatgagaagctggaggaaatcgataggaaacactcagagcttagcgaactgaacgtgaaggttcttgaagccctggagctgtataataagttagtcaatgaggctcccgtgtattccgtctactctaagcttcatccccccgcacactatccaccggccagcagtggcgttccaatgcagacctacccagttcaatctcatggggggaattatatgggtcagagcatccaccaggtgacagtggctcagtcatactcactgggacccgaccaaattggaccattgagaagcctgccacccaacgtgaatagttctgtgacagcgcaacccgctcaaacctcctatctgtccactggacaagacacagtttctaaccccacatacatgaatcagaactcgaacttgcagtcagctactggcaccaccgcctatacacaacagatgggcatgtccgtggatatgtcctcttaccagaatactactagtaacctgccacagctagcggggtttccagttacagttccagctcatcctgtagcacaacaacatacgaattatcaccagcaacccctgctttag

SEQ ID NO: 134393 - DNA, 3129 bp, Artificial Sequence
  Description of Artificial Sequence: Synthetic coding sequence
atgccgatgtgggctggtggggtgggtagtcctcgccgagggatggccccagcatctactgatgatcttttcgcccgaaaactgcgccagccagcccgccctcccctgacgccccacacatttgagcctaggccagtgcgaggtcctctcctgcgctccggctcagatgccggggaagccaggcctccaacgccagcttccccaagggcccgagctcattcccacgaggaagcctcccgaccggctgccacttctactagactttttacagatccacttgcactgcttgggttgccagctgaggagccagaaccagcctttcctcctgtactagagccccgctggttcgcacactatgatgtccagtcgttactgttcgattgggccccacgcagccaagggatgggttctcactcggaagcgagctccggaaccctcgcatccgccgaagatcaagctgcaagtagcgacctgctgcacggggcccccggctttgtttgcgaattagggggcgaaggggaactgggactcgggggacctgccagtccgcctgtcccacccgcgctgcccaatgccgctgtgtcaattctggaagagccccagaaccgtacaagcgcttactctctggaacacgctgacctcggcgcaggatactacagaaagtacttctatggaaaagagcatcaaaactttttcggcatggatgagtctctgggccccgtggctgtgagcctgcggcgggaagagaaggaaggtagtggcggcgggacactgcacagctaccgtgtcatcgttcgaacaacccagctacgtaccctgcggggaactatatccgaggacgccctccctcccggtcccccacggggactaagccctcgcaagttactcgagcatgttgccccacagttgtccccatcctgtcttcgcctaggatcagcctctcctaaggtacctaggaccttactcacactggacgagcaggtgctcagctttcagcgaaaagtggggatcctctactgtagagctggccagggatccgaagaagaaatgtacaataaccaggaagccggccccgcatttatgcaattcctgaccttattgggagatgtcgtgaggctcaagggcttcgagagttacagagcacagctggataccaaaactgactcgacgggaactcattccttgtatacaacttaccaggaccatgagattatgttccatgtttctaccatgctgccttacacccccaataaccaacagcagctgcttcgtaaacgccacatcggaaacgacatcgtcacgattgtattccaagagcccggatccaagcccttctgtccaacaaccatacgtagccattttcagcatgtcttcttggttgttcgggcacacacaccatgtaccccccatactacatacagggtcgcagtaagcaggactcaggatacccctgcttttggtccagccctgccagcaggaggtggacccttcgcagcaaatgccgacttccgggcatttctccttgcaaaggctcttaatggcgaacaagccgctgggcacgctcgccagtttcacgccatggctaccaggacacggcagcagtatctccaggatctggcaacaaacgaagtcacaaccaccagcctcgattccgcatctagattcggcctgcctagcctcggcgggcgcagacgcgcagcaccgaggggccccggggcggaattgcaggccgcagggtccctggtatggggggtgcgggctgccccgggtgcgcgggtggctgcaggcgctcaagcttctggccctgaaggcatcgaagtaccttgtctgttagggatttcagccgaggcccttgttttagtggccccacgggacgggcgggtcgtattcaattgtgcttgcagagatgtgctggcatggactttctctgagcaacagctggacctgtaccacggccggggggaggctataacactaaggttcgacgggtctccaggccaggcggtcggggaagtcgtggccaggcttcagcttgtttccaggggctgtgagacacgcgagctcgccctaccaagagatgggcagggcagactgggttttgaggtggatgcagagggcttcgtaacccacgtcgaaaggtttaccttcgctgagactgccgggctgagaccaggagctaggcttctccgtgtgtgcgggcagacactgccctcactccggcccgaagctgccgcccagcttctgcggtccgctcccaaagtgtgtgtgactgttcttccacccgatgaaagcggcaggcctcgccgaagtttcagcgagctttatacgctgagcctccaggagccaagtcggagaggagcaccggatccagtgcaggatgaggtacaaggggtgacattactccccactacgaagcagctgctacatttatgtcttcaggatggaggctctccccccggcccgggtgatctcgccgaagagagaaccgagtttctccactctcagaacagcctgagcccgcgcagctccctaagcgacgaagccccagtgctgccaaatacaacgcccgatttgctgctcgccaccaccgctaagccgtctgtcccaagcgccgactccgagacccctctgacgcaggatagacccggaagccccagtggctctgaggacaagggaaatccagctccagaactccgcgccagtttcctcccgcggactctgtcgcttcggaactccatatctcgtataatgagtgaggcaggctcggggaccctagaagacgaatggcaggctatctctgagattgcctctacttgcaacaccattctggaaagcctgagcagagaaggacaacctattcccgagagtggcgaccctaaagggacaccaaagtccgacgccgaaccggagcctgggaacctcagcgagaaggtttctcatctggagtcaatgcttcgtaagctgcaggaggatctgcagaaagagaaggccgatcgcgccgcgctggaagaggaggtcagaagtctgagacacaacaacagacgcttgcaggcagagtcagaaagtgccgccactagactattgttggcaagcaaacagctgggctctcccacagctgatttggcctag

SEQ ID NO: 134394 - DNA, 2823 bp, Artificial Sequence
  Description of Artificial Sequence: Synthetic coding sequence
atgcccatgtgggcagggggcgtgggctcgccgcgccgggggatggcaccagcctcaaccgatgacctcttcgccagaaagttgcgacagcctgctaggccccccctgacccctcacactttcgagccgagacccgtgcgaggcccactgctcaggagtggttctgatgcaggggaggctcgtccccccacccctgcatccccacgcgcacgagcacactcccatgaagaagccagccggccagccgctacttccactaggctttttaccgaccctctggccctgctcggcctgccggcagaggaacctgaacctgcgtttccacctgtcctggagcccaggtggtttgcccattacgacgtgcaatccctgctgtttgactgggcgccgcgatcacaaggtatgggctcccacagtgaagcaagcagcggcaccttggcgagtgctgaggaccaggccgcgtcatccgaccttcttcatggcgctccaggcttcgtatgcgaacttgggggcgagggagagcttggccttggagggccagccagtcccccagtccctcccgcgctccccaatgccgcagtgtcgattcttgaagagccgcagaatcgaacaagcgcttacagcctggaacatgccgacttaggagccggatactaccggaaatatttttatggcaaggaacaccagaactttttcggcatggacgagtcactggggcccgtggctgtgtcccttagacgcgaagagaaggaaggcagtgggggcggaacactgcacagctaccgtgtaatagtgcggaccactcaactcagaaccctgcgtgggaccatctcggaagatgcacttccacccggccctcctcggggcctgagtcctaggaagttacttgagcacgtggccccccagttgagtccatcctgtctgcgcttggggagtgcttcgcctaaggttccgaggacactgctcacattggatgaacaggtcctatccttccagcggaaagtcggtatactgtactgtcgcgccggccagggctccgaggaggagatgtacaacaatcaggaagcaggcccagcctttatgcagttcttaaccttgttaggggatgtagtgagattgaagggattcgaatcctaccgcgcgcagctcgacaccaagactgactccactgggactcatagtctgtacacaacttaccaagatcatgaaataatgtttcacgtatcgacaatgctgccttatacgccaaacaaccaacaacaattactacgcaaacggcacatagggaacgacatcgtgacaatcgtgttccaggaacctgggagcaaacccttttgcccaacaactattagatctcatttccaacacgtcttccttgtcgtccgcgcgcacacaccatgcactccccatacaacatacagagtggccgtgtctcggacccaggatacccccgcatttggacctgccctccccgctggcggtggaccatttgcagccaacgcagatttcagagcctttctgttggctaaggcacttaacggcgagcaagccgccggccacgctagacagtttcacgcaatggctacacgcactcgtcagcagtacttgcaggatttagctacaaatgagcagctggatttgtatcacggtagaggtgaggccatcactcttcggttcgatggcagccccggccaggcagtaggcgaggttgtcgcgcgcttgcagctcgtatctaggggatgtgagacaagggaactcgccctgccgagggatggtcaggggcgactcggattcgaggtggatgccgaaggatttgtgactcatgttgaaaggttcacgttcgctgagacagctggactgaggccaggggcccgtttgttgcgtgtgtgcggacaaactctaccctccctgcgaccagaggcggcggctcaactgctgcgctctgccccgaaggtatgcgtgaccgtgctgcctccagatgagagtggcaggccaagacggtccttttctgaactctatacgctgtcgctgcaagaacctagcagacgtggtgcgcctgatcctgtgcaggacgaggtgcaaggcgtcactttgttgcccacaacaaaacagctcctgcacctgtgtctccaggatggcggatctccacccggtccgggggatttggcagaagaaaggaccgagtttcttcactcccagaacagcctgagccccagatcttcattgtcagatgaagcaccggtactgccaaatactaccccagatctgctattggcaacaactgcgaaaccgtctgtgccatctgcggattccgaaactccattaactcaggatcgccccggcagtccttcaggcagcgaggataagggcaaccccgcaccagaattgagagcctctttcctccctagaactctgagtcttaggaacagtatttccagaattatgtccgaagctggatccggaaccttagaggatgagtggcaggctatcagcgagattgcttcaacctgcaacacaatactcgaaagcttgagccgggaaggccaacccatccccgaaagcggggacccgaaaggaaccccgaagtccgacgcggaacctgaacctggaaatctatcagagaaagtgtctcacctggagagcatgctgcgtaagctgcaggaagacttgcagaaagagaaggccgacagagcagcgctggaagaagaagtgcgttctctaaggcacaacaacaggagactccaggcggagtccgagagcgctgcaactagactgctcctggcgagtaagcagctcggtagtcccacagccgatcttgcttag

SEQ ID NO: 134395 - DNA, 21 bp, Artificial Sequence
  Description of Artificial Sequence: Synthetic coding sequence
atgccaatgtgggcgggctag

SEQ ID NO: 134396 - DNA, 312 bp, Artificial Sequence
  Description of Artificial Sequence: Synthetic coding sequence
atgccaatgtgggctgggggtgtcgggagcccacgtcgaggcatggcacccgccagcacagacgatctttttgccagaaaactcagacagccagcgagaccccctctgacacctcacacatttgagcctcgcccggtacgggggcctctcctgcgttctggcagtgatgcaggggaggctaggccgccaaccccagcctcacctcgggcacgagcgcattcccatgaagaagctagtaggcctgcagccacgagcacaagactgttcactgaccccctcgctctcctgggcctccctgccgaggagccttag

SEQ ID NO: 134397 - DNA, 3129 bp, Artificial Sequence
  Description of Artificial Sequence: Synthetic coding sequence
atgcctatgtgggccggtggggtgggttctccccggcgcggcatggccccagcaagtacagatgacttgtttgctcgtaaattgcgccaaccagcccgtccgcctctgaccccacatacgttcgaacctcgacccgtcagagggccactccttaggtccggaagtgacgccggcgaggcaagacccccaactccggcctcccctcgtgcaagagcacactcccatgaagaagcctcccgcccagcggcaacaagcacccgactatttaccgacccactagcgctcctgggtctgcctgccgaagagccagagcctgcctttccgcccgtcttggagccccggtggttcgcacactatgatgttcagtccctcctgtttgattgggctcctaggtcccaggggatggggagtcatagtgaagccagttctggaacactggcctcagctgaagaccaggctgcctcaagtgaccttctccatggcgctccgggttttgtgtgcgagttagggggggaaggcgaacttggtctaggcggaccagccagccctcctgtcccgccagctttgccgaacgcagcagtgtctatcctggaggagccacagaaccgcacgtctgcctactcactcgagcacgccgatctcggagccggctattaccgaaagtatttttacggtaaggaacatcagaatttttttggaatggatgagtcgttgggacctgttgctgtaagccttagacgagaagagaaggaggggagcggcggggggaccctgcactcctatagggtgatagtgcggaccacccaattgcggaccctccgcggaaccatttctgaagatgcgctgccacccggcccccctcgcggactgagtccacgtaagctgttagagcacgtggctccacagctctcccccagctgcctgcgcctggggagtgccagccccaaagtgcccaggaccctactcacactcgacgaacaggtactgtcttttcagcgtaaagtcggcattctgtactgtcgagccggtcagggctccgaggaggaaatgtacaataaccaagaggcaggaccagccttcatgcaatttctcacgctcctaggagatgtagtgcggctgaaaggatttgaaagctacagggcccagctagacaccaaaacagatagtaccggaactcactcactttacaccacctatcaggaccatgaaatcatgtttcacgtgtctaccatgctcccatacacccccaataatcaacagcaactgctccgcaaaaggcatatcggcaacgatatcgttaccatcgtgtttcaggaaccgggcagcaagccgttttgccccacaacgatccggtctcatttccaacacgtcttcttggtggtgcgggcacacactccatgtaccccacataccacatatcgcgtcgcggtttctcggactcaggatacacccgcctttggccccgcgctgccagccggaggtggtcctttcgctgcgaacgcggacttcagggcttttctgcttgccaaagccctgaatggcgaacaggctgctggccacgcacgacagtttcacgcaatggcaacgcgaacccgccagcaatatctgcaggatttggcaacaaacgaagtcacaaccaccagcttggacagcgcaagtaggttcggcctaccgtccctcggcggccggaggagagcagctccacgtggacctggcgccgagctgcaggccgctggcagcctggtctggggagttagagccgctcccggtgcccgagtggccgccggagctcaggccagcggccctgaagggatcgaggtcccctgtctgttaggaatctctgcagaagctctagtgctcgtggcccccagggatggcagagtagttttcaactgtgcttgtagagatgtattggcttggactttcagcgaacagcaactggacctctaccatggtcgcggagaagccataacgctgcggtttgacggcagccccggacaggctgtgggtgaggtggtggctagactgcagcttgtgtcaagaggttgcgagactcgcgaactggctcttcccagggacggtcaggggcggctaggcttcgaggttgacgcagagggatttgtcacccacgtggaacggtttacttttgcggagaccgctggtctcagaccaggagccaggctacttcgcgtgtgcgggcaaacgctacccagtctccgccccgaggccgcggcccagttactcaggagcgccccaaaagtgtgcgttactgtgttaccccctgacgaaagcggccggccacgaaggtccttcagcgagctctacactctttctctgcaagagccttctcgccgaggggcgcccgatccagttcaagacgaagtgcaaggagtgaccttgcttcccacgactaaacagctgctccatctgtgtctgcaggacggtggatcgccccccggcccgggtgacctggcagaggagcgaaccgaatttctgcattctcagaattctctgtcccccaggtccagccttagcgatgaagcccccgtcttgccgaacacaacaccagacctcctgcttgcgacaactgccaagccgtcagtgccttcagcggactcggaaacgcccttaactcaggacagacccggatctccgtcgggctctgaggataagggtaatccagctccagagctccgtgcctccttcctccctagaaccctgagtctgcgaaactccatatcccggataatgtccgaggcaggcagcggaacactagaagacgagtggcaggccatctctgagatcgcatcgacctgtaacactattctggagagtctgtctcgcgaaggccaacctatcccagagagcggtgatccgaaaggtaccccgaagagtgatgctgagcccgagcctggaaatttgtcggaaaaagtatcccacctcgaaagcatgcttagaaagcttcaagaggacctacaaaaagaaaaggccgaccgagctgcactcgaggaggaggtgcgctctttacgccataataacagacgcttgcaggccgagtctgagagtgcggctacacggctacttctggccagcaagcagctgggaagtcccaccgctgatctcgcgtag

SEQ ID NO: 134398 - DNA, 5169 bp, Artificial Sequence
  Description of Artificial Sequence: Synthetic coding sequence
atgtctgatcctcgtcagtcacaggaagaaaaacataaactcggccgggcctcctccaagttcaaggatccaccgcgcatcatgcaaagtgacgattatttcgccaggaagtttaaagccatcaatggaaacatggggcctaccacctccctgaatgcctctaactctaatgagactggcggcggcggccccgcgaacggtaccccagccgtgcccaagatgggcgtgagagcaagggtatctgaatggccaccaaagaaagattgcagtaaagagcttacatgcaaagcactgtgggagtcccgttcccaaacaagttatgagtcaatcaccagtgtcctgcagaatggacaatctgatcagagcgagggacagcaggatgagcaactggatttagacttcgtcgaggccaagtacaccataggagatatctttgtgcactcaccccagagaggtttgcatcccatccgccagcggagtaactccgacgttactatcagcgatatcgacgccgaagacgtgttggatcagaacgccgtgaacccaaacaccggagcagctctccacagagagtatggttcaacaagcagcatcgaccggcaagggctgagcggcgaaaatttttttgctatgttacgaggctatcgcgttgaaaactatgaccacaaggccatggtgcccttcggatttcccgaattctttcgatgtgacccagctatctcgccatcgctgcatgctgcggcccagattagcaggggcgaatttgttagaatcagcggtttagattacgttgatagtgccctgctgatgggaagggatcgggacaagccatttaagcggagactgaagagcgagagcgttgaaacttcactgtttcggaagctgaggactgtaaagtcagaacatgagacctttaagtttacaagcgagctagaagagagcagattagagaggggtatccggccatggaactgtcagagatgtttcgcccattacgacgtccagtccattctctttaacattaacgaggcgatggcaacaagggctaatgtaggtaaacgtaagaacataactaccggtgccagcgcagcatctcagacacagatgcctactggccagaccggcaactgcgaatctccactgggcagcaaagaggatctgaacagtaaagaaaacctcgatgctgatgaaggggacggcaagagtaatgaccttgtgctgtcatgtccatacttcaggaacgaaacgggcggcgagggcgacagacgtattgccctgagccgggccaactcttccagtttctcaagcggggagtcttgcagcttcgagtccagtctgtctagtcactgtaccaacgctggagtctccgtgctggaggttccccgagaaaaccaaccgatccatcgcgagaaggttaagaggtacatcatagagcatatagatctgggcgcatattactaccgcaagttcttctatggaaaagaacaccaaaactactttggcattgatgaaaatctgggccccgtcgccgtgagcatccggcgggaaaaagtagaagacgcgaaagaaaaagaagggtcccagttcaactaccgtgtggcctttcgtacctctgagctcaccacactacgcggcgcgatacttgaagatgcaattccaagtaccgctcgccacgggacagcacgtggcctccctttgaaggaagtgttagaatacgtgataccagagctgtccattcagtgcctccgtcaagcctctaattcccccaaggtgagcgaacagctgctgaaattagatgaacagggcctgtcctttcagcataagatcgggatcctgtattgcaaggctggacagtctaccgaggaggaaatgtacaacaatgagaccgccggacctgccttcgaggagttcctagaccttctgggacagcgcgtgcgactgaagggcttcagtaaatatcgagcccaactcgataataagacagacagcaccggcacacactcactgtacacaacgtacaaggactacgagctcatgttccatgtctcaaccctgttgccatacatgccaaacaatcggcagcagcttctgcggaaaaggcatatcgggaacgatattgtgacaattgtatttcaggagccaggtgctttaccgtttacccccaagagcatcagaagccattttcagcacgttttcgtgatcgtcaaggtgcataacccctgcaccgaaaacgtttgctattctgtcggcgtgtccaggagtaaggacgtgccaccttttggccctccaatccctaagggtgtaacatttcccaagtcagcggtgtttagggacttcctgctagcgaaggttatcaacgccgagaatgcagcccataaaagtgaaaagtttcgcgccatggctacacgaaccagacaggagtacctgaaagatttggccgaaaactttgtaaccaccgccaccgtcgataccagcgtgaaatttagctttattaccctgggcgcaaagaagaaagagaaagtgaagcctcggaaggacgcccatctttttagcattggcgccatcatgtggcacgtgattgccagagattttggccaatctgcggatatcgagtgcctccttggcatctcaaacgaatttattatgcttattgagaaagacagtaaaaacgtggtgttcaactgcagttgtcgcgacgtaattggatggactagcggacttgtgtccataaaagtgttctatgaacgcggagaatgtgttcttctgagtagcgtggacaattgcgcggaggatatacgcgagatcgtgcaacgattagtgattgtcactcgagggtgtgagaccgtggagatgacactccgtcgtaacgggctcgggcaacttgggtttcacgtgaacttcgagggaattgtcgcagacgtcgagccatttggctttgcgtggaaagccggcctgaggcagggatcaagactggttgagatttgcaaggttgcggttgcaactctgactcatgaacagatgatcgatctcctccgaaccagcgtgactgtgaaggttgttataatccagccgcacgacgatggaagtccgcggaggggatgtagcgaattgtgtcggatcccaatggtcgagtataagctcgacagtgagggaactccctgtgaatacaagaccccgtttcggcgtaatacgacctggcatagagtgcctaccccagccctgcagcccttaagccgcgcgtctcctatcccaggcacgccggatcgtctgccctgtcaacagctcttgcagcaagctcaggccgcgatacctcggagtactagttttgaccgaaagctgcccgatgggaccaggagctctcctagtaaccaatcctcctctagtgacccaggccctgggggctccggcccttggaggccccaagttgggtacgatggctgccaatcgcctctgcttttggaacaccagggatcaggtcctctggagtgcgacggagcccgcgaacgtgaagacacaatggaggctagtcgtcacccagagactaagtggcacggccccccttccaaagtgctgggatcttataaggagagggccctgcagaaggatggcagctgcaaagattctcccaataaactgtcgcatattggcgacaaatcatgttcatcacacagttcgagcaatactctctcctccaacacaagcagcaacagcgacgacaagcattttggaagcggcgaccttatggacccggagttgttgggccttacttacatcaagggggccagtaccgactcaggtattgatactgctccatgcatgcctgccacaatattagggcccgtgcatctcgcaggcagccgcagcctgatacactcgagagccgagcagtgggcggatgcagccgatgtgagcggcccagatgacgagccagcaaaactctatagcgttcacggctacgcctccacaatcagcgccggatccgcagccgagggcagtatgggcgatctgagcgaaatctcatcgcactccagcgggtcacatcattcagggagcccatcggctcattgctccaagagctcaggatcgctcgactctagcaaagtctatattgtatctcatagtagcggccagcaggtgcctggaagtatgagcaagccctaccaccgccagggcgccgtgaacaagtatgtcatcggatggaaaaagagcgaaggcagtcctccccctgaagagcccgaggtgacagagtgcccgggcatgtactcagagatggatgtcatgagcacagctacacagcaccagaccgtggtgggcgacgccgtggctgagactcagcacgttttgtccaaggaggactttctgaaactgatgctgcctgactcaccattggtggaggaaggaagacgcaagttcagtttttacgggaatttgtctcccagaaggtcactttatcgtaccctgtctgacgagtcaatctgctcaaatagaagagggtcttccttcggctcatctcggtcgagtgtgctggaccaggctctccctaatgatatccttttttccacgacacccccttatcattctacactcccacctcgtgctcacccggcaccctctatgggatcactgcgtaacgagttttggttcagcgatggttctctgtccgacaagtccaaatgtgctgacccaggcctcatgccacttccagacacagcaactggcctggactggacccatttggtcgatgccgctagagcctttgaggggttggacagcgacgaagagttgggtcttttgtgtcaccacacaagttaccttgatcagagggtggctagcttctgtacactgacagacatgcagcatggccaggatctggaaggtgctcaggaacttcccctgtgcgtggaccctggaagtggaaaagagtttatggataccactggagagcgaagcccgagcccattaacggggaaggttaaccagcttgagctcatcttgcggcagcttcagactgatctgaggaaggagaagcaagataaagcagtcctgcaagctgaagtgcagcaccttcgtcaggacaatatgcgtctgcaggaggagagccaaacggccaccgctcagcttagaaagtttaccgagtggttctttactacgatcgataagaagtcttag

SEQ ID NO: 134399 - DNA, 2337 bp, Artificial Sequence
  Description of Artificial Sequence: Synthetic coding sequence
atgtccccttgctttagtttcatcgggtgtaagttgtgtagcatagtgacaagagggtgcgaaacagttgagatgacacttcgacgtaacggacttgggcagctgggctttcacgtgaattttgaggggatcgtggccgacgtagaaccctttggcttcgcctggaaagctggcctgcgtcagggctccagactagttgagatttgtaaagtcgcagtggcaacactcactcatgagcagatgattgacttgctgaggacttcggtgacagttaaagtggtcatcattcagccacatgatgatggcagtcctcggcggggttgctccgaactgtgtaggatcccaatggtagaatacaaactggattccgagggtacaccttgtgaatataagactcccttcagacgcaacacaacctggcacagggttcctacacctgctctgcaacctctctcccgcgccagtccaatccctggcacccccgatcgcctgccatgtcaacagctgctgcaacaggcccaggctgccataccgaggagtaccagctttgacagaaagctcccggacggcacgaggtccagccccagcaatcagagttcatcctccgacccagggcctgggggctcagggccctggcgtccacaagtcggatacgatggctgtcagtcccccttactccttgagcaccaaggctccggcccactggagtgcgacggcgcacgggaaagagaagatactatggaagcctcacgtcatcctgagacgaagtggcacggacccccaagcaaggttctaggatcctataaagaacgggctttgcagaaggacggatcctgtaaggactcccctaataagctcagtcatattggcgataaatcctgctccagtcattcatcctctaacaccctctcatctaatactagtagcaattctgacgacaaacatttcggttccggcgacctgatggacccagagctccttgggctgacctacattaagggcgcctctacagatagcgggatcgacacagccccatgtatgccagccacaattctggggccagtccatctggcaggatcccgcagtctgatccatagcagggccgagcaatgggcagatgccgccgacgtttctggacccgatgacgagcctgctaagctgtactcagtgcacgggtatgcatccacgatatccgctggatccgcagccgaaggttcaatgggtgatcttagtgaaatcagtagccattcgtccggcagccatcatagtggcagcccatctgcccactgtagcaagtcctccggcagtctggacagcagcaaagtgtacattgttagccatagtagcgggcagcaggtgccaggctctatgagcaagccataccaccggcagggagctgtaaacaagtatgttataggctggaagaaaagcgaagggtctcccccaccagaggagcctgaagtaaccgaatgtccgggcatgtattccgagatggacgtcatgtctaccgccacccagcaccagaccgttgtaggcgacgcagtggccgagacccaacacgtgctgagtaaagaagatttcctgaagctcatgcttcctgatagcccccttgtcgaggaagggcgcagaaaattctcattctacggaaatctgtctcctagacgttcactatatcggaccctcagcgacgagtctatatgttcgaatagacggggatctagtttcggatccagtagatcctctgtccttgaccaagcccttcctaacgacattttattttcaacaactccaccgtaccactctacccttccccccagggcccatcccgcaccctccatgggatcgctgcgtaatgaattctggttctcggacgggagcttatcggataaaagtaaatgcgcagacccggggttgatgcctctgcccgatactgctacgggactcgactggacgcacctggtggacgcagcccgagcctttgaggaccagcgcgtggcatctttttgcaccttgacagacatgcagcacggccaggatctcgagggcgcacaagagttaccgctctgtgtggatccaggctccggcaaggaattcatggatactacgggggagcgttctccatccccgctcacgggcaaggtcaaccagctcgagcttattctgaggcagcttcagacagacctccgcaaagagaagcaggataaagcagtgttgcaggccgaagtgcagcatctgaggcaggataacatgcgcctgcaagaggagagtcaaacagcaaccgcccagcttcggaagttcactgaatggttctttactactatcgacaaaaaatcctag

SEQ ID NO: 134400 - DNA, 5169 bp, Artificial Sequence
  Description of Artificial Sequence: Synthetic coding sequence
atgtctgacccccgacagagccaagaagagaagcataaactggggcgggcctccagcaaattcaaggatccccctcggattatgcagtcagacgactattttgcccggaagttcaaggcgataaatggcaacatgggccctactacgagtttaaacgccagtaattcgaacgagacaggcgggggtgggccggccaacggcaccccggccgttcctaagatgggggtgcgcgccagggtgtcggaatggccacctaaaaaagattgttctaaggagctgacttgtaaggccctatgggaatctcgctcccagaccagctatgaaagtattacttcggtactgcagaacgggcagtctgatcagtctgaggggcagcaggacgaacagctggatctagacttcgtggaggctaaatataccataggggacatcttcgttcacagcccacagcgtggactgcaccctattcgacagcgatccaacagtgacgtcactatttccgatatcgatgccgaggacgtattggatcagaatgctgtaaacccaaacactggtgcagctctgcacagggagtatggcagtacatcgtctatcgatcgtcagggattatctggagagaactttttcgccatgctccgagggtacagggtagagaactacgatcataaagccatggttcccttcggctttcctgagtttttcaggtgcgaccctgccataagccccagcctgcatgctgccgcccagatctcccggggggagttcgtacggatctcaggactggactacgtagactcggcccttctgatgggtcgcgaccgggataagccattcaaaagacgcctcaaaagcgaatcagtggagacatcactgttccgcaaattgaggaccgtaaaatctgaacatgaaacgtttaaatttacctcagaattggaggagtccagactagaacgcggaatacgaccgtggaattgccaacgatgttttgctcattatgatgtccaaagcatcctcttcaacatcaatgaagccatggccacacgagcgaacgtgggaaagcggaagaacattacaactggagcatccgctgcttcccaaacacagatgcccacaggacaaacaggaaactgcgagtcccccctggggtccaaggaagacctcaactcaaaggaaaaccttgatgccgatgagggcgacgggaagtctaatgatctggtgctctcttgcccttatttcagaaatgagaccggtggggagggggaccggaggatcgcattgagtagggcgaactcaagctccttctcttccggggagagctgcagcttcgaatcctcattgagcagtcactgcaccaacgctggtgtctctgttctagaagttccacgtgaaaatcagcccatacaccgggaaaaggtaaagaggtacatcatcgagcacatcgacctgggagcttactactatcggaaatttttttacggtaaggagcaccagaattattttggaattgacgaaaacctcggaccggtggcggtgagcatccggcgggagaaggtcgaggacgcaaaggaaaaggagggatcccagttcaattaccgcgtggcattccggacctccgagctgactacactgcgtggcgcaattctcgaagacgccatcccatcaacggctcgacatgggactgctagaggcttgccactgaaggaagtcctggaatatgtcattcctgaactgagtatccagtgcttgaggcaggcgtctaacagccctaaggtaagcgaacaactcctgaagctggatgagcagggcttgtctttccagcataagatcgggattctgtattgtaaagcagggcagtccactgaggaagagatgtacaataatgagactgctggtcctgcttttgaagaattcttggacttgcttggtcaacgcgtgcggttgaaggggttctccaagtatagagcccagctggacaacaaaactgactctactggtacccacagcttgtacaccacctacaaggactatgagctcatgttccacgtgtcgacattgctgccctatatgccgaacaacagacagcaacttctgcgcaaaaggcacataggaaatgacatcgtgacgatagtgtttcaggaacctggagcgctccctttcacccctaagtccattaggtcacacttccaacacgtatttgtcatcgtgaaggtacataacccttgcaccgagaatgtctgttattccgtgggggtgtctcggtcgaaagatgtgccaccatttggtcctcccattccgaaaggcgtaaccttccccaaaagcgctgtgtttcgggatttcctgttggccaaagtcattaacgctgagaacgcggcacataaatctgagaaatttagagctatggcaacacgaacccgccaggaatacttgaaggatctggctgaaaacttcgtgactaccgccaccgtcgatacatctgttaagtttagcttcataaccctgggcgccaagaagaaggaaaaggtgaaaccccgtaaagacgcccaccttttcagcatcggcgcaatcatgtggcacgtaattgccagggactttggccagtctgcagacatcgagtgtctactcgggatatcaaacgaattcataatgttgatagaaaaggacagcaaaaacgtggtatttaattgctcttgtcgcgatgtgattggctggaccagtggcttggtttcaataaaggtcttttacgagcgaggagagtgtgtgctgctgtcctcagtggacaactgcgctgaagacattagggagatagtgcagaggctcgtgatcgtgacccggggctgtgaaaccgtagagatgactctgcgcagaaatggcctgggtcaattagggttccatgtaaacttcgagggcatcgtggctgacgttgagcccttcggcttcgcctggaaagcaggtctgcggcaggggtcccggctggtggagatttgcaaagttgccgtagctactttgacccatgagcaaatgatagacctgctgcgaacctccgttacagtgaaggtggtcataattcagccacacgatgacgggtctccacgccgcggatgtagcgagctgtgccgcatccccatggttgagtacaagttggactctgaagggaccccatgtgaatacaagacgcccttccgcaggaatacaacatggcaccgcgtcccgacccctgccctgcagccactatctcgcgcatcaccaattccgggcacacccgatcgcttgccttgtcaacagctacttcagcaagcccaggctgcaatccccaggtctacctctttcgacagaaaactgcccgacggaaccagatccagtcctagtaatcaatcgtcgtcgagcgatccaggtccaggcggcagcggtccgtggcgccctcaggtagggtacgacggatgtcagtcaccgttactcctggaacatcagggttcaggccccctggaatgtgatggagcgcgggagcgagaagacaccatggaagccagcaggcatccggaaacaaaatggcatggccccccctccaaggtccttggttcatacaaggaacgcgcccttcaaaaggatggctcatgtaaggattccccgaacaagttatcccatatcggggacaaaagttgtagcagccacagtagttctaacacactgtcaagcaacacgtccagcaattccgacgataaacacttcgggtccggagatttgatggaccccgagctgcttggtcttacctacataaaaggtgcaagtacggatagtggtatcgacacagctccatgtatgcctgcaactattctcggtcctgttcacctggccggatcaaggtctttgatccactcacgcgccgagcagtgggccgacgcagccgatgtcagcggtcccgatgacgaacccgcaaagctctactcagtgcacggctacgctagtacaatttcagcggggtccgctgccgaggggagcatgggggacttaagcgagattagcagccacagctcgggttcccaccattcaggcagcccaagcgcgcactgcagtaaatcttccggtagtttagattcaagtaaggtgtacattgtaagtcattcatccggacaacaggtcccaggcagtatgtctaaaccttaccatcgtcagggtgctgtaaacaaatacgtgataggctggaagaaaagcgaaggctctcctccccccgaagagcccgaggtcaccgagtgccccgggatgtattcagagatggatgtcatgtccacggctacccaacatcagacagtggtaggagatgcagtggccgagactcagcacgtgctcagcaaagaggatttccttaagctcatgcttcccgacagcccactggtagaagagggaaggcgtaaatttagtttttacggcaatctatccccaaggaggtctctgtacaggacactgagcgacgaaagcatttgtagcaatcgacgcggttctagctttggctcctcccgctccagcgtcttggatcaggccctgcctaatgacatcctcttctccacaacccccccctaccactccaccctgcctccaagggcacacccagctccaagcatgggcagcctgagaaatgagttctggttcagcgacggtagtctgtccgataagtctaaatgtgccgaccctgggctcatgcccctccctgacaccgcaactggtctggattggacacatctggtggatgccgcacgggcattcgaggggcttgatagtgacgaggagctgggcttactctgccatcacacctcttatctcgatcagcgcgtcgcctctttctgcacattgacggacatgcagcacggccaggacttggaaggcgctcaagagcttcctctatgcgtggatcccggatctggaaaggagttcatggacactacaggtgaaaggagtccttcaccactgacggggaaggtgaaccagctagagctgattctgcggcagcttcagaccgatcttaggaaagaaaagcaggacaaagccgttcttcaggcggaggtgcaacacctgcggcaagataacatgcgcctgcaggaagaatcgcagactgccacagcacaactgagaaagtttacagagtggttctttacaaccatcgataagaaatcttag

SEQ ID NO: 134401 - DNA, 918 bp, Artificial Sequence
  Description of Artificial Sequence: Synthetic coding sequence
atggatcccaaagggcttctcagcctgacgtttgtacttttcttgtcattggcctttggagcatcttatgggaccggaggaaggatgatgaactgtcccaagatactgcgtcaactgggaagcaaggtgctgctccccctgacctacgaacggataaataagtctatgaacaaatctatccacattgtggtcaccatggcaaagagcttagagaactctgtagagaacaagattgtatcccttgacccctcggaggcagggcctcctcgttacctgggagaccgatacaaattctatctggaaaacttgacactggggatccgggaaagccgcaaggaggatgaggggtggtatctgatgacactggagaagaacgtgtcggtgcagaggttctgtttgcagctgcggctgtacgaacaggtgtccacgccagagataaaagtgttgaacaagactcaggaaaacgggacttgcacccttatcctgggttgtaccgtcgagaaaggagatcatgtcgcttattcctggtcagaaaaagcgggtacccaccctttgaacccagctaatagctcgcacctgctaagcctgactttgggcccacagcatgctgacaatatctacatatgcaccgtgagcaatcccataagcaataacagccagacattctccccttggcccgggtgccgaactgatccctccggaaaaacgaaccactaccagaccactgtggaaaaaaaaagcctaaccatttacgcccaagtccagaaaccaggtcccctgcagaagaagcttgattcttttcccgcccaggatccgtgtactactatttatgtggccgcaacagaaccagtacccgagagcgtgcaagagactaattctattaccgtatatgcttctgtgacacttccggagtcctag

SEQ ID NO: 134402 - DNA, 1008 bp, Artificial Sequence
  Description of Artificial Sequence: Synthetic coding sequence
atggacccaaaggggttgctgagcctcacatttgtcctcttcttatcactggccttcggggcatcttacggcacaggagggagaatgatgaactgtccaaaaattcttcgccaattagggtctaaggtgctactcccactcacctacgaacggatcaacaagtccatgaacaagagcatacacatcgttgtaaccatggcaaagtccctcgagaactctgttgaaaacaaaattgtttctctggacccatctgaagctggacctcctaggtatctgggtgatcggtataagttctaccttgaaaacttgaccctaggcatcagggaatctagaaaagaggatgaaggctggtatttgatgactcttgagaagaacgtgtcagtccagcgattttgcctgcagctgcgactgtatgaacaggtttccacgcccgagatcaaggtgctcaacaaaactcaagaaaatgggacatgcactctcatcctgggatgtacagtggagaaaggggatcacgtagcctattcatggagtgagaaagccgggacccatccgttaaatcctgccaattcttcacacctgttgtcactcaccttagggcctcaacacgccgataatatttatatctgtacggtgtctaatccaattagtaacaacagccagacgttcagcccctggccagggtgccgcacagaccccagcgagacaaaaccttgggctgtctacgctggcctcctgggcggcgtgattatgattctcattatggtggttattctgcagctgagacggaggggcaaaaccaatcactatcagactaccgtggagaagaagagtctgaccatttacgcccaggtgcagaagccgggccctctgcagaaaaaattggatagtttccccgcccaggatccctgcactacaatatacgtcgccgccacagaaccagttccagaatctgtccaggagactaactcgatcactgtgtacgctagcgtaaccctgcctgagtcttag

SEQ ID NO: 134403 - DNA, 897 bp, Artificial Sequence
  Description of Artificial Sequence: Synthetic coding sequence
atggatcctaaaggcctcctcagtctaactttcgtactgtttctctctttggcattcggcgcatcctacggaactggaggtagaatgatgaactgccctaaaattcttagacagctgggtagcaaagtgcttcttccactaacttatgagcgtataaataaatccatgaataaatccatccacatcgtggtgaccatggccaaatccttagagaactcagtggaaaacaagatcgtgtccttggacccaagcgaagccggtccccccaggtacctcggggacaggtacaagttctatctcgaaaacttaacactgggtatccgggagtcgcggaaggaagacgaggggtggtacctgatgacacttgaaaagaacgtcagtgtacagcgtttttgcctgcagctgagattgtatgagcaggtgtccaccccagagattaaggtgttgaataaaacgcaggagaacggaacatgtaccctcatccttggctgtaccgtggaaaagggcgatcacgttgcttactcctggtccgaaaaggcaggtacccatccactcaaccctgctaactcctcacatctcctgagcctaaccctgggccctcagcacgcagacaacatctacatatgtacggtgtccaatcctatcagtaacaattctcagaccttttccccatggccagggtgtaggactgatccttctgaaactaagccttgggctgtatatgccgggctcctcggtggtgtcataatgatccttatcatggtcgttattctgcagcttagacgcagaggaaagaccaatcactaccagacaacagtcgagaaaaaatccttgaccatttacgctcaggtgcagaagcccggtgattcgcaccatcagactagtgatctgttttag

SEQ ID NO: 134404 - DNA, 435 bp, Artificial Sequence
  Description of Artificial Sequence: Synthetic coding sequence
atggacccgaagggacttctttctctcacctttgtcttattcctgagcctggccttcggggcctcctatggtactggtggtcgaatgatgaattgcccaaagattttgagacagctgggtagcaaagtactcctgccgctgacttacgaaaggattaataaatcaatgaataagtccattcacatagtcgtgactatggctaagagcctagaaaactctgtggaaaacaagattgtgtcactcgaccctagtgaggctgggcctcctcgctatctaggcgaccgctataagttctatctggaaaacctcactcttggtatccgggagtcacggaaggaggacgagggatggtatctgatgaccctggagaagtccctccatttcggatatctgtactttgtcctgggagccgaccatgataatttgcagacttag

SEQ ID NO: 134405 - DNA, 810 bp, Artificial Sequence
  Description of Artificial Sequence: Synthetic coding sequence
atggaccctaaaggcctactgagcctgaccttcgtattgtttcttagcctggccttcggggcctcgtacggtactgggggcaggatgatgaattgtcccaagatcctgcgtcagctgggcagcaaggtgctcttgcctctgacctatgagagaatcaacaaatctatgaataaaagcattcacattgtggttaccatggccaagagtttggagaacagtgtagagaataagatcgtatctctcgatccatctgaagccggacctcctcggtacttgggcgataggtataaattctatctcgaaaaccttactctcgggattcgcgagagtcgcaaagaggacgagggctggtatctaatgaccctggaaaagaatgtcagtgtgcagcgtttctgtctgcagctgcggctgtacgaacaggtgagcactcctgagatcaaggtcttgaacaagacccaggagaacgggacatgtaccttgatcctcggctgcaccgtggagaaaggcgaccacgtggcatactcttggtcggaaaaagcaggaacacacccgcttaatccggccaactcatcacatctgcttagccttacattgggaccgcagcacgccgataacatatatatctgcaccgtgagcaatcctatctcaaacaactctcagacattcagcccatggccaggttgccgtaccgatcctagtgaaacgaaaccatgggccgtttacgcagggctgctcgggggagtgattatgatactgattatggtcgtcatactgcagctgcgtcggagggcctcttcggaagagacttag

SEQ ID NO: 134406 - DNA, 1029 bp, Artificial Sequence
  Description of Artificial Sequence: Synthetic coding sequence
atgtgtagtaccatgagcgctccgacctgcctggcacacttgcccccttgtttcttgctgctggcgctcgtcctggtaccatccgacgcgtcaggtcagagtagcagaaacgattggcaggttctgcaaccggagggaccaatgctagtcgccgagggggaaactctgctgctcagatgcatggttgtgggctcttgtacagatggcatgataaagtgggtcaaggtgtccacccaggatcaacaagagatctataacttcaagagaggctctttccctggtgtcatgccaatgattcaaagaacaagcgaaccattaaactgcgactactccatttatatacacaacgtgactcgtgagcatacaggaacttaccactgtgtgcgatttgacggcttaagtgagcattccgagatgaaaagcgatgagggcaccagtgtcctggtgaaaggcgccggggaccccgagcccgatctgtggataatccagcctcaagagctagttttaggcacaacaggcgatactgtgttcttaaactgcacggtgctgggtgacggcccacccggccccatcagatggttccaaggcgccggattaagccgggaagctatttacaatttcggcggaatctctcaccctaaggagactgccgtccaggcatccaataacgactttagcatcctgctgcagaacgtgtcgtcagaggacgcggggacttactactgtgtgaaattccagaggaaaccgaataggcagtacttaagcggccaaggtacctccctaaaggtgaaggctaaaagcaccagtagtaaagaggccgagttcacgtccgagccggccaccgagatgtcacccactggacttctcgtggtgttcgcccctgtggtgctaggcctgaaagctataacactggccgccctgttgctggctctagctacgagccgccgctcaccgggccaggaggatgtgaaaactactggaccagcgggggcgatgaacactcttgcctggtcaaaagggcaagaatag

SEQ ID NO: 134407 - DNA, 624 bp, Artificial Sequence
  Description of Artificial Sequence: Synthetic coding sequence
atgtgtagcacgatgagcgctcctacctgcctcgcccatctacccccctgctttttactgttggcactggtgctggtccctagcgacgccagcgggcaaagttctagaaacgactggcaggtacttcagcctgaggggcccatgttagtggccgagggcgctggtgatccagagcctgacctgtggattattcagccacaagagctggtgttgggtacaactggagatacagtttttttaaattgtacagtcctgggagatggccctccaggccctatccgctggttccaaggcgctgggctgtcaagggaggccatttacaactttggtggtatttcacacccaaaagaaactgcagtgcaggcttcaaacaacgacttttctatcctcctgcagaatgtcagcagtgaggacgccggcacgtactattgcgtgaagttccaaagaaagcctaacaggcaatatctaagcggccaaggcacttccctcaaggtaaaggagcagaacttgcctcttccaaagaggcaaaactctcctgtgaatctccagttgagatgcttgcaacaggtttcggtccctacaagcgtagagtcaatgagcccaccacaggcaagagggccatag

SEQ ID NO: 134408 - DNA, 624 bp, Artificial Sequence
  Description of Artificial Sequence: Synthetic coding sequence
atgtgtagcaccatgtcagcgccgacatgcttggctcacctgccaccatgcttcctgctgctggcactagtcttagtaccgagcgatgcttcgggccagagttctcggaatgattggcaggttttacaaccagaaggaccaatgctggtagctgaaggcgccggggaccccgaacctgacctttggatcattcaaccccaggaactcgtgctgggcaccactggtgacaccgtgtttctcaattgcaccgtcctgggagacggtccacctggacccattcgatggttccagggtgctgggctgtctcgggaagccatttataatttcggaggcatcagccaccccaaggagactgccgtgcaagcgagtaacaatgatttttcaatcctcctgcagaatgtgtcttccgaggacgccggtacatactattgtgtgaagtttcagcgaaaaccaaatagacagtatctctctggccagggcacatctcttaaggtgaaagaacaaaacttgcccctccctaaacggcagaatagccccgtgaacctacagctgagatgcctgcaacaggtgtccgttcctacctctgtggaaagcatgagtcccccacaggcccgcggtccttag

SEQ ID NO: 134409 - DNA, 735 bp, Artificial Sequence
  Description of Artificial Sequence: Synthetic coding sequence
atgtgctctaccatgtccgctccaacatgcctggcacacctccccccttgctttctgctgctcgcactggtgttggtgccaagtgatgcaagcggccagagcagcaggaatgactggcaggtgctgcagcctgagggaccaatgctcgtggccgagggcgctggagaccctgagcccgatctctggattattcagcctcaagaactagtgctcggtacaaccggagacactgttttcttaaactgcaccgttcttggcgatggacccccgggccctattcgttggttccagggggccggcctgtcacgggaagccatttataacttcggcggcataagtcaccctaaagaaacagcagtgcaggccagtaacaacgatttcagcattctgctacaaaacgtctcctcggaagatgccgggacctactattgtgttaagttccagagaaaaccaaatagacagtaccttagtgggcagggtacatccctgaaagtgaaggctaaatctacaagctcaaaggaagcagagttcacttctgaacctgcgaccgaaatgtcccctaccgggctgttggtagtgttcgcacccgtcgttctaggcctgaaagccatcacactggctgccttgcttttagccctggctactagtcggcgctcgcctgggcaggaggatgtcaaaacaacaggccctgctggggcaatgaataccttggcctggtctaaggggcaggaatag

SEQ ID NO: 134410 - DNA, 633 bp, Artificial Sequence
  Description of Artificial Sequence: Synthetic coding sequence
atgaaaagcgacgagggcactagcgtccttgtgaaaggggcgggagatcccgaacccgacctttggatcatacaaccacaggaactcgtgctaggcacgactggggacacagtgtttttgaattgcaccgttctcggggacggaccacccgggcccattcggtggttccagggggccggactctctcgtgaggcaatttacaacttcggtggcatcagccatcccaaggagaccgcagtgcaggcatccaacaacgacttcagcatattgcttcagaacgtcagttccgaggatgccggcacgtattactgcgtgaagttccagaggaaacccaaccgtcagtaccttagcggccaaggaacctccctaaaggttaaagctaagagtacatcctccaaagaagccgagtttacaagcgagcccgcaacagaaatgagtcccactggcgaacgtacacacctcagcggcgtgaacgagtcccctaccgggaaaggtgcaatgaatggcctcgttatgggccgggagcagtcccagaccccgggagcaaacctgccaccgaggatgctgccaggccttcacctcaattgtcgtactaggactcctgaaaaccacgtgattactgcccagctgtag

SEQ ID NO: 134411 - DNA, 2046 bp, Artificial Sequence
  Description of Artificial Sequence: Synthetic coding sequence
atgaacgcatcttccgaaggagagtcatttgccggtagcgtgcaaattccaggcggtactaccgtgctggtggaactgacacccgatatccacatctgtgggatctgcaagcaacagttcaacaacctcgatgcatttgtcgcccataaacagtcagggtgtcagctgactggaacttctgctgcagccccctccactgtccagttcgttagcgaagagaccgttcccgccactcagactcaaactactacccggacaataacgtccgaaacacagacgatcacagtttccgctcccgagtttgtcttcgagcacgggtatcagacttatcttccaaccgagagtaacgagaaccagaccgcgacagttattagcctacctgctaagagccgcacaaagaagcccaccacccctcctgcccagaaaaggctcaattgttgctaccctgggtgccaattcaagacggcctatggcatgaaagatatggagaggcacttgaaaattcatacaggagacaagccacataaatgtgaagtttgcggtaaatgtttttctagaaaagacaaattgaagacccatatgcggtgccatactggagtgaaaccatataagtgtaagacttgtgattacgctgctgcggattctagtagtctgaacaagcatctgcggatacactcagacgagcggccatttaagtgccaaatctgcccttatgcatcacggaactccagtcagctgactgtgcacctacgttcccacactggagatgcccctttccaatgctggttgtgctccgctaaattcaagatctcttctgatctgaaaaggcatatgcgggtgcactccggtgaaaagccattcaagtgtgagttctgcaacgtgcgctgtactatgaaaggcaatcttaagtcacatataagaatcaagcactccgggaataatttcaagtgtcctcactgcgacttcttgggagatagcaaggccacgctccgcaaacacagtcgcgtgcaccagagcgagcatcctgaaaagtgcagtgagtgctcttactcctgctcttccaaagccgccctccgtatacatgaacgaattcactgtactgaccggcccttcaaatgcaactactgctcgtttgataccaagcaaccgagtaacctgtctaaacacatgaagaagttccacggtgacatggtgaaaactgaggctctggaacgcaaagacaccgggaggcagagctctaggcaggtcgccaaattggacgccaagaagtcattccattgcgatatctgtgatgccagctttatgagggaggattccctgcgcagccacaagcggcagcattcagaatactccgagtccaagaattcagacgtgactgtgcttcagtttcagattgaccctagtaagcagcccgcaaccccactaacggtgggacaccttcaggtgcctctgcagcccagtcaggttcctcaattcagtgaaggtcgagtgaaaatcattgtcggacaccaggtgccccaggccaatactatcgtccaggccgccgctgctgccgtcaatattgttccacctgcacttgtagcacagaatccggaggaactgcccggcaatagccggttacaaatcttgaggcaagtatctctcatcgcccctcctcagtcctcccgttgtccctctgaagcaggagcaatgacccagccagctgtgctgttgacgacccacgaacagactgacggcgctacacttcaccagaccttaatccccactgcgtcaggaggcccccaggagggtagcggaaaccagacattcatcacaagcagcggtattacatgcaccgacttcgagggcctgaacgcgctgatccaggaagggacggcagaggtcacggtggtgagcgacggaggacaaaacattgccgttgctacaaccgccccccctgtattctcctcctcttctcagcaggagctgcccaagcaaacttacagtattattcagggcgcagcccatcctgcgctgctttgtcctgccgactcaatcccggactag

SEQ ID NO: 134412 - DNA, 1164 bp, Artificial Sequence
  Description of Artificial Sequence: Synthetic coding sequence
atgccagtccccgcatcctggccgcaccctccaggtcctttcctgctccttactctcctgttgggactgaccgaggtagctggggaagaagagctgcaaatgatacagcctgagaaacttctactggtcacggtggggaaaactgccaccctacactgcaccgtgacttctctactccctgtcgggcctgtactttggttccgaggagtgggccctgggcgagagctgatatataaccagaaggaggggcattttccccgtgtgaccaccgtgagcgacctgaccaagcgtaacaacatggacttctcaatcaggattagctccatcacaccggcagatgtgggcacgtattattgcgtgaagtttcgcaaggggtccccagagaatgttgagttcaagtccggccctggcactgagatggcgttaggcgccaaacccagcgcgccagtagtgctgggaccagccgcccgcacaacaccagaacacacggtgtcgttcacctgcgaaagccacggctttagcccaagggacataaccctgaaatggtttaagaatggcaatgaactttccgattttcagactaacgtcgaccctaccggccaatctgtagcttactctatccggtcaaccgcccgggtggtactcgatccatgggacgttcgcagtcaggtaatttgtgaagtggcccacgtgacactgcagggagaccccctgcggggtacagctaacctgagtgaggcgatacgcgttccacccactttggaggtgactcagcagcctatgagagttgggaaccaggtcaatgtgacctgtcaggtccgcaaattctatccccaatccctccagctgacctggagtgaaaatggcaatgtttgtcagagagagacagccagtactcttactgaaaacaaagacggcacatataattggaccagctggttcctagtcaatatctccgatcagcgggacgatgtggtgctgacatgtcaagtcaaacacgatggccagcttgctgttagcaaacggcttgctcttgaggtcactgtgcatcagaaggaccagagcagcgatgccacccccgggccggcaagcagccttaccgcgctcctgctgatcgccgtactgttaggcccaatctacgttccttggaaacagaaaacgtag

SEQ ID NO: 134413 - DNA, 513 bp, Artificial Sequence
  Description of Artificial Sequence: Synthetic coding sequence
atgccagttccagccagctggccccaccccccgggaccctttctcttattgacattattgcttggacttacagaggtagccggagaggaggagttacaaatgattcagccagaaaagctgcttctggtaaccgtgggaaagacagccacactacattgtactgtgacatctcttctgcccgtgggcccagtgctctggttccggggggttggccccggcagggagctgatttacaaccaaaaggagggtcacttccctagggttacgacggtgtccgacctgacaaagcgcaacaacatggacttcagcatcagaatttcaagcattactcctgccgatgtgggcacttattattgtgttaagtttaggaaggggtcacctgagaatgtcgagtttaaatcaggccctggcacggagatggctcttggtggccccgcttcctcactaacagcactccttctgattgcagtcttgctagggccgatttatgttccatggaagcagaagacatag

SEQ ID NO: 134414 - DNA, 1065 bp, Artificial Sequence
  Description of Artificial Sequence: Synthetic coding sequence
atgattcaaccagagaagctgctgctggtgacagtcggcaaaacagcaaccctgcactgtacagtgacctccttgcttcccgtcggccctgtcctttggttcaggggtgtggggcccggacgcgaactgatctacaatcaaaaggagggacattttccacgcgtcacaactgtgagtgatcttactaagcgcaacaatatggatttctccatcaggatttcttccattaccccagcggatgtgggcacgtactattgcgtcaaattccgcaaaggatccccggaaaacgtggagttcaagtcagggccgggaaccgaaatggccttgggcgccaaaccaagcgcccctgttgtattgggcccagctgctcgaacaactcccgaacacactgtttccttcacctgcgagagccatgggttctcgcccagagacatcactctgaaatggtttaagaacggaaacgaactgtccgatttccaaactaatgttgaccccaccggccagagtgtggcttattctatccgatccactgctcgggttgttctcgacccatgggacgttcgttcccaggtcatatgtgaggtagcccacgtcacacttcagggcgatccactacgtgggacggcaaatctctcagaggcaatccgcgttcctccaacgcttgaagtgacgcaacaacctatgagggtcggaaaccaagtgaacgtcacctgccaggtcagaaagttttacccccagtctttacagctcacttggtcagagaacgggaatgtttgtcaaagggagaccgcctctacacttacagagaacaaagatggaacctataactggacaagctggttccttgtcaatatcagcgaccaacgagacgacgtggtcttaacatgccaagtcaagcacgacggccagctcgccgtgagcaagaggcttgcacttgaagtgactgtccatcagaaggaccaaagttcggacgccacccctggccccgcctcttccttaacggcccttctcctcatcgctgtgctcctggggcccatatacgtgccttggaaacagaagacctag

SEQ ID NO: 134415 - DNA, 831 bp, Artificial Sequence
  Description of Artificial Sequence: Synthetic coding sequence
atgcctgtgcctgccagctggccccatccccctggacctttcctcctcctgaccctcctgttgggtctcactgaggtggccggagaagaggaattgcaaatgatccagccagagaaattactgctggttactgtcggaaagactgcaacactgcattgtactgtgacatctttgctccccgtagggcctgtgctctggtttaggggcgttgggcctgggcgggagctgatatataaccagaaggaaggccactttcctagggtgaccactgtgagcgatctcactaagaggaataatatggacttcagtatccgaatatcatccatcaccccggcagatgtgggcacctattactgtgtcaaattcaggaagggcagtcccgagaatgtggagtttaaaagcggccctggtaccgaaatggccctaggcgctaaaccatcagctcctgttgtacttgggcctgcagcacggacgacgcctgaacacacagtctcttttacctgtgagagtcacggattctctcccagagacatcacgctgaaatggttcaagaacggcaatgaactgtcagattttcagaccaatgtggaccctaccggccaatcagtggcttatagtatccggagcacggctcgggtggtgctggatccttgggacgtaagatcccaggtcatatgtgaagttgcccacgttacactccaaggggaccctctgcggggtaccgctaacttgagcgaggcgatacgggggcccgcgagttccctgactgctctgctgctgatcgcagtgttgctgggccccatttatgtcccctggaagcaaaagacgtag

SEQ ID NO: 134416 - DNA, 1386 bp, Artificial Sequence
  Description of Artificial Sequence: Synthetic coding sequence
atggctccccagtctctaccttccagccggatggcgccacttggcatgcttttggggctgctgatggcggcttgcttcaccttctgcctttctcaccagaacctaaaggagtttgctctgaccaacccggagaagagttctactaaggaaaccgagaggaaagagaccaaggcagaggaggagcttgatgccgaggtactcgaggtatttcaccctacgcacgagtggcaggccctccagcctggccaggccgtaccagccggtagccacgttagactcaatctgcagactggggagagagaagccaagttacagtatgaagataagtttcgcaacaacctgaaagggaagcgactggatattaatactaatacctatacatcgcaggacctcaagtcagccctggctaagtttaaagagggagccgaaatggagtcctccaaagaggataaggctaggcaggctgaggttaaaaggctgttccgaccaatagaggaattgaagaaagactttgatgagttaaacgtcgttattgagacagatatgcagatcatggtcaggctgatcaataagttcaacagttcgtcgtcatccttagaggagaaaatagcggcgctgttcgacctcgaatactatgtccaccagatggataatgctcaggacctcctgagctttggtggtttacaggtagttattaacggacttaactccaccgagccccttgttaaggagtatgctgcttttgtgcttggggctgccttctcctccaacccaaaagtgcaggttgaagctatcgagggaggcgcgctgcaaaagctgctcgttatccttgctactgagcagcccctgacggccaagaagaaagttctcttcgcattatgtagcctgctgcgtcacttcccatacgcacagagacagttcctgaaacttggcgggcttcaagtcctgcgaaccctggtgcaagaaaaaggtactgaagtgctagctgtacgggttgtcacattgttgtatgaccttgtgactgagaagatgtttgccgaggaagaagccgagttgacacaggagatgagcccagagaaactgcagcagtacaggcaggtgcatcttctgccgggcctgtgggagcagggctggtgtgagattactgctcacttgttagcacttccagaacatgatgcccgggagaaggtcctgcagacactgggcgtgctgctgactacatgtagggaccgctataggcaggacccacagctcggcagaaccttggcctctctgcaggccgagtaccaagtcctcgcatcactcgaacttcaggacggagaagatgagggttacttccaggagctgcttggttctgtgaactcactgctgaaggagctcagatag

SEQ ID NO: 134417 - DNA, 1386 bp, Artificial Sequence
  Description of Artificial Sequence: Synthetic coding sequence
atggcaccacaatcactgccatcttcgaggatggctccgttgggaatgttactgggtctgctcatggctgcttgcttcacattttgtctgtcacaccagaatttaaaggaatttgccctcaccaacccagaaaagtcctcgaccaaagaaaccgagagaaaagagacaaaagccgaagaggaactggatgccgaggttttagaggttttccatcccacgcacgagtggcaagccctgcaacctggccaagctgtccctgcaggctcacatgttcggcttaatctgcagaccggagaacgggaggcgaagttacagtacgaggacaagtttagaaataacctgaaggggaaacggctggacataaataccaacacgtacaccagtcaggaccttaaatccgccctggcgaaattcaaggaaggcgcggaaatggaaagctccaaggaagacaaggcacgacaggccgaggtcaagcggctgtttagaccgatcgaggaacttaagaaggactttgacgagctaaatgtggttatcgaaaccgacatgcagataatggtaagactgatcaacaaattcaattcttctagttcctcgttggaggagaagatcgcagccctcttcgaccttgaatactacgtgcatcagatggataacgctcaggatctgctgtccttcggggggcttcaggtcgtcataaacggcctcaacagcaccgagccattggtgaaggagtacgccgcgtttgtccttggcgcggccttttcaagtaatcccaaagtccaggttgaggctatcgagggcggtgcattacagaaactgttggtcatcttggccacagaacaacctttaactgctaagaaaaaggtattgtttgccctgtgttcgctgctccggcacttcccctacgcacagcgacaattccttaaactcggaggtctgcaggtgttgcggactcttgtccaggaaaagggtacggaggttttagcagtgagggttgtaaccctgctgtacgaccttgtgaccgaaaagatgtttgcggaggaagaagccgagctcactcaggaaatgtcccctgagaaacttcagcaatatcggcaggtgcacctgctcccaggtctgtgggagcagggctggtgcgaaatcaccgcccatcttttagccctcccagaacatgatgcacgcgaaaaagttctgcagacgctcggcgtcctattaactacttgtcgggaccgctacaggcaggacccccagttgggccggaccctcgcctccctgcaggctgagtaccaggtactggcatccctggaactgcaggatggcgaagatgaggggtattttcaggagctcttggggtcagtaaacagcctgcttaaggagctgcggtag

SEQ ID NO: 134418 - DNA, 288 bp, Artificial Sequence
  Description of Artificial Sequence: Synthetic coding sequence
atggccccacagtccctgcccagttctaggatggctcctctcgggatgctgctggggcttcttatggctgcatgttttacattttgcctgagtcaccagaacctgaaagagttcgcccttacgaatcccgaaaagtcttctacaaaggagacagaacggaaagaaaccaaagctgaggaagagttggatgccgaagtgctggaggtgttccatccgacgcatgaatggcaggcactgcagcctgggcaggctgtcccagccggcagccacgtccggcttaacctatag

SEQ ID NO: 134419 - DNA, 492 bp, Artificial Sequence
  Description of Artificial Sequence: Synthetic coding sequence
atggctccacagagtctgccctcttctagaatggctcctctcggtatgctgctcggccttctgatggctgcgtgcttcacgttctgtcttagccaccagaatcttaaagagtttgccctgactaacccagagaagagctccaccaaggaaacagaaagaaaggagacaaaagccgaggaggagctggatgcagaggttctcgaggtcttccatcctacccatgaatggcaagccctgcaacccggccaagcagtacccgcaggatcccatgtccgactgaatcttcagacgggggaacgggaggctaagcttcagtacgaagataagtttcgcaataaccttaagggcaaacgactggatattaatacaaatacatacacctctcaggatctaaaaagcgcactagccaagtttaaggagggagccgagatggaatcgtctaaagaagataaagctaggcaggctgaggtgaaacggctgtttagaccttag

SEQ ID NO: 134420 - DNA, 372 bp, Artificial Sequence
  Description of Artificial Sequence: Synthetic coding sequence
atggcaccacaatctctcccaagctcccgcatggcacccctggggatgttactgggccttcttatggctgcctgttttactttctgcctatcccatcagaacttaaaagagtttgccctcaccaacccagagaaaagcagcaccaaagaaacagagagaaaagaaactaaagcagaagaggagctcgatgccgaggtcctggaggtgtttcatcctacccatgagtggcaggctctacagccaggccaagctgtgcccgctggaagccacgttcgcctgaacctccagacgggcgaaagagaggccaagctgcaatacgaagataagtttagaaacaaccttaaggggaaacgcctcgacataaacacttag

SEQ ID NO: 134421 - DNA, 579 bp, Artificial Sequence
  Description of Artificial Sequence: Synthetic coding sequence
atggcagcatgctttaccttctgcttgtcacatcaaaaccttaaagaattcgccctgacgaatccagagaaatcttccacaaaggagacagagagaaaagagactaaggctgaggaggaacttgatgctgaagtgctggaagtattccaccctactcatgagtggcaagcacttcagcccggtcaggcagttcccgctggatcccacgttagacttaatcttcagactggagaaagagaagcaaaactgcagtacgaggataagtttaggaataacttgaagggtaaacgccttgacattaacacaaatacatataccagccaggatctaaaatccgcccttgctaagttcaaggagggagcagagatggagagttcaaaggaggataaaatggacaatgctcaagacctcctgtccttcggcgggttacaggtggttatcaatggactgaactccactgagccgctggtaaaggagtatgctgccttcgttctgggcgccgccttctcgagtaaccccaaggtgcaggttgaagctatcgagggaggagcactacagaaattactggtgatactttag

SEQ ID NO: 134422 - DNA, 3822 bp, Artificial Sequence
  Description of Artificial Sequence: Synthetic coding sequence
atgaagcggcggctggacgatcaggaaagcccggtttatgccgcacagcagcggcggatcccaggaagtactgaggccttcccgcaccagcatagggtgctggcccccgccccgccggtgtatgaagcagtgagtgaaacgatgcagagtgctaccgggatacagtactcagtgacaccatcctaccaggtttccgcaatgccccagagtagtggctcacatggccctgcaatagcggcagtgcacagttctcatcaccatcccacagccgtgcagccacatggcggtcaggtggttcagtctcatgctcacccagctccaccggtggcacctgtgcagggccagcagcagttccagcgattgaaagttgaagacgccctgagttatctggaccaagtcaagctgcagtttggctcacagccccaagtgtataacgacttcctcgatattatgaaggaattcaaatcacagagtattgatacacccggcgtcatttcgagggtgagccagctgttcaagggtcaccccgacttgattatgggttttaatacatttctccctccgggatacaagattgaagtgcagacaaacgatatggtcaacgtgactactccgggccaggttcatcagatccctacccacgggatccagccccagccacagccccccccacaacatccctcacaaccatctgcacagtcagctcccgcccctgctcaaccagcccctcagccaccgcccgctaaagtatccaagccttcccaacttcaggcgcatacccccgcctctcagcagacccctcctctgccaccctacgcctcaccacgatctcccccagtccagccccataccccagtgacaatttcactgggaactgccccatcactgcagaataaccaaccggttgaattcaaccacgctataaactacgtgaataagattaagaacaggttccaaggccagcccgatatttataaggcttttctggaaattcttcacacctaccagaaagagcagcgaaacgcgaaggaggcaggtggaaactacacgccagcactgactgagcaagaagtgtacgcacaggtggccagactgttcaaaaaccaggaagacttactctcagaatttgggcaatttttgccagatgctaacagcagtgttctgctgtctaagactactgccgagaaggtcgatagcgtgcggaacgatcacggtggaacagtcaaaaagcctcaactcaacaataaaccacagcgaccctctcagaacgggtgccagattaggagacatcctaccggaacaactccaccagtaaaaaagaaacccaaactgttaaatctgaaagattcatctatggcagacgcctccaaacacggcgggggcactgaatctctgttcttcgacaaagtgcgaaaggccctgagatctgccgaggcatatgagaattttttacgctgtctcgttatcttcaatcaagaagtgatctcaagagcggaattagtgcaactggtgagcccctttctggggaaatttcccgagctatttaactggttcaaaaacttcctagggtacaaggagagcgtgcacctggagacgtatcctaaggagagggccaccgagggcatcgccatggagatagactacgcctcatgtaagcgccttggtagctcatacagggccctacctaagtcttaccagcagccgaagtgtacaggaaggacccccctttgcaaggaggtcctgaatgatacatgggtgagtttcccctcctggtccgaagattccacctttgtgtctagtaaaaaaacccagtatgaggagcatatttatcggtgcgaggacgaacggttcgagttggacgtggtcctggaaaccaatttagcaacaatccgggtcctggaagcaattcaaaagaagctgtctcgcctctcggcagaagagcaagcaaagttcaggctggataacacactcggaggaacttccgaagttatacaccgaaaggccctgcagagaatttacgcagacaaggcagccgatataattgacggcctccgaaaaaatccgagcatcgctgtgcccatagttctgaagcgactaaaaatgaaagaagaagagtggcgggaggctcagcgtggttttaacaaagtgtggagggagcagaacgaaaagtattatctgaagtctctggatcaccagggtatcaacttcaagcagaatgacacaaaggttctgcgaagcaagagtttgcttaatgaaatcgagtccatctacgacgagaggcaagagcaagccaccgaggaaaatgctggggtgcccgtgggtccccacctaagcctcgcctacgaagacaaacagatcctggaggacgccgctgcccttatcattcatcatgtgaagaggcaaaccggcatccaaaaggaagataagtacaaaattaagcagatcatgcatcattttattccagatctcttattcgcccagcgcggtgacctgagcgatgtggaggaggaagaagaagaggaaatggatgttgacgaggcgactggtgctgtaaaaaagcataacggagtaggagggagccctcctaagtctaaattgcttttctcgaacacagccgctcaaaaactgcgggggatggacgaggtttacaatttattttacgttaataataattggtacatctttatgcgactacatcagattctgtgccttcgattactgcgcatttgctcacaggcagaacgacagatcgaagaagagaaccgcgaacgggagtgggaaagggaggtgctaggcatcaaaagggacaagtccgactcccctgcaattcagctccgactgaaggagcctatggacgtggacgtggaggactattaccctgcttttctggatatggtgcgcagtctactagacggtaatatcgatagctcccagtatgaagacagcctgagggaaatgttcactattcacgcatatatcgctttcacgatggataaacttattcaaagcatagttaggcagttgcaacacatcgtaagcgacgagatctgtgtgcaagtaaccgacctctacttggctgagaataacaacggagccacaggcgggcagctcaatactcagaacagcagaagtcttctggagagtacctaccaaagaaaggcagagcagctgatgagtgacgagaattgttttaaactgatgttcatccaatcacaagggcaggtacagctcaccattgagctgctagacacagaggaggaaaattccgacgatcccgtcgaggcagagcgatggtctgattatgttgaaaggtacatgaatagtgataccacatcccctgagctgagagaacatctagctcaaaaaccagtcttcctgcctcggaacctgcgcagaattcgcaaatgccagcggggccgggagcagcaggagaaggagggaaaggaggggaattctaaaaagacgatggaaaacgttgactctctcgacaagctagagtgcaggtttaaattgaactcatataaaatggtttacgtgattaaatctgaggattatatgtatagacgcacggccctactgagagcccaccagagccacgaacgcgtatctaaaaggctccatcagagatttcaggcatgggttgacaagtggaccaaggaacacgttccaagagagatggcagccgaaacaagtaagtggctgatgggtgagggtctcgaaggactggtgccctgcacgacaacctgcgataccgagactctccactttgtttccatcaacaaatatcgggtcaagtacggtactgtattcaaggcgccatag

SEQ ID NO: 134423 - DNA, 3822 bp, Artificial Sequence
  Description of Artificial Sequence: Synthetic coding sequence
atgaagaggcgactggatgaccaagaatcccccgtctacgctgcacagcaaagacgcatacccggatccaccgaggccttccctcatcagcatagagtgctcgcgcctgccccaccagtgtacgaggccgtctctgagaccatgcagagtgcgactggtattcagtactccgtgacaccctcctaccaggtttccgctatgcctcaaagctcgggatcacacggcccagccattgccgctgtgcattcatcccatcaccacccaacggcagtacagccgcacgggggccaggttgtgcagagccatgcccacccagccccacctgtggcacccgtccagggccagcaacagtttcagcggctgaaagtcgaggacgcgcttagctacctggatcaagtaaaattacagtttggcagccagccgcaggtgtacaacgactttctggatatcatgaaggagttcaagtcccagtcaatcgacacacccggcgtaatatcaagagtaagccaactgttcaagggtcacccagacttaatcatgggctttaacactttcttgccacctgggtacaagattgaagttcagactaatgacatggtgaacgtaactactcctgggcaagtacaccagattcccacccacggcattcaaccccagccacagcctccgccccaacacccaagccagcctagcgcccaatctgcaccagcacccgcacagcctgccccacagccaccaccggccaaagtgagtaagccgagtcaactgcaggcgcacaccccagccagccagcagactcccccccttcccccctatgcttctccccgcagccctcctgtgcagccccacacgcctgtcacgatttcactgggcaccgcccccagtttgcagaataaccaacctgtagagttcaatcatgcgataaactatgtaaacaaaatcaaaaacaggttccagggacagcccgatatttacaaggcttttctggagatactccacacctaccagaaagagcagcggaatgccaaggaagctggcgggaactacactccagctttaactgagcaggaagtgtatgcccaagtggctcggctgtttaaaaatcaagaggacttactgtctgagtttggacagttcctcccagatgccaactcgtctgtgctgttaagcaagacgaccgctgaaaaagtggactcagtcagaaatgatcatgggggcactgtcaagaagccacaactgaacaacaaacctcagagaccctcccagaatggctgtcagatcaggcgccatcccacgggaaccactccaccagtgaagaagaagccaaagctgttgaatctgaaggattcctctatggctgacgcttctaaacacggcggaggcactgaaagcttattcttcgacaaggtgaggaaagcgctgcgtagcgctgaagcttatgagaactttctacgatgcctcgtcattttcaaccaggaggtaattagccgagccgagctcgtccagcttgtctccccctttcttgggaagttccctgagctctttaattggtttaaaaattttctaggctacaaggaatcagttcatctggagacttacccaaaagagagggccaccgaaggcatcgccatggaaatcgactacgcttcctgcaagaggctgggcagctcctatagggccctgcccaagagctaccaacaacctaaatgcacaggaagaactccactgtgcaaggaagtcctgaacgatacatgggtatcctttccaagctggagcgaagacagcacatttgtgtccagcaagaagactcaatacgaggagcatatatacagatgtgaggacgaaagatttgaactggacgtggttctggaaaccaacctggctaccatccgagtgttggaggctatccagaaaaagctgagtcgtctctctgcagaagagcaggcaaagtttagactagacaatacgctcggcggaacctcggaggtgatccatagaaaggcattacagcgtatatatgcagataaagccgcagacataattgacggtctgagaaagaatccgagtatcgctgtccctatcgtgcttaaaagactcaaaatgaaggaggaggagtggagagaggcccagcgcggattcaataaagtttggcgtgagcaaaatgaaaagtactatttgaaaagtcttgaccaccaaggaataaatttcaagcagaatgataccaaagtgctacgctccaagtctctcctgaacgaaatcgagtcaatatatgatgaaaggcaggagcaagctacagaggagaatgcaggcgttcctgtcgggcctcacctgagtctggcctacgaagacaaacagattttggaggacgccgctgccttaatcatccatcacgtgaaaaggcagactggcatccagaaggaggataagtacaaaataaaacaaatcatgcatcatttcattccagatcttttgtttgcgcagaggggggatctgtcagatgtggaagaggaggaagaggaggaaatggacgttgacgaagccaccggtgcagtcaaaaagcacaatggagtggggggctctcctcccaagtccaaactgctctttagtaataccgccgctcagaaactgcggggtatggatgaagtgtacaatctcttttatgtgaataataattggtacatcttcatgaggcttcatcagattctgtgccttcggctcctgcgcatttgcagccaagccgaaagacaaattgaggaggagaaccgggagagggagtgggaaagggaagttctaggtatcaagcgggacaagagtgactcccccgcgatccaactcagactgaaagagcctatggatgttgatgttgaggactactatcctgccttcttggatatggttaggagcctcctcgacggcaatattgactcctcccagtacgaagactccctccgtgagatgtttacgatccacgcatacattgcatttaccatggacaagcttatccagtctattgtgagacagctccagcacatagtgtccgacgagatctgtgtacaggtgaccgatctgtacctggctgagaataacaatggggcaacgggcggccagctgaatacgcagaatagccgctccctgctggaatcaacatatcagagaaaggcggagcagctgatgagtgatgaaaattgctttaagcttatgtttattcagagccaggggcaggttcaactgacaattgaacttctggatactgaggaggaaaatagcgatgaccccgttgaagcggaacgttggagtgattatgttgaacggtatatgaatagtgatactacatctcccgaattgcgggagcacctggctcaaaaaccagtattcttgccgcggaacttacgacgcatcagaaaatgtcagcgcgggcgcgagcagcaggagaaagagggaaaagaagggaacagtaaaaaaactatggaaaacgtagattccctggataagcttgaatgtcggtttaaactgaatagctacaagatggtgtacgtaataaagtctgaagactatatgtaccggcgaaccgccctgctgcgtgcacaccagtcacacgagagggtgagtaaacggctgcaccagaggtttcaggcttgggttgataagtggacgaaggaacacgtcccacgggagatggccgccgaaacgtctaagtggctcatgggcgaagggctcgaaggcctggtgccatgcaccaccacttgtgatacagaaaccctgcattttgtgagtattaacaaataccgggttaaatatgggacagtttttaaggcgccttag

SEQ ID NO: 134424 - DNA, 3822 bp, Artificial Sequence
  Description of Artificial Sequence: Synthetic coding sequence
atgaagaggcgcttagacgaccaagaatccccagtttacgccgctcaacagaggcgaattcccggctcaacggaagctttcccacaccaacaccgcgtgttggcacctgccccgccagtctacgaggctgtttcagagactatgcagtcagccaccgggattcagtacagtgtcactcccagctaccaggtgagcgctatgccacagtcaagtggcagtcatgggccagcgatcgccgcggtacattcttcccatcatcatcccacagccgtccagccacacggaggtcaggtggtccagtctcacgctcatcccgctccccctgttgccccagtccagggtcagcagcagtttcagcggctcaaggtcgaggatgctctttcatacctagaccaagtaaagctgcaattcgggtcacagccccaggtctataatgatttcctagatattatgaaagagttcaagagccaaagcatcgacaccccaggagtgattagccgggttagccaattgttcaagggccatcctgacctcattatggggtttaacactttcctaccacccggctacaagatcgaggtccagactaacgatatggttaacgttacaacacccggtcaggtgcaccaaatccccacacatggtatccagccccagccccaacctcccccccaacatcctagccaaccctcggcccagagtgctcctgctcctgctcagcctgctccccagcctccaccggctaaggtgtcaaaacctagccagctgcaggcacacacccctgccagccagcagacgccgccattgccaccctatgcttccccgagaagccctccagttcagccacatactcccgtgactatcagccttggcactgccccatccctacagaacaatcagcccgttgagtttaaccatgcaatcaactacgtcaacaaaattaaaaataggttccaagggcagcctgatatatacaaggcatttctggagatcctgcatacataccaaaaagaacaacggaacgctaaagaagccggtggtaactacacacccgccctgacagaacaagaggtctatgcacaggttgcccggctgtttaagaaccaggaggatttactcagtgagtttggccagttcctgcctgacgcaaactcctcagtgcttctgagcaaaactaccgcagagaaggtagattctgtacgcaatgaccacgggggcacagtcaagaagccccaattgaataataaaccacagaggccgagccagaacggatgccagatccgcagacatcccaccggcacaacaccaccagtgaaaaagaaacctaagttgctgaacttgaaggattctagcatggcggatgcctctaagcatggtggcggcaccgagtctctgtttttcgataaagtgcggaaagctctcagatctgcagaggcctatgagaacttcttgagatgtctagttatatttaaccaggaggtgatttctagagccgagctcgttcagctcgtttctccattcctaggcaaatttcctgaactttttaattggttcaagaacttcctgggatataaggagtcggtccatttggagacctatcccaaagagagggccacggagggtattgccatggaaatcgattacgccagttgtaagaggcttgggtcctcttatagagccttacccaagagctaccagcagcctaaatgtacaggtagaaccccactgtgtaaggaggtcctaaatgacacctgggtctcgttcccaagctggtccgaggatagtaccttcgtgtcttcaaaaaagacacaatacgaggaacatatctacagatgtgaagatgaacggttcgagctcgatgtggtgctggagacgaacctcgccacgatccgcgttctggaggcaattcagaagaagctttcaaggctgtcggccgaggagcaggcaaagttcaggctggacaatacactgggaggcacttcagaagtgattcatcgcaaggccttgcaacgaatctatgctgataaagcggccgacattatcgacggcctgcggaaaaacccttctatagctgtccccatcgtgttaaaacggcttaaaatgaaagaggaggagtggcgagaagcacagagagggttcaacaaggtatggcgggaacagaatgagaagtattacttaaagtccctggatcaccaggggatcaatttcaagcaaaacgataccaaggttcttcgctcaaagtccctgctgaatgaaatcgagagcatttacgatgaacgtcaggaacaggcaaccgaggaaaatgcaggggtgcctgttggcccccacctgtccctggcatatgaagacaaacagattctcgaagatgcagccgccctgatcatccaccatgtcaagaggcaaaccggcatacaaaaggaggacaaatacaaaataaagcagataatgcatcacttcattcctgacctcctgttcgcacagcgaggtgatctgtccgacgtggaggaagaagaggaggaagagatggatgttgacgaagctacgggggcggttaaaaagcataacggggtgggcggaagtccccctaaatcaaaattactattcagcaacacggccgctcagaaacttagaggcatggatgaagtatataatctcttctatgtgaataacaattggtacatcttcatgagactgcatcagatcctgtgtttacgactgctgcgaatctgttcccaagcggagcggcagatcgaggaggaaaacagagaaagggaatgggaacgggaagtgctgggcatcaagcgtgacaagagtgattccccagcaatacagctgcgcctcaaagaacccatggatgttgacgtggaggattactacccagccttcctcgatatggtgcgcagcctgctggacggcaacatagacagctcacaatatgaagatagcctcagagaaatgtttactattcacgcctacatcgcttttaccatggacaagctcatacagtcgattgtgcggcagcttcaacacattgtctctgacgaaatttgcgtccaggtcacggacctgtatcttgctgaaaacaataacggtgccactggcggccaactgaatacccaaaactctcggtccctacttgagagcacgtaccaacgtaaggctgagcagttaatgagtgacgagaattgtttcaagctcatgtttatacagtctcagggacaagtgcagctgaccatagagctgctggacaccgaagaggaaaactctgatgatcctgtagaagcagagcgttggagcgactatgtggaacgttatatgaattcggataccacaagcccagaactgcgagagcacttagctcaaaagccagtcttcctacctcgaaacctgcggcggatacgaaagtgccagagaggaagggagcaacaagagaaggaagggaaggagggtaatagtaagaaaacaatggagaacgtggattctctagacaagttagagtgccggtttaagttgaattcctacaagatggtctacgtcatcaaatcagaggattacatgtaccgccgcactgcgctgctcagggcccatcaaagccacgaaagagtgtccaaaaggctgcatcagagattccaggcctgggttgacaagtggacaaaggagcatgttcccagggaaatggcggccgaaacatctaaatggcttatgggcgaaggattggagggcctggtgccctgcaccactacctgtgacacagagacacttcacttcgtgtctatcaataagtacagggtgaagtatgggactgtcttcaaggccccttag

SEQ ID NO: 134425 - DNA, 3393 bp, Artificial Sequence
  Description of Artificial Sequence: Synthetic coding sequence
atggcgcacgccggtggtggatctggggggtccggggccggtggtcctgctgggcgcggcctgagcggtgctcggtggggacgctccgggtcggccggacatgagaagctgcccgtccatgtggaggacgcactcacttacctagaccaggtgaagatccggttcggatctgacccagctacttataacggatttctagaaatcatgaaggaattcaaatcacagagtatagatacgccaggcgtgatcagaagggtgtcccagttgttccacgaacatcccgaccttattgtgggattcaatgcgttcctgccactaggataccgaattgacatccccaagaatgggaaactgaatatccagtctccgctgaccagtcaggagaactcccataatcacggagacggtgcagaggacttcaagcagcaggtcccttataaggaggataagccacaagtacctcttgagtccgatagcgtcgaatttaataatgccatttcatatgttaacaagataaaaacccgatttcttgatcatcccgaaatctatcgaagttttcttgagattctgcatacgtatcagaaagagcagctaaataccagggggcgcccattccgagggatgagcgaagaggaggtgttcaccgaagttgcaaacctgtttcgtggccaggaagaccttttgtccgagttcgggcagtttctgccggaggctaaaagatctttgtttacaggcaacggcccttgtgaaatgcactccgtgcagaagaacgaacacgacaagacaccggaacattcccggaagagatcgaggccaagcttgctgagaccggtgagtgcgcctgcgaaaaaaaagatgaaactgcggggaacaaaggacttatcaatcgcggcggtcggcaaatacggcacactgcaggaattctcgttctttgacaaggttcgcagggtgttaaaatctcaggaggtctacgagaacttcttgaggtgcattgcgttattcaaccaagagctcgtgagcggatctgaactgctccaactggtttctccattccttggaaaattccctgagctgttcgcccagttcaagtccttcctgggagtgaaagagctgtcattcgcaccaccaatgagcgacaggagtggcgacggcatatcccgcgaaatcgattacgcgtcgtgtaagcgcataggcagctcctaccgggccctgcccaagacctatcagcagccaaagtgttccggacgtaccgcgatctgcaaagaagtgctgaatgacacttgggtgagcttccctagctggtctgaggattctacattcgtttcttctaaaaaaacaccatatgaagagcagctgcatcgctgtgaggatgagaggttcgagctcgacgtggtgcttgagaccaacctggccacgattagagtcttggagtccgttcagaaaaaactgagccggatggcccctgaagaccaagaaaaatttagactcgacgactccttgggtgggacgtccgaagtgatccagcgccgggccatatatcggatctatggtgacaaagcgccagagatcatcgaaagtctgaagaaaaatcctgtaaccgccgtgcccgtggtcctgaagagattgaaggcgaaggaggaggaatggagggaggcccagcaggggtttaacaagatctggcgcgaacagtacgaaaaggcctatttgaagtcacttgaccatcaggctgtgaactttaaacagaacgacaccaaggctctccgctcaaaatcgctcttgaacgaaattgaatcagtgtatgacgaacaccaggagcagcattctgaaggaagaagcgctcccagcagcgaacctcatttgatttttgtatatgaggacagacagatccttgaggacgcggccgcactgatcagctattatgtgaagcgacagcccgccatccagaaggaggatcaaggcaccattcaccagctcctccaccagtttgtgcccagtttgtttttcagccagcaactggatctgggtgcttcagaggagagcgcggacgaggacagagactctccacagggtcaaacgacagatccgtcagaaagaaaaaagcctgcccccggaccccactctagcccacctgaggaaaagggagctttcggcgacgctcccgcaacagagcagccccctttgccacccccagcgccgcacaaacctctcgacgatgtctactctctgttcttcgccaataataactggtatttctttctacggctgcaccaaaccctgtgtagccgcctgttaaaaatttaccgccaggcgcagaagcagctgctggagtacaggactgaaaaagaaagagaaaagctgttatgtgaagggcgaagagaaaaggggtcggaccctgctatggagttgcggctgaagcagccctccgaagtggaactggaggaatactatccagcattcctggacatggtcaggtctctacttgaagggtcaatagatcccacccaatatgaggacaccttaagagaaatgttcaccattcatgcctacgttggctttaccatggataaactcgttcaaaacattgccagacagttgcatcatctcgtctccgacgacgtgtgtttaaaggtagttgagctctatttaaatgagaaaaagcgaggtgctgccggagggaatctgagctccagatgcgtcagagctgcacgggaaacgtcctatcagtggaaggccgaaagatgtatggcagacgagaattgtttcaaagtgatgttccttcagcggaagggacaggtcattatgacaattgagctgctagacactgaagaagcgcaaacagaagatcccgtggaggtccagcacctagccaggtatgtagagcagtacgtcggcacagaaggggcttcctctagcccaaccgagggttttctgttaaagcctgtgttcttgcagcgaaacctaaagaaattccggcgcagatggcagtccgagcaagcccgtgccttgagaggcgaggcccggagcagctggaaacggcttgtgggcgtagaatcagcctgtgacgtcgattgtcggttcaagctttccactcataagatggtatttatcgtcaattcagaagattacatgtatcgtaggggcacgctgtgtagagccaagcaagtgcagcccctagtcttgctgcgacatcatcagcattttgaagaatggcattctcggtggttagaagataacgtgaccgtggaggctgcaagcctcgtgcaggattggctgatgggcgaagaagatgaagacatggtgccttgcaagacactgtgtgaaacagtgcacgtccacggtcttcctgtcacacgttaccgtgtgcagtactcccgtaggcctgcatccccttag

SEQ ID NO: 134426 - DNA, 3489 bp, Artificial Sequence
  Description of Artificial Sequence: Synthetic coding sequence
atggctcacgcaggaggcggctcaggggggtctggggccggagggccagctggtagaggattgagtggcgcccgatggggaagaagcggctctgccggccacgaaaagttacctgtgcacgttgaggatgcgcttacctatctcgatcaagtgaaaataagatttggctccgatcccgccacgtataacggtttccttgaaatcatgaaggaattcaaaagtcaatccattgacacacccggggtcattagaagggtgagccaactatttcacgagcacccggatctcattgtgggctttaatgcttttctgccccttggttatcgtatcgacattccaaaaaacggtaaactgaacatccagagccctctaacatctcaggagaattcccataatcatggcgatggagcggaagacttcaaacagcaagttccctacaaggaggacaaacctcaggttcccttagagtccgattcagttgagttcaataacgccatatcttacgttaataaaatcaaaacccggttcctagaccacccagagatctaccgcagctttcttgaaatcctgcacacctaccagaaggaacaactcaatacaagagggcgccctttccgagggatgtctgaggaagaagtgtttactgaggtggctaatctgtttagggggcaggaggatctgctaagcgagttcggccagttcctacctgaagccaagagatccctgttcaccgggaacggcccatgcgagatgcactccgtgcagaaaaacgagcacgataagaccccagagcacagtcgtaaacggagcaggccatccctgctccgcccggtgtccgcccctgccaagaaaaagatgaaactgcgggggaccaaagatctgtcgattgcagcggtgggtaaatacggcactctgcaagaattctccttcttcgacaaggtgcggcgcgtcctgaagagccaggaggtctacgaaaattttctgcggtgcattgccttattcaatcaagaactcgtcagcggtagcgagctcctccaattagttagtcctttcctggggaagttccctgagctgtttgctcaattcaaaagctttcttggggtaaaggagctgtcttttgcccccccaatgagtgatcggagtggagacggcatatctagagaaattgattacgcctcctgcaaacgtattgggtcgagctacagggccctgccaaagacctatcaacagccgaaatgttcggggcgaactgccatatgtaaagagcttgaccattggacgttactgcagggctcatggactgatgactactgcatgagtaagttcaaaaacacctgctggatccccggatattctgccggagtgcttaatgatacctgggtgagtttcccatcatggagcgaggacagcactttcgtctcgagtaaaaagaccccctatgaagagcagttacatcggtgcgaggacgagcgtttcgagctggatgtcgtcctcgagacaaacctggccactatccgtgtcctagagagcgtgcaaaaaaagctgtctcggatggctcctgaagaccaggaaaagttcagactggatgactctttggggggcacgtcagaggtgatccagcggagggcaatctaccgtatctatggagataaggctccagaaattattgaaagcctgaagaagaatcctgtgactgccgtccccgtcgtcctgaagagattgaaagctaaagaggaggagtggcgggaggcccagcagggcttcaacaagatttggcgagagcagtacgagaaagcctaccttaagtcccttgatcaccaggctgtgaactttaaacagaatgacacaaaagcccttcgctctaaatctctgttgaatgaaattgaaagtgtatatgacgaacatcaagagcaacactcagaaggccgaagcgctccctctagtgaacctcacttgatttttgtgtatgaagatcgccagatcctagaagatgcagcagctcttattagctactacgttaagaggcagcccgcaatccagaaagaggaccaaggcacaatacaccagcttctgcaccagttcgtgccatcactgttcttctcccagcagctggacctcggggcaagtgaagagtccgcggatgaggaccgggattctccccaggggcaaacaactgatccttccgagaggaaaaagcctgcaccgggccctcattcctcacctcctgaggaaaagggagcttttggagatgcccctgccaccgagcagcctccccttcccccacctgctccccataagcccctcgacgacgtttattctctgttttttgctaacaataactggtatttttttcttaggttgcaccagacgctgtgttctaggttactcaaaatctacaggcaggcccagaagcaattgctggaatacagaacagagaaggaacgcgaaaaactcctgtgcgagggtcgccgagaaaagggctcagatcctgctatggaattgcgacttaaacagccttcagaagtggaactggaagagtattatccagctttcctggacatggttagatctctgctggaaggctcaattgacccaactcagtatgaggataccctcagagagatgtttactattcacgcttatgttgggttcaccatggataagctggtgcagaatattgcaagacagttgcaccatcttgtgtctgacgacgtctgtctcaaggtagtcgagttatacctgaacgagaagaagcgaggggccgccggcggtaacctaagttcacgctgcgtgcgggcagcaagagagacttcataccaatggaaagctgagaggtgtatggccgatgagaattgtttcaaggttatgttcctgcagaggaagggacaggtgatcatgacgatcgagctgctggacacagaagaagcccagacggaagaccctgtggaagttcagcatctggccaggtacgtcgaacagtatgtagggactgagggagccagtagcagcccaacagaggggttcttgttaaagcctgtatttctacaaaggaacctgaaaaaatttagacggaggtggcaatccgaacaggccagagcactgaggggcgaggcacggtcttcctggaaacgcctggttggggtggagagtgcatgtgacgtggactgcagattcaagctttcaacacataagatggtgtttatagttaactctgaagactacatgtacagaagaggcactttgtgcagagccaaacaggtgcagccactggtgctgctcagacatcaccaacattttgaagagtggcatagtcggtggctcgaggacaacgtaacagttgaagctgctagtctggtgcaggactggctgatgggggaggaggacgaagacatggtgccatgtaaaacactgtgtgagacggttcatgttcacgggctccctgtcacccgctaccgtgtccagtattccagaaggcccgctagtccctag

SEQ ID NO: 134427 - DNA, 3171 bp, Artificial Sequence
  Description of Artificial Sequence: Synthetic coding sequence
atgtctagccagcaatttccacgattaggagccccatctacaggtctgtcacaggcgcctagccagatcgcaaattcaggctcagccggcctgataaatcccgcggcgactgtgaatgatgaaagcgggcgggactccgaggtctccgcccgcgagcacatgagcagctctagctctctccaaagtagggaagagaaacaagagcccgtggtggttcgaccctaccctcaggttcagatgttgtccactcatcacgcagtggcctcagctactcccgttgccgtgacggccccaccagcacacctaacccctgctgtcccactttccttttctgagggactgatgaaaccgccgcccaagcctaccatgccctctcggccaatcgctcccgcccctccatccacactgtcattgcctcctaaagtgcctggacaggtgacagtaacaatggaatccagcatcccacaggcatctgcaatcccagtggccacaatctccggtcaacagggtcacccgagcaacctgcaccatattatgacaaccaatgtccagatgtcaattatcaggagcaacgctccagggcctcccttgcatattggtgccagtcatcttccacgcggtgccgcagccgccgcagtgatgtctagcagcaaggtgaccacagtcctcagacccaccagtcagctgccgaacgctgctaccgcacagcccgccgtccagcacatcatccaccagccaatccaaagtcgcccgcccgtcaccacttctaatgcaatcccgccggccgttgtagccaccgtctccgccactagggctcagagtcccgtgatcacgacaaccgctgcccatgccacagacagcgcactcagcagacccaccctgagtatacagcacccccctagcgctgccatttccattcagcgcccggcccaaagcagagatgtgaccacccgaatcaccctccctagccaccctgcgctggggacccccaagcagcagctgcacaccatggctcagaaaacaatcttctccaccggtactccagtggctgcagctaccgtcgcccccatcttggccaccaacaccataccatccgcaaccaccgcaggctccgtgagtcacacccaggcgccgactagcaccatagtcactatgaccgtaccgagccattcaagccatgccacagctgtgaccacatcaaacattcccgtggcaaaagtggtcccccaacagatcacccacacatcgccgagaatacagcctgactaccctgcagagaggtcttctttgatccctatcagcggccaccgtgcatcccccaaccccgttgccatggaaacacgctctgacaataggccttctgtccctgtgcagtttcagtactttctgccaacatacccgccttctgcatacccactggcggcacatacatacacacctattacttccagcgtctccactatccgccaatatcctgtttctgctcaagccccaaatagcgctatcactgcccaaactggggtcggtgtggcctcgacagttcatctgaacccgatgcagttgatgacagtcgacgctagccatgctcgacacatccaaggcatacagcccgcaccgatatcgactcagggcatccagcctgctcccattggcactcctggtatacagcctgctcccctgggtacgcagggcatccacagcgctactcccataaacacccagggcctgcagcctgcacccatgggtacccagcaacctcaacccgagggtaagacttctgtcgtccttgctgatggcgccaccatagtggcaaatcccattagcaatccattttcagctgctcccgccgctaccacagtggtgcagactcatagccagtctgcttcaaccaacgctcccgcacaaggaagcagtccccggccatctatcctaaggaaaaagccagccactgacgggatggcagtgcggaagaccctcatccctccccaaccccctgacgttgcctcccctcgagttgagagtagcatgcgctcaacatctggaagcccaagacccgcaggagcgaaacctaagtcggagatccacgtttctatggctactcctgttactgtgagtatggagactgtgtcgaaccagaacaacgaccaacccactatcgcagtgcccccaaccgcccagcagccgccacccacaattcccactatgatcgcagcggcttcacctccttcgcagcctgctgttgcgctgtcaaccatccctggggccgtccctattaccccaccgatcactacgattgctgcggcccctccaccctctgttaccgtgggcgggtctctctcatcggtgttggggccccccgtccccgaaataaaggtcaaagaggaagtagaacctatggatatcatgcgacccgtttctgctgtgcctcccttggcgaccaacacagttagtccctcactggccttattagctaacaatttgtccatgccaacatcagacctccctcccggagcgtccccacgcaaaaaacccagaaaacagcaacacgtcatctcaaccgaggaaggcgacatgatggagaccaattctactgacgacgaaaagtcaacagcgaagagcctgctcgtcaaggccgagaagcggaagagcccacccaaggagtatatcgacgaggaaggggtgcgatatgtaccagtacgtccgcggccccctatcacgctgttacgccattaccggaacccctggaaggctgcctaccaccacttccagcgctactcggatgttcgggtgaaagaggaaaaaaaagccatgctacaagaaatcgctaatcagaagggcgttagctgtcgggctcaaggctggaaagtccacctctgtgcggcccagctgctgcagctgactaacttggagcatgacgtgtatgagcgcctgaccaatcttcaggaaggcatcattcccaagaagaaagcagctactgatgatgatttgcaccggatcaacgagctcattcaggggaacatgcaaaggtgtaagctggttatggatcagatctccgaagcaagggatagtatgctgaaagtcctggatcacaaagacagggtgttgaaattgctgaacaaaaacggcactgtgaaaaaagtttccaaattaaaaagaaaggagaaggtgtag

SEQ ID NO: 134428 - DNA, 3147 bp, Artificial Sequence
  Description of Artificial Sequence: Synthetic coding sequence
atgggcccacctcgacatcctcaagcaggcgagattgaagccggcggggcaggcggagggaggaggctccaggtcgaaatgtccagccaacaatttccgaggctcggcgcaccatccaccggactgagtcaggcacccagccaaatagccaattccggctcggccggactgataaaccccgccgcaacggtcaacgatgagtctggcagagactctgaggtttcagcccgagagcacatgtcaagcagcagctctctgcaatctcgagaggagaagcaagaacctgttgtagtacggccctaccctcaagtgcagatgctaagtacccatcatgcggtcgccagcgctaccccagttgctgtgaccgccccaccggcacacttgacacctgccgtgccgctctcattcagcgaaggtctcatgaaaccccctccgaagcctactatgcctagtcgccctatagctcccgccccccctagcaccttatctcttccacccaaagtacccggccaggtcaccgttactatggaatcctctatcccgcaggccagcgcaattccagtggccacaatctccggacagcagggccaccccagtaacttgcatcatattatgaccaccaatgtacaaatgagtatcatccgtagcaatgcgcccggcccccctctccatattggagcttcccacctgcccagaggggccgcagctgccgctgtgatgtcatcttctaaggttacaacagtacttcgacccacgtctcagctgcctaacgctgctactgcccagcctgccgtgcagcacattattcatcaacctattcagtctaggcctcccgttactacttcgaacgcgatacctccagccgtggtcgccacagtaagtgcaaccagggcgcagagccccgtgatcacaacgacagccgcccatgctactgatagtgctctcagtcggcccacccttagtatccaacacccgcccagcgctgccatttccatccagaggccagctcagagtagagacgtgactacgcgcatcacgctgcccagccatcctgccctcggcacaccgaagcaacagttgcataccatggcccagaaaacaattttcagtaccggtacaccagtcgctgctgcaaccgttgcccctattctggcaactaacactattccgtcagcaaccactgccgggtcagtgagtcacacccaggcccctacgagtacaattgtgaccatgaccgttccatcacattctagccacgctactgccgtgacgacatccaatataccggtggccaaggttgtccctcagcaaatcactcatacgagccccagaattcaacccgactatcccgctgaaagatcgtctcttattccgatttccggccaccgtgcctctccgaatcctgtggccatggaaacgcgatctgacaacagaccttcagttccagtccagtttcagtactttcttccaacttaccccccttcagcctacccgctcgctgcgcatacatacactccaatcacttcctcagttagcacaatacggcaatacccagtgtccgctcaggcccctaactcagccatcactgcccagactggcgtgggtgttgctagcacagtccatctgaatccgatgcagttaatgacagttgacgcttcacatgctaggcacattcagggaatccagccggcccctatctccacacaggggatccagccagccccaataggtacgcctggcattcagccggcccctctcgggacccagggcattcactcggcaacacccattaatacccaagggcttcagcccgccccaatgggcacccaacaaccgcagcctgagggaaagacatctgctgttgtgttggcggacggcgccactatcgtagccaatccgatcagcaacccctttagcgcagctccagccgcaacaacagtcgtgcagacacactcccagagcgctagcactaacgctcctgctcaaggctctagtccccgacctagcatcctgcgtaaaaagcctgcaactgatggggctaaacccaagtctgagattcatgtgagcatggctacgcccgttacagtttcaatggagacagtgtcaaatcagaacaacgatcagccgacaatcgcagtgccaccaactgcacagcagcctccaccgacaatccctaccatgatcgcagcagcctctcctccatcacagccggccgttgccctgagtactatacccggagctgtgcctattactccacctattaccaccattgcggccgctccacccccaagtgtcaccgtgggtgggtcactgtccagcgtgctgggacctcccgttcccgagatcaaagtcaaagaggaagttgagccaatggatattatgcggcccgtatcggcagtcccgcccctggccacgaatactgtcagcccctctctggctctcctggcgaataacctgagcatgcccacctcagatctcccgccaggggcgtctccgcggaaaaaacctcgcaagcaacaacacgttataagcaccgaagaaggggacatgatggagactaatagcacggatgacgagaaatctaccgcgaagtcccttctggtaaaggcagaaaaacgtaaatccccccccaaggagtatatcgacgaagaaggcgtcaggtacgtcccagtgcgccccagaccccccatcaccttgcttaggcattataggaatccgtggaaagcagcgtatcaccatttccagaggtactctgatgtgagagtcaaggaggagaagaaggctatgttgcaggaaatcgctaatcagaagggcgtttcctgtagagcacagggatggaaagttcatctgtgtgcggcgcagctgcttcaattaacaaacttggaacacgacgtgtatgaacgcttgaccaacctgcaagaagggatcatcccgaaaaaaaaggccgccacagatgatgacttacatcgaataaatgagctgatacaaggaaacatgcaaaggtgcaagctcgtgatggatcagattagcgaagctagggatagtatgctaaaggtcttggaccacaaggacagggtactcaagttactgaacaaaaatggaacagtgaagaaagtgtcaaagcttaaaaggaaagaaaaggtctag

SEQ ID NO: 134429 - DNA, 3252 bp, Artificial Sequence
  Description of Artificial Sequence: Synthetic coding sequence
atgggtccccccagacatccccaggccggtgaaatagaggctggtggtgcaggcggaggcagacggctgcaggtggagatgtctagccagcaattccctcgcctgggcgccccctctactggcctgtcccaggctccatcacaaatagctaatagcggttccgctggtcttatcaatcctgctgcaaccgtgaacgacgagtcaggaagagattcagaggtctccgccagggagcatatgtcatcaagcagttcacttcagtcccgcgaggaaaagcaggagcctgtggtagttcggccatatcctcaggttcagatgctcagtactcaccatgctgtggcatcggctacgcctgtggccgtgactgcaccccctgcgcatcttacgcccgctgtaccactctctttttcagagggcttgatgaaacctccccctaagccaaccatgccatcacgtcccatcgctcccgccccaccttcaacactctcactgccgccgaaagttcctgggcaggtgaccgtgaccatggaatcctccattcctcaggccagcgctatccctgtggctactatctcgggacagcagggacatccctctaacctgcatcatattatgaccaccaacgtgcagatgtccattattcggtctaatgcacctggcccacctctccacatcggggccagtcatcttcctcgcggagctgctgccgcagcagtaatgagcagcagcaaagtgacgaccgtattacgcccaacttcccaactgcctaacgccgcaacggctcaaccagctgtacagcatatcatccaccagcccatccaatctcggccacccgtgaccacatcaaatgctatcccaccggccgtcgtcgctaccgtgagcgcaactagagcccagtctcccgttataacgactacagctgcacatgcgacagactcggcactgtcacgccctaccctatctatacagcaccccccgtccgctgctatcagcattcagcgccccgcacagtcccgggacgtgactacacggatcactctgccatcgcacccagctcttggtaccccaaagcagcaactgcacaccatggcccagaaaaccatttttagcaccggcacccctgtggctgccgccaccgtggcccctatcctggccactaatacaatacccagcgcaacaacagcaggatcagtttcacatacacaagcccccactagcaccatcgtgaccatgactgttccatctcacagctcacacgcaacagccgtaacaacaagtaatatacccgtggctaaagtggtgccccaacaaattacccacaccagtccacgcatccagcccgattacccggccgagagatcatcgcttatcccgatttcaggccatcgcgcttcccctaacccagtggcgatggaaacccgctccgataatagaccatcagtcccagtccagttccaatatttcctccccacctacccccccagcgcatacccactcgctgcccacacatacactcctattaccagttctgtgtcaacaatccgccaataccctgttagcgcgcaggccccaaattcggccatcacagcccagacaggcgtgggtgtcgcttcaactgttcatttaaatcctatgcaactgatgaccgttgacgcatctcatgccagacacatacaagggatccaacctgcacccatttcgacacagggcatccagcccgctccaatcggcacacctggtattcaaccagctccccttgggacccagggtattcattcagccacccctatcaatacccaaggcctgcagcccgcccctatgggtactcagcagcctcaacctgaaggtaagacgtcagccgtggtactcgcagacggtgccaccatcgtggccaacccgatatccaatccttttagcgccgcacccgctgctacgaccgtcgttcagacacactcccagtcagcaagcaccaacgcacccgcacagggctcaagtccccggccctctattctgcgtaaaaaacctgcaaccgatggcatggccgtcaggaagacactgattccgccacagccacctgacgtagcgtctccacgcgtggaatcgagcatgcgcagcacaagcggttcaccgaggccagccggtgcgaaaccaaagagcgagatacacgtgagcatggcaacccctgttacggtaagtatggaaacagtaagtaaccagaataacgaccagcccacaatcgccgtacctccaacagcccagcagccccctccaacaatccctactatgattgctgccgcatcacctccaagccagcccgccgtggccctcagcaccatcccgggtgctgtgcctatcacccctccaatcactaccatcgccgcagcacctcctccgtcggttacggtcgggggcagccttagctcagtcctggggccccctgttcccgaaattaaggtcaaggaagaggttgagcccatggacataatgcgccctgtgagtgctgtcccccccctcgcgacaaacaccgtgagccctagtctagcgctattggccaacaacctttcaatgcctacctctgatttgccacctggggcatccccacgcaaaaaaccacgcaaacagcagcatgtgatcagcactgaagagggcgacatgatggagaccaactcaaccgatgacgaaaagagtacagccaaatcgcttttggtcaaggccgaaaagcgtaagtcgcccccaaaagaatatatagatgaagaaggcgtaaggtatgtgccagtgaggccccggccaccaattaccctgctaaggcactaccgcaacccctggaaagctgcataccatcatttccagcgctattctgatgttagagtgaaagaggaaaagaaagcaatgctccaggagattgccaaccagaagggtgtgtcttgcagagcccaggggtggaaggtccacctttgtgccgcgcagttactccagctgaccaatctggaacacgacgtgtacgagcgactgactaaccttcaggaggggattattccaaagaagaaagcagcaacggacgacgatttgcaccgcattaatgaattgatccaggggaacatgcagaggtgtaaactcgtgatggaccagatctccgaggcccgcgattccatgcttaaggtcctggaccacaaggaccgtgtgctgaagctcctgaacaaaaacgggacggtgaagaaggtgagcaaactaaagaggaaagaaaaggtctag

SEQ ID NO: 134430 - DNA, 789 bp, Artificial Sequence
  Description of Artificial Sequence: Synthetic coding sequence
atgtctagccagcagtttcctcggctcggagctccctctaccgggctgagtcaggctccatctcagatcgcaaattcgggctccgcagggctcataaatccagcagccactgtgaacgatgagtccgggcgggacagcgaagtcagtgctcgcgagcacatgtcaagcagctcttcactacagtccagggaggagaagcaggaacccgtggtcgtgaggccgtacccacaagtgcagatgctttctacacatcacgccgtggcgtcagcaaccccagttgccgtcacagcaccacctgcccacctaacccccgcagtacctctcagctttagcgagggcctaatgaagccgccccctaaaccaactatgccttcacgtccaattgcacctgctccacctagcacactctctctgcctcccaaagtgcccggccaggtgacagttaccatggaatcaagcattccacaagcaagcgccatccctgttgcaacaatcagtgggcagcaaggccacccttccaacctgcaccacatcatgacaacaaatgtgcagatgtccataatccggtcgaatgctccgggcccacctttacacatcggagcgtcccatctccccaggggggctgctgccgcggccgtgatgtcttccagtaaggtcacgacagtgctgagacccacgtcacagttgccaaatgcagcaaccgcccaacctgccgtccagcatattatccatcagcctattcagagtagaccacccgtgacaacatccaacgctatccctcccgcctag

SEQ ID NO: 134431 - DNA, 630 bp, Artificial Sequence
  Description of Artificial Sequence: Synthetic coding sequence
atgaacccgtctatgaagcagaagcaagaggagattaaagaaaacatcaagaacagctctgttccacgcagaacactaaaaatgattcagccgtctgcaagcggcagtttggtgggcagagagaatgagctgtcagcgggcctctccaagcgaaagcatagaaatgaccacttaacttccacaacttcttccccaggcgtcattgtgccagagtcatctgagaataagaatctcgggggtgtgacacaggagtcatttgacctcatgatcaaggagaaccccagcagtcagtactggaaagaagttgctgagaagcgcagaaaagccctctatgaggcactaaaggagaacgaaaagctgcataaagaaattgagcagaaggacaatgagattgctcgactgaagaaggagaacaaggagctcgcggaagtggctgaacatgtgcagtatatggcagagttgatagagagactaaacggcgagcccctggataactttgagagtctggataatcaggagtttgatagtgaagaggagactgtggaagattccttggtcgaagactcagaaataggcacctgcgcagagggtaccgttagctcttctactgacgctaaaccttgtatctag

SEQ ID NO: 134432 - DNA, 2622 bp, Artificial Sequence
  Description of Artificial Sequence: Synthetic coding sequence
atggccgaaatggagaaggaaggacgtcccccggagaacaagaggagcaggaaaccggcccaccccgtgaagcgagagatcaacgaagagatgaaaaactttgcagagaataccatgaacgagttgcttggctggtatggctatgacaaagtcgaactgaaagacggagaggatatcgagttcaggtcttaccctacagatggcgagtcgaggcaacacatcagtgtgctgaaggaaaatagcctgccaaaaccaaaattgcctgaggacagtgtcatttctccctataatatcagcaccggctactctgggctggctactgggaacgggttgagtgattccccagcgggctccaaggaccacgggtcagttccaattatcgtgccgttgatcccccctccctttattaagcctcctgccgaagacgatgtgtccaatgtgcagataatgtgtgcatggtgtcagaaggtggggatcaagaggtacagtctgtcaatgggcagtgaggtcaagtccttttgctctgagaagtgttttgccgcgtgccgtcgggcgtattttaagagaaacaaagctagagacgaggacggtcatgccgagaatttccctcagcaacattatgcgaaagaaaccccgcgtctggcctttaaaaacaactgtgagctgctggtgtgcgattggtgcaagcacattcggcacacaaaggaatacctggacttcggcgacggcgaacgtagactgcaattttgctctgccaagtgtttgaatcagtacaagatggacatcttttacaaggagacacaggcaaacctgcccgcaggcctatgctccacgcttcaccccccaatggagaacaaagccgaaggcaccggcgtacagctgctcactcccgactcctggaatatcccgctgaccgatgccaggcggaaagcccctagtcccgtcgctaccgccgggcaatctcaggggccaggtccaagtgcaagcaccacagtgagtccaagtgatacagctaactgctctgttactaagataccaacccccgtgcctaagagcattccaatctccgagactcccaacatcccgcccgtatccgtgcagccacctgcctccattgggccccccctgggcgtaccaccccgaagccctccaatggtaatgaccaatcgaggtccagttcctctgccaatcttcatggaacagcagattatgcagcagatccgacccccatttattcgaggaccaccgcaccacgcttctaatcctaacagccccctgtccaatcctatgttgccgggcatcgggccgcctcccggcgggccacggaacttagggccgacatcaagtcccatgcaccggccaatgttgtctccacacatccatcctccctccaccccaactatgcccggcaatcccccgggactgcttccaccccccccacctggcgctcccttgcccagcctgccttttcctccggtctctatgatgccaaacggacccatgcccgttcctcagatgatgaatttcggactgcctagcttagcacctctcgttccacctccaacgctgctagttccgtacccagtgatcgtgcccctcccagtgcctatccctattcccatccctatcccccatgtttctgacagtaaaccccctaatgggttctcctccaatggcgagaattttatcccaaacgcccctggggacagcgccgcagccggtggtaaaccaagcggtcattccctttctcctcgagatagcaagcaaggctcctctaaatccgctgatagtccaccaggctgcagcgggcaggccctgtctcttgctcccaccccagctgagcacggtaggtcagaagtggtcgatcttacccgccgcgcgggttcccctccaggacccccgggtgccgggggccaactggggttccccggcgtccttcaggggcctcaggatggcgtgattgatctaacagtcggccaccgggcgagactgcacaacgtcatccatagggcactgcatgctcacgtgaaggcagaacgtgaaccctctgctgccgaacgaaggacatgcggcggctgtcgcgatggccactgttccccacccgcggccggcgaccctggcccgggcgctccagcaggtccagaggccgctgcagcgtgtaacgtaatcgttaacggcactagaggcgcagcagcagagggcgctaaaagtgccgagcctccccccgaacagccccccccaccacccccccccgccccccctaaaaaactgctgtcaccagaggagccggctgttagtgaactcgaaagcgtgaaggagaataattgcgcctctaactgccacctcgatggtgaagccgccaagaagctgatgggcgaggaggcgctcgcaggcggtgacaagtcggatcccaacttaaacaaccctgccgacgaagatcacgcttacgcactgcgaatgctccctaagactggctgtgtcattcagcctgtccccaagccagctgagaaggccgccatggccccatgtattatttcttccccgatgttgagtgcaggcccagaggatctggagccaccacttaagaggaggtgccttcggatacgcaatcagaacaaatag

SEQ ID NO: 134433 - DNA, 1233 bp, Artificial Sequence
  Description of Artificial Sequence: Synthetic coding sequence
atgccaggcgtgtgtgatagggcccctgactttttgagcccctctgaggatcaagtcctacgccccgctttggggtcaagcgtcgccctcaactgtactgcctgggtcgtgtccggcccacactgctcgctgccaagcgtgcaatggctaaaagatggccttccactcggtatcggagggcattattctcttcacgaatattcctgggttaaagcaaacctgtccgaggtgctggttagcagcgttctcggagttaatgtcacttctaccgaggtgtacggtgcttttacctgttctattcagaatatctccttcagttcatttaccttgcaacgagctggcccgacctcgcatgtggcggccgtactggcttccctgttagttcttcttgcactgctcctggccgccctgctatatgttaagtgccgactcaacgtgcttctgtggtatcaggacgcatatggagaggtggagataaatgacggtaaactctacgatgcctacgtcagttactcagattgccccgaagaccggaaattcgtcaactttattctgaaacctcagcttgagcggaggcggggctacaagctttttctggacgacagggatctgctccccagagccgaacccagtgccgacctgctcgtcaacttaagtcgttgcaggcgcctgatcgtggtgctctcagatgcatttctatcccgagcgtggtgtagccactcattcagggaagggttgtgccgacttctcgagctcacaaggcgccccatttttatcacctttgagggtcagaggcgcgacccagctcaccctgctcttcgcctgttgagacagcacaggcatctggtgacgttgctcctctggagacccgggtccgttacgccaagtagcgacttttggaaggaagttcaactggccctccctcgcaaagtccagtatcgccctgtcgaaggcgacccccaaacgcagctgcaggatgataaagatccgatgcttattctgaggggccgtgtccctgagggtagggctctggattccgaggtagaccccgatcccgagggggacctcggagtgcgaggcccagtctttggggaaccaagcgctcctccccacacgtctggcgtctcactgggcgagtcaaggagctcagaagttgacgtgagtgacttgggatcccgcaattactccgcacgtaccgacttttactgcctagtgtctaaggacgacatgtag

SEQ ID NO: 134434 - DNA, 1515 bp, Artificial Sequence
  Description of Artificial Sequence: Synthetic coding sequence
atgcccggtgtatgcgacagagcccctgactttctttcaccttccgaggatcaggtgctgcggcccgcgctagggtccagcgtcgccctgaattgtacggcgtgggttgtgtccggcccacattgttccctgccatctgtccagtggttgaaggacggtctacctctcggcataggaggccactattcactgcatgagtactcatgggttaaggccaacctgtccgaagtcttggttagtagcgtgctgggcgtgaacgtgacatctactgaagtgtatggggccttcacctgctcaatccaaaatattagttttagttcctttactctgcaacgcgcaggtccaacctcccacgtggcggctgtgctcgccagtttactagtgctcctcgccctgttgttggcggccctgctctatgtgaagtgccgcctgaacgtactgctgtggtatcaagacgcctacggtgaagtcgagatcaacgatggcaaactctatgacgcatacgtgtcttattcggactgtcccgaagatagaaaatttgtgaacttcattttaaagcctcagctggagcgccgtcgggggtataagttgtttcttgatgacagggacctgctgcctagggctgaacccagcgccgatctcctggtgaacttgagccggtgtaggcgcttgatagtggtactgtctgacgccttcttatctagagcctggtgctcccattcatttcgcgagggtctgtgccgactacttgaactgacacgacgacccattttcattaccttcgagggacaacgtagagatcctgcccatccagctctgcgcctgctgcgccagcaccgtcatcttgtcaccttgctgttatggcgtccggggagcgttacgccatcaagcgatttctggaaggaggtgcagctcgccctgcctaggaaagtccaataccgacctgtcgaaggtgacccacagacccagttgcaagacgataaagatccaatgttaatcctgagagggcgagtccccgaaggtagagccttggattctgaggtggatcccgaccctgaaggggatctcgggatgccagcccagccacactcccccaccggtgaagcacagcacagagcagaatggggccaggcacagggcacaggccctggcggggctcctggtgtagaggatagcagtcgtcatcgtgaacctttacatggtctatgtcccgggggcgcgcggccttcagtgtgccttggtacaagttgggctagccaggccatcacagccggcggcgagcaggggcaaccgttggccgtgggtctggggcaaggatgcggatggccaccacaagctagcaggagcccccaccctaggtgtccaggagcgtgcttgtggcgtgccatctcctccaccgcacaccaatgggggctcgccggtcgggagccagagcagagaagtggacggttgggttccaggttggctaagctgcagtgtccgcacagactcctgctgcctggcgtgcagggatag

SEQ ID NO: 134435 - DNA, 1233 bp, Artificial Sequence
  Description of Artificial Sequence: Synthetic coding sequence
atgcccggtgtttgcgacagggcacctgacttcctgagcccttctgaagatcaggtgctgcgacccgctctgggatcttccgtagcgcttaattgcaccgcctgggtcgttagcgggccccactgttccttaccatccgtccagtggttgaaagatgggttaccgctgggaattggtggacattactcattgcacgagtattcgtgggttaaggccaacttatctgaggtcctggtctccagcgtcctcggtgtaaacgtgacaagtactgaagtctatggcgcgtttacatgttccatacagaatatatccttcagttccttcacgctgcaaagagctgggcccacgagtcacgtggctgcagttctggcctctctgctggttctcctggcactcctcctggccgctctgctgtacgtgaagtgccggctcaacgtgctgctgtggtaccaagatgcctacggcgaagttgaaatcaatgacggcaagctatatgacgcctatgtatcgtacagcgattgccctgaagatagaaagttcgtaaatttcatccttaagcctcagctggagcggagaagagggtataaactgttcttagatgatcgcgatcttctgccccgtgcagaaccatctgctgatttgctggttaacctctcacgatgccggcgccttatcgttgtactgtccgatgcctttctaagtcgcgcctggtgtagtcacagcttccgcgaaggattatgtcgcctgctcgaactcacaaggcggcccattttcattacctttgaggggcagaggcgagatcccgctcacccagccctacggctcctgcggcagcacaggcatcttgtgacgttgcttctctggcgccctggatctgtgaccccatcctctgatttttggaaggaagtgcagctcgctcttccccgcaaggttcaatacagacccgtggagggggatcctcagacccaactacaggatgacaaggacccgatgctaattctgcgtggcagagtgcctgaaggccgcgctctggattccgaagtcgaccccgatcccgaaggtgaccttggcgtgagaggcccggtttttggggagcccagtgcacccccacatacgagtggtgtgagcctcggagaatcaagatcttctgaagtggatgtttcagatttggggtcacggaactacagtgcacgtactgacttctactgtctggtaagcaaggatgacatgtag

SEQ ID NO: 134436 - DNA, 1233 bp, Artificial Sequence
  Description of Artificial Sequence: Synthetic coding sequence
atgcccggcgtgtgcgatcgtgctcccgattttctgtctccgtcagaagatcaggtactcaggcccgctttgggatcatcagtagcactgaactgcacagcctgggtggttagcggcccccactgtagcttacctagtgtacagtggctgaaggacggcctgccgctagggataggcggccattattcactgcacgagtattcatgggtaaaagccaatttaagcgaggtattagttagctcagtactaggcgtaaacgtaacatctactgaggtgtatggagctttcacatgctccatccagaacatatccttctcttcttttactctgcagagagcgggccctactagtcacgtggccgctgtgctggccagtctgcttgtattgctcgcactactgctggccgctctgctgtacgtgaagtgcaggcttaacgtactgctgtggtaccaggacgcgtatggggaagtcgaaatcaatgacggcaagctatacgatgcatacgtcagctattcagattgtccggaggataggaagttcgtgaacttcatcctgaaaccccagcttgaaaggcgacgcggttacaagctgttccttgatgatcgggacctgctcccacgggcagagcccagcgcggacctgctcgtgaaccttagtcggtgccggaggctgatcgtggtgctgtcagacgcattcctcagtcgggcttggtgctcacattcattcagggagggactctgtcgtttactggaattgaccaggaggccaatttttatcaccttcgagggccagcggcgagaccccgcacaccccgcactgcgacttctgcggcagcatcgccacctggtcacgctgcttctgtggcggcctggaagcgtaacacccagtagtgatttttggaaagaagtacagctcgcactgccacgcaaggtgcagtacaggcccgtcgagggcgacccacagacacaactccaggacgacaaagaccctatgctgattttaagaggaagagtccccgaaggacgcgcgttggactcagaagttgacccagaccccgaaggagacctgggagtccgcgggcccgtgtttggagagccctctgctcccccacatacttccggcgtgtcattaggggagtctaggagcagcgaggtggatgtttccgaccttggatcccggaattattccgcacgaaccgatttctactgcctcgtgtctaaggatgacatgtag

SEQ ID NO: 134437 - DNA, 1515 bp, Artificial Sequence
  Description of Artificial Sequence: Synthetic coding sequence
atgcccggcgtctgcgatagagcgccagattttctgagcccctccgaagatcaagtcctgcgcccagccctgggcagcagtgtggccctgaactgtacagcttgggttgtttctggacctcattgcagtttaccttcggttcaatggctaaaggatggattgccattggggattggaggccattattcactgcacgaatattcctgggtgaaggcaaaccttagcgaagttctggtgagctccgtgctgggtgtcaacgtcacgtctaccgaggtctatggcgccttcacctgctcaatccagaatataagcttttctagctttacgctgcagagagctgggccaacctcacatgtggccgccgtcttggccagcttgttagtgttactggccctgctgctggctgccctgctgtacgtaaaatgcaggctgaacgtcctgctgtggtatcaagacgcctacggagaagtggagatcaatgatgggaaactatacgatgcttacgtttcctacagcgattgtcctgaggatagaaaatttgtcaattttatccttaagccgcagttggaacgccggagagggtataagctctttcttgacgatcgggatttgttaccgcgggccgagcccagcgctgatctgctggtcaatttgtcaagatgccgccggctgattgtcgtcctctcggatgcattcctcagtcgtgcctggtgttcccattcttttcgagaaggtctgtgccgcctgttggagctcacccgccggccgatttttattacttttgagggccagcgtcgcgaccctgctcacccagcattgaggctcctccgccagcacagacacttagtcaccctgttgctgtggaggcctggctccgtcacgccatcatcagacttctggaaagaggtgcagctggcactgcctcggaaagtgcagtaccgaccggttgaaggcgaccctcagacgcagcttcaggacgataaagacccaatgttgatcctccgaggcagggtcccagagggcagggccctcgatagtgaagttgatcccgaccccgaaggtgaccttggaatgccagctcagcctcatagccctacaggagaagctcagcacagggctgagtggggccaggcacaagggaccggcccggggggcgctcccggggtggaggatagtagccgtcacagggagcctctgcacgggctgtgtcctggcggtgccaggccgtcagtatgcctaggaaccagttgggctagtcaggccatcaccgccggaggggagcagggccaaccactcgccgtcgggctgggccagggttgcggctggcccccccaagcaagccgcagtccccatccccggtgtccaggggcatgcctgtggcgtgccatctcgtccaccgctcatcaatgggggctggccgggcgggagcctgagcagcgcagcggccggcttgggagccgactggctaaactgcagtgcccacacagacttctcctccctggggtgcaggggtag

SEQ ID NO: 134438 - DNA, 1107 bp, Artificial Sequence
  Description of Artificial Sequence: Synthetic coding sequence
atgtttgccaagggaaagggctcggccgtgccatcagatggtcaagctagggagaagctggctctttatgtgtatgagtacctattacacgtcggggctcagaagagtgcccagacctttctcagcgagatcagatgggagaaaaacataactttgggcgaaccccctggcttcttacattcttggtggtgtgtgttttgggacctgtactgtgcagctccagaacgcagagacacatgcgagcattcatctgaggctaaggctttccacgactacagtgctgccgccgctccatcccctgtgcttggaaacattccacctaacgacggcatgccaggaggtcctataccacccggcttcttccaaggaccccccggcagtcagccatccccacacgcgcagccccctcctcacaatcccagcagtatgatgggaccccattcgcagcccccaggcggcgtccccggcacccaaccgctactacctaatagcatggatccaactcgccaacagggccatcccaatatgggtggctctatgcagcgtatgaaccctcccaggggcatgggtccaatgggccccggaccccaaaattatggaagtggcatgagacctccgcccaatagcctgggtccggctatgcccggcattaacatgggccccggtgctggaaggccctggcctaatccaaattctgcgaattccattccttactccagcagtagtcctggtacctatgttggacccccgggaggtggcggtcctcctggaactcctatcatgccaagccccgccgacagcaccaactcttcggataacatatatacaatgataaatccagtgccacccggtggatctcggtccaacttccccatgggaccaggaagcgatggcccaatgggtggcatgggtggcatggagcctcatcacatgaacggaagtctgggcagtggggacattgatggattgcccaagaattcaccaaacaatatcagcggtatttcaaatcccccaggcactcctcgcgacgacggagagcttgggggtaacttcctgcactcatttcaaaacgataattactcaccgtcaatgaccatgagcgtttag

SEQ ID NO: 134439 - DNA, 1086 bp, Artificial Sequence
  Description of Artificial Sequence: Synthetic coding sequence
atgttcgctaaaggaaaaggaagcgcagtgccatctgacggccaagcccgtgagaaactggccctctacgtgtacgaatacctgcttcatgttggagctcagaagagcgcccagacttttttgagcgagatccggtgggagaagaatataacattgggtgagcctccaggattcctgcactcttggtggtgcgtcttctgggacctatattgcgccgctccagagcggagggacacctgcgaacacagtagtgaggccaaggcatttcatgactactctgctgccgccgccccatcacccgtgttgggtaacatcccaccgaacgacggtatgcccggcggcccaatacccccaggtttttttcagccctttatgtcgcccaggtatgccggaggaccacgtccaccaatcaggatgggaaatcaaccacccggcggagtgcccgggacacaaccattgcttcccaatagcatggacccaacccggcagcaaggtcacccgaatatgggtggttccatgcagagaatgaaccctccacgtgggatgggtccaatgggacctgggccacagaactatggatcaggcatgcgccctccgcccaactccctggggccagcgatgccgggcatcaacatgggccccggagcaggtagaccctggcctaatcccaacagcgctaacagcattccatacagtagttccagtccgggcacctacgtggggccccccggggggggaggtcctcccggaactcctatcatgcccagcccagcagatagcaccaacagtagcgataacatctatacaatgatcaatcccgtaccacctgggggctcacgctcaaattttccaatgggccctgggagcgatggacccatggggggtatgggtggaatggagccccatcatatgaatgggagtctaggttctggcgacatagatgggctgcccaagaatagtcccaacaatatatccggaatcagcaacccccctggcacgccaagggatgacggagagcttggcgggaacttcctccattcgttccagaatgataattactcaccctctatgaccatgagcgtgtag

SEQ ID NO: 134440 - DNA, 1167 bp, Artificial Sequence
  Description of Artificial Sequence: Synthetic coding sequence
atgttcgctaaagggaaggggtctgctgtgcctagcgatggccaggcacgggaaaaactagccctctatgtctacgaatatctgctccacgtcggggcccagaagagtgcccagacttttttgtctgagatccgatgggaaaagaacatcactcttggggagccccctgggtttctgcactcttggtggtgcgtgttttgggacctctattgcgccgccccggaacggcgcgacacctgtgagcattcttctgaagcaaaggcatttcacgactacagcgctgccgccgccccaagcccagttctgggcaacatcccacccaatgacggtatgcctggcggcccgatcccgcccgggttttttcaaggcccccctggctcacagccgtccccgcacgcacaacccccaccgcacaatccttcaagcatgatgggaccgcacagccagccttttatgagcccccgatacgctggcggaccaagaccacctataagaatgggcaaccagcctcctggtggcgtgcctggaacacaacctctgctgcccaactccatggatcctactagacagcagggccaccctaacatggggggctccatgcagaggatgaatcccccacggggaatgggaccaatgggcccaggtccccagaactatggatccggcatgcggccacccccaaacagtctgggacctgccatgccaggtatcaatatggggcccggcgctggccggccgtggccaaatcctaattctgcaaattcgatcccctatagcagttcaagcccagggacctatgtgggaccccctggtggcggcgggccaccgggaactccaattatgccttctcctgcggattccactaattcatctgataatatctacacgatgataaatcccgttccccccggtggttcccgctccaacttcccaatgggtcccggctccgatggacctatggggggcatggggggcatggagccgcaccacatgaacggctccctcggctctggagatattgatggactgccaaaaaatagtccaaataacatctcaggcatatctaacccccccgggacaccaagagatgacggcgaactgggcgggaactttctgcacagtttccagaacgataactattcaccgtctatgacgatgtccgtatag

SEQ ID NO: 134441 - DNA, 837 bp, Artificial Sequence
  Description of Artificial Sequence: Synthetic coding sequence
atgcccggtggtcccataccacctggtttcttccaggggccccctgggtcacagccttctccccatgctcagccccctccacataatccctcatctatgatggggccccactcacagccctttatgagcccaagatacgcaggaggaccccgcccacccatacggatggggaaccagcctccaggcggggtgccgggaacacagcccctccttcccaattcaatggatcctaccagacaacaggggcacccgaatatggggggttctatgcaacgcatgaacccacctcgcggaatggggcccatgggtcccggaccacaaaactacggatcgggaatgaggccccctcccaacagtctggggccagcaatgccgggcattaacatgggccctggggcagggagaccctggccgaacccaaattctgccaacagtataccatacagttcctctagtcctgggacttacgtcggccctcctggcggaggggggccccccggaacacccattatgccatctccggcagattcaaccaactcttcggataacatctataccatgattaacccggttcccccaggtgggagcagatcgaattttcctatggggccaggcagtgacggccccatgggaggaatgggcggaatggagccccaccacatgaacggatcactcggctccggggatatcgacggtttgcccaaaaacagccccaacaacatcagtggaatatcaaatcccccgggcacaccacgcgatgatggcgaattgggaggaaacttcctgcattcattccaaaatgataactacagtcccagcatgactatgtcagtctag

SEQ ID NO: 134442 - DNA, 471 bp, Artificial Sequence
  Description of Artificial Sequence: Synthetic coding sequence
cctccaggtggggttcctggaacacaacccttgttacccaacagtatggaccctacacgccaacaggggcatccaaacatggggggtagcatgcagcgtatgaacccccctaggggaatgggcccaatgggccctgggccccagaactatgggagtggcatgagacccccaccaaatagtctcggcccagccatgccgggaattaacatgggacccggcgcgggaagaccttggccaaatccaaactccgctaatagcataccctactcttcttcctcacctggcacctacgttgggcctccgggcgggggcggaccaccaggcacacccatcatgccaagtccagctgactcgactaattcgtccgacaacatttacaccatgataaacccagtgccacctggggggtcccgctccaacgtctctctcctgagtaacaacctacacatccgccaccataacaagagctag

SEQ ID NO: 134443 - DNA, 1158 bp, Artificial Sequence
  Description of Artificial Sequence: Synthetic coding sequence
atgtacgccaaggggggtaagggaagcgccgtcccatccgactcacaggcgcgagaaaaactggccctgtacgtatatgagtatctgctgcacatcggagcacagaagtctgcccagaccttcctgtctgaaattaggtgggaaaagaatattacactgggtgagcctccagggttccttcatagttggtggtgcgtgttctgggacttgtactgcgccgctcctgaccggcgtgaagcatgtgaacactccggcgaggctaaggcctttcaggattacagtgccgccgccgctccctcacccgtgatgggttctatggctcccggagacactatggccgctggctctatggccgcaggattttttcagggacccccgggatctcagcctagtccccataaccccaacgcccctatgatggggccacacggccagccgtttatgtcccctagattcccggggggtccccgccccaccctgcgtatgccatcacagccccccgctggcttaccagggtctcaaccccttctgccaggggcaatggagccttcccctagggcccagggacacccatctatgggtggaccaatgcagagagtgactccacccaggggaatggcttctgtaggccctcagtcttatggagggggtatgagacctcccccaaattccttggctgggcccggcctacctgcaatgaatatgggacccggcgtgcgcggaccatgggcgagcccgtctggtaactcaatcccttatagtagctcatcccctggttcatacaccgggccccccggcggtgggggacctcctggcacacctattatgccctcccctggtgattccactaatagtagtgaaaacatgtataccattatgaaccccatagggcaaggcgcaggccgggcaaattttcctcttgggccaggcccagaaggaccaatggccgccatgagtgccatggagccacaccacgtcaacggttcattgggttccggagatatggacgggttgccaaaaagttcccctggtgctgtcgccggtcttagcaacgctccggggacaccacgggacgacggagagatggccgctgcgggaacctttctccacccatttcccagcgagagttatagccccgggatgaccatgtccgtttag

SEQ ID NO: 134444 - DNA, 1092 bp, Artificial Sequence
  Description of Artificial Sequence: Synthetic coding sequence
atgtacgccaaagggggcaagggcagcgctgtgccaagcgacagccaagccagggagaagctggcactttatgtatatgagtacctactgcatatcggcgcgcagaagagcgcccagacgtttctgtctgaaatcaggtgggaaaagaacattacgctgggagagccccctggatttctgcacagttggtggtgtgtgttctgggatctatactgcgccgctccagatcggcgcgaggcctgtgagcatagtggcgaggccaaggcatttcaggattacagtgcagccgccgcaccatcgccagtaatgggtagtatggcccctggagataccatggctgcaggatctatggcagccggtttctttcagccattcatgtcaccccggtttcccgggggccccaggcctaccctgcgaatgccaagtcagcccccagccggactgccagggtcacagcctctgttgccgggggcaatggagccaagcccacgcgcccaaggacaccccagcatggggggtccgatgcagcgggttacaccccctcggggaatggccagtgttggcccccagtcatatgggggaggaatgaggccaccgccaaactctctggctgggcctgggcttccggccatgaacatgggaccaggcgtccgaggaccctgggcttcaccttccggcaattcaattccctatagtagcagtagcccgggctcatatacaggaccaccgggtggaggaggtcccccgggcactccaatcatgccctcccctggagacagcactaactcctcagagaacatgtacacaattatgaaccctatcggacagggggccggacgtgcaaactttcctctcggaccagggccagagggccctatggcagctatgtcggctatggagcctcatcacgtgaacggatccctgggatccggggatatggacgggcttcccaaatcctcccccggagcggtggcgggattaagcaacgcccctgggacgcccagggatgatggagaaatggccgccgcaggtactttcctgcatccctttccttctgagtcctacagtcctggcatgaccatgtcagtctag

SEQ ID NO: 134445 - DNA, 2301 bp, Artificial Sequence
  Description of Artificial Sequence: Synthetic coding sequence
atgaaggaaaaatctaaaaatgccgccagaactagacgggagaaggagaacagcgaattctatgaattggccaagctcctccctcttccgtcggccattacttcacagctggataaagcgagcataattcgccttaccacctcctatctgaagatgagggttgtctttcccgaaggactaggagaagcttgggggcattccagcaggacatcccctttggacaacgtgggtagagagctaggcagccacctgttacagactctcgatggcttcatcttcgtcgtggccccagatgggaaaattatgtacatcagtgaaacggccagtgtgcatctcggcctgtcacaggtggaactgaccggaaattctatttatgagtacatccatcctgctgatcacgacgagatgaccgccgttttgaccgctcatcagccttaccacagtcattttgtccaggagtatgagatcgagcggtccttcttcctgcgaatgaagtgcgtgctcgccaaacgaaatgccgggctcacatgtggtggatacaaggttatccactgtagcggctacctcaagatcagacagtacagcctggacatgtctcctttcgatggatgctaccagaacgtcggccttgtcgctgtgggccacagcttgcctccttccgccgtgaccgaaatcaagctgcatagcaacatgttcatgtttagagccagcctcgatatgaaattaatatttcttgatagcagagttgccgagttaactgggtacgagccacaggacttaatcgagaaaaccctgtaccaccacgtccacggctgcgacacctttcacttgcgatgtgcccatcacctgttgttggttaagggtcaggtcaccacgaagtattatcgcttcctggccaaacacggcggctgggtttgggtgcagtcatacgcgacaatagtccacaattccagatcctcaagaccccattgtatcgtgagtgtcaattacgtcttgaccgacaccgagtacaaggggcttcagctgtccctggatcagatttcagccagtaaacctgccttctcatatacaagctcgtcaacacctactatgacggataatagaaagggggccaagagccggctaagctctagtaagagtaagtcgagaacttcaccctacccccagtactccggtttccacacagaacgttccgagtcagaccacgacagtcagtggggcggtagccccctcaccgatactgcatccccgcaactgctagaccccgctgacaggcccgggtcccagcacgacgctagttgtgcctaccgccagttttccgaccgatcctccttatgttacggcttcgcgctggaccattcgcgtcttgtggaagaacggcacttccacacgcaggcatgcgaaggcgggcggtgcgaggcagggcggtatttcttaggaacaccccaagctggacgggagccatggtggggatcccgcgctgctctgccactcaccaaagcctccccagaatcccgggaggcctatgaaaactccatgccacatatcgccagcgtgcatcggatccatggaaggggtcattgggacgaagatagcgttgtgtcttcgccggatcccggatctgccagtgagtccggtgaccggtaccgcaccgagcagtatcagtcctcaccccacgagcctagcaagatagaaacgttgatccgcgccacccagcagatgatcaaagaagaagagaatagactgcagctgagaaaggccccttctgaccagctggcgtcaatcaatggggccgggaaaaagcattccctgtgttttgcgaattatcagcagcccccacccactggagaagtgtgccatggttcggcactggcgaatacgtctccgtgcgaccacatccagcaacgcgaggggaagatgttgtccccacatgaaaatgattatgacaactctccaacggctctctctcgtatctcatcaccaaattccgatcggattagcaagagctcgttgatccttgccaaggattacctccattctgacatatcaccccaccagactgccggagatcacccaacagtttcccctaattgctttggatcacatcgtcagtattttgacaaacacgcttacacccttacggggtacgcactggagcatctctatgacagtgagaccattcggaattattctctggggtgcaatgggagtcactttgacgtgacatcacatcttcgtatgcagcccgaccccgcgcagggtcataaaggcacttcagtgattatcactaatggctcctag

SEQ ID NO: 134446 - DNA, 2301 bp, Artificial Sequence
  Description of Artificial Sequence: Synthetic coding sequence
atgaaagagaaatccaagaacgcagctaggacccggcgagagaaagagaacagcgagttttatgagctcgccaagctactgccattaccctccgcgataacctcacagctggataaggcatccattatccgtttgaccactagctatctgaagatgagggttgtgttcccagagggtctgggcgaagcttggggccattcctctaggacaagccctctcgataatgtgggtcgtgagctaggaagccatctgctgcaaaccctggatggatttatcttcgtagtggcgccagacggaaagatcatgtatatctcggaaaccgcttctgtgcacttaggcttgtcgcaggtggaactaacggggaattccatttatgaatacatacacccagccgatcacgatgaaatgactgcggtgctgactgcccaccaaccatatcactcgcactttgtccaggaatacgagatcgagaggagcttcttcctcagaatgaaatgtgtgctggccaaaagaaacgcggggctgacttgcggagggtataaggtgattcactgctccggctacctgaaaattcgtcaatattcgctggatatgagtccattcgatggctgttatcagaatgtggggctagtggccgtgggtcattcattaccacctagtgccgtgacagagataaaactgcattcaaacatgtttatgtttcgcgcgtctctggatatgaagcttatcttcttggactctcgtgtcgctgaactgaccggctacgaaccacaggacctgatcgaaaagacgctataccatcacgtacacggctgtgacacctttcacctgaggtgcgcccatcacttgctgcttgtcaaagggcaggtgaccaccaagtattataggttcctcgctaagcatggaggatgggtgtgggtccagtcctatgctactatcgtacacaattcacgttcctcaagacctcattgcattgtcagcgtcaattacgttctcacggacaccgaatacaaaggcctccagctgagcttggatcaaatctctgcttccaagcctgctttctcctacacgtcaagctccacacctacaatgaccgataacaggaaaggggcaaagtctcgcctctccagcagcaaatccaagtcccggacttctccttaccctcagtacagcggtttccacacagagcgtagcgagagcgaccatgactctcagtggggtggaagcccccttacagacaccgccagtccacagctccttgacccagccgatagaccgggtagccaacacgacgccagttgtgcctatcgccaattttcagaccggagctcattgtgttatggcttcgcccttgatcacagcaggctggtcgaggagcgccacttccacacacaagcttgcgagggggggagatgtgaagccggaaggtacttcctaggcactccccaagctggccgcgaaccatggtggggttcccgcgccgcacttccattaaccaaagccagtccggaaagtcgggaggcctatgagaactcaatgccccatattgccagcgtacaccggatacatggccggggccactgggatgaggacagcgtcgtgtcttctcctgaccccggcagcgcctcagaatctggtgaccgctatcgcactgagcagtatcaaagctctccccacgaaccttccaagatcgaaactctgatcagagctacacagcagatgatcaaagaggaggaaaaccggctgcagctgaggaaggccccctcggaccagttggccagtattaacggcgctggcaaaaagcactccctgtgttttgccaactaccagcaacctccaccgactggcgaggtgtgtcacgggtcggccttagcgaacaccagcccatgtgatcatatccagcagcgagaggggaagatgctctccccccacgaaaacgattatgacaactctcccacggcactcagcagaatctcctctcctaacagcgacaggatctcaaaatcttctctgattttggccaaggactacctgcactccgacatcagcccacatcaaacagccggggatcaccctactgtaagcccgaactgcttcggctcccacagacagtactttgacaaacatgcctacaccctgacagggtatgctctggagcacttgtatgactctgaaactataagaaattatagcctcggatgcaacgggtcacactttgatgttacttcgcacttgagaatgcagcccgacccagcacagggtcacaaaggtacaagtgtgatcattaccaatggttcctag

SEQ ID NO: 134447 - DNA, 2004 bp, Artificial Sequence
  Description of Artificial Sequence: Synthetic coding sequence
atgaaggaaaagagtaagaatgcagccaagacaagaagagaaaaagaaaatggcgaattctacgagcttgccaaactgctgccactgccttccgccattacaagtcaactcgacaaggcttctatcatccggctgacgacatcatatctcaaaatgcgcgctgtatttcccgaagggctgggggatgcttgggggcagccgtctagggccggccctcttgacggagttgcaaaagaactgggatcacacctgctacagactcttgacggattcgtgtttgtggttgcctctgacggcaaaattatgtatattagtgagacagcgtccgtgcacctaggcctaagtcaggtcgaactcaccgggaacagcatctacgaatatattcacccatctgaccacgacgaaatgaccgcggtgctcaccgcgcaccagccacttcatcatcacctgttgcaagaatacgaaatcgaaaggtccttctttttgcgaatgaagtgcgtgcttgccaagcgtaacgctggactgacatgcagcggctacaaagtgatccactgtagcggttatcttaagatccgccagtatatgcttgacatgtccctctacgactcatgctatcagatcgtggggctcgtggcagtcgggcagtcattgcccccctctgccattacagaaatcaagctttatagcaacatgtttatgttcagggctagcctcgacttgaagctcattttcctcgacagtcgggtaaccgaggtgactgggtacgagcctcaagatctgatagagaagacactatatcaccacgtccatggatgtgacgtcttccacctccgctatgctcaccaccttctgctggtcaagggccaggtcacaactaagtattacaggcttctgtccaaacgcgggggatgggtctgggtgcagtcatacgccacagtggtacataacagccgctcctctcgccctcattgcatcgtgtccgtgaactatgtgctcaccgaaatagaatacaaggagctgcagttgtctttggaacaagtttctacagctaagagccaggactcctggagaacagctctgagcacgagccaggagaccagaaaacttgttaaaccgaagaatacgaagatgaagaccaaattaagaaccaacccttatccccctcagcaatacagtagttttcagatggacaaacttgaatgcggccagctcggcaattggcgcgcctcaccacccgcctccgccgctgcacccccagagctccagcctcacagtgaaagtagcgatttgctgtacaccccatcttactccttacctttctcgtaccactacggccacttccctctcgactcccatgtgttttcatccaaaaagccaatgctgcccgccaaatttggacagccacaaggaagcccctgcgaggttgccaggttcttcctgtcaacgctgcccgcttccggcgaatgccagtggcactatgctaatcccttagtcccctcatcctcttccccagccaagaaccccccagaaccacctgccaacaccgcccggcactcattagtgccatcctatgaagcccccgcggccgctgtccgccgattcggcgaggacactgctccaccatcttttccatcttgcggtcactatagggaagagcccgctttggggcctgccaaagctgcaaggcaggcagctcgcgacggagctcggctagcccttgccagggcagctccagagtgttgcgcccctccaactccagaagcacccggggcgcctgcccagctcccctttgtcctgctgaattaccatcgcgtgttagctcggagagggcctctgggcggcgcagccccagcggcctctggtttggcatgtgcaccaggcggaccagaggcagctactggagctctgcggctgaggcacccttctcctgctgctacctcgccccctggagccccactgcctcactacctgggagcatctgtgatcattacgaacggtcgctag

SEQ ID NO: 134448 - DNA, 1713 bp, Artificial Sequence
  Description of Artificial Sequence: Synthetic coding sequence
atgaaggagaagtccaaaaacgcagccaaaaccagaagggaaaaggaaaatggtgagttttacgagctggctaaactgctcccattaccttccgcaattacctctcaactcgataaggcttccatcattcgtcttaccactagctatctgaagatgagggccgtcttccctgagggtctgggggatgcttggggccaacccagtagggcaggcccccttgatggtgttgccaaagagctcggttcacatctcctgcagactttagatggcttcgtctttgtagtggccagcgatggcaaaattatgtacatttctgagacagcctcggttcatttaggactctctcaggttgaattaacaggtaattccatatatgagtacattcaccctagcgatcatgacgaaatgactgccgtactgacagcacatcagccgctgcaccaccatctcttacaggaatacgaaatagaaagatcattttttctgcgtatgaaatgcgtgcttgctaaacgtaacgcaggactgacatgctctggttacaaggtgatacattgcagtggatacctgaagattcggcagtatatgctcgacatgagcctgtatgattcctgctaccagatcgtaggtttagtggcagttggacagtcccttccaccttctgctattactgaaattaaactctacagcaacatgttcatgtttcgggccagcctggacctcaaactgatcttcctggattcgagggtgacagaggtcactgggtatgagccacaggatctgatagaaaagacactctatcaccatgtccatggctgtgatgtgttccatctgcgctatgctcatcacctcttattagtgaaaggccaggtaacgaccaagtactacaggctgctctctaagcgcggtggctgggtgtgggtccagtcctatgccacagtggtgcacaactctcgatcatcccggccacactgtattgtctcagtgaattatgtactaacggagattgagtataaggaactgcagctgtccctcgagcaggtatcaactgcaaaatcacaggatagctggaggaccgcactttccaccagccaggagacgagaaagctggtgaagcctaaaaataccaagatgaagaccaaactacgcacaaatccctacccaccgcaacagtatagctcctttcagatggataagttagaatgcggacagctgggcaattggcgggccagtccccctgcaagcgccgcagcccctccagagttacagccccatagtgagagctctgatctcctgtataccccctcttattccctaccattcagttatcattacgggcactttccccttgattcacacgtattctcctccaagaaacctatgctgccggccaaatttggccagccacagggaagcccttgtgaggtggcccgcttcttcctgagtactctaccagcctccggcgaatgccagtggcattatgccaaccctttggtcccttcatcctcctccccagccaaaaaccctccagagccccctgcaaataccgccagacactctctggtgcccagctacgaaggcggatccggtctgctagtgggaaaagttggtggcctccgaacggcgggatctcgctcgtcccacggcggtggatggcaaatggaaacagagccaagtagattcggtcagacctgccctcttagtgccagcaaatag

SEQ ID NO: 134449 - DNA, 447 bp, Artificial Sequence
  Description of Artificial Sequence: Synthetic coding sequence
atgttcagacgccccgtgttgcaggtccttcggcagtttgtcaggcacgagtctgaaacgactacttcactggtgcttgagaggagtctcaatcgggtacatctgttgggcagagtggggcaggatcccgttctcagacaggtggaaggtaaaaatccagtgactattttctcactcgccactaatgagatgtggcggtctggagactctgaggtgtaccaattgggcgatgtctcccagaaaaccacttggcaccgcatcagcgtgttccggccaggacttagagatgttgcgtaccagtacgtgaagaagggctcccgtatctacctcgaggggaaaatcgattacggcgagtacatggataaaaacaacgtgagacgacaggcaaccaccatcatcgccgataacatcattttcctgagcgatcagactaaagagaaagagtag

SEQ ID NO: 134450 - DNA, 366 bp, Artificial Sequence
  Description of Artificial Sequence: Synthetic coding sequence
atgttcaggagaccagtactgcaggtgctgaggcagttcgtgcgacacgagtccgaaaccactacatccctggtcctggagcgcagtctcaaccgggttcatctgctcggacgggttggccaggatcccgtgctacggcaggtggaagggaagaatcctgtgacaatctttagcctagctactaatgagatgtggaggtccggagattccgaagtttaccaattaggggacgtgtcacagaagactacttggcatcgcattagtgtatttcgaccggggttgagagacgtcgcttatcagtatgtgaaaaagggaagccgaatatacctggagggtaaaattgactacggagagtacatggactag

SEQ ID NO: 134451 - DNA, 447 bp, Artificial Sequence
  Description of Artificial Sequence: Synthetic coding sequence
atgttcaggagacctgtgcttcaggttttgagacagttcgtgaggcatgagagtgagacaaccacttctctggtgcttgaaaggagcctgaatagggtccacctcctgggacgtgtgggccaagacccagtgctgagacaggtcgagggcaagaaccctgtgaccatattctccttagcaaccaacgaaatgtggcgcagtggcgacagcgaagtgtaccagctgggagatgtgtcacagaaaactacgtggcaccggatcagcgtgttccgccctggcctgagagatgtggcctatcagtatgtgaagaaagggtcgagaatttacctggagggcaagatcgactacggcgaatatatggacaaaaataacgttcgtaggcaggcaacaaccatcatcgcggacaacatcatcttcctgagcgaccagaccaaagagaaggagtag

SEQ ID NO: 134452 - DNA, 408 bp, Artificial Sequence
  Description of Artificial Sequence: Synthetic coding sequence
atgtttaggcgcccagtcctacaggtgctgcggcagttcgtccgacatgaaagtgaaacgacaacaagtctagtcttggagcggtccttgaacagggtacacctactcggccgggttggccaggacccggtcttgcgacaagtggagggcaagaatccggtcaccatcttctcgcttgccactaatgagatgtggagatccggggatagtgaggtctatcaactcggtgacgtgtcacaaaagacaacatggcacaggattagtgtttttcgtcctggactcagggacgttgcatatcaatacgttaagaagggcagcagaatctacttggaggggaaaatcgactacggggagtacatggacaagaataatgttcgcagacaggccacgactataattgctgactag

SEQ ID NO: 134453 - DNA, 87 bp, Artificial Sequence
  Description of Artificial Sequence: Synthetic coding sequence
atgtttcgcagacctgttctacaagtccttcgtcagttcgtgaggcacgagagtgaaacgaccactagcctggtactcgaacgctag

SEQ ID NO: 134454 - DNA, 447 bp, Artificial Sequence
  Description of Artificial Sequence: Synthetic coding sequence
atgtttcgtcgccctgtattgcaggtgcttcgccagtttgtgcggcacgagtccgaaactactactagccttgtgctggagcggtcccttaacagagtgcatttactgggtagggtgggacaggatcccgtcctgaggcaggtggagggtaagaacccagtgacaatcttttctctggcaaccaacgagatgtggcggagcggggacagcgaggtttatcagctcggcgatgtgagccagaagaccacatggcataggatctccgtattcagacctggactccgagacgttgcctaccagtacgtaaagaagggctcaaggatatatcttgagggtaaaattgattatggtgagtacatggataaaaataacgttcgcagacaagcgactacaataattgcggataacataatctttctgagcgaccagaccaaggaaaaggagtag

SEQ ID NO: 134455 - DNA, 447 bp, Artificial Sequence
  Description of Artificial Sequence: Synthetic coding sequence
atgttcagaagaccagtcctgcaggtgctgcggcagtttgtcagacacgagagcgagactacaacgtctctggtgttggagcgtagccttaacagggtgcacctattgggcagggtgggccaggaccccgttcttcgccaggtggagggcaagaacccagtgacaatctttagcctggcgaccaacgagatgtggcgaagcggcgattccgaggtttaccagcttggcgatgtttcccaaaaaacaacatggcaccggatatcagtcttccggcctggtctccgcgatgtggcttaccagtacgttaaaaaaggtagccggatctatttggaggggaaaattgattatggcgaatacatggataagaataacgtacggcgacaggctacaaccatcatcgctgacaatatcatctttctgagtgaccagacaaaagaaaaagaatag

SEQ ID NO: 134456 - DNA, 447 bp, Artificial Sequence
  Description of Artificial Sequence: Synthetic coding sequence
atgttccgacgccccgtcttgcaggttctgagacaattcgtgcggcatgaatctgagaccacaacatcactggttctcgaacgatccctcaaccgcgtgcacctgttgggaagagttggccaggatccggtgctgcggcaggtggaaggcaagaatcctgtgaccatcttttctctggcaacaaacgagatgtggcgctctggcgactccgaagtataccagctgggggatgttagccaaaagacgacatggcatagaatttccgtcttcagacctggactgagggacgtcgcctatcagtacgttaagaagggaagtcgaatctacctagaaggcaagattgactatggcgagtatatggataagaataacgtgaggagacaagccactacaataatcgcggataacatcatcttcctgagcgaccaaacaaaggaaaaggagtag

SEQ ID NO: 134457 - DNA, 1086 bp, Artificial Sequence
  Description of Artificial Sequence: Synthetic coding sequence
atgtatgggaaaggcaaatctaattcctctgcagtgccctctgactcgcaggcaagggagaaactcgccctttacgtatatgagtacctcctgcatgtcggagctcaaaagtccgcccagaccttcctttctgagattcggtgggaaaagaacattaccttgggggagcctcccggatttctccatagttggtggtgcgtgttttgggacctctactgcgctgcccccgaaaggagggaaacttgtgagcacagcagtgaggccaaagcctttcacgattattcagctgcagccgcgcccagtccagtgctgggtaacataccacccggcgatggaatgccagtgggccccgtgccccctggattcttccagcccttcatgtcacctcgttatcccgggggtcctcgacccccactcaggatccccaaccaagccttgggcggtgtccccggatctcagcccctgctcccatctgggatggatcccacacgccagcaggggcatccaaatatgggcgggcccatgcagcgaatgacacccccccgaggcatggtgcctttgggtccccaaaactacgggggagcaatgcgaccccctttaaacgcactgggggggccaggtatgccagggatgaatatggggcctggaggcggcagaccctggccaaacccgaccaacgccaactctatcccctacagctctgcatcaccaggcaattacgtgggtcccccgggcggaggtggaccccctggcactccaatcatgccatccccagccgacagcactaattcaggagataacatgtacaccctcatgaacgctgtgcccccaggcccaaatcgccctaattttcccatgggcccaggaagtgatggccccatgggtgggctagggggcatggaatcacatcacatgaacgggtccctgggatccggcgatatggactccattagtaaaaactctccgaacaatatgtccttatcaaaccagcccggaactcctcgtgatgacggcgaaatggggggcaatttcctcaatccgttccagagcgagtcctactcaccaagcatgacaatgtcggtctag

SEQ ID NO: 134458 - DNA, 945 bp, Artificial Sequence
  Description of Artificial Sequence: Synthetic coding sequence
atggggaagaatataaccttgggggaaccacctgggtttctgcattcttggtggtgtgtcttttgggacctttactgcgcggcccccgaaagaagagagacatgtgaacatagttccgaggccaaggccttccatgattactctgccgccgctgcaccaagcccagtgttagggaatatcccaccgggtgatgggatgccggtgggacctgtgcctcccggtttcttccagccattcatgtctcctcgttatcctggtggaccccggccacccctccgcataccgaaccaggccctggggggtgttccaggatcccaaccgctgctcccatctggaatggatcccacacggcagcaaggtcaccccaacatgggtggccccatgcagcgcatgacccctccacgtggcatggtgccgctcgggccccagaactacggtggagcaatgagacctccactaaacgcactgggaggccctggcatgcccggaatgaacatgggaccaggaggggggcgaccatggcctaacccaacaaacgctaatagtataccttactcctctgcttcccccggaaactatgtgggtcctcctggcgggggtggccctccaggcacccctattatgccgtctcctgcagactccacaaacagtggtgacaacatgtacactctgatgaacgcagtacctccgggccccaaccgcccaaatttcccgatgggacctggatcagacggacctatgggcggattaggcgggatggaatcccaccacatgaacggctccctgggtagtggcgatatggactcaatttccaagaactctccgaataatatgtcccttagtaaccagcctggaacccccagggatgacggggagatgggcggtaactttctgaaccctttccagagcgagtcctactcccctagcatgaccatgtccgtctag

SEQ ID NO: 134459 - DNA, 1026 bp, Artificial Sequence
  Description of Artificial Sequence: Synthetic coding sequence
atgtacgggaaggggaagtccaacagtagcgccgtgccctcagactcgcaagctcgggaaaagctggccctgtatgtctacgaatacttgctgcatgtgggtgcccagaagtcagcccagacgttcctgtcagagatcaggtgggagaaaaacataactttgggcgaaccccccggattcctgcattcttggtggtgtgtgttctgggatctatattgcgcagcgcccgagagaagggaaacctgcgaacattcttcagaggcaaaggcctttcatgattattccgcggcggcagcgccctctccagtcctggggaacatcccacctggcgacggaatgccagtgggtccagtccctcccgggttctttcaggctttggggggagttcctgggtcccagcctcttttacctagcggcatggatcctactagacagcagggccatcctaatatggggggtcctatgcagaggatgacacccccacgcggtatggtccccctgggcccccagaactacgggggggctatgaggccaccactcaacgccctcgggggaccaggcatgcctgggatgaatatggggcctggcggcggccgcccctggccaaaccccacaaacgctaactccatcccatatagttcagccagcccgggtaattatgtggggccacccggcggtgggggccccccaggcacacccatcatgcctagcccagccgacagcactaattcaggagacaacatgtataccttgatgaatgctgtgccccctggcccgaaccggccaaactttcctatgggccctggcagtgatggacctatggggggtctgggcggaatggagtcccatcacatgaatggatcactgggatccggtgatatggattccatctctaagaattctccaaataatatgagcttgtcaaatcaaccaggaacacctcgcgacgatggggagatggggggaaattttcttaaccctttccagagtgagtcctacagtccctctatgaccatgagcgtgtag

SEQ ID NO: 134460 - DNA, 1200 bp, Artificial Sequence
  Description of Artificial Sequence: Synthetic coding sequence
atggccttctggggatggagggctgccgcagcccttagactgtgggggagagtggttgagcgggtcgaagcagggggaggggtgggaccttttcaggcctgcggatgtagactggtattgggcgggcgggatgacgtgagcgcaggactccgaggctcccacggcgcgcgcggcgagccattagatcctgcacgccctctgcagcgccctccccggcctgaagtgcccagggctttcaggcgtcagccacgggcggccgccccttccttctttttttcaagcattaagggcggaaggcggagcatctcattctcggtgggagcatcatcggtcgttggttcaggagggtcttccgataagggtaagctcagcctccaggatgtcgccgagctgatccgagcacgtgcctgccaacgagtggtagtaatggtgggcgctgggattagcacaccttcaggaatcccagactttcggtctccaggttcaggcctctactccaatctgcagcagtacgatcttccgtacccggaggcgatatttgaactacctttcttcttccacaatccaaagccctttttcacactggcgaaggaactctacccaggcaattacaagcccaatgtgacacattatttcctccgcctgctgcacgataagggcttgctgcttcggctgtatacccagaatattgacggactagagcgtgtgtccgggattccagctagtaaacttgtggaggctcacggcacctttgcatctgccacctgtactgtttgccagcggccattccctggtgaggatattagagctgatgtgatggcggatagggttcccaggtgccctgtttgtactggagttgtgaagcctgacatcgtgttcttcggagaaccgctgccacagaggttcctcctacacgtggtggactttccgatggccgacctactattaattctcgggacctcactggaagtggaaccattcgcctctttgacggaggccgtccgatcctcagtgccccgcctcctcatcaacagggatctggtcggccccttggcctggcacccacgcagccgcgatgtggcgcagttgggagatgtagtgcatggggtggagtctctagtagaactcctcggctggaccgaggaaatgcgagatttggtacagagagagacaggcaaactcgatgggccagacaagtag

SEQ ID NO: 134461 - DNA, 957 bp, Artificial Sequence
  Description of Artificial Sequence: Synthetic coding sequence
atggctttttggggatggagagccgcagctgcgctgaggctttggggccgagtcgtggaacgagtagaagctggggggggggtcggccctttccaagcatgcgggtgccgcctcgtcttgggtggccgagatgatgacgttgctgaactgatccgcgccagggcctgtcagcgggtcgtagtaatggtcggagccggtatctctacaccttccggcatacccgattttcgttctcccgggtccgggctgtacagcaacctgcaacaatatgatctgccctatcccgaggcaatcttcgaacttcccttcttctttcataaccccaaaccatttttcacgttggccaaggaactgtacccaggaaactacaaacccaacgtgacacattactttctccggctgctgcacgataaaggcctgctgctacgactgtatacccagaacattgacggcctggaacgagtgagtggcatcccggcttccaagctcgttgaggctcatggcacgttcgcctccgctacttgtacagtgtgccagaggccatttcccggggaagatattcgtgcggacgtaatggccgacagagtcccaagatgcccagtgtgcacaggagttgtaaagcccgacatcgtcttctttggggagccgcttccacaacgattcctgctgcacgtcgtagacttccccatggcagacttgcttttgatcctcggcacaagtctggaggtggaaccctttgcctctttaaccgaggcagtgcgcagtagtgtccccagattgcttatcaacagagacctggtcggccctctagcatggcaccccaggagccgcgacgtcgcccaacttggcgacgttgtccatggcgtcgagtcattggtggagctgcttggatggacagaagagatgcgggacttggtacagagagaaaccggaaagttggatggccctgataagtag

SEQ ID NO: 134462 - DNA, 774 bp, Artificial Sequence
  Description of Artificial Sequence: Synthetic coding sequence
atggtgggggctgggatctctaccccatctgggatccctgattttagatccccaggctccgggctctacagcaacctccaacaatacgacttaccttatcctgaggccatttttgaactgccgttttttttccacaatccgaagcctttcttcaccctcgctaaggagctctatcccggcaactataagcctaatgtgacgcactactttttgcgcctgctgcatgacaagggactgctcctccggctctatacccagaatatcgacggactcgagcgggtcagcggaatccccgcgagtaaactggtcgaggcgcacggcactttcgcaagtgcgacttgcaccgtctgccagaggcccttccctggcgaggacatcagggccgatgtgatggcagaccgcgtgccgagatgtccagtctgcacaggagtggtgaaaccagacatagtgttctttggcgagcccttgccacagcggttcctgctgcacgtggtggactttcccatggccgacctattgcttattcttgggacgtccctggaggtggagcctttcgcctctctgacggaggctgtcaggtcgagcgttccccgcttacttatcaacagggatttggtgggacccttggcatggcacccaagatccagggatgttgcacagctgggtgacgtggtgcacggtgtagagtctcttgtggagctccttgggtggacagaagaaatgagggacctggtgcagcgagaaactggcaagcttgacggaccagacaagtag

SEQ ID NO: 134463 - DNA, 945 bp, Artificial Sequence
  Description of Artificial Sequence: Synthetic coding sequence
atgaaaatgagctttgcgctgaccttccgaagcgcaaaaggcagatggattgccaatccttcgcagccatgttccaaggcctctatcggattgttcgtgcccgcctcacccccactggatccagagaaggttaaggagcttcaacggttcattaccttgtctaagaggttactggtgatgactggagccggtatctcaactgaatccggaatccccgactacagaagcgagaaggtcgggctctacgcgagaactgatcgaaggccaatacagcacggcgacttcgttcgcagcgctcccatcagacaacgatactgggctcggaacttcgtcggttggcctcagtttagttctcatcagcccaatccagcccactgggcgctatctacctgggagaagctgggcaaactgtactggctggtgacacagaacgtggatgccttgcacacgaaagcagggagtaggcggttgacagaactccacggctgtatggaccgggtcctgtgcctggattgcggagaacagactcctaggggggtgctgcaagagagatttcaggtgttaaatccaacatggtcggctgaggcccacgggttggccccggacggtgatgtcttcctgagtgaagagcaagtgcgttcgttccaggtgccaacctgcgtgcagtgtggaggccacctcaaacctgacgtggtgttctttggagacacagtaaacccagataaagtggacttcgttcacaagagagtgaaggaggcagatagtctgttggtggtaggctcaagcctccaagtctacagcggctataggtttattctaacagcatgggagaaaaagcttccaatcgccattcttaatataggaccgacacgatctgatgacctcgcatgccttaaactcaatagcagatgtggggaactgctaccgctgattgatccctgctag

SEQ ID NO: 134464 - DNA, 879 bp, Artificial Sequence
  Description of Artificial Sequence: Synthetic coding sequence
atgagaccacttcagatcgtgccatcgcgactaatcagccaattgtactgcgggttgaagcctcctgcctctaccaggaatcagatttgcctcaaaatggctcgccccagctctagcatggctgatttccgcaagttctttgcaaaagctaagcacattgtgatcataagtggggccggcgtgagcgcggaatcaggggttccaaccttcaggggtgcagggggctactggaggaaatggcaggcccaggatctcgccacaccactggcattcgcacacaacccaagccgggtctgggagttttaccactatcggcgggaagtaatgggaagcaaggaacctaacgccggccacagggcgatcgccgagtgcgaaacaagattaggcaaacagggaaggcgagtggtggtcatcactcagaatatagacgaactacaccgcaaggctgggacaaagaatctcttagagattcacggatccctgtttaaaacccgatgcacaagttgtggcgtcgtagctgaaaactataagagtcccatctgcccagccctgagtggcaagggctgtgaagaagccggctgcggtggcctgctgcgaccgcacgtcgtgtggtttggcgaaaacctagaccctgccattctggaggaggtggatcgggagctggcccattgcgatctgtgcctggtggtggggaccagctctgtggtgtatcccgccgctatgttcgctcctcaagtggccgcaagaggagtgcccgtagcggagttcaatacagagaccacacctgcaacaaacaggtttagatttcacttccaggggccttgtggaaccacacttcctgaagcgctagcatgccatgaaaatgagactgtgtcctag

SEQ ID NO: 134465 - DNA, 933 bp, Artificial Sequence
  Description of Artificial Sequence: Synthetic coding sequence
atgcgcccgctgcagatcgtgccaagtcgcctgatctcccagctgtactgcggcctgaaaccacctgctagcacacggaaccagatttgcctgaaaatggcccgccccagtagctctatggccgacttcaggaagttctttgcaaaagctaaacatattgtgataatctcaggggcaggcgtttcagccgagtccggagtgccaaccttcaggggcgccggcggatattggaggaagtggcaggcacaggatctcgcaacccccttggccttcgcccataatccatctagggtctgggagttttatcactacaggcgggaagtgatgggttctaaagagccaaacgcggggcaccgggctatcgcagagtgcgagactcgcctgggaaaacaaggcagaagggtagtcgttatcactcagaacatcgatgaactccatcgaaaagccggcaccaagaacctgctggaaatacatggtagtttgttcaagactaggtgcacatcctgtggggtggttgccgagaactataagtcacctatctgccccgccctatctggcaagggtgcccctgaaccgggcacccaagatgcatccatcccggtcgaaaagctccctagatgcgaagaggctggctgcggcggtctcttgcggcctcatgtggtttggttcggcgagaacctcgaccctgcaatcctggaagaggtggatagagaactggcccattgtgacctgtgccttgtggtgggcacctctagcgtcgtgtaccctgccgcaatgttcgctcctcaggtggctgccaggggtgttcccgtggctgagttcaatacagaaacaactccagcgaccaataggttcaggtttcactttcagggaccatgcggcaccactctgccagaagccctggcatgtcacgagaacgagacagtctcatag

SEQ ID NO: 134466 - DNA, 900 bp, Artificial Sequence
  Description of Artificial Sequence: Synthetic coding sequence
atgaggccgctgcagatagtcccgtcaagactcatctcccaactctattgtggcttaaaaccacccgcctctactcgtaatcaaatttgcctgaaaatggcgcggcctagctctagtatggccgacttcaggaagttctttgctaaagcaaaacacatcgtgatcatatctggagcaggcgtctcggccgaatccggcgtccccaccttcagaggagccgggggctattggcggaagtggcaggcccaggatctcgcaacccctttagcgttcgcccacaatccatctcgcgtctgggaattttaccattatcgccgggaggtcatgggctccaaagaacctaacgcagggcatcgtgcaattgccgaatgtgagactcgtctcggaaaacagggcagaagagtggtggtcatcacccagaatatcgacgaactacaccgcaaagcaggcaccaaaaacttactagagatacatggatctctgtttaagacccggtgcacctcctgcggtgtggtggcagaaaactacaagtctccgatttgccctgcactgagcgggaagggcgcgccagagcccggaacacaagacgcgagcattccagtcgagaagctacccaggtgtgaagaggcaggctgtggggggctgttgagacctcacgtcgtgtggttcggggagaacttggaccctgcaatccttgaggaggtcgaccgagagctggcccattgtgatttatgcctagtggtcgggacttcttctgtcgtatatcccgccgccatgttcgcccctcaggttgcagcaagaggggtcccagtagcagagtttaacaccgagaccacacccgcaacgaatcgcttcagtcacctcatttccatatcctccttgataattattaaaaactag

SEQ ID NO: 134467 - DNA, 609 bp, Artificial Sequence
  Description of Artificial Sequence: Synthetic coding sequence
atggggtcaaaagagccgaacgccggccaccgcgctattgccgaatgtgagactaggcttggtaagcagggccggcgggtcgtggttattacccaaaacatagatgaactgcaccggaaagccgggacaaaaaatctgctggagatacacgggtctctgtttaaaacccgctgtacatcctgtggagtggtggccgagaactacaagtctcccatatgtcccgcacttagcggcaaaggcgctccggagcctggcactcaggatgcatccatacctgttgaaaaactgcctaggtgcgaagaggctggatgcggaggactgttgcggccccacgtggtctggttcggagagaatctggatcctgctatcctggaggaggtggatagagagctcgcacattgcgacctctgcctggtcgtgggcacctcttcagtggtttatcccgcagcaatgttcgccccacaagtggctgccagaggtgtgcctgttgctgaatttaacaccgaaacaacacccgccacaaaccggttcaggtttcactttcaaggcccatgcgggaccaccctgcccgaagcgctggcttgccacgagaatgaaacagtttcttag

SEQ ID NO: 134468 - DNA, 1203 bp, Artificial Sequence
  Description of Artificial Sequence: Synthetic coding sequence
atggccgcaggtgggttgtcgaggtccgagcggaaagcagccgaacgggtgcgccgactcagagaggagcagcagagggagcgtctgcgccaggtcagtcggatccttcggaaagcagcagccgagagatcagccgaagaggggaggttgctcgctgaaagtgccgatctcgtaactgagctgcagggccgatcccgaagaagggaagggctcaagcggagacaggaagaggtgtgtgacgacccagaggaactacggggaaaagtgcgcgagcttgcttctgcagtgaggaacgctaagtacttggtggtctacactggcgccgggatatctactgcagcatcgatcccagactaccgtggccctaacggggtctggaccctcttgcaaaaggggcgaagcgtctccgccgccgacctgagcgaagccgaacccacactgacccatatgtcaatcacacggctgcacgagcagaagctggtccagcacgtggtttctcaaaattgtgacggtcttcatctgaggagtgggttgccacgaaccgcaatctccgagttacatggtaacatgtatattgaggtgtgcacatcttgtgtgcctaaccgggaatatgtgcgagtgtttgacgtgaccgaacgcactgcactacatcgccaccagacaggccgaacttgccataagtgcggtacccagctgcgagataccattgtccatttcggggagcgaggcacgttgggacagccgttgaactgggaggccgccaccgaagccgctagcagagctgataccatcctttgccttggaagttccttgaaggtactcaagaaatatcctagattatggtgcatgactaaacctcctagccgacgcccaaagctttacattgtcaatttgcagtggacccctaaggatgattgggctgccctaaagctgcatggaaaatgtgacgacgtgatgagacttctgatggccgagttgggtcttgagatccctgcctactcacgctggcaggatccaatctttagcttagccactcccttgcgggcgggagaggaaggttcccacagccgaaaaagcctctgtaggagccgggaggaagccccaccgggtgacagaggtgcacccttgtcctcagctcctattttgggaggttggttcggtcgaggttgcacaaagagaaccaaaagaaaaaaagtcacatag

SEQ ID NO: 134469 - DNA, 963 bp, Artificial Sequence
  Description of Artificial Sequence: Synthetic coding sequence
atgcctggcccacgccggcgctcaccctccgcatgcccacaagtctcacggatcctgagaaaagctgctgccgaacggagtgcagaggagggcaggctgctggctgaatccgctgatcttgttaccgagcttcagggccgatcacggcgaagagaaggtttgaagcggaggcaggaggaggtctgcgacgaccctgaggaactgcgaggaaaggtcagagagctagccagcgccgttaggaatgcaaagtacctagtcgtgtacacgggcgctggaataagcaccgcagcgagcatccctgactatcggggccccaatggagtgtggactttactgcagaaggggcgcagcgtttccgcagccgacctaagtgaagcagagccaaccctgacgcatatgtctatcaccagattgcacgaacagaagcttgtgcagcacgtcgtctctcagaactgcgacggtctgcacctgcgctcgggtctcccccgtactgcgataagcgaactacacggaaatatgtacattgaggtgtgtaccagttgtgttccaaacagggaatacgtgcgcgtctttgacgtcactgaacgaactgcactgcatcgccaccagaccgggcggacctgtcacaagtgcggcacacaactcagggacactatcgtgcactttggcgagcggggcactctcggacaacctctgaactgggaggcagccactgaagccgcttctcgagcagatacaatactatgcctaggcagttctctgaaggtgctgaaaaagtatccccggctatggtgcatgaccaaacccccatccaggaggcccaagctgtatattgttaatctgcagtggactcccaaggacgactgggcagcactgaagctgcacggcaaatgcgacgacgttatgcggcttcttatggctgagctgggactagagatcccagcttactcccgggtgctgtag

SEQ ID NO: 134470 - DNA, 855 bp, Artificial Sequence
  Description of Artificial Sequence: Synthetic coding sequence
atgtcaatgttaccatcgtttggattcacacaagaacaagtagcatgtgtttgcgaagtccttcagcaaggcggaaatctcgaaagactggggcggttcctgtggtccctgccggcttgtgaccatttgcataaaaatgagtccgttctcaaagctaaagccgttgttgcctttcaccggggcaacttcagggagctgtataaaattcttgagtcacatcagtttagcccccataaccatcctaagctccagcagctgtggctgaaagcacactatgttgaggccgaaaaattaagagggcggccgctcggggctgtgggaaaatatagagtgaggcgcaaattccccctgcctcgaaccatttgggacggcgaagaaacaagctactgttttaaggaaaagtcacgaggagtgctgcgagagtggtacgcacataacccataccccagccctcgcgaaaaacgggagcttgccgaagccactgggttgactactacccaggttagcaactggttcaaaaataggagacagagggacagggcagctgaggcaaaagaacgggagaatacagaaaataataatagtagcagcaacaaacagaatcaactgagtccactggaaggcggaaaaccactcatgagcagtagtgaagaggagtttagcccccctcaatcaccagaccaaaactccgtgctgttgctgcagggaaacatggggcatgctcgtagttccaactacagtctgcctggccttaccgcttcacagccctctcacggactccagactcaccaacaccagctccaggattctctgttgggcccactgacctcatctctcgttgatcttgggagctag

SEQ ID NO: 134471 - DNA, 876 bp, Artificial Sequence
  Description of Artificial Sequence: Synthetic coding sequence
atgtccatgctgccgaccttcggatttacacaagagcaggtagcttgcgtatgcgaagtcttacagcagggcggtaatattgagaggctgggccgattcctgtggagcttgcctgcttgcgaacacctgcataaaaatgaaagtgtgctgaaggcgaaagcggtggtagcctttcaccggggcaacttccgggagctgtacaagattctggagagccaccagtttagcccacacaaccatgctaaacttcagcaactctggctgaaggcacattacatcgaggccgagaaattgcgcggcaggcctctaggcgcggtgggaaagtatcgcgtcaggaggaagtttccactaccacgcagtatctgggacggagaggaaactagttactgcttcaaggagaagtctcggagcgttctccgagaatggtacgcgcacaacccctacccgagcccacgggaaaagcgcgagctcgctgaggctaccggtctgactaccacgcaagtttcaaactggttcaagaaccggaggcagcgcgatcgcgcagcagaggcgaaggagagagagaacaacgagaactccaacagcaactctcacaacccgctgaacgggtccggcaaatctgtccttggttccagcgaagacgaaaagactccatccggaacacctgaccactcatcatcttctcctgcgctactgctatccccccctccaccaggtttaccaagtctacactccctgggacatccaccaggaccgagtgcagtacccgttccagtgcccggcggcggaggcgcagacccgctgcagcaccatcacggcctgcaggattcaatcttgaatcctatgagcgctaatctcgttgatctggggtcttag

SEQ ID NO: 134472 - DNA, 999 bp, Artificial Sequence
  Description of Artificial Sequence: Synthetic coding sequence
atggtcttccggagtcctttggacctctattctagccatttcctgctgccaaatttcgcagactcacaccaccgatccatactcctggctagcagcggcggaggaaacggagctgggggtggcggcggcgcgggcggtggcagcggagggggaaatggggcgggaggtgggggcgctggtggcgcaggcggggggggtggcggcggctctagggctccacctgaggaactttctatgtttcaactccctaccctaaatttctctcccgagcaggtggcttcggtgtgcgagacgctggaagaaactggagacatcgagcggctgggacggttcttgtggagccttccagttgctccaggagcttgcgaggccatcaataaacacgaatctattttaagggctagagcggtggtggctttccacacaggtaactttagggacttataccatatcctggagaaccacaaatttaccaaggagtcccatggtaagctgcaagcaatgtggctggaagctcactatcaggaggccgagaagttgagaggccgccccttggggccagtagacaagtatagagtccggaagaagttccccctgcccaggaccatctgggacggagagcagaagactcactgtttcaaggagcggacacgttctctgcttcgggaatggtacctccaggacccttacccaaacccaagtaagaagcgcgagctagcccaagccactggcttaacccccactcaggtcggaaactggttcaagaatcggagacagagagatagggccgctgccgctaagaacaggcttcagcaccaggcaatcggcccatccggtatgagatccctcgccgagcccggttgcccaacacatggcagtgccgaatcaccctccaccgctgcttccccaacaacctccgtgtccagccttacagaaagggccgatactggcacctccatcctctccgtcactagttccgacagcgagtgcgacgtatag

SEQ ID NO: 134473 - DNA, 1020 bp, Artificial Sequence
  Description of Artificial Sequence: Synthetic coding sequence
atgaactgggagttgttactttggctcctggtgctgtgtgccctcctgctgctgcttgtccaactgctgcgctttctgcgcgccgacggagacttaacactgctgtgggcagaatggcaaggccggcggcccgaatgggagcttacagacatggtggtttgggtcaccggcgccagcagtggcatcggagaggagcttgcgtatcagctgtccaagctgggggtttcactggtcctgtctgcaaggcgggtgcacgaactggaacgcgttaaacgccgctgcttggagaacggcaacctcaaggaaaaggatattctcgtactccccctcgatctgaccgatacggggagccatgaagcagctacaaaagcagttctgcaggaattcggccggatagacattttggtgaacaatggcgggatgagtcaacgttcactgtgcatggatacgtccctggacgtgtacaggaagttgatcgaactgaattacctgggaactgtgagcttgacaaagtgtgtcctcccccatatgattgagcgcaagcagggaaagattgtgacagtcaactctattcttggtattatctccgtgcccctgagcatcggctactgtgcttccaagcatgccctgaggggatttttcaatgggctccgtaccgaactggctacatatcccggaataattgtgtctaatatctgtccaggaccggtgcagtcaaacattgtagaaaatagtctcgctggcgaagtaacaaagaccattggcaataatggggaccagtctcataaaatgacgacatctaggtgtgtacgcctgatgttgatctctatggctaatgatctgaaggaagtgtggatatccgaacagccattcctgttggtcacatatctgtggcaatacatgcccacctgggcctggtggattaccaacaagatgggaaagaagcgaatcgagaacttcaagtctggagtggatgctgacagcagttatttcaagatttttaagaccaagcatgattag

SEQ ID NO: 134474 - DNA, 2220 bp, Artificial Sequence
  Description of Artificial Sequence: Synthetic coding sequence
atggccacactgcctgccgagcctagtgcaggacctgcggctgggggcgaagccgtggcggccgcggccgctacggaggaggaggaggaggaggcgagacagcttctgcaaacattgcaggccgccgagggcgaagctgccgcagcagcgggtgcaggggccggagccgcagctgccggagctgaggggcctggcagcccaggtgtgccggggagcccccccgaggccgcctccgagccccccacgggcctccgtttcagccctgagcaggtcgcctgcgtatgcgaggcgctgctgcaggccggccacgccgggcggctgagccgcttcctcggcgccctgccgccagccgagagactacgaggtagtgacccagtgctgagggcccgggcattggtagccttccagcggggagagtacgctgaactgtaccgtttactcgaaagccgaccctttcccgctgcccaccacgcatttctgcaggatctctacctgagagccaggtaccacgaggctgaaagagccagaggaagagccctcggggctgttgataaatatcgccttaggaagaagttccctcttcccaaaaccatttgggatggcgaagaaactgtgtactgcttcaaggaacggtcccgggctgcgctcaaggcctgctatcgcggcaaccgctatccaaccccagacgagaagaggaggctcgccacgctcacaggactgtctctgacccaggtttcaaattggttcaagaaccgtagacagcgggaccgaacgggagccggcggcggtgctccttgcaaatcagagtctgacggtaacccaactacagaggacgaatcctcccgcagtcctgaagatctcgagagaggagctgcacccgtgtccgccgaggcagcagcccagggtagcattttcctcgctggcaccgggccccccgcaccttgcccagcctcatcttctatactggtcaacggatcttttctggctgcctcaggttcacctgctgtcctgcttaatggaggccctgtcataatcaatggattggcccttggagaggcgtccagtcttgggcctcttctgttaactgggggtggcggtgcgcccccaccacagccgtctcctcagggcgcttcagagaccaagacatccctggtgttggatcctcagacgggagaggtccgtctggaagaagctcagtctgaagcccccgagaccaagggagcacaagtagccgcccccggccccgcactgggtgaagaggtcctcggccccctggcacaggtggtgcccggaccccccacagccgccaccttccccctaccacccggcccggtgcccgctgtggctgccccgcaggttgttcccttgtcacccccccccgggtaccctacaggcttgagtcccactagtccgctgttgaatctcccccaggtggtgcctacctcgcaggtcgtcactctgccccaggctgtcggcccgttgcagctgttagccgcgggacctggcagtccggttaaagtggcggccgccgccgggcctgccaatgtccacttaattaactccggagtgggcgtaactgcccttcagctgccttcagcaactgcaccgggtaactttttattggctaatccggtaagcggatctcccattgtaacaggtgtagcactgcaacagggaaaaattatcctgacagcaacttttcccactagtatgctggttagccaggtgctgccccccgctccaggccttgccctccccctgaagcccgaaactgcgatcagcgttcccgaaggagggctcccagtggcaccctcacctgccctccctgaggctcacgcgctggggacgctgtccgcccagcagcctccccctgcagcagccaccacttctagtacgtcactgcccttcagcccagatagccctgggctcctcccaaattttcccgcaccccctccagagggcctcatgttatcccccgctgctgtgcctgtgtggtcagcaggcctcgagctcagtgcgggaacagagggactgctggaagctgagaaggggctgggtacacaggccccgcatacagtgcttagattgcctgatcccgacccagaaggcctattgctcggcgccactgcaggcggtgaggtggatgaaggcctggaggccgaggccaaggtgcttacccagctgcagtcggtacccgtcgaggagcccttggagctatag

SEQ ID NO: 134475 - DNA, 741 bp, Artificial Sequence
  Description of Artificial Sequence: Synthetic coding sequence
atgtttcaactacccatcctaaattttagtcctcagcaggtagccggcgtttgcgagacactggaggaatcaggcgatgttgaacggctgggcaggttcctctggtcccttccagtcgcccctgctgcttgcgaagctctgaacaaaaacgagtctgtcctgagagcccgagcgatcgtggccttccatggggggaactaccgcgaactgtaccatatactagagaatcacaaatttactaaggagtcacacgctaagctacaggctctttggctagaagcacactatcaggaggccgaaaagttaagaggacgcccactaggtcctgttgataaatatcgagttcggaagaagttccccctgccaaggactatctgggatggggagcaaaaaacacactgtttcaaggaaaggactcgccacttgctgagggagtggtacctccaggatccctacccgaatccaagcaagaagcgagaattggctcaagccacgggcctgacgcccacccaggtgggaaattggtttaaaaatcgccggcagcgcgaccgcgccgctgcggccaagaaccggctccagcaacaggtcctctcacagggcagcggtagagctctcagggctgagggagacggaactcctgaagtgctgggagtggcaacaagccctgccgccagcttatcaagcaaggccgctacttctgcgataagcatcactagctcagattcagaatgcgatatctag

SEQ ID NO: 134476 - DNA, 360 bp, Artificial Sequence
  Description of Artificial Sequence: Synthetic coding sequence
atgacccaacagggagccgctctgcagaattacaacaacgaactggtcaagtgtatcgaggagctgtgtcagaaaagagaggagctttgtcggcagatacaggaggaggaggatgagaagcaaaggcttcaaaatgaggtgcggcaactgactgaaaaactggcccgagtgaacgagaatctcgcccgcaagatcgcgtctcggaatgagttcgatcggaccatcgccgagactgaggccgcctatttgaagatcttggaatcgtctcagacactcctcagcgttctcaagcgggaagctgggaatctgacaaaagcgaccgctccagatcagaagagctcaggtggccgtgatagttag

SEQ ID NO: 134477 - DNA, 666 bp, Artificial Sequence
  Description of Artificial Sequence: Synthetic coding sequence
atgctctggctgtttcagtcccttctgtttgtgttttgtttcggaccaggccagcttcgcaatatacaggtcaccaaccactcacagctgtttcagaacatgacatgcgagctgcatttgacatgcagcgttgaggatgccgacgacaacgtctcgttccgttgggaggccctgggtaacacgctgagctctcagcccaacctaactgtttcctgggatcctaggatatcctccgagcaggactacacctgcatcgccgaaaacgctgtctctaatctctctttcagcgtgtctgcccagaagctctgtgaggacgtgaagatccagtacacagacaccaagatgatcctttttatggtgagtgggatctgcatagtcttcgggttcattatcctgctcctgctcgtgctgcggaagagacgcgattcactatcactgagtacccagcgtacgcaggggcccgcagagtccgccagaaacctcgaatatgtcagcgtctcaccgacaaacaacacagtatatgccagcgtgacgcatagcaacagagagacagagatctggacgccccgagagaacgataccattactatttacagcaccatcaatcacagcaaagagtcgaagcccacgttctctagagccacagccctggacaacgtggtctag

SEQ ID NO: 134478 - DNA, 999 bp, Artificial Sequence
  Description of Artificial Sequence: Synthetic coding sequence
atgctttggctgtttcaatccttgctgttcgttttttgtttcgggcccgggaacgtggtgagtcagtcctcactgacccccctgatggtcaatggaatccttggcgagtccgtgacacttccgctcgaattcccagcaggcgagaaggtgaactttatcacatggctgtttaatgaaacaagcttagcattcatagttccccacgagacaaagagcccggagattcacgtgactaacccaaaacaggggaaacggctgaatttcacccaatcctatagtctacaactgtcgaacctgaagatggaggatactggcagttacagggctcagatttccaccaaaacgagtgccaaactgtctagttacaccctgcgcattctcagacagctgcgtaatattcaagtgaccaaccattcccagttgtttcaaaatatgacttgcgaacttcatttgacttgtagcgtcgaggatgctgatgacaatgtttccttcaggtgggaggcactcggcaatacattgtctagccaacctaacctgactgtgtcttgggatccacggatctcgtcggagcaggactacacttgcattgcagaaaatgctgtttcaaatctgtcatttagcgtatccgcccagaaactgtgtgaagacgtcaagatccaatatactgatacaaagatgatcctgttcatggtctcaggcatctgtatagtcttcgggtttatcatccttctgctgctggtgctgcggaagcgaagagactcattgagcctgtcgacacagcgcactcagggaccggccgagtccgcgcgtaatcttgaatatgttagcgtttcccctaccaataacactgtgtacgcatcagtgacgcatagtaatcgggaaacggaaatctggaccccaagagagaacgatactattacaatctattcaacaatcaaccattccaaagagagtaagcccacattttcacgcgctacagcgcttgataacgttgtgtag

SEQ ID NO: 134479 - DNA, 996 bp, Artificial Sequence
  Description of Artificial Sequence: Synthetic coding sequence
atgctctggctatttcagtctttgctttttgtcttttgcttcgggcctgggaatgttgtgtcccaatcgtcccttacccccttgatggtgaacgggatcctcggtgagtccgttaccctgcctctggaattccctgctggagaaaaggtaaatttcattacttggttgtttaatgagaccagcctcgcttttatcgtgccacacgagactaaatctccagaaatacatgtgactaatcccaaacaggggaagagattaaactttacacagagctactctctacagctatccaacttaaagatggaggacaccggcagctatagggcccagatctccacaaagacctctgccaagctgtcatcctacactttgaggattctgagacagttgagaaacatccaggtgacaaaccattcccagctgtttcaaaacatgacctgtgagctgcatctcacttgctccgtggaagacgcagatgataatgtcagtttcagatgggaagccctggggaacacattgtccagccaacccaatctcactgtgagctgggacccacggatctcctccgagcaggactatacatgtatcgcagagaacgctgtgtcgaaccttagcttctcagtaagtgcgcagaaactttgtgaggacgtcaagattcagtataccgacaccaaaatgatcctctttatggtatcaggtatctgtattgtgttcggcttcattatcctgctgctcctggtgctgagaaaacgaagagattcgttatcgctgtccacccagagaacccagggaccggaaagtgcacggaacctggaatatgtgagcgtgtccccaaccaataacaccgtctacgccagtgtcacacatagcaatcgagaaacagagatttggacaccccgcgagaacgatacgatcactatttactctacaatcaaccatagtaaagagagcaagcctacgttctctcgcgccacagcgctcgataacgtagtttag

SEQ ID NO: 134480 - DNA, 891 bp, Artificial Sequence
  Description of Artificial Sequence: Synthetic coding sequence
atggcagggtcacccacttgcctgacgcttatctatattctttggcagctcacggggtctgccgccagcggccctgtcaaggagctcgtcgggtctgtgggtggggcagtaactttccccctgaagtctaaagtcaaacaggttgacagcattgtgtggacattcaacactaccccgctggtcacaatccagccagagggcggtacgatcatagttacacagaaccggaatcgagaacgagtggactttccggacggaggctactctctgaagttgtcaaaacttaaaaagaacgactccgggatctattacgtaggcatctattcatcatccctccagcaaccctcgacccaggagtatgtcctccatgtgtacgaacacctcagtaaacccaaagtaactatgggactccagagcaacaagaacggaacctgtgtgacgaacctgacctgttgcatggagcacggggaagaagatgtaatctacacttggaaagcgctgggacaggcggccaacgaaagtcataacgggagcatcctgccgattagctggcgctggggcgagagcgacatgactttcatttgtgtcgccagaaaccccgtgtctagaaatttttcgtcccctatcctagcaaggaagctgtgtgaaggagcagccgacgatcctgactcatcaatggtgcttctgtgtctacttttggtcccattattgttatcactcttcgtcctcgggttattcctgtggtttctgaagcgcgaacgccaagaggaaaacaatcccaaaggacgatcgagcaagtacggattacttcattgtggcaacaccgagaaggacggtaagtcacccctcacagctcacgacgcccggcacacaaaagctatctgcctctag

SEQ ID NO: 134481 - DNA, 687 bp, Artificial Sequence
  Description of Artificial Sequence: Synthetic coding sequence
atggcagggtcccccacatgtctgacgctcatctacatcctgtggcagctcacagaacatttatccaaacctaaagtgaccatgggccttcaaagcaacaaaaatggaacgtgtgtgaccaatctaacatgttgcatggaacacggggaagaggacgtgatatacacctggaaagcacttggccaggctgccaacgaatcccacaacggttcaattctccccatttcttggcgctggggggagtcagacatgacgtttatctgcgtggcccgcaacccagtcagtcggaacttttcaagccccatactcgctaggaaactctgtgagggggcggccgacgacccagacagctccatggttctgttgtgtttactgctggtgccattacttctctctctttttgtgctcgggctgtttctctggtttctgaagcgcgagaggcaagaggagtatattgaggaaaagaaacgcgtagacatctgtcgggaaacgcctaatatctgtccacattctggtgaaaacaccgaatacgatacaatccctcatactaatcgtactatcctgaaggaagatccagccaacactgtgtacagcacagtagagatccccaaaaaaatggaaaacccccattccttgctgacaatgcccgatacgcctcgcttgttcgcctacgagaacgtgatttag

SEQ ID NO: 134482 - DNA, 1008 bp, Artificial Sequence
  Description of Artificial Sequence: Synthetic coding sequence
atggccggtagcccaacttgtctcacactcatttatatcctttggcagttgaccggatccgccgcttcgggccctgtcaaggagctggtcgggtcagtcggaggagccgtcacatttccccttaaaagcaaggttaagcaagtggactccattgtatggacatttaatacgacaccactggtgaccatccagcctgagggtggtacaattatcgtgactcagaatcgcaatcgagagcgagtcgattttccggacgggggctatagcttaaagctctccaaactcaaaaagaatgatagtggaatctattatgtgggcatatactcctcgtccctgcagcaaccctccacacaggagtacgtcttacacgtatatgagcacttgtctaagccgaaggtaacaatgggccttcaatcaaataaaaatggcacttgtgtgacaaaccttacctgttgcatggagcatggcgaagaagacgtgatctacacttggaaggctctcgggcaggccgcaaatgagagtcacaacggctctatactgcccatctcctggagatggggcgagagtgacatgacctttatatgtgtagccagaaatcccgtgagtcgcaatttctcttcccccattcttgctaggaagctgtgcgagggcgcggcggacgacccagattcgagcatggtcctcctatgcctcttgttagtgccactgctcttatcactgttcgtactcggcttgtttctctggttccttaagcgcgaacggcaagaagagtacatcgaagagaagaagagggtggacatctgccgcgaaacccctaatatctgccctcactcaggtgagaacacagaatatgacactattccacacacaaaccggactatcctgaaagaagacccagccaataccgtgtatagtaccgtggaaatacccaaaaaaatggaaaacccacatagcctactgaccatgccagacacacctcggctcttcgcttacgagaacgtgatctag

SEQ ID NO: 134483 - DNA, 615 bp, Artificial Sequence
  Description of Artificial Sequence: Synthetic coding sequence
atggcaggttctcccacttgtctgactcttatctatatcttgtggcagcttaccgggtcggctgcttccggaccggttaaggaactcgtcggatctgtgggcggggccgtgacatttccacttaagagcaaagttaagcaggttgactccatagtctggacattcaacacaactcctctggtgacaattcagccagagggtggcacaatcatcgttacccaaaatcgaaatcgagagcgcgttgatttccctgacggaggttatagtctgaagctatccaagctgaagaaaaacgactccggaatttattacgttgggatttactccagctcccttcagcagccaagtacccaggagtacgtcctgcatgtctatgagtacattgaggagaaaaaacgcgtcgacatctgccgagagactccaaacatctgcccacatagcggagaaaacactgagtatgacactattccacacaccaaccgaacaattctcaaagaagatcccgccaatactgtgtattcaaccgttgagattcccaagaaaatggagaatcctcacagtttactgaccatgcctgatactccaagactgttcgcgtacgagaatgtgatctag

SEQ ID NO: 134484 - DNA, 498 bp, Artificial Sequence
  Description of Artificial Sequence: Synthetic coding sequence
atggcagggtcccctacctgcctgacgctcatttacatcctgtggcagttgaccgggtctgccgccagtgggcctgtgaaagaactggtgggctccgtggggggggctgtgacgtttcctcttaagagcaaagtgaagcaggtggatagcatagtgtggacattcaacacaacccctctcgtcactattcagccagagggcgggactatcatcgtgactcagaaccggaacagggagcgggtagactttccagatgggggctatagtctaaagctctctaaacttaagaaaaacgattccgggatttattatgtgggaatttatagctcttccttacagcagccctcaacacaagaatatgtccttcacgtctacgaaaataatcctaaggggcggtctagtaaatacggcctcctccactgcgggaatacagaaaaagatggtaaatcccctttaactgctcatgacgctaggcataccaaggccatctgcctatag

SEQ ID NO: 134485 - DNA, 450 bp, Artificial Sequence
  Description of Artificial Sequence: Synthetic coding sequence
atggcgggttctcctacttgtctcaccctgatttacatcctgtggcagttgacagaacatctgagtaaaccaaaagtcacaatgggattacagtcgaataaaaatggcacatgcgtcaccaatcttacttgttgtatggagcatggcgaggaagacgtcatctacacttggaaggctctgggccaagcggctaacgagagtcataatgggtccatcctccccatatcctggcgctggggagaatctgatatgacctttatctgcgtggccagaaacccagtctccagaaacttttccagccccattttggcacggaaattatgcgaagagaataatcctaagggaaggtcaagtaaatacgggctgttgcactgcggaaacacagagaaagacggcaagtccccactgacggcccacgacgccaggcacactaaagccatctgtctctag

SEQ ID NO: 134486 - DNA, 567 bp, Artificial Sequence
  Description of Artificial Sequence: Synthetic coding sequence
atggctggatctccaacctgtctgacactgatctatattctgtggcagcttactgagcatttgtccaaacccaaagtcaccatgggtctacagtctaacaaaaatggcacttgcgtgaccaatctgacctgctgcatggagcacggtgaggaagatgtaatatacacatggaaggcactaggccaggcggctaacgagagccataatggctctatcctgcccatttcgtggagatggggcgaatcagacatgacgttcatatgtgtggccaggaaccccgtgagtaggaacttctccagtcccatcctagctagaaagctctgcgaggagtacatcgaggagaagaagagggtcgatatttgccgggagactcccaacatctgcccccactccggagagaatacagagtatgacactattccgcatacaaatcggaccatcttgaaggaagaccccgcaaatactgtatacagtaccgttgagatccccaagaaaatggaaaatccccactctttactgacaatgcctgataccccccgactgtttgcctatgagaatgtcatctag

SEQ ID NO: 134487 - DNA, 858 bp, Artificial Sequence
  Description of Artificial Sequence: Synthetic coding sequence
atggtgatgcggcccctgtggagcctcttgttgtgggaagccctcctgccaattactgtgacgggggcccaggtgctgagtaaggtcggtggctctgttctcctcgtagctgcccgccctccaggatttcaggtgagagaggcaatttggcgctcactgtggcctagcgaggagctgctggctacttttttcagaggcagtctggagactttataccattctcgctttctgggccgtgcgcagctccacagcaacctgtcactggagttgggaccactagagtccggagactccggcaacttctcagttttgatggttgacacccgggggcagccctggactcagactttgcagcttaaggtgtatgatgctgtgccacgccctgtggttcaagtctttattgcagtcgaaagagacgcacaaccctccaagacctgtcaggtattcctgagttgctgggcccccaatattagcgaaattacctattcctggcgccgggagaccaccatggatttcggaatggaacctcacagcctgtttactgacgggcaggtgctgagcatttccctgggacccggggaccgcgacgtggcctattcatgcatagtgagcaaccccgtctcatgggatcttgccactgtcacaccatgggactcctgtcaccatgaagcggccccgggaaaggccagctataaagacgtgcttctcgtggtagtgcccgtgtcgctcctgcttatgttggtgacactcttctccgcatggcattggtgcccttgttctggaaaaaaaaagaaggacgtccatgctgatcgagtcggaccggagactgagaaccccctggtgcaggacctaccatag

SEQ ID NO: 134488 - DNA, 531 bp, Artificial Sequence
  Description of Artificial Sequence: Synthetic coding sequence
atggtcatgagacctctttggtcactgctgctgtgggaagacgctgttcctcgcccagtagtccaggtatttattgcagtcgagcgggacgcacagccctccaagacctgccaagttttcctctcttgttgggcccctaatatctctgagatcacgtattcatggcgccgtgagacaacaatggacttcggtatggaaccccactctttatttacagatggtcaagtgctgagcattagcttaggtcccggcgacagggatgtcgcctactcttgcatagtttctaatcctgtttcctgggatctggcaactgttaccccttgggatagttgccaccacgaagcagccccgggcaaagcctcttacaaagatgtcttattggtggtcgtgcctgtgtctctgctgctgatgttggtgaccctcttcagcgcttggcactggtgcccctgttccggtaaaaagaagaaggatgtgcacgcagatcgcgtgggccctgagacggagaacccgctcgtgcaggatctaccatag

SEQ ID NO: 134489 - DNA, 444 bp, Artificial Sequence
  Description of Artificial Sequence: Synthetic coding sequence
atgggaggacgccatcatctccaaagacaagtgagtgagtcaatgtcggccctctttcaggcggtgcgactcgagtcagcctgggcagatcgagtgcgatacatggtcgtagtgtacagcagtggcagacaggatacggaggagaatattctattaggggtggatttctccagcaaagaaagcggtttctccgtgtcaactgctggccgtatgcacatttttaaaccggtctccgtgcaagccatgtggtctgcgctgcaggtgctgcacaaagcgtgtgaggtggcacgccggcacaattactttcccggcggcgttgcgctgatatgggctacttactacgagagttgcatcagcagtgagcaatcatgcatcaacgagtggaacgctatgcaggatctagagagcactcggcctgactcaccagccctctttgtagattag

SEQ ID NO: 134490 - DNA, 2112 bp, Artificial Sequence
  Description of Artificial Sequence: Synthetic coding sequence
atggctcgcgctcgtcgggccgtggttggtagcgtcagagacgtgtccacagccgccaccaatttattctactttacagacttttgcattttcctgcaacccacacattgtttctgttgccctgaggtgtccagctctaattaccttagtgaatctttcttcatggtgaaaggcgcggccctgtttcttcagcagggtagttcacctcaggggcagcgctctctccagcatccacataagcacgcaggcgatctccctcagcacttgcaggtcatgattaacctgctgcggtgcgaggaccggatcaagcttgcagtgagattagagtcagcgtgggccgatagagttagatacatggtggtggtctattcaagtggaagacaggatactgaggaaaacatccttctgggagtggacttcagctccaaagaatccaaaagctgcacaattggtatggtgcttaggctgtggtccgataccaaaattcacttagacggcgatggcggcttttccgtgtcaacagctggacgaatgcatatatttaaaccggtatcagttcaagccatgtggtcagctctacaggtgctccataaggcgtgtgaagttgccaggaggcataactacttccccggcggggtagccctaatttgggccacttactacgagtcctgcatctcgtccgagcagtcgtgtataaacgagtggaacgccatgcaagacctcgaatcaacaagacccgattcacctgcactgtttgttgacaagcctactgaaggagaacgaaccgagcgactcatcaaagctaagttgcgttcaatcatgatgtctcaggatctggagaacgtgaccagcaaagaaatccggaatgagctcgagaagcagatgaactgcaatctgaaagagctcaaagagttcatcgataacgaaatgctcctgattttggggcagatggacaaacctagcttaatctttgaccatctgtacctggggtctgagtggaacgcctctaacctagaagagctgcagggcagtggggtggactatattcttaatgttaccagggagatagataactttttccctgggctcttcgcctatcacaacattagagtctatgatgaggagaccactgatctgctcgcacattggaatgaagcctaccatttcattaacaaagccaagcggaatcacagtaaatgcctggttcactgcaagatgggcgtgagcagaagcgcatccaccgtaatcgcctacgccatgaaggaatttggctggcccctagagaaagcgtacaactacgtaaaacaaaagcgatctattactcggcctaacgcaggattcatgagacaactgtctgaatacgaaggcatactggatgcctccaagcagaggcataacaaactttggcgtcagcagactgacagctctttgcagcagccagtcgacgaccctgctgggcccggcgatttcctgcccgaaacgcccgatgggactcctgagtcccagctaccctttctggatgatgctgctcagccagggctaggacctcccctgccttgctgtttccggcgcctcagcgacccactgctccctagcccagaagacgaaacagggagcctggtgcaccttgaggacccagagcgtgaggccctcctggaggaggccgcaccacccgctgaagtccaccggccagcacgccagccccagcaggggagcggcctctgtgagaaagatgtcaaaaaaaaactagaattcggctccccaaaggggcgcagtggctcattgctgcaagtagaagaaactgagagggaggaagggctcggagcaggtaggtggggacagctgcccactcagctcgatcaaaaccttctcaactccgagaatctcaacaataacagcaagcgttcttgtccgaatggcatggaggtgggaagggctagacctgctggctggcacactccgagtctcccgtctcacagtaactggcccaccagtgcttccgtagtcggtactactggcacccggcaccacactcagctgatattcttctattgtctactctgggccccgtcaagccatcttcagggccctgaggggtccttcaccggctag

SEQ ID NO: 134491 - DNA, 3150 bp, Artificial Sequence
  Description of Artificial Sequence: Synthetic coding sequence
atggcgttggtgactttgcagcggtctcctactccctcggcagcatcgagctcagcatccaactctgagcttgaagccggctcagaagaggacagaaaactaaatcttagcctgagtgaaagtttcttcatggtgaagggggccgccctattcctgcagcagggaagttcgccccagggccagagaagcctgcagcatccgcacaagcacgccggtgacctgccacagcacctgcaggttatgattaacctactgcgttgcgaagaccgcatcaagctggcggtccggttagagtctgcctgggcagatagggtaagatacatggttgtcgtgtacagcagcgggcgccaggatactgaagagaatatcctgttgggggtcgacttttccagtaaggagagtaaaagttgtactatagggatggtgctccggctgtggtccgacacaaagatacacctcgacggcgatggtggcttctcagtctctacggccggccggatgcatatttttaaacctgtttctgtccaggccatgtggtccgcactgcaggtactgcataaagcttgcgaagtcgcgagacgccataattatttccctggaggtgtggcactgatctgggccacctattacgaaagttgcatttcttccgagcagtcctgtattaacgagtggaacgctatgcaggatctggagtccacacgccccgactctcccgccttgttcgtggataagccaaccgagggagagagaactgaaagactgattaaggccaaacttagatctatcatgatgtcccaggaccttgaaaacgtgactagcaaggagatcagaaacgagctggagaaacaaatgaattgcaacctgaaggagctgaaagagttcattgataatgagatgctcctaatcctcggccaaatggacaagccttcccttatcttcgaccatctctatcttgggtcagaatggaatgcctctaacctggaggaactgcagggcagtggcgtcgattatatcctcaatgttacaagagaaatagataactttttcccggggcttttcgcttatcataatatccgagtgtacgacgaggagacaaccgatctcctggctcactggaacgaggcctaccactttatcaataaagctaagaggaaccacagcaaatgcctcgtgcattgcaagatgggcgttagtcgatctgccagtaccgtgattgcgtacgcaatgaaggagtttggctggcctctcgagaaggcctacaactacgtgaagcagaagagatccatcaccagacccaacgccggcttcatgcggcagctgtccgagtacgagggcatcttggatgccagtaagcagaggcacaacaagctgtggcggcagcagacagactcttcactgcagcagcccgtcgatgatccggctggccccggcgactttttacccgagactcccgacggcactcctgaatcacaactgcccttcctggacgatgctgcacagccaggtcttggccctccgctgccatgctgcttccggagactttccgatccattgctaccatccccggaagacgaaaccggaagcctagtgcacctggaagatcctgagcgtgaggcccttctcgaagaggccgcaccccccgcagaggtccacaggcctgcacggcagccccagcagggtagtggactgtgtgagaaggacgtgaaaaagaaactcgagttcggctctcccaaagggaggagcggcagcctcctccaggttgaggagaccgagcgtgaggagggattgggtgccggcaggtggggtcaactgccaactcagcttgatcagaacctcctgaatagcgaaaatttaaataacaatagcaaacgttcatgtcccaatggcatggaagacgatgccattttcggaattcttaacaaggtgaagccctcttacaagtcttgtgccgactgtatgtatcctacggcctccggcgcacctgaagcatctcgggaaaggtgtgaagacccaaacgcgcccgcgatttgcacgcagcctgccttcctgcctcatatcacctcttccccagtggcacacctcgctagccgctcaagagtgccggagaagccagccagtggcccgacagaacctcccccattcctgcctcctgcaggatcccgccgggcggacacaagcggccctggcgccggcgccgccttggagcctccggcatcactgttagaaccctctcgggagactccaaaggttctcccaaagtctctgctgttaaaaaattcccattgcgataaaaatccaccttctacggaggtcgtgattaaagaagaaagttccccaaagaaggatatgaaacccgccaaggatctacgcctgctattctctaacgagtccgagaaacctaccactaactcctacctgatgcaacatcaggagagcataattcaactccagaaggcaggcttagttaggaagcacacaaaagaattagagaggcttaagagtgtcccagccgatccggcaccgcccagcagagatggtccagcttcaagacttgaggcctcaattccagaagagtcgcaggatccggccgcacttcatgaactagggcctctggtcatgccgtctcaggctggctctgatgaaaaatcggaagctgcccctgcctctcttgagggtggcagtcttaagagccctccacctttcttctatcgtctggaccatacgagttcctttagtaaggatttcctaaagacaatctgctatacgcccacgtcttccagtatgtcttccaatctgactcgtagcagcagctccgatagcatacacagcgtgcggggcaaaccgggcctagtcaaacaacgcacccaggaaattgaaacccgactgcgtctcgcaggcctgacagttagttcccctttgaagcggtctcattcgctggccaagttgggatccctgactttttccactgaagatttgtcttctgaggccgatcccagcaccgtggccgattctcaggacaccacattgagtgagagcagcttccttcatgaaccacagggtacccccagggatcccgcggccacatccaagccatctggtaagcccgcccctgagaacctgaagtccccgagttggatgtctaaaagctag

SEQ ID NO: 134492 - DNA, 2214 bp, Artificial Sequence
  Description of Artificial Sequence: Synthetic coding sequence
atgcggtgttacctttcatgggatcgctggacctccccaccactatctagtattatctttatcagcgtggactacatactgaacgtcaccagagaaatcgacaacttttttcctggcctctttgcgtaccataatattagggtgtatgacgaggaaactactgacctgcttgcacactggaacgaggcctatcactttattaataaagcaaaaagaaatcactccaaatgtctggtgcattgtaagatgggcgtcagccgaagtgccagcaccgtgatcgcctacgctatgaaagaatttgggtggccgctggagaaggcttataattatgtcaaacaaaagcggtccattacgaggccaaatgctggctttatgcgtcagctgtccgaatatgaaggcatcttggatgcaagtaagcagaggcacaataagctgtggcggcagcagaccgattcgtctctgcaacaacccgtggatgaccccgcagggcccggggacttcctcccggagaccccggacggcacgcctgagtcacagctgcctttcctagacgatgcagcccagcccggattgggccctcctctgccctgttgttttagaagactctccgacccacttcttccctcgccagaggacgagaccgggtcgctggtgcacctggaggacccagaacgggaagcgttattggaggaagcagccccaccggctgaggtgcatcgacctgcgagacagccgcaacagggttcagggctttgcgagaaagatgtgaaaaaaaaactggagttcgggagcccgaaaggaaggagtgggagcttgttgcaggtcgaggagacagaacgggaggagggcctgggcgccggacgatggggccaactcccaacacagctggaccagaatttgttaaattcggaaaacttaaacaacaattctaaacgaagttgtcctaatgggatggaagatgacgccatttttggcattctgaataaagttaaacccagttacaaatcttgtgccgactgtatgtatcctactgcaagcggggccccagaggccagccgggaacggtgcgaggaccccaacgccccggctatctgcacccaacctgccttcctccctcatattacgtcgagtcccgttgctcacttggccagcaggagccgcgtcccagagaagcccgcctccgggccaactgagcccccaccctttcttccaccagccgggagccggagagctgatacaagcggacctggcgctggcgccgcattggaaccaccagcttctctgctcgaaccatcaagagaaacacctaaagtgttgcccaagtcattgctgctcaaaaacagccactgtgataagaacccccccagcacagaagtggtcataaaagaggagtcatcccctaagaaggacatgaagccagccaaggacctcaggctgctcttttccaatgagagcgagaaaccaactaccaactcctacctgatgcagcatcaagagagtataattcagcttcagaaagcaggtctggtgaggaagcacaccaaggagttggagcgtctcaagtccgtccctgcagaccccgccccaccttccagggacggccctgcgtcgcgcctggaagcttctatcccagaggagtcccaggatcctgcggctttgcatgaactgggccctctggtgatgcctagtcaggccggctcggacgagaagtccgaagctgcacctgcatctctcgagggcgggtcacttaaaagccccccaccattcttctaccgcctggaccacacatcaagcttttctaaggatttcttgaaaaccatatgctacacccccacgagtagctcaatgtcctcaaatcttacacgctcctccagcagtgatagcatacattctgtgcgtggcaaacctggactagttaagcaacggacccaggagattgaaacgaggttgaggctggcagggctgactgtatcatcaccgctcaaacgcagccattccctggccaagctgggaagcctgacattttccacggaggatctcagcagtgaggccgatcccagtaccgtcgctgatagccaggacactacactgtccgaatcatctttcctgcatgaaccccaggggacgccacgggaccctgcagctacatcaaaaccctctgggaaacctgctcccgaaaacttgaaatcaccttcctggatgtctaagagctag

SEQ ID NO: 134493 - DNA, 2079 bp, Artificial Sequence
  Description of Artificial Sequence: Synthetic coding sequence
atggctttagttactctgcagcgctcgcccacgccgtctgcagcttcgtccagcgcatccaacagcgagctggaggccggcagtgaggaagatcgtaaattaaatcttagcttgtcagaatccttttttatggtcaaaggagccgctcttttccttcagcagggatccagtcctcagggacagagatccctgcagcatcctcacaaacacgcaggcgatctgccgcagcacctacaggtgatgatcaatcttttacgatgcgaggatcggatcaagctggccgttagactcgaatcagcttgggccgatcgcgtaagatacatggtggtggtgtactccagtggcagacaggatactgaggagaatattcttctcggtgtggatttttcgtcgaaggagtctaaatcctgtaccattggcatggtgcttcggctgtggtctgacacaaaaattcacctggatggtgacggcggatttagcgtgagcacagctggcaggatgcatatctttaaacctgtgtctgtacaggcaatgtggagcgccttacaggtgctgcacaaggcctgcgaggtcgctaggcgacacaactattttcctggtggagtagccctgatctgggccacctactatgagtcatgcatcagcagcgaacagtcatgtatcaacgagtggaatgcgatgcaggacttggagtcaacccggccggattcgcccgcgctattcgtggataaacccaccgagggggagcgcaccgagagacttatcaaagctaagctccggtcaattatgatgagccaagatctcgaaaatgtaacgtcaaaggagatacgcaacgagctcgaaaagcaaatgaactgcaatttgaaggagctcaaagaatttatagataacgaaatgctactgatcctcggtcagatggacaaacccagcctgatctttgaccatctttatctcggatcagagtggaatgccagcaatttggaggagttgcagggctccggggtggattacattcttaatgtgacccgcgaaatcgacaactttttcccaggactgttcgcctatcacaatatccgggtgtatgacgaagaaactacagatctcctggcacattggaacgaagcctaccacttcattaacaaagctaaaaggaatcactccaagtgcctagtgcattgtaaaatgggcgtgtcccggtccgcttccacggttatcgcttatgccatgaaggaatttggctggccgctggagaaggcgtacaattacgtaaaacagaaacgtagcatcactagaccaaatgctggcttcatgaggcagctgtctgaatatgagggcatcctggacgcctctaagcagagacacaataaactgtggcgccagcaaactgattccagcctgcagcagcctgtggatgacccggccgggcctggtgactttctgcccgagacccccgacgggacccctgagtcccagctcccctttctcgatgatgccgcccagcctggtcttggtcccccactgccatgctgctttaggagactgagtgatccgctattgcccagtcccgaggatgagacagggagtctcgtgcatctagaggaccctgagagagaagctcttctggaagaagcggctcctcccgcagaggtccaccgtccagcgaggcagccccagcagggatcaggcctttgcgagaaggatgttaagaagaagctcgagtttggctctcccaaagggcgatcaggaagtctgctgcaggtagaggagacggaacgggaagagggactgggtgctggacgctggggacaactacccacccagctcgaccaaaatctgctgaactccgagaacctcaataacaactctaagcggtcctgccccaatggcatggaggttggcagagcccgaccggccggatggcacacccctagcctcccatcgcattccaattggccaacttccgcttcagtggtcgggacaaccggcaccaggcaccatacccagctgatctttttctactgcctcctgtgggccccctcctcccaccttcaaggacctgaggggagtttcaccggttag

SEQ ID NO: 134494 - DNA, 4272 bp, Artificial Sequence
  Description of Artificial Sequence: Synthetic coding sequence
atggctttagttaccgtacagagatcccccacaccttctactaccagttccccatgtgcgtctgaagccgactccggcgaggaagagtgcaggtcacagccacgaagcatttctgagtctttcctgacagtgaagggtgccgcactgttcctgcccaggggcaacggctctagtactcccagaataagtcaccgacgcaataagcacgccggtgacctgcagcaacatttacaagcaatgttcattttgctgagacctgaagataatattagactggccgtgcggcttgagagtacctaccaaaacagaaccagatacatggtcgtagtcagcaccaacggaagacaggataccgaggagagcattgtgctcgggatggacttttcttcaaatgatagtagtacatgcacgatggggctcgtactccccttatggtctgatactctcattcatctggatggagacggcggcttctctgtgtccacagataatcgcgtacatattttcaaacctgtctccgtgcaggctatgtggagtgccctgcagtcgctgcataaggcttgcgaggtggcacgagcccataattattatcctggctctctgttcctaacatgggtgagttattacgagagccacattaactctgaccagagctctgtgaacgagtggaacgcaatgcaagacgtgcagagtcaccgacccgatagccctgcccttttcactgatatccccacagagcgcgaacgaacggaaaggcttattaagacaaagcttagggaaatcatgatgcagaaagatcttgagaacataacttcaaaggagataaggaccgaactggaaatgcaaatggtttgcaatctgagggaatttaaggaatttattgacaatgagatgatagtaatactgggtcagatggacagcccgactcagatctttgaacacgtgttcttggggtcggagtggaacgcctcaaacctggaggacctccagaacagaggcgtgcgatacatccttaatgttactcgtgaaattgataattttttcccaggtgttttcgagtatcataacattcgcgtgtacgatgaggaagcaactgacctgttagcctattggaacgatacttataaatttatttcaaaggccaaaaaacacggctcaaagtgtctcgttcactgtaagatgggagtcagcaggtcagctagtacagtgatcgcttacgccatgaaagagtacggctggaatcttgatcgggcttacgactatgttaaagaacgtcggacggtaaccaagccaaatccatccttcatgcggcagcttgaagagtaccagggcattctgttggcctctaaacaaagacacaacaagctctggagatctcattctgatagtgacttgagcgaccaccacgagcccatctgtaaaccgggattggagctaaacaaaaaagacattactacttctgctgatcaaattgcggaggtcaagactatggagtctcatccacctatccccccggttttcgtggaacacatggttccacaagatgccaatcagaaaggcctgtgtactaaggagcggatgatctgcctggaatttacgtctcgcgagtttcacgcaggacagatagaggatgaactgaacctgaatgatatcaacggatgcagcagcggctgctgcctgaacgagagtaaattccctctagataactgtcacgcctcaaaagccctgattcagccaggtcacgtgccggagatggctaataagtttcccgacttgacagtcgaggatttggaaacagacgccttaaaggcagatatgaacgtgcatctgctgccgatggaagagctcaccagtccattgaaggacccacccatgagccccgacccagagtcgccctccccgcaaccatcctgccaaactgagatttccgacttctctacagaccgcatcgactttttttctgcgttggagaagttcgttgagctatcccaggagacccgctctcggtcctttagccacagccgcatggaagaacttggtggaggccgcaacgagagctgtcggctctcagtggtggaagtggcaccaagtaaggtcactgctgacgatcaacggtcatcctctttgagcaataccccacacgctagcgaagagtctagcatggacgaagagcaatccaaagccatctcagagctggtctcccctgatatttttatgcagtcccatagcgagaacgcaatctccgtcaaagaaatcgtgacagagatcgaaagtatcagccaaggagttgggcaaatacagctgaagggcgacattctacccaatccctgccacaccccaaagaagaactcaattcacgagcttctgctagaacgggcccagacccccgaaaacaagcctgggcacatggagcaagacgaggattcttgtaccgctcagcccgagctggcaaaggattctggcatgtgtaatcctgaagggtgtcttaccacccatagctctatcgccgacctcgaggagggagaacctgctgagggagagcaagaactccagggctcaggaatgcatccaggagcgaagtggtaccccgggagtgtgcgccgggccactctggagttcgaagaaagactacgtcaagagcaggaacaccacggagctgcaccgacctgcacaagtctgtcaactcgcaaaaactcaaagaatgattcaagtgtagcagatctggcccccaagggtaaatctgacgaagcacctccagaacacagttttgtgctaaaagaacccgagatgtctaaaggtaaaggcaaatatagcggcagcgaagctggttctctcagtcacagcgagcaaaacgcaaccgtgcctgcaccccgcgtactggagtttgatcacctccccgatccacaggagggtccggggtctgataccgggacacaacaggaaggagtgctcaaggacctcagaacagtgattccataccaggagtcggagacccaggccgtgccgctccccctgcccaaaagggttgagataattgagtatacccatatcgtaacatcacccaaccacacgggtcctggcagtgagatcgcgaccagtgagaagagtggagagcaagggttacgaaaagttaatatggaaaaaagtgtgactgtgttatgcactttagacgagaacctgaaccggaccctggatcccaaccaggttagtttacatccacaggttctcccactcccacatagtagttcccccgagcataacaggcctacagatcatcctacctccatcctatccagcccagaagaccggggctcctctctgtccactgcactcgagacggccgctcccttcgtgtcacatactactcatttattgtcagcctctctggactatctgcaccctcagacgatggttcacctggaaggcttcacagaacagtcaagtacaacagacgagccctccgcggaacaggtgagttgggaagaatcccaggaatcacctctcagctcaggctcagaggtgccttataaagatagccagctgagcagcgctgatctcagccttatttccaagctgggggataacactggagagttacaggagaaaatggatcctctccctgttgcttgtagacttcctcactcctcttcatccgaaaacatcaagtctctgtcacatagccctggggtggtcaaggaacgcgccaaggagatcgagtctcgcgtggtctttcaggccggtctgaccaaaccctcacagatgagacgctcagcgtcccttgcaaagctgggataccttgacctgtgtaaggactgccttcctgagagggagccagcatcctgcgaaagccctcacctaaaactcctgcagccattcctccggactgactctggtatgcacgccatggaagatcaagagtccctggagaatccgggggccccccacaaccccgagccaaccaagagctttgtggaacagctaacgaccacagagtgcatcgttcagtcgaagcccgttgagcggcctctcgtgcaatatgccaaagaatttggatcctcacagcagtatttactcccaagggcgggattggaactcacaagctccgaagggggattacctgtactgcagacacagggcttacagtgcgcttgtcctgctcccggactcgccgtggcaccaagacaacagcacggtaggactcacccgctgcggagacttaagaaggcgaatgataagaaacggaccacaaatccattttacaacactatgtag

SEQ ID NO: 134495 - DNA, 609 bp, Artificial Sequence
  Description of Artificial Sequence: Synthetic coding sequence
atgacactctcaacgcttgcgaggaaaaggaaagctcccttggcatgtacatgttccctgggtggtccggacatgatcccctacttcagcgccaacgcagtgatctctcaaaatgccatcaatcaactgattagcgaaagcttcctgacagttaaaggggcggccttattcttgcctcgggggaatggttcctcaactcccaggatcagccaccgaaggaataagcatgctggcgacctacagcaacatcttcaggctatgtttattctgctgaggccagaggataatatcaggctggccgtgaggttggaatccacgtatcagaaccggaccagatatatggtcgtggttagtacgaacggcaggcaggacacggaggaatccattgttctggggatggacttcagcagcaacgacagctctacttgcactatgggcttagtgttacccctgtggagtgatactctgatccacttagacggagacggaggcttctccgtatcaacagataatcgagtgcatatcttcaagcctgtgtccgtacaggctatgtgggttgatcgggacagtcggaacaagcactgcgacgtgcttttggtcgaggaatag

SEQ ID NO: 134496 - DNA, 1350 bp, Artificial Sequence
  Description of Artificial Sequence: Synthetic coding sequence
atggccctggtcacagtgcagcgatctccgaccccaagcaccacgtcatctccttgcgcctccgaggccgattcaggcgaagaggaatgtcggtcacagcctcggagcataagcgaatctttcttgacagtaaagggcgcagctttgttcctgcctagagggaacggctcttccacacccaggattagtcatcgaaggaacaagcacgcgggcgaccttcagcaacatttgcaggccatgttcatccttcttaggccggaggacaatattcgtttggctgtgaggcttgagagcacctaccagaaccgcactaggtatatggtggttgtgtctacaaatgggcggcaggacaccgaagagtcaatcgtgctcggtatggactttagttcaaatgattcctcgacctgcactatgggcttggttctgcccttatggtccgataccctgatccaccttgatggggacggggggttcagcgtgagcaccgataaccgggtgcatatcttcaagccagtgagcgttcaagcaatgtggtccgctctgcagtcactgcacaaggcttgtgaggtcgcccgggcccacaattattaccccgggagtctgtttcttacatgggtgtcctattacgagtcccacattaactcggaccaatcttcagttaacgagtggaatgcaatgcaggatgtgcagagccatcgacctgattctccagcgctgttcaccgatattcccaccgaaagagaacgaacggaaaggctcatcaaaacaaagttgcgtgaaattatgatgcagaaggacctggaaaatatcacgagcaaagaaattaggaccgagctggaaatgcagatggtttgtaatcttcgggaattcaaggagttcattgataacgaaatgatagttatcttaggtcagatggactctcctacacagattttcgagcacgtgtttcttggttccgagtggaacgcttccaatctggaggatctccagaacaggggagtgagatacatcctgaacgtgacacgtgaaatcgacaatttctttcctggagtttttgagtatcacaacatcagggtctacgacgaggaagccaccgatttgttggcctactggaacgatacatataaattcatttccaaagcgaaaaaacacggatccaaatgcctggtacactgcaaaatgggcgtgagccggagcgcgtcaacagtcatcgcttatgctatgaaggagtacgggtggaatctagaccgcgcctacgactacgtgaaggagcggagaaccgtgaccaagccaaatccaagctttatgagacagctggaagagtatcaggggatcctgctggcccgttag

SEQ ID NO: 134497 - DNA, 4353 bp, Artificial Sequence
  Description of Artificial Sequence: Synthetic coding sequence
atggcattagtgacagtccagcggtcgcccaccccttccacgacatcttctccttgcgcttcttcaagccatctggaggatagcgaaagcgctgcgttgctgtgttgtgaatgtgaagaatccgaaatttttactgattccaacgaggccgattccggagaagaagagtgccgaagtcagcctcggtcaatttcagagtcattcctgacagttaagggggccgccctcttcctccccaggggaaatggctcaagcactccaaggatcagccatcggagaaataaacacgccggcgacctgcaacaacacctgcaggccatgtttatactattgcgccctgaagataatatccgcttagcagtgcggctcgagtcaacataccagaatcgcactcggtacatggttgttgtgtcaactaacggcaggcaggataccgaggaatccattgtgctagggatggacttctcttcaaatgattcctcaacatgtaccatggggctcgtactcccattgtggagcgatactcttatccaccttgatggggatgggggcttttccgtctccacggacaaccgggtgcatatttttaagcccgtcagtgtacaagcgatgtggagtgcattgcaatctctgcataaggcttgcgaggtggcacgagcccacaactattacccagggagtttgtttctcacgtgggtatcttattatgagtcacatataaatagtgaccagtccagtgtcaacgaatggaatgccatgcaggacgttcaatcacaccggcctgactccccggctctgtttacggacatacccaccgaaagagaaagaactgaaagattgattaagacaaagctccgcgaaattatgatgcagaaagaccttgaaaatatcaccagcaaagagattagaaccgagctcgaaatgcagatggtgtgtaatctgcgggagttcaaagaatttatagataacgaaatgatcgtgattctgggacaaatggactctcctacccagatttttgagcatgtctttctgggctctgaatggaatgccagtaatctagaagacctgcaaaataggggcgtacggtacattcttaacgtgacacgcgagattgacaatttttttcccggggtgtttgagtaccataacattagagtgtatgacgaagaagccaccgacttgcttgcgtattggaatgacacttacaagttcatctctaaagcgaaaaagcatggctccaagtgtctggtgcactgtaaaatgggcgtcagtagaagcgccagcacagtgattgcatacgccatgaaggagtacggctggaacctcgatcgggcttatgattatgtgaaagagcggagaacagtcactaagccgaatcccagctttatgcggcaactcgaggaatatcaaggaattttactagccagtaagcagcggcacaacaagctgtggcggagccacagcgactcagacctgagtgatcatcacgagcccatatgtaaacctggactggagctgaataagaaagatataactacaagtgccgatcagattgcggaggtcaagacaatggagagtcaccctcccattccgcctgtattcgtggaacacatggtgcctcaagatgctaaccaaaaggggctgtgtaccaaggagcgcatgatctgtctggagttcacatcccgcgagtttcacgcaggacaaattgaggatgagctcaatttgaacgacattaacgggtgctctagtggctgctgcctcaatgaatccaaatttcctctcgataattgtcatgcctctaaggctctgatccagcctgggcacgtccctgagatggccaataagttcccagatctcaccgtggaagaccttgaaactgacgcactgaaggccgacatgaacgtgcatttattgcctatggaggagctcactagcccactgaaggacccaccaatgtcacctgaccctgagtcaccaagcccacaaccatcatgccaaaccgagatcagcgacttctccacagatcgcatcgacttcttttctgccctggaaaaatttgtggagctaagccaggaaactcgatctagaagcttcagtcattcacgcatggaagagctaggcgggggccgtaacgaatcctgcagactctccgtggtcgaagtggcccccagcaaggtgacagcagacgaccagcgcagcagctcactttccaatacacctcatgcctcggaggaaagcagcatggatgaagagcagtcaaaagcaatctcagagttggtgtcccctgatatttttatgcaatctcatagtgagaatgctatctcagtcaaggaaatcgtcacagagatcgagtccatttctcagggggttggacaaatccaactcaagggcgacatactcccaaatccttgtcatactccaaaaaaaaactctatccacgagttactattggaaagagctcagaccccagaaaacaaacctgggcacatggagcaggatgaagatagttgcacagctcagcccgagctggctaaggattctggcatgtgcaaccctgaaggctgtctgacaactcactcctctattgctgatctcgaggagggggaacctgccgagggcgaacaggagctccagggaagtggcatgcacccgggtgctaaatggtatcccggttctgtgcgtagggccacccttgagttcgaggagcgactgaggcaggagcaagagcatcacggagccgcgccaacatgcacttccctcagcacccggaaaaattccaaaaatgacagctctgttgcggacctggcacccaagggcaagtctgacgaggcccctcccgaacatagctttgtgctgaaagaacccgagatgtcaaagggaaagggaaaatactctggttctgaggccggcagtttgagtcactccgagcagaatgctaccgtacctgctcctagagtgctggagttcgatcatctccccgacccccaggaaggtcccggtagcgataccggcacccaacaggaaggagtgctgaaggatctgagaacagttattccatatcaggagtctgaaacccaggccgtgccactgcctttgccaaagagggtggagatcattgagtacacccacattgtcacaagccccaatcacaccggacccggctcggagattgccacctcagagaagagtggcgagcaagggctcagaaaagttaacatggaaaagtctgtcacagtactctgtacacttgatgaaaacttaaatcgaacactcgatcccaatcaagtttcattgcacccacaggtgctccctcttcctcatagttcctctccagaacacaaccggccgaccgatcaccctacgagtatcctgtcctcgcccgaagacaggggctcctccttgtctacggctctggaaacggccgcccccttcgtatcccacacaacgcatctattgtccgcctccttggactatttacacccccaaacaatggtgcaccttgagggtttcacagagcagagttccaccactgatgaaccctccgccgaacaggtgagctgggaggaatctcaagagagccccctgtcttccggtagtgaggtgccatataaggactcacagttgtccagcgcagacttaagtttgatttccaagctgggtgataacacgggggaactgcaggagaaaatggaccctttgcccgtggcttgccgtctacctcattcctcctcttccgagaacatcaagagtctctctcattcacccggcgtggtgaaagagcgcgcaaaggaaattgagagccgagtggtctttcaggccggcttaacaaaaccctcccaaatgcgccgcagtgcctctctcgccaaacttggttacttagacctatgtaaggactgtttgccggagcgcgagcctgcaagctgcgagagccctcatttgaaactgctgcagccttttcttaggacagactctggaatgcatgccatggaggatcaggagtctctggaaaacccgggagccccccacaatcctgagcctaccaaatcctttgtggagcaactcacaactactgagtgcatcgtgcagtctaagcctgtggagagacccttagttcagtacgccaaagagtttggttcctcacagcagtacctcctccccagggccggtctggagctgacctcctcggagggagggcttcccgtgttgcagactcagggcctgcaatgcgcttgtccggcccccgggctggctgtggctccccgtcagcagcacggacgcacgcatccgctgaggagactcaagaaagctaacgataagaaacgaaccactaatccgttctataatactatgtag

SEQ ID NO: 134498 - DNA, 1980 bp, Artificial Sequence
  Description of Artificial Sequence: Synthetic coding sequence
atggccctggtgacggtgagccgttcacccccaggatctggtgcttccactccagtagggccttgggatcaggcagtgcagcgtcggagcagacttcaacgaaggcagtctttcgcagtgctacggggagcggttttaggcctgcaagacggcggcgataacgacgacgctgccgaggctagctcagaacccaccgaaaaagctccgtccgaggaggagctgcacggcgaccaaacggattttgggcaaggatcgcagagcccccaaaagcaggaggaacaaagacagcacctgcacttgatggtacagctactgaggccccaggatgatatccgccttgccgctcagctagaagccccacgaccgccgagactgcgttacctgttggtggttagtacccgggagggagagggtctgtcacaagacgagacagtgctgcttggcgtggattttcctgactcttcctctcctagctgtaccctcggtctggttctgcccctatggtctgacacacaggtgtacctcgacggcgacggaggttttagtgtcacctctggcggccagtcccggatattcaaaccaatctctattcaaaccatgtgggcaactctccaagtgctgcaccaagcctgtgaggcggccttgggcagcgggctcgtgccaggtggtagcgctttgacgtgggcttcacactaccaggagcggctgaactctgagcagtcttgtttgaacgaatggaccgcgatggccgacctcgagagcctgaggccgccctcagccgaaccaggcggatcctcggaacaggaacaaatggaacaagccatccgcgcagagctctggaaagtcctggacgtgagtgacctggaaagcgtgacaagcaaagagattaggcaagcgctcgagctgaggctgggtctgcctctgcaacagtatcgcgactttatagacaaccaaatgctacttctggttgctcagagagaccgcgccagcaggatttttccccacctttatctgggatcagagtggaatgccgcgaacttggaggagcttcaacgtaatagggtcacccacattctgaacatggctcgggagatcgataatttctatccagagaggttcacttatcacaacgtgagactatgggacgaggagagcgcacagttacttcctcactggaaagagacacataggttcatcgaggctgccagagcacaagggacccacgtgctggtccattgcaaaatgggagtcagtaggagcgctgccactgtccttgcatacgccatgaaacagtatgagtgtagtttggaacaagctctgcggcatgttcaggagctaagacccatcgcccgccctaaccctgggtttctcagacaactgcagatttaccagggcatacttacagcttcccggcagtcacatgtgtgggagcaaaaagttggaggcgtgtcccctgaggagcatccggccccagaggtcagcacaccttttcctcctctgcctcccgaacccgaaggtggcggagaggaaaaggttgtggggatggaagagtctcaggccgcacccaaggaagagcccggcccccggccgcgcattaacttacgtggggtcatgcgatccatttccctgcttgaacccagtcttgagttggaaagcactagtgagactagcgatatgcctgaggtatttagtagccacgagagttcccacgaggagccattgcaaccattcccacagctggctcgcacaaaaggaggacagcaggtggatcggggaccacagccggcgctgaagtcacggcaatcagtcgtcactctccaagggtcagccgtggtcgccaataggacgcaagcgttccaggaacaggaacaagggcagggtcagggacaaggcgagccttgcattagttctaccccgcgtttcaggaaagtggtgcgccaggcctccgtgcatgactctggggaggagggagaagcctag

SEQ ID NO: 134499 - DNA, 2091 bp, Artificial Sequence
  Description of Artificial Sequence: Synthetic coding sequence
atgcttctctggatcctactgctggaaacctccctgtgcttcgccgccggtaacgttaccggcgatgtttgcaaggagaagatctgcagctgtaatgaaattgaaggagacttgcacgtcgactgcgaaaagaagggatttacctctttacagaggttcacagcacccacatcacaattctatcacctgttcttgcatggcaattctctgactaggttattcccaaatgaattcgccaacttttacaacgcagttagcttgcacatggagaataacggactccatgagatagtgcccggggcttttctcggtcttcagctagttaagagactgcacattaataataacaagatcaaaagcttccgaaaacagacttttctggggttagatgacctggaatatcttcaggccgattttaatcttctgcgagatatcgatcccggagcttttcaggatctcaacaaattggaggtgctgatcttaaatgataacctgattagtaccctaccagctaatgtatttcagtatgtgcccataacccacctagatctgagagggaaccgactgaaaactctgccctatgaagaagtgctcgaacagatcccggggatagccgaaatcctcctggaggacaacccttgggattgcacgtgcgacttgttgtctctaaaggagtggcttgagaacattccaaaaaacgctctgattggaagggtggtgtgcgaggcgcctacccgtctgcagggcaaggacttgaacgagactacagagcaggacctgtgtcccctgaaaaaccgcgtggattccagtctgcccgcccctcctgcacaggaggagacatttgctccaggaccactgcccactccttttaagacgaacggacaagaggatcacgcgactcctggatccgcaccgaacggtggcacgaaaatcccggggaattggcagatcaaaattaggccgacagccgcgatagccaccggatcctctcgaaacaaaccactggccaatagcctgccctgtcccggtggctgttcctgcgaccatataccaggaagtgggctcaaaatgaactgcaacaaccgcaatgtgtcctctctggcagatcttaagcctaaattgtcgaatgtccaggaattgtttctgcgtgacaacaaaattcacagtattcgtaagagtcattttgtggattataagaatcttattctgctggacttaggaaataataatatcgcaaccgttgaaaataatacattcaagaacctcctggacctgcggtggctgtatatggactccaattacctcgatactctgtccagagagaaatttgctgggctgcagaacctggaatatctaaatgtggagtacaacgccatccaacttatcctaccgggcacctttaacgcaatgccaaaactacggattcttatcttgaataacaacctcctgcgctctttgccagtagacgtgtttgccggagtgagcctgtctaaactctcactgcataacaattatttcatgtacttaccggtcgctggggtgcttgaccaactgacttcgattatccagatcgatctgcatggcaatccttgggagtgctcctgtacaattgtcccctttaagcagtgggcggagcgacttggatccgaagtactgatgtctgaccttaagtgcgaaaccccggtaaatttttttaggaaagacttcatgctgctgtctaatgatgaaatctgccctcagctttatgccagaatcagtccgaccctgacatctcattctaagaactccactggacttgctgaaaccgggacccactccaatagctatttggacaccagtcgagtgtccatctccgtgctagtaccaggactgttgctcgtcttcgttacatcagccttcacagtggtgggcatgttagtgtttatcttaagaaatcggaagcgtagcaagagacgcgacgcaaattcaagtgctagcgagattaattcactgcagactgtctgcgattcctcttattggcataatggcccatataacgcagatggcgctcaccgagtttatgactgtggaagtcacagcctctcggactag

SEQ ID NO: 134500 - DNA, 2175 bp, Artificial Sequence
  Description of Artificial Sequence: Synthetic coding sequence
atgctgtctggggtgtggttcctgagtgtgctgaccgtagcaggaattctgcagacagagtcacgcaaaaccgctaaggatatctgtaaaataaggtgcctttgtgaagaaaaagagaatgtgctcaacattaactgtgaaaacaaagggttcacaaccgttagtctgctgcagccaccgcagtaccgaatatatcaacttttcctcaacggaaacctgcttacgcggctgtaccccaatgaatttgtgaattattccaacgccgttaccctgcacctgggcaacaacgggctgcaggagattcgtacaggcgcattttccggactcaagacccttaagagactccatctaaataacaacaagctcgaaattctgcgagaggatacttttttagggctggagtcgctagagtacctccaagccgactacaattacattagcgccatcgaagcgggggccttctccaagctcaataagctcaaggttctgatcctaaacgacaatctacttctttcattgccctccaacgtttttcgctttgtgttgttgacacatttagacctgcgcggcaacaggctgaaggttatgccattcgccggggtgcttgaacatattggggggattatggaaatacagctggaagagaacccatggaactgcacatgtgatctgctacctctgaaagcgtggcttgatactatcacagtatttgtgggcgaaattgtgtgcgagaccccctttaggctgcacggaaaggacgtaactcagctgacacgccaagatctgtgtcccaggaaaagtgccagtgacagtagccagcgtggatcccacgccgacactcacgttcaaagactgagcccaaccatgaatcctgcgcttaaccctacaagggcacccaaggcaagtaggccaccaaagatgcggaaccgaccgactccccgggttacagtgtccaaagatagacagtccttcggccccatcatggtgtatcagacaaaatcgccagtccctctgacttgtccaagctcttgtgtctgcacatcacagtcaagtgacaatggcctgaatgttaattgtcaggagagaaagtttacaaacataagcgatttacagcctaaaccaacaagccccaaaaagctctacctgactgggaactatctgcagaccgtgtacaagaacgatctgcttgagtattcatccctcgatttactgcacctgggtaataataggatcgccgtgatccaggagggagcgtttacaaacctcacgagcctccgcagactttatctgaacggcaactaccttgaggtgctgtatcctagcatgtttgatgggctgcagagccttcagtacctgtacctggagtataatgtcatcaaggaaattaagccgctcactttcgacgcactgataaatttacaactcctgttccttaacaacaacctcctgaggagcctacctgacaatatttttggcgggacagcgctcacacgtcttaatctccggaataaccactttagccatcttcctgtaaagggcgtgctggaccaactgcccgcttttattcagattgatcttcaagagaatccatgggactgcacatgcgatatcatggggctgaaggattggaccgagcacgcaaatagtccagttattataaacgaggtgacctgcgagtctcccgcgaagcacgctggcgagattctgaagttcttggggagggaggctatttgtcccgactctcccaatctgtccgacggtacagtgctgtccatgaaccacaacacggatacaccccgctctctctcagtgtccccaagctcttacccagagctgcacaccgaagtgcctctgtctgtcctgattttgggcctgttagtcgtcttcattctctcagtgtgttttggggccgggctgtttgtcttcgtgctgaaaagacggaaaggggtcccctctgtgcccagaaacacgaacaacctcgacgtctcttcattccagctgcagtatggaagttataacacagagacacacgacaagacggacgggcacgtgtataattacatccctccgccggtcggacaaatgtgccagaatcccatttacatgcaaaaagagggcgatcctgtagcctattatagaaatttgcaagagttttcctactcaaaccttgaatag

SEQ ID NO: 134501 - DNA, 2538 bp, Artificial Sequence
  Description of Artificial Sequence: Synthetic coding sequence
atgcttagcggagtatggttcctctcagtgttaactgttgccggcatccttcaaacagagtcccggaagaccgctaaggacatttgtaagatcaggtgcttatgtgaggagaaagagaatgttctcaatatcaactgtgaaaataaaggtttcaccaccgtgtctcttctgcaacctccacagtaccggatttaccagctgttcttaaatggcaatctcctgacccgtctgtacccaaatgagtttgtcaactacagtaacgccgtaacgctccatctgggcaataacgggctgcaggagatccggaccggcgcattctccggtcttaaaacactcaaaaggctgcacttaaacaacaataaactggagatactccgagaagacaccttcttgggcttggagtctctggagtacctgcaggctgattataattacataagtgccattgaagctggggcttttagtaaactcaacaagctaaaagtcttaatcctgaatgacaacctgttgctgagtctcccgtctaacgttttccggtttgtgctcctgacccacctcgatcttcggggtaacaggctcaaagtcatgccattcgccggagtcctggaacacatcgggggcatcatggaaattcagcttgaagaaaacccctggaactgcacctgcgacctgctcccactgaaggcgtggctggacaccattacagtgttcgtgggagagatagtgtgcgagaccccattccggttgcacggtaaagacgtgacccagctgaccaggcaggacctctgccctaggaagagcgcgtctgactccagtcaaagaggatcccacgctgacacacatgtacagcgcctcagccccacaatgaatcccgcactgaatccaacccgggcacccaaagcctccagaccacctaagatgagaaatagaccaactccaagagttactgtgtctaaggaccgccagagcttcggacccatcatggtctatcagacaaagtcccccgtacctctcacctgtccgagctcatgcgtatgcacgagccagtcttcggataacggcctgaacgtaaattgccaagagaggaagtttaccaacatttctgacttgcagcctaagcctaccagtcccaagaaattgtacttgaccgggaactacctccagacagtttacaagaacgacctcctcgagtactccagcctggacttgctgcatctgggtaacaaccggattgccgtgattcaagaaggcgccttcacaaatctgacatccctgcgacgcctgtatctcaatggcaactacctggaagttctttacccaagcatgttcgacgggctccagtccctccagtatctctacttagagtacaacgtgatcaaagagatcaagccactgacgttcgacgccctgatcaacttgcagctgctcttcttgaacaacaacttgttacgaagtctacccgataacatattcggcgggactgctctcaccagactcaatctgcggaataatcatttctctcacctgcccgtgaagggcgtgctcgatcagctcccggcatttattcagatcgatctgcaggagaatccatgggactgtacttgtgacattatgggtctcaaggactggacggagcacgctaactcccctgtcattatcaatgaagtgacatgtgaatcaccggccaagcacgcaggggagatcctgaaatttctcggccgtgaagccatttgcccagatagtcccaacttgagcgacggtacggtgctgagcatgaaccacaataccgacaccccacgctccctgtccgtgagtccatcttcctatccggaactacacacagaagttcccttgtcagttctcattcttgggcttctggtcgtgttcattctgtccgtgtgcttcggtgcaggactcttcgtcttcgttctaaagagacggaaaggtgtacccagtgtaccaaggaacaccaacaacctggacgtgtctagcttccagttgcaatatggttcatacaacacggaaacccatgataaaacggatggccacgtctacaactatatcccaccccctgtaggtcaaatgtgccagaacccaatttatatgcaaaaagaaggtgacccagtggcctattatagaaatctccaagagttctcctattctaatctcgaggaaaaaaaggaggagcctgccaccccggcatacactatttctgcaactgagttacttgagaaacaagcaactccgagagagcctgagttactctaccaaaacatcgcggagcgtgtgaaagaactgccaagcgcaggactggtccactacaatttctgcacactgcctaaacgacagttcgcaccatcatatgagtcaagaagacagaatcaggatcgcataaacaaaaccgtgctgtacggtaccccccggaagtgttttgtggggcagtccaaacctaatcacccgctgcttcaagccaaaccccaatctgagccagactatctcgaagtgctggaaaagcaaaccgctattagtcagctgtag

SEQ ID NO: 134502 - DNA, 2538 bp, Artificial Sequence
  Description of Artificial Sequence: Synthetic coding sequence
atgctatccggagtgtggttcctgagtgtgctgactgtggctgggattctgcagacagaatcacgaaagaccgctaaggacatctgcaaaatccggtgcctgtgtgaggagaaagagaacgtcctgaacatcaactgcgagaacaagggattcaccacggtatcactcttgcaaccccctcagtacaggatctatcagctctttttaaatggaaatctcttgacaagactatatcctaatgaattcgtgaactattcaaacgccgtaactttgcacctgggcaacaacgggctgcaagagatacggaccggggcatttagcggcctgaaaacgttaaagcggcttcacctcaacaacaataagcttgagattctgagggaggataccttcctcggactcgaatccctggagtacctgcaggcagactacaattatatctcagccatcgaggccggtgctttttcaaaactcaataaactgaaagttctcatcctgaacgacaacctcctgctttcccttccaagcaacgtgtttcgatttgtgcttctcactcacctcgatctgagagggaatcgccttaaagtgatgccatttgctggcgtgctcgagcacatcggcgggataatggaaattcagttagaagaaaacccctggaactgtacatgcgatctgttgccgctgaaggcctggctggacaccattaccgttttcgtcggagaaattgtctgtgagaccccattcagactccatggaaaagacgtcacacagttaactagacaggacctgtgcccgcgtaagtcagctagcgatagtagtcaacgaggatcccacgctgatacgcatgtccagcgcctctcccccaccatgaacccggccctgaaccctactcgggcaccgaaagcctcacgcccaccaaagatgaggaatcggccgacccccagggtgaccgtgtctaaagaccggcagagcttcgggcccatcatggtctaccagactaaaagtcccgtgccactgacgtgcccatcaagctgcgtttgcaccagccagtcctcagataatggcctgaacgtgaattgccaggagcgcaaattcacaaacatcagcgacctccagcccaaacctacatcaccaaagaaactctatctcaccgggaactacttacagaccgtatacaaaaatgatctgttagagtatagttcccttgacctcctgcacctgggaaataaccgcatagccgtgattcaggagggcgcctttaccaatcttacttcccttcgtcggttgtacctgaacgggaactaccttgaagtgctctatcccagcatgtttgatggattgcagtccctgcaatacctctatctcgagtacaacgtcataaaagaaatcaaacccctgacctttgacgcattgattaatttacagcttctctttctgaataacaacctgctccgcagcctgcccgacaatatctttggcggtaccgcacttacacgtctgaacctgaggaataaccacttttcacacctcccagtcaagggtgttcttgaccaactgcccgcctttattcagattgatctgcaggagaatccctgggattgcacatgtgacataatgggactgaaagattggaccgaacacgccaattccccagtgattatcaatgaagtgacctgcgaatcccctgcaaaacacgcaggcgagatcttgaagttccttggacgtgaggctatctgccccgacagcccgaatttgagcgacggcacagtgctgagcatgaaccacaacaccgatacacctcggtctcttagcgtgagtccgagcagttaccctgagttgcatactgaggtgcccctgtctgtgctgattctaggattactggtggtgttcatactctctgtctgctttggcgcaggactgttcgttttcgtgctaaagcgaagaaaaggagtgccctcagtgccccgcaacacaaataaccttgatgtgagttcctttcagctgcagtacggttcatacaatacagaaacccacgacaagaccgatggacatgtttacaactatatcccccctccggtaggtcagatgtgtcagaaccccatatacatgcagaaagaaggtgaccccgttgcttattaccgcaacctgcaggagttcagctacagcaatctcgaggagaagaaggaggagcccgccacccctgcttataccatctcagccacggaattactggagaaacaggccactcctcgagaacccgagctgctttaccagaatatcgccgagcgagtgaaagagctgccttctgctggcctcgttcattataacttctgtacattgccgaagagacagtttgcccccagttatgagagtcggcgacaaaatcaggacaggattaacaaaactgtgctgtacggcacccccaggaagtgttttgtgggtcagtccaaaccaaatcatcctctacttcaggctaaacctcagtccgagccggactatctggaagtgcttgagaaacagactgcgatctcgcagttatag

SEQ ID NO: 134503 - DNA, 2538 bp, Artificial Sequence
  Description of Artificial Sequence: Synthetic coding sequence
atgctcagtggtgtgtggttcctgtctgtgctgaccgtggctggcatcctgcaaacagagtctcgaaagaccgcaaaggatatctgcaagatcaggtgtttgtgtgaagagaaggaaaacgtgttaaacattaactgtgagaacaagggcttcactaccgtgagtctcctgcagccgccacagtataggatttatcaactgttcttgaatgggaatctcctcacgcgcctgtatccaaacgaatttgtgaactactccaatgcagtgaccttgcatctcgggaacaatggactgcaggaaataaggacaggggcattctcaggcctgaagaccttgaagaggctacacttgaataacaacaagctagagatattaagagaagacacctttctgggcctcgagagcctcgaatatttgcaagctgattacaattatataagtgctatcgaagctggcgcctttagtaagctgaacaagctgaaagtgctgattcttaatgacaatcttctcctgagcctgccctcaaacgtgtttagattcgttttactgacccacctagatctccggggcaaccgtctcaaggtaatgcctttcgctggtgtacttgagcacatcggagggattatggaaatccagctggaagaaaatccttggaactgcacttgcgatctgctgcctctgaaagcgtggctcgacacaatcactgtctttgtgggagagattgtttgtgaaacccccttccgactgcatgggaaagacgtaactcagctgaccaggcaggacctgtgcccccggaagtcagcgagcgatagttcacaacggggatcccacgcggacactcatgtgcaaagactgtcgccaactatgaatcctgctctgaatccgaccagagcccccaaggcatctcgacccccaaagatgcgtaatcgccccaccccacgagttactgtcagcaaggaccggcaatctttcggccccatcatggtgtaccagacaaagagtccggttcctctcacctgcccctcaagttgcgtatgcacctcacaatcttctgacaacggtctcaatgtgaactgtcaggagagaaagtttaccaatatatctgatctgcagcccaaacccaccagccccaaaaagctgtacctgaccggcaattatctccagacagtgtacaagaatgatctgttagagtatagttccctcgacttactgcatctgggtaataatcggattgcagttatacaggagggtgctttcaccaatctgacaagtctgcgccggctctatctgaatgggaactatctggaagtgttgtacccgtcaatgtttgacgggttgcaatccctgcagtacctctatcttgaatacaacgtgattaaggagattaagccactgactttcgacgcattaatcaacctgcaactgctgtttctaaacaacaacctattgcgatcactgcccgataacatcttcggcggcacggccctgactcgactcaaccttcgtaataatcatttctcccacctgccagttaaaggggtcctcgatcagctgccagcatttatccagatcgatctgcaagagaatccttgggactgcacctgtgacatcatgggcctcaaagactggactgagcacgccaacagcccagtgattataaatgaggtcacctgcgaaagccccgccaagcacgctggtgaaattttgaagttcctgggacgcgaagcaatctgtccggacagccctaacttgtccgacggcacggtgctgagcatgaatcataatacggatacaccacgatccctgagcgtgagccctagttcctatcccgagctccatacggaggtaccattatctgtgctcatcttaggattgctcgtagtctttattctgagcgtttgcttcggagcgggactgtttgttttcgtgctgaaacgacggaagggagtcccatccgtgccgcgcaatacaaataatttggacgtgtcctcctttcagttacagtacgggtcttacaatacagaaactcacgacaagactgatgggcatgtgtataattacatacccccgccggtgggacagatgtgtcagaacccaatttatatgcagaaggaaggagatcctgtggcttattacaggaatctgcaggagttctcgtactctaatctggaagaaaagaaggaggaacccgccacaccagcctacactatatcagcaactgagcttctggagaaacaggccacaccaagagagccagaattgttgtatcagaatattgccgaacgtgtgaaggaactgccctcagcaggactagtccattataatttttgcacgctaccgaagcgccagtttgctccaagctacgaatctcgcaggcagaaccaggaccgaataaataagactgtcttgtacggcacacccaggaaatgttttgtaggtcagtcaaaaccaaatcaccctttactccaggccaagccgcagtccgagcctgactatttggaggttctggagaagcaaaccgcaattagtcagctttag

SEQ ID NO: 134504 - DNA, 2538 bp, Artificial Sequence
  Description of Artificial Sequence: Synthetic coding sequence
atgctgtccggcgtttggttcctgtcagtgttgaccgtggccggcattctgcagaccgaaagcagaaagacagcaaaagatatctgtaaaatccggtgcctgtgtgaggagaaggaaaacgtgctgaatatcaattgtgagaacaaaggttttacaaccgtgtcccttctccagccaccccagtatcgaatctaccagttattcctcaatggcaatcttctcacccggctgtatcccaatgaattcgttaattacagtaacgccgtaaccctacaccttggcaacaacggcttgcaggagattagaactggcgccttctcaggacttaagacactgaagaggctgcaccttaacaacaataagctggagatcctgcgcgaagacacctttctcggcttggagtctttagaatatttacaagcagattacaattatattagcgcgatcgaagcgggcgccttcagcaaactgaacaaactcaaagtgctgatactgaatgataatcttctactgagcctcccatcaaacgttttccgcttcgtgctgctgacccatctggacctccggggaaacaggctcaaggtcatgccttttgccggggtgcttgaacacatcggtggtatcatggagatccagctggaggagaatccgtggaattgtacctgcgatctccttcccctgaaggcctggttggatacaattactgtatttgtcggtgagattgtgtgtgagaccccttttcgattacatgggaaggacgtgacacagctgactcgtcaggacttatgtcctagaaagtcagcttccgattcctcgcagagaggctcacatgccgatacccacgtccagcggctatctcccacaatgaaccccgccctcaatcctacccgcgctccgaaggcctcacgcccccctaagatgaggaacagaccaacgcccagggtgacggtctcaaaggatcgtcagtcttttggaccaattatggtttaccaaactaaaagtccggtcccccttacgtgcccatcctcgtgcgtgtgcacctcacagtctagcgacaatggtttgaatgtcaactgccaagagcgcaagtttacaaatatcagcgatctgcaacccaagccaacctcgcctaaaaagctttaccttactggcaactatctacagaccgtgtacaagaatgatcttcttgaatactccagtcttgacctgctgcatctgggcaataataggattgcagtgattcaggaaggagctttcaccaatcttacctccctgagacggctctatttgaacgggaattatttagaggttctgtatcccagtatgttcgatgggctgcaaagcctccagtatctttacctggagtataacgtgattaaggagatcaaaccattgacatttgatgctctgatcaacctgcaactcctgttcctcaacaacaatttgcttagatcgctccccgataatatatttggaggcaccgccctgacgcgactcaaccttcggaacaatcacttttcccaccttccagtgaagggggtactggaccagttaccagcttttatccagattgatttgcaagaaaacccatgggactgcacctgcgacataatggggctgaaggattggaccgaacacgccaactcccccgtgattataaatgaggttacgtgcgagtctcccgctaaacacgccggtgagatactgaaattccttggaagagaagccatttgtcctgactcccccaacctgtcagatggcaccgttctatcaatgaaccacaataccgacactccacggtccctatcagtcagtcccagttcatatcccgaattgcacactgaagttcccttatcagtgttaattcttggacttttggttgtgtttattttgagtgtgtgttttggcgccgggctgttcgtgttcgtgcttaaacgcagaaagggggtgcccagtgtcccccgcaacacaaacaacctggacgtttcttccttccagctccagtatgggtcatataatactgagacccatgacaaaaccgacggccacgtctacaactacataccccctcctgtaggccagatgtgccagaaccccatctacatgcaaaaggaaggggaccccgtggcttactataggaatctgcaggaattttcttactctaatctagaggagaagaaagaggagcctgccacacctgcgtatactatctctgcaactgagctgctggaaaaacaagccacaccacgtgaaccagaactgctctaccaaaatatcgccgaacgagtgaaagagctgccctccgcgggccttgtgcactataacttttgtaccctgcccaagcgtcagttcgcgcccagctacgagtcaagacgacaaaaccaagatagaattaataagaccgtgctgtacgggactccccggaaatgtttcgtgggccaaagcaaaccaaatcatcctctcctgcaggctaagcctcagtccgaacctgattacttggaggtcctagagaaacagaccgcaatctcccagctgtag

SEQ ID NO: 134505 - DNA, 2538 bp, Artificial Sequence
  Description of Artificial Sequence: Synthetic coding sequence
atgttgagtggggtgtggttcttgtccgtacttacagtcgcaggtatcctgcagactgaatccagaaagactgccaaagatatctgcaagattcgatgcctgtgtgaggaaaaagaaaatgttttgaacatcaattgcgaaaataaaggcttcactacagtctccctgctgcagccgccacagtaccggatctatcagctgttccttaacgggaatctgttgacccgactctatcccaatgagttcgtgaattattcgaatgccgttaccctgcatctcggaaataatggcctacaggagattcgcaccggtgcctttagtgggctcaagacccttaagcgcctgcacctaaacaataataaattggagatacttagggaagatacttttcttggactcgagtccctggagtatcttcaggcagactataactacatctcagcaatagaggccggcgcgtttagcaaattaaacaaactgaaagtactgatcctgaatgataacctgttgcttagcctcccctcaaatgtcttccgcttcgtcttgctcacccacttggacttaagaggtaaccgcctaaaagttatgccattcgcaggggtgctggagcacataggagggattatggagattcagcttgaagagaatccctggaattgcacatgtgaccttcttccgctcaaagcatggttagatacaatcacagtgttcgtgggggaaattgtgtgtgaaaccccttttagactccacggaaaagatgtgacgcagctcacccgtcaagatttgtgtccgaggaaaagcgcatcagactcttcacagagaggttcccacgccgatacacatgtgcagagactgtctcccaccatgaaccccgctcttaaccctacaagagcgccaaaggcaagtcgccctcctaagatgcgaaaccggccaaccccccgggtgacagtgtcaaaagataggcagtcttttggacccatcatggtgtaccagaccaagtcacctgtgcctctgacttgcccttcgagctgcgtctgcacaagtcaatcttccgacaatggtcttaatgttaattgtcaggagcgcaaattcaccaacattagcgatttgcagcccaagccaacctccccaaagaagttgtatctgactggcaactatcttcagaccgtgtacaaaaatgaccttctggaatattctagcctagatctgctacatcttggaaacaaccgcatcgccgtgatccaggagggggcattcaccaaccttacctctctgcgcagactttatttgaacggaaactacttggaggtcctgtatccttccatgttcgatggactgcaatctctccagtacctgtatctggaatacaatgtgattaaagagataaaacctctcactttcgatgcactaatcaacctgcaattgctctttctgaacaataatctgctgaggtccctgccagacaacatcttcggcgggaccgctttgaccagactcaaccttaggaataaccacttctcccacctgcctgtcaagggtgtgttggatcagctgcccgcattcatccagatcgatctccaagaaaacccctgggactgcacgtgtgatattatgggacttaaggattggacagagcacgcaaacagccccgtgattatcaacgaagtcacatgcgaatctcccgcgaagcacgccggagaaatcctgaagtttcttgggcgagaggctatttgccccgatagcccgaacttgtcggatgggacagtcctctccatgaaccacaatactgacaccccacgctccctctctgtgagccctagttcctacccagagctgcacaccgaggtaccactttcagtgctcatactaggcctcctggtggtcttcattttgtccgtctgttttggtgccggcctgtttgtcttcgttctcaagagacggaagggcgtcccaagcgttcccagaaacaccaataatctagacgtcagtagctttcagttacagtacggttcatataataccgagacccacgacaaaactgacggacatgtctataattacataccaccgccagtgggtcagatgtgccaaaatcctatctacatgcagaaagagggggatccagtcgcatactaccgaaacctgcaggagtttagttacagcaacctggaagaaaagaaggaagaacctgcaacccccgcgtacacaatttccgctaccgagctgctggaaaagcaagccacgcctagagagccagagctcctgtaccagaatatagccgagcgcgtgaaagaactccccagtgcaggactagtgcactataacttttgtaccttgccaaagcgccagttcgcaccatcatacgagagtagaagacagaaccaagataggatcaacaagaccgtgctctacggtactccacgaaaatgttttgtaggacagtctaaacccaaccacccactcctacaagccaaaccccaatccgagcctgattaccttgaagtcctggagaaacagaccgctattagtcagctctag

SEQ ID NO: 134506 - DNA, 2934 bp, Artificial Sequence
  Description of Artificial Sequence: Synthetic coding sequence
atgaaaccgtccatcgctgaaatgttgcacaggggacggatgctgtggattattctgctatcaaccattgcactgggctggacgacaccgattcctctaatcgaggactcagaggagattgacgaaccctgctttgatccatgctactgtgaggtgaaagaatcgctctttcatattcattgcgattccaaggggttcaccaatattagccagatcacggaattttggtcacggccctttaaactctacttgcagcggaacagcatgcgaaaattatataccaactcttttctacatctgaacaacgccgtgagtataaacttgggcaacaatgcgttgcaggatatacagactggcgcattcaacggcctcaaaatcttgaagcgattgtacctgcacgagaacaaactcgacgttttcagaaatgacacctttctcggtctggagagcctggagtacttacaggctgattataatgttataaaacggattgagtccggagcatttagaaatctgagcaagctccgggtgctgatcttaaatgataatctcatccccatgttgccgaccaatctgttcaaagccgtctccctgacccacctcgacctgagggggaacagactgaaagtgcttttttaccgaggcatgctcgatcacattggccgatccctgatggagctccaacttgaagagaatccgtggaactgcacatgtgagattgttcagttgaaatcttggctggaaaggataccatatactgctctggtgggcgatatcacctgcgagacgccattccacttccatgggaaagatcttagagagattcgaaagacagagctctgcccactactctctgacagcgaggtcgaggcttctcttgggatcccccactcaagctcttctaaagagaatgcctggcctaccaaaccctcgtctatgctgtcatctgtccacttcaccgccagctctgtcgagtacaagtcaagcaacaagcaaccgaagcctacaaagcagccgagaacaccccgaccgccctccacaagtcaagcattgtaccctggacccaaccagccacccatcgccccttatcagactcgcccccccatcccgatcatttgtcccacagggtgtacctgtaatctgcacataaatgacttgggccttaccgttaattgtaaagagcgggggttcaataacatttcagaactgcttccacgccccctcaacgcaaagaaattgtatctgagttcgaacctgatccaaaagatttatcgatctgatttctggaatttttctagtcttgatctgcttcacttgggaaacaaccgaatttcgtacgttcaggacggcgcttttataaatctgcctaaccttaaaagcctgttcctcaacggtaatgatatcgagaagcttactcctggaatgttcagagggctccagagcctacactatctgtactttgaattcaatgtcatcagggaaatccagccagctgctttcagtttaatgcccaatctgaaactgctttttctaaacaacaatctgctgcgtaccctgccaacggacgctttcgccggaacttctctggcccgccttaatctccgcaagaactattttctctatcttcctgttgcgggcgtcctggagcacctcaacgctatcgtgcagatagacctcaacgagaatccatgggactgtacttgtgaccttgtcccatttaagcagtggattgagaccataagctctgtatctgtggtgggagatgttctgtgccgctcacctgagaaccttacccatcgggatgtacgaacaatcgagctcgaagtgttgtgccctgagatgcttcatgtagccccagccggcgaaagccccgctcagcccggagattcacacctgattggagctcctaccagtgctagtccctacgagttttctccccccggggggccagtccccctctctgtgctgattttaagtctcctggtattgttcttctctgccgttttcgtggccgctggcctgtttgcatatgtgctgcgcaggcggaggaaaaaactccctttcaggtcaaaacggcaggaaggcgtggatctcaccggtattcaaatgcagtgccacaggctgtttgaggacggaggcggcggcggcggaggaagcggggggggcggccgtccgactctttcttccccagagaaggcccctcctgttggtcatgtgtatgaatatattccgcatccagttactcaaatgtgcaacaacccaatctacaagcccagagaggaagaagaagtcgcagtgagcagtgcacaggaagcaggttcggctgaacggggaggcccgggtacacagcccccaggtatgggagaagccctccttggctcggaacaattcgccgagactccaaaagagaaccactcaaattaccgaacgcttcttgagaaagagaaggagtgggcactggccgtgtcatccagtcaacttaataccattgtgaccgtgaatcaccaccatccacatcaccccgcggttggaggcgtgagcggtgtggtcggcggaacggggggcgatcttgccgggttcagacaccacgaaaaaaatgggggtgttgtccttttcccacctggcggcggttgtgggtcaggaagtatgctgctagatcgggagcgaccacagcccgccccatgtactgtcggattcgtagattgcctttacggcaccgttcccaaattaaaagagctgcacgtgcacccacctgggatgcagtacccggatcttcagcaggacgcacgcctgaaagaaaccttgctctttagtgcaggtaagggtttcaccgatcatcaaactcagaagagcgactaccttgagctccgcgccaaactgcaaacaaaacctgattacctcgaggtgttggagaagacaacctatcgcttttag

SEQ ID NO: 134507 - DNA, 2934 bp, Artificial Sequence
  Description of Artificial Sequence: Synthetic coding sequence
atgaaaccatccatcgctgaaatgctccaccgaggccggatgttatggattatcctgttgtcaacaattgctttggggtggaccacccctatacccttgattgaagatagtgaggagatcgatgagccatgtttcgacccatgttattgtgaggtcaaggagagcttgttccatatccattgcgatagcaaagggttcaccaacatcagtcagatcaccgagttttggtcccgcccattcaagctgtatctccagagaaacagcatgcggaaattgtacaccaacagcttcttgcacctgaacaacgccgtgagtatcaacctgggtaacaacgcactgcaggacattcagacgggagcctttaatggtttgaagattctgaaaaggttatacctccacgaaaataagctggacgtgtttcggaatgacaccttcttgggcctggagtcccttgagtacttgcaggccgactataatgtgattaagaggatcgaaagtggggcttttaggaatctcagcaagctgagggttctcatcctgaacgacaacctcatccccatgctaccaacaaatctctttaaagcggtctcacttacccacctcgacctgcggggaaacagactgaaggtcttgttctaccgcggcatgcttgaccatatcggacgcagtttaatggagttgcagctagaagagaacccgtggaactgcacctgtgagattgtacagttgaagtcatggcttgaacgaataccatacaccgcacttgtgggagacattacttgtgagacacccttccatttccatggcaaggacctaagggaaatccgtaagactgagctgtgtcctctgctctctgatagtgaagtagaggcgagcctcgggataccacacagtagttccagcaaggagaatgcatggcccactaagcccagctcaatgctctcctctgtacatttcacagcttcttctgtcgaatataaatctagtaataagcagccaaaaccaacaaagcaaccgaggaccccaaggcccccctctacaagccaggccttataccccggaccgaatcagcctcctatcgccccttatcagacaaggcctccaatacccattatttgccctactgggtgtacctgtaacttgcatatcaatgacttaggactaacggtgaactgcaaagagaggggttttaacaacatatccgagctcctccctaggccgttgaatgcgaagaagctgtatctgtccagcaatctgatacaaaagatttatcggagcgatttttggaactttagtagtttggatttactgcatctcggcaataataggatcagttatgtgcaggacggagccttcattaatctgccgaatctgaagagcttattccttaacggaaacgacattgagaagttaacacccgggatgtttcgggggctgcagagccttcattacctgtatttcgaattcaacgtgataagggaaattcagcccgccgcgttttccctgatgcccaacctcaagttgctgtttctgaacaacaacttgttgaggactttgccaaccgatgctttcgccgggaccagcctggcaaggttgaatctcaggaaaaactactttttgtatcttccggtcgccggtgttttggaacatctgaatgcaatagtccaaatcgatctgaatgaaaatccctgggactgtacctgtgatctcgtgccctttaagcagtggattgaaaccatctcaagcgtgtccgttgtaggtgacgtactttgtcggtcaccggaaaacctgacccatcgcgacgttcggaccatagagttagaggtgctttgccctgaaatgctgcatgtggcacctgcaggtgaatcacccgctcagccaggggatagccacctcatcggcgcccctactagtgcctccccttacgagtttagtccaccgggagggcctgtccctctgagtgtgctcattctctcattactggtgcttttcttctccgctgttttcgtggccgcaggattgttcgcgtacgtacttcgtcggcgacggaagaaactgcccttcagatccaagcggcaagagggcgtagacctaactgggattcagatgcagtgccatcgtctctttgaagacggaggcggaggtggggggggatcagggggaggaggtagacctactctgagcagccctgaaaaggccccccctgtaggccacgtgtacgagtacatcccccatcccgtgactcaaatgtgtaacaacccaatatataagccccgagaggaagaggaggtcgccgtgtccagtgcccaggaagctggttccgccgagcgcggcggacccgggacgcagccccctggcatgggggaggctttactgggtagcgaacaatttgctgagacaccaaaagagaaccattcgaattatagaacactcctggagaaggaaaaggagtgggcgctggccgtgtcttcctcacagctgaacactatcgtcaccgtgaatcaccaccatccccatcatcccgctgtgggtggagtgtcgggggtcgtcgggggaaccggtggcgacctggcagggtttcgccatcacgagaaaaacggcggcgtggtcttgttcccccccggcgggggttgtggctccggtagcatgcttctggatcgcgagcgcccccaaccagccccttgcacagtcgggttcgtagactgtctgtatggcacagtccctaaacttaaggagctacacgtccatccgccaggcatgcagtaccccgaccttcaacaagatgctaggctgaaggagacgctcctattttctgccggcaagggctttaccgaccaccaaacccaaaagtctgattacttagagctccgggctaaacttcagaccaagccagactaccttgaggtgctagagaaaacgacttacagattctag

SEQ ID NO: 134508 - DNA, 492 bp, Artificial Sequence
  Description of Artificial Sequence: Synthetic coding sequence
atgaagcccagtattgcagagatgctgcacagaggacgtatgttgtggataatactgctgagcacgatcgccctggggtggactacccctattccgctcatcgaggacagtgaagagatcgatgaaccatgctttgatccttgctactgcgaggtcaaagagtccctcttccacattcactgtgacagcaaaggattcacaaacatctcacaaattaccgagttctggtctagaccctttaaactgtatctgcagcgtaacagcatgagaaagctgtacacgaactcctttctacacctcaacaacgctgtttctatcaacctcgggaacaatgctcttcaggacatccagacaggggccttcaacggcttgaagatccttaagcgtctgtatctgcacgaaaataagctcgacgtgttcagaaacgatacttttcttggcctggaatcgctggaatatctccaggccgactataacgtgattaaacgatag

SEQ ID NO: 134509 - DNA, 2514 bp, Artificial Sequence
  Description of Artificial Sequence: Synthetic coding sequence
atgttcctgtggttattcctaatcctgtccgcactgatttccagtacaaatgccgattcagacatttcagtcgagatttgcaacgtgtgcagctgtgtctccgtagagaatgtgctgtacgtcaattgcgagaaagtgagcgtgtacagaccaaaccagctgaaacctccatggtcaaacttctatcacctcaatttccagaacaattttctcaacatcctatatccgaacacttttctaaactttagtcacgctgtttccctacaccttggaaataataagctgcagaacatcgaaggaggcgcctttctcggactatcggcgctgaaacagctccacttgaataataacgaattgaagatcttgcgcgcagacacattccttggaatcgagaacctggagtacctacaggctgattacaacttgataaaatacatcgaacggggagccttcaacaagcttcacaaactgaaagttctcatcctgaacgacaatctcattagctttttgcctgataatatcttcagattcgctagcctcacacacctggacattcgcgggaataggatacagaagctcccctacataggagtgttagagcacattggccgagtggttgagctgcagctggaggataatccctggaactgcagttgcgacttactacccctgaaggcatggttggaaaacatgccttacaacatctatattggtgaggccatctgcgagacacccagcgacctgtatggcagactgctgaaagaaacgaacaagcaggaattgtgcccaatggggacgggatctgattttgacgtaagaattctgccgccttcccagttggagaacggttacactacgccgaatgggcatacaacgcagaccagcctgcataggctggtgactaagcccccaaagacaacaaacccatcgaaaataagcggtatagttgcaggaaaggcattatctaatagaaatctctcgcagattgtaagctatcagactagagtgcccccactcaccccgtgcccagcaccttgcttctgtaagacacacccctcagatctggggttgtcggtgaactgccaagaaaagaatatccaatcaatgagcgagctcatcccaaagccgctgaacgctaaaaaactgcatgtgaacggaaacagtattaaggacgtcgatgtgagcgattttaccgatttcgaaggcttggacctgctgcatctgggttccaatcagataaccgtcataaaaggcgacgtgttccataatctgacgaatctgagaagactatacctgaacggtaaccagatcgagagactatatcctgaaatcttttcaggattacacaacctgcaatacctgtacttggagtataacctgatcaaggagattagcgctgggaccttcgacagcatgccaaatctccagcttctgtatcttaataataatctgctgaagagcttaccagtgtatatattctccggcgcaccattggctcgcttgaatttacgcaataacaagtttatgtacctcccggtctcaggggtcctggaccagctgcagtctctcacacagatcgaccttgaaggcaacccctgggactgcacttgcgatctggtggccctgaaactttgggtggagaagctgagcgatggaatcgtcgtcaaagagctaaagtgtgaaaccccagtccaattcgctaatattgaactcaaatccctcaagaatgaaatcctctgtccgaagctgcttaataagccttccgctccgtttacgagcccagctccagccatcacatttactacccccctcggccccatcaggagcccgccgggcgggcctgtacctctttctattttgatcctgtccattctggtagttcttatcctcaccgtgtttgttgccttttgcctactcgtttttgtgcttaggcggaacaagaagcctacagttaaacatgaggggctcggaaacccagattgtggctccatgcaactccagctgcggaaacatgatcacaagacaaataagaaggatggactttccaccgaggccttcattccgcagacaatcgagcaaatgtcaaagtctcacacctgcggattgaaagagtccgagactggttttatgtttagtgatccaccgggccaaaaagtggtcatgagaaacgtggccgataaggaaaaagacctgctccacgtggacacgagaaagcgcctgtccaccatagatgagttagacgagcttttcccatcacgcgatagtaacgttttcatccaaaattttcttgagagcaagaaggaatacaacagtatcggcgtttccggcttcgagatccggtaccctgagaagcagcccgacaaaaaatctaagaaatcactgatcggtgggaaccattcaaagattgtggtggagcaaaggaagagtgaatacttcgagctgaaggccaaactccaatcctcccctgattacttgcaggtcctagaggagcagacggctcttaataaaatctag

SEQ ID NO: 134510 - DNA, 2514 bp, Artificial Sequence
  Description of Artificial Sequence: Synthetic coding sequence
atgttcctgtggctttttctcatcctctccgcactgatcagctccacaaatgctgatagtgacattagcgtagaaatttgtaacgtttgttcatgcgtaagcgttgaaaacgttctgtacgttaactgtgaaaaggtgagcgtttatcggccgaaccaattgaaaccaccctggtcaaatttctatcacctgaactttcaaaataattttctcaacatactttacccaaacactttcctgaacttcagccacgccgtgagcttgcacctgggaaataacaaactccaaaatatcgaaggaggggcttttcttggtttatccgcccttaaacagctccacctgaacaacaatgaactaaaaattctcagagctgacacattcctggggattgaaaatctggagtacctacaggcggattacaacctcattaaatatattgaaagaggcgccttcaataagctccacaaattgaaggttttaattctgaatgacaatctcatcagcttcctgcccgacaacattttccgcttcgcgtccctgacacatctcgatattaggggaaacagaattcaaaagttgccttacatcggcgtgctcgagcacataggtagagtcgtagaactgcagctagaggacaatccctggaattgctcttgtgacttgctgcctttaaaggcatggctggagaatatgccttacaacatttacatcggcgaagctatctgtgagacaccaagcgacctgtacggtagactgctcaaggaaactaacaaacaagaactatgccctatgggaaccggctcggactttgacgtgcgtatcttgcctccatctcaacttgaaaacgggtataccacacctaacggtcataccactcagacaagccttcaccggctggtcacaaagccccccaaaactaccaaccccagcaagatttccgggattgtcgcaggcaaggcgttaagcaatagaaacctatctcagattgtgagctatcaaacccgggtgccaccactgaccccttgcccagctccctgtttctgtaagacgcacccaagtgacctaggcctgtccgtcaactgccaggaaaaaaacattcagtctatgtctgagttgatacccaagccactgaacgctaaaaagctgcacgtcaatggaaatagtatcaaagatgtggatgttagcgattttaccgattttgagggcttagatcttctgcacttggggtcgaatcaaattaccgtgatcaaaggggatgtctttcacaacctgacaaatttaagacggctctacctgaatggtaaccagatcgaaaggctctatcctgaaattttctccgggcttcataatctgcagtacctgtatctggagtacaacctcattaaagaaatcagcgcgggcacctttgacagcatgccgaacttgcagcttctgtatctcaacaataatttacttaagtctttgcctgtgtacatcttttccggcgccccattggctagactgaatctgcgcaataacaaattcatgtatctcccagtgtccggcgttctggatcagcttcaatctctgacccaaatagatttggagggcaacccttgggactgcacgtgtgaccttgtcgccctgaaactgtgggttgagaaactcagtgacggaatcgtggtcaaggaactgaagtgtgaaaccccagtccaatttgcaaacattgagttgaagtctctgaagaacgagatcctctgtcccaaattactgaataagcctagtgctcctttcacaagtccagccccagccatcacatttacgactccactcggacctattcggagtcctcccggcggacctgtgcctttatctatccttatcctgagcatactggtggtgctgattctaacagtgttcgtcgcattttgtcttctggtcttcgtgttgagacgcaataaaaagccgacggtgaagcatgagggactaggcaatccagactgcggcagtatgcaactccaactgaggaaacatgatcataaaacaaataagaaggatgggttgtctactgaggcttttatacctcagactatagagcaaatgagtaaaagccacacttgcgggctgaaggaatcagaaactggattcatgttttctgatcccccagggcaaaaggttgtgatgcggaatgtggccgacaaggagaaggacctactccacgtggacaccagaaaacgcctgtccaccatcgacgaactggacgagttgttccctagccgcgactctaacgtgtttattcagaactttctggaatccaagaaggaatataactcaattggtgtgagcggtttcgagatccgataccctgaaaaacagcccgacaaaaaatctaagaaatccctcattgggggcaatcattcaaagatagtcgtggaacagcgcaaatctgaatattttgagcttaaagccaaactgcagagcagccccgattatctgcaggtgctcgaggaacagactgcacttaataagatttag

SEQ ID NO: 134511 - DNA, 2514 bp, Artificial Sequence
  Description of Artificial Sequence: Synthetic coding sequence
atgttcctctggctgttcttaatcctgtctgctctgatctcgtctacaaatgccgattccgatatatccgttgagatctgtaacgtttgctcttgtgtaagtgtcgagaacgtcctgtatgttaattgcgaaaaggtcagcgtatatcgcccaaatcagctgaagcccccctggagcaatttctaccacctcaattttcagaacaacttcctcaacatcctgtacccgaatacattcttgaatttctcccacgccgtgtcactgcaccttggaaataacaaactccagaatatcgagggaggcgcctttctggggcttagcgcactgaaacagctccacttgaataataacgagctgaagattctgcgtgccgatacctttctggggatcgagaacctggagtatctccaggccgactacaacctcatcaaatacattgaacggggagctttcaacaaactccacaagcttaaggtgctcatcctgaacgacaacctgatttctttcctgccagacaacatttttagatttgcatccctgactcacctagacatcagaggtaaccgcattcaaaagctcccttatataggcgttcttgaacacatcggacgagtggtggagctccagctggaagataatccctggaattgctcctgtgatttactgcctctgaaggcttggctggaaaacatgccatacaacatttatatcggcgaagccatctgtgagacaccatctgacttgtatggaaggctgttaaaagagaccaataaacaggagctgtgtccaatgggaaccggtagcgatttcgacgttcgaatattgcccccttcgcagttggagaacggatatacaactccaaatggccacaccactcagactagtctgcaccgattagttacaaaacctcctaaaactacaaatccgtctaagatcagtggcatagtagcagggaaagcacttagtaaccgtaacctttctcagatagtctcttaccagacacgggtgcctcctctaacaccgtgtccggctccttgtttctgtaagactcacccttcagatttaggtttgtctgtgaactgtcaggagaaaaatattcaatctatgagcgagctgatacctaaaccgttgaacgccaagaagctgcacgtcaatggaaacagcatcaaagatgtggacgtgtccgatttcaccgattttgagggccttgatctgctgcatctgggaagcaaccagataaccgttattaagggagatgtgtttcacaatcttacgaatctgcgacgactttacctgaatggaaatcagatcgagcgcctctacccagagatcttttccggtctccataatctccaatatctgtacctggagtacaacctaattaaggaaatatctgccgggacctttgactccatgcctaatctccagctcctgtacttgaacaacaatctcctgaagagcctgccggtgtacatttttagtggcgctcccttggcccgccttaatcttaggaataacaaatttatgtatttgcctgtatcaggcgtcctggatcagctccagtccttgacacagattgacctggaaggtaacccgtgggactgcacttgcgatcttgtcgcattaaagttatgggttgagaaattgagcgacgggatagtggtgaaggaacttaagtgcgagacccctgtacagttcgctaatatagaacttaagagcctgaaaaacgagatcctctgccccaaactcttaaacaaaccctctgccccgttcacttctcccgcgcctgccatcaccttcactacacccctcggaccaattcgcagcccaccgggtggtcccgtacccctttctattctcatcctctccatattagtggttttaatacttacagtgttcgtcgcattttgccttctcgtctttgtcctgaggaggaacaaaaagccaactgtgaagcacgaaggtcttggaaatcctgactgtggcagcatgcagctgcagctgagaaagcacgaccataagactaacaaaaaagacggattatcaactgaagcttttattccccaaaccattgaacaaatgtccaagtcacacacctgcggactgaaggagtccgaaaccggctttatgtttagtgatccgccggggcagaaggtggtcatgagaaatgtagcagataaggagaaggatctgctgcatgtcgacaccagaaagcggttgtctactatcgatgaacttgatgagctgttcccatcacgcgatagtaatgtgtttatccagaattttcttgaatctaagaaggaatataactccattggagtttccggcttcgaaattcggtatccggagaaacaacctgataagaagagcaagaagagcttgatcggagggaatcattccaagatcgttgtggagcagcgcaaatctgagtacttcgagctgaaagcaaagttgcagagctcccccgactaccttcaggtccttgaggagcagaccgccctcaacaaaatatag

SEQ ID NO: 134512 - DNA, 2877 bp, Artificial Sequence
  Description of Artificial Sequence: Synthetic coding sequence
atgcacacgtgctgcccccccgttaccctggagcaggacctccacagaaaaatgcactcatggatgctgcagaccctggcctttgcagtcacatcgttggtgctctcttgcgcggaaacaattgattactatggagagatttgtgacaatgcctgcccctgtgaagaaaaggatgggatcctgacagtcagctgcgagaataggggaattatctcgctaagcgaaatcagtcccccacgattcccgatatatcatcttttgctctcagggaacctgctgaacaggctgtacccaaacgaattcgtgaattacaccggcgcgtctatattacatttaggttccaacgtgatccaggatatcgaaaccggcgctttccacggactgcgcggactgcgtagactccaccttaacaacaacaaattagaactacttcgggacgatactttcctgggcctcgagaatttggaatacctgcaggtggactacaattacatcagcgtgatcgaacctaatgcatttgggaagctccacctgttgcaggtattgatacttaatgacaatctactcagctcactgcccaataatctgttcaggttcgtgccccttacccatctcgacctcaggggaaacagactgaagcttctcccttacgtcggcctcttgcagcacatggataaggtggtggaattgcagctggaggaaaatccatggaattgcagttgtgagcttatttctttaaaggactggctggatagtatttcatactccgccttggttggtgacgtggtctgcgaaaccccatttcgcttgcacgggcgcgaccttgacgaggtttcaaaacaggaattatgtcctaggcgtctgatttccgactatgaaatgaggcctcagacgcctctgtccacaaccgggtatctgcacacaacccccgcttccgtgaatagtgtcgctacatcatccagtgccgtgtataaacccccactcaagcctccaaagggcaccagacagccaaacaaaccacgggtgcgcccgacttctagacaacccagcaaagacctgggttactccaactacgggccaagcatcgcttaccaaactaaaagcccagtacctctggagtgtcccaccgcttgttcatgcaatctgcaaatttccgatttgggtttaaatgtgaattgccaggagaggaagatcgaaagcatcgctgagttacagcctaaaccatacaaccctaagaaaatgtaccttacggagaactacatcgcggtggtgcggcggaccgacttcctagaagcgactggtctggatttgcttcatttggggaacaatcgcatatctatgatccaggatcgcgcctttggggatctgaccaatctgcgacgtttatatttgaacggcaaccggattgaaagattgtctcctgagctgttctacgggttgcaatcactgcaatatctgttcctccagtataatctgatccgggaaatccagtctggcacattcgatccagtacccaacctacaattgctgtttttgaacaataacctcttgcaggccatgccttcgggggtgttctcaggccttactcttctgaggcttaacctgcgatctaatcatttcaccagtctgcccgtctcaggggtactggaccagctgaagtccttgattcagatcgacctacacgacaacccctgggattgtacctgtgatattgtggggatgaagctgtgggtcgagcagctgaaggtaggcgtgcttgtggatgaagtgatctgtaaggcccccaagaaattcgcagaaactgatatgcgctcgatcaagagcgagctgctgtgcccagattatagcgacgtggtcgtgtcaacgcccacgccaagcagcatacaggtgcccgctcgcacatccgcagtcacccccgcagtgaggttaaacagcacaggcgcccccgccagcctgggtgccggcgggggagcatctagtgttcctcttagtgttcttatcttgtccctcctgcttgtatttattatgtctgtgtttgtggccgccgggttgttcgtgctggtgatgaagcgcaggaagaaaaaccagtccgaccatacctcgaccaataattctgacgtgtcttcatttaatatgcagtattccgtctacgggggagggggtggaaccgggggccacccacatgctcatgtgcaccatagaggcccggcgcttcccaaagtaaagacccctgcggggcacgtatacgaatacattcctcaccctcttggccatatgtgtaaaaacccaatttaccgctcccgggagggcaactccgttgaggactataaagacctgcacgagctgaaggtgacctactcctctaaccatcacttgcagcagcaacagcaaccgccaccccctcctcaacagccccagcagcagccacctccccagcttcagttacagcctggcgaagaagaaaggcgagaatcacaccacctgagatctcccgcttactcagttagtacgatagagccacgcgaagatctgctctccccagtacaggatgccgatagattctacagaggaatcttggaacccgacaagcactgtagcacaacgcctgccggcaattcccttcctgagtaccccaagtttccatgttctcccgcagcttatacattctctcctaactatgatttgcgacgcccgcatcagtatctgcatccgggggccggcgacagcagacttagagagccagtgctatatagtccacctagtgctgtgtttgtcgagcctaatagaaatgaatatctggagttgaaggctaagctgaacgtagagcctgattacctggaagtcttagaaaagcagaccaccttctcacagttctag

SEQ ID NO: 134513 - DNA, 2154 bp, Artificial Sequence
  Description of Artificial Sequence: Synthetic coding sequence
atgggagctggcaaacatcgggaaggaggcgggggggatcccacctccctgaacgggtgtgcagatctaatccaaaggcggactgagatcagcagggatcttgatgaggttagcaaacaggagctttgcccgcgcaggctcatcagcgattacgagatgcggccgcagaccccactgtccactactggttacctccacactactccagccagtgtgaacagcgtcgctacctcatcttctgcggtctacaaacctccactgaagcctcccaagggcacacggcagccaaataaacctcgcgtcagacctaccagcagacagccgtctaaggacctgggttactccaactatgggccttcaatagcctaccaaacaaaatctccagtacctttggaatgtcctactgcctgcagttgtaatcttcagatttctgatctgggtctcaacgtaaactgccaggagcgtaaaattgagtctattgcagaactccagcctaaaccttacaaccccaagaaaatgtatctaaccgagaattacatagccgtcgttaggagaaccgactttctggaggccaccggtttagacctgttgcatttaggaaataaccgtatatcaatgatacaggatcgtgctttcggggacctgaccaatctgagaagactgtacctcaacggtaatcgaatcgagcggttgtccccggaactattttatggcttgcaatccttgcagtatctatttcttcagtacaatctcattcgcgagatccagagcggcacctttgatccagtgcccaacctgcaactactgttcctgaataacaatctcttgcaagctatgccatctggcgtgttctctggactgacacttttgcgcctgaacctgaggagcaatcacttcacgtcgttgcccgtgtcaggagtgctcgaccaattgaaatctttgatccaaatcgatctgcacgacaacccttgggactgcacatgcgacattgttggtatgaaactgtgggttgaacagttaaaagtcggagttctcgtggacgaggtgatctgtaaagcccctaaaaaatttgctgagacagacatgcgcagcattaagtcggagttactgtgccccgactatagtgacgttgtagtgtccactcccactccttcatcgatacaggtgcctgcaagaacttcagccgtcacgcccgccgtacggctgaactcaaccggggcgcctgcctctctgggcgccgggggaggagcctcgtcagtgcccctttccgttctgatactgtcactcctgctggtgtttattatgtctgtcttcgtggccgctggattgtttgttcttgtgatgaagaggaggaagaagaaccaaagcgatcatacaagcaccaacaactctgacgtttccagctttaatatgcagtactcagtttacggcggaggagggggcaccgggggacacccccacgctcatgtgcaccataggggtcctgctctgcctaaggtaaagacgcccgctggccatgtgtacgagtacataccgcatcccctcggccatatgtgtaaaaaccccatctacagatcgagggaggggaactcagttgaagactacaaagacctgcacgagctcaaagtcacctactcatctaatcatcacttgcaacagcaacagcagccaccccccccgccccagcagcctcaacagcaacccccccctcagttacagttgcaacccggggaggaggaaagacgggagagccatcacctcaggtctcccgcctacagcgtgagtacaattgaaccacgtgaagatctgttgagccctgtccaggatgctgatcgcttctaccgcgggatactcgagcccgataaacactgcagtaccactccggctggaaactcgctcccggaataccctaagttcccatgcagccctgcggcctacacattctcaccaaattatgatctgagacgcccgcatcagtacctgcatccaggcgcaggtgattccaggctacgtgagcccgtgctctactcccctccatctgcagtgttcgtggagcctaaccggaatgaatacctggagcttaaagctaagctgaatgtcgagcccgactatctcgaggtgctggagaaacaaacaactttttctcaattttag

SEQ ID NO: 134514 - DNA, 2526 bp, Artificial Sequence
  Description of Artificial Sequence: Synthetic coding sequence
atgaaactgtggatccacttgttttattcatccctcttggcatgtatcagtctccatagtcagaccccagtcctgtcttcacgcggctcatgtgattccctctgcaactgcgaggagaaggacggtaccatgcttataaattgcgaagccaagggtataaaaatggtcagcgagattagtgtcccaccatcccggccatttcaactgtcacttctaaacaatggactcactatgctgcacactaacgacttctctgggctgaccaatgccatttccatacacctgggattcaacaacattgcggatatagagattggcgccttcaacggtcttggcctgctgaaacaactccatattaatcataatagcctcgagatcctcaaggaagacaccttccacggtttggagaacctggaatttttacaggctgacaataactttatcactgtgattgaaccatcagctttctctaaactcaatcgcctgaaagttctcatcctgaatgacaacgcaatcgagtcattgcctcctaacatatttcgattcgtcccactaacacacctggacttaagaggaaatcaactgcagacactgccttacgtggggtttctggagcatatcgggaggatattggatctgcagttggaggataataagtgggcttgtaattgtgatttgctacagttgaagacttggctggagaatatgccaccccagtcaattatcggtgacgtggtgtgcaatagtcccccgtttttcaaagggagtatactgtctaggttaaagaaagaatccatctgcccaacaccccccgtctatgaggaacatgaagacccgtccggcagcctgcacctcgccgcaacatctagtattaatgattctcggatgagtaccaagaccacttccatactcaaattaccgactaaggctccgggactaatcccgtatatcactaagccttcaacacagttaccaggcccttattgtccaataccatgtaactgtaaggtgctgtctccatcgggtctgctgatccactgtcaggaacggaacatcgagagcctgtccgacctgaggccaccacctcagaacccgcggaaactgattctggcaggtaatattattcacagcctgatgaaatcagatcttgtcgaatactttaccttagagatgctgcatctaggtaataatcgcatcgaggtgctagaggaagggagctttatgaatctaacacgcctccagaagctgtatttgaacggtaatcacctcactaaactttcgaagggcatgtttctggggttgcataacctcgaatatctctacctcgaatataacgcaatcaaggaaatcctgcccggcactttcaacccaatgcccaagttgaaagtgctttatctgaacaacaatctacttcaagtcctgcccccccacatattctccggcgtacctctgacaaaggtgaacctgaaaaccaaccagtttacacacttgcccgtgtccaatatcctggacgatctggacctgctaacccaaattgatcttgaagataatccgtgggattgctcctgcgatctcgtgggcctacagcagtggatccagaagctaagcaaaaacacagttacagatgacattctgtgcaccagtccgggccatctggataagaaggaactcaaggccttaaactcagaaatcctgtgtccggggctcgtcaataatcccagcatgcccacgcagacaagttatctcatggtgaccacgcccgcaaccaccacgaacacagcggacacaatccttagatcactcacggatgctgtacctctgagcgtgctcatcttaggtttactaattatgttcattacaattgtgttctgtgcggccgggatagtggtgttggtactacatcgacggaggaggtacaaaaagaaacaagtcgacgaacagatgcgggataacagcccagtgcacctgcagtacagcatgtacggtcacaaaaccactcaccacaccacggagcgccctagtgcatcactgtacgaacagcacatggtgtctcccatggtccacgtgtacaggagcccttctttcggccctaaacacctggaagaggaagaggaacgaaacgaaaaggaaggcagcgacgcgaagcacttgcagcgcagtctgctcgaacaggaaaatcattctccccttacaggaagcaacatgaagtacaaaacaactaaccagtccacggagtttctatcctttcaggatgctagttcgctgtatcgcaacattttggagaaggagagggagttacagcaactcgggattaccgaatatctgcgcaagaatatcgcgcagcttcaacccgacatggaagcccactatccgggggctcatgaggagctgaaattgatggagacgctgatgtacagtagaccacgcaaggtgctcgtagagcaaactaaaaatgagtacttcgaattaaaagctaatctgcacgcagagcccgactatcttgaggtgctggaacagcagacctag

SEQ ID NO: 134515 - DNA, 4578 bp, Artificial Sequence
  Description of Artificial Sequence: Synthetic coding sequence
atgaggggcgtgggctggcaaatgttatccctaagcttgggattggtgctggctattctgaacaaggtggcgccacaggcgtgccccgcacagtgttcatgctccggttcaacagtggactgccacggactagctctgaggtctgtccccagaaatattccacggaataccgagaggcttgatctcaatggcaacaatattacacgaataaccaaaacagatttcgctggactgcggcatctgagagtgctgcaactaatggaaaacaagatctctaccattgaaaggggggcatttcaggacctgaaggagctcgaaagactgaggcttaaccggaatcacctgcagctcttccccgagcttctgttcctcgggacagctaagctgtacagattggatctgtccgaaaatcagatccaagctatccctaggaaggccttccgtggtgctgttgatatcaaaaacctgcagctcgattacaaccagatttcgtgtatcgaggatggcgcatttagagccttgagggacctggaggtactcacgttgaacaacaataatattactcgtttaagtgtggctagctttaatcacatgccgaagcttaggacctttagattgcatagcaacaacctctattgtgactgtcacctcgcatggctgtccgactggctgaggcaaaggccccgggtcggcctatacacccagtgtatgggcccctcacacctgcgcggccacaatgtagccgaagtccagaaaagagaattcgtgtgctctgggaagggcgaaggtcatcagagtttcatggccccatcttgctcagtcctccactgtccggccgcttgcacatgttcaaataacatcgtagattgtcgcggcaagggtctgacagaaatccctacaaacttgcccgagaccatcactgaaatccgcctcgagcagaacactattaaggtcattccacctggcgcgttctccccttataagaaactgcgccgcatcgatctatcgaacaatcagatatcagaactggcgccagatgcttttcaggggctgcgaagcttaaattctttggttctgtatggaaacaaaatcactgagcttcccaagtcactcttcgaggggctgttctctcttcagcttctcctgcttaacgcgaataaaatcaattgtttgcgcgtagatgcattccaagacctgcataatctgaacttactgtccctatatgataacaagctacaaacaatcgccaagggcacatttagtcctctgagggctattcagacgatgcatttggcacagaatcccttcatctgtgattgccacctaaaatggctggctgattacttacataccaacccaatcgaaacttctggcgccaggtgcacgtcaccccgcaggcttgccaataaaaggatcgggcagattaagtctaagaagtttagatgcagtggcacagaggattatcgttctaaactgagcggcgactgctttgctgatttggcgtgtccagaaaagtgtagatgcgagggcacaactgtggattgttctaaccaaaaactaaacaagatcccggagcacataccacaatataccgctgagctcagactgaacaataatgaattcaccgtgttagaggctactggaattttcaagaaattaccacagttgaggaagatcaatttctcaaacaataaaatcacagacatcgaggagggagccttcgaaggtgctagcggggttaatgagatactcttgacgagtaaccggcttgaaaacgtccaacataagatgttcaaaggcctggaatcactgaagaccttgatgctacgctctaaccggattacctgcgttgggaacgactcttttatcggtctgtcaagcgttaggctgctttccctttacgacaatcagataacaactgtagcacctggtgccttcgataccctgcactccctcagtaccctgaacctgttagccaaccctttcaattgcaactgctatctggcatggctgggcgagtggctgagaaagaagagaatagtgacaggcaaccctaggtgccagaaaccctatttcctaaaggagatccccatccaggacgtcgctattcaggatttcacatgtgacgacgggaatgacgacaattcttgcagccccctgtcacggtgtcccacggaatgcacctgcctggacacagtggtaagatgctccaataaaggcctgaaagtgctccctaaaggcattccccgggacgtcacagaactctatttagacggaaaccagtttactctcgtgcccaaggagttaagtaactacaaacatcttacgctgattgacctcagtaacaaccgcatttctacgctctcaaaccagtctttcagtaatatgacacagcttctcacactcatcctatcttacaatcgcctcaggtgcattccccctcgcacgttcgacggcctaaagagtctgaggctcctctctctgcatggcaatgacatttcagttgtccccgagggggcatttaacgatctctccgctttgtctcacctggcgatcggagctaatccactctactgtgattgcaatatgcagtggctatcagattgggtaaaatctgagtataaagagcctgggattgctcggtgtgctggcccaggcgaaatggctgataaactccttctgacaaccccttcaaaaaagtttacctgccagggccctgttgacgtaaacattctggccaagtgtaacccgtgcctcagtaacccttgtaagaacgacggcacctgcaacagcgaccccgtggatttctaccggtgcacatgcccctatggatttaaggggcaggattgcgatgtccccatacatgcctgcatttcaaatccctgcaaacatgggggtacttgccacttgaaggaaggggaagaagatggattctggtgtatatgcgcagacggcttcgaaggggagaactgtgaagtgaatgtggatgattgcgaggataacgattgcgaaaataactcgacatgtgtggacggcattaacaattacacttgtctttgtccccctgagtacactggcgaattatgcgaggaaaagcttgacttttgtgcacaggacctaaacccctgtcaacacgatagcaagtgtattctgactcctaaaggcttcaaatgtgattgcaccccagggtatgtgggggaacattgtgacatcgacttcgacgattgtcaagataacaagtgcaaaaatggtgcccactgcaccgatgccgtgaacggatacacttgtatatgtccagaaggatattcaggcttgttttgcgaattctccccacctatggtgcttccccgtacttcaccctgcgacaattttgactgccaaaatggcgcacaatgtattgttaggatcaatgaaccaatctgccagtgtctgcctggctatcaaggtgaaaaatgtgaaaagctggtgtcagtaaactttatcaacaaggagtcctatctccaaatcccttctgctaaagtgcgaccccagacgaatatcacccttcaaatcgcaaccgatgaagacagcggtatacttctttacaaaggggacaaagaccacatcgctgtggagctgtatagaggacgcgttagagcgagttatgataccgggtcacaccccgccagtgccatatattcagtggagacgatcaacgacgggaactttcatattgtcgaactcctggcactggaccagtcactctctctctctgtggatggcggcaatcctaagataatcaccaacttatcaaagcagtctactctaaatttcgactccccactctacgtcggaggtatgcctgggaagtcaaacgtagcaagtctgcgtcaggcacccggccagaacggcacaagttttcacggctgtataaggaacctgtatatcaattcggagttacaggactttcaaaaggtgcccatgcagacaggaatactgccaggatgcgagccgtgtcacaaaaaggtgtgcgcccatggaacttgccagccttccagtcaggccggtttcacatgcgaatgccaggagggatggatgggacctctgtgtgaccagcggaccaacgacccttgtttggggaacaaatgcgtgcacggtacgtgccttccaattaacgcgttttcgtattcttgtaagtgtctagagggccacggaggtgttctctgtgacgaggaggaagaccttttcaacccctgtcaggcaatcaagtgtaagcacggaaaatgtagactgagcggactggggcagccttactgcgagtgcagcagcggctatactggtgatagctgcgaccgagagatctcctgtagaggagagcggatacgggactactaccaaaagcagcagggctacgctgcctgtcaaactactaagaaggtctccagactggaatgtagaggcggctgcgctgggggtcagtgctgtggccccctgagatccaagagacgcaaatattctttcgagtgtacagacggtagtagcttcgttgatgaggtcgagaaggtggtcaaatgtgggtgtaccagatgtgttagctag

SEQ ID NO: 134516 - DNA, 4566 bp, Artificial Sequence
  Description of Artificial Sequence: Synthetic coding sequence
atgcgcggcgtgggttggcagatgctctcacttagtctgggacttgtgcttgctattttaaacaaagtggcccctcaggcatgcccagctcagtgctcatgctctgggtcaacagtcgattgtcacggccttgctcttaggtctgtacctcgaaacatccctaggaatacagagcggctggacctgaatgggaacaatataacacgcataaccaagacagattttgccggcctccgccacctgagggtgttacagctcatggaaaataagatcagcactatcgaaaggggggccttccaggaccttaaggaactggagcgtttgcgcctgaatcggaaccatcttcagctgtttcccgagttattgtttttggggacagcaaagctctaccggctggatctttcggaaaaccagatccaggcgattccacggaaggcctttcgaggagccgtcgacattaaaaacctgcagctggactacaaccaaatctcttgcatcgaggatggcgcatttagagccctaagggacctggaagtgctgaccctcaacaacaacaacattaccagactctccgtcgcttcgtttaaccatatgccaaagctcaggaccttccgactacacagtaacaacctttactgtgactgtcatcttgcctggctgtctgactggctcaggcagcgacccagggtaggactatacacccaatgcatgggcccatcacatctgagaggacacaatgtggcagaggtgcaaaagcgggaattcgtgtgttccgggcatcagagcttcatggctcctagctgtagcgttctccactgccccgccgcctgcacatgtagcaataacatcgtagattgcaggggtaaaggtctaacagagatccccaccaatttgccagagactataacagaaatacgactggaacagaacacgataaaggtgattccgccgggcgccttctcgccatacaagaaactgaggcgaatagatctgagcaacaaccaaattagtgaactcgctcccgacgccttccaaggccttaggagtctgaactccctcgttctgtacggtaacaagattacagagctcccaaaaagtctttttgagggactgttcagtcttcagttgttactgctgaacgcaaataaaattaattgtctcagagtcgatgcatttcaggatctgcacaatttaaacctactctcactatatgataacaaactccagacaattgctaaaggtacattcagccctttacgggcgatccagaccatgcacttagctcaaaaccccttcatctgcgactgccacctaaaatggctagccgactaccttcacaccaatccaatagaaacaagtggagcacggtgtacatcgccacgcaggctggctaacaaacggatagggcagattaagagtaagaagttcaggtgcagtggaactgaggactatagatccaaactttcaggcgactgctttgccgatctagcatgccctgagaagtgccgctgcgagggtaccacggtggattgttctaatcagaaattgaacaagattcctgaacacattccacagtacaccgcggagctgcgcctgaacaacaacgagtttaccgtcttggaggccactggcatctttaagaagctcccccaactgaggaaaatcaacttctctaataataagatcaccgacatcgaagaaggcgccttcgagggagcaagcggagttaacgaaattctgctcacgagcaaccgtctggagaatgtgcagcataaaatgtttaagggcttagagtccttaaagacattgatgctgaggagcaatcgaattacttgcgtcggcaacgactccttcattggcctgtcatccgtgcgtctgctaagcctctacgataaccagattacaaccgtagcaccaggagcttttgatacactgcacagcctgagtactctgaacctgttggccaatccatttaactgtaactgttacctcgcctggcttggcgagtggttgcgtaaaaagcgtatcgtgactggaaatccccgctgccaaaagccctacttcttgaaagagattcctatccaggatgtcgccatccaggatttcacctgcgatgacgggaatgatgacaattcctgctccccgctgtcacggtgtccaactgaatgtacatgccttgacaccgtggttcgttgctccaataaagggttgaaggtgctccccaaaggtattccacgcgatgtcacagaattgtatctggatggaaatcaattcacactagttccgaaggaactgtccaactacaagcacctgacacttattgatcttagtaacaaccgcatcagcaccctctctaatcaaagtttctctaatatgacacaactgctcaccctgattctctcttataataggttgaggtgcatcccacctcgaaccttcgatggcctcaaatctctgcggctgctgtcattgcatgggaatgacatctctgtggtcccagaaggcgcgttcaatgacctgagcgccctgagtcaccttgcaatcggagcaaatccgctttactgcgattgtaacatgcagtggttgtcagactgggtgaaaagtgaatataaagaacctggcattgctcgttgcgctgggccgggtgagatggccgacaaacttctcttgacaacgccctcgaagaaattcacgtgccaggggcctgtagatgtcaatatccttgctaagtgtaacccctgtctgtccaatccctgtaagaacgacggaacttgtaattccgaccctgtggatttctataggtgtacctgcccttacggctttaaagggcaggactgcgatgtgcccatccatgcatgcattagtaatccatgtaaacatggcggcacgtgtcacctgaaggaaggggaggaggacggtttctggtgtatctgcgctgacgggtttgaaggcgagaattgtgaagtcaatgtggacgactgtgaggacaacgactgcgaaaacaattcaacctgtgtggatggaataaataactatacctgtttatgccctcctgaatacacaggggagctttgtgaggagaagctggacttttgcgcacaggatcttaacccttgccagcatgattctaaatgtatcctgaccccgaaggggtttaagtgcgattgcacgcctggttacgtgggagaacactgcgacatcgatttcgacgactgccaggacaataagtgcaaaaacggcgctcattgtacagatgccgtgaacggatacacttgtatctgccctgaaggatactctggcctgttttgcgagttcagtcctcctatggtactccctaggacttcaccatgcgacaactttgactgtcaaaacggcgcccagtgcatcgtccggatcaatgagccaatctgtcaatgtctcccgggatatcagggggagaaatgcgagaagctggtttcagtgaatttcatcaataaagagtcttacctgcagattccctctgccaaggtacgcccacagacgaacattaccctgcagatcgccaccgacgaagattccggtatacttctgtataaaggagataaagaccacattgcagtcgagctctacagagggcgtgtaagagcgtcctacgacaccggttcccaccccgcgtccgcgatctactccgtggaaacaattaatgatggtaactttcatatcgtggaactgttagcactggatcagtctctgagtctcagcgtggatggaggaaatcccaaaatcatcacgaatctcagcaaacagagcaccttgaacttcgattctcccctgtacgtaggcggtatgcctggcaaatcgaatgtggcatccttaagacaggccccaggacaaaacggaaccagcttccacggatgcattcggaatctgtatatcaatagtgaattgcaagatttccagaaagtcccgatgcaaacagggatactgccaggatgtgagccttgccataaaaaagtgtgtgcccatggcacctgccaaccatcctcgcaggccggatttacgtgcgagtgtcaggaagggtggatgggtccactgtgcgaccagagaaccaacgatccatgcttgggcaacaaatgcgtacacgggacatgcctccctattaacgcgttcagctacagctgcaaatgcttggagggccacggcggggtgttgtgcgacgaagaagaggatctatttaacccctgtcaagccattaagtgcaaacacgggaagtgtagactttcaggtctgggacaaccttactgcgagtgctcttctggctatactggagactcttgcgacagggaaataagctgtcggggcgagcggatcagggattactaccagaagcagcaaggatacgccgcctgccagacaactaagaaggtgtcacgtttagagtgccgaggcggctgcgcgggaggtcagtgctgtgggcccctacgaagtaaaagaagaaagtacagcttcgagtgtactgacggtagttcatttgtggacgaagtcgagaaggttgtcaaatgcggctgcaccagatgcgtgtcatag

SEQ ID NO: 134517 - DNA, 4578 bp, Artificial Sequence
  Description of Artificial Sequence: Synthetic coding sequence
atgcgaggcgtcggttggcagatgttgagcctgagtttaggtctggttctggccattctgaataaggtggcgccacaagcctgtccggcacagtgttcctgcagcgggtctacagtggattgccatgggcttgctctcaggagcgtcccaagaaatatccccagaaataccgagagactcgacctcaatggcaataacatcactcggatcacaaaaacagactttgcgggccttcgccacttacgggtgctccaactgatggagaataagataagcactattgaacggggtgcctttcaggatctgaaagaactagaacgcctacggctgaaccgcaaccatctgcagctgttcccggaactcctcttcctcggaacagcaaaactttacagactcgatctttctgaaaaccagattcaagcaattccacgcaaagcctttcggggggctgtcgatattaaaaatttacagttagattataatcagatttcttgtatcgaagatggagccttcagggccctgagggacctggaggtccttaccctgaataacaataacatcacaaggttaagtgtggcatccttcaatcacatgcctaagctgcggaccttccggctgcacagtaataacctgtactgtgactgtcatttagcatggctttcggattggttgcgccaaagaccacgggtgggactctacacgcagtgcatgggcccttcgcatctgcgaggccacaatgtcgctgaagtccaaaagcgggaatttgtgtgcagcgacgaggaggagggtcaccagagcttcatggctccaagttgtagcgtcctgcattgccccgcagcttgcacctgttctaataacattgtagactgtcggggcaaaggtctgaccgaaatacccacgaatttacccgaaactattacagagatcaggctggaacaaaatacaatcaaggtgattccacccggagctttttctccttacaagaaacttcgaagaatcgacttgagtaacaaccagataagtgagctggcccccgacgcgtttcagggccttaggtcactgaattctctagtgctgtacggcaacaagattacagagctgccaaagtcgctttttgagggcctgttctcactgcaacttctgttactcaacgccaataaaatcaattgtctccgagtagatgccttccaggacctgcacaatctcaatctgctaagtttgtatgacaacaaactacagactatcgcaaaaggaaccttctcccccctccgggccatccaaacaatgcatttggcacagaatcctttcatctgcgactgccacctgaagtggctggcagattatctacacacaaaccccatcgagacttctggggcccggtgcacaagccctagacgccttgcaaacaagagaattggtcagatcaagagcaagaagttcaggtgtagcggcacggaagattatcgcagtaagctgtcgggggattgctttgctgacttagcctgtcctgaaaagtgccgatgcgagggtaccacggttgactgtagcaatcaaaagctgaacaaaataccagagcacataccccagtacaccgcagagctgaggctgaacaataacgagtttaccgtgctggaagcaactggcatctttaagaagcttccacagctccggaaaattaacttctccaataacaaaattacagatatagaggaaggtgcgttcgaaggcgcgtctggtgtgaacgagatcctgttgaccagtaatcgattggagaacgtgcagcacaaaatgtttaagggcctagaaagccttaagacactcatgcttcggtcaaacaggatcacatgcgtaggtaatgatagcttcataggccttagctctgtgcgcctgcttagtctttatgacaaccaaattacgaccgtagccccaggcgctttcgacacactgcacagtcttagcacccttaacctcctcgcaaacccttttaattgcaattgctatctggcatggttgggagagtggctcagaaaaaaaaggatcgtgaccggaaacccccgctgccagaaaccttacttcctgaaagagattccgatccaggatgtagccatccaggactttacctgcgatgacggcaatgacgataacagctgttcccccctctcgcgctgtcccacggaatgtacgtgcttggatactgtcgtgcgctgcagcaataaggggctgaaagtgttaccaaaggggataccgcgcgacgtgaccgagctgtatctggacgggaatcaatttaccctggtgcctaaagaattgagcaactataaacacctcacattgattgatctctccaacaaccgtatctccactctgtccaatcaatccttctcgaacatgacacagttactgaccctaatcctgagctacaatcgcctgagatgtattccccctaggacattcgatggcctcaaaagcctcagactgctgtcactgcatgggaacgatatttccgtggtgccagagggggctttcaatgacctgtccgcactgtctcatttggcaataggcgctaacccgctgtattgcgactgcaacatgcagtggctctctgactgggtgaagtcagagtacaaagaaccaggcatcgcccgctgtgctgggcctggcgagatggctgataagttgttgctgacgactcccagtaaaaaatttacatgtcagggccccgtggacgtcaatattttagctaaatgcaatccatgtctgtccaatccttgtaaaaacgatggcacctgcaacagcgaccccgtcgatttctatcgatgcacttgcccttacgggtttaagggacaggactgtgacgtgccaatccacgcctgcatctctaacccgtgcaagcatggagggacttgtcacctgaaggagggcgaggaggacgggttctggtgcatatgtgccgacggattcgaaggtgagaactgtgaagttaatgtggatgactgtgaagataacgattgtgaaaataatagtacttgcgtcgacgggatcaataactacacatgcttatgcccaccggagtacacgggggaactttgcgaggagaaactggacttctgcgctcaggatctcaatccttgccagcatgattccaaatgtatattgaccccgaagggcttcaaatgcgactgcactccaggctacgtaggagagcactgcgatattgactttgatgattgtcaagacaacaaatgtaaaaacggggcccactgtacagatgccgttaacggatacacctgtatatgtcccgagggctatagcgggctgttctgtgaattttctcctcccatggtcctgccaaggacatccccttgcgacaattttgactgtcagaatggggctcaatgcatcgtgagaatcaatgaacccatatgtcaatgtcttccaggctatcagggcgagaagtgcgaaaaactggtcagcgtcaatttcattaacaaggagagttatctccaaattccctcagccaaggtgaggcctcagacaaatataacgttacagatcgccaccgacgaggatagtggaatcttactgtacaaaggcgacaaagaccatattgccgttgaactgtaccgcgggcgtgtgcgggcaagctatgacacgggttctcatccggcatctgccatctattctgtggaaactatcaacgacggaaactttcacattgtagaactacttgcactggaccagagcctaagcctgagcgttgacggaggcaaccctaagataataaccaatctgtccaagcagtctaccctcaactttgactcgcctctgtatgtaggcggaatgccaggaaaaagcaacgtcgcctccttgcgccaagctccaggccaaaacgggacttctttccacggatgcatccgaaatctgtatatcaacagtgaactgcaagattttcagaaagtacccatgcagacagggatactgcccggctgtgaaccttgtcacaagaaggtctgtgcacatggaacctgtcaaccatccagccaggccggcttcacgtgcgaatgccaagagggctggatgggccccctatgcgaccagagaacgaacgatccctgcttgggaaataagtgcgtccacggtacgtgtctgcctatcaatgcgttttcctattcttgcaaatgtctagagggccacggaggcgtgctgtgcgatgaggaagaagatctgtttaatccttgccaggctatcaagtgtaaacacgggaagtgcagactgtctggattaggccaaccatactgcgaatgcagctccggctacacaggggattcctgtgatagagaaattagctgcagaggtgagcgcataagggactattatcaaaaacaacagggatacgcggcatgccaaactactaagaaggtgtctcgcctcgagtgtcgaggaggctgtgctggcgggcaatgttgcggtccccttaggtccaaaagacgtaagtattcattcgaatgcaccgatggaagtagctttgtggatgaggtggagaaagttgtcaagtgcgggtgcacaaggtgcgtatcttag

SEQ ID NO: 134518 - DNA, 4590 bp, Artificial Sequence
  Description of Artificial Sequence: Synthetic coding sequence
atgcgcggagtcggatggcaaatgctgtccttaagcctggggttagtcctggctatcctcaataaagtggcaccccaggcctgtcctgctcagtgtagttgctctgggtcaacagtggattgtcatgggctcgcgctgcgttccgtgccacggaatattccgaggaacacagaacggttagatttgaacggcaataatatcacgcgcatcactaaaaccgactttgcgggattacggcacctccgcgttcttcagcttatggagaataaaatcagcacaatagagagaggcgctttccaggatcttaaagagttggaaagactgcgactgaacaggaatcatctccaattgtttccggaactcctctttctggggactgccaaactgtatagactggatttgagtgaaaaccaaatacaggccatccctaggaaggcctttcggggagccgtggacatcaagaacctccaattggattacaaccaaattagctgcattgaggatggggcattccgtgcattgcgagatcttgaagttttgaccctgaacaacaataatataacacggctatctgtggcgagtttcaaccatatgcccaagctacggacctttcggctgcattccaataacctgtactgcgattgtcacttggcctggctgagtgattggctccgacagcgacctcgcgttggcctgtacacgcagtgcatggggccaagccacctgcgaggccacaatgttgctgaggtccagaaaagggagttcgtctgttctgggcatcagagtttcatggcaccctcctgctccgtgttgcactgcccagcagcatgtacttgttccaacaacatagttgactgcagaggcaaaggacttacagagattccaacaaacctcccagaaactattactgagattcgtctggagcagaacacaattaaagtgatcccaccaggcgcgttctccccatataagaagttgaggcgcatcgatctctctaataatcaaatatccgagctggcccccgatgccttccagggccttcgctcgctcaactctctcgtgctgtatggaaacaagatcacggagctgcccaagtctctctttgagggtctttttagtcttcaacttctattgctaaatgccaataaaatcaactgtctgagagtggacgctttccaggatctgcacaatctgaacctcttatctttgtatgataacaaattgcagaccatagctaagggaacttttagccccttgcgggctatccagacaatgcatttggctcaaaatccctttatttgcgattgtcacctgaagtggctggcggattatctgcacacaaacccaattgaaacttctggggcccggtgcacaagtccccggaggctcgcaaacaaacgcattggacagatcaaaagcaaaaaatttagatgctccgccaaagagcagtattttattcctggcacagaagattaccgaagcaagctttctggagactgctttgcggatctcgcctgtcctgaaaagtgtagatgcgaaggtaccacggtggattgctcaaatcagaagctcaataagattcccgaacatatcccccagtataccgccgagctcagactgaataacaacgagtttaccgtgctcgaggcaaccggtatctttaagaaattgcctcagctgcgcaaaattaacttttccaataacaaaatcaccgacatcgaagagggggcctttgaaggcgccagtggcgtcaatgagatcctcctcacctcgaaccggctcgaaaatgtccagcataagatgttcaaagggctggaatccttgaagactctgatgctgcgaagcaaccgcattacatgcgtgggaaacgactctttcatcggactaagcagcgtacgtctgctcagtctgtatgataatcagattaccaccgttgcaccaggtgctttcgatacattgcattccttatctactctcaacttgctggcaaatcccttcaattgcaactgctatctcgcctggctgggagaatggctaagaaagaagcggatagttacggggaacccccggtgtcaaaaaccctatttcctgaaggaaattccaatccaggatgtggccatccaggacttcacctgtgatgatggcaatgacgacaatagctgttctccactcagccgctgccctactgagtgcacctgtctcgacaccgtcgtgcgttgtagcaataaaggactaaaagtgctcccaaaaggcataccacgcgatgttacggagctgtacctcgatggcaaccagtttaccctggtccccaaagagctgtcaaattataagcaccttaccctgatagatttaagcaataatagaatctctaccctgagtaaccagtcattttcaaatatgacccagctcctgacattgatcctaagctacaaccggttgcgctgcattccccccagaaccttcgacgggctcaagtcgctccgactgttaagtctccacggaaacgatattagcgtggtccccgaaggcgcatttaatgacctctctgcactttcacatctggcaatcggggctaatccactgtactgcgattgcaacatgcaatggttgtctgactgggttaagagcgagtataaagagccaggaatagcccggtgtgccgggccaggtgaaatggccgataagctcttattaacaacaccgagcaagaaattcacatgccaaggtcctgttgatgtgaatatccttgccaagtgcaacccctgtctctccaacccttgcaagaatgatgggacctgcaattctgaccccgtggatttctatcggtgcacatgtccttacggtttcaaaggtcaagactgcgatgtgcccatacacgcctgcatctccaatccctgcaaacatggtggtacctgtcacttgaaggagggggaggaggacggattttggtgcatttgcgccgacggtttcgagggtgagaattgcgaggtgaatgtggatgactgtgaagacaatgattgcgagaataattccacttgcgttgacggaatcaataattatacctgtctgtgtccccccgaatacaccggtgagttgtgtgaggagaagttagatttctgcgcccaagacctgaatccttgccaacatgacagtaaatgtatcctgactccaaaaggcttcaagtgcgattgtacgcctggctacgtcggagagcactgtgatatcgacttcgatgattgtcaggacaacaaatgcaaaaacggcgctcattgcactgacgccgtaaacggttacacttgcatatgccccgaaggctacagtgggttgttttgcgaattctccccaccaatggtcctcccacgtaccagcccctgtgataacttcgactgccagaatggagcacaatgcattgtgcgcatcaacgagcccatctgtcaatgcctgccaggttaccagggggagaagtgtgaaaagctcgtgagcgttaatttcatcaataaggagtcctaccttcagatcccttccgcaaaggtgcgccctcaaaccaatatcaccctgcagatcgcgacggacgaggactcaggcatcctgttgtacaaaggggacaaagatcacatcgccgtggaattatacagagggagagtcagagcctcttacgacacaggatctcatcctgcatccgcaatttatagtgtggagacaataaacgatgggaacttccacatcgtagagttgttggccctcgatcagtccctgtccctctccgttgacggtggaaacccgaagattattaccaacctgagcaagcagtccactctgaatttcgattcaccactatatgtgggcggcatgccagggaaaagcaacgtggctagcttaaggcaagctccaggtcagaatggaacgtcattccatggctgcatccggaacctgtatatcaatagtgaactgcaagattttcaaaaagtcccaatgcagaccggtatcctgcccggctgcgagccttgccataaaaaagtctgcgctcacggaacgtgtcagccttcaagtcaagcaggttttacttgtgagtgccaggagggctggatgggtcccctttgtgaccagcgtacaaatgacccctgcttgggaaacaaatgtgtgcacggcacctgcctgccaataaatgcctttagctattcctgtaaatgtctggaaggacacggtggagtgctgtgtgatgaagaggaggatcttttcaatccatgccaggcaattaaatgtaaacacggcaagtgtagactttcgggtctcggccagccatattgtgaatgcagctctggatatacaggcgattcatgtgaccgcgagatatcatgccggggcgaaaggatcagggactactaccagaagcaacagggatatgctgcttgtcaaaccactaaaaaagtcagtcgtctcgagtgcagagggggatgcgccggggggcagtgctgcggtccgctccggagcaagagaaggaagtattccttcgaatgcactgacggcagcagcttcgtcgacgaggttgagaaagtcgtgaaatgtggatgtactaggtgcgtgtcctag

SEQ ID NO: 134519 - DNA, 4419 bp, Artificial Sequence
  Description of Artificial Sequence: Synthetic coding sequence
atggctccggggtgggctggggtcggagcagcagtgagagcccggttggcactagccctcgcgcttgcatcagtgctcagcggacctccagccgttgcctgcccaactaaatgtacttgctcagctgcctcagtggactgtcacggccttggtctgagagctgtcccccgcggtattcctcgcaatgctgagcgcctagacttggatagaaataacatcactcgtattaccaagatggatttcgccggtctgaagaatctacgcgtactgcatcttgaggacaaccaggtttccgtcattgagcgcggcgcatttcaggacctcaaacagctggaaagactgcgccttaataagaataagctgcaagtactcccagaactgctgttccagagcacacccaagctgaccagactggacttgtccgaaaatcagatccagggcatccccaggaaagcatttcgtggcatcacagatgtaaagaatctgcaattggacaacaatcacataagctgcatcgaggacggcgcattccgcgccctcagggaccttgaaattcttacccttaacaataataatataagccggattctagtcacaagctttaaccatatgcccaagattagaaccctaagactacattcgaaccatttgtactgtgactgtcacttggcctggctctctgattggctgagacaacgccggacggtggggcagtttacactttgcatggccccagtccatttgcggggtttcaacgtggcagacgtgcagaaaaaagagtacgtctgtccggcgccacatagtgagcccccttcctgcaacgccaatagcatatcatgtccctccccttgcacatgctcaaacaatattgtagactgtcgcggcaagggactcatggagattcccgctaacctgccagagggaatagtggaaattcgcttggagcaaaactctatcaaggccatccccgcaggagcttttacgcagtataagaagctcaagcgaatcgatatctccaagaaccagattagtgatatcgcccccgacgccttccagggcctcaaatccttgacctcacttgtgctgtatggcaacaaaatcaccgaaatcgtgaagggactcttcgatggattggtgtcattacagctgttactgctcaatgctaacaaaatcaattgcctgcgtgtcaacaccttccaggacctgcagaacctgaatctgctttctctttacgacaataaactccagacaatcagcaaggggctgtttgcgcccctgcagtctatccagaccctccatctggctcagaacccattcgtgtgcgactgtcacctgaagtggctggccgattatttacaagacaatcctattgagacgagcggggctcggtgttccagtccgcgccgtctagcaaataagcgcatctcacagatcaagtccaaaaaattccgctgttctggaagcgaggactaccgttctcgtttctcgtccgagtgcttcatggacttagtttgcccggaaaagtgccgctgcgaggggaccattgtggattgcagcaaccagaagctagtgcgcatcccatcacatctaccagaatacgttaccgacctgcggctcaacgacaatgaggtctccgtgctagaagccactgggattttcaaaaaactaccaaatctgaggaagatcaacttgtccaacaacaagatcaaggaagtgcgcgagggagctttcgacggcgccgcttctgttcaagagctgatgttaaccggaaatcagctggaaaccgttcatgggagagtgtttagaggactctcaggcctgaaaactctcatgctgcgtagtaacctcatcgggtgtgtgtcaaacgacactttcgccggcctaagttccgtgagattgctgtctctgtatgacaaccggatcactacaattaccccaggggccttcacaactctggtctcactgtctacaattaatctgttgtctaacccttttaactgtaactgccatttggcctggctcgggaagtggttacggaagcgcagaatcgtctccggcaaccccaggtgccagaagcccttttttcttaaggaaattcccatccaagatgtggcaatacaggattttacatgcgatggcaatgaggagagcagctgccaattaagccctcggtgtccggagcagtgtacttgtatggagaccgtagtgcggtgttccaacaagggacttcgagctttgccccgcggcatgcctaaggatgtgacagagctgtatctggaaggaaaccatctgacagctgtcccccgggaactgtccgctttgagacatctcacgttgattgacttgtcgaacaatagtattagtatgttgaccaactatacattttcaaatatgtcccacttgtccacactgattctcagttataacagactacgctgtattccagtccacgcattcaacggcctcagatctctgcgggtgctaactctccacggtaatgacattagttcagtgcctgagggctcatttaacgatttaacatccctctcccacctggcgctcggcaccaaccccctgcactgcgattgttctctgaggtggctatctgagtgggttaaggctggatataaagagcccggcatcgcccgctgttccagtcccgagccaatggccgacaggttgctcctgacgaccccaactcacagattccaatgtaagggaccagtggacattaatatagtggccaaatgcaacgcctgcctgtcttcaccatgcaagaataacggtacatgcacgcaagaccccgtggaactctatagatgcgcatgtccttacagctataaggggaaggactgcaccgtgccgatcaacacctgcattcagaacccctgtcagcacggcggtacatgtcacttgagcgactctcataaggacggattctcctgttcctgtcctctggggtttgaagggcagaggtgcgagatcaatccagacgactgcgaagataacgactgtgaaaacaacgctacgtgcgttgatggaataaacaattacgtgtgcatctgtccacccaactatactggcgaactttgtgacgaggtgatagatcattgcgtgcccgagctcaacctgtgccagcacgaagccaagtgtatcccgctggacaagggattttcctgcgagtgtgtaccgggatattctggtaaactgtgcgagaccgacaatgatgactgcgtggctcataaatgtagacacggggcgcagtgcgtggacaccatcaacgggtacacttgtacttgcccccagggatttagcgggcccttctgcgaacatccccctcctatggtgcttttgcagacctccccatgcgatcagtatgaatgtcagaatggtgcacaatgcattgttgtgcaacaagagccaacttgcagatgcccacctggctttgcaggacccaggtgtgagaaactcatcactgttaactttgtaggtaaggacagctatgttgagctggcttccgctaaggtccggccccaagcaaacatttctctgcaggttgctaccgacaaagacaacggaattttgctgtataagggagacaacgaccccctcgccttagaactgtatcaagggcacgtgcggttagtatatgattctctgagctcccctccaactacagtttattccgtcgaaaccgtcaatgatggccaatttcactccgttgaactggtgaccctcaatcagaccctgaatcttgtcgttgataaagggacacccaagagcctcgggaaactgcagaagcaaccagcagtggggattaacagccccctgtacctcggaggaatacctacctcaactgggttgtcagccctgagacaggggacggatcggcctctgggcggatttcatggttgcatccacgaggtgaggatcaacaatgaactgcaggactttaaagctcttcccccccagagtctaggcgtgtctccaggttgtaagtcctgcacagtctgcaagcacggcctctgcagatcagtggagaaggactctgttgtctgcgaatgcagacctggttggaccgggcccctgtgcgaccaggaagcacgcgatccctgcttgggacatagatgtcatcacggcaagtgcgtcgccaccggtacctcatacatgtgcaagtgtgcagagggctacggcggggacctttgtgacaataagaacgacagcgccaacgcctgcagtgcctttaaatgccaccacgggcaatgtcatatttctgatcagggggaaccttattgtctctgtcaacctggattctctggagagcactgtcagcaagtgttccgggctcaggtttttcagtcaagtctgccaggcaactgtagctggtcatgttggcctccccggcctccgatgccttag

SEQ ID NO: 134520 - DNA, 4572 bp, Artificial Sequence
  Description of Artificial Sequence: Synthetic coding sequence
atggccccggggtgggccggtgtcggcgccgccgtgagagctcgtcttgctctggccctggcactggcgtctgtgctcagtggccctcccgcagtcgcatgtccaactaagtgcacatgctccgcagcttccgtcgattgccacggactgggtctgagggcggtgccacggggtatcccccgaaatgccgagagacttgacctggaccgcaacaacatcacccgcatcactaagatggacttcgccgggctcaaaaacctgagggtgctccatctggaggacaaccaggtgagtgttatcgagaggggcgcctttcaagacctcaaacagctcgagaggctcagactgaacaaaaacaagctccaggtactgcccgagctgcttttccagagtacccccaagctgacgcgcctggatctgagcgagaaccagattcagggtataccaaggaaggcttttagggggattacggacgtaaagaacctgcagctggataacaatcacatatcatgtattgaagatggggcattcagagcactgcgggacctggaaattctgacactgaacaacaacaatattagcagaattttagttacatcatttaaccatatgccgaagattaggacacttcgcctgcattcaaaccatctgtattgcgattgccaccttgcgtggctttccgactggctgagacagcgacgaacagtcggacaatttactctgtgtatggcccctgtgcacttgagggggttcaacgtggccgatgttcagaaaaaggagtacgtatgcccagccccccactcggaacctccatcatgtaatgctaattcgataagctgcccatcaccatgcacttgtagtaacaacattgtagattgcaggggaaaaggactcatggaaatcccagccaacctccccgagggcatagtggagattcgacttgagcagaattctatcaaggccatacctgcgggggcgtttacccagtacaagaagcttaagaggatcgacatttccaaaaaccaaattagcgacatagcccctgacgcatttcagggcctgaaaagtctaacatcacttgttctctatggtaataaaatcacggaaatcgtgaaaggactcttcgatggcctggtcagtttacagctgctccttttgaacgcaaacaaaatcaattgtctaagagtcaatactttccaagatctccagaacttgaatctcctgagcttatatgataacaagctgcagactatatctaaggggttatttgccccgcttcagagcatccaaactctgcacttagcgcaaaatcccttcgtgtgcgattgccacctcaaatggttagcagattacttgcaagacaatccaattgaaaccagcggcgcacgatgtagctctccacgtagactggccaataaaaggatctcccagatcaaaagcaagaagttccgttgttctggctctgaggattatagatcccggttttcatccgagtgcttcatggatctcgtgtgtcccgaaaaatgcagatgtgaagggaccatcgtcgactgctctaatcagaagctggtgcggattccctctcaccttccggaatacgtcacggacttgaggttgaatgataacgaagtatctgttctagaagccactgggatcttcaagaagctgccgaacctcagaaagatcaaccttagcaataataaaatcaaagaagtgagagaaggcgcattcgacggggcagcgtctgtccaagagcttatgctcactggcaaccaactcgaaaccgtgcacggccgagtattccgcgggttgagcggactgaagacattgatgctgagatctaatctcatcgggtgcgtcagcaatgataccttcgctggcctgtccagcgtgaggttactgagcctatacgataaccgcattacgactataacaccaggcgcatttacaacactggtgagccttagcacgatcaatctcctgagcaacccctttaactgcaactgccacctggcctggctggggaaatggttgcggaagcgccggatagtgtcaggaaatccaagatgtcagaagccattcttcctgaaggaaattccaattcaggacgtggccattcaggacttcacatgcgatggcaacgaagaaagttcgtgtcagctgtctcctcgctgccctgaacagtgtacttgtatggagacagttgtgcgatgttcaaataagggcctcagagcccttccccgcggtatgcctaaggacgtcaccgagctctacctggaaggaaatcacctaactgcagtgcctcgagagctatccgctctgcgccacctcactctcattgacctgtctaacaatagtatctcgatgttaacaaattacacctttagcaatatgagtcacctctcaaccctaattctgagctataacagattgagatgtattccggtgcacgcattcaatggtctgcgatctctcagagtcttgactctccatggcaatgatatatccagcgtgcccgagggcagcttcaatgatctgacgtctctctcccatcttgccctcggtaccaaccccttgcactgtgactgttcattgagatggctctccgagtgggttaaggccgggtataaggaaccggggatagcaaggtgtagttctccggaacccatggccgacagattgctgctgactacgcccacccatcgctttcaatgcaaaggacccgtcgacataaacattgtggccaaatgcaacgcttgcctctcctcaccttgtaaaaataacggcacttgtacgcaagatcccgtggagctttaccgatgcgcctgcccctatagctataagggtaaggattgtactgtgcccataaatacttgcatccagaatccgtgtcagcatggcggcacttgtcatctaagcgattcccacaaagacggtttctcatgttcttgtccattaggcttcgagggtcaacgatgcgagataaatcctgacgattgcgaggacaacgactgtgagaacaacgctacgtgcgtggacggcattaacaactacgtgtgtatttgcccacctaactatactggagagctctgtgacgaggtaattgatcactgcgtcccggaactcaacctttgtcaacatgaggcaaagtgtattcctctggacaaagggttctcttgtgaatgcgtccccgggtattctggtaagctatgcgaaaccgacaacgacgactgtgtggctcacaaatgtcgccacggcgcacagtgcgtggatacaatcaatgggtacacctgtacgtgcccccaaggcttttctgggcctttttgcgaacacccaccccctatggtcttactgcagaccagcccttgtgatcagtatgagtgtcagaatggtgcccaatgtattgtcgtgcaacaggagcccacgtgcaggtgtcccccgggatttgccggaccaaggtgcgaaaagctgattacggttaactttgtgggtaaggatagttacgtcgaactggcttctgctaaggtaagaccacaagcaaatatctcactccaggtggctacggataaagacaatgggatcctgctatacaaaggtgacaacgacccacttgccctggaactctaccaaggccacgtgagactggtctacgacagccttagttctcctccaaccaccgtatattccgtagagaccgtgaatgatggtcaattccactcagtcgagctggtgacattgaaccagacccttaacttggtagttgacaagggcacaccaaaaagcctggggaagcttcagaagcagcccgcggtagggatcaacagcccactctacctggggggcatccctacaagcacaggtctctccgcacttaggcagggcaccgatcgtcccctgggtgggttccatggttgtattcacgaagtaaggattaataacgaacttcaggactttaaggcgctgcctcctcagtcactcggggtgagtccagggtgcaaatcatgcactgtatgtaaacacgggctttgtagatccgtagaaaaggactctgtagtgtgcgagtgcagaccaggatggacaggaccattgtgtgatcaagaggcccgggacccgtgcctagggcacaggtgccaccacggaaaatgtgttgcaactgggacaagttatatgtgcaaatgtgctgaggggtatggcggggatctttgtgataataagaatgacagtgcaaatgcatgttccgctttcaaatgtcatcacgggcaatgtcacatttccgatcagggagagccttattgcctatgccaacccggctttagcggagaacactgtcagcaagagaatccatgcctgggtcaggtggtgagggaggttattaggcgccagaaagggtatgccagctgtgccacagctagcaaagtgccaattatggagtgtcgaggtgggtgtggaccccagtgttgtcagccaacgcggtcaaagagacgtaagtacgtctttcagtgtaccgatggttcctcgtttgttgaagaggtcgaaagacacctggagtgtgggtgcctggcctgtagttag

SEQ ID NO: 134521 - DNA, 3258 bp, Artificial Sequence
  Description of Artificial Sequence: Synthetic coding sequence
atgtctactcctagtagatttaagaaagacaaagagattatcgctgagtacgagtcacaggtgaaggagattcgcgctcagttggtagagcagcaaaagtgtcttgagcagcaaacagaaatgcgagttcagctattgcaggacctgcaggattttttccgaaaaaaggccgaaattgagacagagtactctagaaacttagagaagcttgccgagaggttcatggctaagactaggtctacaaaggaccaccaacaatacaagaaggaccagaatcttctctcccccgtgaactgctggtacctgctgctgaaccaagtccgacgcgagtcaaaagaccacgcgacgctgagcgacatttacctgaacaacgtgatcatgcgcttcatgcagatctcagaagattcaacaagaatgttcaaaaaatccaaggaaatcgcattccagctgcacgaggatctcatgaaggtgctaaacgaactctatactgttatgaaaacctaccacatgtaccatgcagagtcaatctccgcagagagtaaattaaaggaggcggagaaacaggaggaaaagcaaatcggcagatcaggtgatcccgtattccatatacggctcgaggaaagacaccagcgtaggtcatctgttaagaagatcgagaaaatgaaagagaagcggcaagccaagtattcagaaaacaagttaaagtccatcaaagcccgcaatgagtacttgttgactttagaggctacaaacgcctccgtctttaagtattatatccatgacctgtccgacttaatagattgttgtgaccttggataccacgcgagccttaaccgagccctcagaacttatctcagcgcagagtacaacttggaaaccagcagacacgagggtttagacatcattgaaaacgccgtggataacctcgagcctcgttccgacaagcagcggttcatggagatgtatccagccgccttctgcccacctatgaaatttgagttccagtcccacatgggagatgaggtgtgccaggtcagtgctcagcaaccagttcaagccgagctgatgttgcgctaccaacagctgcagagtcgcttagccaccttgaagatcgaaaatgaagaggtgaagaagactactgaagccactctccagaccatccaagacatggtgacaatagaggattacgacgtttcagagtgtttccagcacagcaggtccacagagagtgttaaatcaacggtctctgaaacatacctgtcaaagccaagcattgctaagcgaagagctaatcagcaggagactgagcagttctattttatgaaactccgtgagtatctagagggtagcaaccttataaccaagctgcaagccaagcacgacctgctccagagaaccctgggtgaaggtcacagagcggaatatatgacgactaggccacctaacgtgccgcctaagccacagaagcacagaaagtctcgccctaggagtcagtacaacaccaagttgtttaacggtgatctggagacttttgtgaaggatagcgggcaggtgatcccactcattgtggagtcatgcatccggtttattaacctgtacggactgcagcaccagggtattttccgggtttcggggagtcaagtggaggttaacgacattaagaactcctttgagcgcggcgagaatcccctggccgacgatcagagcaatcatgacatcaactcagttgccggagtgctgaagctgtacttcagaggtttagagaatcctttatttccgaaggagcgcttcaatgacctcatctcctgcataaggattgataacttgtacgaaagggccctgcacataaggaaacttctcctgacacttcctaggtctgtcctaatcgtgatgaggtacctctttgcattcctgaatcacctttcccagtactctgatgagaatatgatggatccctacaatttagccatttgttttgggcccaccctgatgcccgtgccagagatacaggaccaggtgtcctgtcaagctcatgtgaatgagatcatcaagactataattatccaccatgagacgatcttcccagacgccaaagaactagacgggcccgtttacgagaagtgcatggccggggacgactactgtgattctccctactcagagcatggcacactcgaggaagtcgaccaggacgcagggactgagcctcatacttccgaagatgagtgcgaacctatcgaggcgatcgccaaattcgattacgttgggcgtagcgcacgcgaactgagttttaagaaaggcgcttctttgttgttgtaccacagggcctctgaagattggtgggagggtaggcacaatggaattgacgggctcgtcccacatcaatatatcgtggtccaggatatggatgacacattttccgatactctctcccagaaagccgacagcgaagcttccagtgggccagtgacggaagacaagtcctctagcaaagatatgaacagccctactgacaggcatccagatggttatcttgcccgccaacgcaaacgaggggaacccccacccccagtgagaagacctggacgaacaagcgatggccactgcccgctgcacccccctcatgccctcagtaactcatccgtcgatcttgggtctccaagcctggcttctcatcctaggggtctcctgcaaaaccgtggccttaataacgatagccctgaaaggcgcaggcgccccggacacggatcgttgactaatatctctaggcacgactcactaaaaaaaattgatagccctccaattcgcaggtcaacaagttccgggcaatatactggctttaacgaccataaacctttggaccctgagaccattgcacaggatattgaggaaaccatgaataccgcccttaacgaactgcgcgaactcgagaggcagtcaacagccaaacacgcgcctgacgtagttctggacacacttgaacaggtgaagaacagccccacaccggccaccagtaccgaatccctctcacctttacacaatgttgccctccggagcagtgagccacaaatcagacgttcgaccagctcttcctcggatactatgtccaccttcaaacctatggtcgcccccagaatgggggtacagctcaagccacctgcactgaggcccaagccagccgtgctgccaaaaaccaacccgacaattggacccgccccacctccccaagggcccaccgataagagctgtacgatgtag

SEQ ID NO: 134522 - DNA, 3189 bp, Artificial Sequence
  Description of Artificial Sequence: Synthetic coding sequence
atgagcacacccagtcgtttcaaaaaagacaaggagattatagccgagtacgagagccaggtcaaagaaatccgtgctcagctggtggagcaacaaaaatgtctggagcagcagacagaaatgcgcgttcaacttttgcaggatcttcaggattttttcaggaaaaaagctgagattgagactgagtattcacgtaacctcgaaaaactcgctgagagatttatggctaagactaggtccactaaggatcaccagcaatacaagaaggatcagaacctactgtcgcccgtgaattgttggtatttgcttcttaaccaagtccgcagagaaagtaaggatcacgccactctgtctgatatctacttaaacaacgtcattatgcggttcatgcagatctccgaggattctactcgaatgtttaagaaatctaaagaaattgctttccagctacacgaagacttaatgaaagtgctcaacgagctgtataccgttatgaaaacataccacatgtaccacgcggagtccattagtgccgaaagcaaacttaaagaggcagagaagcaggaagaaaaacagattgggcggtccggcgaccctgtattccatatccggctcgaagaaagacatcagcgcaggagcagcgtgaagaagatagagaaaatgaaggaaaaacggcaggctaagtacagcgaaaacaagctgaaatctataaaagctcgtaatgagtatctcctgacactggaggccactaatgcgtctgtgtttaaatactacattcacgacctgagcgatctgatagattgttgcgatctggggtaccacgctagcttaaacagggcactgagaacttatctttcagctgagtacaatctcgagactagccgtcacgagggccttgatatcatcgagaatgcagttgacaatcttgaaccccgaagcgacaagcaacgcttcatggagatgtaccccgctgccttttgtcccccaatgaagttcgagttccagtcacatatgggcgatgaggtttgccaggtgagtgcacagcagcctgttcaggccgagctcatgctcagatatcagcagctccaatccagacttgctactctcaaaatcgaaaacgaagaggtgaaaaaaacaaccgaagccaccctgcagaccatacaggacatggtcaccatcgaagactacgatgtgtccgagtgtttccagcactccagatccacagagtccgtgaagtccacggtgagtgaaacatacctgagcaagccatcaattgcaaagcgcagggctaatcagcaggagaccgagcagttttactttatgaaattgagggaatacctggagggaagtaatctgattacaaaattgcaggctaagcatgacctcttgcagaggacgctgggggagggccaccgcgcagaatatatgactacctcccgcggacggaggaattcccacaccaggcaccaggattccggacaggtcatccctcttatagtggagtcttgcattcggtttattaatctttacggcctccagcaccagggtatctttagggtgtccgggagccaggttgaggtgaatgacataaagaatagcttcgaacgcggcgagaaccctttggcagacgatcaaagcaaccatgatatcaactcagtcgctggtgtactcaagctctatttccgtggcctggaaaatcccctgttccctaaagagcggtttaatgatctgatcagctgcataaggatcgacaatttatacgaacgcgctctgcacatccgaaagctgctgctcaccctgcctcggtccgtcctcattgttatgaggtaccttttcgcgttcctaaaccacctatctcagtatagtgacgaaaatatgatggatccatataatctcgcgatttgcttcggacctaccttgatgccagtcccggagatccaggatcaggtttcctgtcaggcccatgttaatgagatcatcaaaaccattattatccaccatgaaaccattttcccggacgcaaaggagctggatggacccgtttacgaaaaatgcatggccggtgatgactattgcgattctccctattccgagcacgggaccctggaagaggtagatcaggacgccggcacggagccccatacatccgaggacgaatgtgaacccatcgaagccatagcaaaattcgactacgtaggtaggagcgctcgggagctgagtttcaaaaaaggcgccagcttactgctgtaccaccgggcctctgaagactggtgggaggggcgccataatgggatcgacggtttggttccacatcaatatatcgtggttcaggacatggacgacaccttctccgacaccctttcccagaaagcggactctgaagcgtccagtgggcctgtgacagaagataaatcttccagtaaggatatgaacagtcccacggacaggcaccccgacggttatctggcccgccagagaaagcgtggcgaacccccaccacctgtgagacgaccaggacggacctccgatggtcattgccctctccaccctccccatgcactaagcaatagctccgtagatctggggagccctagcttggccagccaccctagaggcctgcttcaaaaccgcggcctgaataatgattcccccgaacggcgtaggcggcctgggcacgggagtctgactaacattagccggcacgattccctcaagaaaatagactctccccctatccggaggtcaacatcctccgggcagtacaccgggttcaacgaccacaagcctctggacccagagactattgcccaagacatcgaggaaaccatgaatactgccctgaatgagctgcgggaactggaacgtcagtctaccgcaaagcatgcacctgacgtagtgctggacactctcgaacaggtgaagaacagtcccacaccggctacttctacagagtctctcagccctctccacaacgtggcattgcgaagctctgagcctcagatccggaggtccacatcgagttcttccgacacaatgagtacttttaaaccaatggtcgccccgaggatgggggtacaactgaagcccccagccctcagacccaagccggccgtcctgcctaaaaccaaccctaccatcggaccagctccgcccccacaaggtccaacagacaagtcatgtactatgtag

SEQ ID NO: 134523 - DNA, 2958 bp, Artificial Sequence
  Description of Artificial Sequence: Synthetic coding sequence
tgaaaggaccagaatgtgctgtcacctgtgaactgctggaatctcttgctcaaccaggtaaaaagggaaagccgcgaccacacaacactgtcagacatctatctgaacaacataattccgcgcttcgtgcaggtaagcgaagatagcggtaggttgtttaaaaagtcaaaggaagtagggcaacagcttcaggatgatttaatgaaggttctcaatgagctgtacagtgttatgaaaacttatcacatgtacaacgccgattccatttccgcgcagagcaaactgaaggaggctgaaaagcaggaagagaagcaaatcggtaagtccgttaaacaggaggaccgtcaaacaccccggagtcccgacagtaccgccaatgtcagaattgaagaaaagcatgtgcgccgtagctccgtgaagaagattgagaaaatgaaggagaagcgtcaagcaaaatataccgagaataaactgaaggcaattaaggcacgaaacgaatatctcctggccctggaagcaaccaacgcttccgtgttcaaatattatattcacgaccttagcgacctgatcgatcaatgttgtgatctgggttaccacgcctcactcaacagagccctacgtacttttttatccgccgagcttaatctggagcagagcaaacacgaagggctggacgctatagagaatgctgtggagaatcttgatgctacttccgacaaacaacgcctcatggagatgtataataatgtgttttgtcctccaatgaaattcgagttccaaccacatatgggagatatggcaagtcaactgtgcgcgcagcagcccgtccaatccgaactggtgcaaaggtgccagcagctccagagcaggctctctacattaaagatagaaaatgaggaagtcaagaaaaccatggaggccactctgcagacgattcaggacatcgtgacagtcgaagattttgatgtgtctgactgcttccagtattccaattcgatggaatccgtgaagtctaccgtgtcagaaaccttcatgagcaaaccttcgatcgccaagagaagggcaaaccaacaagaaactgaacagttctactttacgaaaatgaaggagtacttggagggccgaaacttgattaccaaactccaggccaagcacgacttacttcagaaaaccctgggggaaagtcaacgcacagattgtagtctggctagaagaagcagcacagttaggaagcaagattcatcccaggctattccactcgtggtggaatcctgtattagatttatatcacggcacgggcttcagcacgagggaattttccgtgttagcggctcccaggtcgaagtcaacgatattaagaatgcttttgagaggggggaagacccactggccggggaccagaacgaccacgatatggactctatagcgggtgtactaaagctttactttcgcggcctggaacaccccctgttcccaaaagatatcttccacgacctgatggcatgtgttaccatggacaatctgcaggaacgcgccctccacatccgaaaggtccttctcgtccttcctaaaacaacccttattatcatgaggtatctgtttgcctttcttaaccatctgagccagttttccgaagagaacatgatggatccttataatctcgcgatttgcttcggccccagcttgatgtccgtgcctgagggccacgaccaggtgtcctgccaagcacatgtgaacgagctcataaaaacgatcatcatccagcatgagaatatattccccagcccacgggaactggaggggcctgtgtatagtagaggcggctcaatggaggattattgcgactccccccatggggaaactacaagcgtcgaagacagtacacaggacgtgaccgcggaacatcacacatcggacgacgaatgtgagcctattgaggctattgccaaattcgattatgttggccggactgcccgcgagctcagcttcaagaaaggcgcctcactcctgttataccagcgtgcaagcgatgactggtgggaggggagacacaacgggatcgatggcctaattccccatcagtacattgtggtgcaggatacagaggacggagtggttgagcgtagcagcccaaagagcgagatcgaagtgatctcggaacctcccgaggagaaagtcacagccagagctggcgcatcttgtccgtcgggaggccatgtagcggacatctaccttgcaaacattaacaagcaacgaaagcgtccagagtctggctctattaggaaaacctttagaagcgattcacatgggctaagctccagcttgaccgatagttcctctccgggggtgggcgcaagctgtcgccccagcagtcaacctataatgagccaaagtctgcccaaggaaggccctgataaatgctctatatccgggcacggaagcctgaactccatatcacggcacagttccctgaagaaccgcctagactctcctcaaataaggaagaccgcgacagccggccgatctaagagctttaataaccatcggccaatggatcccgaggtgatcgcgcaagatatcgaagctaccatgaattcggccctcaacgaactgagagagctggaacgccagtcaagtgtgaagcacacgcccgacgtggtgctcgacaccctggaaccattgaagaccagcccagtggtcgcccccacctccgagccatcttcccctcttcatacacagctcctcaaggaccctgagcccgcgtttcagagatccgcatccaccgccggcgacatagcctgtgcattccggcctgtcaagtccgtgaagatggctgcccctgtaaaacctcccgcaactcgtcccaaacctactgtgtttcctaagactaatgcgacatctcccggcgttaatagtagcacttcaccgcagagtactgacaagtcctgtacagtgtag

SEQ ID NO: 134524 - DNA, 2796 bp, Artificial Sequence
  Description of Artificial Sequence: Synthetic coding sequence
caatctaaggaagtgggccagcagctgcaggatgatctaatgaaggtgctaaacgagctttattctgtcatgaaaacctaccacatgtacaacgccgatagcatctccgcccagagtaagttgaaggaagccgagaaacaagaggagaagcagattggcaagtccgtcaagcaggaagacagacagactcctagaagcccagattccacagctaatgtccggatcgaggagaagcatgtaaggcggagttcagtgaaaaagattgaaaaaatgaaggaaaagaggcaggctaaatacacggagaacaagttgaaagcaattaaggctagaaatgagtatctactggcattagaggccacaaacgcaagcgtttttaagtactacattcatgacctcagtgacctcattgaccagtgctgtgacctgggctaccatgcttccctcaacagggccctacggacgttccttagtgcggagctaaatcttgagcagtcaaagcacgagggactggatgctatcgagaacgcagtggagaacttggacgcgaccagtgataagcagagattaatggagatgtataataatgtcttctgtccccccatgaagttcgagtttcagccccatatgggggatatggccagccagctctgcgcacaacagcccgttcaatccgagctggtacagagatgtcagcaactgcagtcgcggctgagcactcttaagattgaaaacgaggaagtgaagaagaccatggaagccactctacagactatacaagatatcgtaaccgtggaggacttcgatgtcagcgattgcttccagtacagtaactctatggagagcgtgaaatccaccgtgtccgagacattcatgagcaaaccctccatcgctaagagaagggccaatcagcaagaaactgaacagttttactttactaaaatgaaagaatacctggaggggcgtaacctgatcacaaaactgcaagctaagcacgacttgcttcagaagactttgggtgagtcgcagaggaccgattgcagcctggccagaagatccagcacagtgaggaagcaagatagttcccaggcgataccccttgtcgtcgagtcctgtatacggttcatcagccgacacgggctccagcacgaggggattttccgtgtctcagggtcccaggtggaagtgaatgatattaaaaacgcattcgagcgtggtgaagaccccctggctggggaccaaaacgaccatgacatggactcaatagctggcgttctaaagctttacttccgtggactcgagcatcccctctttcctaaagatatcttccatgacttgatggcatgcgtaacaatggacaatctgcaagagagggcgctccatatacgcaaggtgctactcgtcctacctaagacgactctcattatcatgaggtacctgttcgcgttcctgaaccacttgtctcagttcagcgaggaaaatatgatggatccatataacctggccatttgtttcggaccctcgctgatgtctgtccccgaggggcacgaccaggtttcttgccaggcacacgtcaacgagcttatcaaaactatcattattcagcacgagaatatttttcccagcccccgcgaactggagggtccggtatactcacgggggggctctatggaagattactgcgactccccccacggagagacaacgtcagttgaggactccactcaggatgtgacagctgagcaccacacttccgatgacgaatgcgagccgatcgaggcgatcgccaagtttgactacgtcggtcgaactgctagagagttgtcgttcaaaaaaggggcatccctcctgctatatcaacgtgcatccgacgattggtgggagggaagacacaatggcatagacgggctgatcccacatcagtatatcgtagtgcaggatacagaagatggagtcgtggaacggagttctccaaagagcgaaatcgaagttatctccgaacctccagaggaaaaagtgaccgcccgcgccggcgcctcctgcccatccgggggacatgtcgccgatatctatctggccaatattaataaacagcggaaacgacctgaaagcgggtccatacggaagactttccggagcgatagccatggactcagctcttcactcactgactcctctagcccgggggtgggcgcttcatgtagaccctcttcgcagcctattatgtcccagtccctgcccaaggagggccccgacaaatgttctatcagtgggcacggctcactaaacagcataagcagacactcatcccttaaaaataggctagatagcccacaaatccgaaaaacggccaccgccggccgctccaaatctttcaataatcaccggcccatggatcctgaggttatcgcacaggacattgaggccacaatgaactctgcactgaatgagctgcgcgaattagaacgccagtcctctgttaagcacacccctgacgtggtgctggatacgctggagccacttaagactagcccagtcgtggcccctaccagcgaaccaagtagcccgctgcatactcagctgctgaaggacccagaacctgcttttcagaggagtgccagcacagccggcgacatcgcctgtgcttttaggcctgttaaaagcgtgaaaatggccgctcccgtgaaacccccagctacacgaccgaagcccaccgtgttccctaagacaaacgccacatctcctggagtgaattccagcacctctccccaaagtaccgacaagtcatgtacggtatag

SEQ ID NO: 134525 - DNA, 2112 bp, Artificial Sequence
  Description of Artificial Sequence: Synthetic coding sequence
cgcaaagatcaaaatgttctttcccctgtgaactgttggaatctgttgcttaaccaagtgaaacgcgaatcaagggaccacacaactctttcagacatctatcttaacaacattattcctcggtttgtgcaggtatcggaagactcaggccgcctgttcaagaagagcaaagaagttggacaacagttgcaggacgatttgatgaaagtgctcaatgagttgtactcagttatgaaaacctatcacatgtacaatgctgacagcatttccgcacagtcaaagctaaaggaggctgagaagcaagaggagaagcagatcgggaagagcgtgaaacaggaggaccgacagactccgcggtcacccgactctacagcaaatgtgcggatcgaagagaagcatgttaggaggtcatccgtgaagaagattgaaaagatgaaagagaagcgccaggcaaaatataccgaaaacaagctgaaagccatcaaggctcgcaacgagtatctgctcgctctcgaagccacaaatgcttcagtttttaagtactatatccacgatctgagtgacctgatcgactgttgtgatctgggctatcacgccagcctgaatcgcgccctaaggacattcctgtcagccgaactcaacctggagcaatctaaacacgagggcttagatgcgattgagaacgcggtggaaaacctagatgctacaagcgacaaacagcgcctcatggagatgtataataacgtgttttgccctccgatgaagtttgaattccagccccatatgggcgacatggcctcacagctctgcgcccaacagcctgtccagtccgagctggtgcagcgctgccaacagctccagtcaagactcagcacccttaagatcgagaatgaggaagtaaagaagacaatggaagcgaccctccagacgatacaggatatagtgaccgtggaggatttcgacgtgtctgattgttttcagtactcaaactctatggagtccgttaagtccaccgtctccgaaacatttatgtccaaaccttcaattgccaagcgacgcgccaaccaacaagagaccgagcagttttacttcactaaaatgaaggagtatctggagggcagaaatttgatcaccaaactccaggctaagcacgacttgcttcaaaagacactaggcgaaagccagcggacagattgctccctggcccgcagaagcagcaccgtccgaaagcaagactcgtcacaagcaatcccacttgtggtcgagagttgtattaggtttatttcccgccatggactgcagcacgagggcattttccgggtatctggaagccaggtcgaggtgaacgatattaagaacgcttttgaaaggggtgaggatcctctagctggcgaccagaatgatcacgatatggatagtatcgcaggagtcttgaagctgtactttcgcggcctcgagcacccgctattccctaaggacatatttcacgatctaatggcctgcgtaacgatggacaatctgcaggaaagagcactgcacatacggaaagtgctgctggttctaccaaaaacaacactgataatcatgcgctatctgtttgctttcctgaatcatctgtcccagttttctgaagaaaatatgatggacccttacaacttggctatttgttttggcccatccctcatgtcagtgcctgaaggtcatgaccaggtgtcttgtcaagcccatgtgaacgagctgattaaaaccattattatccagcacgaaaatatcttcccctcccctagagagttagagggtcccgtgtatagcagaggcggtagtatggaagactattgcgattcacctcacggcgaaactacctcagtcgaggactccacccaggatgtcacagctgaacatcacacatccgatgatgaatgcgagccaatcgaggctatcgctaaatttgattacgtaggtcgcaccgccagagagttaagcttcaaaaaaggtgccagcttgctcctatatcagagggccagtgacgactggtgggagggccgtcacaatggcattgacgggctcatccctcatcagtatattgtcgtgcaagacacactcatctcatag

SEQ ID NO: 134526 - DNA, 759 bp, Artificial Sequence
  Description of Artificial Sequence: Synthetic coding sequence
atggaagactattgcgattcgcctcacggtgaaactacttctgtcgaggattcaactcaagatgtaaccgctgaacaccatacaagcgacgacgagtgtgaaccaattgaggcaatcgcaaaatttgactatgttggtaggaccgccagagaactctcctttaagaagggcgcctctcttctgctgtaccagagggcctcggacgactggtgggaaggacgccataatggcatcgacggcttgattcctcaccaatatattgtagtccaggacaccgaggatggcgtcgtagagaggtcctccccaaagtctgaaattgaggtgatcagtgagccacccgaagagaaagttactgcccgggccggagcttcttgtccatcaggcgggcatgttgcggatatctacttggccaacattaacaacaatcttcacttagataatacaaaacccgtgactacaaaacaacggaagagacctgaaagtggtagcatcagaaaaaccttccggtctgattctcacggtctcagctcttccctcaccgatagctcctcccctggggtaggcgcgagctgtcgtcctagttcacagcccattatgtctcagagcttgcctaaagaaggtccagataagtgctccatcagtggacacgggagtctgaacagcattagtcggcacagcagtctgaagaatcgtctggactcgcctcagattcgtaagactgctacagccggcaggtctaagtcattcaacaatcactag

SEQ ID NO: 134527 - DNA, 693 bp, Artificial Sequence
  Description of Artificial Sequence: Synthetic coding sequence
tgagcagaacatcacacatccgatgacgagtgtgaacccatcgaggctatagccaagtttgactatgtcggacggacggcccgggaactgtcattcaaaaaaggcgcctcattgctactttatcagcgtgccagcgacgactggtgggagggtcgtcataacgggatcgatggtttgattccccatcagtacattgtggttcaggatactgaggacggagtggtggagagaagctcaccaaaatcagagattgaggtcatctctgaaccaccagaagagaaagtgactgcaagagcaggcgcaagttgtccatccggaggtcatgtggctgatatctacttggcaaatatcaacaacaacctgcacctggataacacgaagcccgtaacgacaaagcagcggaaaaggcccgagagcggatcaattagaaaaacatttaggagcgattcacatggcctgtctagttctctaacagactcctcctcccccggcgtcggggcttcttgtcgaccatcctcgcagcctattatgtcacaatctttacctaaagaggggcctgataagtgttccatctctgggcacggcagcctgaactcgatcagcaggcattcctcacttaaaaatagactggattctcctcaaataaggaaaacggcgaccgcaggacgatccaaatctttcaataaccactag

SEQ ID NO: 134528 - DNA, 1353 bp, Artificial Sequence
  Description of Artificial Sequence: Synthetic coding sequence
gtgaagaaaacaatggaagccactctgcagacgatacaggacatcgtaacggtagaagatttcgatgtgagcgattgctttcagtatagtaacagcatggagagcgttaagagcactgtgagcgaaacatttatgtcaaaaccttcaattgccaaacggagagcaaaccagcaggaaacagaacagttctactttacaaagatgaaagagtatctggagggcaggaatttgataacaaagttgcaggcaaagcatgacctccttcaaaagaccctgggagaatctcagcggaccgactgcagcctggccagacggagtagcacggtgcgcaagcaggatagctcgcaagcgataccactggtggtcgagtcctgtattagatttatatcccgacacggactgcagcacgaaggaatcttcagggtttcaggttcccaagtggaggtgaatgacatcaagaacgcctttgagcggggcgaagaccctcttgccggggatcaaaatgatcacgacatggacagtattgctggggtgcttaagctgtactttcgaggtcttgaacatccacttttcccaaaagacatctttcatgacttgatggcttgcgttactatggacaatctccaggaaagggcgctgcatatcagaaaggtgctactcgtcctgccgaagactacactgattattatgaggtacctctttgcatttctgaaccatctctcccagtttagcgaagagaatatgatggacccttataatcttgccatatgctttggaccctcactcatgagcgtaccagagggtcacgatcaagtgtcttgtcaagcccatgtgaatgaacttattaaaaccatcatcatccagcatgaaaacatctttcccagcccaagagagcttgaaggtccagtttactcaaggggcggatccatggaggactactgtgactctcctcatggggaaacgacttcggttgaagacagcacccaagatgtgaccgcagagcatcacactagcgatgacgagtgtgagccaatcgaagccatcgccaagttcgattatgtgggcaggacagccagagagctctcctttaaaaagggcgccagcctgctgctgtatcagagggcttccgacgactggtgggaaggccgacacaatggcattgatggactgattccccaccaatacatcgtcgtgcaggacacggaggatggggtggtggagagaagcagcccaaagtccgagattgaggtgatttcagagccacccgaggaaaaggtgaccgctcgggcaggtgcctcttgcccctcgggtggtcacgtagccgatatctacctggcaaacatcaataagtag

SEQ ID NO: 134529 - DNA, 3228 bp, Artificial Sequence
  Description of Artificial Sequence: Synthetic coding sequence
atgtctagtcagacgaagtttaaaaaggacaaagaaatcatagcagagtatgaagcccagatcaaggagatccggacacagctggtggagcagtttaaatgcctggagcagcaatccgaaagtaggctgcagctactacaggacctgcaagagttctttaggaggaaagcagaaatcgaactcgagtactcacggagcttggagaaactggccgagcgcttttccagcaaaattcgctccagtagggagcaccagtttaagaaggatcaatatcttctgtcacctgtcaactgctggtacctggttctgcaccagactagaagagaaagcagggatcacgctactctgaacgatatttttatgaataatgttatcgtcaggctatcgcaaattagcgaagatgtcattagactgttcaagaagtcaaaggaaatcgggcttcagatgcacgaggaactgctgaaagtgactaacgagctttacacagttatgaagacttaccacatgtaccacgctgaaagtataagcgcagagtcaaagttgaaggaggctgaaaagcaggaagaaaagcagttcaataaatcaggagatctctctatgaatctgcttcggcacgaggataggccccagaggcggtcttcagtgaagaagatcgaaaagatgaaggaaaagcgccaagccaaatacagcgaaaacaaactaaagtgtacgaaagctagaaatgattaccttcttaatttggcagccacaaatgcagcgattagcaaatactacatccacgacgtgtccgatctcattgactgctgcgatctgggcttccacgcatcgctggcgcgcaccttccgtacatacctcagcgccgaatacaacctggagacctctaggcatgagggtttggatgtgattgaaaatgctgttgataatttggactcccgcagcgacaaacacacagtaatggacatgtgtaatcaggtgttttgcccgccccttaaattcgagtttcagcctcacatgggggacgaggtttgccaggtgtcagcacagcagcctgtccaaaccgaactccttatgcggtaccatcagcttcagtcacgcctcgccaccttgaagattgagaatgaagaggtacgcaagaccttagatgctaccatgcaaacattgcaggatatgctgactgttgaggactttgatgtgtcggacgcctttcagcactcgcggtcaacagaaagcgtgaagtccgcggcttcggaaacttatatgtccaaaattaacattgctaagagacgtgctaatcagcaggagaccgagatgttttacttcactaaattcaaagagtatgtgaacgggtccaacctcatcacaaagctgcaggcaaaacatgatcttctcaagcagacacttggagagggagaacgcgcggaatgtgggacgacccggggcaggcgaaatgcacgaaccagaaatcaggactcggggcaagctatcccattagtcgtggaatcttgtataaggtacattaacctttatggccttcagcaacaggggatcttccgtgtccccggctcacaggtggaagttaacgacattaagaatagcttcgaacgcggcgaggatcctctagtggacgatcagaatgagagggatattaactcagtcgccggcgtgctcaagctgtattttcgtggtctggagaaccccctcttccctaaagagcggttccaggacctaatcagcacgattaagttggagaatcccgccgagagggtccatcagatccagcagatcctcgtaacacttccccgggttgtgatcgttgtcatgagatacctgtttgcattcctcaaccacctgtcccagtactcagatgaaaatatgatggacccctacaatctggccatctgctttggacctacgctgatgcatattcccgatggacaagaccccgtaagttgtcaagctcatatcaacgaggttattaaaaccattattattcaccacgaagccattttcccgtcacctcgggagctggagggtcccgtgtacgaaaagtgcatggcgggcggagaagaatattgtgattcacctcattcagaacctggcgcgatagacgaagtggaccatgataacggcacagagccgcatacctccgacgaggaggtcgagcagatagaagctattgctaaattcgactatatggggaggagcccacgggaactcagcttcaagaagggcgccagcttactactatatcaccgtgccagcgaagactggtgggagggccgacataatggtgtggatggattaatccctcaccagtacattgtagttcaggacatggatgacgcattctccgactctctctcccagaaggcagactccgaagcttccagcgggccgttgctcgacgataaggcctcaagcaaaaatgacctccagtctcccacagaacacatatccgattacggcttcgggggggtgatgggccgagtgaggctgcgctctgatggcgctgccatcccaagacgacgatcgggcggagacacccactcccctcctcggggcctcggcccttcaatagacacgccaccccgcgctgccgcatgtccttcctctccgcataaaatccctcttacccgcggtaggattgagagcccagagaaaaggagaatggctactttcggcagcgcgggcagtattaactatccggacaaaaaggccctttccgaaggacactccatgcgctcaacatgtggatcgactcgtcactcatcattaggtgaccacaagagtctggaggctgaagcactggccgaagacattgagaagaccatgtcaaccgcgctccacgagttaagagagctggagcgccaaaacaccgtcaagcaggctccagacgtcgtcctggatacactcgaacccttaaagaaccctccagggcccgtgtccagtgagcctgcttccccactccacacaattgtaatcagagacccagacgcagccatgcggaggtcaagctcatcatccacagagatgatgacaacttttaagcccgccctgagcgcgagactggcgggcgcccagctgcgcccccccccaatgaggcctgttcgccctgttgtgcagcacaggtcgtcaagttcaagtagttcaggcgtcggcagccccgcagtcacccctactgagaaaatgtttccaaactcctccgcagacaaatcaggcactatgtag

SEQ ID NO: 134530 - DNA, 3300 bp, Artificial Sequence
  Description of Artificial Sequence: Synthetic coding sequence
atgtcctcacagacaaagtttaagaaagataaggaaatcatagccgaatacgaagcccagattaaagaaattagaacacagcttgtcgaacaatttaagtgtctggaacaacagtcagagtcacgcctgcaattgctccaggatcttcaggaattctttagacgaaaagctgagatcgagctggagtactccaggtcacttgagaagctggcggagagattcagttcaaaaattagatccagtagagagcatcagtttaagaaggatcagtacctcctatcccccgttaactgttggtacctggtgttacaccagactagacgggagtcccgcgatcacgccactctgaatgatatcttcatgaataacgttatcgtgagactgagtcagattagtgaggacgtaatccggctgtttaaaaaatccaaagagattggactccaaatgcatgaagagctgttgaaggttaccaatgaattgtacactgtgatgaagacataccatatgtaccacgcagaatccattagcgctgaatcaaaactgaaggaagccgagaagcaggaggaaaagcaatttaataaatctggggaccttagtatgaacctcttaagacacgaggaccggccgcagcggcggtcatccgtaaaaaaaatagagaagatgaaggaaaaaagacaagcaaagtatagtgagaataagctcaagtgcacaaaagcccggaatgattacctgctgaacttagccgcgacaaacgccgccatttcgaaatactatatacacgatgtgagtgaccttatagactgttgcgatttgggcttccatgcttccctcgcgagaacatttcggacttacttaagcgcagagtacaatctcgagacctcaagacacgagggactggacgtgatagaaaatgccgtggacaatcttgacagccgctccgataaacataccgtgatggacatgtgtaatcaggtcttttgccccccattaaaatttgagtttcagcctcacatgggagatgaagtgtgccaggtaagtgcacagcagccagtccaaaccgaacttcttatgcggtaccaccagctacagagccggttggccactcttaaaatcgagaacgaggaagtaaggaagacattggacgcaaccatgcagacattgcaggacatgctgaccgtagaggactttgacgtgagcgacgctttccagcactcaagatccacggaatccgttaagtctgcggccagcgagacgtatatgtcaaaaatcaacatcgctaaacggcgggccaatcaacaggaaaccgagatgttttatttcactaagtttaaggagtacgttaacgggtccaatctcatcaccaagctacaggcaaagcacgacctactcaagcagactttaggagagggagaacgggcggagtgcggcacaacccggccaccatgccttccgccgaagccgcaaaaaatgagacgtccaagacccttaagcgtgtattctcacaagttgtttaacggaagcatggaggcatttatcaaggatagcgggcaagccatccccttggtagtggagtcctgtatccgatatattaacctctacggcctgcagcagcaaggcatctttagggttccagggtcacaggtggaggtgaacgacattaaaaatagcttcgagcgcggcgaggatcctttggtagacgaccagaacgagcgggatattaactccgtggctggcgtcctcaagctgtattttcgagggttagagaatcccctgtttccgaaagaacgttttcaggatttgattagtaccatcaagctcgaaaaccccgccgagagagtgcatcagatacagcagatcctagtcacacttccacgcgtcgtcatcgtcgtcatgcggtatctgtttgcctttctcaaccatttaagccagtatagcgacgaaaacatgatggatccctacaatctcgccatctgcttcgggccaaccctgatgcacatcccagacgggcaggaccccgtctcctgtcaggcacacattaacgaggtcatcaagacaattataatacaccacgaagcaatttttcctagccctcgtgagctggagggacctgtctacgagaagtgcatggccggcggcgaggagtactgcgattccccccattcagaaccaggggcaatcgatgaggttgaccacgataatgggactgaaccacatacatctgacgaagaggtggaacagattgaagctatagcgaagttcgattacatgggacgctcaccacgcgaattgtcgttcaagaagggcgcttctctgctattgtaccacagggccagtgaagattggtgggagggcagacacaatggtgtcgatggcctgatcccccatcagtacattgtcgtgcaggatatggatgacgcattctctgattccctgagccagaaagccgatagtgaagcatcctccggtcctctcctggacgataaggctagctccaaaaatgatttgcagagcccgaccgagcatatctcagattacggattcggtggagtgatgggcagggttcgtctccgtagtgacggagccgctatcccccgacgcagaagcggcggcgatacccatagcccccccaggggtcttggcccttctattgacacgccacccagagccgctgcttgcccatcttcccctcataaaattcccctcacccgcggcagaatagagagtcccgaaaagcgccgaatggcgacgtttgggtccgccggatcaatcaattatccagacaagaaggccctgagtgaaggccacagtatgaggagcacatgcggtagtacccgacattccagccttggcgatcataaatcgctggaagccgaagcactggctgaggacatcgaaaagaccatgtccacagctctccacgagttaagagaactggagcgacaaaatacagtgaaacaggcacccgacgtcgtgctcgacactctggaacccctaaagaacccgcctggcccagtctctagcgagcccgcatcccctctgcacaccatagtgattagggatccagacgcagccatgagacgctcaagtagtagtagcactgaaatgatgactacgttcaaacctgctctctctgcaagactcgcgggtgcccagctccgtccacctccaatgcggcctgttcgaccagtcgtgcagcatcggagctcctcatcatcgagttcaggcgtggggagccccgctgtgactcccaccgaaaagatgttcccaaactcctcagccgacaaatccggcacaatgtag

SEQ ID NO: 134531 - DNA, 1008 bp, Artificial Sequence
  Description of Artificial Sequence: Synthetic coding sequence
atgaacaatgtgattgtgagactgtcccaaatttctgaagatgtgattaggttattcaaaaagtcaaaagagatcggactccaaatgcacgaggagctgctgaaggtgaccaatgaactatatacggtgatgaaaacgtatcatatgtaccacgctgaatccatatcggcggagtcaaagctgaaggaggctgagaaacaagaagaaaagcagtttaataaaagcggagacctttctatgaacctgctccggcacgaagatagaccccaacggcgctcgtctgtcaaaaagatcgaaaagatgaaagagaaacgccaggccaagtactccgaaaacaagttaaagtgtacaaaggcccgtaacgactacttactcaatctcgcagctacaaacgctgctatctccaagtactacatacacgacgtgtcagatctgattgattgctgcgacttgggctttcatgcatcattggctcgcaccttcagaacctacttaagcgctgagtataatctcgagacatcccggcacgaaggtctcgatgtgatagagaatgctgtcgacaacttggattctagaagtgataagcatactgtgatggacatgtgtaaccaagtattttgtcctccgcttaagtttgagtttcagcctcacatgggggacgaagtatgtcaggtgtccgctcagcagcctgtccagaccgagctcctcatgcgatatcatcagctacagagcagacttgctaccctcaagatagagaacgaggaggtgcggaagactctcgatgcaacaatgcagactctccaagacatgcttactgtggaggatttcgatgtaagtgatgcctttcagcactcccggagtaccgagtccgtgaaaagcgccgcaagtgagacctacatgagcaagatcaacatcgcaaaaaggagggcaaaccagcaggagaccgaaatgttctacttcacgaaaggacctgacgatgtattcccaatctgccatccccgattgtag

SEQ ID NO: 134532 - DNA, 360 bp, Artificial Sequence
  Description of Artificial Sequence: Synthetic coding sequence
atgtcctggtggcgaaataatttttggatcatcctggctgtggccatcatcgttgtatctgttggcttggggctgattctttactgtgtgtgtaagtggcagcttagaagaggcaagaaatgggagatcgccaagccattgaagcacaagcaagtagacgaagagaaaatgtatgacttcctcctccttcggacagcatgtagtcttccacccttgcccctgcattacaggaccagcatgacagagacatatggtgtgcttctttgtcgccctgggtggtcagccctggcgcgtagtaggctgacggctgcctcagccagctgggttcaagcgattctccttccacagccccccaagtag

SEQ ID NO: 134533 - DNA, 438 bp, Artificial Sequence
  Description of Artificial Sequence: Synthetic coding sequence
atggatacttttacagtacaagattcgacagccatgtcctggtggcgcaataacttttggatcatactggccgtcgcaatcattgtggtcagcgttggtcttggattgattttgtactgtgtttgcaaatggcagctccgaaggggaaagaaatgggagattgccaaaccactgaagcacaagcaggtcgacgaggagaaaatgtatgaaaacgttctgaacgaatctcctgttcagctgccaccattgccccccagaaactggcccagtctcgaagatagtagtccccaggaggcacccagccaacccccagctacatatagtctcgtgaataaagttaagaataagaaaaccgtgagtattccttcatacatcgaacctgaggatgactatgatgacgtcgaaattcctgccaacacagaaaaagcctccttctag

SEQ ID NO: 134534 - DNA, 438 bp, Artificial Sequence
  Description of Artificial Sequence: Synthetic coding sequence
atggacaccttcaccgtgcaggattcgaccgccatgtcctggtggcgcaataacttttggattattttggcggtcgccatcatcgtagtcagcgtgggcctcgggcttattctctattgtgtgtgtaagtggcagctcaggcgcgggaagaaatgggagattgcaaaaccactaaaacacaagcaagtggatgaagagaaaatgtatgagaacgtgctgaatgagagtcccgttcagctgccacccctgcctccgcgcaactggccaagcctggaggacagttcaccccaggaggccccctcccaacctccagctacatatagccttgtaaataaggtgaagaataagaaaacagtgagcataccttcttatatagaaccagaggatgattacgatgacgtggagatcccagccaatactgagaaggccagcttttag

SEQ ID NO: 134535 - DNA, 1398 bp, Artificial Sequence
  Description of Artificial Sequence: Synthetic coding sequence
atgaatgtgacctcattgttttcatttacttcccctgccgtgaaaaggctcttaggttggaaacagggggatgaggaagaaaaatgggccgaaaaagccgttgacgctctcgtcaaaaaactaaaaaagaaaaaaggagccatggaagagctggagaaagccttaagctgccctggtcagcctagcaattgcgtgaccattcctcgctccctagatggtcgacttcaggtgtcacataggaagggcctgccccacgtcatttactgccgcgtatggcggtggcccgacctgcagagccatcacgagttgaagccccttgagtgctgcgaatttccattcggcagtaagcagaaggaggtatgtatcaacccataccattacaaacgagtagaatccccagtgctgccccccgtactggttccacgccactcggagtacaatccacagcattccttgctggcccagttcaggaatttgggtcagaacgagcctcatatgccactaaatgcgaccttcccggactccttccagcagcccaactctcacccgtttccgcatagcccaaattcaagctacccgaatagtcctggctcatccagcagcacctacccacacagccccacatcaagtgacccgggaagcccattccagatgcccgccgacacacccccccctgcgtatcttcctcctgaagaccccatgacacaggacggcagtcagccaatggatacaaacatgatggcccccccgttaccttcggaaataaatagaggagatgtccaggcagtggcctacgaagagcccaagcattggtgttccatcgtgtactacgagctaaataatagggtcggagaagcatttcacgccagcagcacctctgtacttgtggacgggtttacagatccatctaataataaaaaccggttctgcctcggcctgctttctaatgtgaatagaaatagtacgatcgagaacacaaggcggcacatcggtaagggtgtgcacttgtattacgtgggcggtgaagtatacgcggaatgcttatctgattcctccatattcgttcagagtcggaactgcaattaccaccacggattccacccaaccactgtgtgcaagattcccagtggatgctctctaaaaatcttcaacaaccaagagttcgcccagctactggcccagtccgtgaatcacggattcgagaccgtctatgagttgaccaaaatgtgtacaataaggatgagttttgtgaagggctggggagccgaataccatcgccaagacgtcaccagtaccccttgctggatcgagatccatctccatgggcccctacagtggttggacaaggtattgacccagatgggatctccacacaaccctatcagctctgtgtcctag

SEQ ID NO: 134536 - DNA, 1398 bp, Artificial Sequence
  Description of Artificial Sequence: Synthetic coding sequence
atgaatgtcactagcctctttagctttaccagcccggcggtgaaacggctcttggggtggaaacagggcgatgaggaggaaaagtgggccgagaaagctgtcgacgctttagtgaagaagttaaagaagaagaaaggcgccatggaagagctggagaaagcattatcgtgtcccggccagccatcgaattgtgtaacgatccctcgctccttggacgggcggctgcaggtgtcacaccgcaaaggcctgccccacgtcatctactgtcgggtgtggaggtggccggacttgcagtctcatcacgaactgaagccactggaatgctgtgagttccccttcgggagcaagcagaaagaggtatgcatcaacccatatcattataaacgagttgagtcgccagtattaccccctgtgttggtgccgcgtcactccgaatataacccccagcattcactgctcgctcaattccgaaatctagggcagaacgagccacacatgcctctcaacgcgaccttcccagactcattccagcagccaaatagtcaccccttcccccatagcccaaattccagctacccgaactctcccggtagcagttcaagtacatacccccactctccaactagctctgacccgggttcaccgtttcagatgcctgctgacactccaccacctgcttatctgcctcctgaggatcctatgacccaggacgggtctcagcctatggacaccaacatgatggcccccccgctgccttccgaaatcaatcggggagatgttcaggccgttgcctatgaagagccaaagcactggtgctccattgtgtactacgagctaaacaaccgcgtgggggaggctttccatgcttcttcaacttccgtgctcgtagacgggtttacggacccatctaataacaaaaacaggttctgcctgggactactgtccaatgtgaacaggaattctaccatcgagaatacccggcgccacataggcaagggcgtgcatctgtactatgttggaggcgaagtgtacgctgaatgtttaagcgatagctctatatttgtgcaatctagaaactgtaactaccaccatggatttcacccgactaccgtgtgcaaaataccatcaggctgcagcctcaagattttcaataaccaggagtttgcacagttgctggcacagtccgtgaaccacgggtttgagaccgtctacgagctcacaaaaatgtgtactattaggatgtcctttgtaaagggctggggagccgaataccacaggcaggatgttacgtcgacgccttgctggatcgagatccatctccatggcccccttcaatggttggacaaagtcttaacccagatgggaagtccccacaatccaatatcttcagtgtcctag

SEQ ID NO: 134537 - DNA, 177 bp, Artificial Sequence
  Description of Artificial Sequence: Synthetic coding sequence
atgaatgttacctctctgttcagcttcacttcccccgccgtgaaaaggttgcttggatggaagcagggtgacgaagaggagaaatgggccgaaaaggccgtcgacgcactggtgaagaaactcaagaagaaaaagggcgcaatggaagagttagagaaggctctttcctgtccgtag

SEQ ID NO: 134538 - DNA, 33 bp, Artificial Sequence
  Description of Artificial Sequence: Synthetic coding sequence
atgaacgtgacctctctgttttcctttacgtag

SEQ ID NO: 134539 - DNA, 288 bp, Artificial Sequence
  Description of Artificial Sequence: Synthetic coding sequence
atgaatgttacgtcattattcagcttcacaagtcctgctgtgaagaggttgttaggatggaagcagggcgatgaggaagagaaatgggccgagaaggccgtggacgccctagttaagaagctgaagaaaaaaaagggcgccatggaggagcttgaaaaagccctgagctgccccgggcagccctccaactgtgtgactatccccagaagcttagatggaagactgcaggtgagccataggaaggggctgcctcatgtgatctattgtagggtgtggagatggccctag

SEQ ID NO: 134540 - DNA, 402 bp, Artificial Sequence
  Description of Artificial Sequence: Synthetic coding sequence
atgaatgtgaccagtctgttcagctttacttctcctgctgtcaagcgtctactgggctggaaacaaggagatgaagaggagaaatgggcggagaaggcagttgatgctcttgtcaaaaagctcaagaagaagaagggcgccatggaagaactagagaaggccctaagttgcccgggacagccttctaactgcgttactatacctagaagcttggatgggcgcttgcaggtcagccacaggaaaggcctgcctcacgtcatctactgtcgggtctggcgctggcccgacctgcagtctcaccatgagctcaagcctctggagtgctgcgaattcccttttggaagtaaacaaaaagaagtctgtataaatccttatcattataagcgtgtggaatcgccctag

SEQ ID NO: 134541 - DNA, 321 bp, Artificial Sequence
  Description of Artificial Sequence: Synthetic coding sequence
atgaacgttacaagcctcttttcctttacatctcctgctgtgaagcggctactgggctggaaacagggtgatgaggaagagaagtgggccgaaaaggctgtcgatgccctggtgaagaaactgaagaagaaaaagggagcaatggaagagttggagaaggctctgtcatgtcctggtcagccttccaactgcgtgaccataccccggtccctggatggccgtctccaagtttctcatcgcaagggcctgccacacgtgatctactgccgcgtgtggcgctggcctgatctacagtctcaccatgagctgaaaccgctctag

SEQ ID NO: 134542 - DNA, 339 bp, Artificial Sequence
  Description of Artificial Sequence: Synthetic coding sequence
atgaacgtgactagcctgttttcttttacatcaccagctgtgaaaaggctattagggtggaagcaaggggacgaggaagaaaaatgggccgaaaaggcagtggacgccttggtaaagaaacttaaaaagaagaagggggccatggaggagcttgaaaaggctctctcatgccctgggcagccgagcaattgcgtgacaattcctcggtcactcgacggtcggcttcaggtgtctcataggaaaggcctccctcatgtgatctattgccgagtatggcgctggcctgatttgcagagtcaccacgagttaaaacccctcgagtgttgtgagtttccatag

SEQ ID NO: 134543 - DNA, 1398 bp, Artificial Sequence
  Description of Artificial Sequence: Synthetic coding sequence
atgaacgtcacttcattgttcagctttacctctccggccgtgaagagactgctggggtggaagcagggagacgaagaggagaagtgggctgaaaaagctgtggacgcgctcgtcaaaaaacttaagaaaaagaaaggcgccatggaggagctggagaaggccctgtcttgcccaggtcagccgtcaaattgtgtaactatcccaaggtctttggacgggcgcctgcaggtctcacatcgtaaaggattgccccatgtgatttattgcagggtctggcggtggcctgacttgcagtctcaccatgagctcaagcccctggagtgctgtgagtttccttttggctcaaaacagaaggaggtctgcatcaacccttatcactacaagcgggtggagtcaccggttctccccccggtgttggtaccaaggcactctgaatataaccctcagcactccctgcttgcccaattccggaacctggggcaaaacgaaccccatatgcctctcaatgcaacctttccagactcctttcagcagcccaacagccaccccttccctcatagccccaacagctcataccccaacagtcccggcagcagctcttctacttatcctcactcgcctacgagttctgacccagggagcccgtttcagatgccagccgatactcctccccccgcctatcttccgcctgaggacccaatgacccaggacggctctcagccgatggatactaacatgatggcccccccactgccaagcgagataaaccgtggagacgtgcaggccgtcgcttatgaggaaccaaagcactggtgttcaatcgtgtattacgaactaaataatcgagtgggtgaggctttccacgcatcatcgacctccgtgttggtggatggcttcaccgatcctagcaataacaaaaatcggttctgcctggggcttctgtctaatgttaacagaaatagtaccatcgaaaatacacgcagacatatcgggaagggcgtgcatctgtactacgtggggggcgaggtatacgcagaatgtctgtctgatagttcaatcttcgtccagtctagaaactgtaactatcatcatgggtttcaccctacaaccgtgtgcaagatcccctctgggtgtagcctgaaaatattcaataatcaggaattcgcccagctgctagctcagtccgtcaatcacggctttgaaacagtgtatgaactcaccaagatgtgcactatacgtatgtccttcgtcaaaggctggggggcagagtatcacagacaggatgtaacgtctacaccatgctggatcgaaatccatctgcacggaccgctacagtggctggacaaggtattaacccagatggggagccctcataacccgataagttcagtgagttag

SEQ ID NO: 134544 - DNA, 1659 bp, Artificial Sequence
  Description of Artificial Sequence: Synthetic coding sequence
atggacaatatgagcataacgaatactccaacatctaacgacgcatgcctctctatcgtgcattcccttatgtgccaccggcaaggcggagagtcagaaaccttcgcaaaacgggccatagagtcactggtaaaaaaactgaaagaaaaaaaggatgaactcgatagtttaatcacggccattaccactaacggtgcccacccaagcaagtgtgttacaattcagcgcaccctagacgggaggctgcaggtggccggcaggaaagggttccctcacgtgatctatgctcggctctggaggtggcccgaccttcacaagaatgagcttaagcacgtcaagtactgccagtacgcctttgacttgaagtgcgatagtgtttgtgtcaacccataccactacgagagggtggtctcccccggaattgatctgtccggactaacactgcagtctaacgcgccaagctccatgatggtgaaggacgaatacgtgcacgactttgaaggccagccaagtctctctaccgaagggcactctatccagaccattcagcacccgcctagtaatcgcgctagcacggagacctactcaacgcctgccctcctggctccatcggaaagtaatgctactagcaccgctaatttccctaatatccccgtggcttccacctcgcagcccgcctcaatcctgggaggctcgcattctgagggactgttgcagatcgcatctggtccccagccaggacagcaacagaatggattcacagggcagcccgccacctaccaccacaactcaaccacaacctggacaggcagccgaaccgccccctacacgcccaatttaccccatcaccagaacggccacctgcagcatcatccacccatgcccccccatcccgggcattattggccagtccataatgaactagcattccagccaccaatctcaaatcacccagcacctgagtactggtgcagcatcgcgtactttgagatggacgtgcaggttggggagacctttaaggtgccttctagctgtcccatagtgacagtcgacgggtatgtggatccttccggtggagataggttctgtctggggcaactttccaacgtacatcggaccgaagctatcgaaagagcgaggcttcacatagggaagggcgtgcagcttgagtgtaaaggtgagggagatgtctgggtgcgatgtctgtccgaccatgccgtatttgtccagtcatactacttggaccgcgaggcagggagggcccctggggacgcagtgcataagatttatcctagtgcctacattaaggtctttgatctcaggcagtgccaccgacagatgcagcagcaggcagcaactgctcaggccgctgccgctgcccaggctgcggctgtggccgggaacatccctggccccggaagcgtgggcggcatagccccagctatttctttgagtgccgccgccggtatcggagtggatgatcttagacgcctgtgtatacttagaatgtcttttgtgaaaggatggggacccgattatccacgccagtcgattaaagaaaccccgtgctggatagagatccatctgcatagagctttgcagctcctggatgaggtcttgcacaccatgccaattgctgatccccagccattggattag

SEQ ID NO: 134545 - DNA, 1659 bp, Artificial Sequence
  Description of Artificial Sequence: Synthetic coding sequence
atggacaacatgtctatcaccaatacccctactagcaacgacgcctgtctctccattgtacattccttgatgtgtcaccgccagggcggcgagtctgagaccttcgccaaacgggccattgagtctttggttaaaaaactcaaggaaaagaaggacgagctcgactccctcatcacggccataaccacaaacggggctcatccaagcaagtgcgttactatccaaaggacactggacgggcgtctgcaggtcgctgggaggaagggttttcctcacgtgatctatgctaggctgtggagatggccggatctccacaaaaacgagctcaaacacgttaagtactgccagtatgcctttgatctgaaatgcgattccgtgtgcgttaatccctatcactacgagagagtagtttctccaggcatcgatctgtctgggctaacactgcaatccaatgcaccgtccagtatgatggtgaaggatgaatatgtgcacgatttcgaaggccagccttcattgagcaccgaaggacactccattcagacgatacaacacccacccagcaatcgtgccagtacagaaacatattctacacctgctctattggctcccagcgagagtaacgccacctctacagccaattttccaaacatcccagtggcctctacctctcagcctgctagcatccttggcgggagccactctgagggactccttcagattgcaagtggcccacagcccggccaacagcagaatgggtttactggtcaacctgccacttatcaccacaattccactactacctggactggctcccggactgctccatacaccccaaaccttcctcatcaccagaacggacacctacagcaccacccaccaatgccaccacacccgggccactactggcctgtccataacgagcttgccttccaacctcccattagcaatcacccagcacccgaatattggtgctcaatagcatacttcgaaatggacgtgcaggttggcgagacgttcaaagtcccttcatcatgtcctatcgttaccgtggatggctatgttgatccatccggcggtgaccgcttttgccttgggcagctctctaatgtgcacagaaccgaagctattgagagagcccggctccacataggcaagggggtgcagttagaatgcaaaggggaaggagatgtatgggtcaggtgcctgtctgatcatgctgtgttcgtccagtcttactatcttgacagggaggccggtcgagctccaggcgatgccgtgcataagatctaccctagtgcctacatcaaagtcttcgatctgaggcagtgtcatcgacaaatgcagcagcaagccgccacagctcaggcagccgccgcagcgcaggccgccgccgtggcaggaaatatccccgggcccggttcggttgggggcatcgccccagctatctctctgagcgccgccgctggcattggggtagacgatctgaggaggctctgcatcttgaggatgtccttcgtgaaaggatggggcccagattacccaagacagtctattaaagaaaccccctgctggatagaaatccacctccatcgggctctgcagctgctcgacgaggtgttgcatacaatgccaatagccgacccccagcccttggactag

SEQ ID NO: 134546 - DNA, 534 bp, Artificial Sequence
  Description of Artificial Sequence: Synthetic coding sequence
atggacaatatgtccattacaaatacaccaacatctaatgacgcctgcctctcaattgtccattccttgatgtgtcacagacaggggggtgagagtgagaccttcgccaaacgggctattgagagcctcgttaaaaaactcaaagagaaaaaggatgaactcgattccctgattacagccatcacaacaaacggagcacacccctcgaagtgcgtaacgattcagagaacattagacggtcgcctgcaagtcgcgggtcggaaaggctttccccacgtcatttatgcccgcctgtggaggtggcctgatctacacaagaacgaactgaaacatgtgaaatattgtcagtacgcttttgaccttaagtgcgactcggtctgtgtcaacccctaccactacgagagggtggtcagcccgggcatagacctctcaggcctgacactgcagagtaatgagaacaactggtacttttctcaactgcttctggacttagacaagggtatgatccaggagcaggcaatccacggcccatag

SEQ ID NO: 134547 - DNA, 1311 bp, Artificial Sequence
  Description of Artificial Sequence: Synthetic coding sequence
atggataatatgtcaattacaaatactccaacgagcaacgacgcttgtctctcaatagtccactcactgatgtgccatcgacagggcggcgaaagtgagacctttgcaaagcgagccatagagtctctggtgaagaagttgaaggaaaagaaggacgaactggactccttaattacggccattactactaacggcgctcaccctagtaaatgtgtgacgatccagaggactctggatggacgcctccaggtggctggccgcaaagggttccctcacgtgatctacgctaggctgtggaggtggccagatctgcacaagaatgagcttaaacacgttaaatattgtcaatatgcctttgatctgaaatgcgacagcgtttgtgtgaacccttaccactacgagcgcgtggtgagtccaggtatcgatctcagcggattgacacttcaatcgaacgctcctagttctatgatggtgaaggacgagtatgtgcatgatttcgaagggcagccttctctgagcacggagggccactctatccagacaatccagcacccacctagtaaccgcgcatccacagaaacctactcaactcctgctcttctcgctccatcagagtcaaacgccacctctaccgcgaatttcccaaacatacctgtagcatccacatcccagcccgcgtcaatcctggggggttcccacagtgagggactgctgcagatcgccagtgggccacagccgggacaacagcaaaacgggtttactggacaacctgctacataccatcacaacagtactacaacatggactggcagtcgcaccgccccctacacccccaatttgcctcatcaccagaatggtcatttgcagcatcacccaccaatgcctcctcacccgggacactactggccagtgcacaacgagctcgcctttcaaccaccaatctcaaaccatcctgctccagagtactggtgttccattgcgtattttgaaatggacgtccaagttggtgagacctttaaagtgccttcatcatgcccgatagttactgtagatggctatgttgatcctagcggaggggaccggttctgcctgggacaactcagcaacgttcacaggacagaagccatcgagagggcccgcctgcacatcggtaagggagtacagttagaatgcaagggagaaggtgacgtatgggtgaggtgcttatctgaccacgctgtgtttgtgcagagctattaccttgatcgagaggctgggcgtgcccccggcgacgctgtccacaaaatttaccccagtgcgtatatcaaatag

SEQ ID NO: 134548 - DNA, 243 bp, Artificial Sequence
  Description of Artificial Sequence: Synthetic coding sequence
atgacctctatggctagcctctttagtttcactagcccagcggtcaaacgtttgctgggatggaagcagggcgatgaggaggagaagtgggctgaaaaggcagtcgacgctctagtgaaaaagcttaagaagaaaaagggcgcaatggaggaactggaaaaggctctttcaagccccggccaacctagtaaatgcgtgacaatacctaggtcactggacggacgactgcaggttagtcactag

SEQ ID NO: 134549 - DNA, 387 bp, Artificial Sequence
  Description of Artificial Sequence: Synthetic coding sequence
atgaccagcatggcaagcctgtttagcttcacgagtcccgccgtcaaacggctccttgggtggaaacagggcgatgaagaggagaaatgggcagagaaagccgtagacgcactcgtgaagaaactcaagaagaagaaaggtgcaatggaagagctggaaaaggctctatcctcccccggccagccatctaagtgcgtgactatccctcgttcactagatgggcggcttcaggtctcacataggaaagggttaccacatgttatttattgccgggtgtggagatggcctgacctccagtcacatcacgagctcaagccattagacatctgtgagtttcccttcggatccaaacagaaagaggtctgcattaacccttaccactactag

SEQ ID NO: 134550 - DNA, 6 bp, Artificial Sequence
  Description of Artificial Sequence: Synthetic coding sequence
atgtag

SEQ ID NO: 134551 - DNA, 405 bp, Artificial Sequence
  Description of Artificial Sequence: Synthetic coding sequence
atgacctctatggcatccttattttccttcacgagccccgcagtgaagcggctgctggggtggaagcaaggagacgaggaggagaagtgggctgagaaagccgtggacgccctcgtaaagaagctgaagaagaaaaagggggccatggaggagcttgagaaggcactgtcctctcccggccagccctcgaagtgcgtgacgatcccaagaagcctggacgggcgcctgcaggtttcacaccggaagggactgccgcatgttatttactgccgcgtgtggagatggccagacctgcaatcccatcacgagcttaaacccctcgacatttgtgagtttccatttggctcgaagcagaaggaagtttgcatcaatccataccactacaagagggtggagtcaccgtag

SEQ ID NO: 134552 - DNA, 6 bp, Artificial Sequence
  Description of Artificial Sequence: Synthetic coding sequence
atgtag

SEQ ID NO: 134553 - DNA, 1395 bp, Artificial Sequence
  Description of Artificial Sequence: Synthetic coding sequence
atgacctccatggccagtctgttcagctttacctccccagcagttaagcgactgctaggatggaaacagggggatgaggaagagaaatgggcagagaaagctgtggatgccctcgtgaaaaaactcaagaaaaagaaaggggctatggaggaactggagaaggccctttccagtcctgggcagcccagtaagtgcgtgacgatcccaaggtctctggacggcagactccaggtgtcacataggaagggcctcccacatgtaatctactgtcgtgtttggcggtggccagatctccagtctcaccacgagctgaagccactggacatttgtgagtttcctttcggatctaaacaaaaagaggtgtgtatcaatccataccactataaacgcgtggagagccctgtgcttcctcctgtgctcgttcccaggcataacgaattcaaccctcagcacagcctcctagtgcagtttaggaacctctctcacaacgagccccacatgcctcagaacgccacctttcccgactcttttcaccaacctaacaatacaccttttccgctgtcacctaatagtccgtacccgccctcaccagcaagctccacttatccaaattcccccgcctcaagtgggcctggtagcccgttccagctgcccgccgatacaccgcctccagcatacatgcctcccgatgaccagatgggccaggataactcacaacccatggacacaagtaataatatgattcctcaaattatgccctccatctcgagcagagatgtgcaacctgtggcttatgaggagcctaaacattggtgtagtatagtctattatgagcttaataaccgagtaggagaggcgttccatgctagcagtaccagcgtgctcgtggatggtttcactgacccatctaacaacaaatccagattctgtttaggtttactctctaatgtgaatcgcaactcgaccattgaaaatacacgcagacatatcggaaagggcgtgcatctgtactatgtcggtggcgaagtatacgccgagtgtctgtccgattcctcaatcttcgtccagagtcggaattgcaatttccaccatggctttcatcctaccaccgtgtgtaaaattccgtcttcatgttcgttgaaaatctttaacaatcaggaattcgctcaactgctggcccagagcgttaaccatggatttgaggcagtttatgaactgaccaaaatgtgtacaatacgtatgtcttttgtgaaggggtggggggcagagtaccaccggcaagatgttacttcaaccccgtgttggatcgagatcctgcacggccctctccagtggctagataaggtcctgacccagatgggaagccctttgaaccctatctcctcagtttcctag

SEQ ID NO: 134554 - DNA, 1395 bp, Artificial Sequence
  Description of Artificial Sequence: Synthetic coding sequence
atgactagcatggcctcgctcttctcattcacctcgccagctgttaaaaggttacttggctggaaacaaggcgacgaggaagagaagtgggctgagaaggccgtggatgcactggttaaaaaactcaaaaaaaaaaagggggcaatggaagaactggaaaaagctctctctagtcctggtcagccaagcaagtgtgtgaccattccccgttcactcgacgggcgattgcaagtgtcccacaggaaggggctgcctcatgtgatttactgccgcgtttggagatggcccgatctgcagagccaccatgaattgaaacccctggacatatgcgagtttccatttggaagtaaacagaaggaggtgtgtatcaacccttaccattataagcgcgtcgaaagtcctgtgcttcccccagtcctagtgccacgtcacaacgaatttaaccctcagcacagcctgctggtgcagttccgtaatttgtcccataatgagccgcacatgccccagaatgcaactttccccgactctttccaccagcccaataataccccttttccgctatctcccaattcaccatatcctccaagcccagcctcttctacatatcccaattctcccgcctcatctggcccagggtctcccttccagctgcccgccgacacacccccacccgcatacatgcctcccgacgaccagatgggacaagataactcccagcccatggacacatcgaacaacatgatcccgcaaattatgccctctatatccagtcgggacgttcagcccgtggcctacgaagagcccaagcattggtgctctattgtttattacgaattaaataatcgcgtcggtgaggcctttcatgcttcatccacatctgtgcttgtggacggctttacagacccctcaaacaataaatcccgtttctgtctcggcctactctccaatgtgaataggaattcaactattgaaaacacccggaggcacatcggcaaaggcgtgcacctttattacgtgggaggtgaggtgtacgcagaatgtcttagcgactcatccatcttcgtccaaagtcgaaactgtaatttccatcatgggttccatcccacaacagtctgtaagattccttcctcctgttcactcaagatatttaacaaccaggagtttgcccaacttctggcccagtcagtgaatcacggcttcgaggcggtctatgaattgacaaaaatgtgcacaattcggatgtcgttcgttaagggctggggggctgagtaccataggcaggacgtgacctctactccgtgctggattgagatactgcatgggccactccagtggctggataaagtgctgactcagatgggctctccactgaatccaatttcgagcgtgtcctag

SEQ ID NO: 134555 - DNA, 1491 bp, Artificial Sequence
  Description of Artificial Sequence: Synthetic coding sequence
atgttcagatctaagcgctccggcctggttaggcgcttatggcgttctcgcgtcgtacccgaccgcgaagagggagggtcgggcggcggcggtggaggggatgaggacggctccctgggtagccgcgcggaacccgctcctcgagccagggagggaggaggatgtggtcggtctgaagttaggcctgttgcgcccaggagacccagagatgctgtaggccaaaggggcgcccagggtgccggccgacgaagacgtgcggggggcccccctaggccgatgagtgaacctggtgctggagctggcagttccctattggatgtcgccgagcctgggggtcctggttggctaccagagagtgattgcgaaaccgtaacctgttgtctgtttagtgaacgcgatgccgccggagcgccgcgggatgcttcagatcctctcgccggcgccgccctcgagccagctggaggaggccgatcgcgggaagctagatcccggttgctgctccttgagcaggaactaaagaccgtcacctatagcctccttaaaagactcaaagaaaggtcccttgatactctgctcgaagcagtggaaagccgggggggtgtgcccgggggctgcgttctcgttccccgggcggatctgcgacttggcggccagcccgctccgccacaacttttactcggacgtctgttcaggtggcctgaccttcagcacgcagtggagctgaagcccctgtgtggatgccacagttttgctgctgcggctgatggtcccactgtatgttgcaatccttatcacttctcgcgcctctgtggacccgaaagtccccctcctccttattctagattgagtccacgggatgagtataaaccactggacctctcagactctacattgtcttatacagaaaccgaggctaccaactcactcatcactgcgcctggcgaatttagcgatgctagtatgtctccggatgccaccaaaccctctcactggtgctcggtcgcttattgggaacatcggacgcgcgtgggccgtttgtatgccgtttatgaccaggccgtgtctattttttatgacttgccgcaggggtccggcttctgtctcggtcaactcaacttggaacagcgctctgagtcagtcagaaggacccgaagtaagattggctttggcattctcctcagtaaagagcccgacggcgtgtgggcctacaatcggggggagcatccgattttcgtgaattctccaacactcgacgcacctgggggtcgcgccttggttgtgcgcaaggtacctcccgggtattcgattaaggtttttgactttgagcggtctggtctgcagcatgcccctgagccggacgctgccgatggcccttacgatccaaattcagtaaggatcagcttcgcaaaaggatggggaccatgttacagtagacagttcataacctcctgcccttgctggttggaaattctgcttaacaatcctcgctag

SEQ ID NO: 134556 - DNA, 708 bp, Artificial Sequence
  Description of Artificial Sequence: Synthetic coding sequence
atgagtagaatgggaaaaccaatcgaaacacagaaatctccaccccccccctactcacgattatccccccgggatgagtataagcctttggacttatccgattcaaccctcagttacaccgagactgaagccactaactctctcattaccgcacctggtgagtttagtgacgcttctatgtctcccgatgctactaagccgagccactggtgctctgtggcctactgggagcacagaacccgcgtggggagactctacgcggtgtacgaccaggccgtttccatattctacgatctccctcagggtagtggattttgcctgggacagctgaacctggagcagcgaagtgagagcgtacggagaactcgttccaaaatcggctttgggattctacttagcaaagaacccgacggggtctgggcttacaatcggggggaacaccctattttcgtgaacagccctaccctcgacgcacccgggggacgcgcacttgtcgtgcggaaggttcccccaggctatagtattaaggtgttcgatttcgaacggtctggcctccaacacgctcctgagccagatgccgcagatggtccttacgaccccaatagcgtgcgcattagtttcgctaagggctggggcccgtgttactccagacagtttataacaagttgcccttgctggttggaaatactgctgaacaacccacggtag

SEQ ID NO: 134557 - DNA, 1017 bp, Artificial Sequence
  Description of Artificial Sequence: Synthetic coding sequence
atgtttcggagcaagcgctccggactggtccgtcgcctgtggaggtctcgggtggtgcctgatcgggaggagggcggatccggaggcggcggcggaggtgatgaggacggcagccttggaagtagagctgagcctgctccccgagcgcgggagggcggggggtgtggaaggtcagaggttaggccggtggcccctcggaggcctcgagacgcggtcgggcagcgaggagcacagggagctggccgacggaggagggcaggaggacccccccgccctatgtctgaaccaggagctggcgctggttcctccctcctcgacgtcgctgagccaggaggtcctggatggctcccggaaagtgattgcgaaaccgtgacttgctgcctgtttagcgaacgcgatgccgcaggcgctccgagagatgccagtgatcccctcgctggtgccgcgctcgaacctgccggcggcggtaggtcccgagaagcgaggagtaggctgctgctgttggagcaggaactgaagacggtgacatactcactcttgaaaaggctcaaagagcggagtctggacactcttttggaggctgttgagagtcgcggaggcgttcccgggggctgtgtccttgtaccccgcgctgatctcaggcttggtggccaaccagctcctcctcagctcctcctgggcagactgttcagatggcccgacctacagcacgccgttgagctaaaacctctatgcggatgccactcgttcgctgcggccgccgacggaccaacagtgtgttgtaacccctatcatttttcccggctttgcggaccagagtctcccccccccccgtactctcggctttctccccgggatgagtataaaccactggatctttctgactctacactatcctataccgaaaccgaagctaccaatagcctgatcacggctccaggcgaattttctgcagccgacgccggcatcggcagcagaggtaatcgcggacttgagagtagtgtgccatgcagctag

SEQ ID NO: 134558 - DNA, 1293 bp, Artificial Sequence
  Description of Artificial Sequence: Synthetic coding sequence
atgcacagcacaacacctatctcttccctatttagctttacttcaccagcagtaaagcggctccttggctggaagcaaggcgacgaggaggagaagtgggccgaaaaagccgtggactctttggttaagaagctgaagaagaaaaaaggtgctatggacgaactggagcgcgcactgtcttgtcctggccagccgtccaaatgcgtcacaatccccagatctctggatgggcggctgcaggtgtctcacaggaagggcctgccacatgtcatttattgtcgagtctggcggtggccggatctccaatcacaccatgagctgaaacccctcgaatgttgcgaatttcccttcgggtctaaacaaaaggaggtgtgcattaatccataccattatagacgcgtcgaaacacccgtcctgccaccagtattggtaccccgacattcagaatataatcctcagctgtctttgctggccaaattccgatctgccagcctgcacagcgagcctctgatgccacacaatgccacgtaccctgactcctttcaacagcctccatgtagcgcattaccaccttccccctctcacgccttttctcagtctccttgcaccgcatcctatccacactcacccggaagtccgagcgagcccgaatctccctatcagcatagcgactttcgcccagtttgttatgaggagcctcagcactggtgtagtgtggcctactatgagctgaacaaccgagtgggcgagacattccaggctagcagccggtccgtgctcattgacgggttcacggatccaagcaacaaccgcaatcggttctgcttgggacttctgtccaatgtgaaccggaattcaacaattgagaatacacgacgacacataggaaagggggtgcacctatactacgtgggcggagaagtttacgccgaatgcgtctcagatagctccattttcgttcagtctcgtaactgcaattatcaacatggattccaccctgccaccgtctgcaaaatccctagtggatgctcccttaaggtctttaacaatcagctttttgcccagcttcttgcacagagcgttcaccacggttttgaagtggtgtatgagctgactaaaatgtgcactattcgaatgtccttcgttaaaggctggggtgctgagtaccatagacaggatgtgacctccactccatgctggatcgagattcatctccatggccctctgcagtggcttgataaggtattaacccagatggggtcaccacataatcccatcagttccgtgtcttag

SEQ ID NO: 134559 - DNA, 1404 bp, Artificial Sequence
  Description of Artificial Sequence: Synthetic coding sequence
atgcattctacaacccccattagctcactgttttccttcaccagtccggcagttaagcgcctactaggttggaagcagggcgacgaagaggaaaagtgggctgaaaaagctgtagactccctggtcaagaagttgaagaagaagaagggggctatggacgagctagaacgagcccttagctgccccggccagcccagcaaatgcgtgacgatccctagaagccttgacggcagacttcaggtgagccatcgcaagggcctaccacacgtgatctattgccgcgtgtggaggtggccagatctccaaagtcaccacgagctcaagcccttagaatgctgcgagttcccgtttggctcaaagcaaaaggaagtttgcattaacccatatcattaccggcgggttgagactccagtgctgcctccagttttggtcccacgtcacagtgaatataatccccaactgagcctgctcgccaaattccgctcagcttcgctccatagcgagccccttatgccccacaacgctacgtaccctgatagcttccagcaacctccctgttcggctctgcccccgtctccatcccacgccttcagccagtcaccctgcactgccagctaccctcattctcccggcagcccttctgagcctgagagtccttaccagcactccgtggacacaccacccttgccctaccatgccaccgaggcatctgagacccagtccgggcagccagttgatgccacggcagatcgccatgtagtcctgtccatacccaacggagatttccggccggtttgctacgaggagcctcagcattggtgcagtgttgcatactatgagttaaacaatcgggtgggcgaaaccttccaggccagcagccggtcggtactaattgacggctttaccgaccccagtaacaataggaacaggttttgcctggggctcctgtccaacgtgaatcggaatagtaccatcgaaaacacccgccggcatattggtaagggagtgcacctgtactacgttgggggcgaagtctacgccgagtgtgtgtccgacagtagcatattcgtgcagagcaggaactgtaactatcagcatggctttcaccctgccacggtgtgcaaaattccctctgggtgttctcttaaagtctttaacaatcaactgttcgcccagctcctcgcgcagtctgttcatcatggcttcgaagtggtgtacgagctgactaaaatgtgcactattcgtatgtcatttgtgaaaggttggggggcggaatatcacaggcaggatgtcacgtctactccctgctggattgagattcatttgcacggacccctgcaatggttggacaaggtgctgactcagatgggtagtccacataaccctatctcctccgtctcttag

SEQ ID NO: 134560 - DNA, 1404 bp, Artificial Sequence
  Description of Artificial Sequence: Synthetic coding sequence
atgcactctaccacgcccatttccagtcttttctcgttcaccagtccagccgtgaagcggctattaggctggaaacagggagacgaagaagagaaatgggctgaaaaagccgtggattcacttgtgaaaaaactgaagaagaagaaaggggccatggacgaacttgagcgcgccctaagctgcccgggacagcccagcaagtgcgtaaccattccgcgttcgctggatggcaggctgcaggttagtcaccgcaagggcttaccccacgtgatttactgtcgagtttggcgttggccggacctgcagtctcatcatgaattgaaacctctggaatgctgcgagtttcccttcggctcaaaacaaaaagaggtctgtattaacccttatcactaccggcgggtagagacgccagtcctgcctcccgtgctggtcccgcgacactctgaatacaatccccagctgagcctcctggccaaattccggagcgcctcactacatagcgagccactgatgcctcacaatgcaacttaccctgactcatttcagcagcccccctgctccgcattgcccccaagcccttcccacgcattcagccagagcccatgcacagcttcatacccccattctcccgggtctccttccgagcccgaaagtccctatcagcactctgtggacacccctcccctcccgtatcacgccaccgaggcctccgaaactcagagcggacagccagttgacgcaacagccgatagacatgtggtgttgagtattcctaatggtgactttcggcctgtctgctacgaagaaccccaacattggtgttcagttgcctactatgaactcaacaatcgcgtgggagagactttccaggcgtcatcccgttcggtgctgatcgacggcttcaccgatccatccaacaatcgtaataggttttgcctgggattattgtccaatgtgaacagaaacagtactattgagaacacgcgccgccatatcggaaagggtgtgcatctttactatgtgggtggagaggtgtacgccgaatgtgtgtccgactcgtcaatcttcgtccagtccagaaattgtaattaccaacatggattccaccccgcaacagtatgcaaaatcccctcaggctgctccctgaaagtgtttaacaaccagctgttcgcccagctgctggctcagtcagtgcaccatggtttcgaggtcgtgtacgagctaaccaaaatgtgtactataagaatgtcgttcgttaaaggatggggcgccgagtatcaccgccaggatgtgactagtacaccatgctggatcgagatccacctacacggcccacttcaatggctcgacaaagtgctaactcagatggggtccccccacaatcctatctccagcgttagttag

SEQ ID NO: 134561 - DNA, 1191 bp, Artificial Sequence
  Description of Artificial Sequence: Synthetic coding sequence
atgaaagctgtcaagtcggagcgggaacgcggatctcggcggcgacaccgggacggagatgtcgtgctccctgccggcgtggtcgtcaagcaagagcgtttatctccagaagtcgcacccccagctcataggaggcccgaccactctggtggatctccttcgcccccaacttcagaacccgccagaagtggccacaggggaaatagagcacgcggagtctcccggtcaccccctaaaaagaaaaataaggcatctgggcgcaggtccaagtccccccggtcaaagaggaatagatctccccaccactcaaccgtgaaggtgaagcaggaacgggaagaccacccacgccgcggccgggaggatagacagcaccgcgagccttcggagcaggaacacaggagggccagaaatagtgacagggaccgacaccgcgggcacagccaccagaggagaacatcgaacgaacggcccgggtcagggcaaggccagggaagagatagggatacacagaatttgcaggctcaagaggaagagcgtgagttctacaatgcgcggaggcgagagcatcgacagaggaacgacgtggggggagggggctccgagagccaagaattagtaccgagacccggcggcaataataaagagaaggaagtgccggccaaggaaaaaccaagtttcgaactgagcggcgctcttctcgaagataccaacactttcagaggcgtggttatcaagtactcagagccccctgaggctcgaattcccaaaaaacgctggaggctgtaccccttcaagaatgatgaggtgctgcccgtgatgtacatccacagacagagtgcatatttgctcggtaggcacagacgcatcgcagatattcctatcgaccacccttcctgtagcaagcaacacgctgtctttcagtataggcttgtggaatatacgcgcgcggacggcacagtgggccgacgcgttaagccttatattattgatctgggaagcggtaatggcacttttctgaataataagagaatagaaccacagagatattacgaactgaaggagaaggacgtgctcaaattcggtttctcctctagggagtatgttctgctgcacgaaagtagcgacacaagcgaaatagataggaaagacgacgaggacgaggaagaggaagaggaagtgtcagatagttag

SEQ ID NO: 134562 - DNA, 1143 bp, Artificial Sequence
  Description of Artificial Sequence: Synthetic coding sequence
atgaaagccgtaaagagcgagcgagaaggcgtagtggtcaagcaggaaagactctcacccgaggtggctccacccgcacatagaaggccggaccatagcgggggaagtcctagcccaccaacatcagaaccagccagatctggacatcggggtaacagggcaaggggggtttcacggtctccaccaaagaaaaagaataaggcctctggccgacggagtaagagtcccagaagtaaacggaatcgctccccccaccactccactgtgaaggtgaaacaggagcgcgaagaccacccacgccgcgggcgggaggaccgacagcatagggaaccctcagagcaagagcatcgaagagcgaggaactctgaccgagaccggcaccggggccacagccaccaaagaagaacatccaatgaaaggcctggtagcggccagggacagggccgtgaccgcgacacacagaacctacaggctcaggaggaggagcgagagttttacaacgcccggcgccgtgaacaccgacagcgcaacgacgtgggaggagggggatctgagagtcaggaactggttcctagacccggggggaataataaagaaaaagaggtgcctgctaaagagaagcccagttttgaactgagcggagcacttttggaagatacaaacaccttcaggggggtcgtaattaagtattccgagccccctgaagccaggatcccaaagaagaggtggagactttacccttttaagaacgatgaggtcctgcctgtcatgtacatccataggcaatctgcctaccttctgggcaggcatcgcaggatcgccgatatcccgattgaccatcccagttgcagtaagcagcatgcagtgtttcagtataggctcgtagaatacaccagagctgacgggaccgtagggcgacgcgtcaagccatatattattgatctgggatccggcaacgggacgtttctgaacaataagcggattgagccacaaagatactacgagttgaaagagaaggacgtgcttaaatttggcttctccagtagagaatatgtgctcctgcatgaaagcagtgacactagtgagattgacaggaaggacgacgaggacgaagaggaagaggaagaggtgtccgacagctag

SEQ ID NO: 134563 - DNA, 2274 bp, Artificial Sequence
  Description of Artificial Sequence: Synthetic coding sequence
atgtctaatccaggaacaaggaggaatggttcttccattaaaattaggctgaccgttctttgcgctaagaacctggcaaaaaaagatttctttcggctcccagatccgttcgccaagattgtggtcgacggatctggacagtgccattccacggatacagtcaagaacacattggaccctaaatggaaccagcactacgacctctacgtgggcaagacagacagcattaccatcagcgtttggaatcacaaaaagattcataaaaaacagggagcaggcttcctggggtgtgtgcgtctgttgtccaacgctatctctcgacttaaagatactggctaccagcgattggatttatgcaagctcaatccatctgacactgacgctgtccgagggcaaatcgttgtgagtctacagactagagatcgcattggcaccggaggtagtgtagtcgactgtcgagggctcttggaaaatgaaggcaccgtgtacgaggacagtgggcccggaagacccctgtcttgctttatggaagaaccggcgccatataccgatagcaccggcgccgcagccggcggagggaattgccggtttgttgagagccccagccaggaccagcgcttacaggctcaacgacttaggaatccagatgtaagggggagtttgcagacaccgcaaaacagaccacacgggcatcagtcccctgagttacccgaaggctacgagcagcggactacggtgcagggccaggtgtactttcttcacacgcaaacgggtgtatctacatggcacgatccgcgcatcccttctcctagcgggacaatccctggtggcgatgccgcttttctttacgagttccttctgcaggggcacacttcagaaccaagagacctgaatagtgtgaattgtgacgagttaggccctttgccacccgggtgggaggtccgcagtaccgtgtctggcaggatctatttcgttgatcataacaatcgaaccactcaattcaccgacccaagactgcaccatattatgaatcaccaatgccagcttaaagagccctcccagcctctgcctcttccatccgaaggaagccttgaggatgaggagttacccgcacagagatacgagagagatctcgtgcagaagctgaaggtgctgagacacgaattgtccttacagcagcctcaggcaggacactgccggatcgaggtttcaagggaggaaatattcgaagagtcatatagacagattatgaagatgaggccaaaggacctgaagaagagactgatggtgaaattccggggagaggaaggtctggactatggaggagttgcaagggagtggctgtatctgctttgtcacgaaatgctcaatccctattacggactgttccagtatagcactgacaatatttatatgctgcaaattaatcccgacagcagcataaatcccgatcacctgtcttacttccactttgtcggtcgaatcatgggattagccgtttttcatggtcattatattaacggaggatttactgtgccattttacaagcagctgcttggtaagcctatacaactatcggacctcgaaagcgttgacccggagttgcacaagtcgctagtgtggatcctggaaaacgacattacccctgtattggatcatacattttgtgtcgagcataacgcgtttggacgcatactccaacatgaactgaagccaaacggaagaaatgtgccagtcacggaggaaaataaaaaggagtacgtgcgcctctacgtgaactggagattcatgaggggcattgaagcccagtttctggctctccaaaaaggtttcaatgagctcattccccagcatctgttaaagccttttgatcagaaggaactggagctgatcatcggcggcctggacaaaatcgacctgaacgattggaagtctaacacgaggttgaagcactgtgtggctgatagcaacatcgtgagatggttttggcaggccgtggagacctttgatgaggagagacgcgcccgcctcctgcaattcgtcaccggaagcacgagggttcccctgcagggttttaaggctttacagggctccactggggcagcaggcccacggttattcacaatacacctgattgacgccaatacggacaacttgcccaaggcccatacttgtttcaatagaatcgatattcctccatatgagtcctatgaaaaactgtatgagaagctgttgacagctgtggaagaaacttgcggattcgcagtggaatag

SEQ ID NO: 134564 - DNA, 2196 bp, Artificial Sequence
  Description of Artificial Sequence: Synthetic coding sequence
atgtccaaccccggcacgcgccgaaacgggagctcgattaaaattagactgaccgtgctgtgtgccaaaaatctggccaagaaggactttttcaggctgcctgatcctttcgccaagattgtcgtggacggttccggacagtgccacagtactgacactgtgaaaaataccctcgatccaaaatggaaccaacattacgacctctatgtaggcaagacagactcgataaccatttcagtctggaatcataagaagattcacaagaagcagggggcaggcttcctcggttgtgtcagactgcttagcaacgccatcagtcggctcaaagacacaggatatcagcgcctggatctttgtaaactcaatccttcagatacagacgccgtgcgcgggcagatcgtggtgagtctccaaacacgcgacaggattggcacaggggggtcagtcgtggattgtcgtgggctgctggagaacgagggaactgtatatgaagactcaggcccaggacgtcccttgtcctgctttatggaggagccggctccctatacagacagtaccggcgcagctgcaggcggaggcaattgccgctttgtggaatccccttcccaggaccagcggctgcaggctcagagactgaggaatcctgacgtgagaggatctttgcaaacaccacagaatcgccctcatggacatcaaagcccggagctgccagaaggctacgagcaacggacgaccgttcaggggcaagtatacttccttcatacacaaacaggcgtctcaacttggcatgacccacggatacctagagatctaaactcagtaaactgcgacgagctcggacccctgccgccagggtgggaggtccggtctaccgtctctggaagaatctacttcgtggaccataacaacaggacaacacaatttacggaccctagactgcatcacatcatgaaccatcagtgtcaactcaaagagcctagccagccgctgccactgccttccgaaggctccttagaggacgaagaactgcctgcccagcggtacgaaagagatctggtccagaagctcaaagtacttagacacgagctgtcactccagcagcctcaggctggtcactgcagaattgaggtatcccgggaagaaatcttcgaagaatcgtatcgtcaaattatgaagatgagacctaaagacctgaagaagcggcttatggtgaaattccggggcgaagaaggtctggactacggcggagttgcccgcgaatggctctacctgctctgccacgagatgctcaacccttactacggtctctttcagtatagcaccgataacatctacatgctgcaaatcaaccctgactccagcatcaatcctgaccatctgtcgtacttccacttcgtggggagaattatgggactggctgttttccatggacactacataaacggcggtttcactgttcccttctataagcagttgctgggaaagcccatacagctcagcgacttggaaagcgtggatcccgaactccataagagcctagtgtggatacttgagaatgatataacgccagtgctcgatcataccttttgcgtggagcacaacgcattcggacggatcctgcagcatgaactgaagcctaacggacgaaatgtgcccgtgacggaagagaacaaaaaggagtacgtccgcctgtacgttaactggcggttcatgaggggcattgaagctcagttcctggcactacagaagggtttcaatgagctgatacctcaacacctgctgaaacccttcgaccaaaaagagctagaacttatcatagggggcctggacaaaatcgatttaaatgactggaaaagcaacactcggctgaagcactgcgtggcagattctaatattgtcagatggttttggcaggcagtggagacttttgatgaggagagaagggctcgcttactgcagtttgtcacaggctctactcgtgttccgctccagggatttaaggccctccagggctccacgggcgccgccggacctcgcctctttaccatccacttgatcgatgcgaacaccgacaacttgcccaaagcacacacatgcttcaaccggatagacatccctccttacgagtcatacgaaaagttgtatgaaaaactccttacagcagtggaagaaacatgtgggttcgcagtagaatag

SEQ ID NO: 134565 - DNA, 1323 bp, Artificial Sequence
  Description of Artificial Sequence: Synthetic coding sequence
atggccacaaggagctgccgagaaaaggcacaaaagcttaatgagcagcatcagctgattctgtccaagctactcagagaagaggataacaagtactgtgccgactgcgaggcgaaggggccgagatgggctagttggaacatcggcgtatttatatgtattagatgcgcaggaatacaccgcaatctgggcgtgcatatcagccgggtgaaaagtgttaatttagatcagtggacagccgagcaaatccagtgtatgcaggatatgggcaataccaaagctcgcctcctctatgaagccaatctcccagagaacttcaggcggccccagaccgatcaagccgtggagttctttattcgggacaaatacgaaaaaaagaaatattacgataagaatgccatagccattacaaataaagagaaggaaaagaagaaagaggagaagaaacgagagaaggaacccgagaagcccgccaagcctcttacagccgagaagttgcagaaaaaggaccagcaattggaaccaaagaaatctacctcacccaagaaagcggcagaaccaaccgtggacttgttaggtctggacggacccgccgttgcccccgtgacaaatgggaatactacagtccccccgctgaacgatgatctcgatatttttgggcctatgatctccaatcccctgcccgccacagtgatgccacccgcacaaggaacacccagtgccccagcagccgctacactttctactgtaacctccggtgacttagatctattcactgaacaaaccactaaatccgaagaagttgcaaaaaagcagctatccaaagacagcatccttagcctgtacggaactggaacaatccagcaacaaagcacccctggtgtgtttatgggccccaccaacattccatttacgtctcaggcgcctgccgctttccagggatttccgtccatgggcgtgcctgtcccagctgctcccgggctgatcggtaatgttatgggccagagcccttccatgatggttgggatgccgatgccaaacggtttcatgggaaatgcccagacaggggtgatgcccttgcctcagaacgtggttggaccacaaggaggcatggtgggtcagatgggcgctccacaaagcaaatttgggctcccccaagctcaacagccccagtggagccttagccagatgaaccaacagatggccggtatgtccatcagctcagctacgcccaccgcaggattcggccagccctcgtcaacaaccgcggggtggtccggctcgagcagcggccagacactaagcactcagctctggaaatag

SEQ ID NO: 134566 - DNA, 489 bp, Artificial Sequence
  Description of Artificial Sequence: Synthetic coding sequence
atgggcaataccaaagctaggctgctctatgaggctaacctccctgagaattttaggcggcctcagactgatcaggccgtggagttttttatccgcgataaatacgagaagaagaaatactacgataaaaatgccatagccatcactaacatttcaagtagcgatgcccctttgcagcccctggtgtccagtcctagtctgcaggctgccgttgacaagaacaagttggagaaggaaaaagaaaagaaaaaggaggagaaaaaaagagagaaggaacccgagaaacccgccaagccccttacagcggaaaaactgcagaagaaagaccaacagctggagccaaagaaatctacctcccccaagaaggcggcagagccaactgtcgacctcctgggactcgtctggcgtaaaattgaaaaagagaagagcgaaagacagttggttgaagtggaggagctcaccttcatgtactgctttcccaagaattag

SEQ ID NO: 134567 - DNA, 1311 bp, Artificial Sequence
  Description of Artificial Sequence: Synthetic coding sequence
atggcaacaaggagctgtagggagaaggctcagaaacttaatgaacagcaccagctgatcctgtctaagctccttagagaggaagataataagtattgcgctgactgcgaggccaagggtcctcgatgggcatcttggaacattggggtattcatatgcatacgatgtgcaggcattcatcgaaatttgggagtccatatttcgcgagttaaatccgtaaatctcgaccagtggactgccgagcagattcagtgcatgcaggatatgggtaacactaaggctcgattgctttatgaggccaaccttccagaaaatttccgaaggcctcaaaccgaccaggccgtagagttctttatcagggacaagtatgaaaagaaaaaatactacgataaaaacgcaatagctatcaccaacaaggaaaaagaaaaaaagaaagaggagaagaagcgcgagaaagaacctgaaaagcccgccaagcccctgacagccgaaaaactccaaaagaaggaccagcagctcgagcccaaaaagtcaacttcccccaaaaaggctgcagaaccaaccgttgacctcctaggtttggatggccccgccgttgcccctgtcaccaacggcaacacaacggtcccacctctgaacgacgatctcgatatattcgggcctatgatctctaaccctctgcccgcaacggttatgccccctgctcaagggacacctagtgccccggcagcagccacgttgtcaactgtcacctccggagatctcgacttattcactgagcagactactaaatccgaggaggtggccaagaaacaactgtccaaggatagcatactctcactctacgggactggaacaatccagcagcagtccactcccggcgtcttcatgggtccaaccaacatcccattcacgtcccaagccccagcagcttttcagggatttccttctatgggggttccagtgccggccgcccccggcctcataggtaacgttatgggtcagtcccccagcatgatggtcggaatgccgatgccgaatgggttcatgggtaatgcccagaccggagtgatgccgttaccacagaacgtggtcgggccccagggcgggatggtgggccagatgggggcacctcagtccaagtttggccttccccaggcccagcagccacagtggagcctctcacagatcatgcagaaaggcgacgctgttctgcagcactcaatctctgccatttattggcctatgactagatggctgaaatgtccactggtcgacgaatcggccgatggttggcacgaatatcaatag

SEQ ID NO: 134568 - DNA, 1404 bp, Artificial Sequence
  Description of Artificial Sequence: Synthetic coding sequence
atggccactaggagctgccgcgagaaggcccagaagttgaacgagcagcatcagttaattctaagtaagctgctgagggaggaggataacaaatactgtgcagactgcgaggctaaaggccctagatgggcctcatggaatattggcgtgtttatctgcatccgctgcgccggaatccatcgtaacctgggcgtgcacatctcaagggtgaagtccgtgaacctcgaccagtggactgcagaacagatccagtgcatgcaagatatgggcaacacaaaggccaggcttttatacgaagctaacttgcctgagaactttagacggcctcagaccgaccaggccgtggaattctttattagagacaaatacgagaagaaaaagtattacgacaaaaacgcgatcgcgatcactaatatctcctccagcgatgcccccttgcagccactggtgtcctctcctagcctgcaggccgcagtggacaaaaacaagctcgaaaaagaaaaagaaaagaagaaggaggaaaagaagcgagagaaggagccagaaaaaccggccaaaccactcaccgccgaaaaactgcagaaaaaggaccagcagctcgagcctaagaagtccacctccccgaagaaggctgccgagccaactgtcgaccttttagggctcgatggcccagcagtcgcccccgtgacgaatggaaatacaaccgtgccccctctgaacgatgaccttgatatctttgggcccatgatcagtaacccgctgcctgctaccgtcatgccgcccgcccaagggacaccttcggcccctgccgccgctactctgtcaacggtgacatctggagatctcgaccttttcactgagcagactacgaagtctgaggaggtagccaaaaaacagctcagcaaagactccattctaagtttgtacggcactggcacgattcagcagcagagtacacctggcgtgttcatgggccccacgaacatcccgtttacgagccaggcaccagccgcatttcagggttttccatctatgggggtgcccgtacccgcggcccccggacttattggtaacgttatgggccaaagcccttctatgatggttggtatgcccatgcctaatggatttatgggcaacgctcagactggcgttatgcccctcccacagaacgtggtggggccccagggggggatggtggggcagatgggggccccacagtccaaattcgggctgccacaggctcagcagcctcagtggagcttgagccagatgaaccagcagatggcaggaatgagcatcagctctgcaacccccacagccggtttcgggcagccaagcagtacaactgccggatggagcggatcctcaagtggtcaaactctgagcacccagctgtggaaatag

SEQ ID NO: 134569 - DNA, 414 bp, Artificial Sequence
  Description of Artificial Sequence: Synthetic coding sequence
atggctacccgctcatgcagagagaaagcgcagaaactgaatgaacaacaccaactcattctgtctaaattgttacgtgaggaggacaataaatactgcgcagattgtgaggctaaaggaccaagatgggcgtcctggaacattggggtatttatttgcataaggtgcgctggcatccatcggaatctgggcgtgcacatctctagggttaaatctgtcaacctcgatcagtggacagcagagcaaattcaatgcatgcaggacatgggcaatactaaggccagactgctctatgaagctaatctgcccgagaactttcggagaccacaaaccgaccacgaggacatcattctagaaaccaccgcagtcattaccctactcttaaataaatgtctaccctatgccaaaccctag

SEQ ID NO: 134570 - DNA, 378 bp, Artificial Sequence
  Description of Artificial Sequence: Synthetic coding sequence
tgaaagtactacgataaaaacgccatcgcaatcacaaatatcagcagctcggacgctccactccagccattggttagctcccccagcctgcaggccgccgtagacaaaaacaagctcgagaaagagaaagaaaagaaaaaagaagagaaaaagcgagagaaggagcctgagaaacccgcgaaaccgttgacggctgagaaacttcagaaaaaggatcagcagctggagcctaaaaagtctacctcaccaaagaaggcagccgaacctacggttgaccttcttggactggtgtggaggaaaatcgaaaaagaaaagagcgagaggcagctggtggaggtggaggaactgactttcatgtattgcttccccaaaaactag

SEQ ID NO: 134571 - DNA, 189 bp, Artificial Sequence
  Description of Artificial Sequence: Synthetic coding sequence
atgcttttcctcaaactgagtgtgttccgcgccgtcgaattctttattagggataaatacgaaaagaagaaatactatgataagaacgcaatcgctattaccaacatctcgtcctccgacgctccactgcagcctctggtgagtagtccatctcttcaggctgcagttgacaagaacaaacttgagtag

SEQ ID NO: 134572 - DNA, 1200 bp, Artificial Sequence
  Description of Artificial Sequence: Synthetic coding sequence
atgatctttaagggaccccgctgggcctcctggaacatcggcgtcttcatatgtatcaggtgcgcaggtatccatcgaaacctgggcgtgcatatttcccgcgttaaaagcgtgaacttggatcagtggacccaagagcaaatccaatgcatgcaggaaatgggcaacgggaaggccaatcggttgtatgaagcatacctcccagagactttccgcagaccgcaaatcgaccctgctgttgaggggttcattcgcgataaatatgaaaaaaaaaaatacatggataggtctctcgacatcaatgcctttcgcaaggagaaggacgacaaatggaaacgcggctccgaacccgtgcctgagaaaaaactggagcccgttgtattcgagaaagtcaagatgcctcagaaaaaggaagatccacaactcccaaggaagagttcacctaaaagcaccgcccccgtcatggatcttctgggtctcgacgccccggtggcttgttctatcgccaactctaagacttcaaataccttggaaaaggacctggacctgcttgccagtgtgccaagtcccagttcatccggctcgcgaaaagtggtcggcagcatgccaacagcgggatcggcaggttcagtaccggaaaacctcaatttgttccctgagcctggctccaaatctgaggagatcgggaagaaacagctgagcaaagattctatcctgagcctgtacggatcacagaccccccagatgcccacccaggccatgttcatggcgcctgcccagatggcctacccgacagcatacccaagcttccctggtgtgaccccccccaattccatcatgggctctatgatgcctccccctgtgggcatggtcgcccagcctggggccagcgggatggttgctcccatggccatgcccgctggatacatgggagggatgcaggccagcatgatgggcgtgcctaacggtatgatgaccacacagcaggcaggatatatggcgggtatggctgctatgccccagactgtctacggggtgcaaccagcccagcagctgcagtggaacctgactcaaatgactcaacagatggcaggaatgaacttctacggcgcaaatggaatgatgaattacggacagtccatgtcaggtgggaatggtcaggccgccaaccaaactctgtcaccacaaatgtggaagtag

SEQ ID NO: 134573 - DNA, 1290 bp, Artificial Sequence
  Description of Artificial Sequence: Synthetic coding sequence
atgaccggaaagtcagtaaaggacgtcgatcggtaccaagcagttctggctaacctcctccttgaagaggataacaagttctgcgcagattgccaatccaagggacccaggtgggcatcatggaatatcggggtctttatttgtatccggtgcgccggcatacatagaaacttgggcgtgcacatttccagagttaaaagcgttaatctcgaccagtggactcaggaacagatccaatgcatgcaggagatgggcaacggtaaggcaaaccgcctctatgaggcatatttgccggagaccttcagacggccccagattgacccagcagttgagggctttatccgtgataagtacgagaaaaagaaatacatggatcgaagcttggatatcaacgctttcaggaaagaaaaggacgacaagtggaaacgcgggtctgagccagtccctgaaaaaaaactcgaacccgtcgttttcgagaaggttaaaatgccacagaagaaggaggacccccagttacctaggaagtctagcccgaagtccacagcaccagtgatggacctcctcggccttgacgcccccgtcgcttgcagcattgcaaattcaaagaccagtaatacactcgaaaaggatctcgacttactcgcaagcgtccccagtccttccagctccggttctcgcaaggtcgtcggtagcatgcccacggcgggaagcgctggctcagtgcccgagaatctgaacctgttccctgagccaggctccaaatcggaggagattggtaagaaacagctgagcaaggattccatcctctctttgtatggtagccagactccccaaatgccaacccaggcaatgttcatggctcccgcacagatggcatacccaaccgcttacccttcgttccctggtgtcacacctcccaactccatcatgggcagcatgatgccaccgccagttggaatggtggcacaaccgggggcctcaggtatggtcgcccccatggcaatgccagccggatatatgggggggatgcaagcaagcatgatgggtgtgcctaatggcatgatgactacgcagcaggctgggtacatggccggaatggccgctatgccacagactgtgtacggcgttcagcccgcgcaacagctacaatggaatctgacccagatgacacagcagatggcggggatgaatttctacggggcaaatggtatgatgaactatggccagtccatgtccggcggtaacggtcaagcagcaaaccagacactgagtccacaaatgtggaaatag

SEQ ID NO: 134574 - DNA, 684 bp, Artificial Sequence
  Description of Artificial Sequence: Synthetic coding sequence
atgactggcaaatcggtcaaggatgtcgacaggtatcaggccgtgctggccaaccttctgctggaggaagataataaattctgcgctgattgtcagtcgaaaggcccaaggtgggcatcctggaacataggcgtgttcatctgcattcgttgtgccggaatccacaggaacctgggagtccacatttctagggtgaagtccgttaacttggaccagtggacacaggaacagatacagtgtatgcaagagatgggtaacggcaaagcaaaccggctgtacgaagcctatcttccagaaacattcaggaggcctcagattgaccccgctgtcgagggatttatccgcgacaaatacgagaaaaaaaagtatatggaccggtccctcgatattaacgcttttcgcaaggagaaagacgacaaatggaagcgaggctccgaacctgtgcctgagaagaagctggagcccgtggtcttcgaaaaagtaaagatgccacagaaaaaagaggatcctcagcttcccagaaagagttcccctaagtccacagcaccagtaatggacctccttggattagacgcccctgtggcctgctccatcgcaaacagtaaaacttccaacactttggagaaagatttggatttgctggcatctgtcccttccccatcaagcagcggttctcgaaagtag

SEQ ID NO: 134575 - DNA, 1050 bp, Artificial Sequence
  Description of Artificial Sequence: Synthetic coding sequence
atgcaggaaatgggaaatggtaaagccaaccggctttacgaggcctatttgcccgagaccttccgaagaccacagattgaccctgccgtggaaggcttcattagggataaatacgagaagaaaaaatatatggacaggagcctggacatcaacgctttcagaaaggagaaggacgataaatggaagaggggctcagaaccagtcccagagaaaaaactagagcccgtggtcttcgaaaaagtgaaaatgccccagaagaaagaagacccccagctgccacgcaagtccagtccgaaaagcacagcacctgtaatggacctgctgggcctcgatgctccagtcgcatgtagcatcgccaattccaagacttctaacaccctggagaaagacctggacctcctggctagcgtgccaagtccatcttcctccggaagccgaaaagtggtgggcagcatgccgactgcaggctctgcaggatctgtgcccgaaaaccttaatctgttcccggaacccggaagcaaatccgaggaaattggcaagaagcaactctctaaggactccattctcagtctctacggaagccagacccctcaaatgccgacgcaagccatgttcatggctccggctcaaatggcttacccaaccgcctatccctcatttccaggtgtaactccacctaactcaataatgggctcaatgatgccaccgcccgtgggaatggtcgctcagccaggagcctctgggatggtcgctcccatggcgatgcctgcaggatacatgggtggcatgcaggccagcatgatgggagtcccaaatgggatgatgaccacacagcaggcaggctatatggctgggatggccgccatgcctcagacggtgtacggcgttcagccggcccagcagctccaatggaacctcacccagatgacccaacagatggcgggaatgaatttctacggggcaaatggtatgatgaactatgggcagtccatgtccggtggcaatggacaggccgctaatcaaaccctgtctcctcagatgtggaagtag

SEQ ID NO: 134576 - DNA, 189 bp, Artificial Sequence
  Description of Artificial Sequence: Synthetic coding sequence
atggccagaggaaatcagagggaacttgcgaggcaaaagaatatgaagaaaacgcaggaaataagtaaagggaagcggaaagaagactccctgacagcctcccagcgcaaacagcgggacagcgaaattatgcaggagaaacagaaagctgccaacgaaaagaagagcatgcagactcgcgagaagtag

SEQ ID NO: 134577 - DNA, 333 bp, Artificial Sequence
  Description of Artificial Sequence: Synthetic coding sequence
atggcgcgtggcaatcagagggaacttgccagacagaaaaacatgaagaagactcaagagatttcaaagggcaaacgcaaggaggactctctcacagcctcccagagaaagcagagctccgggggtcaaaaatccgagagcaagatgtccgcgggccctcatctgccattaaaggccccaagagagaacccttgctttccgctcccagctgcgggaggaagcagatactatctggcgtatggatctattacccccatatcagctttcgtctttgtcgtcttctttagcgtcttttttccaagcttttacgaagatttttgctgctggatctag

SEQ ID NO: 134578 - DNA, 147 bp, Artificial Sequence
  Description of Artificial Sequence: Synthetic coding sequence
atgaaaaaaacgcaggaaatctcaaagggaaagagaaaagaagattccctgaccgccagccaacggaagcaacgtgacagtgagatcatgcaggagaagcagaaagccgccaatgaaaagaaatctatgcagacccgcgagaaatag

SEQ ID NO: 134579 - DNA, 63 bp, Artificial Sequence
  Description of Artificial Sequence: Synthetic coding sequence
atgaagaagacacaggagatttcaaagggtaagcggaaagaagacagcctgactgccagctag

SEQ ID NO: 134580 - DNA, 291 bp, Artificial Sequence
  Description of Artificial Sequence: Synthetic coding sequence
atgaaaaagactcaggagatatctaagggtaaacgcaaggaggactccttaaccgcgtcccaacgaaagcagagctctggtgggcagaaatcggagtccaagatgagtgcaggaccacacttgccactgaaagcaccacgcgaaaacccctgctttccgctgcccgctgcgggaggtagcagatactatcttgcctatggctcaattacaccgatctccgccttcgtcttcgttgtcttcttttctgtgttctttcccagcttctacgaggacttctgttgctggatctag

SEQ ID NO: 134581 - DNA, 270 bp, Artificial Sequence
  Description of Artificial Sequence: Synthetic coding sequence
atgaagaaaactcaggagatctctaaaggcaaacggaaggaggacagcctgactgcttctcagcggaaacagtcctccgggggacagaagtctgaatcaaagatgagtgcggggccacacttacctctcaaggctcccagggaaaacccctgctttccactcccagctgcaggcgggagtcgatactatttggcctatgggtccataactcccatcagtgcctttgtctttgttgtctttttctccgttttctttccctcattttattag

SEQ ID NO: 134582 - DNA, 3156 bp, Artificial Sequence
  Description of Artificial Sequence: Synthetic coding sequence
atgggatccgcagaggacgccgtcaaagagaagctgctctggaatgtgaagaaggaagttaagcagattatggaagaagccgtgacccgcaagttcgtccatgaagatagcagccacattatcgccctttgtggggcggtcgaggcctgcttgctgcatcagctacgcaggagggccgcagggtttttaaggtcggataagatggccgcgctattcactaaagttggtaagacgtgcccggtcgctggagagatttgtcacaaggtgcaggaactgcagcaacaggccgaaggcagaaaaccatctggggtctcccaggaggcactgaggcggcagggcagcgcgtccggtaaggctcccgctttatcaccacaagccttaaagcatgtgtgggtaagaaccgccctgatagagaaggtcctggacaaggtcgtgcaatatctggctgagaactgttctaaatattatgagaaggaagcactactcgcggatccagtcttcgggcccattctagccagtttgttagttggcccttgcgccctggagtacactaaattgaagactgcagaccattactggaccgacccaagcgctgacgagctggtgcagagacaccgcatacgcggacccccaacccgacaagactctcccgctaagcggcccgcactgggcatccgtaaacggcattcttctggctctgcttccgaggatcgccttgccgcttgcgcaagagagtgcgtggagagcctccatcagaatagtcggacgagactgctttacgggaagaatcacgtgttggttcagcctaaggaggacatggaggcagtgcctggatacttatcacttcatcagagtgccgaaagcctgacgcttaagtggacccccaaccagctgatgaacggaacattaggagatagcgagcttgaaaagtcagtctactgggactacgccctcgttgtgcccttcagtcaggtcgtgtgtatccattgccaccagcaaaagtcgggtggaacactggtgctagtgtcgcaggacggcatacagagacctccattacactttccacaaggcggacacctcctgagcttcctgagctgcctcgaaaacggcctgctcccccgcggtcaactcgagccacccctgtggactcagcagggtaagggcaaggtgtttccaaagctccgtaaacgatccagtattcgttctgttgatatggaggagatgggcactggaagggccactgattacgtttttcggataatctacccagggcaccggcatgagcacatcacaatcaattatcaccacctggcggcctccagggctgccagtgtagacgatgatgaggaggaggaagacaagctccacgcaatgcttagcatgatctgcagccgaaacctcaccgcacccaatccaatgaaagatgcgggagacatgattgagatgcagggcttcggcccaagcctccctgcgtggcacctcgagccgctgtgctcccaggggagttcctgcctgtcgtgcagctcaagctcaagcccccacgctacaccttctcattgttcttgtattcccgaccgtctcccactgaggctgctctgcgaatctatgaaacgccagattgtttcaagggcattctatggttggcttgcccactgcagacacctcagcaccgtgaggacacatctctctgctctggtccatcactccgtgattcccccggaccgccctcctggcgctagcgcagggcttaccaaggacgtgtggtccaagtaccaaaaggataagaagaactataaagaacttgagttactgcggcaggtgtactacggcggcattgaacacgaaattcggaaggatgtctggccatttctgctggggcactacaagttcgggatgagcaaaaaggagatggagcaggtagacgcggttgtggctgcacgatatcagcaggttctggctgaatggaaggcctgtgaggtcgtggttcgccaacgcgagcgcgaggctcatcccgcaacaagaacaaaattttcgtctggctcatctatcgattctcatgtgcaaaggttgattcaccgggatagcaccatatccaacgatgtgtttatctccgtagacgatctagaaccccctgaaccccaggaccctgaagactcgcgtcctaaacccgagcaagaagccggacctgggactccaggtaccgctgtggttgagcagcagcattcggtggagtttgattctcccgattcagggctgccctcgtctcgtaattactccgtggcgtcagggatccagtctagcctggatgaaggccagtccgtcgggtttgaggaagaagatggaggcggggaagagggtagttctggccccgggcccgccgcgcacacactgcgcgaacctcaggacccgagccaggaaaagccccaggcaggagaattggaggccggcgaagagcttgccgcagtctgcgcggccgcatataccatagaactgctggacactgtggccctcaacctgcatcgaatagataaagacgtgcagaggtgtgaccgaaattattggtactttaccccacctaatctggaaagactacgggacgtcatgtgctcctatgtttgggagcacctggatgttgggtacgttcaaggaatgtgtgatttactagccccactccttgtgacactcgataatgaccagctggcatatagttgttttagccatcttatgaagaggatgtctcaaaattttccaaacggtggcgctatggacacccactttgccaatatgcggtctctcatacagatcttagacagtgaactcttcgaactaatgcatcagaatggcgactacacacatttctacttttgttatcgctggtttcttctggacttcaagagggaactcttatatgaggatgtttttgccgtttgggaggtgatatgggccgcacgacacataagctccgagcacttcgtcttatttatcgctttggctctggtggaggcctatcgcgagatcatccgagacaacaacatggattttactgatataattaagttctttaatgaacgggcagagcaccacgatgcccaggaaatactgaggattgcacgcgacctcgtgcataaagttcagatgcttatagaaaacaagtag

SEQ ID NO: 134583 - DNA, 3021 bp, Artificial Sequence
  Description of Artificial Sequence: Synthetic coding sequence
atggggagcgccgaagatgccgtcaaggaaaagctcctgtggaatgttaagaaggaagttaagcagatcatggaggaggccgtcactagaaaatttgtccatgaggactcttcacatataatagcactgtgtggcgctgttgaggcctgtcttttacatcagctcagacgaagagctgcaggatttctcagatctgataaaatggcggccctgtttactaaggtgggaaaaacctgtccagtggctggtgagatttgccacaaggtacaggaactgcagcagcaagccgaggggagaaagccttcaggtgtgtcccaggaggccctgaggcggcaggggagtgcctcaggaaaagcaccagctctaagcccccaggccctaaaacacgtatgggtacgtacagcactgattgaaaaagtactcgacaaggtggtgcagtatctggcagaaaactgttccaaatactatgaaaaagaagctctcttagccgatcctgtgttcggtcctatcttagccagtctcttagtggggccatgtgccctcgagtacaccaagcttaagaccgctgaccactattggaccgatccatcagctgatgaattagtgcagcgccatcggatcaggggaccaccaacgaggcaggatagcccagcgaagcgtccggctttgggaattcgcaagcgtcatagttcagggtctgcgagcgaagataggcttgccgcctgtgcaagggaatgcgtggaatccctccatcagaactctagaaccagactcctctatggcaaaaaccacgtactggttcagcccaaggaggacatggaggctgttccaggctacttatctctgcaccagtcggccgaaagtctgactctcaaatggacccccaaccagctcatgaacggcaccctgggggacagcgagctcgaaaaatctgtatactgggactacgccctggtagtgcctttctctcaagtggtctgcatccactgtcaccaacagaagagtggagggaccctggtcctggtcagccaagatggcatacagcgaccccctctccactttccgcagggggggcatcttttatcgttcctgagttgtctggagaacggccttctgccccgcgggcagttagagcctcctctttggacccagcaaggcaaaggcaaagttttcccaaaactgcggaaacgttcctccatcagatctgtggacatggaggaaatgggcactggcagggctaccgactacgtttttaggattatttacccaggccatagacacgagcataacgctggcgatatgatcgagatgcagggctttggaccaagcctccccgcttggcatctggagcccctgtgttcccagggatctagttgcctcagctgttcatcatcatcttcaccacatgccactccatcacactgtagttgcataccagacagactacctctgagattactgtgtgaatctatgaaaagacaaattgttagtcgggccttctacggctggctggcacattgtcggcatctctccactgtgagaacacatctgtcggcactcgtgcaccatagcgtcattccccccgataggccaccaggggctagcgctggcctcaccaaagatgtgtggtcaaagtatcaaaaagataagaaaaactacaaggaacttgagctgctgcgtcaggtgtactacggtggcatagagcacgagataagaaaagatgtgtggccgttcctcctggggcattataagttcgggatgtcaaagaaagagatggaacaagtagacgccgtcgtggccgccagatatcagcaggtgttggccgagtggaaggcttgcgaagtagtggtacggcagcgtgagcgcgaggcccacccagcaacaaggacaaagttcagtagcggttcctcaatcgatagccacgttcagcgactcatccaccgggactctactatatctaatgatgttttcatctctgtagacgacctcgagcccccagaaccacaggatcccgaagactcgcgccccaaacccgagcaggaagcgggacctggcacaccagggacagccgttgtggagcagcagcatagcgttgaatttgactcccctgacagcgggttaccttcgagccgcaattactcagtggcttccggtattcagtcttccctcgatgagggacagtctgtcggcttcgaagaagaagatggtgggggggaagaagggtcaagtggtccagggccagcggcccacacccttcgagagcctcaagatccttctcaggagaagccccaggctggagagttagaggccggagaagagctggctgctgtctgtgcagcggcttatacaatcgagctcctagacactgtggcattgaatctccaccgcatcgacaaggacgtccagcgctgcgacagaaactattggtactttacaccaccgaacctggagcgcctccgagacgtgatgtgcagctacgtttgggagcatttggatgtcggttatgtacagggcatgtgcgatctactggcaccgctcctggtgactttggacaatgaccagctggcctactcttgtttcagtcacttgatgaaaagaatgtcccagaactttcctaacggcggcgcgatggatacacactttgccaatatgaggagcctgatacaaatcctggactccgagttgttcgagttaatgcaccagaatggcgattacacccatttctatttctgctaccgatggttcctgctagacttcaagcgcgagctgctctatgaggacgtcttcgccgtttgggaggttatttgggctgccagacatatctcctctgagcatttcgtgctctttatcgcccttgcattggtggaagcttaccgcgagatcatcagggacaacaacatggattttacagacatcatcaagttcttcaacgagagagcagagcaccacgacgcccaggaaatcctaagaatcgcacgggatctcgtgcacaaagtacagatgctgattgagaacaaatag

SEQ ID NO: 134584 - DNA, 795 bp, Artificial Sequence
  Description of Artificial Sequence: Synthetic coding sequence
atgtgccataagaacggctttccgcaggagggagggatcacagcggccttccttcagaagagaaaactacgactgagcaaaaatcatcgtccagcacgggctaaggtgacagagcacgtacggggcactagacccggacgggccacggcgggcccagcagcctcaacacgcgctgccggctctttattcttcgacagatggggaaaccggggcccagctggttgtcggggatcaagtcacctgccacagcagctcaaatttactacctctgactcctgtgatcgaattaaagatgagttccaactgctccaggcccagtaccactctctcaaacttgagtgtgataaacttgcttccgaaaagagcgaaatgcaacggcactatgttatgtactacgagatgagctatggactgaatatcgaaatgcataaacaagccgaaatcgtcaaacgtctcaatggcatttgcgcccaggtcctaccatatctgtcccaggagcaccagcagcaggtgctcggagccatcgagagagctaagcaagtgacggcgcctgagcttaatagcatcatccgacagcagctccaggcccatcagttatcgcagttgcaggcacttgccctgcccctaacccccctgccggtcggcctgcagcccccaagtctgcctgccgtcagtgcaggaaccggtctgctgagcctgtcagctcttggatcccaggcacacctgtccaaggaagataaaaacggtcacgacggagacacacatcaagaggatgacggcgaaaagtccgactag

SEQ ID NO: 134585 - DNA, 267 bp, Artificial Sequence
  Description of Artificial Sequence: Synthetic coding sequence
atgaacatgagtaaacagcctgtgtccaacgtgagagccatccaggcaaacatcaacataccaatgggcgcctttagacccggagccggtcagcctcctcgccgcaaggagtgtaccccggaagtggaggaaggggtaccgcccacatccgatgaagaaaaaaagccgattcccggcgccaagaagctcccaggacctgcagttaacttgtctgaaattcaaaacatcaaatccgagctgaagtacgtgcctaaagcagaacagtag

SEQ ID NO: 134586 - DNA, 6411 bp, Artificial Sequence
  Description of Artificial Sequence: Synthetic coding sequence
atggctgacgttactgcgagatcacttcagtacgagtacaaagcaaatagtaatttagtactgcaagcagataggtccttgatcgatcgtacgcgtagagatgaaccgacaggcgaagtgctgtcactggttggcaaactggagggaacgcggatgggagacaaggcacagcggacgaagccccagatgcaggaagagcgcagggctaaacggagaaagagagacgaggatcgacatgatataaataagatgaaagggtacacattactctctgaggggattgacgaaatggttggaatcatctacaagcctaagactaaggaaacccgagagacatacgaagttttgcttagcttcatccaggctgcactgggtgatcagccgcgggacattctgtgcggcgcagcggacgaagttctagcagtactcaaaaacgagaaactgagggacaaggagcggaggaaagaaatcgacctacttctggggcagaccgacgatactcgctaccatgtgcttgtgaatctgggtaaaaaaattactgactacggtggggacaaggagatccagaatatggatgacaatatcgacgagacctacggcgtcaatgttcagttcgagagtgatgaagaggagggagacgaagatgtgtacggcgaggtgcgtgaggaagcttcagatgatgacatggagggcgacgaggcggtggtacgctgtactctgagcgcaaaccttgtcgcttccggcgagcttatgtcaagcaagaaaaaggacctccacccgagggacatcgatgctttttggctgcagagacagctcagccgattctacgatgatgccatagtttcccagaagaaagccgacgaagtcctggaaattctgaagactgcttcggacgatcgagagtgtgagaaccagctagttctgcttctcgggttcaacacttttgactttataaaggtcctgcgtcaacaccggatgatgattttgtactgtaccctgctggcctcagctcaaagtgaagctgagaaagagaggattatgggaaagatggaggccgatccagagctgagtaaattcctgtatcagctccatgaaaccgagaaggaagatttaatcagagaagaacggtcgcgaagagagagagttcggcagtcacgcatggacaccgacttggagaccatggatttggaccagggaggcgaagccctcgctcctcggcaagtgctggatctggaagatctagtcttcacccaagggagccacttcatggccaataagaggtgtcaattacctgatggatcttttcgtcgtcagcggaaaggatatgaggaggtgcacgtacctgccctcaaaccaaagccctttggatctgaggagcagctgctgcctgtagagaagcttcccaagtacgcccaggcgggattcgaagggtttaaaacgctgaatcggattcaaagcaagctctacagggcagctctggaaacggatgagaatcttctcctctgcgctcccaccggagccggaaagactaatgtcgcccttatgtgtatgctcagggagatcggtaaacatatcaacatggatggaacaattaacgtcgacgatttcaaaatcatttacatagcacccatgcgctccctggtgcaggagatggtgggatcttttgggaagcgcctcgccacctatgggattaccgtggccgagctgacaggcgaccatcaactgtgcaaagaggagatttcggctactcagatcattgtgtgtactccagagaagtgggacatcatcacacgaaaaggaggagagagaacctatacccagctggtccggcttattattctcgacgaaattcatcttttgcacgacgaccgaggccctgtgcttgaggccctggttgccagggccattagaaatatagagatgactcaggaagacgtgagacttattggactctcagccaccctgccaaactatgaggacgtggccacgttcttacgcgtggacccggccaaagggttgttctacttcgacaactcgttcagacccgttccgctggaacagacctacgtgggcatcacagagaaaaaggcaatcaagaggttccagattatgaacgagattgtctacgagaagataatggagcacgctggtaagaaccaggtgctggtgtttgtgcatagtcgtaaggagacaggaaagaccgccagggcaatcagagacatgtgtctggagaaggacactcttgggctgttcctgagggaaggttctgcgtccactgaagttctgaggaccgaggccgaacagtgtaagaacttagagctcaaggacctgctgccgtacggattcgcgatccaccatgcgggcatgaccagagttgatcgaactctcgtggaagacctgtttgctgacaaacacattcaggttttggtgtctaccgcaacactcgcatggggcgtcaatctcccagcccacacagttatcattaagggcactcaggtgtattcacccgaaaaggggcgctggaccgaactgggcgccctggacatcctacagatgcttggtcgggccggacgtccacagtatgacacaaaaggcgagggcatccttatcacgtctcatggtgagctacagtactacctgtctttgctgaatcagcagctacccatagagagccaaatggtttccaaactccctgacatgttgaacgccgaaatagtcctcggcaacgtccaaaacgctaaagacgcagtgaactggctgggctacgcttacttatatatcagaatgttgcgcagccctaccctgtacggaatctcccacgatgacctaaagggtgatcccctgctggatcagagaaggctggacctcgtgcacaccgcggcactgatgctggacaagaacaatctcgtaaagtatgacaaaaagaccggcaacttccaagttactgaacttggcagaattgcctcccattactatatcaccaacgataccgtgcaaacatataaccagctactgaaacctactcttagcgagattgaactgtttcgagtgttctctttgtcgtcagagttcaaaaatattacagtccgggaggaagaaaagctggaactccaaaaactgcttgaaagagtccctatacccgtcaaggagtcaattgaggagccaagtgccaaaatcaacgtgctactccaagcatttatctcacaattgaagttggaaggtttcgccctgatggccgatatggtctatgtgactcagagcgccgggcgactgatgcgcgccatatttgaaatcgtactgaatagaggatgggctcagctcactgacaaaactcttaacttgtgcaaaatgatcgataagagaatgtggcagtcaatgtgtccgctgcgccagttcagaaaactgccagaagaggtagtgaagaagatcgagaaaaagaattttccttttgaacggctctacgatttgaaccataatgaaattggggagctcattcggatgcccaagatggggaagaccattcataagtatgtccatctcttccccaaactcgaactctctgtgcacctgcagcctataacccgttccactctgaaggtggagcttaccatcactcccgacttccagtgggatgaaaaagtgcacgggtcaagcgaagcgttttggatcctggttgaggatgtggacagcgaggtgattctgcaccacgagtattttctgctgaaagccaagtacgcccaagatgagcatctgatcactttttttgtgcccgtgtttgaacccctccccccccagtacttcatccgcgtggtatcggatcggtggttgtcctgtgagacacagttgcccgtctcattcaggcatctgatacttcctgaaaagtatccccctcccaccgagcttctcgatttacagcctctccccgtaagcgcgctgcgtaattcagctttcgagtccctttaccaggacaaattccccttcttcaatcctattcaaacccaggtgttcaacacagtgtataattccgacgataacgtgttcgtaggtgcaccaacagggtccggcaaaacaatttgcgcagagtttgctattctgaggatgctgttgcagagcagcgagggaaggtgtgtctatattacccccatggaagctttggccgagcaggtatatatggactggtacgagaagtttcaagaccgacttaataagaaggtggtccttcttacaggagagacttccactgacctgaagctgcttggcaaaggtaacattatcatcagtaccccagagaagtgggacatactcagccgcagatggaaacagcgcaagaatgtgcagaacattaatttgttcgtcgttgacgaagtccacctgattggcggagagaacgggccagtgctggaggtgatttgcagcaggatgaggtatatctcatcccagattgagcgacctattcgcatcgtagccctgtcaagttcactttccaatgccaaggacgtggcacactggttggggtgcagcgcaacttccacatttaactttcatccgaatgtcagacccgtcccccttgagctgcacatccagggattcaacatctcccacacccaaactaggctcttaagtatggctaaaccagtgtatcacgcgatcactaagcattcacctaaaaaacccgtaattgtgttcgtgccttcacgcaaacagacccgcttgaccgctattgatatactgacaacatgtgctgccgacattcagcgacaacgctttcttcattgcactgagaaggatcttattccctatctggaaaaactatccgacagcaccttgaaggagactttactgaacggggtcggataccttcacgagggcctatcccccatggagagacgccttgtagagcaattgttcagcagcggagctattcaggtcgtcgtggcgagccgaagcttatgttgggggatgaacgttgcagcccatcttgtgatcattatggatacacaatattataatggcaaaatccatgcctacgtggactatccgatctacgacgttctgcaaatggttgggcacgctaataggccactgcaagacgacgaaggacgatgtgtgataatgtgtcaggggtccaaaaaggatttcttcaaaaaattcctgtacgaacccttgcctgtggaaagtcatttggatcattgtatgcacgaccattttaatgctgagattgtaactaaaactattgagaacaagcaggatgccgtggattatctcacttggaccttcttgtatcgccgaatgacgcaaaaccccaactactacaatctgcagggcataagccaccgccacctgagcgaccatttgtcagagctggtggagcagactctgtctgacctcgaacaatcaaaatgtatttccatcgaagacgaaatggacgtcgcacccttgaatctgggcatgattgccgcatactactacataaattacacaactatcgagctgttctctatgtccctgaacgccaaaaccaaggtgaggggcctgattgaaataatcagcaacgctgctgagtatgagaacatcccaatccgccatcacgaggacaatttgctgcgccagttggctcagaaggtgccgcataaacttaacaacccaaaattcaacgatccccatgttaagactaatctgcttctacaagcccacctctctagaatgcaactctctgccgaactgcagtcagacaccgaggagattctgtccaaagctattcgcctcatccaggcttgcgtcgatgtcctgtcctcaaatggatggctgtccccagctctggccgctatggaactcgcgcagatggtgacgcaggctatgtggtcaaaggattcctacctgaaacagttgccccattttacaagtgagcacataaaaaggtgtaccgacaaaggcgttgaatcagtatttgatatcatggagatggaggacgaggagaggaatgctctgctacaattgacagatagtcagatagccgacgtggctcgattctgtaatcggtacccaaacatcgagttgtcatacgaggtggtggacaaggactccattcgctccggagggcccgtggtagtcttggtacagctcgagagagaggaggaggtgaccggacccgtaatcgctcccttgttcccacagaagagagaggaaggatggtgggttgtcattggtgacgctaagtctaacagcctcatctcaattaaacgcctcactctccagcagaaagccaaggtgaagttagattttgtagcacctgccaccggggctcataattatactctttattttatgagcgatgcttatatgggatgtgaccaggaatacaagttctcagtagacgtaaaggaagccgagaccgactcagattctgactag

SEQ ID NO: 134587 - DNA, 1878 bp, Artificial Sequence
  Description of Artificial Sequence: Synthetic coding sequence
atggcagatgtgactgctaggtcactgcagtacgaatacaaggcaaactcaaacctggtgctgcaagccgacaggtcactgatagataggactaggagggacgaaccgaccggcgaggtgctttctctggtagggaagttggaagggaccaggatgggtgataaggctcaaaggacgaagccgcagatgcaagaggaaagaagagccaaaaggaggaaacgagacgaggaccgccatgatatcaacaagatgaaaggctatacgctgctctccgaggggattgacgagatggtgggcatcatctataaaccgaagacaaaagaaacacgtgaaacctacgaggtgttgctgtcatttattcaagcagcactaggggatcagcctagagatatcctctgtggtgccgctgacgaagtgctcgctgtgcttaaaaatgaaaagctgcgggacaaggagaggcgaaaagagattgaccttctcctgggacagactgatgacacaagataccacgtgctggtgaacctgggaaaaaagataactgattatggtggagataaggaaatacagaatatggatgacaatatagatgagacctacggcgtgaacgtacagtttgaatcagatgaggaggagggagatgaggatgtgtatggtgaagtgagagaggaggccagcgacgacgacatggagggcgacgaagctgtagtgcggtgtacactgagtgctaatttggttgccagcggggagttgatgtcctctaagaagaaagatctacacccacgcgacatagatgccttctggctccaaagacagctctctaggttttatgacgacgcaatcgtgagtcagaaaaaggccgacgaagtcctggagatcctcaagactgcgagcgacgaccgcgaatgcgagaaccagctagtgttattactcgggttcaatacattcgattttatcaaagttctgaggcagcatcgtatgatgatcctatactgtacattactagcgagtgcccaatctgaggccgaaaaagagaggattatgggtaagatggaagccgatcctgaactgtccaagttcctctatcaacttcacgagacagaaaaagaagacctgatacgggaggaaaggtctcggagggaaagagtacgccagtccaggatggatactgacttagagacaatggacctggaccagggcggagaggccctggcgcctcgtcaggtccttgaccttgaggacctagtgttcacccaaggctctcactttatggctaacaagagatgtcagctgcctgacggctcgtttagacgacaacgcaagggctacgaggaggtccacgtgccagccttgaaacccaagccctttggcagtgaggaacagttgctccccgttgagaaactgcccaaatacgctcaagctggcttcgagggtttcaaaacacttaatagaattcaatccaaactgtaccgggccgccctggagacggacgagaacctactgctttgtgctccgactggagcaggcaagactaatgtcgcactgatgtgcatgctgagggagatcggtaagcacattaatatggacgggactataaacgtcgatgatttcaagatcatctacattgcccccatgcggtctctcgtacaagaaatggttgggagttttggaaaaagggacgcgaaatcaaacagcctgatttccattaaacgcctcaccctgcagcagaaagcaaaggtgaagttggactttgtggctcctgctaccggtgcacacaattatacactttactttatgtccgacgcttatatgggctgcgatcaggaatataaatttagcgtcgacgttaaagaggctgagacagactcggattccgattag

SEQ ID NO: 134588 - DNA, 1788 bp, Artificial Sequence
  Description of Artificial Sequence: Synthetic coding sequence
atgcgttatatctcttcacagattgagagaccaatcagaattgttgctctctccagttcactgtctaacgctaaggatgtagcacattggcttggatgttcggctacctcaacttttaacttccatccaaatgttcgacctgtacctctggagttgcacatccagggctttaatatttctcacacccagactaggctgttgtcaatggctaagccggtgtatcacgcaattaccaaacatagtcctaagaagcccgtaatcgtgttcgttccctcgaggaaacagacaaggctaacggccatagatatcctgaccacttgtgccgcagatattcagcgccaaaggtttctgcactgtactgagaaagaccttattccttacttagagaaactgagcgactcgaccttaaaggaaacactgcttaatggagtcggatacctgcatgagggactcagtcccatggagaggcggctcgtagagcaactgttttccagtggggctatccaggtggttgtcgcatcccggtccctctgttggggaatgaacgtagccgcccacctcgtgatcatcatggacacgcagtactataacggtaagatacacgcttacgtggactatcccatatacgacgtcttgcaaatggtgggccatgctaatcggcccctgcaggacgacgaagggcgctgcgtcattatgtgtcagggatctaagaaggattttttcaaaaagttcctctatgagcccctcccagtagaatcccatctcgaccactgcatgcatgaccatttcaacgcagagattgtgactaagaccatcgaaaacaagcaagacgccgtcgattacctgacttggacgttcctttataggagaatgacccagaatccaaattattacaatcttcaggggatttcacaccgacatctttccgaccacctgagcgaattagtggagcagacattatcagatctggaacagagcaagtgcatcagtatcgaggatgaaatggacgttgcaccccttaatctcgggatgatcgctgcttattactatatcaactacactactatagagttgttcagcatgtccctaaacgcaaagacgaaggtgagaggactgatcgaaatcatcagtaacgctgctgaatatgaaaacatcccgataagacatcacgaagacaatttactgaggcagctggctcagaaagtgccgcacaagctcaacaaccccaaatttaacgatcctcacgtgaaaacgaacttgttactgcaggcccacctgtcccgaatgcaactgtctgccgaactgcagtctgacacagaagaaattttgtccaaagccattcgcctgattcaggcttgcgttgacgtactgtcctccaatggctggctgagtccagcactggccgcgatggagctggctcagatggtgacccaggcaatgtggtccaaagacagctaccttaaacagctgccgcactttacgtcagaacacatcaagcgctgtaccgacaaaggcgtggagagtgtcttcgatatcatggagatggaggacgaagaacgcaacgccctcctacagctaactgatagccagattgccgacgtcgctcggttctgtaacaggtatccaaatatcgagctttcctatgaggtggtggataaagactctattcgttctggagggccagtcgtagtccttgttcagcttgaacgagaagaggaagtcaccggccccgtgattgcccctttattcccacagttcagggctggccgctcagggtcaaggctgtag

SEQ ID NO: 134589 - DNA, 1788 bp, Artificial Sequence
  Description of Artificial Sequence: Synthetic coding sequence
atggcaaagcccgtgtaccacgccattacaaagcactcgcctaaaaaaccggtgatcgtgttcgttccatccagaaagcagacacgactcacagctatcgatatcttgaccacatgcgcggccgacatacaacggcaacggtttctgcactgcacagagaaggacctcatcccttatctggagaaattgtcagatagcacattgaaggagaccctcctcaatggcgtcggatacctgcatgagggcctgtcaccgatggagagacgacttgttgaacaactgttttctagtggcgcgattcaagtcgttgttgcatcaagatcgctgtgttggggaatgaacgtggccgcacacctggttattattatggatacacagtattacaacggcaagatccacgcctatgtggactaccccatatacgacgtcctgcagatggtgggccatgcgaaccggccattgcaggacgatgaaggacggtgtgtgatcatgtgtcagggttctaagaaggatttttttaaaaaatttctgtatgaacctctccctgtggagagccacctggatcattgtatgcacgaccacttcaatgctgagatcgtgaccaagaccatcgagaataaacaggatgcggtcgactatttaacatggacttttctgtacaggcgcatgacacagaacccaaactattataacctgcagggaatctcgcataggcacttgagtgatcatctctccgagctggttgagcagaccctgagtgatctggaacaatcaaagtgtatctctatcgaagatgagatggacgtggctccgctcaatctgggtatgatcgctgcctattactatatcaattacactacaatcgaactcttcagcatgtctttgaatgccaagactaaggtgaggggtctcatagaaattatctcaaacgccgctgaatatgagaacataccgatccgccatcacgaagacaatcttttgcggcagcttgcacagaaagtgccgcataaactgaataatccaaaatttaatgacccccatgttaagacaaatcttctcctacaagctcatctctcacggatgcagctgagcgcagaacttcaaagtgacacagaagagattctttccaaggcaatccgcctgattcaagcttgcgtggacgttctttcttcaaatgggtggctctcgcccgcactggcagccatggagctggctcagatggttacgcaggccatgtggtcaaaggacagttacctgaaacagttgccccactttacaagcgagcacatcaagcggtgtacagataaaggagtggagtctgtattcgacattatggaaatggaagacgaggagcggaatgcactcctacagctgacagatagtcaaatagcagatgtggcccgtttttgcaaccgttaccccaacatcgaattgagctatgaagtggtcgataaggacagcatcaggtctggagggcctgtagtggtgctagtccagttggaacgcgaggaagaagtgaccgggccagttatcgctcctctgtttccacagaaacgcgaggagggctggtgggtcgtcatcggagacgccaagagtaacagcctcatctccatcaaacggttgacattacaacaaaaagctaaggtgaagcttgatttcgtagcccccgcaactggcgctcacaattatacgctgtacttcatgagcgacgcctacatgggctgcgaccaggagtataagttcagcgttgatgtcaaagaagctgagacagacagcgactctgactag

SEQ ID NO: 134590 - DNA, 2325 bp, Artificial Sequence
  Description of Artificial Sequence: Synthetic coding sequence
atgatgatactgtattgcactctgttggctagcgcgcagtcggaagcggaaaaggaaagaattatgggaaaaatggaggccgaccccgagttgtcaaagttcctctatcagctacacgagacagaaaaggaggacctgatcagagaggaacggagtaggcgggaacgggtgcgccagagccgcatggatactgacttggagacaatggacctggaccagggaggcgaagccctggcgcctcgccaggtgctcgatctggaagatctggtatttacccaaggctctcatttcatggctaacaagcgctgtcaactgccagatgggagttttcggaggcagagaaagggctacgaggaagtccacgtacccgctcttaaacctaagccattcggcagcgaggaacagctcttgcctgtagaaaagcttccgaagtacgcccaggcgggattcgaaggctttaagacactgaaccggatccagtcgaaactttacagagcggccctggaaaccgacgagaatctgctgttatgtgccccaacaggggctgggaagaccaatgtcgccctgatgtgcatgctgagagaaattggaaaacatataaacatggacgggacaataaatgtagacgactttaaaattatttacattgcccccatgcggagcctggtacaggagatggtggggtcctttggcaagagactggcgacatacggaataaccgtggccgaacttactggcgaccaccagctgtgcaaagaagagatttccgctacccagataatcgtgtgtacaccagagaagtgggatatcattacaagaaagggtggagaacgcacgtacacccaactcgttcgcttaatcattctcgacgaaatccacctgctccatgatgaccgggggcccgtgttggaggccttagtggctagggccataagaaacattgaaatgacccaggaagatgttaggcttattggcctttccgccacccttcctaattatgaggacgtggccacgttccttagggttgatccggcgaaaggcctgttttattttgacaacagttttaggccggtgcctctcgaacagacatatgtggggatcacggagaagaaagcaatcaaaagatttcagatcatgaacgagatcgtgtatgagaaaattatggaacacgcgggcaagaaccaggtgctcgtttttgtccactcaagaaaagaaaccggaaagacagcgagagcgatccgcgacatgtgtctcgagaaggacaccctgggactgtttttgagggagggtagcgccagcaccgaagtgcttcgcaccgaggccgagcagtgtaaaaacctcgaactgaaggacctactgccatacggcttcgctattcaccatgcagggatgacccgggtggataggactctggtggaagatttgtttgcagataagcacatccaggtgctcgtaagtaccgcaaccctggcatggggcgtcaaccttccagcacacaccgtcatcattaagggaacacaggtgtactcacctgagaaaggcaggtggacggaactgggcgcactcgacatactccaaatgttgggacgtgccggacgtcctcagtatgacactaagggagagggaatactcattacctcccacggcgaattgcagtattacctgagccttctcaatcagcaattgcccatcgaaagccagatggtctctaaattgccggacatgctgaacgccgagattgtcctgggcaatgtgcaaaacgccaaggacgccgtgaattggctgggctacgcctacttatacatcagaatgttgcggagtcccacactctacgggatatcccacgacgacctgaaaggcgaccccctgctcgaccaacgccggttggacctcgtacacactgccgccctgatgttagacaaaaataacttagtcaagtacgacaagaaaacgggcaatttccaggtcacagagttgggacgcatcgcgagtcactactacataacgaacgacacagtgcaaacatacaatcaactcttgaagccaacactgtccgagatcgaattatttcgggtgtttagtctgagcagtgagtttaagaatatcaccgttcgggaggaggagaagctcgaactgcagaagctgctggaacgggtacctattccagtgaaggaatccattgaggagcccagtgccaagattaatgtgctgttacaggcatttatctcccagctgaagctcgagggctttgctctgatggccgacatggtctatgtcacacagtcggctggacggcttatgagagccatattaaagctaagctag

SEQ ID NO: 134591 - DNA, 2160 bp, Artificial Sequence
  Description of Artificial Sequence: Synthetic coding sequence
atgctgctccagagcagtgagggtagatgcgtatatattacaccaatggaggctttggccgagcaggtgtacatggattggtatgaaaaattccaggacaggctcaataagaaggtcgtgcttttgacaggcgagaacggtccagtgctcgaggtgatctgtagcaggatgaggtacattagttcgcagatcgagaggccaatccgaatcgtggccctgtcatcctcattgtctaatgccaaggatgttgctcattggctgggctgctccgcgacatctacttttaactttcatccaaatgtgcggcccgtgccattggagctgcatatacagggatttaacataagccatacccagactaggctgctcagcatggccaagccagtctaccatgcaatcaccaagcactctcccaaaaagcccgttatcgtcttcgtgccctctaggaaacagacacgacttactgcaatcgacattctgaccacctgtgccgccgatatccaaagacagagattccttcactgcactgagaaggacctgatcccgtaccttgagaagctgtcagacagcacgttgaaggaaacacttctcaacggagtcggctatcttcacgagggtctcagccccatggagcggcgcttagtcgaacagttgttctccagcggtgccatccaggtggtcgtagccagtagaagcttgtgttggggaatgaatgttgccgcccacctagtgattattatggatacccaatactataacggcaagattcacgcctatgttgattacccaatatatgacgtactccaaatggttggacatgctaaccggccactgcaggatgatgaaggccgttgtgttatcatgtgccaaggatcaaagaaggatttcttcaagaaatttctctacgagccattaccggtggaaagccatttggatcattgtatgcacgaccatttcaatgctgaaattgtcaccaaaaccattgagaacaaacaggatgcagtggactacctgacctggacatttctgtatagaagaatgacccagaaccctaattattacaacttacagggcatcagccacagacatcttagtgatcatttgagcgagttagtggagcagacactgagtgatttagagcagagcaagtgtatttcaatcgaagatgagatggacgttgctcctctcaacttaggaatgattgccgcctactattacatcaattataccacaattgagttattcagcatgtcgctgaacgcaaaaacgaaagttcggggcctgatcgagattatttccaatgccgccgagtacgagaatataccaatccgtcaccatgaggacaacctgctgcgacagctcgctcagaaggtgccacacaaactcaacaatcctaaattcaatgacccccacgtgaagactaatctgttgctacaggctcatctgtctagaatgcaactgtccgccgagctgcaaagcgacaccgaggagatcctcagcaaggccattcgcctgattcaggcgtgcgttgacgttctctcttccaacgggtggttgagtcccgccctggccgcaatggagctggctcagatggtcacacaagccatgtggtcaaaggactcctatttaaagcaattgccgcactttacaagcgaacacattaaacggtgcacagataagggtgtcgagtctgtcttcgatataatggaaatggaggacgaggaaaggaacgctttactgcagctaactgacagccagatcgccgacgtggcccgcttttgcaacaggtaccccaacatcgaactgagctatgaagtagtggataaagatagcatcaggtccggaggccccgttgtagtcttagtgcagctcgagagggaagaggaagtgacaggacccgtgatcgccccacttttcccacaaaaacgtgaggagggctggtgggtagtgattggggatgcgaagtctaacagcctaatcagcatcaaacgcctgacgctccagcaaaaagccaaagtgaagttggacttcgtcgctcccgcgaccggagctcataactatactctctattttatgtctgacgcttacatgggttgtgaccaggaatataaatttagtgtcgatgtgaaggaagccgaaactgactccgatagcgactag

SEQ ID NO: 134592 - DNA, 1074 bp, Artificial Sequence
  Description of Artificial Sequence: Synthetic coding sequence
atgattgagcagcagaaaaggaagggtccagaactgcccctggtcccggtgaagcgccagcgccacgagttactgctgggggcagggtccgggcccggagccggccaacagcaggcaaccccaggcgctctgctgcaggccggacctccccgctgcagctcattgcaggctccaatcatgttgttaagcgggcacgagggcgaggtgtattgctgtaagttccatccaaatgggagcactttggccagtgcaggtttcgacaggcttattctgctatggaacgtatatggcgactgcgataattacgccactcttaagggccactctggggcagtaatggagttacactacaatactgacgggagcatgctgttcagtgcaagtacagacaaaacagtggcggtatgggacagtgaaaccggcgagagggttaagaggctcaagggccatacgagctttgtcaactcttgctacccagcgcgacggggtccacagttggtatgtacagggagcgacgatggcacagtgaaactgtgggacattagaaagaaggccgccattcagaccttccagaacacctaccaggtcctcgctgtcacctttaatgatacgagcgaccagataatttctggcgggatcgacaatgacatcaaggtgtgggacttacgccagaacaagctgacgtatacaatgcgcggccacgctgactctgtcaccggattaagtctgtcgtccgaaggcagctacctgttgtcaaatgctatggataatacagtgcgcgtgtgggatgtgcgcccctttgcgccaaaagaacgctgcgtgaaaatattccagggaaacgttcataactttgagaagaatttactgagatgctcctggtccccagacggtagcaagattgcagccggttccgcggacaggttcgtctacgtatgggacaccactagcagacgtatcttatataagctgcccggacacgcaggcagcatcaacgaggtggccttccaccccgacgagcctatcattatctctgcctcttccgataagcggctttatatgggcgagattcagtag

SEQ ID NO: 134593 - DNA, 384 bp, Artificial Sequence
  Description of Artificial Sequence: Synthetic coding sequence
atgatactgattagcgctgggtgccctggcggactgtggcccattgtggtgctcgtaggtttgttcatatggatttgttttgctgtacgcgtgtgggacgtaagacccttcgcacccaaggagagatgcgttaaaatctttcagggaaatgttcacaactttgagaagaatcttctgcgatgcagctggtcaccggacggctccaaaattgctgccggatccgccgataggttcgtctatgtgtgggacaccacctcacggcgaatcctttacaaacttcccggccacgcagggagcattaacgaggtggctttccatcccgacgagccgataattatctccgcctcctccgacaaacgactttacatgggcgagatacagtag

SEQ ID NO: 134594 - DNA, 1230 bp, Artificial Sequence
  Description of Artificial Sequence: Synthetic coding sequence
atgattgagcagcaaaagcggaagggacctgaactgcctctcgtgcctgtgaaaagacagagacatgaactactcttgggagcagggtccggaccgggagccggacaacagcaggctaccccaggcgctctgttgcaagcaggcccgccacggtgcagcagtctccaagcacccataatgctgctcagtggacatgagggtgaggtgtactgttgtaaatttcacccaaacgggtccaccctcgcctcagctggcttcgatcggttaatcctgttatggaacgtgtatggtgactgtgataactacgccactttaaagggtcattctggcgctgtgatggaactgcactacaataccgatggctcaatgctgttcagtgcaagcacagataagacagtagcggtttgggatagcgaaaccggtgaaagggtgaagaggctgaaaggacacacttcatttgtgaattcttgctaccccgccaggaggggtccccagttggtgtgcactgggtcagatgacggcaccgtaaaactgtgggacatccgaaagaaggctgctattcaaaccttccagaatacatatcaggtcttagccgttaccttcaatgacacttctgaccagattatcagcggcggcatcgacaacgacattaaagtatgggatcttagacagaataagcttacttacaccatgcgaggccatgccgattctgtgacagggctgagtctgagttccgaaggctcatacctgctgtcaaatgccatggacaacaccgttcgagtgtgggatgtgcggccgtttgccccaaaggagcgatgcgtcaagatcttccagggaaacgtccataatttcgagaaaaacttgctccgctgctcatggtctccggacggcagcaaaatcgcagctggaagcgcggaccgattcgtgtacgtatgggatacaacatctcggcgcattctgtacaaactgccaggccatgcgggcagcatcaacgaagtcgcattccaccctgatgagcctatcatcgaaacaggcttccaccggataggtcaggggggacatgagctcctgacctcttcaaatccacccgctagcgcatctcaatcagctggtataaccggggtgtcccactgtgctcaacttcagaccgtctttatgtgggtttcaatgagtgtgtcaccactgctgattagcggagaatcaaagtctaacgcccccttctcatcttag

SEQ ID NO: 134595 - DNA, 849 bp, Artificial Sequence
  Description of Artificial Sequence: Synthetic coding sequence
atggctgtcccagagactcgaccaaatcacactatatacataaataacctgaatgagaaaattaagaaagacgaacttaaaaagagcttgtatgctatttttagccagtttggccagattctcgacatcctggtgagccgctccctcaagatgcgcgggcaggccttcgtaatcttcaaggaggtatctagcgcaaccaatgccctgaggtctatgcagggattccccttctacgataaacctatgaggatacaatacgccaagacggatagcgacatcatagctaaaatgaagggtacatttgtggagcgggaccgcaaacgtgaaaagcgcaagcctaaatcgcaggagactcctgccacaaagaaggccgtgcaggggggtggcgctacccctgtcgtaggtgctgtccaaggcccagtgcccgggatgcctccaatgacacaggccccgcggattatgcaccatatgccagggcagcccccttacatgcctccgccaggcatgatacctccacctggtctggccccaggtcagatccctcccggcgcaatgccaccccagcagctgatgccaggccagatgccccctgcccagccactctccgaaaatccacccaaccatatcctgtttcttaccaatttacctgaggagaccaacgaactcatgctctcaatgctgttcaatcagttccccggatttaaggaggtgagactggtccccggccggcacgatatcgcctttgtggaatttgacaacgaggttcaggccggcgcagctcgggacgccttacagggattcaagatcactcagaataacgccatgaagatctcctttgctaaaaagtag

SEQ ID NO: 134596 - DNA, 612 bp, Artificial Sequence
  Description of Artificial Sequence: Synthetic coding sequence
atggccgtccccgaaaccaggccaaatcacaccatctacataattgcgaaaatgaaagggacattcgtggagcgggaccggaagagggaaaaaaggaagcctaagtcccaggagacccccgcgaccaagaaggcagtccagggcggcggtgccacacccgtcgtgggtgccgttcagggacccgtccctggaatgcctccaatgactcaggcaccaaggatcatgcaccacatgcctggccaacctccttatatgccgccgccgggcatgatccccccccctgggctcgcccccggtcagatccctcctggcgcaatgcccccccaacagttgatgccaggtcagatgccgcccgcacaacctctgtcagaaaatccgcccaaccatattctgttcctaaccaacctgcctgaggaaacaaacgaactgatgcttagcatgctattcaaccaatttcctggcttcaaggaggtgagacttgttcccggccggcatgatattgctttcgtggagttcgataatgaggtccaggccggggcggcgagggacgcactgcaaggtttcaagattacccagaacaacgcgatgaagatcagcttcgccaagaagtag

SEQ ID NO: 134597 - DNA, 768 bp, Artificial Sequence
  Description of Artificial Sequence: Synthetic coding sequence
atggttaagctgaccgcggagctgatcgagcaggctgcacagtacaccaatgccgtgcgcgacagggaactggacttgagggggtataaaatcccggtcatagagaacctcggagcaactctggatcagtttgacgccatcgacttctccgacaacgaaatccggaagctcgacggtttcccgctcctgaggagacttaagactctgctggtgaataataacaggatatgccggatcggggaggggctggatcaggctttaccctgtctaactgagctaatattgaccaacaactccctcgtcgagctgggagatctagaccccctcgcgagtctgaaaagcctgacctacctatctatattaaggaacccagttacaaataaaaagcattaccgcctgtatgtgatatacaaagtgccccaagtgagggtcctagactttcaaaaggtgaaactgaaggagaggcaggaggcagagaaaatgtttaaaggcaaaaggggggcccaactagcaaaggatattgcccgcaggtccaaaaccttcaacccaggagccggcctcccaacagacaagaaaaagggcggtccttcaccgggcgatgtggaagcaatcaaaaatgccatagcgaacgctagcaccctggccgaggtcgaacggctgaaaggattgctccagtccggacagatcccagggcgggaacggagaagcggccctacggacgatggcgaagaggagatggaggaggataccgtgactaacggatcttag

SEQ ID NO: 134598 - DNA, 480 bp, Artificial Sequence
  Description of Artificial Sequence: Synthetic coding sequence
atgccaaaattctactgcgattattgtgacacttatctgacgcacgactcgccatcagtgcgcaagacccactgtagcggtaggaaacataaggagaatgttaaagattactaccagaaatggatggaggagcaagctcagagcctcatcgacaaaaccacagctgcatttcagcagggcaagataccaccaacgccattcagcgcacctcctccagctggcgcaatgattccacctccacccagtctccccggcccaccccgcccaggaatgatgcctgcgccccacatgggaggaccgcctatgatgcccatgatggggccacctccaccaggcatgatgccggtgggaccagccccagggatgagaccccctatgggggggcacatgccaatgatgcccggtcctccgatgatgcgccctccagcacgtcctatgatggttcccacaaggccaggcatgactaggccggatcgctag

SEQ ID NO: 134599 - DNA, 543 bp, Artificial Sequence
  Description of Artificial Sequence: Synthetic coding sequence
atgaacagtgccagcgttgacgggcatctcagcggatgcaggttgttcttgtttctctccccattattccggttctactgcgattactgtgacacataccttacgcacgactcaccgtcagtgcggaagacacattgctcaggtaggaagcacaaggagaatgtcaaggactactaccagaagtggatggaggaacaagcccaaagcctcatcgacaagactactgctgccttccaacaggggaaaattccgccgactccctttagcgcgccacctccagcaggggccatgatacccccacctcccagtttgcctgggcctccaaggcccggcatgatgcccgcacctcacatggggggccctccaatgatgcccatgatgggacctcccccccccggaatgatgcctgtcgggcctgctccagggatgcggcctcctatgggtggccatatgcccatgatgcctggcccccccatgatgcgcccccccgcaaggccgatgatggtgccgacaagacctggaatgacacgacccgacaggtag

SEQ ID NO: 134600 - DNA, 357 bp, Artificial Sequence
  Description of Artificial Sequence: Synthetic coding sequence
atggaggaacaggcccagtcactgatagacaagactaccgccgccttccagcagggcaagattccacccactccattcagtgctcctccacccgcaggcgccatgatacctccccccccttcgttacccgggccacctcgacccgggatgatgcccgctccacacatgggcggacctcccatgatgccaatgatgggccctccacctccgggcatgatgcccgtcggtccagcccccggaatgcggcctcctatgggcggccacatgcctatgatgcccgggcccccaatgatgcggccaccagcacggccgatgatggtgcctacccgcccagggatgactcggccagacagatag

SEQ ID NO: 134601 - DNA, 159 bp, Artificial Sequence
  Description of Artificial Sequence: Synthetic coding sequence
atgcgtattgagggatgcataattggcttcgacgagtacatgaatctggtgctggacgacgctgaggaaattcattcgaaaactaaaagtcggaagcagctgggcaggattatgctcaagggggacaacattaccttacttcagtcagtttccaactag

SEQ ID NO: 134602 - DNA, 279 bp, Artificial Sequence
  Description of Artificial Sequence: Synthetic coding sequence
atggcttacaggggacaggggcagaaggttcagaaagtgatggtccagcctataaatttgatcttcagatatctccagaatcgaagccgcatacaggtgtggttgtacgaacaggttaatatgaggatagaagggtgtatcattgggtttgacgagtatatgaatttggtgctcgacgatgccgaggagatccacagcaagactaagagtcgcaagcagctcggacgaatcatgcttaagggagataacataacattgttacagagtgtgtcaaattag

SEQ ID NO: 134603 - DNA, 723 bp, Artificial Sequence
  Description of Artificial Sequence: Synthetic coding sequence
atgacagttgggaagagtagtaagatgctgcaacacattgactatagaatgcgctgcattttgcaggacggacgtatctttattgggaccttcaaagcattcgataaacacatgaatctgatcctgtgcgattgtgatgagtttcggaagataaaacctaagaacgcgaagcagcccgaacgcgaggagaagcgggtactcggactggtgcttctgcggggcgaaaatctggtgtctatgacagtggaggggccccccccaaaggacacaggaatcgctagagttcctctggctggggccgctggcggcccaggcgtgggtcgcgctgcaggaaggggggtccccgcaggagtgcccattccacaagccccagcgggtctggctgggccagtgagaggggtgggaggccccagtcaacaagtgatgactccccaggggcgggggacagtagcagctgccgcggtggccgcaacagctagtattgccggcgctccaacccagtatccccctggcagagggactcctccacccccggtcgggcgggctactccacctcccgggattatggcacctccgcccggcatgcggccccccatggggcctcccattggccttccacctgctcgtggcactccgatcggcatgcccccaccagggatgaggccgccccctccggggattcgcggaccacccccccccggaatgagacccccccgaccctag

SEQ ID NO: 134604 - DNA, 723 bp, Artificial Sequence
  Description of Artificial Sequence: Synthetic coding sequence
atgactgtgggaaaaagttctaagatgctgcagcacatcgactaccggatgcgctgcatcctgcaggacggacggatttttataggaacatttaaagctttcgataagcacatgaacctgatcttgtgtgattgcgacgagttccggaaaatcaagcccaaaaatgcaaaacagcctgagcgcgaggagaagagagtgcttggtttggttctgctgcgtggggaaaacctcgtcagcatgactgtcgagggccctcctccaaaggacacaggtatcgctagggtccctttggcgggcgcggctggaggccccggcgttgggcgagcagcggggagaggtgtcccagcaggggtgccgatcccgcaggcaccagccgggctggctgggcccgtcaggggagtgggaggcccgtcacagcaggtgatgaccccccagggaaggggcacagtggctgctgcagccgtggctgcaacagcgtctattgccggcgcccctacccagtacccacctggccgaggaacccctcccccgcccgtgggaagagctacccccccccccggcatcatggcgccgccccccgggatgaggcctcctatggggccccccataggactgccgccagcaaggggtactcctattgggatgccccctcccggaatgcgcccccccccccctgggatacgcggtccgcccccaccaggcatgcggccccctcggccatag

SEQ ID NO: 134605 - DNA, 723 bp, Artificial Sequence
  Description of Artificial Sequence: Synthetic coding sequence
atgaccgttggcaagagttctaaaatgctgcagcacatcgattacaggatgcgctgcatccttcaagatgggcgaatctttattggcactttcaaggcgtttgacaaacacatgaatctgatactgtgcgactgtgatgagttccggaagataaaacctaagaatgcaaaacagccagagagggaagaaaagcgcgtgctcggactggtgctcctgcgcggtgagaaccttgtgtcaatgaccgtggaagggcccccacccaaagacaccggaatcgcccgtgtgcctctcgccggcgctgcaggcgggcccggcgttggtcgggccgccgggagaggggtcccagcaggggtgccgattccacaagctcctgccggtctggccggccccgtccgcggtgtgggggggccatcccagcaagtaatgaccccccagggcagaggaacagtggctgctgccgctgtcgccgctaccgcaagtatcgccggtgcgcctactcagtacccaccaggccgcggaactcctccaccacctgtcggccgagccaccccccctcctggcatcatggcacctccccccggtatgcgcccgcctatgggtcccccaataggcctgcctccagccaggggtactccaatcggtatgccccccccaggaatgcgcccacccccgcctggcatacgtggtcccccgcctccggggatgcggcccccgcgcccctag

SEQ ID NO: 134606 - DNA, 723 bp, Artificial Sequence
  Description of Artificial Sequence: Synthetic coding sequence
atgaccgttggcaagtccagcaaaatgctgcagcacatagactaccggatgcgctgcatcctacaggacggtagaatattcattgggacctttaaagcattcgacaagcatatgaatctgattttgtgcgactgtgacgagtttcgcaaaatcaagccgaagaatgccaaacagcccgaacgagaggaaaaacgagtgttgggcctggtgctcctgagaggggagaacctggtaagcatgactgttgagggacctccaccaaaggacacgggtatcgctagggtaccgctcgccggggctgccggggggccaggggtggggcgagccgcgggaagaggtgttcctgcgggtgttccgatcccgcaagctcccgctggtcttgccggccctgtgcgaggtgtcggtggcccatctcaacaggttatgacaccacagggtagggggaccgtcgctgccgcggcagttgccgccactgcatccattgcgggggcccctacccagtacccacctggccgcggaacaccacctcctccggtggggcgcgctactcctccaccgggtatcatggctcccccccccggcatgagacctcctatggggccccccatcgggctgcctcccgcacgaggcaccccaattggtatgcctcctcccgggatgaggcccccacctcccgggatccgcggacctccacctcccggcatgcggccccctcgcccttag

SEQ ID NO: 134607 - DNA, 735 bp, Artificial Sequence
  Description of Artificial Sequence: Synthetic coding sequence
atgatggattctcagaccgtgggtaagagtagtaaaatgttacagcacatcgattatcgcatgaggtgtatcctgcaagatgggaggatctttatcggcaccttcaaggcgttcgataaacacatgaacctgattttgtgcgattgcgatgaattccgtaaaatcaaaccaaagaatgcgaagcagcccgagcgagaggaaaagcgggtgctgggactcgtgcttttgcggggggagaatctagtctccatgacggtggaggggccgccacctaaggataccgggattgccagggtccctttggcgggagccgcaggaggacccggcgtaggcagagcagctgggcgcggggtgcctgctggtgtccccattccacaggctcccgccggattggctggacctgtccggggtgtcgggggcccatcccagcaagtgatgacaccccagggccgggggaccgtggcagccgcagcggtggcggctacggcctcaatagccggggcccccacccagtacccaccggggagaggcacacccccccctccagtgggtcgggctacgccccctcccgggatcatggcacctcccccaggcatgcggcccccaatgggtccacctataggcctgccacccgcccggggaaccccgattggaatgcccccgcctgggatgcgccctcctccccctggaatccgcggacctcccccacccggtatgcggccccctaggccttag

SEQ ID NO: 134608 - DNA, 945 bp, Artificial Sequence
  Description of Artificial Sequence: Synthetic coding sequence
atgtctagagtgcctgcttttttgtccgctgcggaggtggaagagcacctgcgcagctccagcctactcattcctcctctcgagaccgctcttgctaacttctcttccggaccagagggtggcgtgatgcagcctgtgcgcaccgtggtgcctgtgaccaagcacagagggtaccttggggtgatgcccgcatatagcgccgccgaagatgcacttactacgaagctggttaccttctatgaagatcgcgggattacatcagtggtgccatcccaccaagccactgtcctcttgttcgagccaagtaatgggactctgctggctgtgatggatggcaacgtaatcacggctaagaggaccgccgcggtctctgccatcgcaacgaaattcctgaaaccaccctctagtgaagtactgtgtatcctcggggcaggtgtgcaagcatactctcactacgaaattttcaccgagcagttctccttcaaggaagtccggatatggaataggactaaagagaatgccgagaagtttgccgatacggtccagggagaggtccgggtctgttcctcagtgcaggaggccgtggcgggtgcagacgtcatcataaccgtgaccttggcaaccgagcccatactcttcggagaatgggtcaagcctggcgcccatatcaatgcggtaggagcttccaggcctgactggagagagttagatgacgaactgatgaaggaagcggtgctgtatgtggattcacaggaggctgcacttaaagagagtggcgacgtcttactgtctggcgctgagatcttcgcagagttgggagaggttattaaaggtgttaaacctgctcattgtgaaaagacaacagtttttaagtcccttggcatggctgtagaggacactgttgcagcaaaactgatttatgattcttggtcctctggcaagtag

SEQ ID NO: 134609 - DNA, 1248 bp, Artificial Sequence
  Description of Artificial Sequence: Synthetic coding sequence
atggccactgttggggagtggtcctgcgtgcggtgcacatttctcaaccccgccggccaaagacagtgctccatctgtgaggccccaagacataagccggacctgaaccacattctgcgtctgtcagttgaggagcaaaagtggccgtgcgcaaggtgcaccttccgcaactttctcggtaaagaagcatgtgaagtctgcgggttcactcccgagccagcccctggtgccgccttcctgcccgtcctgaacggggtgctgccgaagccacctgccattctcggcgagcctaagggaagttgccaggaagaggcagggccggtccggaccgccgggctagtggccacggaacccgcgcggggacagtgtgaggataaagatgaggaggaaaaggaggagcaggaagaagaggaaggcgcggcagaacctcggggaggttgggcgtgccctcggtgcaccctgcacaacacaccagtcgcaagttcctgttccgtgtgcggtggccctcgacgtctcagtctccctagaattccccctgaggccctggtcgtgcctgaggttgtggccccagcggggttccacgtggtacccgctgccccacctcctggcctgccaggggagggcgccgaagcgaaccccccggcgacatcccagggaccggccgcagagcccgaacctccaagagtgccaccattctcgccctttagcagtaccttacagaacaaccccgtgccacggtctagacgtgaagttccaccgcagctgcagccccccgtacctgaggccgcccagccctcgccctctgcaggttgtcgtggcgcccctcaagggtccggatgggctggcgcctcgcgcctggcagaactgttgtcaggcaaaagactgagtgtgctagaggaggaggctactgaaggcggaacaagtagagttgaggctggctcgtctacctcagggagtgacataattgatctggctggcgacactgtgaggtataccccagcctccccttcatcgccagatttcacaacatggtcatgtgcaaaatgtactctgcggaaccctagccctccctctctgcagcctctagggagaggccctgagtctttaccccgtgctgccggcccccgcgctgggtgcgtgcagctcgaagccggccacgggggggcccggggctccccagcagatcacgctgggcgcagacatcatcctgcacaccgagagcctaggcgcgcggccagaggcccttag

SEQ ID NO: 134610 - DNA, 270 bp, Artificial Sequence
  Description of Artificial Sequence: Synthetic coding sequence
atgagttcacagcagcaaaagcagccttgtacacccccaccgcagctacagcagcaacaagtcaagcagccatgccagcctccccctcaagaaccatgtatcccgaagacgaaggagccctgccacccaaaggtaccagagccttgtcaccccaaagtgcctgagccatgtcaacctaaggttcctgagccctgccatccaaaggtccccgagccctgcccgtccatagtaacacccgcccctgctcagcagaaaacaaagcagaagtag

SEQ ID NO: 134611 - DNA, 222 bp, Artificial Sequence
  Description of Artificial Sequence: Synthetic coding sequence
atgtcttcccagcagcagaaacagccgtgcaccccacctcctcagttacagcagcagcaggtaaaacagccttgtcagccgcctccccaagagccgtgtataccgaaaaccaaagaaccctgccaccctaaggttccagaaccgtgtcaccctaaagtgcccgaaccctgtccttctatagtaacacctgcacccgctcagcaaaagacaaagcagaagtag

SEQ ID NO: 134612 - DNA, 219 bp, Artificial Sequence
  Description of Artificial Sequence: Synthetic coding sequence
atgagctatcagcagcagcagtgcaagcaaccatgtcaacctccaccagtgtgtcctactccaaaatgtcccgaaccatgccctccgccaaaatgcccagagccctgccctcctcctaagtgtccacaaccttgcccaccccagcagtgtcagcagaagtacccacccgtgacaccgtctccaccttgccagtctaagtatccacctaaatcaaagtag

SEQ ID NO: 134613 - DNA, 219 bp, Artificial Sequence
  Description of Artificial Sequence: Synthetic coding sequence
atgtcttaccagcagcagcagtgcaaacagccctgtcagcccccccccgtgtgtcccacccccaagtgcccagaaccctgtcccccgccaaagtgtcccgagccctgcccccctccaaagtgtccccaaccatgccccccgcaacagtgccagcagaagtatcccccggtgacccctagtcccccgtgccagccgaagtatcccccaaagagtaagtag

SEQ ID NO: 134614 - DNA, 219 bp, Artificial Sequence
  Description of Artificial Sequence: Synthetic coding sequence
atgtcgtaccaacagcagcagtgcaaacaaccatgtcagcctccccctgtgtgtccaactccgaaatgtcccgaaccgtgccctccacccaagtgtccagaaccttgcccaccacctaaatgtcctcagccctgccccccccagcagtgtcagcaaaagtatcctcccgtcacacccagccctccctgccagcctaaatatccaccaaagtcaaagtag

SEQ ID NO: 134615 - DNA, 219 bp, Artificial Sequence
  Description of Artificial Sequence: Synthetic coding sequence
atgtcatatcagcagcagcagtgcaagcagccctgtcagcccccacccgtgtgccctacccctaagtgcccagaaccctgcccccctccaaagtgtcccgagccatgccccccacctaagtgccctcagccgtgcccaccgcaacagtgccaacagaaatatcctcccgtaaccccctcccccccctgtcagcccaagtatcctcccaagtccaaatag

SEQ ID NO: 134616 - DNA, 510 bp, Artificial Sequence
  Description of Artificial Sequence: Synthetic coding sequence
atgtcgagctatcagcagaaacaaacattcacccctccacctcaattgcagcagcagcaggttaagcagcccagtcagcctccaccacaggaaatctttgtgcccaccacgaaggaaccgtgccactcaaaggtgcctcagcctgggaatacgaaaattcccgaacctgggtgcaccaaggttccagaaccaggctgtacgaaagtgccggagcctggctgtaccaaagtccccgagccaggttgtacaaaggttccagagccgggctgtacaaaggtgcctgaaccaggctgcaccaaagtgcctgagcctgggtacacaaaagtccccgagcccgggtctattaaggtgcctgatcagggttttattaagtttcctgaaccaggtgctataaaagtgcccgagcagggttacaccaaagttcctgttcccggatataccaagttaccagaaccatgccctagtactgtgaccccgggtccggctcagcagaagaccaaacagaaatag

SEQ ID NO: 134617 - DNA, 510 bp, Artificial Sequence
  Description of Artificial Sequence: Synthetic coding sequence
atgagttcataccaacagaaacaaacttttacccctcccccccagcttcagcagcagcaggtgaagcagccctcccagccacccccacaggagatcttcgtcccgacaactaaagagccctgtcattcaaaggtcccccagccaggcaacacaaagatcccagaaccaggttgcacaaaggttcctgaacctggctgtactaaggtcccagagcctggatgcaccaaggtgcctgagccagggtgcactaaagtgccagaaccgggatgcaccaaggtcccggagcccggctgtactaaggtgcctgaaccgggctacacaaaggtgcccgagccaggatccattaaagtacccgatcagggatttatcaaatttccagagccaggagcgatcaaagtccctgaacagggctacacgaaggtccctgtcccagggtataccaaactgccagaaccatgtcctagcaccgtgacacccggcccagcccaacagaagacaaagcagaaatag

SEQ ID NO: 134618 - DNA, 480 bp, Artificial Sequence
  Description of Artificial Sequence: Synthetic coding sequence
atgagtagttaccaacaaaaacagacctttacaccacccccacaactacagcagcagcaagtgaaacagccctcacaacccccaccacaggagatattcgttcccacaacaaaagaaccttgccattctaaggttccacagcccgggaacacaaaaatccccgagcccggatgcacaaaagtgccagaaccaggctgcaccaaggtacccgaacctggctgcaccaaagtgccagagccagggtgcactaaggtccccgaacctggctgcaccaaagtgcccgagccagggtgtactaaagttcccgaacccgggtatactaaagtcccggagcctggctccataaaggtccccgatcagggtttcatcaagtttcccgaacccggagctatcaaagtgccggaacagggctatacaaaagtgcctgtaccaggctacaccaagttacccgagccatgtccctccacagtgaccccctag

SEQ ID NO: 134619 - DNA, 486 bp, Artificial Sequence
  Description of Artificial Sequence: Synthetic coding sequence
atgagctcctatcaacagaagcaaactttcactcctcccccccagctgcagcagcaacaagttaaacagccaagtcagccgccgcctcaggagatattcgtgccgaccactaaggagccatgccacagcaaagtcccgcagcctggaaacacgaaaatacccgagccgggctgcacaaaagtaccggaacctggatgcactaaagtgcctgagccgggctgtaccaaggtgcctgagccgggatgtaccaaggtgcccgagccagggtgcaccaaggtgcccgaacccggctacaccaaggttccggaaccagggagcattaaagtcccggaccaggggttcattaagttccccgagcctggtgcgattaaggtgccagaacagggttacacaaaagttcctgtgccaggctatacaaagttaccagaaccctgtcccagcaccgtgactcccggcccggcccaacaaaagacgaagcagaagtag

SEQ ID NO: 134620 - DNA, 10989 bp, Artificial Sequence
  Description of Artificial Sequence: Synthetic coding sequence
atgtctaggcgagcccctggcagcaggctctcttcgggaggcggaggcggggggaccaaatacccccgtagctggaatgactggcagccccgcactgacagcgctagcgccgatcccgacaacttgaagtacagctcttcccgagaccgcggtggtagctcctcctatggacttcagccaagcaactcggccgtggtgtctcggcagcgccatgatgatacacgcgtgcatgccgacatccagaatgatgaaaaaggaggatacagcgtgaatggagggagtggagagaacacatacggcagaaaatcactgggacaggagctgagggtcaacaacgttacatccccggaatttacctccgttcagcacggcagcagagccctcgccacaaaagatatgagaaaatctcaggagcgatctatgagctatagtgatgagagccgactctcgaatctcctgcgccgaattactagagaggacgatcgggatcggcgactggcaaccgtcaagcaactgaaggaattcatacagcagccagaaaacaaactggtcctggtgaaacagctggacaacatcttggcagccgtgcatgacgtgcttaacgagtccagcaaactgctccaggagttgcgacaggaaggtgcctgctgtctagggctactctgtgcctccctttcttacgaggctgagaaaattttcaagtggatctttagcaagttctcctcgagcgcgaaggatgaggtaaagctgctctacctgtgtgctacctacaaggcattggaaaccgttggagaaaaaaaggcattctcatctgtgatgcagttagtgatgaccagtctccagagcatcttagagaacgtcgacacacccgagctcctgtgtaagtgtgttaagtgtatactcttagtggcgaggtgctatccccatattttctctacaaacttccgcgacacggttgatatactggttggttggcacattgaccatacccagaaaccaagtctgacacaacaagtgtccgggtggctccagtcattggagccgttctgggtagcggacctcgctttctcaaccacattactggggcagttccttgaggacatggaagcctacgcagaagacctttctcacgtggcctccggggagtccgtggatgaagatgtgcctcctccctcagtctccctccccaagctggcagccttactgcgggtatttagcaccgtcgtgcggtcaatcggcgagaggttcagtcccataaggggtcctccgatcacagaggcgtacgtgacagacgtgctgtatcgagttatgcgctgcgtaaccgctgcaaatcaggtatttttctccgaagctgtgttgacagcagcaaacgagtgtgtaggcgtgctgcttggttcactggaccccagcatgaccatccactgcgacatggtgatcacctatgggctcgaccagctggagaattgccagacgtgcggaaccgactacataatcagcgtactgaatctcttgaccctaattgttgagcagattaacaccaagctgcccagtagctttgtagagaagctgtttataccatcgagtaagctgttattcttaagataccataaggagaaggaggtcgtggcagtcgctcacgcggtctaccaggccgtcttaagccttaaaaacatccctgtcctagaaaccgcatacaagctcatcctaggtgagatgacgtgcgcactgaataacctactgcacagtctgcagctcccggaagcttgcagcgagatcaagcacgaagcatttaaaaatcatgtttttaacgttgacaatgctaagttcgtagtgatcttcgaccttagtgccctgaccacaatagggaatgccaagaattctttgatcggaatgtgggcactcagccctaccgtcttcgctctacttagtaaaaatctgatgatcgtgcatagtgatcttgcagttcattttcccgccatccagtatgcagtgctttacaccctgtatagccattgtacccgacacgaccactttatcagctcctcactgagtagtagttccccctcactcttcgatggcgccgtcattagtacggtgacaactgcaaccaaaaaacatttttctattatccttaacctgctggggatccttctcaaaaaagacaatctcaaccaagatacccggaagctcctgatgacctgggctctggaggcagcggtgcttatgaagaaatcagaaacctacgcacccctgttctcactgcctagctttcataaattttgtaagggactgctggccaacacactggtggaggacgtgaacatttgcctccaggcgtgttcctccctgcacgcactctcctcatccctccccgacgacttactgcaacgctgtgtggacgtgtgccgcgtccagctcgtgcacagcggaacacgaatacgacaggccttcggtaagcttttgaaatcaattcctctggatgtggtcttgagcaataataaccatactgaaatccaggagatttctctagctctgcgctcccacatgtccaaagctccatcaaacacgttccatccacaggatttcagcgatgtgatctcttttatcctgtatgggaacagtcaccgaacaggtaaagacaattggctcgagcggctgttctatagctgccagcgcctggacaagagagaccagtcaacaataccgcgcaaccttctgaagaccgatgcagtactctggcagtgggccatttgggaggctgcacagttcaccgtgctgtcaaaactgagaactcccctggggagggcacaggacacattccagacaatcgagggcattatacgatcgctggctgctcatacactgaacccagatcaggacgtcagtcagtggactaccgccgacaacgacgaaggacacggcaataaccagttgaggctcgtgctgttgctgcagtatctggaaaatctcgagaaactgatgtataacgcttacgaggggtgtgctaatgccctgacgagtccgcctaaagtgatccgcacctttttctacaccaaccggcagacttgccaagactggttgactcggatcaggctgtcaattatgcgcgttgggctgctggctggacagccagcggttaccgttcggcacgggttcgatttgctcacggagatgaagaccacaagtctgtcccaggggaatgaactagaggtcaccatcatgatggtggtcgaagctctgtgtgagttgcactgccccgaggctatccaggggattgcagtgtggagctctagcattgtcggaaaaaatctgctgtggatcaattccgttgctcagcaggccgagggccggttcgagaaggcctctgtggaatatcaggagcacctgtgcgcaatgacaggcgtagactgttgcatcagctctttcgataaatcggttttaactctggctaatgccggccgtaattccgcttcccccaagcacagccttaacggtgaatccagaaagacggtgctgagcaagcccactgacagttcgcccgaggtgattaactacctgggaaataaggcctgtgagtgttacatcagtatagccgactgggctgccgttcaggaatggcaaaacgccatccatgatctcaaaaagtctacctcatctaccagcctcaatctcaaggccgacttcaactatattaagtctttaagttctttcgagagcggcaagtttgttgagtgtacagagcagctggaactgctgccgggcgagaacatcaatctccttgcaggaggatctaaggagaaaattgatatgaagaagctgctgcccaatatgctgtcccccgacccccgcgagctccagaagtcgattgaagtgcaacttctccgtagtagcgtttgccttgcaaccgccttaaatcctatcgagcaggaccaaaaatggcaaagcatcacggagaatgtcgttaagtatttaaaacagactagtcgtattgctataggaccgttgcgcctctccactctcacagtgtcgcagtcgctgcccgtcctttccacgctgcagttatattgctcttctgctctcgagaacaccgtgagtaacagattgtctactgaagattgcctcatccctctcttttccgaggcgctgcggtcctgcaaacagcatgatgttagaccttggatgcaggcgctgaggtatacaatgtaccagaaccagctccttgagaagatcaaggagcagacagtgcccatacggtcccaccttatggagcttggattgactgctgctaaattcgcacgtaaaaggggaaatgtgtccctcgcaacccgccttcttgcccaatgcagcgaagtgcagttaggcaaaacaaccacggcgcaagatcttgtacagcactttaaaaagctgtccactcaggggcaggttgatgagaagtggggacccgaactggatatagagaaaaccaagttgctttataccgctggacagagtacacacgcaatggagatgctgtccagctgcgcaataagcttttgtaaatccgtgaaagccgagtacgctgtagctaaaagcattctgacgctggccaagtggattcaggccgaatggaaagagattagtggccagctaaaacaggtataccgcgcccagcatcagcagaacttcaccggactcagcacattgtctaagaatatcctgacactaatcgagttgccatcggttaacactatggaggaggaatacccacggatagagagcgaatcgaccgtacatataggggtgggcgagcccgattttatcctgggacagctgtaccacctttcttctgttcaagcacccgaagtggccaagtcttgggccgccctcgcaagttgggcctaccgctggggacgcaaggtggtggacaacgcctcacagggcgaaggcgtgagactgctccccagggagaagtccgaggtccagaatctgttgcccgatacgattactgaagaggagaaggagaggatctacggcatactgggccaggccgtatgtcgcccagcaggtattcaggatgaggatattactttgcagataaccgagtccgaggataacgaggaagatgatatggtagatgttatctggaggcagctaatttcctcctgcccctggctctccgagcttgatgagagtgctacagagggcgtcatcaaggtctggaggaaagtggtcgacaggatcttctcactgtataagctgtcatgctctgcttacttcactttcctgaagctgaatgctggacagatccccctggacgaggacgacccacgactgcatctgagccaccgggtggaacagtcaaccgatgacatgattgtgatggccacactacgactgctccggttgctggtaaagcacgccggcgagttacgccagtatttagagcatggactcgaaaccaccccaactgccccttggaggggtataatccctcaattattttccagactgaaccatcccgaagtttatgtacgccagagcatttgcaacttactgtgtagggtggcccaggactcgccacacctgatcttataccccgcaatagtggggacaatttccctgagcagtgaaagccaagctagcggcaataaattctcaactgcaatccccacattattaggcaacatccagggcgaggagctgctagtatcggaatgcgaaggcggctcaccaccagcgagtcaagatagcaataaggacgaaccaaaatccggactaaatgaggatcaagcaatgatgcaagattgttactcaaagatcgtggacaaactcagcagcgcaaatcccaccatggtactgcaggtgcaaatgcttgtggctgagttgcggcgcgtcaccgttctttgggacgaattatggctcggcgtgttgcttcagcagcacatgtacgtcctgaggcgaatccagcagttggaagatgaagtcaagcgcgttcaaaacaacaacactctacgaaaggaggagaaaatcgccataatgcgagagaagcacactgctctgatgaaacccattgtattcgcactcgagcatgtaaggagtatcaccgctgcacccgcagaaacccctcacgaaaagtggtttcaggataattatggggatgccattgagaatgcgcttgaaaagctcaagacccccctcaaccctgctaaaccagggagtagctggattcctttcaaagaaatcatgttgagcctccagcagagagctcagaaacgagcctcctatatactccggctggaggagatctccccttggctggctgccatgaccaataccgagatcgctctcccaggagaggtgagtgcccgtgatactgtaaccatccatagtgtcggaggaaccatcacaatcctccctaccaagactaaacccaaaaagctacttttcctgggcagcgacggtaaatcatacccctatctgttcaaggggttagaggaccttcatctggacgagcgcatcatgcaatttttaagcatagtgaacaccatgttcgcaactataaatagacaagaaacaccacgatttcacgctcggcactactcggttacgccacttggcaccagaagtggcctgattcagtgggtggacggcgcgacacccttgttcgggctgtataaacggtggcaacagcgggaagcagcccttcaggcccagaaagcccaggattcctaccagactccccagaatcctggcatcgtgcctaggccaagcgaactgtactactcaaagatcggcccagcccttaagactgtgggcctctctctcgacgtctcacggcgggactggccattgcatgtgatgaaggccgtcctggaagaacttatggaagccactccccctaatttgctggccaaggagttgtggtccagttgtaccacacctgatgagtggtggcgcgtgacccaatcatacgccaggtctaccgcggtcatgtctatggttggctacatcatcggtcttggggacagacacctcgataatgtgctgatcgacatgactacaggggaggttgtgcatatcgactacaatgtttgcttcgaaaaaggcaagtcactgagggtcccagagaaggtgcctttcagaatgacacagaacattgaaactgcacttggggtgaccggagtggagggggtgtttcggctgtcatgtgagcaagtgctgcacatcatgagaagaggtcgcgagaccttgctgacactgctggaagcattcgtatacgaccctctcgtggattggactgccggtggtgaggcaggttttgctggggccgtttatggcggagggggccagcaagcagagagcaaacagagtaaaagggagatggaacgagagatcacgaggagtcttttttcctccagagtcgccgaaatcaaggtgaactggtttaaaaaccgggatgagatgctggtagtgctgccgaaactggacggctctctggacgaatacctgagccttcaggagcaacttaccgatgtcgagaagctgcagggaaagctcctggaggagatcgagttcttagaaggggctgagggcgtggatcacccttcccatactctacagcatagatactccgagcacacccagttgcagacccagcaaagggccgtgcaggaggcaattcaggtaaagctgaacgagttcgagcagtggattacacattatcaggccgcttttaacaatctggaagcgacccaactagcaagcttgctgcaagaaatctccacacagatggatctgggcccgccgtcttatgtccccgctaccgccttccttcagaacgcggggcaggcccacttgatttctcagtgtgaacaactggagggggaggtgggagctctgctgcagcagcgtcgctcggtgctccgaggttgccttgaacagttgcatcactacgcaaccgtggccctgcagtatcctaaagccatctttcagaagcaccgaatagagcaatggaagacatggatggaagagctcatctgtaatacaacagtcgagcgatgtcaggagctttatcgtaagtacgagatgcagtatgcaccccagccaccacccacggtctgtcaatttattacagcaactgagatgaccttacagcggtatgccgcggacatcaatagccgtctgattcgccaggtcgaacgcctgaagcaagaggccgtaacagtgccagtgtgcgaagatcagctgaaggagatcgaacggtgtatcaaagtttttctgcacgaaaatggggaggagggaagccttagcctagcctctgtgataattagcgccctttgtacgctgactcggaggaatctaatgatggaaggcgctgcatctagcgctggcgagcagttggtcgatctcacgagccgagatggggcatggttcctggaggaactgtgttctatgtcaggaaacgtgacctgcctggttcagctgctgaagcagtgtcacctggtgccgcaggacctggatatcccaaaccctatggaggcatctgagactgtgcatttagccaacggagtctatacctcacttcaggagctcaatagtaactttagacagattatcttccctgaggccctacgctgcctcatgaagggagaatacaccctcgagtcaatgttacatgaactggacgggcttatcgagcaaacaaccgatggcgtgccccttcagaccctagtggagtccctgcaagcatacttgcggaacgctgccatggggctggaggaggagacccatgcacattacattgatgtggcacgtctgttgcacgcccaatatggcgagctgatacagccccgcaacggttcagtagacgagacgcctaaaatgtctgccggccaaatgctgctggtggcgtttgacggcatgtttgcccaggttgagactgcatttagcttgttagtcgagaaactgaataaaatggaaatcccaatcgcctggaggaaaatcgatatcatcagggaggctaggtctacacaggtgaactttttcgatgatgacaatcatcggcaagtgctcgaagagatcttctttctgaaacggctgcagactatcaaggaatttttccgcctgtgcggcacgttctcaaaaaccctctcaggctctagttctctggaggatcagaatacagtgaacggtcccgtgcagatcgttaacgtaaaaacgctgtttagaaatagctgtttcagtgaggaccaaatggctaagccgatcaaagccttcacggcagattttgtacgtcaactactgataggactcccgaatcaggctttaggcctgacactgtgttcttttatctctgcactgggggtggatataatcgcccaagtagaggcgaaggattttggagccgagtctaaggtttcagtggatgacctgtgtaaaaaagcagtagaacataacatccagatagggaagttttcgcagttggtgatgaaccgggcaacagtgttggcctccagctatgacaccgcctggaagaaacatgaccttgtgcggcggctggagacatcaatctcttcatgtaagacttccctgcaacgcgtgcagctgcacattgccatgtttcaacagtggcagcatgaagacctgttgataaaccgacctcaggcaatgagcgtgaccccccctcctaggagcgccatcctgacgtccatgaaaaaaaagttgcacacgctcagccagatagagacctcaatcgccaccgtccaggaaaagctggccgccctcgaaagcagcatcgaacaaagactcaagtgggctgggggagcgaacccagccctggcccctgtgctgcaagattttgaggctacgatcgctgaaagaaggaaccttgtgcttaaggagtcccagagggccagccaggtgacattcctctgttcgaacatcatccactttgagagtctgcggactcgaacagcagaagccctgaatctggacgccgccctattcgagcttatcaaacgatgccagcaaatgtgctcttttgcgtctcagtttaatagttccgtcagtgagctggaactgcggcttctccagagggtggacactggacttgagcacccaattggctccagtgaatggctgttgtctgcgcacaaacaactcacacaggacatgtcaactcagcgggcaatacaaacggaaaaggagcaacagattgagaccgtgtgtgagacaatccagaatcttgtggataacataaagaccgttttgaccggacacaataggcaattgggggatgttaaacacttactgaaagccatggctaaagacgaagaggctgcacttgccgatggcgaagatgtcccatacgaaaactcggtaaggcagttcctgggagagtacaaaagctggcaagacaatatccagaccgtgctgttcactctggtgcaagctatgggacaagtacggagtcaggagcacgtcgagatgctgcaggagattacacccaccttgaaggagctgaagacacagtcccagagcatctataacaatttggtgagcttcgcgtccccactcgtcaccgacgccactaacgaatgcagctcacctacttcatctgctacttaccagcctagctttgccgctgctgtacgctctaatacaggccagaaaacccaacctgatgtgatgagtcagaatgctaggaagctcatccagaaaaatttagctacttctgccgatacccctccaagtacagtgcctgggacaggaaagagcgtggcctgcagccctaagaaggccgtcagagatcctaaaactggtaaggctgttcaggaacgcaactcctatgctgtgagcgtgtggaagcgggtcaaggccaagcttgaaggccgggatgtggatccaaatcgcagaatgagcgtggccgaacaagtggattacgtcatcaaagaagcgactaacctggataatttggcccagctgtacgagggctggacagcatgggtgtag

SEQ ID NO: 134621 - DNA, 10986 bp, Artificial Sequence
  Description of Artificial Sequence: Synthetic coding sequence
atgagccggcgcgctcctggaagccgcctgtcgtcaggggggggcggaggcggaactaagtaccctcgcagctggaatgactggcagccccgaaccgattctgcatctgccgaccctgacaacttaaagtactcttccagcagggaccgcgggggatcatcttcttacggtctccagccaagcaattccgcagtagtgtcaaggcagcgccacgatgacactcgggtccacgccgacatccagaacgatgagaagggcgggtactctgttaatggcggttccggggaaaatacatacggccgaaagagcttgggacaggagttgcgcgtgaacaacgtgaccagtccggaatttacctcagtacaacacgggtcaagggccctggctacaaaggacatgcgcaagtcccaggagcggtctatgtcatactccgacgaatcccgtctgagtaatttactgcgcaggatcactagggaggatgaccgagatcgacgccttgccactgtcaaacagttaaaggagttcattcagcagccagagaataaattggtactggtgaagcagctcgacaatatcctagcggctgtacacgacgttctgaacgagtcatcgaaacttctccaagagctgcggcaggaaggggcctgctgccttggcctgctctgtgcgtccttgtcttacgaggctgagaagatcttcaaatggatcttttccaagttctcctccagtgctaaggatgaagtgaagttgttatacttatgtgccacgtacaaggccctggagaccgtgggcgagaaaaaagccttcagtagcgtgatgcaacttgtgatgacctccctacaatctattctcgagaatgtcgataccccggagctcctgtgcaagtgcgtgaagtgcattcttttagtcgcccgatgttatccccatatattctctacgaacttccgagacacagtggacatcctggtaggttggcacattgatcatacccagaaaccttcgttgacccagcaagtttcgggctggctacagagcctggagccgttctgggttgctgaccttgccttctcgaccacacttctggggcaattcctggaggacatggaggcctatgccgaagatcttagccacgtggccagtggagaaagtgtggacgaggatgtgccccccccgagtgtgtctctgcccaagttggcagcgctgctgagggtgttctccactgtggtccgtagcataggcgaaagattctcaccaatcagggggcctcctataaccgaggcatatgtgacagacgtcttataccgggtaatgagatgcgttactgctgcaaaccaagtgtttttctcagaagccgtgcttaccgctgctaacgaatgtgtgggggtcttgctcgggtcacttgatccaagtatgacaatccactgtgatatggtaatcacttacggcctggatcagctcgagaactgccaaacttgtggaactgattacatcatatcagtcctgaatctgttgacactcattgtcgaacagatcaatactaaactcccttcgtcatttgtggagaagctgttcattccctcttccaagttactattccttcgctatcataaagagaaggaggtggttgctgtcgctcacgcggtctaccaagcggtgctctcgctcaagaacattcccgtgctcgaaactgcctataagctcatattaggcgaaatgacttgcgccctcaacaacctactgcattcactgcaactgcctgaggcctgctccgaaatcaaacacgaggcttttaagaaccacgtgttcaacgtggataacgccaaatttgtcgttatttttgacctgagtgcccttacaacaatagggaatgctaagaactcattgattgggatgtgggcgctaagccctaccgtgtttgctcttctcagcaagaacttgatgatcgtccattctgacctcgcagtgcacttcccagcaatccagtatgcggtcttgtatacgctgtatagtcattgtacaaggcacgatcattttatttcctcaagtctgtcttcctcctccccctcactgtttgacggcgcggttattagtaccgtgaccaccgccacaaaaaagcacttctcaattattctaaacctgttggggatcttgctcaagaaggataacctcaaccaagatacccgtaagctactgatgacatgggctctggaggcggccgtgctaatgaaaaagagcgagacctacgcacccctgttctctcttcccagctttcacaaattctgtaaaggactgcttgctaacacgctcgtcgaagacgtgaacatctgcttgcaagcctgcagctcactgcatgcactctcttcatcactccccgatgacctgctccagagatgtgtggatgtgtgtcgcgtgcaacttgtgcatagtggcacaaggataagacaggccttcggcaaactactgaaatcaatcccgctggatgtcgtgctgtctaataacaatcatacggaaattcaagaaatttcactggcgttacgatctcacatgagcaaggccccgtccaacactttccacccacaggacttttcggacgttataagctttatcttatacggaaactcacatcgcacaggaaaggacaattggttagaacgccttttttactcatgccagcggctggataaacgggaccaaagcacaatcccccgcaatctgcttaaaaccgacgcggtgctttggcaatgggccatctgggaggccgcccagttcaccgtgctgagcaaattgcgcaccccactgggccgggcccaggacactttccagactattgagggcatcatccgcagcttagcagctcatacacttaaccccgatcaggacgtcagtcagtggaccaccgccgataacgacgaggggcacggtaacaatcagctcaggctggtccttctgctccaatacctggaaaacctggaaaagctgatgtacaacgcgtacgagggatgtgcgaacgctctaacatcgccccccaaggtaattaggacattcttttatactaatcggcagacatgccaggattggctgaccaggattcgattgtcaatcatgcgggtcggccttctggccggacaaccggctgtgactgtacggcacggatttgatttgctgaccgagatgaagacgacatcattgagccaaggcaacgagctcgaagttactatcatgatggtcgtggaggcactgtgcgagctccactgtccggaagctatccaaggcatcgcagtttggtcatccagcatagtgggtaagaatctgctctggatcaactccgtagcccagcaggccgaggggcgctttgaaaaggcttccgtggaataccaagaacacctgtgtgccatgactggggtggactgctgcatctcctccttcgacaagtccgtgcttaccttggcaaatgccgggcgcaactccgcctcacctaagcactcgctcaacggtgagagtaggaaaacggtcctgtcaaagcccaccgacagttctccggaggttatcaattatctgggcaataaggcctgcgaatgctacatatcgattgctgattgggccgcagtccaggaatggcagaacgcgattcacgatctcaaaaagagtacttcatccaccagcttgaatcttaaagcagacttcaactacatcaagtccctgagctcgttcgagtcagggaagtttgtggagtgtactgagcagctggagctcctgccaggtgagaatatcaatctgctcgctggaggatcaaaggaaaagatcgatatgaagaagctattgcctaacatgttgagtcccgatcccagggaactccagaaaagcatagaggtgcagttgctgcggtccagcgtatgtcttgctacagcccttaatccaattgagcaggaccagaagtggcagtctatcactgaaaacgtggtgaagtatctcaagcagacgagtagaattgctatcggaccgctgcgattaagcaccctcaccgtgagccagtccctgccggtcttgagcacacttcagctgtattgcagcagcgccctggagaacacagtttccaaccgactgtctacggaagactgcctgattcctctttttagcgaggcactgaggtcgtgtaagcaacatgatgtacggccatggatgcaggctctgcgctatactatgtatcaaaatcagctgctagagaaaatcaaagaacaaaccgtgcccatcaggagccatctaatggagttagggctcactgccgctaaattcgcaagaaaaagggggaacgtatccctggccacccgattattggcccaatgcagtgaggtgcagctgggaaagacaacaaccgcacaggacctggtgcagcactttaagaagctatcaacacagggccaggtggatgagaaatgggggccagagctcgacatcgagaagacaaagctgttgtacactgccggccagagtacccacgccatggaaatgcttagtagctgcgcaatctcgttctgtaagtcggtgaaagcagagtacgccgttgctaagtccatcctgacattagctaaatggattcaggctgaatggaaagaaataagcggtcagctgaagcaggtgtatagagctcaacatcaacagaatttcaccggcttgtccacactgtccaaaaatatcctcaccctgatcgaactcccgagcgttaacactatggaggaggagtatcccaggatcgagagcgagagtacggttcacattggggtcggagaaccagacttcattctcggccagctgtatcacctgtccagcgttcaagcgccggaggtggctaaaagttgggcagctctagcgtcctgggcataccggtggggccgtaaagtagtggataacgcaagccagggagagggggtccggctattgcctcgcgaaaagtctgaagtgcagaacctcctgccagatactatcaccgaggaggaaaaagaacgcatatacggtatcctgggacaggcagtctgcagacccgccggcattcaggatgaggatataacattgcaaattacagagagcgaagataacgaggaggacgatatggtggatgtgatatggcgacaactcattagtagctgcccctggctttctgagctggatgaatccgccaccgaaggagtgattaaagtctggcgcaaggttgtagataggatcttcagcttgtacaagctgtcctgtagtgcatacttcacattccttaaattgaacgccggacagatccccctcgacgaggacgatccgagactgcatctgtcacaccgggtcgaacaaagtaccgatgacatgatcgtaatggccactttacggctgctccgactgctcgtcaagcacgctggtgaactgaggcagtatttggaacacggactcgagaccacacccacagccccctggcggggcattattccgcagctcttctctcggcttaaccaccctgaggtttacgtgcggcagagcatctgtaatcttctctgccgtgtcgcacaggacagcccgcatctcattctatatcctgcaatcgtgggcaccattagccttagctccgagtcccaggctagcggcaataagtttagtactgcaattccaaccctgctagggaacatccagggcgaggagctcctggtgtccgagtgcgagggcggctccccaccggcatcacaggactcgaataaggatgagccaaagtctgggctcaacgaagatcaagcaatgatgcaggactgttattccaaaatagtggacaagcttagcagtgctaatcctactatggtgctgcaggtgcagatgcttgtggcagaattgaggcgggtgacagtgttatgggacgaactttggctgggagtgcttctgcagcaacacatgtatgtgctgaggaggattcagcagcttgaggacgaggtcaaaagagtacagaataataatacactcagaaaggaggaaaagatcgcaattatgagagagaaacataccgccctgatgaaacccatcgtgttcgccctggagcatgtcaggagtattactgccgcacccgccgaaacccctcatgagaagtggttccaggacaactacggagacgcaatcgaaaatgcgctggaaaaacttaaaactcctctcaatccagcgaaaccaggcagctcatggattccattcaaggaaattatgctctcgcttcaacagcgcgctcagaaacgggcatcctacattctgaggctagaagaaatcagtccctggctcgctgctatgacgaacaccgagatagctctgccaggcgaagtgtcagccagggataccgtcacaatacatagtgtggggggcacaatcactattttacctactaaaacaaaacccaaaaagctgctgtttctaggttcagatggcaaaagttatccgtaccttttcaagggcctcgaagacttgcatctggatgagcgcattatgcagttcttgtctattgtcaataccatgttcgcgaccatcaatcgccaagaaacccctcggtttcacgctcgacactactccgtgactcccctagggacgaggtcggggctcatccagtgggtggatggtgccactccactgtttggtttgtacaagaggtggcagcaacgagaagcggcattacaggcccagaaggctcaggactcctatcagaccccacagaatccagggatagttcctcggcctagtgaattatattatagtaaaatcggccctgccctgaaaaccgtcggcctgtcactggacgtgtctcgccgagattggcctctccatgttatgaaggctgtcttagaggagctcatggaggctactccccccaaccttctggctaaggagctgtggagttcttgcacgactcccgacgagtggtggcgggtaactcaatcatacgccagatccacagctgtgatgtccatggtgggctatattatcggccttggcgatcggcaccttgacaacgttttgattgacatgacgacaggagaggttgtgcacatagattataatgtttgctttgagaaagggaagtctcttagggtgcctgaaaaggtacctttccgcatgacacagaacattgaaaccgcactcggggttacaggcgtggaaggtgtattccgtctttcctgcgaacaggtgctgcacatcatgcggcgagggcgcgaaacacttctcaccctgttagaagcttttgtttatgatcctctcgttgattggacagccgggggcgaagcaggattcgccggagctgtgtacggaggtggaggacagcaggcagagagcaaacaatctaaaagagaaatggagcgggagattacccgctccctgttctcttcccgtgtggccgaaattaaggtgaactggttcaaaaacagagatgagatgttggtggtcctgcctaagttggacgggagtttagacgagtatctctctctgcaggagcagctgactgacgtggaaaaactccaggggaagttgctggaggagatcgagtttctcgagggggctgaaggggtagatcacccgtctcatacattgcagcatcggtattctgaacacacacagctccagacccagcaaagggcagtccaggaggccattcaagttaagctgaacgaatttgagcagtggatcacccactatcaggcagcttttaataacctagaggcaacccagctcgcttctctgctgcaggaaatcagtacccagatggacttgggtccaccaagctatgtccccgctaccgcatttttgcagaatgcaggtcaggctcacctgatctctcagtgcgagcaactggagggagaagtcggagccctattacaacaacgccgctccgtcctgcgggggtgcttggaacaattacatcattacgctacagttgccctgcagtacccgaaggccatcttccagaagcaccggatcgaacagtggaaaacttggatggaagagttaatctgtaacacaaccgtggaaaggtgtcaggaactctatcggaagtacgagatgcagtatgcgccgcaacctccaccgactgtgtgccagttcatcacagccaccgagatgacactgcagcggtacgccgccgacatcaactccagacttataagacaggtcgagagactcaaacaggaggcagtaaccgtgcctgtctgcgaggaccaattgaaagagatagagagatgcatcaaggtgttcctgcatgaaaacggtgaagagggaagtctttccctggcttcagtgattatcagtgccttatgcacactgacccgcaggaacctgatgatggaaggcgccgccagttcggctggggagcagttagtggatttgaccagtagagatggcgcctggtttcttgaagaattgtgcagtatgtctggcaatgtgacctgcctggtgcagctgctgaaacagtgtcacctggtgccccaggacctcgatattcccaatccaatggaagcatctgagactgtgcacttggcgaatggggtatatacgtcactgcaggagctgaactccaactttagacaaattattttccctgaagccttgaggtgcctcatgaagggtgagtacacactggagtcaatgctgcacgaactagacggactgatcgagcagactaccgacggcgtacctctgcagactctggtggagtcactccaggcttacttgagaaacgctgccatggggcttgaggaggaaactcatgcacattacattgatgtggccaggctactgcatgcgcagtatggagagctgattcagccccgcaatgggtctgtggatgagactcccaagatgtctgccggtcagatgctcctcgttgcattcgatggtatgttcgcccaagtagaaacagctttctccttactggtagagaaattaaacaaaatggagatcccaatcgcctggcgcaagattgacatcattagagaagctaggtctacccaggtaaacttctttgatgacgataaccacaggcaggtgctcgaagagatctttttcctcaaacgactccagactataaaagagtttttccgattgtgtggcacattctctaagaccttgtcagggtcaagctctctcgaggatcagaacaccgtgaatgggcccgtccagatcgttaacgtgaagaccctctttcgtaacagttgcttctcagaagaccagatggctaaacctatcaaggccttcacagctgattttgtgcgccaattacttattgggctgcctaatcaggccctgggactcaccctttgttcttttatctcagcactgggggtcgacattatagcgcaggtagaagctaaagactttggcgccgagtctaaagtttccgttgacgatctctgcaagaaggcagtggagcacaacattcagataggaaaattcagccaactagtgatgaatagagccacggtcctggctagttcctacgatacagcatggaagaagcatgacctggtgcgtagactggagacttctattagctcctgtaagaccagcctgcagagggtgcaactccatatagctatgttccagtggcagcacgaagatcttttaatcaacagacctcaagccatgagcgtgacccccccccccaggtcagccattctgaccagcatgaaaaagaagctccacactctgtcccaaatagagactagcattgccacggtccaagaaaagctggcagcattggagagtagtatcgaacagcggttaaaatgggccggaggtgctaatccggccctagcccctgtcctgcaggattttgaggcaactatcgccgagagaaggaacctggtcctgaaggagagccaacgtgctagtcaggtgacttttctgtgctccaatattatccacttcgaatctctgaggacccgaacggctgaagctctcaacttggatgctgcgctgtttgagctgatcaagcgctgtcaacaaatgtgctcttttgcaagtcagtttaactctagcgtgagcgaactggagctccgattactccaacgtgtcgacacaggtctggaacaccccatcgggtccagtgagtggctgctgtccgcacacaagcagctgacacaggacatgtctacgcagagggccatccagactgaaaaggagcagcagattgaaactgtctgcgagactatccaaaaccttgtcgataatattaaaactgttctcactggtcacaacagacagctgggggacgtgaagcatctgctcaaggctatggcaaaggacgaggaggcagctctggcggatggcgaggacgtgccctacgaaaattccgtgcgtcagtttctgggggaatacaaatcatggcaggacaatatacagaccgtgctgttcaccctggtgcaagccatggggcaggtcagatcgcaggaacatgttgagatgctccaggagatcacccccacattgaaagagctgaagacccagtcacagtccatctataacaatctggtttccttcgcctcccccctggtgactgacgccaccaacgagtgcagcagtcctacaagcagcgccacgtaccaaccttcctttgcagcagcagttagaagcaacaccgggcagaagacacaacccgatgttatgtctcagaatgcacggaagctcatccaaaagaatctagctacgtccgccgacactccgccttccaccgttccgggtacgggtaagagcgttgcatgttcccccaaaaaggcggttagagaccccaagactggtaaggcagtccaggaacgcaacagctacgctgtgtccgtttggaaaagagtgaaggccaagttagagggtagagacgtggatccaaacaggcgaatgtcagtggccgagcaggttgattacgtgatcaaagaagccacaaacctggataacctcgctcagctctatgagggctggacggcttgggtctag

SEQ ID NO: 134622 - DNA, 3051 bp, Artificial Sequence
  Description of Artificial Sequence: Synthetic coding sequence
atgagccagggcccgcccactggtgagtcctctgagcctgaagcaaaggtattgcataccaaacggctctaccgggcggtcgtcgaggcagtccaccgactggacctcatcctttgcaataaaacagcctaccaggaggtattcaagcccgagaacatttcgttgcggaataagttacgcgagttatgcgtgaaattgatgtttctgcacccagttgactacggcaggaaagccgaagaacttctttggaggaaagtatattatgaggtcatacagctgatcaagaccaacaaaaaacacatccactctaggtccacgttagaatgcgcctataggactcacctggtggccggcatcggcttctaccagcatctgctactgtacatacagtcccattaccagctggaacttcaatgctgcatagactggacgcacgtgacggatccattaatcggatgcaagaaacccgtctcagcttctgggaaggagatggactgggctcagatggcctgccaccgttgtttggtataccttggagatttaagtcgttatcagaatgagctggctggcgttgacacagaactgctagctgagagattctactaccaggctctatctgtggcccctcagataggtatgcctttcaatcagctggggactttagctggatcaaaatactacaatgttgaggcaatgtattgttatctgcggtgtatccagtccgaagtgagctttgagggtgcttatggaaatcttaagcgcttgtatgataaggcagctaagatgtaccatcagctcaaaaaatgtgaaacacgcaaactttccccaggcaaaaagaggtgcaaggatatcaagcggttgctcgttaatttcatgtacctgcagtcactgctacagccaaagtcaagctccgttgattctgaactgacctctctttgccagtctgtactggaggacttcaacttgtgcctcttttacctgcccagttcccccaatctgagcttagcctctgaggatgaagaggagtacgaatccgggtatgccttcctgccggacttacttatttttcaaatggtgattatttgcctgatgtgcgtgcacagtctggagcgggccggaagcaagcagtactctgccgcaatcgccttcacactcgcgcttttttcccacctggtgaaccacgtgaatataagacttcaggccgagttagaggaaggagagaacccggtgcccgcatttcagagcgacggcacagacgagcccgagtccaaagagcctgttgaaaaggaggaagagcctgatcctgagcctcctcccgtcacacctcaggtcggagagggaaggaagtctaggaaattttctagactgtcctgtctgcggcggcgtagacaccctcccaaagtgggggacgattccgatctgagcgagggctttgagagtgattcctcccatgacagtgcaagagcctctgaaggaagcgactctggctccgacaagtcgcttgaaggcggaggcacagccttcgacgcagaaacagattcagaaatgaactcccaggaatcccgttccgacctcgaggacatggaagaggaagaaggcactaggagtcccacgctagagccaccgcggggacgctctgaagcaccagatagccttaacgggcctctgggcccttccgaggcctcaatagcttctaacctgcaggctatgagcacgcagatgttccaaacaaagcgatgctttcgcctcgcccccactttttcaaacctgctgctgcagcctactacgaaccctcacacaagtgctagccaccgcccatgcgtcaatggcgacgtcgataaaccctcagaacccgcctccgaggagggttcagagtcagaagggtccgaatcctcaggtcgttcctgcaggaatgaaagatcaatacaagagaagttacaggtgctcatggctgaaggactgttgcccgccgtgaaggtgttcctggactggcttcggacaaatcccgacctcatcatagtttgtgcacagtcttcccagtccttgtggaatagactgtccgtcctcttgaatcttctgccagcagcaggagaattacaggaaagcggattggccttatgtcctgaagtgcaggacctcctcgagggctgcgagctgccggatttaccgagctcactgctgctgccagaagatatggccttacggaacctgcccccactgcgcgccgcccaccggcggttcaatttcgataccgatagacctctcctcagcacactcgaggagtcagtggtgagaatttgttgcataaggtcctttggccactttatagctaggctgcaggggtcgatattgcagttcaatccggaggtgggcatcttcgtgtcaatcgcccagagtgagcaggaaagtctgctccaacaggcccaggcacagtttaggatggcccaagaagaagcccgccgcaataggctgatgcgcgacatggctcagctgagactgcagttagaagtgagccaactcgagggcagcttgcagcagcccaaggcccagtccgccatgtcgccttacctggttcctgacacacaggcactctgccaccatcttccggtgatcaggcagctggccaccagcggacggttcatcgttatcataccgaggaccgttattgacggactggatctactgaagaaagaacaccctggagctcgtgacggcatccgctacctagaggcagagtttaagaaaggaaatagatatattcggtgccagaaagaggtgggaaagagcttcgaacggcacaaactgaagaggcaggacgcagacgcttggacactgtacaaaattcttgattcctgcaagcagcttaccttggcgcagggtgccggtgaagaagacccatccggcatggtgaccattataacaggcctaccactggacaaccccagtgttctcagcggaccaatgcaggccgccttacaggccgcagcccacgccagcgtggacatcaaaaacgtcttagacttctacaaacagtggaaagaaatcggatag

SEQ ID NO: 134623 - DNA, 1125 bp, Artificial Sequence
  Description of Artificial Sequence: Synthetic coding sequence
atgagtcagggaccaccaacaggcgaatcgagcgaaccagaggcaaaagtactgcacaccaagcgcctgtaccgggcagtcgtggaagcagttcatcgccttgatctgatcctgtgcaataagaccgcttaccaggaagtgttcaagcccgaaaatataagcctgcgcaacaagctgcgggaattgtgcgtgaagctgatgtttctgcatcccgtcgattacggaaggaaagccgaagagctgctgtggcggaaagtgtactacgaggttatccagcttattaagacaaacaagaagcacatccacagccggtcgaccctggaatgcgcctaccggacccatctggtggcagggatagggttctaccagcatctgcttctttatattcagagtcactaccagcttgagctgcaatgctgtatcgactggactcacgtgaccgatccactgatcggttgcaaaaagccagtctcagcctccggtaaagaaatggattgggcccagatggcttgccatcgctgccttgtgtacctgggggacctctccagatatcagaatgagctcgcgggggtggataccgagttactggccgagaggttctattaccaggctctgtcggtcgccccacagataggcatgccatttaaccagctgggcaccctcgcaggttcgaagtattataatgtggaggctatgtactgctatcttaggtgcattcagagcgaggtcagcttcgagggtgcttacgggaatttgaagcggctctacgataaagccgcaaagatgtaccatcaactgaagaaatgcgagacgaggaagctgagccctggcaagaagcgctgcaaggacataaaaagattgctcgtgaatttcatgtatctgcagagcttactccagcccaagagtagaggatgcacttctcactgtcccacttctgccctgtgcttgcccctgtctagcttccagggtagagaacaggctcccccccgggcggcaggctccctagcttgcgccagcacggtctcttgcgcccaccagccgcataggtgttgtgctctctgctcgtggctgctatgctgggaccgcatgggctgtcaagaggagaagaagggcggcgccgtgtag

SEQ ID NO: 134624 - DNA, 417 bp, Artificial Sequence
  Description of Artificial Sequence: Synthetic coding sequence
taatttatcgtgattattccacgcactgttattgatggtctggatctcctcaagaaggaacaccctggcgcacgagatggtatacggtacttggaagctgagtttaagaaagggaaccgctacatacgatgtcagaaagaggttgggaagagtttcgaacgacataaacttaaaaggcaagacgccgacgcctggactctatacaagatccttgactcttgcaagcagctgacactcgcccagggtgccggggaagaagacccaagcggaatggtgaccattatcacaggcctacccttggacaacccctccgttctgtccggacccatgcaggccgctctgcaggcagcagcccacgcatcggtcgacatcaagaacgttcttgacttctataaacagtggaaggagattgggtag

SEQ ID NO: 134625 - DNA, 3438 bp, Artificial Sequence
  Description of Artificial Sequence: Synthetic coding sequence
atgctcgtgaccgatctcgaatacgcactggataaaaaagttgagcaagatttatggaatcatgcctttaaaaaccagatcaccacgttgcagggccaagccaaaaatcgggctaatccaaaccgcagcgaggtccaggccaatttgagcctgttcctggaagctgcctcaggattttacactcagctgctgcaggagctgtgcacagtcttcaacgtggatctgccgtgtcgtgtgaagagctcacaattaggaatcatctctaataagcaaacacacacatccgccatagtaaagccccaatcaagctcgtgctcctacatttgccagcactgtcttgtccacctgggggacatcgctaggtaccgcaaccagaccagccaggccgaaagttattatcggcacgcagcccagctggtgccctccaacggtcaaccctacaaccagctggccatcctagcgagctcgaagggcgaccacctgacgacaatattctactattgtcggtccattgctgtaaaattcccattccctgctgctagtactaacttacagaaagctttaagcaaggcactggagtctcgggacgaggtgaaaactaagtggggagtatccgacttcatcaaggctttcatcaaattccacggacacgtgtatctgagcaaatccctcgagaagctcagtccacttagggagaagttggaagagcaatttaaacgtctgctgtttcagaaggcctttaatagccagcaactcgtgcacgtgaccgtgatcaacctgttccagttacaccacctgagggacttttctaatgagactgagcagcatacctactcgcaggatgagcagctgtgctggacccagctgctggcattattcatgtcgttcctgggcatcctgtgcaagtgtcctctccaaaatgaatctcaagaagaatcgtataatgcgtatcccctgcccgccgtgaaagtcagtatggactggctgcggctccgaccccgtgtctttcaggaggccgtggtggacgagagacaatacatatggccttggttaatatctctgctgaattctttccaccctcatgaagaagacctctcatccattagcgcaacaccccttcccgaagagtttgagctgcagggatttctcgcactacggcccagtttcaggaacctcgactttagcaaagggcatcaagggattaccggcgataaagaggggcagcagcggaggattcgccagcaacggcttatctctatcggcaagtggattgccgataatcaaccacgcttgatccagtgcgaaaacgaagtaggcaaattgctcttcattaccgaaattccagaattgatcctggaagaccccagcgaagccaaggagaacttaatcttgcaagagacaagcgttattgagtctctggcggccgatggatccccaggtctgaagagtgttctgtccactagccgaaatctttcaaacaactgcgacacaggtgagaaaccagttgtgactttcaaggaaaacatcaagacccgcgaagttaaccgcgaccaagggaggagtttcccgccaaaggaggtgaggagagactatagcaaaggcatcactgtgaccaagaatgatggtaagaaagacaacaacaaacggaagacggaaactaagaagtgcaccctcgaaaaactgcaggagacgggcaagcagaacgttgctgtccaagtgaagtcccagacagagctaaggaagacacccgtgtcagaggctcgtaaaaccccagtcacacagacaccgacccaggcctcgaatagccagtttatccccatccatcatcctggggctttcccgccactgccaagccgcccaggatttcccccgccaacatacgtgatcccacctccggtcgccttttcaatgggcagtggctatacttttcctgctggtgtgtccgtgccaggcaccttcctgcaacctacggcgcattcaccggcaggtaatcaggttcaggccgggaaacaaagccacattccctattcacaacaacggccctcaggcccagggccaatgaaccaaggcccacagcaaagccaacctcctagtcagcagcctctgacgtccctgcctgcgcagccgactgcgcaatcaacaagtcaactgcaagttcaggctctgactcagcagcagcaatctccaaccaaggccgtgcccgccttggggaaatccccaccccatcactcaggcttccagcagtaccaacaggctgatgcttcgaagcaactgtggaatccccctcaagtgcagggtcctcttgggaaaattatgcccgtgaaacagccatactatttacagacacaagacccgataaagttgttcgaaccgagcctgcaaccccctgtaatgcaacaacagccactagagaaaaagatgaaaccgttcccgatggaaccttacaatcacaacccctcagaggtgaaggtgccagaattctactgggattcttcctattccatggctgacaacaggagtgtgatggcccagcaagccaacatcgaccggcgcggcaagaggagccccggagtgtttcggcccgaacaggatcctgtgccaagaatgccgttcgaggatcccaaatctagccccttattgcctccagatctgttgaaatcactggctgccctcgaggaagaagaggagttgatcttctctaatcctcccgatctgtaccctgccctgttgggacctctggcaagtcttcccggcaggagcctgttcaaaagtttgctggagaagccttctgagctgatgagtcattcctcttctttcctcagcctaactggatttagcctgaatcaggagagataccctaacaacagcatgttcaatgaggtttatggcaaaaatctgacatcaagcagcaaagccgagctgtcacctagcatggcacctcaagagacgtccctgtattcccttttcgaggggaccccctggagccccagtttgcctgcctcgagcgatcattctacgcctgcctcccagtcgcctcacagctcgaacccttcctctcttcctagctctccaccgacccataatcacaacagtgtccccttttccaacttcggccctattggtacccctgataatcgtgatagacggacagcggaccggtggaaaaccgacaaaccagctatgggcggctttgggatcgattatttgtcggcaacctcatcaagcgaatcgagttggcatcaagcctccaccccctccggcacttggaccggtcatggtccctcaatggaggattcttccgctgtgctgatggaatccctgaagagtatttggtcctctagtatgatgcaccctggtccctccgcgttggaacagttgctgatgcaacagaaacaaaaacagcagagaggacagggaactatgaatccccctcattag

SEQ ID NO: 134626 - DNA, 3414 bp, Artificial Sequence
  Description of Artificial Sequence: Synthetic coding sequence
atgtcactgcagtctgcacagtacctgaggcaggcagaggttcttaaggccgacatgacagactccaaacttgggcctgccgaggtctggacatccagacaggcacttcaggacttatatcaaaagatgcttgttacagacctggagtatgcgttggacaaaaaggtagagcaggatctgtggaaccatgccttcaagaaccagatcaccactttgcagggacaggccaaaaacagagctaacccaaatagatcagaagtgcaggctaacctctccctatttctcgaagccgcctccggcttttacacacaacttctgcaagagttgtgtacggtattcaacgtcgacctcccatgtagagtgaagtcgtcccaactcggaataatatctaataagcaaacacacacaagtgcgatcgttaaaccacagagcagtagctgctcttacatatgtcagcattgcttggttcacctcggggatatcgctaggtatagaaatcaaacctcacaggcggaaagctactatcgccacgcagcccagctggtgcccagcaacggtcagccctataatcagctcgctattctggcgagctccaagggagaccatctgacaactatcttttattactgtcgctccatcgccgtgaagtttcctttccctgccgcaagtactaatctccagaaggctctaagcaaggctctcgagagtagggacgaggtgaaaactaaatggggcgtgtcggacttcatcaaagcattcataaaatttcacggacacgtgtatttgtcaaaatccctggaaaaactctctccgctgagggaaaagctggaagaacagtttaaaagattgctgtttcagaaagcctttaacagtcagcagctcgtccacgtgactgttattaacctgtttcagctgcaccacctgcgggatttctctaatgagaccgagcagcatacctattcccaggatgaacagttgtgctggacccaactcctcgcgctgttcatgtcctttctaggaattctatgtaagtgcccgttgcagaacgaatcacaggaggaatcctataacgcctaccccctgcccgccgtcaaggtgtccatggattggttgcgtcttagaccccgcgtgttccaggaggctgtcgtagacgagcgccagtacatttggccctggttaattagcttgctgaattcatttcatccgcacgaggaggatctgtcctctatatcggccacccctctccctgaagaattcgaactgcagggcttcctggccttacgccccagcttcaggaaccttgatttcagcaagggtcaccaggggatcactggcgataaggagggtcagcaacgtcgcatccgtcagcagcgccttataagtatcgggaaatggattgccgacaaccagcctcgcctcatccagtgtgaaaacgaggtgggcaaacttctatttataacagaaattcctgagctgatccttgaagaccctagcgaggctaaggagaatctgattctccaagagacttccgtcatagaaagccttgcggccgatggttcacctgggttgaagtccgtgctaagtactagccgaaatctcagtaataactgtgatacgggagaaaagcccgttgtgaccttcaaagaaaacatcaaaactcgtgaggtgaatcgggaccaaggtcgctctttcccccctaaagaagttaggcgcgactacagtaagggcattaccgtgaccaagaacgacggaaaaaaagacaataacaaaagaaagacggaaacgaagaaatgcactctggagaaactccaggagacgggaaagcaaaacgtagctgtccaggtgaaatcccagactgagctgcgcaagacacccgtttccgaggcaaggaagacacctgttacccagaccccaactcaggcgtctaactcccagtttatccccatccaccatcctggcgcgtttcctcctttgcctagccgccctggattcccccctcccacctatgttattccccctccagtagctttctcaatggggagtggctatacatttcctgccggtgtctctgttccaggaacttttttacagcctacagcccattccccagctgggaatcaggtgcaagccgggaagcaaagccacattccttacagtcagcagcgcccaagcgggccaggaccaatgaatcaggggccgcagcagtctcaacctccttcccaacagcccctgacgtccctgcccgcacagcctacggcacagtccacgagccaactgcaggtccaggctctgacacagcagcaacagagtcctaccaaagctgtgcccgctctgggcaaatcaccaccccatcactcaggatttcagcagtaccagcaggctgatgccagcaaacagctttggaacccccctcaggtccagggtcccttggggaaaatcatgccagtaaagcagccatactatctgcagacgcaagacccaattaagcttttcgagccatctctgcagcctccagtgatgcagcagcagccactggagaagaagatgaagccgtttcccatggaaccatataatcataacccatccgaggtgaaggtgcccgagttttactgggactcgagttattcgatggccgataaccggtccgttatggcacagcaggctaacatcgaccgaaggggaaaacgttctccgggtgtgttcagacccgagcaggaccccgtgccaaggatgccattcgagaagtccctgctggaaaagccttcagaactgatgagtcacagctcatccttcctgagtctgacaggatttagcctaaatcaagagagatacccgaataatagcatgttcaacgaggtatatggaaagaacttgacctcaagttccaaggccgagctgtctccaagtatggctccacaagagaccagtctgtactctctgtttgagggtaccccatggagcccctcattaccagcgtcttccgaccactccactccggctagccagtccccccactcgtctaacccttcatcattgcctagctctccacccacccacaaccacaactctgttcctttctccaactttggtcctatcgggaccccagacaaccgggatagaaggaccgctgatagatggaaaaccgataaaccagccatgggtggctttggaattgactatctgagcgcaacaagctcttctgagtcatcatggcaccaggccagcactccaagcgggacatggaccgggcatggaccaagtatggaagatagcagtgcagtgctaatggagagcctcaagtcaatctggagcagcagcatgatgcatcccggcccaagtgccctggagcagctattgatgcagcagaaacagaaacagcagcgtggacaggggaccatgaaccccccccactag

SEQ ID NO: 134627 - DNA, 3513 bp, Artificial Sequence
  Description of Artificial Sequence: Synthetic coding sequence
atgcggaactggatgtttctccagatagtgatcgtgggcgagaatgtgtcttttaagtcccagatgaggactgaaaatctgaaatccgaagagcaccttaagagctcaaatatcagacaggcagaggttctcaaagctgacatgacagactctaaacttggacccgccgaggtttggacttcccggcaggctctacaggatctctaccagaagatgctggttaccgacctggagtacgccctagacaaaaaagttgaacaggatctttggaatcatgcgttcaagaatcagattactaccctacaggggcaggcaaagaatcgagcaaatcccaacagaagcgaggtccaggcgaatctaagcctgtttctggaagccgcatcagggttttacactcagctactccaggagctttgtacagtttttaatgttgacctgccttgcagagtgaagagctcccaacttggtataatatcaaacaagcagactcacacaagtgcaattgtgaagccccagagctcctcatgcagctacatctgtcagcattgcctggtgcatttgggagatattgcgagatatcgtaatcaaaccagccaggctgaatcatactaccgccacgcagcccagttggttccatcaaacggacagccttataatcagcttgccatactcgcaagttctaagggtgatcacctgacaaccatcttctactattgtaggtccattgccgtgaaatttccatttcctgctgcctcaacaaacctgcagaaagccctgagcaaagcactggagtcaagagacgaggtgaagacaaagtggggtgtaagcgatttcataaaggctttcattaaattccacggccacgtgtatctatctaagagccttgagaagctgagccctctcagggagaaactcgaggagcaatttaagaggctgcttttccagaaggcatttaacagccagcagctcgtgcacgtcacagtgattaacctgttccagctgcaccacctccgcgattttagcaacgagactgaacaacatacttatagtcaagatgagcaactgtgttggacgcaactactggccctgtttatgagtttcctgggaatcctttgcaaatgccctttgcagaacgaatctcaggaagagtcttataacgcatacccgctgcccgctgtaaaggttagtatggattggctccgccttcgtcctagagtgttccaggaagcagtcgtggacgaacggcaatacatatggccatggctcatcagtcttcttaattcatttcatccgcatgaagaggatctgagttctatctccgcgacaccccttcctgaagagtttgaactgcagggattccttgcgttgcggccctcattccggaacttggacttttctaagggccatcagggaattacaggcgacaaagaaggccagcagagacggattcgtcagcagcgccttataagcatcgggaaatggatcgcggacaatcagccacggttaatccagtgtgaaaatgaggtcggcaagctgctgttcatcactgaaatcccagaactcatcctcgaagatcctagtgaggccaaggaaaacctgattctccaggaaacgagtgtcattgaaagcctggccgccgacggtagcccgggactgaagtccgtcctttccacgagtcgaaacctgagcaacaactgtgatacaggcgagaagcctgtggtaactttcaaagagaacatcaagaccagagaggttaatagagaccaggggcgcagcttcccccccaaagaggtgaaatctcagacagaattacgtaaaaccccagtatccgaagcaaggaagacgcccgtgacgcagactccgacccaggcttcgaactcccagtttattccaatacaccatccgggcgcattccctcccctcccatctcgacctggttttccccctcctacatacgtcattcctcccccagtagctttttcaatgggaagcggctacacttttcccgccggggtgtcagttccagggacttttctacaaccaaccgctcacagcccagcaggaaaccaggtccaggcaggcaagcagtcacatatcccctactctcagcagcgtccatcaggccccggtccaatgaaccaggggccccagcagtcacagccacccagccagcagcccctgacaagcctacctgcgcagccaacagcccagtcaacctctcagctgcaggtgcaggctttaacccagcagcagcagtctccaaccaaagctgtcccggccctgggaaagagccccccgcatcactccgggttccaacagtaccaacaggccgatgccagcaagcagttgtggaacccaccccaagtgcaaggacctctcgggaaaatcatgccggtgaaacaaccctattatttacagacccaggatcccattaagttgttcgagccgagtctgcagcctccggttatgcagcaacaaccgctcgagaagaagatgaagcccttccctatggaaccatacaatcacaatccgtccgaggtaaaggtgccagaattttactgggactcatcttattcaatggctgataacagatccgtaatggcacagcaggcaaacattgaccgacgcggaaagaggtcacccggagtgtttaggcccgagcaagatcccgttccccggatgccatttgaggaccccaagagttcaccactccttccacccgatctcctgaagagccttgctgcactggaggaggaggaagagttaatattctcaaacccacccgacctctatccagccctgcttgggccacttgcttctcttccaggccgctcactgttcaaatccctactcgagaagcccagcgaacttatgtcccacagctctagcttcctgagcctaaccggtttctcattaaaccaagagagataccctaataacagcatgttcaacgaggtttacggaaagaaccttactagcagctctaaagcagaactttctcctagcatggcacctcaagagacatctctgtacagcctattcgaaggcacaccatggtctccgagcctccctgcttcaagcgatcacagcacccctgcatcccaatcaccccactcttcaaatcccagcagcctaccctcttccccacccacgcacaatcacaactcagtacccttttccaacttcggccctatcggaacaccagacaatagggacagacggaccgcagacagatggaaaaccgacaaacctgccatggggggctttggcattgattaccttagcgcgacctccagcagcgagtcctcttggcatcaggccagtacaccctctggaacctggaccggacatgggccaagcatggaagattcctcagccgtcttaatggaatctttaaagtcaatttggtctagtagcatgatgcacccaggtccatcggcactagaacagctccttatgcaacagaaacagaagcaacaacgggggcaggggaccatgaatcctccccactag

SEQ ID NO: 134628 - DNA, 2274 bp, Artificial Sequence
  Description of Artificial Sequence: Synthetic coding sequence
atgctggtgaccgacctggaatatgccttagataagaaggtggagcaggacctgtggaaccatgcctttaaaaatcagataaccactttgcagggtcaggcaaaaaaccgcgcgaatccaaaccggagtgaggtccaggccaatctttcactgttccttgaagccgcctcaggcttctatactcagctgctgcaagagttgtgcacggtttttaacgtagacctgccctgtcgggttaagtcgtcgcagctggggatcatttccaataaacagacacatacatcagctattgtcaagccacaaagcagttcatgcagctatatctgccagcactgtctagtgcacctgggtgatatcgctagataccggaaccagacctcccaggcagaaagctactacagacacgccgcacagctggttccgtctaatggccagccttacaaccagttagcaatactggcctctagtaaaggcgatcatctcaccactattttttactattgtcgcagtatcgctgtgaaattcccattcccggcagcttccactaacttgcagaaggcgctatctaaggcgttagaatcacgggatgaggtcaagacaaagtggggcgtgagcgacttcattaaagccttcatcaagtttcatggtcacgtctacctgtctaagagtttagaaaagctgtcacctctccgcgaaaagctcgaggaacagttcaaaaggctactgttccagaaagccttcaacagtcaacaactcgtgcacgtgaccgtgatcaacctgtttcagctccaccacctccgtgacttcagcaacgaaacagagcagcacacctacagccaggatgagcagctttgttggacccaactgcttgcgttattcatgtccttcttaggaattttgtgtaagtgtccactgcagaatgagagccaggaggaatcctataacgcatatccccttccggcagttaaggtctccatggactggcttagactgaggcctagggtgttccaggaagcagtagttgatgagagacagtacatttggccctggctgatctctttacttaattcctttcacccccatgaggaagatttgtcctctatttcagccacccccctccctgaagaatttgaactgcagggttttctggcactccgtcctagcttccgaaatctggatttctcaaaggggcaccaaggaataactggcgacaaggagggacagcagaggcgcatccgtcagcaaagactgatatccataggtaagtggattgctgataaccagcccagactcattcagtgtgagaatgaagtgggcaaactcctctttattacggaaatcccggaacttattctggaagacccctcagaggccaaggagaacctcattctgcaagagacgtcagtaatcgaaagccttgctgcagatgggagccctggcctgaagtccgtgctcagtacttcgcgaaacctgtctaacaattgtgatactggggaaaaacctgtggtgactttcaaggagaacatcaaaactcgtgaagtgaacagggatcagggcagatccttccctcccaaagaagtcaaatcgcagacagagttgcgtaagacccccgtgagtgaagcccgcaagaccccagtgacccaaacaccaactcaggcctcaaacagccaatttatcccgatccaccaccccggagcgttcccaccactgcccagccgtcccggatttcccccccctacctatgttattcctccccctgtggccttttctatgggcagcggctacacgtttcccgctggtgttagcgtcccagggacattcctgcagccgacggctcatagtccggccggcaaccaggttcaggctggcaaacaatcacatattccttactcacaacagagacccagcggtccaggacctatgaatcagggacctcagcagagccagccacctagtcagcagccattgactagtctcccagcccagccaaccgcacagtccacctctcaattgcaggtccaggctctgacacagcagcagcaatctcccactaaggccgttcctgccctggggaagtctcccccccaccactccgggttccagcagtatcagcaagctgacgcatccaaacagctctggaacccaccacaggtgcaggggcctctgggaaagatcatgcctgtcaagcagccctattacctacagactcaggaccccatcaaacttttcgaaccctccctgcagcctcctgtgatgcagcagcagcccctgtag

SEQ ID NO: 134629 - DNA, 3150 bp, Artificial Sequence
  Description of Artificial Sequence: Synthetic coding sequence
atgctggtgacagacttagaatacgctttggataagaaggtggagcaagatctgtggaatcatgcttttaagaaccagattaccaccctccagggccaggccaagaatagggcaaacccgaatcggagtgaagtacaggccaacttatctctgtttctcgaggccgcctctgggttttacacccaactgctgcaagagctctgcaccgttttcaatgtagatctgccctgtagggtcaagtcctctcaacttggcattatctcaaataaacaaacccacaccagtgctatcgtgaagcctcaaagctcgagctgcagttatatctgccagcattgcctggtgcacctcggagacattgccagatatcggaaccaaactagccaagctgagtcctactacaggcatgcagctcagcttgtgcctagcaatggccagccatacaaccaactagccattctcgccagcagcaaaggcgaccatctgaccacaatcttctactactgtaggtcgatcgccgtgaagtttccctttcctgcagcctcaacgaatcttcaaaaagccctgagtaaggctcttgagtcaagagacgaggttaaaaccaagtggggtgtatccgattttataaaggccttcataaagtttcacgggcacgtttacctgtcaaaaagcctggagaaactgtctcctctaagagagaagttggaggaacaatttaagcggctcctcttccaaaaagcctttaactctcaacaactggtacacgtgaccgttattaacctatttcagttgcatcatctccgagacttttccaacgagactgagcagcacacttactctcaggatgaacagttgtgctggacccagttgctggccctcttcatgtcctttctggggatcctgtgtaagtgtccactgcaaaacgagtctcaggaggaatcctataatgcatacccattgcccgccgtgaaagtgtcaatggattggctccggctgcggccacgtgttttccaggaggcagtcgtcgatgagcggcagtatatttggccttggcttatttccctattgaattcctttcaccctcacgaggaagacctttcatccatatcggctacgccgctccccgaggaattcgagctccaaggctttttggcattgagacccagtttccggaatctggatttctcaaaaggacaccagggaattacaggcgacaaagaaggtcagcagcgtcgaatcagacagcagcgcctgatctctataggcaagtggatcgctgacaaccagcctaggctcatacagtgcgaaaacgaagtcggcaagctcttgtttatcacagagattcctgagctcatcctggaagatccgtctgaggccaaggagaatctgatcttgcaggagacttctgtgatcgagagtctcgctgcggacggctcccccggactgaaatccgttcttagtactagccggaatctctcaaacaattgcgacacgggagaaaagccagtggtcacctttaaagagaatataaagactcgtgaggtgaaccgcgaccagggtcgatcgttcccaccaaaggaggtgaaaagccagaccgaacttagaaagaccccggtgagcgaggctcgaaagaccccagtcactcagactcctacacaagccagcaactcccagtttatccccatacatcatcccggagctttccccccactcccatcccggcccggttttcccccaccaacttatgtgattcctccgccagtggcttttagtatggggagtggctacaccttccctgcaggcgtcagcgtgccaggcaccttcttacagcctaccgcacacagccctgcaggcaaccaggtgcaggctgggaagcaaagtcatataccttactcccagcagagaccatccggcccaggtcctatgaaccagggaccccagcaaagtcagcctccctctcagcagcctttaaccagcctccccgcacagcccacagcccagtctacttctcagttacaggtgcaggccctgactcagcaacagcagtctcctacgaaggccgtgccagctctgggtaaatcccctcctcatcatagcgggtttcagcaatatcaacaagcggatgcatctaagcagctctggaatcctccccaggtccaggggcctctgggaaagattatgcctgtgaagcagccgtattacttgcagactcaggacccaattaagcttttcgaaccatccctccaacctcctgtgatgcaacagcagccattagagaaaaagatgaagccttttcctatggaaccatacaatcataacccttccgaagtgaaggtccctgagttctactgggactcctcttattccatggcggacaaccgctctgttatggcgcagcaggcaaatattgaccggcgaggtaagagatcgcccggcgtgttccgacccgagcaggacccagttccccgcatgccttttgaaaagtccctgctcgaaaaaccctctgaactcatgagtcattctagttccttcctctctctcacaggcttttctcttaatcaggaacgttacccaaacaatagtatgtttaacgaagtctatggcaagaaccttactagtagctccaaggcagaactctctccttccatggcgccacaggagaccagcttgtactccctcttcgaaggcactccttggagtccctcacttccagccagctcagatcacagcacacccgcctcacagtcaccacacagttccaatccatcctcccttccatccagtccccccacacataatcacaactccgtgccgttctcaaattttgggcctattggaactcccgataaccgggaccggcgcaccgccgacaggtggaagactgacaagcccgcaatgggggggttcggcatcgactatctatccgccacttcaagctccgagtcctcgtggcaccaggctagcactccctcaggaacatggactggacacgggccgagcatggaagactcctctgccgttcttatggaatccttgaaatcgatttggtcctcctctatgatgcatccaggtcccagtgctctggagcagctgttgatgcagcaaaagcagaagcagcagaggggccaaggtactatgaacccaccccactag

SEQ ID NO: 134630 - DNA, 3537 bp, Artificial Sequence
  Description of Artificial Sequence: Synthetic coding sequence
atgtccttacagtcagctcagtacctgagacaagccgaagtgctgaaggccgatatgaccgacagtaaactgggccctgctgaggtgtggacctcccgccaggccctccaagacctgtatcagaagatgctggtaaccgacctagagtacgctctcgataagaaggtggagcaagacttatggaaccatgccttcaaaaaccaaatcaccactctgcaggggcaggcaaaaaaccgcgcgaatcctaatagatcagaagtccaggccaacttgagcttattcttggaggcggccagcggcttttacacccagctacttcaggagctgtgtaccgtgtttaatgtcgacttgccttgtagagtgaaatcctcacagctgggcattatcagcaacaaacaaactcacacctcggccatagtcaagcctcagagtagctcctgtagttacatctgccaacactgcctcgtacatctgggtgacatcgcaaggtacaggaaccagacttcccaggccgagagttattacaggcatgccgctcagttggtgccgtccaacggccaaccctacaatcagcttgctatattggcttctagtaaaggggaccacctcactaccatattctattactgcagatccatagccgtcaaattcccgttccccgccgcatcaacgaacctgcagaaggccctctctaaagccctggaatccagggacgaagtgaaaactaagtggggggtgtcagattttatcaaggcgttcattaagtttcacggccacgtgtacctgagcaagagcctggaaaaactgtcgccattgagagagaagctggaagagcagttcaaacggctcctgtttcaaaaggcattcaattctcaacagcttgttcatgtcaccgtgatcaacctgtttcagctgcatcatttgcgcgatttttccaatgagacagagcagcacacctattcgcaggatgaacagttatgctggacacagttgctggccctgttcatgagcttcctcgggatcttgtgcaagtgtcccctccagaatgaaagccaggaggaatcttacaatgcctacccacttccagccgtcaaggtatcgatggactggctgaggctgcgtccacgggtttttcaggaggcagtggtcgacgagcgacagtatatctggccctggctgatttccttgctcaattccttccaccctcatgaggaagatctctcatccatcagcgctactccgctgccagaagagtttgagctccagggcttcctcgccttacggccttcttttcgcaatctggactttagcaaggggcatcagggcatcaccggagataaggaagggcaacaacggcgaattcgacagcaacgtctgatctccattgggaaatggattgccgataatcagccgcgcttaattcagtgtgaaaacgaggtaggcaagctactcttcatcaccgaaatcccagaactcatcctcgaagacccatctgaggccaaggaaaaccttatcctccaggaaacaagtgtaattgaatcactggcggccgatggcagcccaggcctcaaaagcgtcttgtcgacttctcggaacctcagcaataattgtgacaccggagagaagcctgtagtcacttttaaggaaaatattaaaacgcgtgaggttaatcgcgatcagggccgctcttttccacccaaggaggtgaaaagccagacggagctgcgcaaaactccagtgagcgaagcccggaagacacccgttactcaaactcccacgcaagcatctaacagtcaatttatccctatccaccaccctggcgccttcccccccctgccatccagacccgggtttccacctccaacctatgtcatacccccccctgttgccttcagcatggggtctggctacacgttccccgctggcgtgtctgtgcctggcactttcttgcagcctacggctcattctccagccggaaaccaggtgcaggccggcaagcagtcccatatcccatactctcagcagcgtccttcaggaccaggtcctatgaatcaagggcctcagcaatcccagccgcctagccaacaaccacttacttccttgccagcccagccaactgcacagagcacttctcaattgcaggtgcaggctctgacccagcagcagcagtccccaacaaaagcagtgccagctcttgggaagtctcccccccaccactctgggttccaacagtaccagcaggccgacgcttcaaagcagctttggaacccaccacaggtacagggccccctggggaaaatcatgccagttaaacagccgtactatctgcaaacccaggaccccattaagctgttcgaacccagcctgcaacctccagtgatgcagcagcagccattggagaaaaaaatgaaaccattccctatggagccatacaatcacaacccttccgaggtcaaagtgccagagttctactgggatagttcttattcaatggccgataaccgcagcgtcatggctcaacaagccaatattgaccgccgaggcaaacggtctcccggtgtgtttaggcctgaacaggatccagtgccaagaatgcccttcgaggaccctaagtctagtccacttctgccccccgaccttctgaaaagccttgccgcccttgaagaggaggaagagctaattttctcaaacccgcccgacctgtaccccgccctccttggcccactggcctcactgcctggccggagcctctttaaaagtcttctggagaagccatcggagcttatgtcacatagctcaagtttccttagtctcaccggattctctttgaaccaggaacggtatccaaacaattcgatgtttaatgaagtctacggtaaaaatctcacttcaagctccaaggcagagttatctccaagcatggcaccacaggagacatccctttattcactattcgagggcacaccctggtctccttcgctgccagctagcagcgatcactcaaccccggcaagtcagtctccacattcgagcaatccatcatccctgccgtcttcccctccaacacataaccataacagcgtacctttttctaacttcggtcctattggaacacccgataatcgggatcggcgcacggctgacaggtggaagaccgacaagcctgcaatgggaggcttcggaatcgattacttgtctgccacttcctcatccgagtccagctggcaccaggcgagtacgccatccggcacatggaccggccacggcccaagtatggaggactcatctgccgtgctgatggagtccttgaagaagcagcagcacggcgtgcagcagttggggcctaagcgccagtctgaagaggagggatccagtagtatctgcgtggcacaccgaggccctcggcctctcccttcttgttcccttccagcctccacatttcgagtcaaattcaaagcagcaaggacttgcgcccatcaagcacaaaagaaaactcgtagacggccgttctggaagcgccggaaaaaagggaaatag

SEQ ID NO: 134631 - DNA, 3276 bp, Artificial Sequence
  Description of Artificial Sequence: Synthetic coding sequence
atgtctctgcagtcagctcagtatttacgacaggcagaagttctcaaggcggatatgaccgatagcaagctggggccggcagaagtctggacatcgaggcaggcgctgcaggacctctaccaaaaaatgttggtgacagacttggaatacgctctggataagaaggtggagcaggatctgtggaaccacgccttcaagaatcagattaccactctccagggacaggctaaaaacagagccaatcccaacaggagcgaggtgcaggcaaaccttagcttatttttagaggccgcctctggattctatacgcagctgctgcaggagttgtgcacagtcttcaacgttgacctcccgtgccgcgtgaagtctagtcagctggggataatttctaacaagcagacgcacacaagcgctatcgtcaaaccccaatcgtcctcctgcagctacatctgccagcattgtctcgttcaccttggcgacattgcccggtaccgtaaccagacgtcacaggccgagtcttactacaggcacgctgcccaattggtccctagcaatggacaaccttataaccagctcgccattctggcctcttctaagggagaccatctcacgactatattttactactgtagatccatcgcggtgaaattcccattccccgctgccagtaccaatctccagaaagcattaagcaaagctcttgagtctagggatgaggttaaaacaaagtggggcgtctctgattttatcaaagcatttatcaagtttcacggccatgtgtatctcagtaaatcactggaaaagctgtctccactaagagagaaactggaagagcagttcaagcgcctcctctttcagaaagcattcaacagccagcaactggtgcatgtaactgtcattaacttgtttcagctccaccacttgagggacttctcaaacgaaaccgaacagcatacttacagccaagacgagcagttgtgttggacccagctactcgcgttattcatgagctttctgggtattctgtgcaaatgcccactacagaatgagagccaggaagaatcatataatgcttacccactacccgcagtgaaggtatcgatggactggttgagactcaggccccgtgtcttccaggaagcagttgtcgatgaacgtcagtatatttggccatggctgatttctctgctgaactctttccatcctcatgaggaagacctgagcagcatctcagcaaccccactccccgaggagtttgagctgcaggggtttctggctttgaggccatctttccggaatctggatttttccaagggccatcaagggattacaggagataaagaaggccagcaacgcagaatcagacagcaaagactgatttcaattggcaagtggatcgctgataaccaacccaggttgatacagtgcgaaaatgaggtcggaaaattactgtttatcactgagatccccgaactgatccttgaggaccctagcgaagcgaaagagaatctgatactgcaggagacaagcgtgattgagtctctcgccgccgacggaagcccaggcctaaagagcgtactgtcgacctcccgcaacctgtcgaataactgcgataccggcgaaaagcccgtagtgacctttaaagagaacattaaaacacgggaggtcaatagggatcaggggagatcattccctcccaaagaagtcaagtcgcaaactgagctacgcaaaacgcccgtgtcggaggccagaaaaacacccgttactcagaccccaactcaggcgagcaactcacagtttatcccaatacatcaccccggcgccttcccccccctgccctccaggcccggcttccctcctcccacctatgttatacccccgcctgttgccttttccatgggaagcggttatacctttcctgctggggtctccgttccagggacatttttacaaccaacagcccatagtcccgcaggaaaccaagtgcaggccggcaagcaaagtcatatcccttactcgcagcaacgcccatcaggccccggcccaatgaatcagggcccccaacaatctcagccaccttcgcaacagcccctgacctcgctgcctgcccagcccaccgctcagtctacatctcagctgcaagtgcaagcgctgacccagcagcaacaaagcccgacaaaggccgtgcctgctctcggcaaaagccctcctcaccattccggctttcagcaataccagcaggcagacgcatccaagcagctgtggaatcctcctcaggtgcaagggccacttggaaagattatgccagtcaagcagccatactacctgcagactcaggacccaattaaattattcgagccttccctccaacctcccgtgatgcagcagcaacctctagaaaaaaaaatgaaaccttttcccatggagccttataaccataatcctagcgaagtaaaggtcccagaattctattgggattccagttactccatggccgacaaccgatccgtgatggctcagcaggctaatatagacagacggggtaagcgttccccaggtgtgttccggccagagcaggacccggttcctagaatgccttttgaaaaaagcctgttggagaagccatccgagttgatgtctcacagctccagctttttgtccctaaccggcttctccctcaatcaagaaaggtacccgaacaactccatgttcaatgaagtgtacggaaagaacctaacaagctccagtaaggccgagctgagtccctcaatggcacctcaggagactagcctgtactctctttttgagggcaccccctggtctccgtccctgccagcatcatccgaccacagtacccccgcaagtcagtccccacattcatccaacccgagcagcctgccaagctcccccccaactcataatcataactctgtaccctttagcaattttggaccaatcggtacacctgataatcgagaccggaggacagctgataggtggaaaacagacaagccagcaatggggggttttgggattgattatttgagtgccacctcatcctcagagtctagctggcaccaggctagcacacctagtggtacctggactggccacggtccatctatggaggacagtagtgccgtcctgatggagtcactcaaatcaatatggtcctctagtatgatgcaccctggtccatcggccttagaacagttgcttatgcagcagaaacagaagcagcaacggggccaggggaccatgaaccctccacattag

SEQ ID NO: 134632 - DNA, 2976 bp, Artificial Sequence
  Description of Artificial Sequence: Synthetic coding sequence
atggccgggcctgtctctttaagagacctcttgatgggtgccagcgcttggatgggcagtgagagcccaggcggctcccctaccgagggtgggggttccgcagctggcggaccagaacctccctggagagaggacgagatctgtgtggttggcatctttggcaaaacagcgctgcgcctgaattctgagaaattctcccttgttaatactgtttgtgacagacaggtgttcccccttttccgccatcaggaccctggagatcccgggcctgggattcggacagaggccggggccgtcggcgaggctgggggagccgaggaccctggggccgctgccggcggctccgtgcgtggttccggggccgtcgctgagggtaataggacagaggcgggtagccaggattactcacttctgcaggcctactactcacaggagagcaaggtgctgtacttattgctgacctcgatctgtgataattcccaactgctgcgagcctgtcgggccctgcagagcggagaggcgggcgggggactgtccctgcctcacgcagaggcccatgagttctggaagcatcaggaaaagcttcagtgcctgagccttctttacttattttccgtatgtcacatcctgctgcttgtgcaccccacttgttcatttgatattacctatgaccgagtgtttagagcactggacggattgaggcaaaaggtccttcctcttctgaagacagcgatcaaagattgtcccgtgggaaaggattggaagctcaattgccgcccttgcccgcctcgcctgttgtttttgtttcagcttaatggcgctctcaaggttgaaccccccaggaaccaagatcccgcccatccggacaaacctaaaaagcatagccctaaaaggcgcctgcagcacgccctcgaagaccagatatacaggattttccggaagtcacgagtgttgaccaaccagtccatcaattgtctttttaccgtgcctgccaaccaagcatttgtctacatcgtgccagggagtcaggaggaggaccccgtcgggatgcttctggatcagcttagatctcactgtacagttaaggaccccgagtcactattggtcccggctcccttgtcagggcctcgtcgataccaagtgatgcgtcaacattccagacagcagctctcattccatatcgacagcagctcgtcctcatcttctggacagctggtggactttacactaagggaattcctctggcaacacgtggagttagtgctcagcaagaaagggttcgatgattccgtgggcaggaatccccagccaagtcatttcgagctccctacatatcagaaatggatcagcgctgcctcaaaactctatgaagtcgcaatcgatgggaaagaggaagatctcgggagtcctaccggggaacttacttccaagatcctcagctcaataaaggtacttgaggggtttctggacatcgatacgaagtttagcgaaaaccgctgtcagaaagccctgccgatggcgcactcagcatatcagagtaatctaccacacaactacaccatgacagtgcataagaaccagctagcgcaagccctgagagtttattcccagcatgcaagaggacctgccttccataagtacgcaatgcagctgcatgaggattgttataagttctggagcaatggccaccagctctgtgaagaaagatcactcactgaccagcattgtgttcataaatttcactctctgccaaaatcgggcgagaagccagaagcggatcggaatccaccagtcctataccacaattctcgcgctcggagcactggcgcttgtaattgcggtcgcaaacaggcaccacgcgacgacccatttgacattaaagccgccaattacgacttctatcagcttttggaggagaagtgctgcgggaaactggatcatattaattttcccgtgttcgaacctagtacccccgaccccgcacccgccaaaaatgagagcagtcccgctccccccgacagcgacgccgataaactgaaagagaaagagccccagactcaaggtgagagcacttctctgtctctggccctttctcttgggcagagtaccgattccctgggcacataccctgccgacccccaggcaggtggcgacaatccagaagtgcatggacaggtcgaagtcaaaaccgagaagcgaccaaacttcgtcgatagacaggcatctactgtggagtacctccctggaatgttgcacagcaattgtcccaagggactgttgcccaaattcagtagctggtctttagtcaaactgggaccagctaagtcatataacttccatacaggcctggaccagcaggggtttattcccgggacaaactatctcatgccatgggacattgtgatcaggacccgcgccgaagatgaaggggacctcgacacaaatagctggcccgcacccaataaagcaattccaggaaaaaggagcgctgtggtgatgggacgcggccggaggagagacgacattgcccgcgcgtttgtggggtttgagtatgaagattcccgcgggaggcgatttatgtgttctgggcccgacaaggtgatgaaagtgatgggatccggccccaaggaaagcgctttgaaggctctaaacagtgatatgcctttatacattctcagcagttcccaaggacgcggtcttaaacctcattacgctcagttgatgcgcctgttcgttgtcgtgcctgacgctcccttgcagatcatccttatgcctcaggtccaacccgggccacctccttgccctgtcttctatcctgaaaaacaggagatcacactgccgccggatggcctgtgggttttgcggtttccctacgcttatgtcaccgagagaggaccgtgttttccccctaaagagaacgtgcagttgatgagctataaggtcctgcggggtgtgctgaaggcagtaacgcagtag

SEQ ID NO: 134633 - DNA, 2925 bp, Artificial Sequence
  Description of Artificial Sequence: Synthetic coding sequence
atggctggccctgtctcgctgagagatctcttaatgggagccagcgcttggatgggcagcgaaagccctggggggtcccctacagagggaggtgggagcgccgcaggtggtcctgaacctccttggagggaagatgagatttgcgtagtggggattttcgggaaaaccgccctccggcttaacagcgaaaaattctctctggtgaatactgtgtgtgaccgacaggtttttcctctgttccgtcaccaagatccaggcgatcctggaccagggatccgcacagaagcaggggccgtgggagaggccggaggggccgaggaccccggagctgccgctgggggctccgttagaggcagcggtgcagtcgcggagggcaaccgcaccgaggctgggagccaagattattcgcttttgcaggcttattacagtcaagagtcgaaggtactttacctgctcttgaccagcatctgcgacaatagccagctacttcgggcttgccgggcactacagagcggcgaagcaggggggggtctgtctctgccccatgcagaggcccatgagttctggaagcaccaagagaaactgcaatgtctgagcctcctatacctgttttctgtgtgtcatatcctactcctcgtgcacccaacatgcagctttgatatcacgtacgaccgtgtctttcgagccttggacggacttcgacaaaaagtgctgcccttgttaaagactgctatcaaagattgccctgttgggaaagactggaaactgaactgtcgcccgtgccctccacggcttttgttcctgttccagctgaacggagccctcaaagtggaacctccacgaaaccaagatcccgcacatccagacaagcctaagaaacactcccccaagcggcggctacagcacgctctggaggaccagatatacaggatcttccgcaaatctcgcgtacttaccaatcagtccattaactgtctctttacggtgcctgcaaatcaggccttcgtgtacatcgtgccagggagtcaggaagaggatcccgtgggcatgctactggatcaacttcgctcccattgtaccgtcaaggacccagagtccctgcttgtgcctgcaccattatccgggcctagaagataccaggtcatgcgccaacactctcgccagcagttgtcattccacatcgattcatcatcatcgagtagctccggacaactcgtcgactttacactgagggagttcctatggcagcacgtggagctagtattaagtaagaaaggatttgacgactctgttggacgaaacccccagccttctcattttgaactgcctacgtaccaaaaatggattagcgcagcctccaagttgtacgaagtggcgatcgatggtaaggaagaagatctgggctcgccaacgggagagcttacgagcaaaattctgagctccattaaagtgctcgaggggtttttggacatagataccaagttttcagagaatcgctgccaaaaggcgctcccgatggctcactccgcataccagagtaacctgccccacaattacacaatgacagtccacaaaaatcagctggctcaggccctgcgggtatatagccaacacgcgaggggccccgctttccataaatacgccatgcagcttcatgaggattgctataaattctggtccaacggccaccagctgtgtgaggagcgttctctgacagatcaacattgtgtgcataagttccattctttgccaaagagtggtgagaagcccgaggccgaccggaatcctcctgtcctttaccacaattccagggctcgtagcaccggcgcctgtaattgcgggaggaaacaggcccctcgtgacgatccgttcgatattaaggctgctaactatgacttctatcagctactggaagaaaaatgctgtggtaaactggaccacatcaacttccctgtgttcgaaccatctacgccagacccagcgcccgctaagaatgagagcagcccagcaccacccgattctgatgcggataaactgaaagaaaaagaacctcagactcagggagagtccacctcgttgagtctggcattgtctcttggacaaagcacggattcattagggacttaccctgccgaccctcaggctggaggcgataacccggaggtacacggccaagttgaagtaaaaaccgagaagcggcctaactttgtggaccggcaggctagcaccgtcgagtatctacccggaatgctccatagtaactgtcccaagggattattgccaaagttctcttcctggagcctagtcaagttaggccctgctaaatcatataactttcatacagggctggaccagcagggcttcattcccggcaccaactacctcatgccttgggacatagtcatacgcaccagggctgaggatgaaggtgaccttgacacgaactcttggcctgccccaaataaggcaattcctggcaagcgttctgccgtggtcatgggacgtggtaggcgccgcgacgatattgccagggcctttgtcggctttgagtatgaagactcaaggggcaggcgattcatgtgcagtggcccagacaaagtgatgaaggtgatggggtcaggtccaaaagagtctgcactcaaagccctgaactctgacatgcctctatatattctgagctcttctcaggggcggggcctgaagcctcactatgcacagttgatgagattgtttgtggtagtccctgacgctcctcttcaaatcattctgatgcctcaggtccagccaggtcctcccccctgtccggtgttttacccggaaaaacaggagataacgttaccacctgatggattatgggtgctgagattcccatatgcgtacctccgggaggacctggtctctcctttgcgtaaaatgtgcagctag

SEQ ID NO: 134634 - DNA, 1563 bp, Artificial Sequence
  Description of Artificial Sequence: Synthetic coding sequence
atgagcgaaagtggacatagccagcctggcctgtacggcatagagcggcggagaaggtggaaagaacccggatccggcgggcctcagaatcttagtggacctggagggcgggaaagagattacatcgcgccgtgggagcgggagcggagggatgcgagcgaagagactagtacatctgtgatgcagaagaccccaatcatcctgagcaagccaccggccgagcgttctaaacagccacctccacctacagctccagccgctccccctgctccagcaccactggaaaagccaatcgttctcatgaagcctagggaggaaggtaaggggcccgtggcagtgactggcgctagcaccccagaggggacagccccacctcctcccgcagcacccgctccacctaagggggagaaagaaggtcagcggcctacccagcccgtgtatcagatacagaaccgaggcatgggaactgcagcacctgccgccatggaccctgtggtaggccaggcgaaactgcttccccctgaaagaatgaaacactcgatcaaactggtggatgatcaaatgaattggtgtgattccgcgatcgaataccttctggatcagacagacgtattagtggttggagtcctcggcctgcaggggacaggaaagtccatggtgatgagcctcctgtcggcaaacacaccagaagaagaccagcgtacctacgtttttcgcgcgcagtctgctgaaatgaaagagaggggcgggaaccagaccagtggaatcgactttttcatcacccaggagaggatagtgttcctcgatacacagcctattctgtccccctcaattctggaccatctgatcaataatgatcgcaaactgccccccgaatataacttaccccatacatatgtggagatgcagagcctgcagatcgctgcctttttattcactgtttgtcacgttgtgatcgtcgtgcaggattggtttactgacctaagcttataccgttttttacaaactgctgagatggttaaaccatcaactccaagtcccagccacgagtcaagcagtagctccggttccgacgaaggcaccgagtactatccccacctcgtgtttctccagaacaaggcaagaagagaagatttttgtccgaggaaacttagacagatgcatctgatgatcgatcaacttatggcccactcccatttacgatacaagggcaccctctcaatgctgcagtgcaacgttttcccaggattgccacccgattttctcgactctgaagtaaatttattcctagttccctttatggattctgaggccgaatctgagaatccccctagagccggcccaggtagcagccccctcttttcccttctacctgggtatcgcgggcacccttccttccagagtcttgtaagtaagttgagaagccaggtgatgtctatggccagaccacagttgtcgcataccatcttgacagagaagaactggtttcattacgcagcccggatctgggacggcgtgcgtaaatcgtctgcacttgctgagtattcgcgactgctggcatag

SEQ ID NO: 134635 - DNA, 2742 bp, Artificial Sequence
  Description of Artificial Sequence: Synthetic coding sequence
atggccgatgaagctctggcgggcctggatgagggcgccttgcgaaagctacttgaagtaaccgctgatctcgctgagcggcggcgtattcgcagcgccatccgcgaactgcagagacaagagctagagcgggaagaagaagcactggcttctaagagatttcgggcagaaaggcaggacaacaaggaaaattggctgcacagtcagcagcgagaggctgagcagcgcgccgccctggctcggctggcagggcagctggaatccatgaatgacgttgaggagctcacggccttgctgaggagtgccggcgagtatgaagaacgcaagttaatcagagcagccatacgacgcgtgcgggcacaggaaatcgaggccgcaactctggcggggcggctgtattctggtcgtcccaactctggaagcagagaagactctaagggcctagcagcccacaggttagagcagtgcgaagtgccagagcgggaagaacaggagcagcaagctgaagtctccaaaccaaccccaaccccggagggaactagccaggacgtaactaccgtgactttgctgctgagagccccgcccggctccacaagcagctcccccgccagtcccagctcttctcctacacccgcttcaccggaacctcctttggaacctgctgaggcacagtgtctgaccgccgaggtccctggatctccagaacctcctccaagtccaccaaaaaccacttccccagagcctcaggagagcccaactctccctagtacagagggtcaggtggtcaataagctgctgtcaggcccaaaggagactcccgcagcccaatcgcccacgagaggaccaagcgacactaaacgagccgatgttgccggaccccgcccctgtcagcggtcgctgtcagtgctatcacctaggcaacccgctcagaacagagaaagtacccctctcgcgagcgggccgtctagttttcaacgcgccgggtctgttcgggatcgcgttcacaaatttaccagcgattcaccaatggcagctaggctgcaggatggaaccccccaagcagccctttcccctctgcctcgtaaggcacccggccctctgccccatcagcatcacccatgtcttttgttacagcgcctgttgctctcaggccccgacaccagcagccggtttagtaaggagcaaaggggtgtggcgcaacccttagcccagcttcgtagttgtccacaggaggaaggacccaggggccgaggccttgccgcccggcctctggagaatcgggcaggaggaccagtcgcacgctccgaagagcctggagcaccgctaccagttgcggtgggcaccgcagaacccggcggaagcatgaaaacaaccttcaccatagaaattaaagatggccgaggacaagctagcaccggccgcgtcctgttacctacaggaaatcagcgagctgagttgacactggggttaagagctcctcctaccctgctgtcgacatcttctggaggaaaatctacaattactcgagtgaattcccctggcacactcgcgaggctgggctccgtaactcatgtgacatccttctcacacgccccccccagctctcgcggagggtgtagcatcaagatggaggctgagcctgctgagcctctggctgccgctgttgaagctgcaaatggtgccgagcagacccgggtcaacaaagcaccagagggacgctcccctctgtccgccgaggagctgatgaccattgaggacgagggcgttcttgataagatgttggatcagtctacagacttcgaggagagaaagttgattcgtgccgccctcagagaactgcgacaaaggaagcgagatcagagggataaggagcgggagcgcaggcttcaggaagctaggggcagacctggcgagggccgcgggaacaccgcgactgaaacgaccactcgccatagtcaacgcgcagcagacggctcagccgtgagtaccgtgacgaagacagaacgcttggtccacagcaatgacggcaccagaaccgcccgtacaaccactgtcgaaagtagctttgttcggcgtagcgaaaatggcagtggctcgacaatgatgcagaccaaaacctttagcagttcttcttcctccaaaaaaatgggttccattttcgaccgggaagaccaagcatccccgagggcgggctctctcgccgccttggagaagcgacaagcagaaaagaagaaagagttgatgaaagcacagagcctcccaaagacctcggcgtctcaggctcgtaaagccatgatcgaaaaattagagaaggaaggtgcagccggctccccaggaggcccccgagctgccgtccagaggagcactagctttggcgtgcctaacgctaactccatcaagcagatgctgctcgactggtgccgggccaaaactcggggttatgagcacgtggacattcaaaacttttcttcttcttggtctgatggtatggccttctgcgccttggtgcataacttcttcccagaggcctttgactacgggcagcttagtcctcagaatcggcgccagaactttgaggtcgcgttttcctcagcagagacacacgccgactgcccccaactattagacacggaggacatggttcggctccgggagccagattggaagtgcgtctacacgtacattcaggagttttatcgatgtctggtgcagaagggactcgtaaagacaaaaaagtcttag

SEQ ID NO: 134636 - DNA, 2748 bp, Artificial Sequence
  Description of Artificial Sequence: Synthetic coding sequence
atggcagacgaggcattagcagggttagacgagggtgctctgcggaagctgctggaagtgaccgcggatttagctgagcgtcgcagaattaggtctgctatccgcgaattgcaaaggcaggaactggagcgcgaggaagaggcattggccagcaagcgatttagggccgagaggcaggataacaaggagaattggttgcacagccagcagcgcgaggcagagcaacgtgccgcccttgccagattggcgggccagttggagagtatgaacgatgtcgaggagctgacagcactgctccggtcggctggagaatatgaagagaggaaactaattcgcgctgccatccgccgagtcagagctcaggagatcgaggcagccaccctcgccggaaggctgtatagcggcaggccaaacagcggctcccgagaagatagcaaaggtctggcggctcaccgcctagaacagtgtgaggtgcccgaacgtgaggaacaggagcagcaagctgaggtgagcaagccaacaccaacccccgaaggaacttcccaagacgtgaccacggtgaccttactcctcagggctccacccggttcaacttcctccagcccggccagtccgagcagcagtccaacgcccgcaagcccggaaccacccctcgagccggcagaagctcaatgtctcaccgctgaagtgcctggttcccctgagcctccgccctcccccccgaaaacaacatctcctgagccacaagagagccctacattaccctcaactgaggggcaggtggttaacaagctcctgtctggacccaaagagacaccggctgcccaatcccccaccagggggcccagcgatactaaaagggctgatgtcgccggacctcgtccctgccagcgcagcctaagcgttctttccccccgtcagccggctcagaaccgtgaatctacccccctagcaagtggtccgtcctccttccaacgggccgggtccgtacgcgaccgagtgcataagtttactagcgactcccccatggccgctcggttgcaggatggcacaccacaggcggccctctcccccctgacgccagcacgtctgctgggaccaagcctgaccagcacaacgcctgcgtcttctagcagcggctcaagtagtagagggccctccgatactagttctcggttctctaaggagcagaggggtgtcgcacagccccttgctcagctgcgatcctgtccccaggaagagggtccacggggtagaggtctcgccgccagacctctggagaaccgagcaggcggcccagttgccagaagcgaagagccaggcgctcccctgcctgttgccgttggcacagctgaacccggcggctccatgaagacgacattcacaatcgagattaaggacgggcgaggacaggcttccactggacgagtccttctgcctacaggcaatcagagggccgaactgactctaggactacgagccccgccgaccttgctgagcacctctagtgggggaaagagcactattacgagagttaattcccccgggacacttgcccgcttaggatcagtgactcatgtcacctcgttctctcacgcccccccctcttcacgcggaggctgctccatcaaaatggaagctgaacctgcagagccattagcagcagcagtggaagcagctaacggagcagagcaaactcgggtcaataaagcccccgaggggcgaagtccactctctgccgaggagctcatgaccattgaggatgagggtgtcctggacaaaatgctggaccagagtacagacttcgaagaacgcaaactgattcgggctgcccttcgagagcttcgacaacggaagcgcgatcagcgcgataaagagcgagaaagacgactacaagaagccaggggaagaccaggagaggggcgtggaaacactgctaccgaaacgaccactcgccactcacagagagctgctgatggcagcgccgtctcaactgtgaccaaaacagagagactggtgcactcgaatgatggtaccagaaccgcgcggacaactaccgtggaaagttcatttgtccgccgcagtgaaaacggctcggggagcacgatgatgcagacgaagactttttcaagctcctcctcaagcaaaaagatgggcagtattttcgatcgagaagatcaggcttccccccgagctggcagcctcgcagcgctagagaagagacaggccgaaaagaagaaagagcttatgaaggcccagagcctgcccaaaacctcggctagccaggcgcggaaggctatgatcgagaagctcgagaaggaaggagctgccggttctcccgggggccctcgcgccgcagtccaaaggagtacaagttttggagtgccgaatgcaaactcaattaagcagatgctcctggattggtgccgcgctaaaactcgcggatacgaacacgtagatatacaaaacttttcaagttcttggagcgacggcatggccttctgcgcgctggtgcacaacttttttccagaagccttcgattatggccaactaagtcctcaaaatagacggcagaacttcgaggtcgctttttctagtgcagaaacccatgccgattgtcctcaactcttagacaccgaggatatggtgaggcttagggagcctgattggaagtgcgtgtatacttatatccaggagttctatcgctgtctagtacagaaaggcctggttaaaacaaaaaaatcttag

SEQ ID NO: 134637 - DNA, 2754 bp, Artificial Sequence
  Description of Artificial Sequence: Synthetic coding sequence
atggcagatgaagcattagccgggctggatgaaggggcgctccgcaaattgctggaggtgaccgccgaccttgcagaaagacgcaggatcagaagcgccatccgggaattgcaaagacaggagttagagcgggaagaggaagctttggcaagtaagcggttccgggcggagcgccaggataataaggaaaattggctccattcacagcagagggaagccgaacagagagccgctttggcccggctggccggacagctggagtctatgaatgatgttgaggagttgaccgcattactccgctctgctggagagtacgaagagagaaaattaatcagggcagcaatcagacgggtgcgcgcacaggagatcgaggcggcaaccctcgcgggtaggctgtactcaggacggcctaacagcgggagtcgtgaggatagtaaagggctcgcggcccacagattagaacaatgtgaagtcccagaacgggaagagcaagagcagcaagctgaagtgtcaaaacctaccccgactcccgagggcacctcccaggacgtcaccaccgtgacattgcttttgcgagcaccacctggaagcaccagttcatctcccgcctcaccgagctctagccctactcctgcctcgccagaaccccctttagagccagccgaggcccagtgcctgaccgccgaagtcccaggctctcccgaacccccaccatccccccctaagacaacaagcccggaaccgcaggagtcaccaactttacccagtacggagggccaggtggtgaacaagctgctgtctggtcccaaagagacgcccgccgcccaatcacccactagagggccgtctgataccaagagggcagacgtagcgggtccccgcccatgccaacgctccctgagcgttctatctcctagacagcctgcccagaaccgtgagtcaaccccactggcctccggaccatcttcctttcagagggccgggtcggtgcgagatagagtgcacaaatttacctctgatagccccatggctgctagactgcaggacgggacaccccaagccgcactatcccccctgactcctgcccgactattaggtccaagccttacctcgaccaccccagccagcagttccagtgggtccagcagtcgggggccctctgatactagctctaggttctctaaggagcagaggggcgttgcccagccgctagcccagctgcgctcatgccctcaggaagaaggccctcggggacgtggtcttgccgccagacctctggagaatagagcgggcggacccgtggcccgctccgaggagcccggcgcaccacttcccgtggcggttggcactgccgaaccagggggatcaatgaaaacaacattcaccattgagattaaggatggccgcggacaggcctctaccggcagagtactgctcccaacaggaaaccaaagagctgagcttacactcggactgagggcgcctccaacgctcctgagcacctccagcggaggaaaatccactattacacgcgtgaacagtccaggaacactggctcgcctgggatctgttacccatgtgacatcattctctcacgcccctccttccagcaggggcggatgtagtattaagatggaagccgagcccgctgaacctctggcggcagctgttgaagccgccaatggcgccgaacagacaagggtgaataaggctcctgaagggcggagccccctttcggccgaagaactgatgaccattgaggacgagggcgttttggacaaaatgttggatcaatccaccgatttcgaggagagaaaattgattcgagctgcgctacgggaattgagacagcggaagcgcgatcagagggacaaggagagggaaaggaggctacaggaagcaaggggccgcccaggcgaagggagggggaataccgcaaccgagacaacaacaagacacagccagagggccgccgatggaagtgccgtgtccaccgttacaaagactgagcggcttgtccattccaacgacgggactcggactgcaaggacgacgaccgtcgagtcttcctttgtgaggagaagtgagaacggtagtggcagcactatgatgcagactaagaccttctcttcctcatcctctagtaagaagatgggaagcatcttcgacagagaggaccaagcatcccctcgggcaggtagtctggcagcactggagaagcgacaggccgaaaagaagaaggaactcatgaaagcacagagccttcctaaaacttcagcctctcaggcgaggaaggctatgattgaaaaactcgagaaggagggcgcagccgggtctccaggcgggcctagagcagcagtccagaggtccacttcatttggcgtgcctaatgccaattctataaagcagatgttattagactggtgccgtgcaaaaaccaggggctatgaacatgtggacatacaaaattttagctctagctggtcagatgggatggcattctgcgcactcgtgcataatttctttcctgaggctttcgactacggccagcttagtccgcagaatagaagacagaatttcgaagttgcgttcagttcggcagaaatgttagtggactgcgtgcccctggtggaagtcgacgacatgatgataatggggaagaagccggatcctaagtgtgtgttcacctacgttcagagtctgtacaatcacctgaggaggcacgagctgagactgcgtgggaaaaacgtgtag

SEQ ID NO: 134638 - DNA, 888 bp, Artificial Sequence
  Description of Artificial Sequence: Synthetic coding sequence
atggaagccgaacccgctgaacccttagccgccgcagtcgaagccgctaacggcgctgaacaaactcgggtcaacaaggcaccggaaggcaggagtccgctgtccgccgaagaactgatgaccattgaagatgagggagttttagacaagatgctggatcaaagcaccgacttcgaagaacgcaaattaatccgggcagcacttcgtgaactaaggcaacggaaacgagacggctccggatccacgatgatgcagacaaaaaccttctccagctcgtcttcgtctaaaaagatgggcagtatatttgatagagaagatcaggcttctccccgggccggttcactcgccgctttggaaaagaggcaggcggaaaaaaagaaggagctgatgaaagcccaaagcctgccgaagaccagcgccagtcaggctagaaaagccatgattgaaaagctggaaaaggaaggagctgccggcagtcctggtggcccgcgggctgcagtgcagcgctctacctctttcggggttcccaacgcgaattctattaaacaaatgctgctcgattggtgcagggctaagacacggggctatgaacacgttgacatccagaatttctcgtccagctggtctgatgggatggctttctgcgctctagtgcacaactttttcccggaagccttcgattacggtcagctctcccctcagaaccggcgtcagaactttgaagtggccttttcctcagccgagacccacgcagattgtccccagcttctcgacacagaggacatggttcgcctgcgcgaacccgattggaaatgcgtgtacacttatatccaggaattttaccggtgcctcgtgcagaagggccttgtgaagacaaaaaagtcctag

SEQ ID NO: 134639 - DNA, 2817 bp, Artificial Sequence
  Description of Artificial Sequence: Synthetic coding sequence
atgacctgcctgtcacacccactgcagctggaggtgactgctgatctggctgagagaagacgcattaggtcagcaattagagaactgcagcgccaggagctggagcgcgaggaagaggcactggcaagtaaacgattccgcgccgaaagacaagataacaaggagaattggctgcattcccagcagagggaagccgaacaacgggctgcactcgcccgcctggccggccagctggaatctatgaatgacgtggaggagttaacggcactcctgaggtctgccggcgaatatgaggaaagaaagttgattagagccgccatcagaagggtgcgcgcccaagagatcgaagctgccacacttgctggaagactctacagcggtcgaccaaacagcgggtccagggaggacagcaaagggctcgccgctcacaggctggaacaatgtgaagtaccggagcgcgaagagcaggagcaacaggcagaagtatccaagcccacgcccaccccggagggtaccagtcaggatgtcactacggtcaccctgttgttaagagccccccccgggtccactagctcatcccctgcgtcgccctcatcatcaccaaccccagctagccccgagccacccctcgaacccgcggaggctcagtgcctcactgccgaggtgcccggatcacccgaaccgccccccagccctcctaagacaacaagtccagaacctcaggagtcgcccacactgcccagtacagaggggcaggtggttaataagttactctcgggacccaaggaaaccccagcagctcaatcccctacacgtggcccgtctgacacaaagagggcggacgtggcaggtcctcgaccatgtcagaggtccttgtccgtgttgtcaccgcgccagccagcccagaaccgggaatctacccctctcgcttcaggaccttccagcttccagagagccggatcagtcagggaccgcgttcataaattcacatccgattctcccatggcagcacgcctgcaggacggcaccccccaggctgccttgtctcctctgacaccagctcgcctgctcgggccaagtcttacctctacaactcccgcttctagttcaagcgggtcctcatccagaggcccatcagacacaagtagtaggttttccaaggaacagagaggggtagcccaaccactggcccagctgcggagctgtcctcaggaggagggtcctcggggccgcggcctcgccgctcggcctctcgagaacagagccggcggcccagtggctcgctctgaggaaccgggagcccccctgccggtggctgtgggaaccgcagagcccggaggatcaatgaagacaacctttaccatagaaatcaaggatggacgcgggcaggcctcgaccgggagggtactcctgcctacaggcaaccaacgcgccgagttgactctcggcctgcgtgctcctcccactttactgtcaacgagctctgggggcaaatctacaattacacgtgtgaactcacctggaactctcgcgcgccttggctcagtgacgcatgtcaccagcttttcacatgccccaccctcgtcacggggtggatgctccatcaaagctgcggaggatgcaggcacacccgtagcccacccgcctgcgtttagtacaagaaggcggagttctactggcacgactcgcagtactagcttgatggaagcagaaccagctgagccactggccgcagcggtagaagctgccaacggcgccgaacaaacgagagttaacaaagcacctgaggggcggtccccacttagtgcagaggaactgatgactattgaagatgagggggtcctcgataagatgctcgaccagtctactgacttcgaagaacgaaagttaattcgcgccgccctgagggaattgcggcagcgcaagagggatcagagagacaaagagcgggagagacgcctgcaggaagcaagaggccgtcctggggagggacgtggcaacactgccacagaaaccacgaccaggcattcgcagcgcgccgccgacggatctgcagtcagcaccgttaccaaaacagagagactagtgcacagtaacgatggcacacgaactgcaagaactacaacagtagagtctagttttgtgagacgctctgagaacggctccgggtctaccatgatgcaaaccaagacattttcctcgtcttcttcaagtaagaaaatgggctctatcttcgatagagaagatcaggcttccccgcgtgccggctctctcgccgccttggaaaagaggcaggcagagaaaaagaaagagctgatgaaagctcaatcattgccaaagacatctgcatcacaggccaggaaagcgatgatagaaaagttagagaaggagggcgccgctggcagtcctgggggccctcgggcagcagtccaacggtctaccagttttggcgtgccaaatgcaaactcaatcaaacagatgctgctcgactggtgtcgcgcaaaaaccagagggtacgaacatgttgacatccagaacttctccagcagctggtccgacggaatggcgttctgtgcactggtccataatttttttccagaggcattcgattacggccagctgtcacctcagaacagacggcaaaacttcgaagtcgccttctcatccgcagagacccatgccgattgcccacagcttctcgacacagaagacatggtgaggcttagagagcctgattggaaatgcgtctacacttacattcaagagttttaccgttgccttgtccagaaaggcctggtgaagaccaaaaaatcctag

SEQ ID NO: 134640 - DNA, 114 bp, Artificial Sequence
  Description of Artificial Sequence: Synthetic coding sequence
atggccgacgaggcgctcgcgggcctggatgaaggagcgctgcgcaagcttttagaggtgactgctgacttagccgagcgcagacgaattcgaagtgccatccgcgagttgtag

SEQ ID NO: 134641 - DNA, 2823 bp, Artificial Sequence
  Description of Artificial Sequence: Synthetic coding sequence
atggcagatgaggcccttgccggcctcgacgagggggcgctccggaaactcctagaggttaccgcagacttggccgagcgtcgccgtataagatccgcgattagagagctgcagaggcaggagctggagagagaggaggaggccttggcctctaagcgcttccgggctgaacggcaagacaacaaggagaactggctgcacagccaacagcgggaggcagagcaacgggcagccctcgccaggctcgcaggacagctggaatcaatgaacgacgtggaagagctgacagccctgttgagatcagcaggcgagtatgaggagcgcaaactgatcagggccgctatccgtcgcgtccgcgcacaggagattgaggcagccacactggccggacgtttatactcaggcagaccaaactccggctctagggaggactctaaggggctggccgcacaccgcttggaacagtgtgaagtgcccgagcgcgaagagcaagagcagcaggcagaagtctcgaaacctacacccacacctgaagggacaagtcaggacgtgaccacagtaactctcctgctgagagcaccccctgggtccacaagctccagtcctgccagcccctctagttctcccactcccgcttccccagaacctccacttgagccagcggaggctcaatgtctgacggctgaagtgccaggttccccagagccaccaccctcaccccctaaaaccaccagccctgaaccacaggagtctcctactctgccatctaccgaagggcaggtagtgaacaaactcctctcaggacccaaagagaccccagcagctcaaagcccaaccagaggaccctctgatacaaagagagccgatgtcgctggccctcgtccgtgtcagagatctctgtctgttttgtctcccaggcagccagcccagaaccgcgaatccacccctttggcctcagggcctagctcttttcagagagccgggagcgtccgcgatagggttcataagtttacaagcgactcccctatggcagctcgcttgcaagacggaactccacaggctgcgctgtctcccctgacaccagcacggctgctgggtccctccctgacttccactactccagcgtcctcatcctccggatcatcctcccggggacctagcgacacaagcagcagattctccaaggagcaaagaggagtggcccagcctttggcacagctgaggtcttgtccacaggaggagggtcccagaggaagaggattggccgcgagaccccttgaaaatagagcaggcggacccgtcgccaggagcgaggaacccggtgcccccttgccggtcgcagtgggcacagcagaaccaggaggctctatgaaaaccacctttacaatcgaaatcaaagatggacgggggcaggcgagcactggccgtgtactcctcccaactggtaaccagagggccgagctgacactagggctgagggccccccccaccctgctgtccacctcttcaggagggaagtccactattacgagagtaaattctcccggcaccctcgctcgcctggggtccgtgactcacgtcacctcgtttagccacgctcctccatcgagccggggaggctgtagcataaaaatggaagccgagccggccgaaccattggcggccgcggtcgaggcagccaatggggcggagcaaacgcgggtcaataaggctcccgagggccggtccccgttgagcgccgaagaactcatgacgatcgaagacgaaggcgtcttggataagatgctcgatcaatctaccgactttgaggagcgcaaactgatcagggcagccctgcgcgaattacgtcagcggaaacgggaccaaagagataaggaacgcgagcgacggctgcaggaggctcgcggacgacccggtgaaggacggggcaacaccgctaccgagacaaccacccgtcattcccagagagcagcagacgggtctgcggtgtctacggtcacgaagaccgaacgccttgttcacagtaacgatggaactcgcacagcaagaaccacaaccgtcgaatcgagcttcgtgaggcgttccgagaacggatcggggtccacaatgatgcagaccaaaactttttcatccagttccagtagtaagaaaatggggagcatcttcgacagggaggaccaggcttctcctagagccggtagtctagccgccctggagaaaagacaggcagagaagaagaaggaattgatgaaggcccagtctctcccaaagacttcagccagccaggccagaaaagccatgattgagaagctcgagaaagaaggagcagcaggctccccaggcggcccaagggcagccgttcagcgctctacatcatttggagttccaaatgcgaattccattaaacagatgctgctggactggtgtagagctaagacgaggggctacgaacacgttgatatacagaacttctcatcttcctggtctgatggcatggcgttttgcgccctagtccacaatttcttccccgaagcctttgactatggacagctctctcctcagaacagacgccagaatttcgaggtggccttctccagcgcagagacccatgctgactgtccacagctgctagacacagaagacatggtgaggctgagagaacctgactggaagatgctggtggactgcgtgcccctcgtggaagtcgatgacatgatgatcatgggtaaaaagccagacccaaagtgtgttttcacttacgtgcagtcactatacaaccatctgcgaaggcacgagctgagattgcgaggcaagaacgtgtag

SEQ ID NO: 134642 - DNA, 1374 bp, Artificial Sequence
  Description of Artificial Sequence: Synthetic coding sequence
atggaacagaaagaggggaaactgagcgaggatggtaccacagtgtcccccgccgccgataatcccgagatgtccggcggtggagcgccggccgaggagacaaagggcacagctggaaaagctataaacgaggggccgcccaccgaatccgggaagcaagagaaggcccccgctgaagacggtatgtccgccgaactgcagggcgaagccaacggactagatgaggtcaaagttgaatctcagcgggaggctggggggaaggaagatgccgaggccgagctgaaaaaggaggatggcgagaaagaggaaacaaccgtggggtctcaagagatgacagggaggaaagaggagactaagtccgaacccaaggaggccgaggagaaggaatcaacactcgcaagcgagaagcaaaaagcggaggaaaaggaagccaaacctgagtccgggcagaaggcggatgcaaacgaccgggataagccagaaccaaaggcgactgtcgaggaggaggatgcaaagactgcaagccaagaggaaaccgtcgtggaggatgaggctaaggctgagcccaaggagcctgatgggaaggaagaagcgaagcatggcgccaaggaagaagctgacgagcccggctcgccctcagaagagcaggagcaggatgtggagaaggagccagagggaggagctggagtaatcccatcatccccggaggaatggcccgagtctcccactggagaggggcacaacctgtcgacggacggactggggccagattgtgtggcctccggacagacctccccctccgcctcggaaagctctccctccgacgttccacagtccccccctgagtccccgtcctccggagagaaaaaagaaaaagcccccgagaggcgagtgagtgcccccgccaggccccggggcccgcgcgctcaaaacaggaaggcaattgtagacaaattcggaggtgctgcttctggacctactgcattgttccgtaatactaaggctgcgggggctgcaattggcggagtgaaaaacatgcttctcgaatggtgtcgtgcgatgactaaaaagtatgaacatgtggacatccaaaatttttcttctagttggagcagcgggatggccttttgcgcactcattcacaaatttttccccgatgcgtttgactatgcagagctggatcccgctaagcgacgccacaacttcacattggcctttagcaccgctgaaaaattggccgactgcgcgcagctgttagatgtagacgatatggtgcgcctggcggtgccagactctaagtgtgtgtatacttacatccaagagctgtatagaagcttggtacagaaaggcttagttaaaacaaaaaaaaagtag

SEQ ID NO: 134643 - DNA, 1539 bp, Artificial Sequence
  Description of Artificial Sequence: Synthetic coding sequence
atgctgcccggcgcggtcggcgagagcgattgtagcgctgaggctcgcgagaagatggagcagaaggaaggcaaactgtctgaggacgggacaaccgtgtcgccagccgctgacaacccagaaatgtctggaggcggcgcaccagcagaagagaccaagggcactgcgggcaaggccataaatgagggcccccccacagaaagcggcaagcaggaaaaagccccagcagaagacggtatgagcgcggagcttcaaggagaggctaacgggcttgatgaagtcaaagtggagtctcagagggaagccggtgggaaagaggacgcggaagcggagttaaagaaggaggacggggagaaagaggaaactaccgtggggtcccaagagatgaccggcaggaaagaggagactaaaagcgaacccaaagaagcagaagagaaggaaagtaccctcgcaagcgaaaaacagaaggcagaggagaaagaggcaaaacccgagtccggtcagaaggctgatgccaacgacagagataaaccagagccaaaggcgacggtggaagaggaggatgccaagacggcaagccaagaggaaacaggccagcgaaaggagtgctcaacagagccaaaagagaaagcaaccgacgaggaagcaaaggccgaaagccagaaagccgtggtagaggatgaggcgaaagccgaacccaaagagcccgatggcaaagaggaagctaagcacggcgctaaggaggaagctgacgccaaagaggaagctgaggacgctgaagaggcagaacctggaagtccatctgaggagcaggagcaggacgtggagaaggagcccgagggaggggcgggcgtaatccccagtagcccagaagaatggcccgagtctccaacaggagagggtcataacctgtctaccgatgggctgggccccgactgtgtggctagcggacagacgtcaccctcagcctccgagagttccccttcggacgtgccacagagccccccggagagcccgagtagcggtgagaaaaaagagaaagcacccgagcgacgcgtctctgcgccggctcgaccaaggggacccagggcgcagaacagaaaagcaatagtggataagttcggtggagcagcatccggaccaacagctctctttagaaatacaaaagccgccggggccgcgataggtggagtgaaaaacatgcttcttgaatggtgcagagctatgacaaagaagtacgagcacgtcgacatccagaacttctcaagctcctggtcctcaggaatggctttctgtgcgttaatacacaaattcttccccgatgcattcgactatgctgagctcgacccagcaaaaaggcgccacaattttaccctggctttttccaccgctgaaaaactggccgattgtgcacagctactggacgttgatgatatggttcgcttagctgtcccagactcaaaatgcgtatacacatacattcaggaactgtacaggagcctggtccagaaaggcctggtaaagaccaagaagaaatag

SEQ ID NO: 134644 - DNA, 1485 bp, Artificial Sequence
  Description of Artificial Sequence: Synthetic coding sequence
atggaacaaaaagaaggtaagctctcagaggatggaaccaccgtgtcccctgcggccgataatccggaaatgtcggggggcggcgcccccgctgaggagaccaagggaacggcagggaaagccattaacgaagggccccccactgaatccgggaaacaggagaaagctcctgccgaagacggtatgagcgcggagttacagggggaagccaacgggttggacgaggttaaagtagaatctcaaagagaggccggggggaaagaggacgccgaggccgagcttaaaaaggaggacggggaaaaggaagagacgacggtgggttcacaggaaatgactggtaggaaagaggagactaagtcagagcccaaagaggcagaggagaaagagtccaccctggcaagtgaaaaacagaaagctgaggaaaaggaggcaaaaccggagtcgggccagaaggccgatgccaatgatagggacaagcctgaaccaaaagcaaccgtagaagaggaggatgctaaaacggcctcccaggaagaaaccgggcagcgaaaggaatgctctacagagcctaaggagaaggccaccgacgaggaggcaaaggccgagtctcagaaagcagtcgtggaggacgaagctaaggccgagcccaaagagcctgacgggaaagaagaggcaaaacatggcgcaaaagaagaagctgacgctaaagaggaggcagaagatgccgaggaagctgagccaggatcaccctccgaggagcaagagcaggacgttgaaaaggaaccggaggggggtgcgggtgtgattccatcttcacctgaggaatggcccgagtcaccaacaggagaggggcacaatctctctaccgatggcctcggcccagattgcgtggcttcgggccaaaccagtccatccgcgagcgaatcaagcccttctgacgttccacagtcccctccagaaagtccaagctccggcgaaaagaaggagaaagccccagaaagacgagtgagcgcaccagctcgaccacgagggcccagggcacaaaataggaaggccatagttgacaaatttgggggcgccgccagtggtccaacggccctctttcgcaacacgaaggccgccggagctgcgattggaggtgtgaagaatatgctgcttgagtggtgccgggccatgactaagaagtacgagcatgtcgatatacaaaacttttcatcctcctggagctctgggatggcgttctgcgctctgattcataaattttttcccgatgccttcgactatgccgagcttgatcctgcaaagcggcgtcacaactttactctcgccttttcgaccgctgagaaactggcggactgcgcacagctactagacgtggatgatatggtcaggctcgccgttcctgattccaagtgcgtgtacacatacattcaggagctgtacaggtccctcgtccagaaggggcttgtcaagaccaaaaagaagtag

SEQ ID NO: 134645 - DNA, 312 bp, Artificial Sequence
  Description of Artificial Sequence: Synthetic coding sequence
atgtcagaggaaaagcccaaggaaggggtcaagactgaaaatgatcacattaacctgaaagtggccggacaggacggatctgtggttcagttcaagattaaacgacacacacccctcagcaagctcatgaaagcctattgtgaaaggcagggtttaagtatgcgtcagatcagatttcgttttgacggccaacctattaacgagaccgacacccccgcccagcttgaaatggaggacgaggacacaatcgacgtcttccagcagcagacagggggcgtgccggaatcctcattagcgggtcactctttttag

SEQ ID NO: 134646 - DNA, 426 bp, Artificial Sequence
  Description of Artificial Sequence: Synthetic coding sequence
atgagtgaggagaagccaaaagaaggagtcaaaaccgagaacgatcatatcaaccttaaggttgctggccaggatggtagcgtagtgcagtttaagatcaagcgtcacaccccattatctaagctgatgaaggcctattgcgagcggcaggtccgccacctggcccctcctcagtccctcccagtgtgcgctctggtactgtgcgtgccaggaattccgcgggctcgggcctccaggggctggacccaaatgcagctccctgaaggcctgtcgatgcgccagatcaggtttcgcttcgacggccagcctattaacgagaccgatactcctgcccaactggaaatggaggacgaagataccatcgacgtattccagcagcagacaggcggcgtaccagagagcagcctggccggacactcattttag

SEQ ID NO: 134647 - DNA, 288 bp, Artificial Sequence
  Description of Artificial Sequence: Synthetic coding sequence
atggctaacgaaaagcctaccgaggaggtcaagactgagaacaacaatcacattaacttgaaggtggcgggtcaagatggaagtgtggtgcagtttaagatcaagcggcaaacacccctgagtaaactgatgaaggcttactgtgaaccaagagggctgagcgtaaagcagatcagattccgtttcggtggacagccaatttccggtacagataagccagcacaactggaaatggaagatgaggacaccattgatgtgttccagcagccaactggcggagtgtactag

SEQ ID NO: 134648 - DNA, 411 bp, Artificial Sequence
  Description of Artificial Sequence: Synthetic coding sequence
atggcgggtgccggttctgctgctgtgagtggcgctggcaccccggtcgctggccctaccgggagagatctgttcgcggaagggctgctggagtttttgcggcctgctgtgcagcagttggactcccacgtgcacgccgtgcgtgagagccaagtagagttgcgcgagcaaatagataaccttgcaaccgaactgtgtcgcattaacgaggatcagaaggtcgccctggacctggacccatacgtgaagaaactcctgaacgcaaggaggagggtcgtgctcgtgaacaatatcttgcagaatgcccaagagagactccggcgcctgaatcacagcgtcgcaaaggaaaccgccaggcgccgagcaatgctggactctgggatttaccctcccgggtcacctggtaaatag

SEQ ID NO: 134649 - DNA, 2298 bp, Artificial Sequence
  Description of Artificial Sequence: Synthetic coding sequence
atggctggttttaaaagagggtatgatggtaagatcgccggcttatacgatctggacaaaacattggggcgtggccacttcgccgtagtcaagcttgctcggcacgtcttcacaggggaaaaggtcgccgtgaaagtcatcgacaagactaagctcgacaccttggccacaggccatctatttcaggaggtcagatgcatgaagctcgtgcagcatcccaacatcgtaaggctgtacgaagtgatagatacccagaccaagctgtacctgatcctggagctaggagacggaggagatatgttcgactacattatgaaacacgaggagggcctcaacgaagacctggcaaaaaaatacttcgcacaaatagtgcacgccatctcgtattgccataagctccacgtggtacatcgggatttgaagcctgagaatgtagtgtttttcgagaaacaggggttggtgaagctcactgactttggattctccaataagtttcagccggggaaaaaactcaccacatcttgcggttctttggcgtactctgcgccggagatcctgctgggggacgagtacgacgcccctgcggtggacatctggagcctgggcgttatcctgttcatgctggtctgcggacagcccccctttcaggaagctaatgacagcgaaactttaacaatgatcatggattgcaagtataccgtgccatcgcatgtgagtaaagagtgtaaggacctaattacacgtatgttacagagagacccaaagcgcagagcttcactggaggagatcgagaatcacccttggctccaaggcgttgatcccagcccagccaccaaatacaatattccgctggtctcctacaaaaaccttagcgaagaagaacacaactctatcattcagaggatggtactcggagacattgctgatcgtgacgccatcgtggaggccttagagacaaataggtataatcacattacggctacatatttcctgcttgcggagagaattctgagggaaaagcaggagaaagagatccagactcgctcggccagtcctagtaacatcaaggctcaattccgtcagtcctggcccaccaaaattgacgtgccgcaggacctggaggacgacctcacagcgactcccctctctcatgcaacagtaccgcaatcgcccgcccgtgcagcagactctgtgcttaacggtcaccgatcaaaggggctgtgtgatagtgctaagaaagacgatctgcctgaactggctggacccgcactgtctacagttccgcccgccagcctgaagccaacagcgagcgggcgtaagtgcttatttcgtgtcgaggaggatgaggaggaagacgaagaggataagaaacccatgtcactatctacacaggtagtgctccgtcggaagccgagcgtcactaatagattaacctcgagaaagagtgccccagtgctgaatcaaatttttgaagaaggcgaatcggacgacgagtttgatatggacgagaatctcccgcccaagctgtccaggctcaagatgaacatagcctcccccggcactgtccataaaaggtatcacagacgtaaatcacaagggagagggagttcatgtagcagcagcgagacgtcagacgacgattctgaatcaaggagacggctcgataaagacagtggtttcacatatagctggcaccgccgggatagttctgagggaccccccggtagcgaaggggacgggggaggccaatccaagccttcaaacgctagcggaggtgttgataaggcatccccatctgagaataacgctgggggcggcagtcccagctctggatctggcggaaatcccactaatacctctggaactacccgcagatgtgcaggaccaagtaactctatgcagcttgccagtagatctgcaggggagctggtggagtcactgaagctgatgtctctttgcctcgggtctcagctccacggttcgaccaagtatattattgatcctcagaatggcctgtccttctcttccgtgaaagtgcaggagaaaagtacgtggaagatgtgcatcagcagtaccggcaacgcagggcaagtaccagccgtaggaggcataaaattttttagcgatcatatggccgacaccacgacagaattagagcgaatcaaaagtaaaaaccttaagaataacgttcttcagctcccgctctgcgaaaagaccatcagcgtgaatatacagagaaacccaaaggagggcctgctgtgcgctagtagccctgcctcatgttgtcacgtgatttag

SEQ ID NO: 134650 - DNA, 2298 bp, Artificial Sequence
  Description of Artificial Sequence: Synthetic coding sequence
atggccgggtttaagcgcggctacgatggtaaaattgcaggcctatatgatctggacaaaaccctgggtcgggggcactttgccgtggtgaagctggctcggcatgtgttcactggcgagaaagtggctgtgaaggttatcgacaagactaaactggacacactggctaccggccacttatttcaggaggtgagatgtatgaagctggttcagcaccctaacattgtccgcctctacgaggttatcgacacacagacgaaactgtatttgatcctcgagctgggcgacgggggagacatgtttgattacataatgaaacatgaagaggggcttaatgaggatcttgcaaagaaatattttgcacagatcgtccacgccataagctactgtcataaattacacgtggtgcaccgggatttaaaacctgaaaatgtcgtcttcttcgagaagcagggactggtcaaattgacggatttcgggttctctaacaagtttcagcccggcaaaaaacttaccacaagctgcgggtctttagcctattcagctccggagattcttttaggcgatgagtacgacgctcccgctgtcgatatctggagcttaggggtgatactgttcatgcttgtatgtggccagccaccattccaggaggctaatgactcagaaactctgaccatgattatggactgtaagtacaccgtgcctagccacgtcagtaaagaatgtaaggacctaatcactaggatgctccagcgagatccaaagcgcagggcctcgctcgaagagattgaaaatcatccatggctccagggtgttgatccaagcccagctaccaaatacaatattcctctggtgtcttataagaatctgagcgaagaagagcacaattctattatccagcggatggttctgggcgacatcgccgaccgggatgctatcgtggaagcgcttgagactaacagatacaaccacataaccgccacctactttttgctcgccgaacgtatcctaagggagaagcaagagaaagaaatccagactaggtcggctagcccgtctaacattaaggctcaattcaggcagtcgtggccaacgaagatagacgttccacaggacctagaggatgatctgaccgctacaccgctttcgcacgctacagttcctcaatccccagcccgggccgctgatagcgttctcaacggccaccgctcaaaaggactgtgtgacagcgcaaagaaagacgacctacctgagctggcaggtccagctctcagtacagtccctcctgcttcactgaaaccaaccgcctcgggcagaaagtgcttattcagagtcgaggaggacgaagaagaggacgaagaagacaaaaagcctatgtccctatctacgcaagtagttctgaggaggaagccctcagtgaccaaccgcttaacgtccaggaagtcagcaccagtcttaaatcagatctttgaggagggcgaatctgacgatgaatttgacatggacgaaaacctccctcctaagttgagtaggctaaagatgaacatagcttcacccggcacagtacataaacggtaccatcggcggaagtcacaggggagagggagcagctgcagctcaagcgagaccagcgacgatgacagcgagtcacgcagacggctcgacaaggattctgggttcacatattcatggcaccggcgggattcctccgaaggtccacctgggtcagagggcgacggcggaggtcagagcaagccatctaatgcctcaggaggcgtcgacaaggcctctccctctgaaaataacgccggtggtggcagcccgtcttctggatcaggagggaatcctacaaatacttccgggacgactaggcggtgcgccgggccatctaactccatgcagctcgccagcaggtctgccggagaactggttgaaagtctgaaattaatgagcctgtgcctaggtagccagctccatggcagcaccaaatatattattgacccccaaaatggcttgagcttttcatccgtcaaagtgcaggagaagagtacctggaaaatgtgcatcagcagtacaggtaacgccggacaggtgcccgccgtgggcggcataaagttcttcagtgatcacatggcagatactacgaccgaactggagcgtatcaagtcgaagaatctcaagaacaacgtcctgcagttacccctttgtgagaaaaccatttccgtgaatatacaacgcaatccgaaagagggcctcctgtgtgcttcctccccagcatcttgttgccatgtgatttag

SEQ ID NO: 134651 - DNA, 2298 bp, Artificial Sequence
  Description of Artificial Sequence: Synthetic coding sequence
atggctggatttaagagaggttatgacggcaagatcgctggactttatgacctcgataaaaccctgggacggggccattttgcagtcgtgaaacttgctagacacgtgttcactggcgaaaaagtggctgtgaaggtcatcgacaaaaccaaactggataccctggccacaggccatctttttcaggaagtgcgctgcatgaagctggtgcaacaccccaatatagtgagattgtacgaagtcatagatacccagactaagctgtatctcatcctggaactgggggacggcggcgatatgttcgactatattatgaagcacgaggagggactgaatgaagatcttgcaaaaaaatactttgcccagatcgtgcacgctatttcatattgtcataagctgcatgtggtgcatagggatttaaagcctgaaaacgtggtgttcttcgagaaacaggggctcgtaaagttaaccgactttggcttctctaataaatttcagccaggcaaaaaactcactacctcttgcgggtctctggcttacagtgccccggaaatcctacttggagacgagtacgacgcccccgcagtggacatctggtcattgggcgtcattctgttcatgcttgtatgcgggcagccgccatttcaggaagccaacgactccgagactctgaccatgatcatggattgcaaatatacggtaccgagtcacgtaagcaaagaatgcaaggaccttatcacgaggatgctccaacgagatcccaaacgccgggcaagtctggaagagatcgagaaccacccttggctgcagggtgtcgaccctagccctgcaacaaagtacaacatccctctggtgtcgtacaaaaatctctcagaagaagagcacaatagcatcatccagagaatggtgctgggcgatattgctgatcgcgatgcgatcgtggaagcactggaaacgaaccgctacaatcacatcacagccacatacttccttctggccgaaagaatcctgagggagaaacaggaaaaagagatccagaccaggtctgcctccccaagcaacatcaaggctcagttccgccaaagctggccaactaagatcgatgtgccccaggatcttgaagatgatcttaccgccacgcccctgagccacgctactgtaccacagagcccagctcgtgcagcagactctgtgctgaacggtcaccggagcaaaggattgtgcgattcagccaaaaaagatgatttgcctgaactcgccggccctgctctttccacggttcccccggcctccctaaagcccaccgcttccggcagaaaatgcttattccgcgttgaggaagatgaggaggaggatgaggaggataagaagcccatgagccttagtactcaggtcgtgcttaggcgaaagccatccgttaccaataggctgacttccaggaagtcagcccctgttctcaaccagatcttcgaagagggggagtccgacgatgaatttgatatggatgagaacttgcctcccaagctatctagactcaagatgaatattgccagtccaggaaccgtgcataagagatatcacagacgcaagagccagggccggggatcatcgtgtagctccagcgaaaccagcgatgacgactcagagtctagaagaagacttgataaggactcgggatttacatactcctggcacaggagagattcctctgagggccccccgggctcagagggagacgggggggggcaatccaagcccagcaacgctagcggtggcgtggacaaggcctcccctagcgaaaataacgccgggggaggttccccctcatccggatccgggggtaaccccaccaacacctctggaacgacgagaagatgcgcagggccttctaattccatgcaactggcctcccggtcggctggggaactcgtcgagtccttaaagctgatgagcctttgcctgggcagccagttacatgggagcaccaaatacattatcgaccctcagaacggactgagcttttcaagtgtgaaggtccaagagaaatcaacatggaagatgtgcatctcaagcaccggcaacgcaggccaggtgcccgccgtggggggtattaagttctttagtgatcatatggcagacacaaccaccgagctggaacgtatcaaatccaagaatctgaagaataatgtgttgcagttgcccttgtgtgaaaagacaatttcagtaaacatccaacgcaaccctaaagaagggttgctctgcgctagttctccggcctcctgctgccacgtcatctag

SEQ ID NO: 134652 - DNA, 9693 bp, Artificial Sequence
  Description of Artificial Sequence: Synthetic coding sequence
atgcagtctagtcccagccccgcccatcctcagcttcctgtactgcagacccagatggttagcgacgggatgaccggttccaacccggtgtctcccgcttctagtagcagccctgcttcatctggtgcaggaggaatttccccacagcatatcgctcaggactccagcttagacggcccgcctggtcccccagacggggccactgtgcccctcgagggcttttccctgtcacaagcggccgatttagctaataaaggccccaagtgggagaaatctcacgctgagatcgcggaacaagccaaacacgaagccgagattgaaacacgaattgccgaattgcgtaaggagggattttggagcttgaagcgacttcccaaggtgcctgagccgcccagacccaagggccattgggattacctctgtgaggaaatgcagtggctgagtgcggactttgctcaggaacgccgctggaagcgaggagttgcccgaaaggtggtgcgaatggtcattagacaccacgaggagcaacgtcaaaaggaagaaagagccaggcgcgaggaacaggcaaaactgcgcagaatcgccagcacgatggctaaagacgttcgtcaattttggtcgaatgtggagaaggtagtgcagttcaagcagcagtcccgcttagaagagaaaaggaagaaggcgctggaccttcatcttgatttcatcgtgggtcagacagaaaaatactccgatttgctgtcacagtctttaaatcaacccttaaccagcagcaaggctggttcctccccgtgcctgggatctagctcagctgcttctagtccccctcccccagcgtcccgactagacgatgaggacggggactttcagccacaggaggatgaggaagaagatgacgaagagacaattgaggtcgaggaacaacaggaaggcaatgacgccgaagcccagcgacgggaaatcgaactactgcggcgagagggtgagctgcctttggaggagttgctgagatccctcccaccgcaactactggagggacctagtagcccttcccaaacccccagctctcatgattccgacacgagggacggtcccgaggaaggagctgaggaggagccccctcaagtattggaaatcaagccaccaccgagtgctgtcactcagcgcaacaaacagccgtggcacccagacgaagacgacgaagagtttaccgccaatgaggaggaagctgaagacgaggaggataccatcgctgcggaggaacagctggagggcgaagtcgaccacgccatggaattgtctgagctcgctagggagggcgagctcagtatggaggagcttctgcaacagtacgcaggggcctacgctcccggcagcgggtcgtccgaggacgaggacgaggacgaagtggatgcaaatagctccgattgcgaaccagagggcccggttgaagccgaggagccacctcaggaggattccagcagccagtcagattccgttgaggataggtcagaggacgaagaagatgagcattcagaggaggaggagacttctggctcttctgcctctgaagaaagtgaaagtgaggagagtgaggacgcccaatcccaaagtcaggcggatgaagaggaagaggatgacgacttcggcgtggagtatctgttagctagggacgaggaacagagtgaagccgacgcgggctcaggcccgcctactccaggtcccacgacccttggaccaaaaaaggagataaccgatatagcagcagccgcagagtccctccagccaaaaggctacacactggctactactcaggtgaagacccccattccactactgctccgcggccagctccgagagtatcagcatatcgggctggattggcttgtgactatgtatgagaaaaaactgaatggaattctggcagatgaaatggggctcggaaaaacaattcagacaatttccctgctggcgcatctggcatgcgagaaaggtaattggggcccacacctgattatcgtcccaacctcggtcatgctcaactgggagatggagcttaagcgctggtgcccgagtttcaaaatacttacatactacggcgctcagaaagaaagaaaactgaagcgccaaggctggacgaagccaaacgccttccacgtgtgcatcacgagctataaacttgtcctgcaggatcaccaggcattcagacggaaaaattggaggtacctgatcttggacgaggctcaaaacatcaagaattttaagagccaacgctggcagagtctcctgaacttcaactcacagagacgattgcttttgactggaacaccgctccagaactcactcatggaactctggagcctgatgcatttcctcatgcctcatgtgttccagtcgcaccgcgagtttaaagaatggttctcaaatcccctgactggcatgatcgaggggagccaggaatataacgaggggttagttaagaggctgcacaaggtgctgaggcccttcttactgcgccgcgtcaaagtcgacgtcgaaaaacaaatgccaaaaaagtacgagcatgttattcggtgccgactcagcaaaagacagcggtgcctgtatgatgattttatggcacagacaactactaaggagacccttgctacaggccattttatgtctgttataaatattttaatgcaactgcgaaaggtgtgtaaccacccaaatttgttcgaccctcgccccgtaacctctcctttcataacaccgggcatctgcttcagcaccgcctctttagtgcttcgcgctactgacgttcatcccctccagcgcatcgatatggggaggttcgacctcatagggttggagggtcgtgtctccagatacgaagccgatacctttctaccacgccatcgattgtctagacgagtgcttctggaagtcgcaacagcccccgacccacctccccgacccaaaccagtcaagatgaaagttaataggatgctccagcccgtaccaaagcaggagggtagaaccgttgtggtagtgaacaaccctcgcgcaccacttggccccgtgccagtgcgaccccctccagggcctgaattgtccgcccaaccaacgcccggccccgtgcctcaagttcttccagcctccctcatggtgagcgcgtcaccggccggtccaccactgattcccgccagccgtcctcctggcccagtgttgctgccacctttgcagccaaatagcggtagcttaccacaggttctcccatcccctcttggcgtccttagtggcacctccaggccccccaccccgaccctttccttgaagcccacaccgcctgcccctgtaaggctatcacctgctccacctcccgggtcatcatctctcctcaagcctctgactgttcctcccggctacacattcccacccgcagccgctacaacaactagtaccactaccgccacggcaaccacaaccgccgtccctgccccaaccccagcccctcagagactgattctctcaccggatatgcaagcccggctcccttccggagaggtagtctccatcgggcagcttgcttccctggcccagaggcctgtggctaacgccggcggcagcaagcctctcaccttccagattcaggggaacaagctgaccctgaccggtgcacaggtgagacagcttgcagtagggcagccacggcccctccagcgcaatgtggtacacctcgtgtcagcaggaggccagcaccacctgatcagtcagcctgcccacgtggcgctgatacaggctgtggcccccacgcccggccctacgcctgtatccgtgctgccttcgagcacaccatccacaactccagctccaacaggcttgtcattgccccttgcggccaatcaggtgccccccactatggttaataacacaggggtagtgaaaatcgtcgtccgacaggcaccccgagatggcctcactccggtgcccccactcgcgcctgctccacgtcctccgagttcaggattaccagctgtcctgaatccccggccgaccctgacgccagggagactccccacccctacgttggggacggctagagcacctatgcctacccccacattggttagaccgcttttgaagctagttcattcgcctagtccagaggtgagtgcttctgcaccgggcgctgcccctttgaccattagctccccacttcacgttccttccagcctgcctggccccgcttcatcccctatgcccatccctaactcatcgccattggcatctcccgtcagttccactgtcagtgtgcccctgtcctcatcattgcctatatcagtgccgactactctcccagctccggcctcagcacctctgaccattccgatctctgcccctctgacagtctctgcttcaggccctgctctgctgacaagtgtcacaccccctctggcccctgtcgtaccggcagccccaggcccgccctcgctggcgccttctggcgcgtcgccatcggcaagcgctctcacattgggcctggccacggcaccttctctgagtagttcccaaaccccgggacaccccctgctattggcgcccacaagcagtcatgtgcctgggctgaactctacagttgcgcctgcgtgttctccagtgttagtccccgctagtgcactcgcatccccattcccaagcgctcccaaccctgcacctgcccaggctagcctcctagctccggcaagctctgcatcacaggcgctggcaactcctctggccccaatggcagctccccaaacagccatcttggccccatctccagcacctcctctggcaccccttcctgtattggctccgtctcctggagctgctccggttctggccagtagccagacccctgtgccagttatggccccaagctctacaccaggcacgagtctggccagcgcttctccagtgccagcccctaccccggtcctggccccttctagcacccagacgatgctgcctgctcctgtcccctctccgcttccctctccagcgagcactcagacgctggctctggctccagcactcgctcccaccttaggtgggagtagccctagccagacgctcagcctgggcacgggcaaccctcagggccccttccccactcaaactttatccctcacccccgcctcatcccttgttccaacacccgcccaaacactttcccttgcccctggcccccccctaggccctactcagacgctgtctttggcccccgcgcctccccttgccccagcttcaccagtggggcctgcacccgcgcatacccttaccctggcgcccgcttcttcttctgcttctttgttggctcctgcaagcgtgcagacactaacgctgtccccagctcccgtccctacactcggcccggcagctgcccagaccttggcattggccccggcgagcacccagtccccagcgagccaggcctcttcgctggttgtttccgcttcaggtgcagcccccctgcctgtgaccatggtgtcacgactgcctgtctccaaagatgaacctgacactctgacacttcgcagtggccccccctcacctccttccaccgccacttcttttggcgggccaaggccacgcaggcagccccctcctccacctcggagtccattttatctggattccctggaggagaaaagaaaaagacagagatccgaaagactcgagcgaatctttcagttgagcgaagcccacggggccctggcgcctgtgtacggaacggaagtgctcgacttctgcaccctgcctcagcctgtcgcaagccctatcggcccacgatccccagggccctcccatcctacattttggacctataccgaggccgctcaccgcgccgttctgttcccccaacaacgcctcgaccagctgtccgaaataattgagagattcatcttcgtgatgcctcctgtcgaggcccccccaccttccctgcatgcttgccatccaccaccctggctggcacctagacaggccgccttccaggagcagttagcttctgagctttggcccagagctagacccttgcaccgaatcgtatgcaatatgcggactcagttccccgacctccgcttaatccagtatgattgcggcaaactgcagaccctggctgtgctgttgcgtcagctgaaagccgagggacatcgcgtcctgatctttacgcagatgaccaggatgctggacgtgcttgaacagttccttacctatcacggtcacctctacctaagattggatggatccacacgggtagagcagcggcaagctctcatggagaggtttaacgctgacaagcgaattttctgtttcatcctgtcaacccgatccggaggcgttggggtcaacttgacaggcgccgacaccgtggtgttttacgattctgactggaaccccacaatggacgcccaggcacaagatcgctgtcatcgaattggccaaacacgggacgtccacatatatcgtctcatctctgaacgtactgttgaggaaaacatcttgaaaaaggcgaatcagaagcggatgctgggagatatggctattgagggcgggaactttacaaccgcgtattttaaacaacagaccatcagagagttgttcgatatgcctctggaagagccttcctcaagcagcgtccccagtgccccagaggaggaggaggaaaccgtcgccagcaagcagacacacatcttggagcaggccctttgtcgggccgaagacgaggaggatattagagccgcaactcaggcgaaggctgagcaggtggccgagctcgcggagtttaatgagaacgatggctttcctgccggggagggagaagaagccggccggccaggggcggaggacgaggaaatgtccagagctgaacaggagatagccgctttagttgaacagctgactccaatagagagatacgctatgaaatttctggaagctagtctcgaagaggttagtcgggaggagcttaagcaggctgaggagcaggtggaggccgctagaaaagacctggatcaggccaaagaggaggtcttccgcttgccccaagaggaggaggagggcccaggggctggagacgagtcatcatgtgggactgggggagggactcaccgacggtccaagaaagcgaaggcaccagaaaggcccgggactcgagtttcagaaaggttgcgtggggctcgggcagagacacaaggggcaaatcacacaccagtcattagcgctcatcagaccaggtccacaacgacaccacctagatgttcaccagcgagggaacgtgtgccaagacctgctccccgacctcggcctaccccagcatccgctccagcagctatacctgccctggtgccggtgccagtaagcgcaccagttccaatcagtgcccccaacccaattacaatactgcctgttcacatcctgccttcacccccaccccccagccagattcctccttgctccagtccagcgtgtacacctccacctgcatgtactcctccgccagcccataccccaccacctgcccaaacctgtctcgtgacaccttcaagtcctcttctcctcggtcctccatccgtgcccatcagcgcatcagtgaccaacctccctctcggactccgtccggaggccgagttatgcgcacaagccctggctagtcccgaaagccttgaactggcttcagtggcttcttccgagacatcgagcttgagccttgtgccccccaaggacctcctgccggtcgctgtcgagatccttccggtcagcgaaaaaaacctatcactcaccccatcggcaccatcactgactctggaggccggcagcatccccaacggacaggagcaggaagcgccagattccgccgaagggaccacattgactgtgctccccgagggggaagagctcccgttatgtgtctcggaatccaacggcctggagctccccccctccgctgccagcgatgaacctcttcaggagcccctcgaagccgaccgcacaagcgaagaactgacagaggccaaaacacctacctcctcaccagagaagccacaagaactggtcacagccgaggttgcagccccctcgaccagctcatctgccacatcaagtcctgaaggtcccagccccgctagaccccctcggcgtagaacttctgctgacgtggaaatcaggggtcagggtacaggccgccctgggcagccgccaggccccaaggtcctccggaaactgcctggtagactggtaacggtcgtggaggagaaagagctggtaagaaggaggagacagcagcggggcgctgcatcaacgctagtccctggggtctccgaaacctctgcctctcccgggtcaccaagtgtgcggtcaatgagtgggccggaaagctcgccaccgatcggcggcccatgcgaggcagcccccagctccagtctcccgacgcctccacagcagcccttcattgcccggcgacacatagaactcggcgtcacgggcgggggttccccagagaacggggatggggcgttactggctatcaccccccctgctgttaagcggcgccgcggccgcccgccaaaaaagaacaggtcacctgctgacgcagggcggggcgtagacgaagctccgtcatctaccttaaaaggcaagacgaacggtgctgaccccgttcccgggccagagaccctcattgtggccgatcctgtcctggagcctcagttaatcccaggcccacagcccctggggcctcagccagtgcacagacctaatccgctactgtcccctgtcgagaagcgtcgccggggaagacctcctaaagcgcgagatctacccatccctggaaccatttccagcgctggagacgggaactcagagtccagaacacagcctccgccacacccgtccccactcacccctcttccccctctgctcgtgtgccccacggcaaccgttgcaaacaccgtcacaaccgtaactattagcacatctccacccaagaggaaaagagggcgcccacctaagaatcccccctccccacgcccctcccagctcccagtgttggatagggatagtacatctgttctcgaaagctgcggactcgggcggcggcggcagccccagggtcagggcgagtccgaaggctcctcctcagatgaagacggatctagacccttgactaggctcgctcgtctgagactggaagctgagggcatgcggggccggaaatccggggggtccatggtggtggccgttattcaagatgatctcgacctggcggattcaggcccaggtggcctcgaactgacccccccagtagtttctctgacacccaaactcaggtctaccagactcagacccggctctctagtgccccccctcgagacagaaaagctgccacgcaagagagcgggtgctccagtggggggttcccctggtctggccaagaggggccggctgcagcccccgagtcccttaggacccgagggctctgtcgaggaatccgaagccgaggcctccggcgaagaagaagagggcgatgggactccaagacggcggcccggccctcggagattggtcggaacgacaaatcagggcgaccagagaatcctgcggtcaagcgcacctccttcactggcagggcccgccgtgagccatcgtggtcgcaaggccaagacttag

SEQ ID NO: 134653 - DNA, 9219 bp, Artificial Sequence
  Description of Artificial Sequence: Synthetic coding sequence
atgcagagtagtccctccccagcccatcctcagctaccggtgttgcagacgcaaatggtctccgacgggatgactggatccaaccctgtctcaccagcatcctcttcctccccagcttccagcggtgcaggcggaattagcccacaacacatcgcccaagacagctcgctggatggcccgcctggtcctcctgatggcgcaacggttcctttggaaggcttcagcctgtcccaggccgccgaccttgctaacaagggccctaagtgggagaagtctcacgctgaaattgctgaacaggccaaacatgaagcagaaatcgagacacgcattgctgagctgcgcaaagaggggttttggtcactcaagagacttcccaaagtgccagagccccctcgcccaaaagggcattgggattatctgtgcgaggaaatgcagtggctgtccgcagatttcgcccaggagagacgttggaagcgcggtgtcgctaggaaggtggttcgcatggttattaggcaccacgaagaacaacggcagaaggaggagcgcgctaggcgtgaagaacaagccaaactgcgtaggatagcctccaccatggcaaaggacgtgagacagttctggtctaatgtcgaaaaggtagtacagtttaagcaacagagtcggctagaagagaaacggaaaaaagcccttgacttgcaccttgattttatagtgggccagactgaaaagtatagcgatctgctgagccaatctctcaatcagcctctcactagtagtaaggccggcagctctccatgtttggggagttcttcggccgcatcctccccgccacctcccgcttcacgcctggatgacgaagacggagatttccaaccacaagaagatgaagaagaggacgacgaagaaacaattgaggttgaggagcaacaggaagggaacgatgcagaagcacagaggcgggagatcgaactgctccgcagagaaggcgagctgccactcgaagagttgctgaggagtctgcccccccagttgctggagggcccgtcgtcccctagtcaaacccccagcagccatgactccgatacgcgcgacgggcccgaagagggtgccgaggaggagcctcctcaggtattggagattaagcctcccccatccgcagtgacccaacgcaacaagcagccctggcaccctgatgaagatgacgaagagtttacagctaatgaagaggaggctgaggacgaggaggacacgatagcggccgaggaacagctcgagggcgaagtggaccacgcaatggagttaagcgagctagcacgggagggagaactgtccatggaagaactcctgcagcagtatgcaggggcctacgccccaggtagtggctctagcgaagatgaggatgaggacgaggtggacgccaacagctccgactgcgaaccagagggtcctgtcgaagctgaggagccaccccaagaggattcaagctcgcagagcgatagcgtggaggataggtcagaagacgaggaggacgaacatagcgaagaagaggaaaccagtggttctagtgcaagcgaagaatcagaatccgaggaatctgaagacgcacagagccagtcacaggcagacgaggaggaggaggatgatgatttcggggtagagtacctgctagcccgggacgaggagcagtccgaagccgacgctggtagcgggcctcccacccctggcccaactactctcggacctaagaaagagattactgacatcgccgccgcagccgagagccttcagccaaaagggtacacacttgcaactacccaggtgaagaccccaatcccactgctactgagagggcagctcagggaataccagcacattggcctggactggctggtcacaatgtatgaaaaaaaactgaacggtatcctggctgacgagatggggcttggcaagaccatccaaaccatctccctacttgcccatttggcttgcgagaagggcaactgggggcctcacctgattattgttcctacctccgtcatgctaaactgggagatggaactcaaaaggtggtgcccttctttcaaaatcctgacctactacggcgcacagaaagagaggaagctgaaaagacaaggatggacaaaaccaaatgcattccacgtgtgtattacatcatacaaattagtcctgcaggaccaccaagccttccgacggaaaaactggaggtacctgatcttggatgaggcacaaaacatcaagaatttcaagtcccagcggtggcagagtctactgaactttaattcccagagaagattgttgcttaccgggaccccgctgcagaactccttgatggaactgtggagcctcatgcactttttgatgccccatgtttttcagagccaccgcgaatttaaagaatggttttccaaccccctcaccggcatgatcgaaggctcccaggaatacaatgaaggcttggtgaagcgccttcacaaggtgctgagacccttcctgctaaggcgcgttaaagtggatgtggagaagcagatgcctaaaaagtacgaacacgtgatccgttgcaggctctcaaagagacaacgctgtttatatgacgactttatggcccagaccacaaccaaggaaaccctcgcgacaggccacttcatgtccgttatcaatatacttatgcagctgaggaaagtgtgtaaccatcctaatttgtttgacccaaggcccgtgacctcgccattcattactcccgggatatgctttagtactgcaagtctggttctcagagccacagacgtccaccctctgcaaagaatcgacatgggccgctttgatcttattggcctggaaggccgcgtctccaggtacgaagctgatacttttctccctagacacaggctaagccggagagttctactggaagtcgcaacggcgccggacccacctcctaggcccaaaccagtaaaaatgaaagtaaacagaatgttacagccagtgcctaagcaggaagggagaacagtcgtggtcgtgaacaaccctagggcaccacttggacctgtccccgtgagacctcctcctggccctgaactgtctgctcagcctacaccgggaccagtgccacaggtgctgcccgcatcactgatggtgagcgccagccctgctggacctcctctcattcctgccagcagaccccctggacccgttctgctcccacccctgcagcccaattccggctccttgcctcaagcgggcgaggtggtgagtatcggccagttggccagcttggcccaacgtcccgtcgccaacgcaggggggtccaagcctctaacttttcagatccagggtaataagctaacgctgactggcgcccaagtccggcagttggccgtgggccagccacgaccactccagatgccccctaccatggttaacaataccggggtggtgaagatagtagtcagacaggcaccgcgggacggcctgaccccagttcccccgctcgctccagctccccggcccccttcgtcggggctgcccgcagttctaaatccacggcccaccttgacccctggaaggcttcctacgcccacattaggcaccgcgcgcgcaccgatgccaacacccaccttggtccgtccactcctgaagcttgttcactccccctctcctgaggtatccgccagcgcccctggagctgcccccctgacaatcagttcccctctacatgttccctcaagcctgcccgggcctgcaagcagtcccatgccaatcccgaacagctctccactagcatcacctgtatcatcaacagtgagcgtgccactgtcctcttctctgcctatttccgtccctacaacactgccagctcctgccagtgcgcctctgactattccaatcagcgcccccctgacagtaagtgcgtcgggacctgccctcttgacttctgtcactccccccctcgctccggttgtacctgccgctcctggacccccttcactggctccttcaggtgcaagcccaagtgcctctgctctgaccctcgggttagccactgccccctccctaagtagttcccaaactcccggacaccctctcctcctggctcccacaagctctcacgttccggggctgaactcaacagtggcccctgcttgtagcccagtgttggtaccagctagtgcgttggcatccccttttccatcagctccaaatcccgcacctgctcaggcctcccttttagcaccagcctctagcgctagccaagcccttgccacaccccttgcaccaatggccgctccccagacagcaatactggccccatcacccgccccacccttggcccctttgcctgtccttgccccatcccctggggcggctcctgtcctggcatcaagtcaaaccccagttccagtgatggcaccaagttcaactcccggtaccagccttgcatctgcttctccggtgcccgcgccaaccccagtgctggctcccagctcgactcagacaatgttacctgccccggttccctcgccactcccctccccagcctcaacccagactctggccctggctccggccctggcgccgacccttggcggttcctcccccagtcagacgctctccctcggcacagggaatcctcagggacccttcccaacccagactctcagcttaactcccgcctcaagcttagtacccacaccggcgcaaacactctcccttgcccctggaccacccctgggccccacccaaaccctcagtcttgcaccagcacctccactcgcacccgcatcccccgttggccccgcgcctgcccacacacttactctggcccccgccagctcttcagcaagtctgttagcacccgcctccgtgcagaccctgaccctttccccggcccccgttcctacgctgggccccgcagccgcgcaaacactggcactcgctcctgcctctacgcaatccccagcaagtcaagccagctctttagtagtaagcgccagtggagctgctccgctgcccgtgacgatggtgtctcgcctgccagtgagcaaagacgagcctgacacgttgactctccgctcgggcccccctagtcccccaagcaccgccacttcttttggtggaccccggccaagaaggcagcctccgccgcccccccgctcacctttctacctggactccctagaggagaaacgaaaacgacagagatctgaacgcctggagaggatcttccagcttagtgaggcacatggagctctggctccggtatacgggaccgaggtgttggatttctgcactttaccacagccggttgcatcccctatcggacccaggagccctgggccttcccatcctacgttttggacatatactgaagcagcccaccgggcggtgctgttcccccagcaaagactcgatcagctgtcggagatcattgaacgctttatcttcgtgatgcctcctgtggaagcgcccccgccttctctgcatgcctgccaccctcctccatggttggcacctagacaagcagccttccaggaacagctggcttccgagctgtggccgcgcgcgcggccgctgcatcggatcgtgtgtaatatgcgaacccagttccctgatctccggcttatccagtatgattgtggaaagcttcaaactctggccgttctcttgaggcaactcaaggctgagggacatagagtgctcatttttacacagatgactcgaatgctggacgttctcgaacagtttctgacttatcacggtcacctatacctgcgactggacgggagtacccgcgtggagcagaggcaggcgctcatggaacgattcaatgcagacaagcggatcttctgcttcattctgagcacacggtccggcggagtcggagttaacctgaccggggccgacacggtggtgttctatgacagcgactggaacccaaccatggacgcccaggcacaggatcgctgtcataggataggccaaactcgggacgttcacatatacaggttgatctcagagcgaacagtggaggaaaacatcctgaagaaagccaaccagaaaagaatgttaggcgatatggccattgaaggtgggaattttacaactgcctacttcaagcagcaaactattcgtgagcttttcgacatgccattggaagagccttcgtcaagctctgttccttctgcaccggaggaagaagaggaaacagttgcgagcaagcaaacacatatccttgaacaagccctctgtagagccgaggacgaggaggacatccgggccgcgacccaggctaaggcagagcaggtggccgagctggctgaattcaatgaaaacgacggatttcccgcaggtgaaggcgaagaggccggcagacccggcgcagaggacgaagaaatgagtcgcgccgagcaggagattgctgcactggtcgagcagttgacacctatagagcgctacgcaatgaagttccttgaagcatctcttgaagaggtatcaagggaggaacttaagcaggccgaggagcaggttgaggctgcccggaaggacctcgatcaggccaaggaggaagtattccggttgccgcaggaagaagaagaaggtcccggcgcgggagacgagagctcctgtgggacaggtggtggcacccataggcgcagcaaaaaagcaaaggctccagagcgtcctggcactagagtcagcgagaggctccgaggcgctcgcgccgaaacacagggtgccaaccatacacctgtcatctccgcacaccagaccagaagtacaactacaccccctaggtgctcgcctgccagggagagagtcccccggcccgcccctaggccgaggcccacgcctgcttccgcacctgcagccattccagccctggttccggtaccagtctctgctcctgttccaattagtgcccctaaccccataaccattctcccagtacacattctgccatctcccccacccccatctcagatccctccttgctcctctccagcttgcacccctcctcccgcctgcacccctccgccggcacacactcctccccccgctcagacttgcctggtgacaccgagcagcccactgttactaggtcctccctctgtccccatcagtgcatctgtcaccaatctgccactggggttgcgcccagaagctgagttgtgcgcccaagccctcgcaagccctgagtctttagagttagcctctgtagctagttcagaaacttcctcactgagccttgtcccccctaaagacctgctgcctgtggccgtggagatcctgcctgtaagcgaaaaaaacctgtcccttactcccagcgcccctagcctcacccttgaggctgggtccatccccaatggccaggaacaggaggcccctgactccgccgagggcactactctgactgttctgccggaaggcgaagaattgcccctctgcgtctctgaatccaatggcctcgaattgccgccctccgccgccagtgacgagccactgcaagaaccattagaagcagaccgcacttcagaggaacttaccgaggccaaaaccccaacaagcagccccgaaaaacctcaggagttagttacggcggaggtggccgctcctagtacgtcaagctctgctacctcctctccagaggggccctccccggcaagaccgcctcgtcggaggacgagtgccgatgtggagataaggggacaaggaacgggcagaccgggccagcctcctggtcccaaggtgctgagaaaacttcctgggagactcgtgactgtagtggaggagaaggagctcgtccgcaggcggcggcagcagaggggggccgcctccaccttggtgcctggggtgtccgaaaccagtgcatcccccggctctccttccgtcagaagtatgagtgggccagagtcctcccctcccatcggtggaccatgcgaggccgctccatcctccagtctccccacaccacctcagcaaccattcatcgcgcgcagacatattgaacttggggtgactggcggcgggtctccagagaatggcgatggcgcactgcttgccattacgccacccgccgtcaaaaggagacgcgggagacctcccaagaagaacagaagccctgctgatgcgggcaggggcgttgacgaggcgccgagctctactctgaagggaaagacaaatggagcagaccctgttcccggcccagaaacgttgattgtggcagatccggtgttggaaccgcagcttatcccaggtccacagccactcgggccacagcctgttcacagaccaaatccccttctttccccggttgagaagcgccgcagaggtaggccgccaaaggcccgtgacctgcccatccctggaaccatctccagcgctggcgatggaaactccgagtccagaacccagcctccccctcatccatcacccctgacgccactgcctcccctgttagtgtgccctacagctactgtcgctaacacagtgaccacggtcaccatctcaacaagcccccccaaacgaaaacggggtagaccaccgaagaatcctccttctcccagaccctcccagctacccgtcctggatcgagacagcacatcagtattggaaagctgtggcctgggcaggcgcagacagccccagggacagggcgagtcggagggatcatcatcagacgaagatgggtctaggccgctaacaagactcgcaagactgcggctggaggctgaaggaatgcgcggtcgaaagagcgggggctcgatggtggtagctgtgattcaggacgacttagatctggctgactctggaccaggaggtctcgagctgacaccgccggtcgtgtccctcacccctaagctcaggtcgactaggctcaggcccggaagtctcgttcctccgttagagactgagaaactgccacgaaagagggccggcgcgcccgtgggagggtctccaggtctggccaaacgggggagactgcaacccccctcccctctggggcctgaaggatcggtggaagagagcgaggccgaggctagcggcgaagaggaggaaggagacggcactccacgtaggcgccctggcccaaggcggctggtgggcactaccaaccagggtgatcagcgaatattgcggtcatcagctccgccatcactcgccggccctgctgtgtctcacagggggcggaaggccaaaacatag

SEQ ID NO: 134654 - DNA, 9507 bp, Artificial Sequence
  Description of Artificial Sequence: Synthetic coding sequence
atgcagagtagcccgagccccgctcacccacagcttccggtgctacagacccagatggtgtccgacggaatgaccggatctaacccagtgagccctgcctccagcagttctccagcttctagcggcgccggcggcatatctccccagcacatcgctcaggattctagcctcgatggccctcccggacctcctgatggagctactgtgcctctcgaagggttctcattgtcgcaggccgccgacctggctaacaagggcccgaagtgggaaaaaagccatgcagaaatcgccgaacaggctaagcacgaagctgaaatcgaaacccggatagccgagctgcggaaggaaggattctggtccttaaaacgactgcctaaggttcctgagcctcctcggcccaagggacattgggattatctatgtgaggagatgcagtggctgtctgcagattttgctcaggagcgacggtggaaaagaggcgtagctcgaaaggtggtgcgtatggtaattcggcatcatgaggaacagcggcaaaaagaagagcgggcacggagagaggagcaggccaaacttcgccgcatcgcatcaacaatggccaaagacgtgcgccaattctggtcaaacgtggaaaaggtggtgcagtttaaacagcagagccggctggaagagaagagaaagaaggcgctcgaccttcatcttgacttcatagttggccagacagagaagtattcggatctcctgtcccagagccttaatcagccgttaacatccagcaaggcgggatcttccccgtgcttgggttccagttccgcagcctctagtcctccgccccccgccagccgcctggatgacgaagacggagatttccaaccccaggaagatgaggaagaggatgacgaggaaaccattgaagtggaggagcagcaggaaggtaatgacgcagaggcgcagcgtagagagatcgaactgctacggcgtgaaggtgagctgcccttagaagaactcttgcgctctctccccccacagctactcgagggaccatcaagcccatcacagaccccctcctcacatgattctgacacaagggacggacccgaggagggggccgaggaggagccaccacaagtcctcgaaattaaaccccccccctctgcggtgacccagcggaacaaacaaccctggcaccctgatgaagacgacgaggaattcaccgccaacgaagaagaagctgaagacgaggaggacacaattgccgccgaggaacaacttgagggggaagtcgatcacgccatggagctgtcagagctcgcccgcgagggggagctaagcatggaggagctcctccagcagtacgcgggagcatacgctcctggtagcggctcttctgaggacgaagatgaggacgaagtggacgccaactcctcggattgtgagcccgaagggcccgttgaggccgaggagcctccacaggaggattcttccagtcagtctgacagtgtggaagacagatcagaagatgaggaagacgagcactccgaagaggaggagacctcaggatcctcagcaagtgaggagagcgaatctgaagaatcagaggatgctcagtcccagagtcaggcagatgaagaggaggaagacgacgatttcggtgtggagtaccttctggctcgcgacgaggaacagtctgaggctgatgctggatccgggccccccacccctggtcctaccaccctgggacccaagaaggagatcactgacatagccgccgcagctgagagcctccagcctaaaggatacaccctcgccacaacacaagtcaagacccctatcccactccttcttaggggtcagctgagagaataccagcacattggtttagattggctcgtcaccatgtatgagaaaaaactcaacggaattctcgcagacgaaatgggactcggcaaaacgattcaaacgatttcactgctagcccaccttgcgtgcgagaaaggcaactgggggccccacctaatcatcgtccctacatcagttatgcttaattgggagatggagctgaagcgctggtgcccatccttcaagatcctcacatattacggagcgcaaaaggagcgcaaactgaaaagacagggctggaccaagccaaacgcttttcatgtgtgtatcacgtcatacaaattggttctgcaggatcatcaggctttcagacggaagaattggagatatttaatactggacgaggcacagaacattaagaacttcaagtcacagcgctggcagagtttgctgaatttcaactctcagcgaaggttgctgctcacaggaacccccctccagaactccttaatggaattgtggagcctgatgcacttccttatgccgcacgtcttccagtcccaccgtgagttcaaggaatggttctcaaacccgcttaccgggatgatcgaagggtctcaggagtataatgagggcctggttaagcgcttgcacaaggttcttcgacctttcctgcttagacgagttaaggttgacgtcgaaaagcagatgccaaaaaaatacgaacatgtcatccggtgtagactgtcaaagaggcagaggtgcctctacgatgacttcatggcccagacaacgacaaaagagactcttgcaaccggccattttatgagcgtaataaacattttaatgcaactgcgaaaggtttgtaatcaccccaacctgtttgatcctagaccagtgacctcacccttcattactcctgggatctgcttttctactgccagcctggtgctgcgtgccactgatgtacacccattgcagaggattgatatgggcagatttgacctcatcgggctggaagggagggttagcagatacgaggcagatacctttctgccccgacatagacttagccggcgtgtcttgctggaggtcgcgaccgctcctgatcccccccccagaccaaaacccgtgaaaatgaaggtgaaccgaatgctgcagccagtccctaaacaagagggaaggaccgtcgttgtggtgaacaatccccgggctcccttgggccctgtaccggtgcggcctcctcctgggccggagctgtctgcccagcctacccccgggcccgtgccgcaggtgctgcccgcctcactgatggttagtgcttctcccgctggcccaccactcattcccgcaagccgccccccaggacccgttctgctcccccctctccagcctaacagtgggtccctccctcaggtgctgccttctccactgggcgtgttgtcaggcacttcccggccccccactccaactcttagtctgaagccaaccccccccgcacctgtgagactaagccctgcgcctccaccgggttcctcctccttgctgaagccattgaccgtgcctccaggttatacgtttccacccgctgctgctacaaccactagcaccacgaccgcaaccgccactacaacggcagtccctgccccaaccccagccccccagcgtctcatcctgtcacccgacatgcaggcaaggctgccttcaggagaagtcgtctccattggccagctggctagccttgctcagagaccagtagctaacgcaggcggatcaaaaccactaaccttccaaattcaaggtaacaaacttacattgactggagcccaggttaggcagctagcagtcgggcagccaagaccgctgcaaatgccccctacaatggttaacaacacaggtgtagtcaagatcgtggtcaggcaggcgcctagggacggactcacaccggtgcctcctctagctcccgcccctaggcctccctctagtggcctgcctgcagttctgaatcctcgtcctacgctgacccctggtcgcctgccaacgcccacgcttggaactgccagagcccctatgcccactcctactctggttcggcctttactgaaactggttcatagcccttcgccagaggtgtcggccagtgcacccggagcagcccccctcaccatctcctctccgctgcatgtccccagctcactcccaggacccgcctcttctcctatgcctatccctaattcaagtcccctcgcatctcctgtgagctccactgtatccgtacccctgtcatcaagtctccctatatcagttcctacaactctccctgctcccgccagcgctcccctgacaattcccattagcgcgccccttacagtgtcagcttcagggcctgcactgttgacttccgtgacaccacccctggctcccgtagtgcctgcggcacccggaccaccgagcctagcccctagcggggcgtcaccatccgcatcagccctgacactggggcttgcaacagcaccgtccctgagttcctcccagacacctgggcaccctctgctcctcgctcccacgtcatcccatgtccccggtctcaatagcacggttgcccccgcatgctctcccgtgctcgtgccagcctctgcgctcgcctcccccttcccatccgcacctaacccagcgccggcccaggcctcactgctcgcgcccgcctcatcagccagccaggcactggctacacccctagcacctatggcagcaccgcagactgccattttggcaccatcacccgcaccacccttggccccactccccgtactcgccccgtcccctggcgcagcgccggttttggcttcatcacaaacccctgttcctgttatggcacccagtagtacacccgggacctccttggcttctgcctctcctgtgccagctcccacacctgtcctggctccttcatccactcagacaatgcttccagcgcccgtgccttcccctttaccgagcccagcatcaacacaaacactggctttagctcctgcccttgcgcccaccctgggaggaagctctccaagccaaacactttcactgggaaccggaaacccccaaggacctttccctacccagaccctgtctcttacccccgcctcaagtctcgtcccaacccctgcacagaccctgagcctggcgcccgggccaccactcggcccaactcaaaccttgtccttggcacctgcaccgcctcttgccccagcttcccccgtggggccagcccccgctcataccctgacattggctccagcctcctcaagcgcttcgctgcttgcccccgcttctgttcagacactgactctcagcccagctccggtccctacccttggaccggccgccgcccagacccttgccctggctcccgcttcgacacagtctccggccagccaggcatccagtcttgtggtgtcggcttcaggcgcagctccactgccagttaccatggtgtcacgcctgccggttagtaaagacgaaccggacacgttgacccttcgttcagggcctccatcccccccgagcactgcaacgtcttttggaggaccccgcccacggcggcagcccccgccccccccgcgatcccctttctacctggattccctcgaagagaagcgcaaaaggcagagaagcgagcggttggaaagaatttttcagttgtctgaagcccatggagctctggcaccagtgtatggcacagaggtactcgacttttgtactctgcctcagccagtggccagccctatcggaccccgttcccccgggccaagccatcccacattctggacttatactgaagccgcccatcgggccgttttgtttccccagcagcggctggatcaactcagcgagattattgaacggtttatattcgtgatgcctcccgttgaagcgccccccccatcactccatgcgtgtcatccccccccgtggcttgcgccccgacaggcagcctttcaagagcagttggccagcgagctctggcctcgcgcacggccattgcataggatcgtatgcaacatgcggacacaatttcccgacctgagactgattcagtacgactgtggtaaattgcagacccttgccgttctcctccgccaactgaaggccgaagggcatagagtcttgatattcactcagatgactagaatgctggacgtgctggaacaattcctgacatatcacggtcacctctacctgagactagacggttctacaagggtggagcaacgacaggccctgatggaaagatttaatgcggacaaacgcattttttgcttcatccttagtactagatctggcggcgtgggcgtcaacttgactggagccgacactgtagttttctacgactctgactggaacccaaccatggatgcccaagcccaggaccgctgccaccgtataggacagacaagagacgttcacatctaccgactgatctcagaaagaacggtggaagagaatattctgaagaaggccaatcagaaaagaatgcttggtgatatggcgatcgagggggggaactttaccaccgcatactttaagcagcagaccatccgcgaactattcgatatgccattggaggagcccagctctagctctgtgcctagcgcaccagaggaggaggaggagactgttgcatctaagcagacacatatccttgagcaggccctgtgtcgcgcggaggatgaagaggacattcgtgctgccacgcaggctaaagccgagcaggtcgcagagctggctgagttcaacgagaacgacggttttcctgcaggagagggcgaggaagcgggaaggccgggcgctgaggatgaggagatgtcccgcgcagagcaggaaatcgcggccctagtggaacagcttacccccatcgagaggtacgctatgaagttcctagaagcgtcactggaggaggtgagccgcgaggagctgaagcaggcagaggagcaggtggaggccgccagaaaggatctggatcaggctaaggaggaggttttccgcctgcctcaggaggaggaggaaggacctggggcgggcgatgagagtagctgcggcaccggaggaggcacgcaccgccggtcaaaaaaggccaaagctccagaaaggccaggcaccagagtctcggaacggttacgaggcgcacgcgctgagactcagggcgcaaaccatactcctgttattagtgctcaccagacacggtcaactactactcctcctcgctgttcgcccgcccgggaacgggtcccacgtcctgccccaagacctcgcccaactccggcttccgctcctgcagcaattcccgccctggtcccagtgccagtgtcagctcccgtgcctatctctgcccctaacccgattacaattctgccggtccacatcctccctagtcccccgccaccaagccaaattccgccatgctcctcgcccgcgtgcactcctcccccagcctgcaccccccctcccgctcacacaccaccgccagctcagacatgcttggtgaccccttcgtctcctctgttgctggggccaccttccgtgcccatctctgcaagtgtgactaacttgccactgggcctaaggcccgaagccgagctctgcgcgcaggccctcgccagccctgagtctcttgaactggcgtctgtggcgtcatcggagacatcctccctgagtctagtcccacccaaggacctgctgcctgtggccgtcgaaatcctgcccgtgtctgaaaaaaacctatctctgactccgtccgcacctagtctaactctggaggcaggcagtatacccaacggtcaggagcaggaggctcccgactcggccgagggtacaacgttaaccgttctccctgagggagaggagctcccgctgtgcgtatccgagagtaatggactggagcttcccccttccgccgcctcagatgaaccgctccaagaaccactagaggccgataggacatccgaagagcttacagaggccaagactccgacgtcctcccccgagaagccccaggagctcgtgaccgctgaggtggcagctccttcaaccagttctagtgccacatcctccccggagggacccagccccgccagaccccctagacggaggactagcgccgacgtggaaatcaggggtcaggggacgggtcggccaggacaaccaccaggcccaaaggtgcttcgtaagctgcccggtcgactggtcaccgtggtcgaggaaaaagagcttgttcggaggcgccgccagcaacgcggcgcggcatccacactggtccctggggtttctgagacttcagcctctccagggagcccaagcgtgaggtccatgagcgggccagagtcatcccccccaatcggtgggccttgtgaagcggccccttcctcatctctgccgacacctccccaacagccatttatcgccagacgtcacatcgagttaggcgtgactggaggaggtagtcccgagaacggagacggagctctcctggccataacgccccccgcggtcaaacgtcgccgggggagaccaccgaaaaagaaccgctcgccagctgatgcagggagaggcgtggacgaggcacccagcagcaccctgaagggcaagacaaacggcgccgaccccgtgcctggaccagaaaccctgatagttgccgaccccgttctagaaccacagctgattcctggtccccagcccctgggcccccagccggtccacaggcctaatcccctgctgtcaccagtggagaaacgccggagagggaggccacctaaggccagagacctgccaatcccggggaccattagcagcgctggggacggaaatagtgaaagtcggacacagccgccccctcatccgagccccttgacacccttgccgccactccttgtttgccccacagccacagttgctaacactgtgaccacggtaaccatcagcacctccccaccaaagaggaagagaggacgaccgcccaaaaacccaccaagtccgcggccctcacagcttccagtgttggaccgcgattcaaccagcgtgctcgaatcctgtgggttggggaggcgcagacagcctcagggacagggagagtccgaaggatcaagctctgacgaggacggcagccggcccctcactcgactcgctcggctgagacttgaagccgaaggcatgcgggggcgaaagtccggcgggtctatggtcgtagctgtaattcaggacgatctggatctcgcggattctggacctgggggtctggagctgacccctccggtagtgtcacttactcctaaactgagatccactcgcctgcggcccggctcacttgtgccccctctggagactgagaagctgcctcgcaaaagagcaggagcccctgtcggaggctctcccggtctggctaagcgcggacggttgcagccaccctcccctttgggcccggaaggctcagtggaggaatctgaggctgaagcttccggagaggaggaggaaggtgacggcacgcccagacgaagacccggccctagacggctggttggcactaccaatcagggtgaccagcgtatcctacgttccagtgcaccaccatcacttgcgggacccgccgtcagccaccgcggccgcaaggcgaaaacgtag

SEQ ID NO: 134655 - DNA, 180 bp, Artificial Sequence
  Description of Artificial Sequence: Synthetic coding sequence
atgcagagcagccctagtcctgcccacccccagctgcctgtccttcaaacccaaatggtctccgacggaatgactggctccaacccagtctcaccagcaagtagcagtagccccgcctcaagtggagcgggaggcatatccccacaacatattgcgcaagatagtagtctagacggatag

SEQ ID NO: 134656 - DNA, 774 bp, Artificial Sequence
  Description of Artificial Sequence: Synthetic coding sequence
atgcatcgcagaggcgtcggcgctggcgcaatcgccaaaaagaaattggcagaagcgaaatacaaggaacgcggcacggtcctggccgaggatcagctcgctcagatgagcaaacagcttgatatgtttaaaaccaacctggaagagttcgcttccaaacacaagcaggaaattcggaaaaacccagagttcagggttcagtttcaggatatgtgtgcaaccataggtgtagatcctttggcctccggaaaggggttctggtccgagatgctgggagtcggtgatttctactacgagttgggggtgcaaatcatcgaagtctgtctcgcactgaagcatagaaatggcgggctaattaccctcgaagaactgcatcagcaggtcctgaagggacgggggaagtttgcccaggacgtgtctcaggacgacttgatacgcgctattaagaagctcaaagcgctgggaaccgggttcggcatcatacctgtgggaggaacttacctaattcagtctgtgcccgccgaacttaatatggaccatactgtggtgttgcagctcgcagagaacggttacgttacggtctctgagattaaagcctccctgaaatgggagaccgaacgggccagacaggttttagagcatctgctgaaagaaggacttgcctggttggatctccaggcccccggggaagctcactattggctgcctgccttgttcaccgacctctattctcaggagataactgccgaggaggcccgggaagcactgccttag

SEQ ID NO: 134657 - DNA, 777 bp, Artificial Sequence
  Description of Artificial Sequence: Synthetic coding sequence
atgcacaggcgcggggtgggcgctggcgccattgcaaagaaaaaactggcagaagccaaatataaggaacgaggaacagtattagccgaagatcagttggcccagatgagtaagcagctggatatgttcaaaaccaacctggaagaattcgcaagtaagcataagcaggagatcagaaagaaccctgaatttagagttcagttccaagatatgtgcgcaactatcggcgtagatcccctagcaagtggtaagggtttttggagtgagatgttaggcgtcggcgatttttattacgagttaggcgtgcagatcatcgaagtgtgtcttgccttgaaacatcgaaacggtggcctaatcacactagaggagctgcaccagcaagtgctgaaaggcagggggaagtttgctcaagatgttagccaggatgacctgatcagagccataaagaaacttaaggctctgggaaccgggttcgggatcatcccggtcggggggacatatctgatccagagtgtgcctgcggaactcaacatggatcatacagtggtgcttcagctggccgagaaaaacgggtatgtgactgttagcgagattaaggcatctctgaagtgggagacagagcgcgctcgccaagtgctggagcacctgctgaaggagggcctggcctggctggatctgcaagctccgggtgaagcccactactggctacccgctttatttactgatctctatagtcaggagataaccgctgaagaggcaagggaagctctgccatag

SEQ ID NO: 134658 - DNA, 1611 bp, Artificial Sequence
  Description of Artificial Sequence: Synthetic coding sequence
atgagttcatctctaggaaaagaaaaggattctaaggagaaagaccccaaagtgccgtctgccaaggaaagagagaaggaagccaaggcttctggcggattcggcaaagagtcgaaggaaaaggagccaaagactaagggaaaagatgccaaggacggcaagaaggattccagcgccgcacagccaggggttgctttttccgtggacaatacaattaaaagacccaatcctgcacctgggaccagaaagaaaagttccaatgctgaggtgatcaaggaactcaataagtgccgggaagagaatagcatgcgcttagatctatcaaagcggagcattcacatcttgccttcatcaatcaaggagctgactcaactgactgaactttacctttacagcaataagttgcagagcctccctgccgaggttggttgcctggttaacctaatgaccctggcgctcagcgaaaatagcctgactagtttacctgacagtctggacaatttgaagaaactgcgtatgctcgatctccgacataacaagttgagagaaattcccagcgtcgtctatcggctagatagtctcacgactctgtacctcagatttaacaggatcaccaccgttgagaaggacattaagaacctgagcaagctgagcatgctatcaattagggaaaacaaaattaagcaactgcctgccgaaataggcaatctcagtagcctgtccaggctgggactgaggtacaaccgcctctcggccatccctagaagcttagctaagtgctccgctctggaggagcttaacctggagaacaataatattagcacgttacccgaaagcctgctcagctccctcgtcaagcttaactctctcacactggcacgtaactgcttccagttgtatcccgttggtggcccctcgcagtttagtaccatctattctttaaacatggagcataataggattaacaaaatccccttcgggatctttagccgagctaaagttctgtcaaagcttaacatgaaagataaccagctcacctcattgcctttggactttggtacgtggacctccatggtagaattaaacctagcaacaaaccagttgaccaaaattcccgaagacgtgagcggccttgtgtcactcgaggtgctcatcctttctaacaacctcttaaagaagctgccacacggcctcggcaatctccgcaaactgcgggaactcgacttggaggagaataagctggagtctttacccaatgaaatcgcctaccttaaggacctccagaagctggtcctgacaaataatcaactgaccacattgccacgtggcattggtcacttaaccaaccttacacacttgggtttgggtgagaacctcttaacgcatttgccagaggaaattgggacccttgaaaatttggaagagctctacctaaacgataaccccaatctgcattctctccctttcgagctcgccctttgctccaaactgtccattatgtctatcgagaactgccccctgagccatctgcctccacagatagtagccggtgggccaagcttcattattcaatttctgaagatgcaggggccatatcgtgctatggtgtag

SEQ ID NO: 134659 - DNA, 1749 bp, Artificial Sequence
  Description of Artificial Sequence: Synthetic coding sequence
atgtcttctagccttggcaaggaaaaagactcaaaagaaaaggatccaaaggtcccctccgctaaagaacgagaaaaagaggccaaagcgagcggtggattcggcaaggaaagcaaagagaaggagcctaaaactaagggaaaggatgccaaagatggcaagaaggacagtagtgctgcccagcccggggtagctttctctgttgacaataccatcaagcgccccaatcccgctccaggtacacgcaagaagtccagcaacgccgaggtcatcaaagaactcaacaaatgtcgcgaggaaaattctatgcgattagacttgtcgaaacgctcgatccatatcttgccctcctcaatcaaggagttaactcaattaactgaactgtacttgtactccaacaagctacagtccctccctgcggaggttggatgcctcgttaacctgatgacgctggcactgtctgagaactctctaaccagtcttcccgactcactcgataatctcaagaagttgcgtatgctggatttaagacacaataaactgcgggaaattcccagcgtggtgtacagactggactctctcacaaccctttacctgagattcaaccggatcaccaccgtggagaaagacataaagaacttgtctaaactgagcatgctttctatcagggagaataaaatcaagcaactgcccgcagaaatcggcgaactctgcaaccttatcactctggacgtcgcacacaaccaactcgagcacctgcccaaggagattggcaactgtacccaaatcacaaatttggacctccagcataatgaacttctggatctccccgataccatcggtaatctgagttccctgtctcgtctcggcttaaggtataaccggctgtccgcaattccacgttccctggccaaatgttcagctttagaggaactcaatctggagaacaacaatatttcaaccctccccgagagcctgctttccagcctggtcaaattgaattctttaactctagctcgcaattgctttcaactctatcctgtcggcggcccgtctcagttctcaacgatctacagcctgaacatggagcacaaccggatcaataagatcccatttggaattttctccagagcgaaggtgctgtctaaattgaacatgaaggacaaccagctaacctctctgcccctcgactttgggacttggacttctatggtggagttaaacctggctaccaaccagctgacaaagatacctgaagatgtgtccgggctagtgtccctggaagtgttaattttatctaataatctattgaaaaagttaccacacggactgggcaatctgagaaagttacgagagcttgacctcgaggagaataagctggaatcactccccaacgagattgcatacctcaaagacctgcagaaactagttttaactaataaccagctcactaccctcccaagaggcatcggccacctcacaaacctgacccacctggggttaggagagaacctcctgacccatttaccggaagaaatcggcaccctggaaaatttggaggaactttatctcaacgataatcccaaccttcactccctgcccttcgagctcgccttgtgctccaagctctcgattatgagcattgaaaactgcccattatcccacctgcccccacagatcgtggccggaggccccagtttcatcattcagttcctcaagatgcagggcccatacagagccatggtctag

SEQ ID NO: 134660 - DNA, 1119 bp, Artificial Sequence
  Description of Artificial Sequence: Synthetic coding sequence
ctggacaacctcaagaaactgcgcatgctggatctgcgacacaacaaattacgcgagattccgtctgtggtataccggttggactcccttaccacattatatctccgcttcaatagaattaccactgttgagaaagacattaagaatctgtctaaactcagtatgctgagtatccgagaaaataaaatcaagcagctgccggctgaaattgggaacttatccagcctgagcaggctgggtctgcgctacaaccgccttagcgccatcccacggtctctggctaaatgctccgcccttgaggaactgaatctcgagaataataacataagcacactcccagagtcccttctgtcttccctggtaaaactcaactcacttaccctagcgcgaaactgcttccagctgtacccagtcggcgggccttctcagttctcgaccatctattctttgaacatggaacacaataggattaacaaaatcccctttggtatcttctcccgggctaaggtgctcagtaagctgaatatgaaggataatcaactcacaagcctgccactagacttcgggacctggacatcaatggtcgagctaaacctggctacgaaccaactgaccaaaatacctgaagatgtcagcggactggtctcactcgaagtgctgatcctgtcaaacaaccttcttaagaagctgccgcatggactcggcaacctgcgaaagcttcgcgaattggacctggaagagaacaaattggaatctctccccaatgagatcgcttacctgaaggacttgcagaaactagtgttgacaaataatcagctgactaccttacctaggggcatcgggcatttgactaaccttacccacctgggactcggagaaaatctgttgacccaccttcctgaagagataggcaccctggaaaacttggaggaactatacttgaacgataatcccaatctgcactctctgccgtttgaacttgcgctgtgttctaagctgagcatcatgtcaatcgagaactgcccactgtctcaccttcccccacagatagtcgccggaggaccgagttttattatccagtttctgaagatgcagggaccctatagagctatggtatag

SEQ ID NO: 134661 - DNA, 588 bp, Artificial Sequence
  Description of Artificial Sequence: Synthetic coding sequence
atgctgagagacggcaggtttgcctgtgctatttgcccccatcgcccggttcttgacaccctggcaatgctgactgcccaccgggctggaaaaaagcacttatcctccctgcagctgttttacgggaaaaagcagcccggtaaagagagaaaacagaacccaaagcatcagaacgaactcagaagagaagaaactaaagctgaagcccccctgctgacccagaccagattgattacacaaagcgcactgcatagggcaccacattacaactcttgttgtaggaggaagtatcgcccggaggctcccggcccgagtgtgtcactatctcccatgcccccatccgaggtgaaactacaatccggtaaaatctcccgagagccagaacctgccgcaggccctcaagccgaagaaagcgccactgtcagtgctcccgccccgatgtcccccacacgtcgccgcgctctagatcattaccttactctgagatcaagcggctggattccagacggaagaggacgctgggtaaaagacgagaacgtggaattcgattccgacgaggaggagcctccagacctcccgttggactag

SEQ ID NO: 134662 - DNA, 693 bp, Artificial Sequence
  Description of Artificial Sequence: Synthetic coding sequence
atgagcttcaaacgtgaaggcgacgactggtcccagctgaacgtcctgaagaaacggcgcgttggagacctcttggccagctacatccccgaagacgaggccctgatgctccgagacggacgcttcgcctgcgctatctgcccccaccggcccgttcttgatactctcgctatgctgacagcacaccgcgctggtaagaaacatttgagcagtcttcagctcttttacggcaagaagcagcccgggaaggaaagaaaacagaaccctaagcaccagaatgagctgcgtcgcgaagagactaaggccgaggcacccttgctcactcagactcgccttatcacacagagcgctctacaccgagctccacattataactcttgctgccgtcgaaagtaccgtcccgaagccccgggtcctagtgtctcgctgtctcctatgcctcctagcgaagtcaaacttcagtcaggtaagatttccagggaacccgaaccggcggccggcccccaggccgaagaatctgctactgtatcagccccagctcctatgtcccccacgcgtcgccgagctttagaccactatttaaccttgcggtctagtggctggattcctgacgggcggggccgttgggttaaggatgaaaacgtcgagttcgattcagacgaggaagagccacctgatctgcccctggactag

SEQ ID NO: 134663 - DNA, 1038 bp, Artificial Sequence
  Description of Artificial Sequence: Synthetic coding sequence
atgtataaggactgtattgagagcactggggactactttcttttatgcgacgctgagggaccttggggtatcattctggaatcgctggctattttaggcattgtggtcacgatcctgttactgcttgcctttctgtttttgatgaggaaaattcaggattgctcccaatggaatgtgttgcctacgcaattgttgttcttgttgtcggtactgggtctgttcgggctggctttcgcgtttatcatcgagttgaaccagcagacagctccagtgaggtacttcctgttcggagtactgtttgcactgtgcttctcatgtcttctggcgcacgcatccaacctggtcaaactggtgcgggggtgcgtctcatttagttggactacaattctgtgcatcgccatcggttgctcactgctccagatcattatcgcaacagagtacgtcacactgatcatgactcgcggcatgatgttcgttaacatgacaccttgccagctgaacgtcgacttcgtggtgttactggtctacgttcttttcctgatggccctcactttctttgtgtcaaaggctaccttctgtgggccatgtgaaaattggaagcaacatgggcgtctcattttcatcaccgtcctgttttcaatcattatctgggtcgtctggatttcaatgttgctgagagggaatccccagttccagcgacagccccagtgggatgacccggttgtgtgcattgccctcgtgacaaacgcgtgggtgttcctgctcttatacatcgtgcccgaactgtgcattctgtacagatcctgcaggcaggagtgcccccttcagggaaatgcctgtccagttacagcttatcagcactcttttcaggtggagaaccaggaactctcccgcgcaagagattccgacggtgctgaagaggacgtggccttgacatcgtacggaacccctatccagcctcagacggtggatcccacccaggaatgcttcattcctcaggccaaattgagcccacaacaggatgcgggaggcgtgtag

SEQ ID NO: 134664 - DNA, 2076 bp, Artificial Sequence
  Description of Artificial Sequence: Synthetic coding sequence
atggagggcaataagctggaagaacaggatagctctccccctcagagtacccccggcctgatgaaaggcaataagcgggaggagcaggggctcggccccgagccagccgccccacagcagcccacggctgaagaggaggccttgatcgagtttcatcggtcatatcgcgaattatttgagttcttctgtaataataccacaatccatggagcaatccgcttggtgtgtagtcaacacaacaggatgaaaaccgccttctgggctgtcctgtggctctgcacctttggcatgatgtactggcagttcggtctgctgtttggtgaatatttctcttatcccgtgtctctgaatatcaatctaaactcggataagttggtgttccccgccgttaccatttgcacattgaacccgtaccgctatccggaaatcaaagaggagttggaggagctcgataggattaccgagcagacactatttgacttgtacaagtatagttccttcaccactttggtcgctgggtccagaagcaggcgcgacctgcgcggcacgttgccgcaccccttgcaaaggctgagagtgccgcctccccctcacggagccaggcgggcgagaagcgtcgcctccagcctccgagacaataacccccaagtcgattggaaggactggaaaattggcttccagctgtgcaaccagaacaagagcgactgcttttaccagacgtactcttccggtgtggatgctgtaagggagtggtacaggtttcactatataaacatactctccaggctaccggagaccctcccgtcacttgaggaggatacacttggcaacttcatttttgcctgtcgatttaatcaggtcagttgcaatcaggcaaattattctcactttcatcaccccatgtatggaaattgttacacatttaacgataaaaacaatagtaacctgtggatgagttctatgccgggtatcaacaatgggctgagcctgatgctgcgggcggagcaaaatgactttatccccctactgagtacagtcacaggcgctcgggttatggtgcatggccaggatgagccagcgttcatggacgacggaggtttcaatttgagacccggagtcgagacatccatatcaatgagaaaggaaaccctggataggcttggcggcgattacggggattgcacaaaaaatggttcagacgttcctgtagaaaacctgtatccttcaaaatacacccaacaggtgtgtatccatagttgtttccaggagagtatgatcaaagagtgtggctgcgcgtatatattttatccgagaccccaaaatgtcgagtattgcgattataggaagcacagctcatgggggcaagtgcggtctctcactccggtgatccccgccctgtgggaggcggaagccgggcgctccaggggctactgttattataagttacaggtggatttttcatccgatcatctggggtgttttactaagtgcaggaagccatgctctgttacatcataccagttgtctgctgggtatagcagatggccgagcgtgacaagccaggaatgggttttccaaatgctgtcacgccagaataattacacagtgaacaacaaacgtaacggagtggccaaggtgaatatcttctttaaggagcttaattacaagaccaattcagaatctccgtcagtgacaatggttacactgctctcgaatctgggatcgcagtggagcctgtggttcggttcatctgtgctgtcggtggtggagatggccgagctcgtctttgatcttcttgtgataatgttcctgatgctcttaaggcgttttcgttcgaggtattggtctccgggcagaggtgggcgaggagctcaggaggtagcttctactttagcttcttctcctccatcccacttttgcccccatccgatgagtctgtccctgagccagcccggacccgcgccctctccagccctgaccgcgcctcctcctgcatacgcaactctgggaccgcggcctagccctgggggctctgctggcgcctcttcatcaacttgccctctaggcgggccttag

SEQ ID NO: 134665 - DNA, 2058 bp, Artificial Sequence
  Description of Artificial Sequence: Synthetic coding sequence
atgttactacatatcaaccccgcctatctttttaaattgctgcatgggtttcccccttggatcatgcctaccgatgggaacttgggcgacaaaaactttcaaatggggaaacccgggcatcgggagggcgctactatgcatgttaagaagtatttactcaagggattgcacagactgcaaaaggggccggggtacacctataaggagttacttgtgtggtattgcgataatactaacactcatggtcccaagcggatcatatgcgaggggcctaagaagaaggccatgtggttcttgctgaccttgcttttcgcggctctggtgtgctggcagtggggaatcttcatccggacttacttatcgtgggaagtgagtgtgagtttgtccgtgggatttaagaccatggatttccccgccgtcaccatttgcaatgcatccccattcaaatactccaaaattaagcatctgctaaaagatctggatgaactgatggaagccgttctggagaggatcctcgctcccgagctctcccacgccaacgccaccaggaatctgaacttctcaatttggaaccatacccccctggtgctcatcgatgaacgcaaccctcatcatcctatggtgctggatttgttcggcgacaaccacaatggcctcacctcatcgtctgcctcggaaaagatctgtaacgcccacggttgcaaaatggcaatgagactctgctccctgaaccgaactcaatgcacctttagaaatttcacaagtgctacgcaggcgctcacagaatggtatatcctgcaggccaccaacatattcgctcaagttccccaacaagagctggtggagatgtcataccccggtgagcaaatgatactggcttgcctattcggggcggaaccatgcaactatcgcaacttcacaagcattttttatcctcattacgggaattgctatatatttaattggggcatgaccgagaaggcgttgccgtctgcaaatcccggtaccgagtttggcttaaagctcattctggatatcgggcaggaggactatgtgcctttcctggccagtaccgctggtgtacgcctgatgctgcacgagcagcgctcgtaccctttcatcagagatgagggaatctatgccatgtctggtaccgaaacctccattggggtcttggtggacaagctccagcgcatgggcgaaccttatagcccatgtaccgttaacggctccgaagtacccgtgcagaacttctactccgactataataccacgtactctatccaggcttgcctgagatcttgtttccaggatcacatgatcagaaactgcaactgtggccactacctataccctctccctaggggagagaaatactgtaacaaccgcgactttcctgactgggcccactgctattccgacctacaaatgtcagtcgcccagcgcgaaacatgcatcggaatgtgtaaggagagctgtaatgacacccagtataagatgacaatctctatggccgactggccctctgaggcatccgaggattggatctttcatgtgctgtctcaggagcgagaccagagcacaaatattacactgtctagaaaagggatcgtcaagctcaatatttactttcaggagtttaactatcggaccatcgaagagagtgccgcaaataacattgtatggctactaagcaatcttgggggtcaattcgggttctggatgggcggctctgtgctatgtctaatagagttcggcgagataattatcgactttgtttggattacgatcataaaactcgtggctttagccaagagcttacgacagaggcgtgctcaagcctcttacgcaggaccaccaccaacagtcgccgaactcgtggaggcccataccaactttggattccagccagataccgccccccgaagccctaatacagggccataccccagcgaacaggccctgcctattccaggcacgcctccccctaattacgactcattacgccttcagcctctggacgtgatcgaatctgactccgagggcgatgcaatctag

SEQ ID NO: 134666 - DNA, 1923 bp, Artificial Sequence
  Description of Artificial Sequence: Synthetic coding sequence
atgcacgtgaaaaagtacctccttaaagggctccatcgacttcagaaaggcccaggctacacttataaagaactcctggtttggtactgcgataatactaacacccatgggccaaaacgtattatctgcgagggcccaaagaagaaggcaatgtggttcttattaacattgctttttgctgccctggtgtgctggcagtggggaatcttcatacggacataccttagttgggaggtgtctgtttcactgagcgttgggtttaagactatggactttccagctgtgaccatatgtaatgcatctcctttcaagtactcaaagatcaagcatcttctgaaagatctggacgaactgatggaggctgttctggaacgcatcctcgcccctgagctaagccatgccaatgctacacgtaatttgaacttctcaatctggaatcacactcctttagtactgattgatgagcggaaccctcaccatcccatggttttggacctgttcggcgataaccacaacggccttacatcttccagtgcctcagagaagatctgcaacgcccatggatgcaagatggcgatgagattgtgttctctgaacaggacccaatgtactttccggaatttcactagcgccacgcaagccctcaccgagtggtacattctccaggccacgaacatcttcgcacaagttccgcagcaggagctcgtggagatgtcttatcctggagaacagatgattctcgcatgtctctttggcgcagaaccttgcaactaccgaaattttaccagcattttttaccctcattacggaaattgttacatctttaattggggtatgacagagaaggctctcccttccgccaacccaggcaccgagttcgggttgaagttgattctcgacataggccaggaagattacgttccgttcctggccagcacagcgggcgtgcgacttatgctccacgagcagcgtagctatccttttatcagggatgaggggatctatgctatgtccggaaccgagacgagcatcggggtcctggtagataagttgcagagaatgggcgagccatactctccgtgtactgtgaatggttccgaggttccagtgcagaatttttactcagactataataccacctattcgatccaggcatgcttgagaagctgtttccaggatcacatgatccgcaattgtaactgtggacattatttatatccactgcctcgaggggagaaatactgcaacaaccgcgacttcccagattgggctcactgttactcagacttacaaatgtccgttgctcagcgggagacgtgcattggtatgtgcaaagaatcgtgtaacgacacacagtataagatgacaatctctatggccgattggccgtcggaggcaagcgaagactggatttttcatgtgttgtcgcaagagagggaccagagcacgaatatcaccctgtcccggaaaggaatcgttaagcttaatatctatttccaagaattcaattacaggaccatcgaagagtctgcagccaacaacatagtctggttattgtctaaccttgggggccagtttggattctggatgggcggctccgtgttgtgcctgattgagtttggcgaaattatcatagatttcgtgtggatcacaatcattaagctcgtggcgcttgccaaatcactcaggcagcgaagagcacaagcctcctatgcgggccccccgcctaccgtggcggagttggtggaagctcacacaaatttcggatttcagcctgataccgccccccgatccccaaacactggaccttacccaagcgaacaagcactgcccattcccggcaccccccctcccaactacgactcattgcgcctgcaaccactagatgttatcgagtcagacagcgagggggacgccatctag

SEQ ID NO: 134667 - DNA, 2115 bp, Artificial Sequence
  Description of Artificial Sequence: Synthetic coding sequence
atggccttcctgtctcgcacaagtcctgtagcagccgcttcctttcagtccaggcaggaggccagaggatcaatccttctgcagagttgccagctccctcctcaatggctcagcaccgaggcgtggacgggcgaatggaagcagccacacggaggcgccctgacaagcaggagcccaggccctgtcgcacctcaacgtccttgccatttaaagggatggcagcacagacccacgcaacacaacgccgcttgcaagcaaggccaggccgctgcccaaacaccccctagaccgggcccacctagtgccccgccgccaccccctaaggaaggccatcaggaaggcctggtggagttgcctgccagttttcgagagcttctcactttcttctgtacgaatgccaccatccacggcgcaatacgcctggtatgttcacgaggcaacagacttaaaaccacatcatgggggcttctctctctgggcgcgctcgtggccctttgctggcagctgggactgctctttgaaaggcactggcaccggcccgtacttatggctgtttctgtacactctgaaaggaagttactgcccctggtgaccctgtgcgatggaaatcctcgacggcccagtccggtgcttcggcacttagaactgttggacgaattcgcccgcgagaacattgacagcctctacaatgttaatctgtctaaaggaagggccgcactaagcgctacagtgcccagacatgaaccacccttccaccttgaccgggagattcgacttcagcgcctatctcattccggttcgagagtgagagtgggcttccggctgtgtaacagtacgggcggcgattgcttttatcgcggatacacctcgggggtggctgcagtgcaggactggtatcacttccattatgtggatatcttggctctgttgcctgcagcttgggaggactctcacggaagccaggatgggcactttgtcctgtcttgtagctacgacggcctagattgccaggccagacagttccggacgttccatcaccctacgtatggatcctgttatacagtggatggggtctggactgcgcaacggcctggcattactcatggggtgggattagtgcttcgggtggagcagcagccacacctgccactgctgagtacattagcaggcatccgcgtgatggttcacggtcgtaaccacaccccttttcttgggcaccattccttctccgtgcggcctggcaccgaggctaccattagcattagggaggatgaggttcatcggttaggaagtccctatggacattgcacggctggcggcgaaggcgtggaagtggaactgctgcacaatacttcctacactagacaggcttgtctcgtatcatgtttccagcaactcatggtcgaaacatgcagttgcggttattatctccatcctctcccagctggtgccgagtattgtagcagtgctaggcatcctgcatggggccactgtttctatcgactctatcaggatctggagacgcatagattaccctgtacgagccggtgccctcgcccatgcagggagtccgcttttaaactaagcactgggaccagccgctggccaagcgctaagagcgcaggctggactctcgctactttgggtgaacaggggcttccccatcaatcccacaggcagagaagctctcttgctaaaattaacatcgtgtaccaagaactgaattaccgctccgttgaagaagccccagtttactcggttcctcagctgctgtctgcaatgggttcattatgtagcttatggttcggcgcgtctgtactttcgctcttggaactccttgagttgttattagatgcatcggctttaactctggtactgggcgggagaaggctgcgccgcgcgtggttctcgtggccacgagcaagccccgcctctggggcgtcctcgattaagcctgaagcatcccagatgcctccacccgcaggcggcacctccgacgatcccgagcccagcgggcctcacctccctcgggtcatgctgccaggtgtgttagccggcgtgagcgccgaagagagctgggccggtcctcagccgctcgaaaccctggacacctag

SEQ ID NO: 134668 - DNA, 1917 bp, Artificial Sequence
  Description of Artificial Sequence: Synthetic coding sequence
atggctgagcaccgctctatggacggacgaatggaggcagccacacggggagggagtcacctgcaggccgctgctcagactcccccccggcctggccccccatcagcaccacccccacctcccaaagagggccaccaagaaggccttgtggagctgcccgcatcctttagggagttgctgacttttttttgcactaatgcaaccattcatggagcgattcggttagtatgtagtcggggaaatcgcttgaaaacgacctcctggggcctgttgagcctaggggccctcgtggccctgtgctggcagctaggcctactcttcgagaggcattggcatagacctgtcttaatggcagtgtcagttcactcagaacgtaaacttcttccccttgtgacactttgtgacggaaacccccgacgccctagtccggtcctgagacacctggaattgctcgacgagttcgctagggaaaatattgacagtctctacaacgttaatctcagtaaagggcgggccgctttatccgcaaccgtgccccgtcacgagccaccctttcacctggaccgagaaattcggctgcagagattgtcccatagcggcagtagggtaagagtgggcttccgactgtgtaattctactggcggcgattgcttttatagggggtacacatcaggagtagcagccgttcaggattggtatcactttcactacgttgacatactggccctactgcccgccgcctgggaggattcgcatggcagccaagatggtcacttcgttctatcttgctcttacgatgggctagactgccaggctcggcagtttcggacgtttcaccatcctacatacggtagctgttacactgttgacggcgtgtggaccgcccaaaggcccggaattacacacggcgtgggcctggtattgagagtggaacagcaacctcaccttccactgctgagcactctggctggtatccgagtaatggtgcacgggagaaaccatactcctttccttggacaccatagtttcagtgtgagaccgggaacagaagccaccataagcatccgggaggatgaggtccacagactagggtccccatacggccactgcaccgcaggaggcgagggagttgaggtggaactactgcacaatacttcatacacacgccaggcttgcctggtctcttgctttcagcagcttatggtggaaacatgttcctgcgggtattatctgcatcctctgcctgctggcgccgagtattgtagcagtgctagacacccagcatggggccactgcttttatcgtttatatcaagatcttgaaacacaccgactgccatgcacgtcgaggtgccctcgcccctgtcgcgaatcggcctttaaactgtccactggtacaagcaggtggccatccgcgaaatctgctggttggacattggcaaccctgggagagcagggcctgccacatcagagtcatagacaaagatcatctcttgcaaagataaatattgtgtatcaggagctcaactatcggagcgtagaagaagcccccgtatacagcgttccacaactattgtccgctatggggtctctttgcagcttgtggttcggcgctagcgtgctaagtctgctggagctgttggaactgctactggatgcgtctgctttgactctggtgcttggcggcaggagactccgcagagcatggttctcctggccacgcgcgtccccggcatcgggagcgtctagcattaagcccgaagcaagccagatgccacccccagccggggggaccagcgatgaccctgaaccctcaggaccccaccttccacgggtgatgctgcccggggtacttgctggtgtatctgcggaagagtcttgggcaggcccccaacctctagagacgctggacacatag

SEQ ID NO: 134669 - DNA, 927 bp, Artificial Sequence
  Description of Artificial Sequence: Synthetic coding sequence
tgagctactgcaagggctgcaacagcatttacagaggccacaagacaagcgtggaggctgagcaggaccgggacgacatctacaatgtggatcagttggccctgttgcccacgccatggcaggacagcgacaggtgctcggacagcgacatcctcctcgccagccgtgactatggcctggacagctagaccagacagctcaggaccttccactacaccccccaccgccgccgcaacacgcagcatggcctcagggcagctttccgccccggcgagtcccaccgtgggagcaagcccttggcccgtgcgaggccagggctgcagatcaggaggactgacccccgccctgggcctccctggcgtgggcctagtgctgagggtagaacagcagcctcatttgcctcttctctcaacccttgccggcattagagtgatggttcatggtaggaatcatacacctttcctcggtcatcactccttttctgtgaggcctggtacagaggccactatctcaattagagaagacgaggtgcatcgcctgggatccccatacggccactgcacagcaggaggggagggcgtggaggtcgaactcctacacaatacatcttataccaggcaggcctgtctcgtgtcctgctttcagcagctgatggtagagacttgcagctgtgggtattatcttcatcctcttccggctggagccgaatactgcagttccgctcgccacccagcgtgggggcactgtttttaccgtctctaccaggacctcgagacccaccgtcttccctgtacttcacgttgcccacggccatgcagggaatccgcattcaaactttcaacaggcactagtcgctggccaagcgccaaatccgccggatggacactggctactctcggcgagcaaggcctgccccatcagtcttag

SEQ ID NO: 134670 - DNA, 2010 bp, Artificial Sequence
  Description of Artificial Sequence: Synthetic coding sequence
atggctgagcacaggtccatggacggtagaatggaggctgcaacacgcggaggctcgcacctgcagatcgcctgggcttgcggaagtcccgaagcactcccgcccgagggcatggccgcccagacccactctgcacaacgctgcctccagactggtccgggctgtagtcctgacgcgccccagccagggccgcctagcgcaccaccaccacctccaaaggaaggacatcaggaaggccttgtggaactcccggcctcgtttcgagaactgttgacattcttctgcactaatgcgaccatccatggagccatccgcctggtgtgttctcgaggcaataggcttaaaacaacgtcatggggactgctgagcctgggcgctctagtcgccttgtgctggcaactgggactcttatttgagcggcattggcaccgcccggtgctgatggcggtttcggtgcacagcgagagaaagctgttgccgttggtaacactttgcgacggcaatccccgaaggccgagcccggtcctgcgccatcttgagctgctcgatgagtttgcccgcgaaaacattgactccctgtacaacgttaatctcagtaagggacgggcggcccttagcgcaacagttccgcgccacgagcctcccttccaccttgatagggagatccgtctacagcgactctctcactcaggcagtcgggtgcgcgttggattcagattgtgtaacagtactggtggcgattgcttttaccggggctatactagcggcgtagccgccgtgcaggactggtatcacttccactacgtggacatcctcgctttactccccgccgcctgggaggatagtcacggatcacaggacgggcacttcgtgctttcatgttcttacgatggcctggactgtcaagcacgccagtttagaactttccaccacccaacgtacggctcatgctataccgtggatggcgtttggaccgcccaaaggcctggaattacacacggtgtgggtctggtcttgagagttgaacaacagccccacctgccgttactcagtactctcgctgggatccgcgtaatggtgcatggccgtaaccacacccccttcttaggccatcatagtttttcagtgcggcctgggacagaggccactatatccatcagagaggatgaagtgcaccgactcggctcgccctatggtcactgcaccgccggaggtgagggagtagaggtggagctcctccacaatacctcatatactcgccaggcttgcctggtctcctgctttcaacagctgatggtggaaacatgttcctgcggatactacctacaccctttgcccgctggggcggagtactgttctagtgcacgacaccctgcctgggggcactgcttttaccgtctgtaccaagacctggagacacacaggctcccctgtacttcaaggtgcccgagaccctgcagagagagtgcatttaagctgagtacagggaccagtcgctggccatccgcgaagtcagccggctggaccctggccacgctcggtgaacagggcctcccgcatcagagtcacaggcagcgtagctctttagctaagatcaatattgtgtaccaggagctgaattaccgtagcgtcgaagaggcccccgtgtactccgttccgcaattgctgtcagccatgggaagcctgtgtagtctttggtttggggcctccgttctgtctttattggagttgctggagctccttctggacgccagtgcactaaccttggtccttggtggccggcgcctgcggcgggcttggttttcatggccgagggcttctcccgccagtggggcatctagtattaagcccgaggccagccagatgccgcccccagcaggtggaacgagcgacgaccccgagcctagtgggccccacttgcccagggtgatgctcccgggcgtactggccggggtatcagcggaggagagctgggccggaccccagcccctagaaacactggatacttag

SEQ ID NO: 134671 - DNA, 2409 bp, Artificial Sequence
  Description of Artificial Sequence: Synthetic coding sequence
atgagggcagttctttcgcaaaaaaccactcccctgcctaggtacctttggcctggacacctgtccggccctaggagattgacatggtcctggtgctccgaccataggacaccaacctgcagagaactcggatcgccccaccctacaccatgcactggaccagccaggggctggcctcggagggggggtgggccctgcggctttacctctgccggccacgtattatgtgggtatccactttgtttactctccgggccgatccagggctgtggtaccggcctgggcgacagttccatggcctttctgagcagaacttctccagtcgcagccgcaagcttccagagccgccaggaagccagaggcagtattttactgcagagctgtcagctcccccctcaatggcttagcactgaggcctggaccggcgagtggaagcaaccacatggtggagccctgacaagcaggagcccaggccccgtggctcctcagcgaccatgccatctcaagggctggcaacaccggcctacccagcacaacgctgcatgcaagcagggccaggctgcagctcagacgcctcctcggcctggccctccctctgcgccgccaccccctccaaaagaaggacatcaagagggcctggtcgaacttccagcctcctttcgtgaacttctcactttcttttgcaccaacgcgaccatccacggtgctatccgcctggtgtgttctcgaggcaaccggctcaaaacaacttcttgggggcttctgagccttggagccctggtcgcactgtgctggcagctgggactgctctttgaaagacattggcaccgacccgttctgatggccgtatctgtacactccgaacgtaaactgctgcccctggtgaccctctgcgacggcaatccacgaagaccctcaccagtgctcaggcacctggaactgctggacgagtttgcgcgcgagaacatcgattccctatataatgtgaacctgtccaagggccgcgctgcattgtccgccactgtgcccagacacgagccacccttccatcttgaccgagaaattaggctgcagcggctatcccactctggatccagagttcgtgtaggcttccgtctgtgcaacagtaccggcggggactgtttttatcgcgggtatacaagtggtgtggccgcagtgcaagattggtaccacttccattatgtggacatcctggccctgctgcccgcagcatgggaggactcacatggctctcaggacggacacttcgtgctgtcctgctcatatgacggcctggactgccaggcacgccaattcagaacttttcaccacccgacttacggcagctgctacacggttgacggggtctggacagcgcaaagaccggggataacacacggtgtcggtttggtgctaagagtggagcagcagccccatctacccttgctcagcaccctcgctgggatcagggtaatggtgcacggaaggaaccacaccccttttctgggacatcattccttctctgttagacccggtacagaagcaacaatttctatcagggaagacgaggtgcacagactgggatccccatatggccattgtactgcaggaggggagggggttgaggtggaactgctgcacaatacctcttatacccgccaggcgtgcttagtgagctgtttccaacaactcatggtggagacttgttcctgcggctattatctacaccctctgccagcaggggcagaatactgctcctccgccaggcacccagcatggggccactgtttctaccgtctgtaccaagaccttgaaacccaccgactgccctgtacaagccggtgtcctaggccgtgtcgggagagtgccttcaagctctctacaggaacctcgcggtggccctccgcaaagagcgccggctggacactggcaaccttgggggagcagggattgccgcaccagtcccacaggcagagatcttctctggccaaaataaacattgtataccaggagctgaactatcgatccgtcgaggaagcaccagtgtactcagttccgcagctgctcagcgctatggggtccctgtgcagcctctggttcggggccagtgtcctgagtctcctcgagctactagagctacttctggatgcatccgctcttactttggtgctgggagggcggcgactgcggcgggcatggtttagctggccacgcgccagccctgccagcggtgccagcagtatcaagcctgaggcctcccaaatgccacctcctgcgggggggacttctgatgatccagagccaagcgggccccatctaccccgggttatgcttccaggtgtgctggccggagtgagtgcagaagaatcgtgggccggcccccagcccctcgagaccctggacacttag

SEQ ID NO: 134672 - DNA, 1917 bp, Artificial Sequence
  Description of Artificial Sequence: Synthetic coding sequence
atggcggaacaccggagtatggatggccgaatggaggcagctacgcgcggaggcagtcatctgcaggcagcggcacaaacacctccacgcccgggacctccttctgccccaccaccgccccccaaagaaggacaccaggaggggttggtagagctccctgctagttttcgggagctgctgaccttcttttgtacgaatgccactattcacggagccatccgcctagtatgttcccggggtaacaggctgaagacaacatcatggggactcctctccctgggtgccctggttgccctgtgctggcaactgggcctcctctttgaaagacattggcatcggccagttcttatggcggtttccgtgcacagcgagcggaaacttcttccccttgtgaccctgtgcgacgggaaccccagacggcccagcccggtactaagacatctggaacttctagacgaatttgcccgggagaacatagattctctttataatgtgaacctgagcaaaggaagggccgcactgtctgcaaccgtgcctcgccacgagcctccttttcacctggatcgggagatccgtctacagaggttgagccattccggttctcgggtgagagtcggcttccgcctgtgcaacagtaccggcggagactgcttctatcgcggctacacgagcggcgtggctgccgttcaggactggtaccactttcattatgtcgacatactcgcactgcttccggctgcttgggaggacagccacggtagccaggatggacactttgtgctgagttgtagctatgacggtctggactgtcaggccaggcagtttagaaccttccatcatcccacctacggctcctgctacactgtagacggagtgtggaccgcgcagcgccctggcatcactcacggggtaggtttggtgctccgcgttgaacagcagcctcacctgcccctgctgtctaccctggccggtatccgggttatggtacatggtaggaatcacactccctttttaggtcaccactcattctctgtccgcccaggcacggaggccactatctctattcgggaggacgaggttcaccgtctggggtcaccttacggacactgcactgctggcggggaaggtgtagaagttgaattactgcacaacactagctacactcgtcaggcctgtctagtttcctgcttccagcagctgatggttgagacgtgttcctgtgggtattatttgcatcccctcccggccggcgcagaatactgtagctccgcgcggcatccagcttggggacattgcttttaccgcctgtatcaggacctggagactcataggctcccttgcacctcgcggtgcccacgcccttgtcgggagagtgccttcaagctgtcaacagggaccagcagatggcctagcgccaagtcagccggctggaccttagcgacactgggagagcagggattgccgcatcagtcacatcgtcaacgctctagtctcgctaagatcaatattgtgtatcaggagctaaattatcgttcagttgaggaggctccagtgtactcggttccacaacttctgtctgccatgggtagtctgtgtagtctgtggttcggtgcctctgtcttgagtctcctggaattacttgaactgctcttagatgcctccgccttgacgctcgttctcgggggcagacgcctgcggagggcttggttcagctggccccgcgcatccccagcttcaggggccagctccatcaagccagaggcatcccagatgccaccacccgcaggagggacctcggacgaccccgagccctctggaccacatcttccaagagtgatgctcccgggggtgctagctggcgtgtccgcagaagagagctgggccgggcctcagccattagaaaccctcgatacctag

SEQ ID NO: 134673 - DNA, 1950 bp, Artificial Sequence
  Description of Artificial Sequence: Synthetic coding sequence
atggcacctggggagaagatcaaggcaaagattaagaaaaacttgcccgtgactgggccacaggccccgacaataaaggagcttatgagatggtactgcttgaacacaaatactcacggctgccgaagaattgtggtgtctaggggtaggttgaggaggctgctgtggatcggatttacactcactgccgtagcccttattctgtggcagtgtgccctgctggtcttttctttctatactgtcagcgtctcaatcaaggtccactttaggaaactagatttcccagcggtgactatctgtaatattaatccatataagtacagtacggtacggcatctgttggccgatttggaacaggaaacaagggaggcccttaaatctttgtatggcttccctgaaagccgcaagcgccgagaagccgagtcttggaactccgtgtcggaaggcaagcaacctcgctttagtcatcggatccctctcctgatctttgatcaggacgagaaagggaaggccagggatttttttaccggacgcaaacgtaaggtagggggctctatcattcacaaggcatctaatgtcatgcatatcgagagcaaacaggtagttggtttccaattatgttcaaacgatacctccgactgcgccacatacacttttagctcaggcatcaacgccatccaggagtggtacaagctgcattacatgaatataatggctcaggtgcctttggaaaagaaaattaatatgagctattctgcagaagaactgttggtaacatgtttcttcgatggggtatcttgcgacgctcgcaactttaccctctttcatcacccgatgcatgggaattgctacaccttcaacaatcgcgaaaacgagaccatcttatctaccagcatgggagggtcggagtatggtctgcaagttatcctgtatattaacgaagaagaatacaatccatttttggtctcaagcacgggggccaaagttattattcacaggcaggacgaatacccttttgtcgaggacgtgggcacagagattgagactgccatggtgacctcaattgggatgcacctcaccgagtctttcaagctcagtgagccatactcacagtgtacagaagatgggtcagatgttcctattcgcaatatctataatgccgcttattccttgcagatttgcctgcactcttgttttcagaccaaaatggtagaaaaatgtggctgcgctcagtacagtcaaccgctgccccctgcggcgaactactgtaattaccagcagcaccccaattggatgtactgttactaccagttgcacagagcctttgtacaggaagaattagggtgccagtctgtgtgcaaggaggcgtgttccttcaaagagtggactttgaccacatcattggcgcagtggcctagcgtggtctccgagaagtggcttctgcccgtcctgacttgggatcaggggaggcaggttaacaaaaagctcaacaagaccgatcttgcaaaactgttgatcttctacaaggacttaaaccagcgctccataatggagtctccagccaattctattgagatgctgctttcaaatttcgggggccaattgggactgtggatgtcatgctccgtggtctgtgtgatcgaaataattgaggtgttttttatagacttcttcagtattatcgctcgacggcaatggcagaaagccaaagagtggtgggcctggaaacaggctccaccttgccccgaggcaccacgcagccctcaaggacaagacaaccctgctctagacattgacgacgatctgcctacgttcaacagcgctctgcacttaccacccgctttggggacccaggtacctggcacacctcctccgaagtacaacactcttcgtctggagcgggctttttcaaatcagttgactgacacccagatgctggatgagctctag

SEQ ID NO: 134674 - DNA, 5943 bp, Artificial Sequence
  Description of Artificial Sequence: Synthetic coding sequence
atggcagcaagactcctagctcccccgggacccgacagtttcaagccatttacgccggagtccctagccaacattgaacggcgcattgccgagtctaagctgaagaagccaccaaaagctgacgggagccacagagaagatgacgaggactctaaaccaaagccaaactcggatctagaggctgggaagagtctgcctttcatttatggcgacattccacagggactggtggccgttcccctcgaagattttgacccttactacctgactcagaaaaccttcgttgtgcttaaccgaggaaaaacattattcaggtttagtgctactccagctctttacattctttcgcccttcaatctgatcaggcgcatcgccatcaaaattctgatccactctgtgtttagtatgatcatcatgtgtaccatcctgaccaactgtgtgtttatgaccttttccaatcctccggactggtctaaaaacgtggaatatacattcactggcatctacacttttgaatccctggttaaaatcatcgccagggggttctgcattgacgggtttaccttcctgcgggacccatggaattggctggacttcagcgtgataatgatggcgtatattacagagtttgttaacttgggcaacgtgtcagcactaaggacttttagagtgttgcgggccctcaaaaccataagtgtcatccccggcttgaaaaccattgttggagccttaattcaatccgtcaagaaattgtctgacgtgatgatattaactgtgttctgtctttcggtcttcgctttgataggacttcaactcttcatgggtaatttaagaaataaatgcgtcgtctggcctatcaattttaacgaatcatatttagaaaatgggacaaaaggattcgattgggaagaatacatcaataacaaaaccaacttctatactgttcccggcatgctggaaccgctcctttgtggtaactcatccgacgccgggcaatgtccggaagggtaccaatgtatgaaggcgggaaggaaccctaattatggctacacctcctttgatactttttcttgggctttccttgctctgttcaggcttatgacccaggactattgggaaaacctgtaccagctgacgctgagggcagctgggaaaacctatatgatattctttgtgctcgtcatctttgttggcagtttctacctagtgaatctcatcttagcagtagtcgccatggcctacgaagaacaaaaccaggcaacattggaagaggctgagcagaaggaggccgagtttaaggcaatgctggagcaacttaagaaacaacaggaagaagcacaagctgccgccatggcaacttccgcgggaaccgtttccgaagatgctattgaggaagagggggaagagggcggagggagccccagaagttcttccgaaataagcaagttaagcagtaaaagtgcaaaggagcgccggaataggcgtaagaaacgaaagcagaaggagctgtcagaaggtgaagagaaaggggatcctgagaaagtattcaaaagcgaaagcgaggacgggatgcggcgcaaagccttcagactgcccgacaacagaatcggaagaaagttttcaataatgaaccagtctctcctgtcgatacccgggtctccgtttctgtccagacataattccaagtcatccattttctccttccgtggtccaggaaggttccgtgaccccggctctgaaaacgaattcgccgatgatgagcattcaacagtggaagagtccgagggaagacgcgacagcctgtttatccccattcgggcccgggaacggcgatccagctatagcggatacagtgggtattcgcaaggttcccgctcttccagaattttccccagcctgaggcgctcagtgaagcgaaactcgactgtggactgcaacggtgtcgtgagcctgatagggggccctggctctcatatcggtggtcggttactccccgaggcaacgacagaggttgagatcaagaaaaagggtcctgggagcctcctggtttctatggaccagctggccagttatggtcggaaggaccggattaattctattatgtctgtggtgaccaatactctggtggaggaactggaagagagccagagaaaatgccctccctgttggtataagtttgccaacacttttctgatctgggagtgccacccatactggatcaaactcaaagaaatcgtaaatctcatagtcatggatccgttcgtggacctggccataacaatctgtattgttctgaatacactgtttatggccatggaacatcaccctatgactcctcagttcgaacacgttctcgcagtagggaatctagttttcacgggtattttcaccgccgaaatgttcctgaagctaatagcaatggacccttactactacttccaggagggctggaacattttcgatggcttcatagtgagtctgtctctcatggagttgagcctggcagacgtagagggtctcagcgtgctgaggagcttcagactcctgcgcgtttttaaactcgccaaaagctggcctacgctgaacatgctcattaagatcataggcaattcagttggagccttaggaaacctgaccttggtgctggccatcattgtcttcattttcgcagtggtaggtatgcagcttttcggtaagagttataaggagtgtgtctgcaagatcaatcaggactgcgaactgccgagatggcatatgcacgacttcttccattctttcctgattgtgttccgggtgctgtgcggagagtggatcgaaaccatgtgggactgcatggaggtcgccgggcaagctatgtgtcttattgtctttatgatggtgatggtgatcggtaaccttgtggtactaaacttgtttctggcgctgctccttagcagtttcagtgcagataatcttgccgcaaccgatgatgatggcgagatgaataatttgcaaatcagtgtcatacggatcaagaaaggcgtggcctggacaaagctgaaggtgcacgccttcatgcaggcccacttcaagcagcgagaggccgatgaagtcaagcctctcgacgagctgtacgaaaaaaaggccaactgtatcgcgaaccataccggggctgacattcacagaaacggcgacttccagaagaatgggaacgggaccacctccggaatcggatccagtgtcgaaaagtacattatcgatgaggaccatatgtccttcatcaataacccaaacctaacagttcgggtgcccatagcagtgggagagtcagattttgagaatttgaatacagaggatgtaagttcagaaagcgatccagaaggcagcaaggacaagctggatgacacatctagtagcgagggatctaccatagatatcaagcctgaggtcgaagaggtgccagtggagcaacctgaggagtacctcgacccagatgcctgcttcacggagggctgcgtgcaaagatttaagtgctgccaagtcaatatcgaagaggggctgggcaaatcatggtggatactgagaaagacttgttttttgattgtggagcataactggtttgaaacattcataatcttcatgattctattgtcctcgggtgctctggccttcgaggatatttacatcgaacagaggaaaaccatcaggacgattctggagtacgccgataaagttttcacatatatttttatcttggagatgctgctcaaatggactgcatacggcttcgtgaagttttttacgaacgcatggtgctggctggattttctgatcgtggcagtgtcactcgtatctctgatcgcaaacgccctcggctacagcgagctcggcgcgattaaatcgttgaggactcttagggctctcagacccctgagagccttgagcagatttgagggaatgcgcgttgtggtgaatgccctagtgggcgccatccctagcattatgaacgttctattggtgtgtctgattttctggctgattttctcaatcatgggtgtgaatttgttcgccggcaaatatcattattgctttaatgagacgagcgagattcggttcgagatagaggacgtaaacaacaaaacggagtgtgagaagctgatggaagggaacaataccgaaatacgatggaaaaacgtcaagataaacttcgataatgtgggagccgggtatttggcattgctgcaggtagctactttcaaaggctggatggatatcatgtatgccgcagtggactctaggaagccagacgaacagccaaagtatgaagacaacatctacatgtatatttatttcgttatatttatcatcttcggatcttttttcacgctaaacctgtttatcggcgtgatcatcgacaattttaaccagcagaaaaagaagtttgggggccaagatatttttatgacagaggaacagaagaaatattataacgccatgaaaaagttaggctcgaagaaaccacagaaacccattcctcggccactcaataaaattcagggaattgtttttgactttgttacacagcaagcgttcgatattgtcattatgatgttaatttgtttgaacatggtgacaatgatggtggaaaccgatactcagtctaaacaaatggagaacattctctactggatcaacttggtttttgttattttttttacgtgtgagtgtgtcctgaaaatgtttgccctcaggcactattattttacaattggctggaatatcttcgacttcgtggtagtgattctttcgatcgtggggatgttcttggctgatatcattgaaaaatacttcgtctctccgactctcttcagggtcattagactcgcacgcattggcaggattctcagactgatcaaaggtgccaagggcatcagaacgctattgtttgccctcatgatgagtctgcctgctctctttaatattggattgttattatttctcgttatgttcatcttctcgatattcgggatgtccaactttgcttatgtcaaacatgaagccggcatcgacgacatgttcaattttgagacctttggaaacagtatgatctgcctgttccagatcacaacgtccgctggctgggacggcctccttcttccaatacttaaccggccgcccgattgttcattggacaaggagcatcctggaagcggattcaaaggagattgcggcaatccctcggtgggcattttctttttcgtgtcatatatcatcatatccttcttgattgtggtgaatatgtacattgccatcatcctcgaaaacttcagcgtggcaacagaagaatctgcagatcccctcagtgaggatgatttcgagacattttacgaaatctgggaaaagtttgatcctgatgcaacccagtttattgagtattgcaagctggccgatttcgccgacgctctggagcacccgcttcgcgtacctaagccaaatacaatagagctgattgcgatggacctgccaatggtctctggagatcgcattcattgcctcgatatcttgttcgcgtttaccaaaagggtgttgggtgatagcggagagctggatatccttcgtcagcagatggaagagcgcttcgtggcctctaatcccagcaaagttagttacgagccaatcaccacaacacttcggcggaagcaggaagaggtgtctgcagtcgtgttgcagcgagcttacagagggcacctcgcaaggcgcggttttatctgcaagaaaacaacaagtaataagctggaaaacggcggaacccacagggaaaagaaagaatccactccctccacggcaagtttgcccagttatgattcagttacaaaacctgaaaaggaaaagcagcagagggctgaggaaggaaggcgagagcgggcaaagaggcagaaggaggtgagagaatccaaatgttag

SEQ ID NO: 134675 - DNA, 4674 bp, Artificial Sequence
  Description of Artificial Sequence: Synthetic coding sequence
atggctgcaaggctgctagctccccccggacctgattcttttaaaccctttacgcctgaatccctggccaacatagaacgtcgaatagcggaaagcaagctgaaaaagccccccaaagcggacgggtcccaccgcgaagacgatgaagactccaagccaaagcccaatagcgacctggaagccggtaaatccttgccattcatatatggcgatataccacaaggcttggtcgccgtcccgctggaggattttgatccctattatttaacacagaaaacgttcgtcgtgctcaatagaggcaagaccctcttccggttttctgccactcctgctctttacatattaagccccttcaatttgatcaggcggatcgctattaaaatcctcatccacagcgtgttcagtatgatcatcatgtgcacaattctgaccaactgcgttttcatgaccttttctaaccccccggattggtccaagaacgtggagtatactttcaccggcatttacacatttgaatctctcgtgaaaatcatcgcacggggattttgcatcgacggcttcaccttcctgcgcgacccgtggaactggcttgacttttcggtgattatgatggcatacatcacggagtttgtgaatctcggaaatgtcagcgcattgagaactttcagggttttgcgcgccctcaaaacaatatctgttattcctggactcaagacaattgtcggggcactgattcaatcggtgaaaaagctatccgacgtgatgatcctgacagtgttctgtttaagtgtgttcgctctcatcggcctgcagctctttatggggaacttgcgaaacaagtgtgtagtgtggcccatcaactttaatgagtcttacctggaaaacgggacgaaaggcttcgattgggaagagtacataaataataaaactaacttctataccgtgcccggaatgctggaaccactcctgtgtgggaattcatccgacgctgggcaatgcccagaaggttaccaatgtatgaaagccgggcgaaatccaaactacggctacacgtcttttgacaccttttcctgggcttttctagcccttttccgccttatgactcaggactattgggagaacctgtatcagttgacgctgcgggcggcagggaagacctacatgatcttttttgttctggtcatattcgtgggatctttctacctggtgaacctgattctcgctgtagtggctatggcatacgaggaacagaatcaggcaaccctggaagaggcagaacagaaagaggctgagttcaaggctatgctagagcagctcaagaagcagcaggaagaggctcaagcagccgctatggcgacctccgccggaacggtgagtgaggacgcaatagaggaggaaggtgaggaaggggggggctcgccccgctcaagtagcgagatctcaaagctcagcagtaagagtgccaaagaacgcagaaatagacgtaagaaaagaaaacagaaggaattgtctgagggggaagagaagggggacccggagaaggttttcaaatcggaaagcgaagatgggatgcgtcggaaggcttttcgacttccagacaaccggataggaagaaagttttccattatgaaccagtcactgctgagtattccagggtccccatttttatcccggcacaactccaaaagcagtattttctccttccgcggcccagggcggttccgcgatcccggatccgagaacgaattcgccgatgatgaacactccacggtggaggagtccgaaggtagaagggacagcctatttatcccaattagggctagggaaagacggtcctcttatagtggatacagtggatatagccaaggtagccgaagcagtaggatcttcccatctctgaggcggtccgtgaagagaaactccaccgtggactgcaacggcgtcgtctccttaatcggcggaccaggatcccatatcgggggtaggctgcttcccgaagccaccaccgaggtggagataaagaagaagggaccgggctcgctgcttgtgtccatggaccagctggcctcctatggtaggaaggacaggattaattcaataatgtcggtcgtgaccaacactctggtggaagagctggaggagtcccaacgaaagtgtcccccatgctggtataaatttgctaatacattcttgatctgggaatgccatccatactggatcaaactcaaggagattgtgaatctgatcgtgatggaccctttcgttgacctggcaattaccatctgtatagtgctgaacactctctttatggccatggaacatcatcccatgacgccgcagttcgaacatgttttggccgttggaaacctggtcttcacaggaatctttactgccgaaatgtttcttaaactgatagcaatggacccctactactatttccaggaggggtggaatatctttgatggattcattgtatcactgtctcttatggagctgagtctggcagacgtagaaggcctttctgtgctgcgctctttcagattgcttagagtcttcaagctcgctaagagctggcctaccctaaacatgctgatcaaaatcatcggcaatagtgttggggctttaggtaacttgacattagtgctggccatcatcgttttcatattcgccgtcgtcggcatgcaattgtttgggaaaagctacaaagagtgtgtgtgtaaaattaatcaagattgcgagctcccgaggtggcacatgcatgatttctttcactcattcctgatcgtctttcgggtgctctgtggcgaatggatagagacaatgtgggattgtatggaggtggctggccaggcaatgtgtctgatcgtgttcatgatggttatggtcattggtaatctcgttgtgcttaatttgtttttggcgctcctgctatcaagcttctccgcggacaatctggctgccactgacgatgacggtgagatgaacaatttacagatttccgtgatacgcattaaaaaaggcgtagcatggaccaaactcaaggtgcatgctttcatgcaagcgcattttaagcaacgcgaagctgacgaggtcaagcctctggatgaattgtatgagaaaaaagctaactgcattgctaatcacaccggagcggatattcacagaaacggggacttccagaaaaatggtaatggcaccacctctggcattgggagttctgtggaaaagtacatcattgatgaagaccatatgagtttcattaacaacccaaacctgaccgttcgcgtcccaatagcggtaggcgaatccgactttgagaacctcaacaccgaggacgtttctagcgaatcggaccctgaggggtccaaggacaagctcgatgacacatcgagttccgagggcagtactattgatatcaagccagaggtggaggaagtgcccgtcgaacaaccagaggagtatctcgatcccgatgcttgctttacagagggatgcgtgcaacgctttaaatgttgtcaagtgaacattgaggaaggattgggcaagagttggtggatccttaggaaaacatgcttcctcattgtggagcataattggtttgaaacgtttatcatttttatgatcctgctgagtagcggcgcgctggcctttgaggacatctacatcgagcagaggaagaccatccggaccatcctggagtacgccgacaaagtctttacgtacatctttatcctagaaatgcttttgaaatggacagcatacggattcgttaaattttttacaaacgcatggtgttggctggattttttgatcgttgctgtggtggtgaacgccctggtcggtgcaattccttctatcatgaacgtcctcctggtttgcctgattttttggttaattttttctatcatgggcgtcaacttatttgccggtaaatatcattattgcttcaacgagactagtgagattagattcgagatcgaagacgttaacaataagaccgagtgtgagaaactaatggaaggaaataataccgagatccgatggaagaatgtaaaaataaactttgacaatgtgggggccgggtacctcgcactgctccaagtcgcgacattcaagggctggatggatatcatgtacgccgccgtggatagccgcaagcccgacgaacagccaaaatatgaggacaacatttacatgtatatctactttgtcatattcattattttcgggtccttctttaccctcaatttgttcattggcgtcattatcgacaacttcaaccaacagaagaagaaatttggcggtcaagacatatttatgacggaggagcagaaaaagtattataatgctatgaagaagctggggagcaaaaaaccacagaaacccatacctaggcctctcaataagatccagggcatcgtcttcgatttcgtgacccagcaggcattcgatatcgttataatgatgctgatctgcctgaacatggttacaatgatggtcgagaccgatacccagtctaagcagatggagaatattctgtactggattaacttggtgttcgttatcttctttacgtgcgaatgcgttctcaagatgtttgctttgagacattattactttacaatcggatggaacatcttcgactttgtggttgtgatcctcagcatagtctag

SEQ ID NO: 134676 - DNA, 3588 bp, Artificial Sequence
  Description of Artificial Sequence: Synthetic coding sequence
ttcctaagtccgcagacctttgtggtcctaaatcggggcaaaacgctgttcaggtttagtgccacacccgcattgtacattctgagtccattcaatctgatacggaggatcgccattaaaattcttatacatagtctgttttccatgattatcatgtgcactattctcactaattgcgtcttcatgactttttcaaatcctcctgattggagcaagaacgtggaatacacattcaccggcatatataccttcgaaagcctggtaaagattattgccagaggcttctgcattgacgggtttacgtttctgagagacccatggaattggttggatttcagtgtcattatgatggcatacattacagaattcgtaaacctggggaacgtttccgccctgcgcacgtttagagtcttgagggcacttaagacaatatccgtgatacctggtcttaaaacaatcgttggtgcgctgatccagagcgtcaagaaactctcagatgttatgattcttactgtattttgtttgagcgtgtttgcactcattggtctgcagctgtttatgggaaacctccggaataagtgtgtggtgtggcccataaatttcaatgagagctacctcgagaatgggaccaagggcttcgattgggaagagtacatcaataataagaccaatttctacactgtgcccggtatgttggagcctcttttgtgtggaaactcatccgacgcaggccagtgccccgaaggctatcagtgcatgaaggcgggcaggaatcccaattacggctacacatcatttgatacctttagttgggcctttcttgcgctttttagacttatgacacaggactattgggagaatctgtaccagctgacactgcgggcggccggaaaaacttatatgatcttttttgttctagtgatcttcgttggcagcttctatctggtcaacctgattctggccgtggtggccatggcttatgaggaacagaatcaggccacactggaggaggctgaacagaaggaggctgagttcaaagctatgctggaacaactgaagaagcaacaggaggaagctcaggcagccgccatggcaactagcgccgggaccgtgagtgaggacgctatagaggaggaaggagaagagggcgggggctcgccccgcagctccagcgaaatctccaaattgtcctctaaatctgcaaaggagaggagaaatagaagaaagaagcggaaacagaaagaacttagcgagggcgaggaaaagggcgaccctgagaaagtattcaagtcagaatccgaggacggcatgcgtaggaaggcctttcggctgcccgataatagaattggcagaaaattttccattatgaaccagagcctcttgtcaattcctgggagtccatttctgagccgccataattccaaatcatccatcttttcattccgaggtcccggccgtttccgcgacccagggagcgagaatgaatttgccgacgatgaacatagtacagtggaagaatctgaagggcgtagggactctttattcatacctataagagctcgggagcgtcgttcctcttacagcggttactctggctactctcagggttccagatccagccgaatctttccatcactgcggcgctccgtgaaacgcaactcgactgtagactgcaacggggttgttagtctaataggaggacccggaagccacatcggtggaaggcttctcccagaagctaccaccgaagtggagatcaaaaaaaagggacctggctccttgctcgtctcaatggatcagctcgcgagctatggaaggaaggaccgcatcaacagcatcatgtccgtggtgaccaataccctggtggaagagttggaagagtctcagaggaaatgtccaccatgctggtataaatttgcgaatacttttctcatctgggagtgccatccctactggattaaactgaaagagattgttaatctgattgtgatggatcctttcgtcgacctggctattacaatttgtattgtgttaaatacactttttatggcaatggagcatcatcccatgacaccccagttcgaacacgttcttgcggttggaaacctggtgttcactggtatcttcaccgcggaaatgtttctaaagctgattgctatggacccctattattactttcaggaaggctggaatatttttgacggcttcattgtgtccctgtccctgatggagctgtcgttggccgatgttgagggacttagcgttttgcgatccttcaggctgttgcgggtgtttaagttagccaagagctggccaaccctcaacatgctaatcaaaattatcggtaattccgtcggagccctgggtaacctcaccctggtgctagctatcatcgtttttatttttgcagtagtggggatgcagctgtttggaaaatcgtacaaggaatgcgtttgcaagatcaaccaggattgcgaactgccaaggtggcacatgcatgatttctttcactcctttctgatcgtttttcgggtgttatgcggtgaatggattgagacaatgtgggattgtatggaggtggctggtcaggcgatgtgtctgattgtttttatgatggtcatggtgatcggcaatctcgttgttctgaatttgtttcttgccctgctgctgtcatctttttcagctgataacctggctgccaccgacgatgacggcgaaatgaacaatttgcagatcagcgtcatccggataaaaaaaggggtggcctggacaaaactcaaagtgcacgccttcatgcaagcacatttcaagcagagggaagctgatgaggtgaagcccctggacgagctgtacgaaaagaaagccaactgcatagccaaccacaccggggcagatattcatcgtaatggcgattttcagaaaaacggcaacggcacaacttctggcatcggttctagcgtcgagaaatatatcatcgatgaagatcacatgagcttcattaacaaccccaatctgaccgttagagtgcccatagcagttggagaatccgatttcgagaacctcaacacggaggatgtttcctctgagagtgacccagaaggcagcaaagacaagctggatgatacatcttcctcagaaggcagtactattgatatcaagcccgaagtggaagaagtgcccgttgagcagcccgaggaatatctagatcctgatgcttgtttcaccgaggggtgtgtgcagagattcaagtgctgccaagtgaacattgaagaggggttggggaaaagctggtggatactgcgcaaaacgtgttttctgattgttgagcacaattggtttgagacatttattatctttatgattctgctgtcaagcggtgctctggctttcgaggacatctatatcgagcagagaaagactattagaacaatcctggaatacgccgacaaagtatttacatacattttcatattagagatgcttctgaagtggacagcttacgggttcgtcaagttcttcacaaacgcctggtgctggctggattttctgattgtcgctgtgccgttgaatctttccggattaatctag

SEQ ID NO: 134677 - DNA, 5820 bp, Artificial Sequence
  Description of Artificial Sequence: Synthetic coding sequence
atggctgcccgtctgctagccccaccaggacctgactcgttcaaacccttcacgcctgagtctttggctaacatcgaaagaagaatcgctgagtccaagctcaagaaaccgccgaaagccgacggatcacatcgggaggacgatgaggacagtaaaccaaagcccaactccgacctggaggccggaaagtctctgcccttcatatatggagatatcccccagggtctcgttgctgtgccactagaagactttgacccatattacttaacccagaagaccttcgttgtgctaaaccggggaaaaaccctcttcaggttcagcgccacacccgccctatatatcctttctccttttaatttaatcaggagaattgccataaagatacttattcactctgtgtttagcatgattatcatgtgtacaattttgaccaattgcgtcttcatgacattcagtaatcctcctgactggagcaagaacgtcgagtacactttcaccggcatctacactttcgaatctttggttaagattatcgcaagagggttctgcatagacggatttaccttccttcgagacccatggaactggctggatttctcggtaattatgatggcttacattactgagtttgtcaatttgggcaatgtatctgctctgaggacttttcgggtgctgcgggcacttaaaactatctccgtgattcccggcctgaagacaatcgttggggccctgattcagagtgtgaagaagctcagtgacgtcatgatcctcaccgtattctgcctatccgtatttgctcttattgggctgcagcttttcatggggaatttgaggaacaagtgcgtcgtgtggcctatcaatttcaatgagtcgtacctggaaaacggtactaaaggctttgactgggaagaatacatcaacaataaaacgaacttttacacggtgcccggcatgcttgagcctttactgtgtggcaatagtagtgacgccggacagtgtccagaaggctaccaatgtatgaaggctgggcgcaaccctaattatgggtatacatccttcgacaccttctcctgggctttcctagccctgttccgactaatgactcaagactattgggagaatctataccagctgactttaagggccgcagggaaaacctacatgatttttttcgtgctcgtgatcttcgtcgggagcttctatctggtcaacctgatactagctgtggtggccatggcctatgaggagcagaaccaggccaccttggaggaggcagagcagaaggaagccgagttcaaggccatgctggagcagctgaaaaagcaacaggaagaagctcaggccgccgcaatggctacgtcagcgggaacagtctcagaggacgcgatcgaagaagagggcgaggaaggcggggggtctccccggtcaagcagcgagattagcaaattgtcatccaaaagtgccaaagaacgacggaatagaagaaagaagaggaagcaaaaggaactttccgaaggagaagaaaagggggatcctgagaaggtttttaaatcagagtctgaggatggtatgaggcgcaaggcatttaggctgcctgataatcgtatcggtagaaaattctccattatgaatcagtccctgctgtctatccctggctcacccttccttagccgccacaattctaaatcctccatcttcagtttccgaggtccaggcaggttccgcgaccctggatctgagaacgaatttgccgacgatgagcatagcaccgttgaagagtcagaaggaaggagagattcccttttcatacctattagggccagagaacgcagatcgtcttactccgggtatagcggctacagtcagggatctcgatccagccggatatttccgagtcttcggcgttccgtaaagagaaactctaccgtggactgtaatggggtggttagcctcattgggggccctggatctcatattggaggacggttgctgcccgaagcaaccacagaggttgagatcaagaaaaaggggcccggatccctgctcgtgagtatggaccaattggcatcttatgggcgaaaggatcgaatcaactccattatgtctgtggtgacgaatacactggtggaggaactggaagaaagtcagaggaaatgtcccccttgctggtacaagttcgccaacactttccttatttgggaatgccatccttactggatcaagctgaaggaaattgtgaatctgatagtgatggaccccttcgtcgacctagctatcactatctgcatcgtgcttaacacacttttcatggccatggagcatcatcctatgactccccagtttgagcacgtgctcgctgtgggtaacctggtttttactggtattttcactgccgagatgtttttaaaactaatcgctatggacccctattattactttcaagagggctggaacatatttgatgggtttattgttagtctctcactcatggaactgagtctcgcggacgtggaagggctgagtgtgttacgcagctttcggcttctcagagtcttcaaacttgctaagtcatggcctacgctgaatatgctgatcaaaatcattggcaacagcgttggcgcacttgggaaccttactttagtgctagctataatagtttttattttcgccgttgtcggtatgcagttgtttggcaagagctacaaagagtgtgtgtgtaagattaaccaggattgcgagttaccacgctggcacatgcatgatttctttcactctttcctgatagtgttccgagttttgtgcggggaatggattgaaaccatgtgggactgtatggaggtggctgggcaggcgatgtgtcttatcgtgtttatgatggttatggtgatcggcaacctcgtggtgttgaacctgttcttagcgcttctgttatcatccttcagcgccgacaacctggccgcaacggacgatgatggtgagatgaacaaccttcaaattagtgtgatcagaatcaaaaaaggcgtcgcttggactaaattaaaagtccacgcttttatgcaggcccattttaagcagcgagaagctgatgaggtgaagccattggacgaactttacgagaagaaggctaactgtattgctaaccacacaggtgctgatatacatcgcaacggcgacttccaaaagaatggaaacggcactacctccggtatcgggtcttcggtcgagaagtacatcattgatgaggatcacatgagttttatcaataaccctaatctgaccgtgagagtgccgattgccgtgggagagtcagatttcgaaaatctgaacacggaggatgtctcgtctgaaagcgaccccgagggtagcaaggacaagcttgacgacacctcctctagtgagggatctactatagacattaaacccgaagtggaggaagtgcctgtggagcagccggaggaatacctggacccggatgcctgtttcactgaagggtgcgtccagaggtttaagtgttgccaggtcaatatcgaagaaggactgggcaaaagctggtggattctgaggaaaacctgcttcctgatcgtggaacataattggtttgaaacctttatcattttcatgatcctgctgtccagcggagctttggctttcgaggatatatacatcgagcaacgcaagactattagaacaattttagagtatgcggacaaggtcttcacatacatcttcatactcgaaatgctgctgaagtggaccgcctacgggttcgtgaaattctttacgaacgcttggtgctggttggacttccttatcgttgcagtcgtagttaacgctttagtgggcgccattcccagtatcatgaacgtgttgctggtgtgcttgatcttttggttaatcttcagtattatgggagtgaatctgttcgccgggaaataccattattgcttcaatgagacttcagagatccgatttgaaatcgaagatgtgaacaacaaaacagagtgtgagaaactgatggaaggcaacaatacagaaattcgctggaaaaacgtaaaaatcaatttcgacaatgtcggagcaggatacctggctctgttgcaggttgccacttttaaggggtggatggacatcatgtatgccgctgtggactctcgcaagcctgatgagcaaccaaagtacgaggacaacatctacatgtacatttattttgtgatattcatcatctttggctctttcttcacactgaacctcttcatcggagtgatcattgataactttaaccagcagaagaaaaaattcggggggcaggatatttttatgacagaagagcaaaagaagtattacaacgccatgaagaagctggggagcaagaaaccgcagaagcccatacctcgcccattaaataagatacaggggattgtgtttgacttcgtaacacaacaagcctttgatatcgtcatcatgatgttgatatgtctcaacatggtgaccatgatggtggagacggacacccaaagtaagcagatggaaaacatcttatattggattaacttagtctttgtaatattctttacgtgcgagtgcgtactgaaaatgtttgctctgcgtcactattactttacaatcggctggaacatatttgacttcgtagtggtgattctgtctatcgtaggtatgttccttgcagacatcatcgaaaagtattttgtgtcgccaacgttgttccgcgtgatccgcctcgctcgcattggcaggattttgcggttgataaagggagccaaggggataagaaccctgcttttcgctctgatgatgtccctccctgcattatttaacatcggtttgttgctctttctggtcatgtttatcttctctatttttggaatgtccaacttcgcatatgttaagcacgaggctggcattgacgatatgttcaatttcgagactttcggcaattctatgatctgcctgttccagatcacaacctctgccggctgggacgggttgttactgccaattcttaaccgacctcccgactgttccctggataaagagcatcctggctccgggtttaaaggcgactgcggaaatccctcagttgggatctttttctttgtgagctacattatcatcagcttcctcatagtggtgaacatgtatattgctatcattctggagaatttttctgttgctacagaggagagcgccgacccactatcggaggacgacttcgaaacattctacgagatttgggaaaagttcgatcccgacgcaacccagttcatcgagtactgtaagctcgccgacttcgctgatgcacttgagcaccctctgcgtgtaccaaaacctaataccatcgaacttatcgctatggatctgccgatggtgtccggcgacagaatacactgtcttgatatactgttcgcctttaccaaaagagttttaggagattcgggagagctggatatcctgagacaacagatggaagaacgcttcgttgcctccaatccgagcaaggtttcatacgaacccatcactaccactctgcgtcggaagcaggaggaagtgagcgccgtggtactgcagagagcttaccgaggacacctcgctcggcggggatttatctgcaagaagacgacatcaaacaagcttgagaatggaggcacacacagggaaaagaaggaatctaccccctctacagcttcactgcctagttacgattctgtgacaaagcctgagaaggagaaacagcagagggccgaagagggtcgcagggaacgtgctaaacgccagaaagaggtgagggaaagtaagtgctag

SEQ ID NO: 134678 - DNA, 2919 bp, Artificial Sequence
  Description of Artificial Sequence: Synthetic coding sequence
atggctgcccggttgctggctcctcccgggccagatagtttcaagccttttacaccagaatcattagcaaacatcgaaaggagaatcgcggaaagcaaattaaaaaagccacccaaagctgatggctcccaccgtgaagatgatgaggacagcaagccaaagccaaattcggacttggaagctggcaagagtttgccctttatttacggtgacattccccaggggctggtagcagtcccccttgaggattttgatccctactatttgacccagaagacgttcgtggtcttgaacaggggcaagacactgtttcgattctccgcaacacctgccctctatattttaagcccgttcaatcttatccgaaggatcgccattaagatccttatccacagtgtcttttcaatgatcatcatgtgcaccattttgacgaactgtgtgtttatgacattctctaatcccccagattggtctaagaacgtcgagtatactttcaccggcatctacacgtttgagtctctcgtgaaaatcatcgctcgaggattttgtatcgacggctttacctttttgcgggacccctggaactggctggacttttccgtcattatgatggcctatgttacagagtttgtggacctggggaatgtatcggccttgagaacattccgggttctgagggctctgaagacaatctccgtgattcccggtctcaagacaatagtcggcgcactgatacagtctgtaaaaaagcttagcgatgtcatgattctgacagtgttttgtttatccgtgtttgcccttatagggttacagctgtttatgggcaatctgcggaacaagtgtgtcgtgtggcctattaacttcaatgagagttacttggaaaacggcaccaaggggtttgattgggaggagtatattaataataagaccaacttctacacagtgcccggtatgctggagccccttttgtgcgggaactcttccgacgctggccagtgccctgaaggatatcaatgcatgaaggcaggccgcaaccccaattacggatacacatcattcgatacattctcctgggccttcctggcacttttcagactcatgacacaggattactgggaaaatctgtaccagctgactctgcgcgccgctggcaaaacgtacatgatctttttcgtccttgtgattttcgtagggagcttctacttggtaaacctgattttggccgtcgtggccatggcttatgaagagcaaaaccaggccacacttgaggaagctgagcagaaagaagccgagttcaaggccatgctggagcagctgaagaaacagcaagaagaggcgcaggccgccgctatggccacgagcgctgggaccgtaagtgaggacgcaatcgaagaagaaggcgaagagggcgggggcagtccacgtagctcttcagagatctccaagctgtcttccaagagcgccaaggaaaggcgaaatcgccgaaaaaaaagaaagcagaaggagctttccgagggcgaggagaaaggagaccctgagaaggtctttaaaagcgaatctgaagatggaatgcgccgtaaagcctttcggctgcccgacaaccggattggaagaaagttcagcattatgaaccagagcctgttaagcattccaggatcaccattcttatcaagacataattccaagagttcaattttttcttttcggggaccggggcgcttcagagatcccgggtctgagaatgaattcgctgatgatgagcattctaccgtcgaggagtccgaagggcggagagattcccttttcatccccatcagagcgcgggagcgaagatctagctatagtggatattcaggatacagtcagggatcccggtcgtcacgcattttcccaagcctgcgccgcagcgtgaaacgaaactctaccgtcgattgcaacggcgtagtaagtctgatcggcggacctgggagccatattgggggcagacttctgccagaagccacgaccgaggtcgaaattaaaaagaaaggcccaggatccctccttgtgagcatggatcaacttgctagctatgggagaaaagatcggatcaatagtattatgtctgttgtgacaaatactctggtagaagagctggaagagtcacagaggaagtgtcctccttgctggtacaaatttgctaacacctttctcatctgggagtgccacccatattggatcaagctgaaggagatcgttaacctgattgtcatggatcccttcgtcgatcttgccatcacgatttgtattgtcctaaatactcttttcatggccatggaacaccaccctatgactccacagtttgaacatgtgttggccgttggcaacctggtctttaccggtatctttaccgctgagatgtttctaaaactgattgccatggatccgtactactatttccaggaagggtggaatatttttgatggttttatagtgagccttagcttaatggaactgtcactggccgatgttgagggcctgagtgtgcttcgctcctttcggctactcagggtcttcaaacttgccaaatcatggcctaccctcaacatgcttataaaaattatcggaaactctgtcggagccctaggcaatttaaccctggtgctggctattattgttttcatttttgcagtggtggggatgcagttgttcggaaaaagctataaggaatgtgtctgcaagatcaaccaagactgtgaactgcctcgatggcacatgcacgatttctttcattcctttctgattgtgtttcgtgtgctgtgcggagaatggatagaaacaatgtgggattgcatggaggttgccggccaggcaatgtgtctcatcgtgtttatgatggtgatggtcatcggcaacctcgtcgtcagcaccaatttgtag

SEQ ID NO: 134679 - DNA, 6030 bp, Artificial Sequence
  Description of Artificial Sequence: Synthetic coding sequence
atggagcagacggtgttagtgccccctggaccggatagctttaactttttcacccgagagagcctggcagccatcgagcggcgcatcgctgaagaaaaggccaagaacccgaaacccgataaaaaggacgacgacgagaatggccctaaaccaaatagcgacctggaggcgggaaaaaacctgccttttatttatggagacatcccccccgaaatggtgtctgagcctttggaagatttagatccctattacataaataagaaaacttttatcgtcctgaacaaagggaaagccatcttccgattttctgctaccagcgcactgtacattctcacaccttttaatccattgaggaaaattgcaataaagatcctggttcatagcttgttcagcatgctcatcatgtgcacaatcctcactaactgtgtatttatgacaatgtccaacccccctgactggactaaaaatgtggaatataccttcaccggaatttatacattcgaatcccttattaaaattatagcgcgggggttttgcctggaagatttcacgttcctcagggacccttggaattggctggatttcactgtgattacctttgcatacgtgactgaattcgttgatctagggaacgtgagtgctctgagaacatttcgggtgctgcgagctctcaaaacaatatctgtcattcctggtctgaaaaccattgtcggagccttgattcagagcgtgaagaaattaagtgatgtcatgattctgaccgtgttttgtctgtccgtgtttgcccttatcggcctccaacttttcatggggaacctgcggaacaaatgcatccagtggccccccaccaacgcaagcctcgaagaacatagcatcgaaaagaacatcacggtgaactacaacggtaccctgataaacgagacagtcttcgagtttgattggaaatcatacatccaggactcccggtaccactatttcctggaagggtttctggacgccctgttatgcggcaacagttcagacgcaggacagtgccccgaaggttatatgtgcgtaaaggccggacggaatcccaattatggttatacatcatttgataccttcagctgggcctttttgtccctattccgacttatgacccaggatttttgggagaatctgtaccagttgaccctgcgggcagcaggcaagacatatatgatatttttcgtgctcgtgattttccttggctccttttacctgattaacctcatcctggcggtggtggctatggcgtacgaggaacaaaatcaggccaccctggaagaagccgagcagaaagaggccgaattccagcagatgatagaacagcttaaaaagcagcaagaagcagcacaacaagccgccaccgccaccgcctcggagcattcgagggaaccatccgcagcaggtaggttgtctgactccagctcagaggcctctaaattatcttcgaagagcgccaaggagcgccgtaatagacgaaagaaacgtaagcagaaagagcagagcgggggggaagagaaggatgaagacgagttccagaagtcagagagcgaagacagcattagaagaaagggcttcagattttccatcgaggggaatcgcctgacttacgaaaagcgctactcgagccctcatcaaagcctgctcagtatacggggcagcttgttctcaccccgcaggaactctcgtaccagcctcttcagcttcagaggtcgtgccaaggatgtggggtccgagaatgacttcgcggacgacgagcattcgacatttgaggacaacgagtctagaagagactcactgttcgttccccggcgtcatggcgagcggcgtaactcgaacctgtctcagacaagtcggtccagccgaatgctggctgtgttcccggctaatggtaagatgcactccaccgtagactgcaatggagttgtatctctggtgggcggtccgtcagtgccaacaagcccagtaggtcagttgcttccagaggtgataatcgataagccagcgactgatgacaacggaacgaccactgaaactgaaatgaggaagaggcggagctcttcattccatgtctccatggacttcttggaagacccttcacagcgccagcgagcgatgtctattgcctctatcctaactaatacagtagaggagttagaggaaagccggcagaagtgccccccatgctggtataagttcagtaatatattcctgatttgggattgcagcccttattggcttaaagtcaaacatgtggtgaatttagtggtaatggacccattcgtggacctcgcaatcacgatctgcatcgtcctaaacacccttttcatggccatggaacactaccccatgaccgaccactttaacaacgtgcttactgttggtaacctcgtctttactggaatctttaccgcagagatgtttttgaagattattgcaatggacccatactactatttccaggaaggctggaacatttttgacgggtttattgtgaccctctcactcgtcgaactgggtctcgccaatgtcgaaggcctttctgttttaagatctttccggctgctgagagtgtttaaacttgccaagtcttggcccacgctcaatatgctaatcaagattattgggaatagtgtaggggccctcggaaacctgacactagtgctcgcaattattgtttttatatttgccgtcgttgggatgcagctgttcgggaagtcctacaaggactgcgtttgcaagattgcgtcagactgccagttaccacgttggcacatgaacgattttttccactcattccttatcgtcttccgagtactctgtggtgagtggattgagaccatgtgggactgtatggaggtggcggggcaggcaatgtgtctaactgtgttcatgatggttatggtcatcggaaacctcgtagttctgaacctctttctggcgctcctcctgtctagtttctccgccgacaatttggccgctaccgacgacgataatgaaatgaacaatctccagatcgccgtggaccgtatgcacaaaggtgtagcctacgtaaaaaggaaaatttacgagtttattcagcagagcttcatcaggaagcagaaaatccttgacgaaatcaaacccctcgatgacctcaacaacaaaaaggattcctgtatgtccaatcatactgctgaaataggaaaggacctcgattacttgaaagacgtcaatgggactacatccgggatagggacagggagcagcgtcgaaaagtacattatagacgaatccgattatatgtccttcatcaacaatccgagtttgactgtgactgtcccaatagccgtgggagagtcagacttcgagaacctcaatactgaggacttttccagtgagtccgacctcgaggaatcaaaggaaaagctgaacgaatcatcctcaagcagcgagggaagcacagtggatattggtgccccagtggaggaacagcctgtcgtggaacccgaggagacactggagcccgaagcatgttttacggaggggtgcgtccagcgcttcaagtgctgtcagatcaatgtggaagagggccgtgggaagcagtggtggaacctgcgcaggacgtgcttcagaatcgttgagcacaattggttcgagacctttattgtgttcatgattctgctgagttcaggcgccttggcctttgaggatatatacatcgatcagcgcaagacaataaagacaatgttagagtacgctgataaggtgttcacgtacatcttcatcctggagatgctgctcaagtgggtcgcttatggctaccaaacctacttcacaaacgcatggtgctggctggatttcctgattgtggacgtttcactcgtcagtcttactgccaatgctctgggatattccgaattaggcgccatcaagtctctgcggactctcagagccctgagaccacttcgcgccctctccaggtttgagggtatgcgcgttgttgtcaatgctctactgggcgccattccatcaataatgaacgtgctgctggtgtgccttattttttggttaatctttagtatcatgggagtcaacctgtttgccgggaagttctaccactgcattaacactacaacaggggacaggtttgacatcgaagacgtcaacaaccacactgactgtctcaagttgattgaaaggaatgagactgctcgttggaagaatgtcaaggtgaatttcgataacgttggcttcggttatctgtccttgcttcaggtcgccactttcaagggttggatggacattatgtacgcggccgttgactctaggaacgtggagctccagccaaagtatgaggaatcactgtacatgtacctgtacttcgtcatattcatcatctttggcagcttcttcacactcaatttgtttattggggtcatcattgataactttaaccaacagaagaagaagtttggtggtcaggatatatttatgacggaagagcagaaaaagtactacaacgccatgaagaaactaggcagcaaaaagcctcaaaagcctattcccaggcctggaaataagtttcagggcatggtcttcgatttcgttacccgccaagtgttcgacatcagcatcatgatcctcatttgtttaaacatggttacaatgatggtggagaccgatgaccaaagtgagtacgtaactacaatcctgtcccgcataaatcttgttttcattgttttgttcaccggtgaatgcgtcctcaaactgattagtctccgccattattattttaccatcggctggaacatttttgattttgtcgtggtcattctgtctatcgtgggaatgtttcttgcagagctaatagagaagtacttcgtgtcacctactctgttcagggttattagacttgcacggattggacgaatcctgcggctgataaagggcgctaaaggtattcgtaccctgctctttgccctgatgatgtccctcccggcgctgttcaatattggattgctgttgtttctcgtgatgtttatttacgctattttcgggatgtccaattttgcttatgttaagagagaggtagggattgatgacatgtttaatttcgaaacattcggcaatagcatgatttgcctcttccagattacgacaagtgctggatgggatggactgctggcccccatcctgaatagtaaacctcctgactgtgatcccaacaaggtgaaccccggttcgagcgtcaaaggagattgcggaaacccgagtgtaggcatcttttttttcgtgtcatatatcatcatctcatttctcgtcgtggttaatatgtacatcgccgtgatcttggaaaacttcagcgtggcaacagaggagagcgcagagcccctctctgaagatgattttgagatgttctacgaggtctgggagaagttcgatccagacgccacccagtttatggagttcgaaaagctcagccagttcgcggccgcactggagcctcccctcaaccttccgcagcccaataaactacagctgattgcaatggacctgcctatggtctccggagacaggattcactgcctagacatccttttcgcatttacaaaacgagttttgggggaaagtggagagatggacgccctcaggatccagatggaggagcggttcatggctagtaaccccagcaaggtctcataccaacctatcacaacaacactgaagcgcaaacaggaggaggtgtcagccgtgatcatacagcgagcctaccggagacatctgttaaaaaggactgtgaaacaagcaagcttcacgtataataagaacaaaatcaagggaggcgcaaatctcctgatcaaggaggacatgataatagatcgtatcaatgaaaacagtataacggaaaagacagacctgactatgagcaccgccgcatgcccaccgtcttacgaccgtgtgactaagccaatcgtggaaaagcacgaacaagaggggaaggacgagaaggctaaaggaaaatag

SEQ ID NO: 134680 - DNA, 5997 bp, Artificial Sequence
  Description of Artificial Sequence: Synthetic coding sequence
atggagcagaccgtgttggtaccgccaggcccggactcgttcaacttttttaccagagaatccctagcggccatagaaagacgcattgcagaggagaaagctaagaaccctaaaccagacaaaaaggacgatgacgagaatggtcccaagcccaactctgatcttgaggccggcaagaatcttcccttcatctatggggatatacctcctgagatggtgtcagagccgctcgaggacctggatccctattacattaacaaaaagacgttcatcgtgttaaacaagggaaaggcaatcttccggtttagtgctacttctgcactgtatatactgaccccatttaaccctctgcgcaaaattgcgattaaaatcctggttcactccttgtttagtatgttgattatgtgtaccatcctgaccaattgcgtgtttatgactatgtccaacccgcccgactggactaagaacgtagaatatacttttaccggaatatacacatttgaatctctgatcaagattatcgcgagaggcttttgtctggaagattttacctttctgagagatccctggaattggctggacttcacagtgatcacctttgcttacgtgaccgagttcgtggatcttgggaatgttagtgccctaagaacttttcgcgtgttgagagccttaaaaactatctctgttatccccgggctcaaaaccattgtcggcgcccttattcaatccgtgaagaagctgtcggatgttatgatcctaacagtcttctgtttgtccgtattcgcacttatcggactgcagcttttcatggggaacctgcggaataagtgcatacagtggccaccgacaaatgcatcattggaggagcacagcattgaaaagaacatcacagtgaactataatggtactctgattaatgaaactgtgttcgaattcgattggaagtcctacatccaggactcgcgataccactactttctcgaggggtttctcgatgctctgctatgcggaaattcctccgatgccgggcagtgtccagagggctatatgtgcgtgaaggccggcagaaaccccaactacggatacaccagttttgacacgttctcgtgggcttttctttccctgtttcgactgatgacacaggacttctgggagaatctgtatcagcttaccttgagggccgccggcaaaacgtatatgatatttttcgttctcgtcattttccttggatccttctacctgattaacctgattctggccgtcgtcgcaatggcctatgaggagcaaaatcaggccacactggaagaagccgaacaaaaggaagcagaattccagcagatgatcgagcagttgaagaagcagcaagaagcagcccagcaggcggcgaccgccaccgcatctgaacactcccgggagccgagcgctgcgggaagactgagcgactcgtcctcagaggcttccaaattgagttccaagtctgccaaggaacgtaggaaccgcagaaagaagagaaagcaaaaagaacagagcggcggggaggagaaggacgaggatgaattccagaagagtgagtccgaggactccatcagacgcaagggtttcaggttcagtattgagggcaacagacttacttatgagaagagatacagctctccacatcagagtctgctcagtatccgcggcagtctcttctcaccccggaggaacagccggactagcttattttcattccggggccgagccaaagacgttgggagtgagaatgattttgcagacgacgaacattctacgtttgaggataatgagagtcgcagagactcattatttgtccccaggagacacggcgaacggagaaactcaaatttgtcacagaccagccgatctagccgtatgctggctgtcttccccgccaacggcaagatgcactcgactgttgactgcaacggtgtggtgtccttggttggaggaccttctgtaccaacttcaccagtggggcagctgctgcccgagggtacaacaacagagactgaaatgaggaagcgcaggtcctcctcatttcacgtgtctatggattttcttgaggacccctctcaaaggcaacgcgccatgagcatagccagtattttgacgaacacggtggaagagctggaagaatcccgacagaagtgtccaccttgttggtataagttcagcaacatcttcctgatatgggactgttcaccctattggctgaaggttaaacacgttgttaaccttgttgtgatggatcccttcgtagatctggccatcaccatttgtattgtactcaatacactgttcatggctatggaacactaccctatgacagatcacttcaacaatgttcttacggtcggaaacttggttttcaccggcattttcacagctgagatgttcctgaagatcattgctatggacccttattattatttccaagagggttggaatatctttgacggctttatcgtgacactgagcctggtagagctcggtttagcaaacgtggaggggctctctgttttaagatcattccgcttattgagggtgttcaaactcgctaagtcgtggccaacgctgaatatgctgataaaaattattggtaacagcgtaggggcccttggaaacctgactttggtcctggctatcattgtcttcatcttcgccgtagtgggaatgcagctgttcggcaaatcctacaaggactgtgtttgtaagattgcctcagattgtcagctgcctcggtggcacatgaatgacttcttccattcctttctgattgtgtttagagtcctgtgcggagagtggatagaaacaatgtgggactgcatggaagtcgctggtcaggcaatgtgccttaccgtttttatgatggtgatggtcataggtaatctggttgtgctcaacctattcctagctttgctcctgtcctcattcagtgctgacaacctggcggccacagatgacgacaatgagatgaacaacctgcaaatagcggtcgacagaatgcacaagggcgtggcatatgttaaacggaagatttatgaattcattcaacaaagctttataaggaagcagaagatactggacgagatcaagcccctcgatgatctcaacaataagaaggattcttgtatgagcaaccatacggccgaaattggaaaggatctggactacttgaaggatgtgaacggcaccacttccggtatagggactggaagcagcgtggagaagtatatcattgacgagtcagactacatgtccttcataaataatcctagtctcacagtgactgtacctattgcagtaggggagagcgatttcgagaatctcaatacagaggatttttctagcgaaagtgacctggaggagagtaaagaaaaactgaacgaatcgtcctcaagctctgagggctcaacagtggatattggcgcaccagtcgaggaacaacctgttgtggaacccgaagagaccctggagccagaggcttgcttcaccgaagggtgcgtgcaacgcttcaagtgttgccagattaacgtggaggagggacggggcaagcagtggtggaatctgagacggacttgttttcgcatcgtcgagcacaattggtttgaaaccttcattgtgtttatgattctgctgtccagtggcgcgctagcttttgaggatatctacatcgaccagcgcaaaaccataaagactatgcttgagtacgctgacaaggtgttcacatacatttttattttagaaatgctgctgaaatgggtagcttacggttatcaaacctacttcactaatgcatggtgttggctggactttcttattgtcgatgtatcactggttagcctgacagcaaacgctctggggtatagcgagttaggggccattaagagcctgcgcactctccgtgccctgcggcctctgagggccttatcccgattcgaagggatgcgcgtggttgttaatgctttactgggggctataccttccattatgaacgttctgctggtgtgcttgatattctggttaatattcagtatcatgggcgtcaacctatttgcaggcaagttctaccactgcattaacacaacaacaggagaccgcttcgatattgaggatgttaacaaccacacagactgtttaaagctcatagagagaaatgagaccgcccgctggaagaacgtgaaggtaaacttcgataatgtgggttttggctatctgtctctcctccaggtcgccacatttaaaggatggatggacataatgtatgcagccgtggattctaggaatgtggaacttcaaccgaaatacgaggagtccttgtatatgtatctgtattttgtgatatttatcatctttggttcatttttcacactgaatctcttcatcggggttatcatcgacaatttcaaccagcaaaaaaaaaagtttgggggccaggacatattcatgaccgaggaacagaagaagtactacaacgccatgaaaaaactggggtccaagaagcctcagaagcccatccctaggcccggcaacaaatttcagggtatggtttttgattttgtcacgcgacaagtgtttgacatctcaatcatgattctaatctgcttgaatatggtgaccatgatggtcgagaccgacgaccaatctgagtatgtgaccacgatcctgagtcgaataaatcttgtatttatcgtactctttaccggtgagtgtgtgcttaagcttatctccctgcgtcattactacttcactatcgggtggaacatctttgatttcgtggtcgtaattctctcgatcgtgggtatgtttctggcagaacttatcgagaaatactttgtgagcccgaccctgttccgggtgatccgcctagccagaattgggcggattctgagactaattaaaggcgcaaaaggaataagaacactcctcttcgccctgatgatgagcctccctgcccttttcaatatcgggctcttactcttcctggtgatgttcatttatgctatctttggaatgtccaatttcgcatacgttaagcgggaagtcggcatcgatgacatgttcaacttcgagacttttggaaacagcatgatttgtctcttccagattacgacaagtgctggctgggatggcctgctggcccccatcctgaactcaaagccccctgactgcgaccctaataaggtaaatcccggctcttccgtgaagggagattgcgggaaccccagcgtaggaatatttttttttgtgtcttacattattatttccttcctggtcgttgtcaacatgtacattgccgttatcctcgaaaacttctcagtagccactgaggaaagcgctgaaccattatccgaagacgatttcgagatgttctatgaggtgtgggagaaattcgaccctgacgcaacccagtttatggagtttgagaagctctctcagtttgccgcggctctcgaaccgcccttgaaccttccacagccgaataagctccaactgattgcaatggacctacccatggtgtccggcgaccgaattcattgtctggacatcctatttgcttttaccaagcgggtactgggtgagtcaggtgaaatggacgcactgcgcatacagatggaggagcgttttatggcctctaatcccagtaaggtgagctaccagcccataactacaacacttaaaaggaagcaggaagaggtctccgccgtgatcatccaacgagcttatcgccgccacttattgaaacgcacagttaaacaggcttcattcacctacaacaagaataaaattaaagggggggccaatcttctgatcaaggaagatatgatcatcgatcggataaacgagaactcgatcaccgaaaaaacagaccttactatgtcgactgctgcctgccccccttcatatgatcgcgtgaccaagcccatcgtagaaaaacatgaacaggaagggaaggatgaaaaagctaagggaaaatag

SEQ ID NO: 134681 - DNA, 5946 bp, Artificial Sequence
  Description of Artificial Sequence: Synthetic coding sequence
atggagcagacagtgttggtgccccctggcccagatagcttcaacttcttcactagagagagtttagctgcaatcgaacgtcgtatagccgaggagaaggctaagaatccaaagccagacaagaaggacgatgatgaaaatggacccaaaccaaactctgatctggaggcgggcaagaatctcccatttatctacggtgacatcccccctgagatggtgtcggagccccttgaagatctcgacccttactacatcaataaaaagactttcattgtccttaacaaagggaaggccattttcagattctcagccactagtgcactgtatatactaacaccattcaaccctctgagaaagatcgctataaaaatattggttcactctctgttttctatgcttattatgtgtaccatcctgacaaattgcgtgtttatgaccatgtctaatcctcccgattggacgaaaaatgtggaatacacctttacaggcatttacacctttgaatcactgatcaaaattatcgcgagaggattctgtctggaagatttcacctttcttcgagacccctggaattggctggacttcactgttatcactttcgcttacgtgacggagtttgtagatttgggaaacgtgagtgcactccgtacctttagagtactgagggctctgaagacaataagtgtgatccctgggctgaagaccatcgtaggtgctctgatacagtctgttaagaagctcagtgatgttatgatcctaactgtgttttgcctatccgtcttcgccctaattggactccagctgttcatgggaaatttgaggaataaatgcatccagtggccaccgactaatgctagcttagaagagcattctatcgaaaaaaacatcactgtcaactacaacggcaccctgatcaatgagacagtgtttgaattcgattggaagagttacattcaagattccaggtaccactatttcctggaagggtttcttgacgcacttctgtgcggcaactcttccgacgcagggcagtgtcctgaaggttacatgtgtgtaaaagctgggagaaaccccaactatggctacacaagttttgacacattctcctgggcctttttgtccctgtttcgcctgatgacacaagatttttgggagaacctttaccagctgacactgcgggccgccggcaagacatatatgatatttttcgtacttgtcatatttctcggctccttttatctgatcaatttgatattggccgtggtggcgatggcatatgaggagcagaaccaagctactttagaagaagccgaacagaaggaagcggagtttcagcagatgatcgagcagttaaagaaacagcaagaagctgctcagcaagctgccacggccactgcaagcgagcacagcagggagccgtccgccgctggcagactctcagactcttcgagcgaagcaagtaagctttcctctaagtccgctaaggagagaagaaatcgaaggaaaaaacgcaaacaaaaagaacagtccgggggagaagagaaggacgaggacgagttccagaaaagtgaatcagaggatagcatccgtagaaaaggtttccgctttagcatagagggaaatcgcctcacatacgagaagcgctatagttccccccaccagagcttactgtcaatccgcggctcattattttcgccaaggagaaatagcaggaccagtctgtttagcttccgtggaagggctaaggacgttggctccgagaacgactttgccgacgacgagcattccacatttgaagacaatgagagcagaagagactcacttttcgtgcccagaagacacggggaaagaaggaacagtaacctctcgcagacaagccgcagctcaaggatgctcgcggtgttccctgccaacggcaagatgcatagcactgttgattgtaacggtgttgtgagtctgggaaccactaccgagaccgaaatgaggaaaagacgctcaagctcgttccacgtgtctatggacttcctcgaagatccaagtcagcgccagagagctatgagcatcgcgtccatcctcaccaacacagttgaagagctggaggagtcccgccagaaatgccccccctgttggtataagttttccaacatttttttaatctgggattgctcaccctactggctgaaggtaaaacacgttgtcaatctggtggtcatggatcctttcgtagatctggcaatcacaatttgtattgtgctcaatactctttttatggccatggagcactacccaatgaccgaccacttcaacaatgtgctgaccgttggcaacctggtttttacgggaattttcactgccgagatgtttctcaagattatcgctatggatccctactactacttccaggaagggtggaatatttttgacgggttcatcgtaaccctatccctggtcgaacttgggctagccaatgtggaggggttatcagtgctcaggtccttcaggttgctgcgagtcttcaagctagctaagagctggcctaccctgaatatgctcatcaaaatcatcggaaatagtgtaggcgcgcttggtaacctgaccctagtcctggccatcattgtctttatctttgccgtggtgggcatgcagctgtttggaaaatcctacaaggactgtgtgtgtaagattgcatctgattgccaattgccccgttggcatatgaatgatttctttcactccttcctgatagtgtttcgcgtcttatgcggcgagtggattgagactatgtgggattgcatggaagtggccggccaggccatgtgcttgacggtgttcatgatggtaatggtcatcgggaacttggtggttcttaatttgttcctggccctgctgctctcctccttttcagccgacaatctggccgcaacagatgatgataacgagatgaataacttgcagattgcagtggacagaatgcacaagggagtagcctacgtcaagaggaagatatatgagtttatccagcagtcctttatcagaaaacaaaagattttggatgaaatcaaaccactggatgacctgaataataagaaggattcctgtatgtctaaccatactgcagaaattggcaaggatctggattacctgaaagatgtgaacggtaccacgtcaggcatcggtactggatctagcgtggaaaagtacattatcgatgagagtgattatatgtcatttatcaacaacccttctttaactgttactgtccctatcgcagtcggtgagagtgacttcgaaaatttgaataccgaggatttctccagtgagtctgacctcgaagagagtaaggaaaaactgaatgagagcagcagtagctcagagggcagcaccgtggatatcggcgcccctgtggaagagcagcccgtggtggagccggaggaaactctggaacccgaggcatgtttcacagaaggctgtgtgcagagatttaaatgctgccagattaacgtggaggaaggccgagggaagcagtggtggaacctccgaaggacctgttttcgaatcgtcgaacacaattggttcgagacatttattgtgtttatgatcctgctgtctagtggggctttggctttcgaggacatttatattgaccagcgaaagaccataaagactatgctcgagtacgccgataaagtgtttacttatattttcattttggaaatgctgctcaaatgggtcgcctacggctaccagacctacttcacaaacgcttggtgttggctcgattttcttattgtggatgtcagcctggtaagtctaacggctaatgctttgggctactcagagctaggggccataaaatccctgagaactctgcgggccctgcggcccttgcgcgccttgagtaggtttgaaggtatgagagtggtggtcaacgcattgttaggcgccatacctagcattatgaacgtattactggtctgtctgatcttctggctaatttttagtattatgggggtcaatttattcgcaggtaaattttaccattgcataaacacgacaacaggagaccgcttcgatattgaagacgtgaataaccatacagattgtcttaagcttatcgagagaaatgagacagccaggtggaagaatgtcaaggtgaattttgataacgttggcttcgggtatttatctctgttgcaggtagctacatttaagggatggatggatatcatgtacgctgccgtggatagtaggaacgtggaactgcagcctaagtatgaagagagcctgtatatgtatctctattttgtaatattcatcatatttggatcattcttcaccttgaacctttttatcggagtgattatcgacaactttaatcagcagaaaaaaaaatttggcggtcaggatatctttatgacagaggagcagaagaaatactacaatgccatgaagaaactcggctcgaaaaaaccccagaagcctatccctagaccgggcaacaagtttcagggaatggtcttcgatttcgtgactcggcaagtgttcgacatttccatcatgatcctcatctgcctaaacatggtcaccatgatggtggagacagatgatcaaagcgaatacgtcactactatcttatcgagaataaatctggtcttcatcgttctctttactggcgaatgcgtcctcaaacttatctccctgcggcactattacttcacaatcggctggaacatatttgactttgttgtggtcatcttatcaattgtcggcatgtttttggcagagttaatcgagaaatatttcgtgtcaccaacattgttccgggtgatccgcctggcaagaatcggccgcattcttaggttaattaagggggcaaaaggcatccgcacacttctgtttgctcttatgatgagcttgcctgcactttttaacatcggcttgctactctttctagttatgtttatttatgcgatcttcgggatgagcaatttcgcttacgtaaagagggaagtggggattgatgacatgttcaatttcgagacctttggaaatagcatgatatgtctgttccagattaccactagtgccggatgggatgggcttctggccccaattctgaatagtaagcctcctgactgtgatccgaacaaggtcaaccccgggagctcagttaaaggtgattgcggaaatccatccgtgggcatatttttttttgtcagctacatcataatctccttcttggtcgtcgtgaacatgtatattgcagttattctcgagaactttagcgtagccacggaagaaagcgccgagccactgagcgaggacgactttgagatgttttacgaagtctgggagaaattcgaccccgatgcaacccagtttatggagtttgagaagctaagtcagttcgccgccgccctggagccaccgctaaacctgccccagccgaataaactccaactgattgccatggatctgccgatggtgtccggagaccgcatccattgcctggatattctgtttgccttcacgaagcgcgtgctcggggagtcaggagagatggacgccctgagaatccaaatggaagagcggtttatggccagcaacccttccaaagtttcctaccagcccatcaccacaactctgaagcggaagcaggaggaagtgtctgctgttatcattcagcgggcctacagacggcatttactaaaacggaccgtgaaacaggcttccttcacttacaataaaaataaaataaaagggggcgctaatctcctcatcaaagaggacatgattattgacagaatcaatgagaactccatcaccgagaaaacggacttaaccatgtcaactgctgcttgtccgccaagctacgaccgcgtgacaaaaccaatagtggaaaagcatgagcaggaaggcaaggacgaaaaagccaagggaaagtag

SEQ ID NO: 134682 - DNA, 6030 bp, Artificial Sequence
  Description of Artificial Sequence: Synthetic coding sequence
atggagcagacagtccttgtcccccctggccctgactcctttaatttctttactagagaaagtcttgccgcaatcgagcgacggatcgccgaggagaaggccaagaacccaaaaccggataagaaagatgatgacgaaaatggacccaagccgaactcggatctggaagccggcaaaaatctcccctttatctatggcgacattcctcccgagatggtcagtgagccccttgaggatcttgacccttactatatcaataagaaaaccttcatagtgcttaacaaagggaaagcgattttccggtttagcgcaactagcgccttgtatattttgacacctttcaaccccttaagaaagatcgccatcaagattctggtacatagcctttttagtatgctgatcatgtgcactatcctgaccaactgtgtctttatgacaatgtccaacccccccgattggaccaagaatgttgaatacactttcactggtatctacacattcgagtctttaattaagatcattgcccgggggttttgcctcgaggacttcaccttcctgagagatccatggaattggttagatttcactgtgataacattcgcttatgtgactgagtttgtcgatctgggcaatgtgagcgccctgaggacatttcgggttctccgggcactcaagactataagcgtcattcctggtctcaagacaatcgtcggcgcacttatccagtcagtaaaaaagttatctgacgtgatgatattgaccgtgttttgcctgtctgtgttcgctcttataggactccaactgtttatgggaaacctgagaaacaagtgcattcaatggccaccgacaaacgcctcacttgaagaacactccatcgaaaagaacattacagtgaactataacgggaccctcattaacgaaactgtcttcgaatttgattggaaatcttacattcaggactccagataccattatttcttggaggggtttctcgatgcactgctttgcggcaacagcagtgacgctgggcagtgccccgaaggctacatgtgtgtgaaggccggaagaaaccccaattacgggtatacttccttcgacacgttctcctgggcctttctgtcgctcttccgacttatgactcaggatttctgggagaatctctaccagttaacgctacgtgccgcgggcaagacttatatgatctttttcgtgctcgttatttttttaggatctttctatctgattaacctgattctagctgtcgtagctatggcttatgaagaacagaaccaagccacactcgaagaagctgagcagaaagaggcagagttccagcagatgattgagcagcttaagaaacagcaggaggcagctcagcaagcagccacggctactgcatccgagcatagcagagagccatccgctgccgggaggctgagcgattctagctctgaagcaagcaaactgtctagtaagagtgccaaggaacggagaaatcgccgaaaaaaacgaaagcagaaagaacagtcgggtggggaggagaaagatgaagatgagttccagaagtccgagtcggaggatagcatacgcagaaaggggtttcggttttcgatcgagggaaacagacttacctatgaaaaacgctattccagcccgcatcagtcgctactgtctattcgtgggtctctattcagccccagacgaaacagcaggacctctctgtttagtttccggggcagggccaaggatgttggatctgagaacgactttgcagacgacgaacactccacgttcgaagacaacgaatcaagacgggactcgcttttcgtcccgagacgccatggcgaacggcgcaactcaaacttgtcacagacaagcagatcctccagaatgctagcagtttttccggccaatggtaagatgcactcaacggtagattgtaatggcgtggtgtcactggtcggcggcccttctgttccaacatcccctgtagggcagctgctccccgaggtcattattgataaaccagcgaccgatgacaatgggacaacaaccgaaactgaaatgcggaaacgccgatctagttcatttcacgtatctatggacttcctggaagatccgagccaacgtcagcgtgccatgagtattgcctctatcctgaccaatactgtggaagagctcgaggagtcacgacagaaatgtccaccctgttggtataagttttctaatattttcctgatttgggactgtagcccatactggctgaaggtgaaacacgtggtgaacctggtggtcatggaccccttcgtcgatctcgctattacgatctgcattgtgctgaatacactgtttatggctatggaacattaccctatgactgaccacttcaataacgtgttgacggttgggaatttggtgttcacaggcatcttcaccgcagaaatgtttctgaagatcatcgccatggatccctactactactttcaagaaggatggaatatattcgatggcttcatcgttaccctgagtctggtcgagcttggtctggccaatgttgagggactctcagtgctgcgaagttttcgcctgctgcgcgtgtttaaattagctaagtcttggcctaccctaaacatgctgatcaaaatcataggaaattctgtgggggctctggggaatctgaccctcgttctcgccataattgtgtttatttttgccgtggtcggaatgcagctgttcggaaagtcttacaaggactgcgtctgtaaaatcgcttcggactgtcagctaccaaggtggcatatgaatgatttctttcactcatttctcattgttttccgggtcctgtgtggcgagtggattgaaacaatgtgggactgcatggaagtcgcgggacaggcaatgtgcctgaccgtatttatgatggtcatggttatcggtaacttggtcgtcctcaatctcttcttggccttgctgctgtctagcttctccgccgacaacctagccgcaaccgacgatgataacgagatgaataacctccagatcgctgtcgaccggatgcacaagggtgtcgcttacgtcaagaggaaaatctacgaatttatccagcagtcattcatcaggaagcagaagatcctagacgaaattaaacctcttgacgacttgaataataaaaaagatagctgcatgagtaaccatactgctgaaattggcaaggacctggactaccttaaggatgtgaacggaactaccagcggcatcggcaccggatcgagtgtcgaaaagtatatcatcgacgaatcagattacatgagttttatcaataatccatctttaaccgtcactgtcccgattgctgttggcgagagcgatttcgaaaatctgaacaccgaggatttctccagtgaatcagaccttgaggaaagtaaggagaagctgaatgaatcatcttcctcctccgaaggcagcactgtggatataggtgcaccagtggaggaacagcctgtcgttgaacctgaggaaaccctggagcccgaggcctgttttactgaaggttgtgttcagaggtttaagtgttgtcagatcaacgtggaagaagggcgcgggaaacaatggtggaatctacgacgaacgtgttttcggatcgttgagcataactggttcgaaaccttcatcgtgtttatgatcctcctttcaagtggtgccctagcgtttgaggacatctacatcgaccaaaggaagactatcaaaactatgctcgagtacgcggacaaagtgtttacgtatatcttcattctggagatgttgctcaagtgggttgcctacgggtaccagacatactttactaatgcttggtgttggttggactttctgattgttgacgtgagtctcgtgtctctcactgctaacgcacttggctattcagaactgggggcaatcaagtctctccgcaccctacgtgctcttagaccattgcgcgcactctcccggtttgagggtatgagggtcgttgtgaatgccttactcggcgcaattccctccataatgaacgttctccttgtctgcctcattttttggctgatcttttcaattatgggggtgaatctattcgccggcaagttctaccactgcattaataccactacaggggaccggtttgatatcgaagacgtgaataaccacacagactgcctgaaattaattgaacggaacgagaccgcaaggtggaaaaacgtgaaagtcaattttgacaacgtagggttcgggtatctgagcttactgcaggttgccacttttaaaggctggatggacattatgtatgccgcagtggattcccggaacgtcgagttacagccaaagtatgaggagtcactgtatatgtacctctatttcgtaatattcataatattcggttccttctttacgctgaacctctttatcggtgtgatcattgacaatttcaaccagcagaagaagaagttcggcggacaggacatctttatgacggaggaacagaagaaatactataacgccatgaagaaattaggctcaaagaagccccagaagccaattccacgccccggaaacaagttccagggcatggtcttcgactttgtcacacgacaagtgtttgatattagtattatgatactgatatgtcttaacatggttaccatgatggtggagactgatgaccaatctgagtatgtaacgacaatattgagccggatcaacctggtatttatcgtgctcttcaccggcgaatgtgtcctcaagcttatctctctgcgacactactattttaccatcggatggaatatcttcgacttcgtggtggtgatcctgtccatcgtgggcatgtttttggcagaacttatcgaaaagtacttcgtgagcccaactctctttagagtgatccgtctggctcgcatcgggcgcatcctgaggctcatcaagggcgccaaagggatcaggactttgctgtttgcactgatgatgagcctgccagcactgttcaacatcgggctattgttattccttgtgatgttcatctatgcaatatttgggatgtcaaactttgcatatgtaaaacgggaggtgggaattgacgatatgttcaatttcgaaacttttgggaacagtatgatctgtctgttccaaatcaccacatcagccggctgggatggtctgctagccccaatattgaactcaaaaccacctgattgtgatccaaacaaggtgaacccagggtctagcgtgaagggggattgcggcaacccttctgttggcatcttctttttcgtaagttatataatcatttcattcttggttgtcgttaatatgtacatcgctgttatattagagaactttagtgttgctaccgaggagtccgccgagccattatccgaggatgatttcgagatgttctacgaagtctgggaaaaattcgaccccgacgccactcaatttatggaattcgagaaacttagtcagtttgcagctgccctggagccccccctgaatctgccacaacctaataagctccaacttatcgccatggacctacccatggtgtctggggaccggatccactgtctggatatcttgtttgctttcacaaagcgggttctgggtgagtcaggcgagatggacgccctgcgaattcagatggaggagagatttatggcttctaatccttccaaggtgtcttaccaacctataacaaccaccctaaaacgaaagcaggaggaagtgtctgccgtgattattcaaagggcctacaggagacatctgctcaaaaggacggtgaaacaggcttcatttacctataacaagaacaagatcaagggcggggccaacttgctcattaaggaggacatgatcatcgacaggataaatgagaatagcatcacagagaagacagatctcactatgtctacggccgcttgccccccctcctatgaccgtgtcaccaagcccattgtggaaaagcatgagcaggaaggcaaggatgagaaggcgaaaggcaagtag

SEQ ID NO: 134683 - DNA, 657 bp, Artificial Sequence
  Description of Artificial Sequence: Synthetic coding sequence
atgggaagactgctggccttggtggtcggagctgccttggttagtagcgcatgcggcggctgtgtagaggtggactctgagactgaagctgtgtacggcatgacctttaaaatcctctgtatttcatgcaaacggcggagtgaaaccaacgctgagacatttactgaatggacttttaggcagaagggtaccgaagaatttgtcaaaatcttacgctacgaaaacgaggtgttgcagcttgaagaggatgagcgctttgaagggagggttgtatggaacggctctaggggaacaaaggatctgcaagacctctccatatttatcaccaatgtgacatacaaccatagtggtgactacgagtgtcatgtgtatcgcctgctttttttcgagaactatgaacataatacgtcagtcgttaagaagatccatatcgaggtagtggataaggccaatcgggatatggccagcatagtatctgaaataatgatgtatgtgctcattgtggttctgaccatttggttggtggccgaaatgatatactgttacaagaagatcgccgcggctactgaaacagccgcccaagagaacgcaagtgaatatctggcgattacttccgaatcaaaggaaaactgcactggagtccaggtggctgaatag

SEQ ID NO: 134684 - DNA, 807 bp, Artificial Sequence
  Description of Artificial Sequence: Synthetic coding sequence
atgggcaggctgctggcactagtcgtcggtgctgctttagtctccagcgcctgcggcggctgcgtcgaagtggattcagaaacagaagcagtgtatggcatgacttttaagattctgtgtatcagttgcaaacgaagaagcgagaccaacgctgagaccttcactgagtggacttttcgtcagaaaggcactgaagaatttgtgaaaatcctgaggtacgaaaatgaggtcctccagctggaagaagacgaaaggtttgagggaagagtggtatggaacgggagccgtggaaccaaggatctccaggacttatcaattttcattacaaatgtgacctataaccactccggggactatgagtgccacgtatataggctgctttttttcgagaattacgaacataatacctccgttgtgaaaaaaatccacattgaggtcgttgacaagggtgaatcgggcgcagcttgtcccttcactgtgacccaccgcagggcccggtggcgagatcgctggcaggccgtagaccgcacagggtggctgtgcgcctggccagccaacagaccacaacagagagccgagggcgagggctcctccccctcctgcccgctgcaactttggccgttatttctgtcttcacctcgcaggggacagagcatgccagtaccccatcggcgctctgggtatcgcacacagttgtgtcatctgtgctgcatgacctcaggcagatgcttgctctctctcagccagcgcgttgtgttaggtctgcccggtattatcattcgatgtgtgtctcgcggcgttgtgtag

SEQ ID NO: 134685 - DNA, 6018 bp, Artificial Sequence
  Description of Artificial Sequence: Synthetic coding sequence
atggcccaatcagtccttgtgcccccgggaccagactcttttcggttcttcacaagagaaagccttgccgcaattgaacagaggatcgccgaagagaaggcaaaacggcccaagcaagaacgcaaggacgaagacgacgagaatggccctaaaccgaattcagatctggaagcagggaagtccctcccttttatctatggggatatacccccagaaatggtttctgtgcccttagaggacctggatccatactacatcaataaaaagacttttatcgtgttgaacaaaggaaaggcgataagcagattctctgccacgcccgccctctacatacttacacctttcaatccgattcgcaagctggccatcaagatattagtgcactccttgtttaatatgctgattatgtgtacgatcctcacaaactgtgtgttcatgacaatgagtaatccgcctgactggactaagaatgtagagtacaccttcaccggcatctacacctttgagagtttgataaaaatcctggcaagaggcttctgcctcgaggacttcacctttcttcgggatccctggaactggctcgatttcacagttatcacctttgcctacgttacagagttcgtcgatctgggcaacgtcagtgcccttcgcaccttcagagtactcagagcactcaaaacgataagcgtgatcccaggcctgaaaaccatagtcggagctctgatccagtctgtgaagaagcttagcgacgtcatgattttgaccgtcttctgcctatctgtcttcgcactgattgggctccagctgtttatgggcaatttacggaataagtgccttcagtggccacccgacaactctagctttgaaataaatattacgagcttcttcaataatagtttagacggcaacggaaccaccttcaacagaacagtttctatttttaattgggatgagtatatcgaagacaaatcccatttttattttctcgaaggtcaaaacgacgctctgctgtgcggcaactcctccgacgctgggcagtgccccgaggggtacatttgtgtcaaagcggggcgtaaccctaattacggatacacatctttcgacaccttctcctgggccttcctatcgttatttcgcctgatgacacaggatttctgggagaatctatatcagcttacattgagagccgccggtaagacgtatatgatcttctttgtgctggtcatctttctgggctccttttacctgattaaccttattcttgcagtggtagcaatggcctatgaagagcagaatcaagcaacattagaagaggctgagcagaaagaagctgagttccagcagatgcttgagcagcttaagaagcagcaggaagaggcacaggccgcagccgctgcagctagcgcagagagtagggatttcagcggggccggtggtattggagttttcagcgaatcaagctctgtcgcttcaaaactttcctctaaaagcgagaaggaattaaaaaacaggaggaagaagaagaagcagaaggagcaaagcggcgaggaagaaaagaatgacagagtgcggaagtctgaaagcgaggatagtattcgcagaaaaggctttcgattctcactggaagggtctcgtcttacttacgaaaagaggtttagcagcccacaccagtccctgttgtccatcagagggtccttgttcagtccaaggcgcaactcccgggccagcctcttctccttcagggggcgcgccaaggatattggtagcgagaatgattttgcagacgatgaacacagtactttcgaagacaatgactcacggcgcgattcactgtttgtgccacataggcacggtgagcgcaggcatagtaatgtgagccaggcatccagagccagccgcgttctccccatcctccctatgaatggcaagatgcacagcgccgtcgactgtaacggggtggtgagcctggtgggagggccaagtacccttacaagtgccggacagttgttaccagagggtaccactaccgagaccgagatacgaaagcggcgcagcagctcctatcacgttagcatggaccttctggaggacccaacttcccgccagcgggccatgagcattgcctcaatcctgacaaatactatggaggagcttgaggagtcccggcaaaagtgccctccatgttggtataagtttgccaacatgtgcttgatttgggattgctgtaagccatggctgaaagtcaagcatcttgtgaacctggttgtcatggacccattcgtagatctcgctataaccatatgcatcgtactcaataccctctttatggcaatggagcattatccgatgaccgaacaattttcatcggtcctaagcgtgggcaacctggtcttcactggcatctttactgctgagatgtttctgaaaatcatcgccatggacccatactactatttccaggaaggatggaacatttttgacgggttcatcgtgtccctgagtctgatggaactggggctagctaacgtggagggattatctgtgctcaggagcttccgtctgttaagggtcttcaagttggcgaagtcttggcctaccttaaacatgctgatcaagatcatcggcaatagcgtcggagccctcggaaatctgaccctcgtcctcgccatcatcgtctttatttttgccgttgtggggatgcagctgtttggaaaatcttacaaggaatgcgtgtgtaaaatctccaacgattgcgaattgccaaggtggcacatgcatgacttcttccactctttcctcattgtgtttcgcgtgctttgcggggagtggattgaaaccatgtgggattgcatggaggtggctgggcagactatgtgtctcactgtgttcatgatggtgatggttatcggcaaccttgtggtgctcaacctgttccttgccctgcttctgagcagtttttcctccgacaaccttgccgccacagatgatgacaacgagatgaataatctccagattgctgtgggacggatgcagaagggcatcgactttgtcaagcgcaaaattcgcgaattcattcagaaggcctttgtgcggaaacagaaggccctggatgagatcaaacccctcgaggatctcaacaacaagaaagactcatgtatctctaatcacaccacaatcgaaattggaaaggacctgaactacttgaaagacgggaacgggaccacgtcagggatcgggagttctgtggaaaaatacgtcgtggatgaatctgactatatgagcttcattaataatccttcactgactgtgactgtacccattgcagtaggagaaagcgacttcgagaacctgaatactgaggaattcagtagcgagagtgacatggaggaatccaaagagaaactaaatgccaccagtagctcagaaggctcgacagttgacataggtgcccccgcggagggagaacagcccgaagtcgagcccgaagagtctctggaacccgaggcttgcttcacggaagattgtgtaagaaagtttaagtgctgtcagatcagtatagaggaaggaaagggaaagctatggtggaatttaaggaaaacttgttacaaaatagttgagcataattggttcgagacattcatcgtgttcatgattctgctgtcgtccggcgccctggcctttgaagatatctacattgagcagagaaagaccatcaaaacaatgctcgagtacgctgataaggtcttcacatacattttcatacttgaaatgctactgaagtgggtagcctacggatttcaagtttactttacgaacgcttggtgttggctggactttctcattgtggatgtctctttagttagtctgacggctaacgctctgggatactctgaattgggagccatcaaaagcctgcgcacacttcgagctctcagacccctgcgcgcattatcgcggttcgagggcatgcgtgtagtggttaatgcactgctgggtgccatccctagtattatgaacgtccttctggtctgccttattttctggctgattttcagcatcatgggtgtgaatctgttcgcaggcaagttttatcactgcatcaactacactacaggagagatgtttgacgtatccgttgtcaataattacagcgagtgtaaggcgctgattgaatccaaccagacggccagatggaagaatgtcaaggtgaattttgacaatgtgggcctcggctacctaagccttctccaagttgcaacctttaaagggtggatggacatcatgtatgcagccgtggattcccgcaacgtggaactccaaccaaagtacgaggacaacctgtacatgtacctgtattttgtcatatttattatattcggctcattctttaccttgaacctgttcatcggcgtgatcatcgataatttcaatcagcagaaaaagaagttcggtggtcaagacatcttcatgaccgaggagcagaaaaagtattataatgccatgaagaagctgggatcaaagaagcctcaaaaacccatccccagaccagctaataagttccaggggatggtgtttgactttgtgactaagcaggtgttcgacataagcatcatgatcctgatctgcctcaatatggtgaccatgatggtggaaactgatgaccagtcccaagagatgactaatatcttgtactggatcaacttggtctttatcgtgctctttaccggcgaatgcgtgctcaaactgatcagcctccgctactattactttacaatcggctggaatatctttgacttcgtggtggtaatcctgtctatcgtgggcatgttcctagcggaactgatcgaaaagtatttcgtgtctccaaccctgtttagagtcatacgcctggcacgcattgggcggatactgcgcctcattaaaggcgcgaaaggcatccggacactgctatttgcacttatgatgagtctgcccgccctgttcaatattgggcttttgctctttttggttatgttcatctatgctatcttcgggatgtccaacttcgcctacgtcaaaagagaagtgggcatcgatgatatgttcaacttcgagacattcggaaatagtatgatctgcctcttccagattacaacttccgccggctgggacggtctcctggcccctattctgaactccgggcctccagactgcgaccctgacaaggatcaccccggctccagcgtgaaaggggattgtgggaaccccagcgtcggcatcttttttttcgtgagctacattatcatctcatttctcgtggtcgttaacatgtacatcgcagttatactcgaaaacttctctgttgccaccgaggagagcgcggagcctctttccgaggatgattttgaaatgttctacgaggtatgggaaaaatttgatcctgacgccacccaatttatcgaatttgcaaagttgtctgattttgctgacgcacttgacccaccattactgattgcaaagccaaataaagtgcagcttatcgccatggacctaccaatggtgagcggtgatcggattcattgcttggacatcctgttcgcctttaccaagagggttctcggcgagtccggcgagatggacgctctaaggatccagatggaagaaaggttcatggctagcaacccatcaaaagtgtcatatgagcccattactaccaccctcaaacggaaacaagaggaggtctcagccataataatacagagggcatacaggagatatttactgaaacagaaagtaaagaaggtgtccagtatctataagaaggataaagggaaggaatgcgatggcactcctataaaagaggataccttgattgacaagcttaatgaaaactctacaccagagaaaacagatatgacacccagtaccacatcccctcccagctacgacagcgttactaaaccagaaaaagagaagttcgagaaggacaagtccgaaaaggaagacaaaggcaaggatatcagggaaagtaagaagtag

SEQ ID NO: 134686 - DNA, 6018 bp, Artificial Sequence
  Description of Artificial Sequence: Synthetic coding sequence
atggcacagtccgtgctggtgccacccggaccggatagctttcgcttctttaccagagaaagtttggcggctatagaacagaggatcgcagaagagaaagcgaaacggccgaagcaggagaggaaggatgaggatgatgagaacggacccaaacctaattcggacctcgaggcaggcaagagcctgcctttcatctacggtgacatacctcctgagatggtatcagtcccgctggaagatctcgacccatattacattaacaagaaaacctttattgtgctcaataagggaaaggccatctcccggttcagtgccactcctgctttatacatcctcacccccttcaaccctatcagaaagttagcgattaagattctggtgcactcactgtttaatatgctcataatgtgcacaatcctgacgaactgcgtctttatgactatgtctaatcctcctgactggaccaaaaacgttgagtacaccttcacagggatctacactttcgagagtttgattaagattttggcacggggtttctgtctcgaggatttcacctttctgcgcgacccttggaattggctcgactttaccgtaatcacatttgcttatgttacagaattcgtaaatcttggcaatgttagcgcattgcggacgttccgagttctccgcgctttaaagaccattagcgtgatccccggcctcaagaccattgtgggtgcccttatccagtccgttaagaagctcagtgacgtcatgatactgaccgttttttgcctgagtgtcttcgcgctgattgggttgcagctgttcatgggaaacttgcgaaacaagtgcctccagtggcccccagacaactcttcctttgagattaacatcacttcttttttcaacaacagtcttgacgggaacggaacaacctttaaccggaccgttagcatattcaattgggacgagtacatcgaggacaagtcccacttctatttcctcgaaggccagaatgacgccttactttgcggcaatagctccgacgctggacagtgcccagaaggttacatctgtgtcaaggctggacgaaatcccaactacgggtacacaagcttcgataccttcagctgggcctttttaagtctgtttagactcatgacccaggacttctgggagaatctatatcagttaacattgcgtgccgcagggaagacgtatatgatctttttcgtgctggtgatttttctgggcagcttctacctgattaacctcatattagcggttgtcgcaatggcctacgaggagcagaaccaggccacactggaggaggctgaacagaaggaagccgagtttcaacagatgctcgaacagctgaagaaacagcaggaagaagcacaggcggccgcagcagctgcttccgccgaatctagagattttagcggagcaggaggcattggggtgttctccgaatcctcttcagtggcttcgaaattaagctccaaatcggaaaaggagcttaagaaccgtcgaaagaagaaaaaacaaaaggagcaatctggcgaggaggagaagaacgacagggtcagaaaaagtgagagcgaggattccatacggcggaagggattcagattttcactagagggtagccgattgacatacgagaaaagattctcttctccgcaccagagtctgttaagtatccggggcagtctgttcagtccaagacgcaattctagagcgtctctcttttccttccggggccgtgccaaggatattgggtccgaaaacgattttgcagacgacgagcactccactttcgaggacaatgattctcgccgagactctctctttgtaccccatcgtcacggtgaacgcagacattccaacgtctcacaggcgtccagggcctctagggttctgcctatcctgccaatgaatgggaaaatgcattcagcggtcgactgtaatggagtcgtgtccctcgtgggcggaccgtcgaccctcacatccgcagggcagctcctgcctgagggcaccaccacagagactgaaatccgcaagcggcggtcatcaagctaccatgtctcaatggacttacttgaagatccaacaagtcggcagcgcgctatgtccatagcctctattctgacaaatacaatggaggagctcgaggaatcacggcagaagtgccctccttgctggtataagtttgctaatatgtgcctgatttgggattgttgtaagccatggctgaaggtgaaacaccttgtaaacctggtggtcatggaccccttcgtagacctggccatcactatctgcatcgtgctgaatactttattcatggccatggagcattaccccatgaccgaacagttcagttctgttttgagcgtaggtaatctagtcttcacgggaatcttcacagccgagatgttcctcaaaataattgcaatggatccatattattactttcaagaagggtggaacatttttgatggtttcatagtgtctctatctttaatggagcttggactggcgaatgtggaagggctctccgtcctacgatcgttccgccttttacgggtatttaaactggctaaaagctggcctacgctaaacatgctcattaagatcattggtaacagcgttggagccctaggaaacctgaccctggttcttgccatcatagtgtttatcttcgcagtagtcggcatgcagctgttcggcaagtcttataaggagtgtgtgtgtaaaatcagcaacgactgtgagctgcctaggtggcacatgcacgactttttccatagtttcctgatcgtcttcagggtgctgtgtggggagtggattgagactatgtgggattgcatggaagtggccggccaaacaatgtgtctgactgtctttatgatggttatggtaatcgggaacctggttgtactgaacctgttcctcgccctgctactgagctcttttagctcggacaacctggctgccactgatgacgataacgagatgaataatctccaaattgctgttggacgtatgcagaagggtatcgactttgtcaaacgtaagatccgagagttcattcagaaagcctttgtgaggaagcaaaaggccctggatgaaatcaagccactagaggatcttaataacaagaaggatagttgtatctctaaccacaccacaatcgagatcgggaaggacctgaactacctaaaggacggaaacggaacaaccagcgggatagggagtagcgtggagaaatatgtcgtggacgagtccgactatatgtcttttatcaacaatccatctctaaccgttactgtgcccattgctgttggtgagtctgactttgaaaatttgaataccgaggaattctcaagtgagtctgatatggaggagagcaaagaaaagctcaatgccacctcctcctctgagggttccaccgtggatattggggcccccgcagaaggcgagcagcctgaagttgagcccgaggagtctctggaaccagaggcatgcttcaccgaggactgcgtgaggaaattcaaatgctgtcaaatctccatcgaggaggggaagggtaagctgtggtggaacctgagaaagacatgttataagattgtggaacataactggttcgaaacttttattgtctttatgatcttgctttcatcaggcgcactggcctttgaagatatctacatagagcaaaggaagacaatcaaaactatgcttgagtatgctgataaggtgttcacctatattttcatactagagatgctcttgaagtgggtcgcttacggcttccaggtctacttcactaatgcgtggtgttggctggacttcctcatcgtggacgttagcctggtgtctctcacggctaacgcactgggatacagtgagttgggcgcaatcaaaagtctgaggacacttagagcacttaggcccctgcgcgccctgtctcggtttgagggcatgcgcgtggtggtaaatgccctgctcggtgccatcccaagtattatgaatgtgctgctcgtgtgcctgatcttctggctgatcttttctattatgggagttaaccttttcgccggcaagttctatcactgtatcaactatacaaccggcgagatgtttgacgtctctgtggtcaacaactactctgaatgtaaggccctcatcgagagcaatcagaccgcccgttggaagaacgtcaaggtgaacttcgataatgtgggcctggggtatctgtcattactgcaggtggcgacttttaagggctggatggacatcatgtacgctgctgtggacagtcggaatgtggaactccaacctaaatatgaagataacttgtatatgtatctgtatttcgtcattttcatcatattcgggagcttttttacactgaatttattcatcggtgtgattatcgataacttcaaccagcagaaaaagaaattcggcggccaagacatcttcatgacagaggagcagaagaaatattataacgccatgaagaagctgggtagcaagaaaccacagaagcccatcccacgcccagctaataaattccagggtatggtgtttgacttcgtgacaaagcaggtgtttgatattagcatcatgattctaatctgtttaaacatggtgacaatgatggtcgagactgacgaccagtctcaggaaatgacaaacatcctgtattggattaacttagtgttcattgtcctgtttacaggggaatgtgtgctgaaactcatctcacttaggtactactattttactatcggatggaacattttcgatttcgtcgtggtcattttaagcatcgtggggatgtttttagcggagttgattgagaagtacttcgtttcaccaactctcttcagagtgattaggctcgcccgcattggtaggatcctgagactgattaaaggcgccaaggggatcagaacacttctgttcgcactcatgatgtctctcccagcccttttcaatatcgggttactccttttcttggttatgttcatttacgccatattcggtatgagcaactttgcttacgtcaaaagagaagtaggtattgacgacatgttcaattttgagacttttggtaactccatgatctgtctctttcagatcaccacctccgcaggctgggatggccttttggctcctatacttaatagtggcccacccgactgtgatcccgataaggatcaccctggatcctccgtaaagggtgattgtggaaatcctagcgtgggtatcttttttttcgttagttacatcattatcagctttctggttgtggtgaatatgtatatcgccgttatcctcgagaattttagcgttgccacggaagagagtgctgagcccctgtccgaggacgatttcgagatgttttacgaggtctgggagaagttcgatcccgacgcaacgcaattcatcgaattcgcaaagctgtccgacttcgctgatgccttggatccccccctcctcatcgcgaagccaaataaggtgcagcttattgcgatggacctgcctatggtgtccggagaccggatccattgcctggacatcctgttcgcttttaccaagcgcgttttgggcgagtcaggggagatggacgccctgcggattcagatggaggagcgctttatggctagcaacccatcaaaggtgagctacgagcctataacaactactcttaaaagaaagcaggaggaagtgtcagctatcattatccaaagggcatatcggcgctacctgctcaaacagaaggtgaagaaagtgtcatccatctataagaaggataaagggaaggaatgtgatggaactcctatcaaggaagacactctcatagataaattgaatgagaacagcacaccagagaagacggacatgacaccttccaccacatcccctcccagttacgactctgtgacaaagcctgagaaagagaagttcgaaaaagataagtctgagaaggaagataaaggcaaggacatcagagaaagtaaaaaatag

SEQ ID NO: 134687 - DNA, 6018 bp, Artificial Sequence
  Description of Artificial Sequence: Synthetic coding sequence
atggctcagtctgtgttggtgccccccgggcctgatagctttagattcttcacgagggaaagccttgcggccattgagcagcggatcgccgaggaaaaggctaagcgaccgaaacaggagaggaaggacgaggacgacgaaaacggtcctaagcccaacagcgacctggaagcaggcaagtcactgcccttcatctatggggatatccctccagaaatggtgagcgtacctctggaggaccttgacccatactacatcaacaagaaaacttttatcgttctcaacaaaggcaaggcaatctcacggtttagcgccactccagccctgtacatcctcaccccctttaatccgatacggaaactcgcaatcaagatcctggttcatagcctttttaacatgttgatcatgtgcacaatcctcaccaactgcgtgttcatgacaatgtccaacccccctgattggaccaaaaatgtggaatacacgtttactgggatctacacttttgagagtttgatcaagatcctggctcgggggttctgtcttgaagacttcacctttttacgcgacccctggaattggctggattttaccgttattacgtttgcctacgtgacggagtttgtcaacctgggcaacgtgtctgcactcagaacatttcgagtcctgcgagccctaaaaacaatctctgtgatcccgggtcttaagaccatcgtcggtgcactcatccagtccgtcaagaaactgagcgatgtgatgatactaacagtcttctgcctttccgtgttcgcccttattggtcttcaactgttcatggggaatctgcgtaacaagtgtctgcaatggccgcccgacaatagttcctttgaaatcaacatcaccagcttcttcaataattcattagatggtaacggaaccacattcaaccgcaccgtttccatcttcaattgggacgagtacatcgaggacaagtctcacttttatttccttgagggtcagaacgacgctcttctgtgcggaaactcttctgatgccggccagtgccctgagggatacatttgcgtaaaagctggaagaaatccaaattacggttatacctcattcgatacctttagctgggccttcctctctctttttcggttaatgacccaggacttctgggagaacttgtaccaactgacgctgcgcgctgctggcaagacttatatgatcttttttgtcctcgtcatctttcttgggtccttttacctcatcaatctcattttagctgtggtcgcgatggcatacgaggagcagaaccaggccactctcgaagaagctgaacagaaagaagcggagtttcagcagatgttggagcaactcaagaagcagcaggaagaggcgcaggctgcagccgcagccgccagcgcagaaagtcgcgactttagcggagccggcggtattggggtcttctccgaaagcagtagtgtcgcttcaaaattgagctccaagagcgagaaagaactgaaaaacagacgtaagaaaaagaagcagaaagagcagagtggcgaagaagagaaaaacgacagggtgcggaaaagcgaaagcgaggacagcatacgtcggaaaggcttccgattctcactcgaggggtcccgactgacgtacgagaagcgcttttcttctccgcaccagtccctcctgtctatcagagggagtcttttcagtccccgcaggaattcacgcgcatccttatttagctttagaggtcgcgctaaggacatagggagcgaaaacgactttgctgacgacgaacattcgacctttgaggacaacgatagtaggcgagatagtctgttcgtgcctcaccggcacggcgagaggcgacatagcaacgtgtcacaagcgagcagggcgtcacgggtgctgcccattctccccatgaacggaaagatgcactcagccgtcgactgcaacggcgtcgtcagtcttgtcggggggccatctaccctgacatctgcgggccagctcctgccagaaggcaccacaacagagactgaaatacgcaaacgcaggagcagctcttatcacgtaagcatggatttgctcgaggacccgactagtcgacagagagccatgagcattgcctccattttaaccaatacaatggaggaactggaggagtcaaggcagaaatgcccaccctgctggtacaagtttgccaatatgtgtctgatttgggattgctgcaaaccgtggctcaaggtgaagcatttggtgaatcttgtggtaatggaccccttcgtagacctcgcgattactatctgtatagtgctcaacacactgtttatggcaatggaacactatcccatgaccgagcagttcagttccgtgctgtccgttggaaacctggtgttcacaggcatttttacagcagaaatgtttctcaagatcatagcgatggacccatactactatttccaagaaggatggaacatttttgacggattcatcgtgagtttatcactgatggagttagggctcgccaacgtggaaggactgtctgttcttaggagttttcggctcctcagggtgttcaagttagccaagtcgtggccaactctgaacatgctcattaagatcatcggcaattccgtgggggcactgggaaatctcactctggtgctggcaattatcgtctttatctttgcggtggtcggcatgcagctcttcggtaagtcttataaggaatgcgtttgtaagatttcaaatgactgcgagctgccgcgatggcatatgcacgacttctttcatagcttcctgattgtatttagagtgctatgcggggagtggatagaaaccatgtgggactgcatggaagttgccgggcagactatgtgcctgacggtattcatgatggtgatggtcatcgggaacctggtggtcttgaatctgttccttgcccttctgctgtcctccttttcctctgacaacctggctgcgactgacgatgacaatgagatgaataacctgcaaatcgcagttggccgtatgcagaagggcatagatttcgtgaaaaggaagatccgtgaattcattcagaaggcctttgtcagaaaacaaaaagccttggacgagatcaaacctctggaagatctgaacaataaaaaggactcatgtatttccaatcacacgaccatcgagataggcaaagatctcaattacctgaaagacggcaacgggaccacaagtggcataggatcctccgtggagaaatatgtagtcgatgagtctgattatatgtcatttattaataatccctccctgaccgtcaccgtgccaattgccgtcggtgagtcagacttcgagaaccttaatactgaagaattctcctccgaatccgacatggaggaatccaaggagaagctcaacgccacctcgtcttcagagggcagcacggtggacattggcgcgcccgccgagggcgaacagccggaggtggagccagaagagtctctggagcctgaggcttgttttacggaggactgtgtgaggaaattcaagtgttgtcagatttctatcgaagaaggcaaagggaagttgtggtggaacctgagaaagacctgctacaagattgtggaacacaactggtttgaaactttcatcgtatttatgattctgctttccagcggcgctctggcattcgaagacatttacatagagcaaaggaaaacaatcaaaactatgttggaatacgccgacaaggtcttcacatacatattcattctcgaaatgctgcttaaatgggtggcttacgggtttcaagtgtattttactaacgcttggtgctggttagactttttgatcgtggatgtgagtctcgtttctctcactgcaaatgccctaggatactctgagctgggcgctattaaaagcttacggactctgcgtgcactgcgcccattacgggcactatcccggtttgaaggtatgcgtgtggttgtgaacgcccttcttggggccataccaagcattatgaatgtcctgctcgtgtgcctgatcttttggttaattttctctattatgggtgttaatctgttcgctggcaagttctaccattgcattaattacacaacgggggaaatgtttgatgtgtccgtggttaataattattctgaatgtaaggctttgattgagtccaatcaaacagcccgttggaagaacgtaaaggtcaattttgacaatgtgggactcggatatctcagcctgctccaggtggcgaccttcaagggttggatggacattatgtacgccgcggttgactcccggaatgtcgaactgcaacccaaatatgaagacaacctgtatatgtacctgtactttgtcatcttcattatcttcgggtcatttttcaccctgaacttattcatcggggtgattatcgataatttcaaccagcagaaaaaaaaatttggtggccaggatatattcatgacagaggaacagaagaaatactacaatgccatgaagaagctggggtcaaagaaacctcagaaaccaatccccagaccagccaataaatttcagggcatggtgttcgacttcgtgacgaaacaagttttcgacatcagcataatgatcctgatttgcctcaatatggtgacaatgatggttgagacagacgatcagtcgcaggagatgaccaacattctgtattggataaacctcgtgttcatcgtgttatttaccggagaatgtgtgttaaagctcatcagcctccgctattactactttactattgggtggaatatttttgatttcgtagtggtgattttgtctatcgtgggcatgtttcttgctgagctgatcgagaaatatttcgtcagccccacgttgtttagagtgattcggctcgccaggatcgggaggattttgcgcttgattaagggggcaaaagggatacgtacattgctctttgccctcatgatgtccctgccagctctctttaatatcggtttgctcctgtttttggtaatgtttatctatgctatattcgggatgtcgaacttcgcctatgtaaagcgcgaggtagggatcgatgacatgtttaactttgagacctttggcaattcaatgatttgtcttttccagattactactagtgcaggctgggacggactgctagcccccatcctgaatagcggcccacccgattgtgatcctgataaagatcaccccgggtctagcgtcaaaggtgattgcgggaatccttcagtaggcatctttttctttgtgagttatatcattatatccttcctggtggtggtgaacatgtatatagctgtgatactcgaaaacttcagcgttgccacagaagaaagcgcagagcccctgtcagaggacgactttgaaatgttttacgaggtgtgggaaaaattcgatcctgatgccacccaattcattgaatttgctaagctgtccgatttcgccgacgcccttgatccacccctactgatcgcaaagcctaacaaagtgcaattaatcgctatggacctgccaatggtgtccggggaccgtattcattgtctcgacattttgttcgccttcaccaaacgggtgctcggtgaaagcggagagatggacgcattgaggatccaaatggaggaaagattcatggcatctaatccctccaaggtgtcatacgaaccaatcaccacgacattgaagcgtaagcaggaggaggtcagcgctattattattcagagagcataccgtagatacttgctaaagcagaaagtaaagaaggtaagcagtatctataagaaggacaagggcaaagagtgtgatggaacaccaatcaaggaagacaccctcatagataagctgaatgagaactcaacaccagaaaaaacggatatgaccccaagcacaacatctccaccctcttacgattctgtgacaaaaccagaaaaggaaaagtttgaaaaagataagtctgagaaggaggataaagggaaggatattcgagaatccaagaaatag

SEQ ID NO: 134688 - DNA, 6018 bp, Artificial Sequence
  Description of Artificial Sequence: Synthetic coding sequence
atggcacagtctgtgttggtgccccctggacctgattcatttaggttctttacaagggagagcctggccgcaattgagcagcgaatcgctgaagagaaggcaaaacggccaaaacaagaacgcaaggacgaggatgatgagaatggccctaaacccaacagtgatcttgaggccgggaagagcctgcctttcatctacggagatatccctcctgaaatggttagcgtaccactcgaggacctcgatccatattatattaacaagaaaaccttcattgtgttgaacaaagggaaggctatctctagattcagtgcgacacccgctctttacattctgaccccctttaaccctattagaaaactggctattaaaattctcgtgcatagtttattcaacatgcttattatgtgtactatactcacgaactgcgtattcatgacgatgagtaatccccccgattggaccaaaaacgtcgagtatacgttcactgggatctacacctttgagagtctaataaagatcctcgctcgcggcttctgcttggaggacttcacattcctaagagacccctggaactggctcgacttcacggtcataacgtttgcatacgtaactgagttcgttgacctcggaaatgtgagtgctctacgaacctttcgcgtgctgagagctctgaagactataagcgtgatcccgggcttgaaaaccatcgtcggagcacttattcagagtgtcaaaaagctcagtgacgtcatgattcttactgtgttttgcctgtcagtgtttgcactgatcggactgcaattgttcatggggaacttgcgcaataaatgtttgcagtggccacccgataactcctctttcgagatcaacatcacctcattctttaacaatagccttgatggaaatggtaccacctttaatcggaccgttagtattttcaattgggacgagtacatagaggacaaatcccatttctatttcctggaagggcagaacgatgccctgctgtgcggaaatagctctgatgcaggacagtgccccgagggatacatttgcgtgaaagctggtagaaatcccaactacggctacaccagtttcgatactttttcatgggcatttctgagcctgtttagactcatgacgcaagacttctgggagaatctgtatcagttaacactgagagccgccggaaagacttatatgatcttcttcgtgctggtgatcttcctcggatcgttctaccttataaatttgatcctggccgtagtggccatggcctacgaggagcagaatcaggcaactctcgaggaggctgaacagaaagaagctgagttccagcaaatgcttgaacaactaaagaagcagcaagaagaggctcaagcagccgcagctgccgcatctgccgaatcaagagacttcagtggcgctggaggaattggggtgttctctgaatcatcctcggttgcttctaagctgtccagtaagtccgaaaaagagctcaagaaccgtaggaagaagaaaaaacagaaagagcagtctggcgaagaagaaaaaaacgatagggtcagaaaaagcgagagcgaggatagcattcgcagaaaaggttttaggttctctctggaaggcagtcgtctcacatatgagaagaggttctcctctccacaccagagcctgctttctattagagggtccttgtttagcccccgccgaaacagccgggctagtttgttctcattccgaggcagggccaaagatatcgggtctgagaacgatttcgccgacgacgaacattccacttttgaagacaacgattctcgccgcgattcgctgttcgtgcctcatcgccatggtgagcgacgccactccaacgttagtcaggccagtagggcctcccgtgtactgcccatcttacctatgaacgggaaaatgcattctgcagtcgactgcaacggcgtggtgtctctcgtgggcggcccgtccacccttacgtccgccggtcagctgcttcctgaaggcacaacgacggagactgagatccgaaagagacggtcttcgtcctaccatgttagtatggacctgctcgaggaccctacatcccgacagcgcgcaatgagtattgcttccattctaaccaatactatggaggagttggaagaaagtaggcagaagtgtcctccctgttggtacaagtttgctaacatgtgccttatctgggattgctgcaagccctggctaaaggtgaagcacctcgtgaacctcgtggtgatggacccttttgtagacttggccatcacaatttgtattgtcctcaataccttgtttatggctatggagcattacccaatgacagaacagttttcatctgtcctgtccgtggggaacctggtattcaccggaatcttcaccgccgagatgtttctgaagatcattgcaatggatccctattactacttccaggagggctggaatatcttcgacggattcatcgtgagcctctcgctgatggagctgggactggctaacgtggaaggtctgagcgtgctgcggtcctttcgcctactccgggtgtttaagctcgcaaaatcatggccaacactcaacatgctgattaaaatcataggaaatagtgtcggcgctctcgggaatctgaccttagtcttagctatcatcgtcttcatctttgctgtggtcgggatgcaactattcggcaagtcatacaaggagtgcgtgtgtaaaattagcaacgactgtgagctcccccggtggcacatgcacgacttttttcacagttttctcatagtgtttcgggtgctgtgtggagagtggatcgaaactatgtgggactgtatggaagtcgccgggcagactatgtgcctgacagtgtttatgatggttatggtgattggcaatctcgtcgtcttaaatctgtttctcgctttattgctttcttcgttctcctccgacaatctggctgcgacagatgacgataacgaaatgaataatctacagatcgcagtcggcaggatgcagaaaggaattgacttcgtgaagcggaagatacgcgagttcatccaaaaagctttcgtgcgaaagcaaaaagcattagatgagattaagcctctggaggacttaaataacaagaaggactcatgcatttcaaaccacaccaccatcgagatcgggaaggacctgaactatttaaaagatggaaatgggacgacctcaggaatcgggtcttctgtggaaaaatatgtcgtggacgaatcagattacatgagcttcatcaataatccctcactcaccgtgacggttcctattgcggtcggagagtccgattttgagaatctgaatactgaggaatttagttccgaaagcgacatggaggagtccaaggagaagctgaacgctactagttccagcgagggatccactgtggacattggagcaccagctgagggggagcagcctgaggtcgaacccgaagagagccttgaacccgaagcctgctttactgaggattgcgttcgcaagttcaaatgttgccagatctctattgaggaggggaaaggcaaactctggtggaatctccgcaaaacctgttacaaaatcgtggagcacaactggtttgaaacctttattgtctttatgatccttttaagctccggcgccctcgccttcgaagacatttacatcgagcagaggaagactattaagaccatgctcgagtacgccgacaaagtgtttacttatatatttattctggaaatgttgctgaagtgggttgcatatggatttcaggtgtatttcacaaatgcctggtgctggcttgattttcttatcgtggacgtatccctcgtctcccttacagctaatgctttaggatattcagagctgggcgccattaaaagtctgagaacactccgggccctccgccctttgcgggccctgagccggtttgaaggcatgcgagtcgtagttaacgctctgctgggcgccatacctagcataatgaacgttctgctcgtctgcctgattttttggttgattttctccattatgggggtgaatctttttgccggaaaattctaccattgtatcaactacaccacaggagaaatgtttgacgtaagcgtcgtgaacaactactcagagtgcaaggccctgattgagtccaatcaaacagcgagatggaagaacgtaaaggtaaatttcgataatgtgggtctgggctatttaagcctattgcaggtggcaacttttaaaggctggatggacattatgtatgcagcagtggactcacgaaacgttgagctgcagcctaagtacgaagacaatttgtacatgtatctgtatttcgtgatttttatcatctttggatctttctttactttaaatctcttcattggagtgatcatcgacaatttcaatcagcagaagaagaagtttggcggtcaggacattttcatgacagaggagcagaaaaaatactataacgccatgaagaaactcggctccaagaagccacagaagcctataccgaggcccgccaataagtttcaggggatggttttcgattttgtgacaaagcaggtgttcgacatatctataatgatactgatctgcctgaatatggtgaccatgatggtggaaacggacgatcaaagtcaggagatgactaatatattatactggataaacctcgtgtttattgtcctatttacaggggaatgcgttctcaagctgataagtctcaggtactactattttactatcggctggaacatatttgactttgtggtggttattctttcaattgtaggaatgtttctcgcagaactgatcgaaaagtatttcgtgtctccgacactgttcagggtgattaggctggctcggattggccggatattacgcttgattaagggtgccaaaggtatacggacgctcctgtttgccttgatgatgtcactgccagcactttttaatattggacttctcctgtttctcgtcatgttcatatacgccatcttcggaatgtccaactttgcctacgtgaaaagagaagtgggaatcgatgacatgtttaactttgaaacttttggcaatagcatgatttgcctctttcagattacaacctccgcgggctgggacggcctactcgcacctattctgaactccgggcctcctgattgtgatcccgacaaggatcatcctggtagctcagttaaaggcgattgcggtaacccctcagtcgggattttcttcttcgtctcatacataatcataagctttcttgtggtcgtgaatatgtatatcgccgtgattcttgagaattttagtgtagctacagaagaaagtgccgaacctctatccgaagacgacttcgaaatgttctacgaagtttgggaaaaattcgatcctgacgctacccagttcatagaattcgccaaactgtcagactttgccgacgccctagaccctcccctcctgattgccaaacccaataaggtccaacttattgcaatggacctccctatggttagcggcgaccggattcactgtctcgatattctgtttgcttttaccaaaagagtgcttggcgagagcggcgagatggacgcgttacggatacaaatggaggagcggttcatggcttcaaaccccagcaaggtgagctacgaacccatcacaaccactctaaagagaaaacaagaggaggtgtccgccatcattattcaaagggcatatcgtaggtatctcttaaaacagaaggtgaagaaagtgagctccatttacaaaaaggacaagggaaaagaatgcgatggtacacccatcaaagaggatacactgattgataagttgaacgagaatagtacaccggagaaaactgacatgacaccttccacaaccagccctccgagttacgatagcgtcacaaaacctgagaaagaaaagttcgagaaggacaagtctgaaaaggaggataaaggtaaagacattcgggagagcaagaaatag

SEQ ID NO: 134689 - DNA, 1512 bp, Artificial Sequence
  Description of Artificial Sequence: Synthetic coding sequence
atggcgcaaagcgtgctcgtgcctccaggccctgattctttccgcttctttacccgagagtctttggcggctattgagcagaggattgctgaggaaaaagcgaaaaggcccaagcaggaacgcaaggatgaagatgatgagaatgggcccaaaccaaatagcgacctcgaagctgggaaatcgctgcccttcatctatggggatatcccacctgagatggtcagcgtgcccctggaggacttagacccatattacattaataagaaaactttcatcgtgctgaataaggggaaggctatatctagattctccgccactccagcactgtacatcctgacaccattcaaccctatacgcaaattggcaattaagatccttgtgcatagtctgtttaatatgctgatcatgtgcactatattaactaattgtgtgttcatgacgatgagtaacccaccggactggacaaaaaacgttgaatacacgttcacaggcatatataccttcgaatctcttataaaaatcctcgctcggggtttttgcctggaggattttacttttctgcgcgatccatggaactggctggattttacagttataactttcgcgtacgtcacagagttcgtggacttggggaatgtgtctgccctaagaaccttcagagtgctgcgtgcgttaaaaaccataagtgtgattccaggtctgaaaaccattgtcggcgctctcatccaatcggtaaagaagttatctgacgtgatgatactcacggtgttctgtttgtcagtttttgccctcatcggcctgcagctgttcatgggcaatctgcgtaacaaatgcctgcagtggcccccagacaattcatcattcgaaatcaatattacaagcttcttcaacaattccctcgatggcaacgggaccacgttcaacaggaccgtttccatcttcaattgggacgaatacatagaagataaaagtcacttctacttcctcgagggtcaaaatgacgcactcttgtgcggcaactctagtgatgctggtcagtgtccagaggggtacatttgtgtcaaggcaggtcggaatcctaattacgggtatacatcttttgatacattcagttgggcttttctttcactgttcaggcttatgacgcaggatttctgggaaaacctgtaccagctgacactccgtgccgccggtaagacctacatgatcttcttcgtcttggtcattttcctcggttctttctatctgatcaacctgatattagccgtcgtggccatggcttatgaagagcagaatcaggcaaccttggaggaagccgagcagaaggaagccgagtttcaacagatgctcgagcaactgaaaaaacaacaggaggaggcgcaggccgctgcagccgccgcgtccgctgaaagcagggactttagtggcgccggtggaatcggagtatttagtgaaagttccagcgtggcctctaaactgtcaagcaagagtgaaaaggaacttaaaaattag

SEQ ID NO: 134690 - DNA, 648 bp, Artificial Sequence
  Description of Artificial Sequence: Synthetic coding sequence
atgcaccgggacgcttggctgccccgccccgccttctccctgacaggtctttcgttgtttttctccctcgtgcctccgggaaggagcatggaagtaacggttcctgcgaccctcaatgttctaaacgggagcgacgctaggctgccttgtaccttcaattcttgctacacagtcaaccataaacagttcagtctcaattggacctaccaggaatgcaataattgctcggaggaaatgtttctgcagttcaggatgaaaatcatcaacctaaaactcgaacgtttccaggatcgagtcgagttttcgggcaacccctccaagtatgacgtgtctgtcatgttaagaaacgttcagcctgaggacgaggggatttataactgctatattatgaaccctcctgaccggcacaggggccacggtaaaatccatctgcaagtgcttatggaggaacccccagagagggactccaccgtggctgtgatcgtgggggcaagcgtgggcggattcttggcagtggttattttggtgctgatggtggttaagtgtgtgcggcgcaaaaaggagcagaaactgagtaccgacgacctcaaaacggaagaagaggggaaaacagacggcgagggaaaccccgatgatggcgctaaatag

SEQ ID NO: 134691 - DNA, 6003 bp, Artificial Sequence
  Description of Artificial Sequence: Synthetic coding sequence
atggcccaggccctgctggtgccacccggcccagaaagtttccgcctattcacccgtgaaagtttggcggcaatcgaaaagcgagctgctgaagagaaagccaaaaagcccaagaaagagcaagacaacgatgatgaaaacaaacctaagcctaacagtgacctggaagccggcaaaaatctcccctttatttacggagatatcccccctgagatggtgagcgaacctttagaagatctcgacccctactatattaacaagaagacgtttattgtgatgaataaggggaaagccattttcagattcagcgctaccagtgccctgtacatcttgacgcccctgaaccctgtgagaaaaatcgccataaagattttggtgcactccctcttttccatgctgattatgtgcaccatacttactaactgcgttttcatgaccctttcaaaccctcccgactggaccaagaatgttgagtacacttttaccgggatctatacttttgagagtctgattaaaatactagctaggggattttgtcttgaagacttcacatttctgcgggatccctggaactggcttgacttttcggtgattgtgatggcgtatgtgacagagtttgtggatttgggtaatgtttctgctcttaggactttccgcgtactcagagccttgaaaaccattagtgtcatccccggtctaaaaactattgtgggcgcgctgatacaatcagtaaagaagttgtccgatgtcatgattttaacagtgttctgcctttctgtgtttgctctcattggacttcagctgtttatgggaaacctccgtaataaatgtctgcagtggccgccgagcgactccgcctttgagactaacacaaccagttacttcaatggaaccatggattccaacggtacctttgtgaatgtgacaatgagtacctttaactggaaggattacattggggacgactctcacttctacgtgctggacgggcagaaagaccctctactttgtgggaacggatcagacgcaggacaatgccctgaaggctacatctgtgtcaaggctgggagaaacccgaactacgggtacactagcttcgacacattcagctgggcctttctgtccctgttccggctgatgacacaggactactgggagaatctgtatcagttaaccctgagggcggctggcaagacttacatgatcttctttgtactagtcattttcttgggctccttttacctggtaaatctcatcctggccgtggtcgccatggcgtatgaggaacagaaccaggctaccctggaagaggctgaacagaaagaggcagagttccagcagatgctggagcagcttaagaagcagcaggaggaggcccaagctgtggctgcagcgtcagccgcttcccgggatttttcgggaatagggggtctcggagagctgctggaaagttcatccgaggcctcgaagctctcctccaaatccgcaaaggagtggagaaataggcggaagaagagacgacagcgcgaacacctcgagggcaacaataagggggaacgtgactcgttccccaaatccgagtcggaagattccgtcaagagaagttccttcttgttttctatggatggaaaccgcctgaccagtgacaaaaagttttgctcaccgcaccagtccctcctctccatcaggggatccctgttttccccccggcgaaactcaaagacaagcatcttttcctttcgtggccgcgccaaggatgttggtagcgagaatgactttgcggacgacgaacactctacgttcgaagatagcgagagcagaagggactcccttttcgttcctcaccggcacggtgagaggcgcaattctaatgttagtcaggcatctatgtcatccaggatggtgcctggcctgcccgctaatggcaagatgcacagcaccgtggattgtaatggggtggtgtctctggtaggaggcccaagcgctctgacatcccctacagggcagctaccccccgaggggaccaccacagaaactgaggtccggaaacgccgcctgagctcctaccaaatttctatggagatgctggaagattccagcggccggcagcgtgccgtctctattgctagtattttgaccaatactatggaagagctcgaagagtctcgccaaaaatgtccaccgtgttggtatcggttcgctaatgtgttcctaatctgggactgttgtgatgcttggctaaaggtgaaacatttggtcaatttaattgtgatggatccctttgtcgacctcgccatcacaatttgcattgtgctgaatacactgttcatggccatggagcattaccctatgacggaacagttctcatccgttcttactgtcgggaatctggtcttcacgggtatctttaccgccgagatggtgttgaaaataattgctatggacccatactattacttccaggaaggatggaacatctttgatggcatcatcgtttccctgtctctgatggagctaggattgtctaatgtcgaagggctttcggtgctgagaagctttagactgctccgcgtgttcaagcttgctaagtcctggcctacactgaacatgctgattaaaattatcggaaacagtgtgggcgcactggggaaccttaccttggtgctggccataatcgtgtttattttcgccgtggtcggtatgcagctgttcggtaagagctataaggagtgtgtgtgtaagatcaacgatgattgcacattgcctaggtggcatatgaacgattttttccatagcttcctgatagtgttcagagttctttgtggggaatggattgagaccatgtgggactgtatggaagtggccgggcagactatgtgtctcatcgtcttcatgcttgtgatggtgattggaaatctcgtggtgctgaacttgtttctagccctcctcctgtcatcctttagctccgacaacctagcggctactgatgatgacaatgaaatgaacaatctgcagatcgccgtcggccgaatgcaaaagggcatcgactacgttaaaaacaaaatgagggaatgcttccagaaggcgttctttcgaaagcctaaggtcatcgaaatccatgagggaaataagattgattcttgcatgtccaataacactggcattgagatctccaaagaactgaactatttgagagacggaaatggaactacctccggggtcggtacagggagcagcgttgagaagtatgtcatcgacgagaatgattacatgtccttcataaacaatcctagcttaactgtgacagtgcctatcgccgtgggagaaagcgattttgagaatctaaatacggaggagtttagctccgagagtgagctcgaagagagcaaagagaaattgaatgccacgagtagttcagaaggctccaccgtggacgtcgtactgccacgtgagggcgaacaagcagaaactgagccggaggaagacctgaaacctgaagcatgcttcacagaggggtgcattaaaaagttcccattctgtcaagtgtccacagaggagggaaagggaaaaatctggtggaatcttaggaaaacttgctacagcatcgtcgaacacaactggttcgaaacttttattgtatttatgatactgctgtcctcaggggcactcgcattcgaggacatttatatcgagcaaaggaaaaccatcaagactatgctggaatatgccgataaagtctttacctatatattcatcctggagatgctactcaagtgggttgcttacggtttccagacctattttaccaacgcatggtgttggttggactttctgatcgtggatgtgagtctagtgagcctcgtcgcaaacgctttggggtattccgaattgggggccatcaaatccctgaggacactgagggcccttagacctcttcgagctttgtctcgttttgaagggatgcgggtcgtcgtcaatgccttagttggagccatccctagcatcatgaacgtactgctcgtgtgcctgattttttggctgatcttcagcattatgggagtcaacttatttgcgggaaagttttaccattgtgtcaatatgaccaccggaaacatgtttgacatcagcgacgtgaacaacctgtccgactgccaggccctagggaagcaggcccgctggaagaatgtgaaggtgaactttgacaacgtaggcgccggataccttgctctacttcaggtggccacgttcaagggatggatggacataatgtacgctgctgtggacagtagggacgttaagcttcaacctgtttacgaggagaatctttatatgtatctatactttgtcatctttatcattttcggcagcttcttcacgctcaatctgttcatcggagtgattatcgacaactttaatcagcagaagaagaagttcggaggacaggatatcttcatgaccgaagaacagaagaagtattacaatgccatgaagaagcttggttccaaaaaacctcagaagccgatccctcggccagctaacaagttccaggggatggtgttcgactttgtaacacgtcaggtatttgatatttcgataatgattctcatatgtctgaacatggtgactatgatggtcgagacagatgatcagggcaagtatatgacacttgtactgagtaggattaatctcgtgtttattgtgctgtttacaggggagtttgtcttgaaactagtctcgttgaggcattattacttcaccatcgggtggaacatcttcgactttgtagtcgtgatattgtctattgtgggaatgtttctcgccgaaatgattgagaagtattttgtctccccaacgctgttccgcgttataaggctggctcgcatcggccgtatcctgcggttaatcaagggtgccaaagggattaggacactactgttcgcccttatgatgtccctgcccgccctattcaacatcgggttgctcttattcctggtaatgttcatatatgccatattcggaatgtctaatttcgcttacgtgaagaaggaggcaggtatcgatgatatgtttaacttcgaaacttttggaaactcaatgatatgtctttttcaaattaccacctctgcgggttgggacggtcttttggcaccaattctgaactctgcccctccagattgcgaccccgatacaattcaccctggtagctccgtcaagggcgactgtgggaatcccagcgtcggcattttttttttcgtgagctatatcattattagcttcttagtggtggtgaatatgtatattgcagtgatcttggagaacttctctgttgccacagaagagagtgccgaaccgcttagcgaggatgatttcgagatgttttatgaagtttgggaaaagttcgaccctgatgccacacagtttattgagttctccaagttgtctgattttgccgccgcactggacccacctctcctgattgctaagccaaacaaagtccagctgatcgccatggatctcccaatggtgtcgggcgaccgcatccactgcttagatatattatttgcattcacgaagagagtgctgggggagtcgggagagatggatgcattacggatacagatggaggatcgcttcatggcgagcaacccttcaaaagtttcatatgagcctattactacaacgttaaagaggaaacaggaggaggtcagcgccgcaataattcagcgcaattttcgctgctatttgctcaaacaacggctaaaaaatatatcttccaactacaataaggaagcgatcaaaggccgaattgatctcccgataaaacaggacatgatcatcgataaacttaacggcaatagcacaccagaaaagaccgacggctcatcctctaccacatctcctccctcgtacgactctgttacgaagccagataaagagaaatttgaaaaggacaagccagagaaggagagtaaaggaaaggaggtgcgggaaaaccaaaaatag

SEQ ID NO: 134692 - DNA, 6003 bp, Artificial Sequence
  Description of Artificial Sequence: Synthetic coding sequence
atggctcaggcgctgctggttcctccagggcccgagagcttcaggctgtttactagggaatctctcgcagctattgaaaaaagggccgccgaggaaaaagccaagaagcccaagaaagaacaggacaacgacgacgagaacaagccaaaacctaattctgacctagaggctggtaagaacctgccttttatctatggagatattccaccggaaatggtgtcagagcccctggaggacctggacccctattacatcaataaaaagacattcatcgtgatgaacaaggggaaagccatcttcaggttctctgcaacctcagcgctctacatcctgaccccactgaatccggttcggaaaatagccatcaaaatactggtgcatagcctcttttcgatgcttatcatgtgcactatactaacaaattgcgtattcatgaccttgtctaacccccctgactggactaaaaatgtggagtacaccttcacaggtatttacaccttcgaatctctgatcaaaatcctagcgcgcggattttgtctggaagatttcacctttctgcgagacccctggaattggctcgactttagcgtgattgtgatggcttatgtcacagaattcgtgtcccttgggaatgtgagtgctctgaggactttccgcgttttacgcgctctgaagacaataagcgttatccctggccttaaaactatagttggtgcgctcattcaatcagttaaaaaactgtctgatgtgatgattttgaccgttttttgtctcagtgtgtttgccctgattgggttgcagctgttcatgggtaacttgaggaataagtgtctgcagtggcctccgtctgattcagcgtttgagaccaacactacatcttattttaatggtactatggacagcaatgggacatttgtaaatgtcactatgtctacattcaattggaaggactacatcggcgatgactcgcacttttatgtcctcgacgggcagaaagacccactgttatgtggcaatgggagtgatgctggccagtgcccagagggttacatttgcgtaaaagctggccggaacccaaactacggttatacatctttcgataccttttcatgggcttttctttccctgttcaggcttatgacccaggattactgggagaatctgtatcagctcaccttgagggccgccggaaagacttacatgatattcttcgtgctggtcattttcctcgggtcattttacttggtcaacctgatccttgccgtcgtggcaatggcctacgaggaacagaaccaagccactctggaggaggcggagcagaaggaggcggagtttcagcaaatgcttgagcaactgaagaaacagcaggaagaagcccaggctgtcgccgctgcaagtgctgcgagtcgagacttttccggaatcggcggcctgggggaactattggaaagtagctcggaggccagtaagctctcgtcgaaaagtgcaaaggagtggcggaatcgccgaaaaaagcggcggcagagggagcacttggaagggaacaataagggcgagcgcgatagtttcccaaaaagcgaatctgaggattccgtaaaacgcagtagcttcctgttctcgatggacggcaaccgtctgacttctgataagaaattctgcagtccacaccagagtctcttgagtatccgggggagcctcttctcccccagaaggaactccaagacctctattttttcttttcgcggccgtgctaaggacgtgggctctgaaaatgactttgctgatgacgagcactcaacctttgaggattcagagagcagaagagattccctgtttgtgcctcatagacatggggagcggaggaactccaatgtttcccaggcaagcatgtcatcgcggatggttcctggcctgccggccaatgggaagatgcactcaaccgtagactgtaacggagtggtttcactggtcggaggtccctctgcattaacaagccctacaggccagctgccccctgaaggtactacaacggaaactgaagtgcggaagaggcgtctatcctcataccagatttccatggagatgctagaagactccagtggtcggcaacgcgccgtgtctatcgcctctatcctcacaaataccatggaagaactggaggaatcccggcagaagtgtcctccatgttggtatcggttcgccaatgtgtttttgatttgggactgctgcgatgcatggttgaaggtgaaacatctggtaaacttaatcgtgatggatcccttcgtcgacctagcgattaccatctgtattgtactgaacacactcttcatggccatggagcattatccaatgactgagcagttctcaagtgtgctcacggtgggaaacctcgtgttcaccggaattttcacggccgagatggtacttaaaatcatcgctatggatccctactactatttccaagaaggatggaatattttcgacgggattatcgtctctctctcgctcatggaactgggactgtcaaatgtagagggcctgtcagtgctccggtccttcagattgctgcgcgtgttcaaactggccaaatcttggccaactttgaatatgttgattaagatcatcgggaactccgttggggcgctaggaaatttaactctcgtcttggccataatcgtattcatctttgccgtcgttggcatgcagctcttcggcaagtcctataaggagtgcgtgtgcaagatcaatgacgactgcacactgccgcgctggcacatgaatgacttcttccactcattcctgatcgtgttcagagttctgtgcggtgagtggatagaaacaatgtgggattgtatggaagttgccggccagaccatgtgtttgattgtctttatgctggtgatggtgatcgggaatctcgtcgtgcttaatttgttcctggcactcctcctgagctcgttcagttcagacaacctcgcagccacagacgatgataatgagatgaacaatctgcagatagccgtgggcagaatgcagaagggtatcgattacgtcaaaaacaagatgcgcgagtgctttcaaaaggccttctttcgcaaaccaaaagttattgagattcatgaaggaaacaaaattgatagttgcatgtcaaacaacacaggaatcgaaatctccaaggagctgaattatctgcgtgatggtaatggcactacctcaggagtggggacgggtagtagcgtggaaaagtatgtgattgacgagaatgattacatgtcttttattaacaatccctcattgacagtgactgttcctattgctgtgggggagtcagacttcgaaaatttgaacacggaagaatttagttccgaaagcgaactggaggaatcaaaagagaagctgaatgccacctctagttctgaagggagcacagtcgatgtggtgctgcctagggaaggggagcaggccgaaactgagcctgaggaagatttgaaaccagaggcatgttttactgaggggtgcatcaaaaagtttccattttgtcaggtctctacagaggaagggaaagggaagatatggtggaacctcagaaaaacctgctacagcatcgtggagcacaattggtttgaaaccttcatagttttcatgattctcctcagctccggggcgctggcatttgaagacatctacatcgaacaaagaaaaactattaagaccatgcttgagtacgccgataaggtgttcacttacatttttatactggagatgttactgaagtgggtggcctatggtttccagacctacttcacgaacgcctggtgctggcttgactttctgatcgtggatgtgagccttgttagtctggttgccaacgccctggggtatagtgagttgggggctattaagagcctgaggacgctccgagccctgcggccccttcgagctctgtcacggttcgagggaatgcgggtagtggttaatgccctagtcggcgccattccatcgattatgaacgtgctcctggtctgtctgatcttttggctgatattttccatcatgggtgtcaatcttttcgccgggaagttctaccactgcgtgaatatgactaccggcaatatgttcgacattagtgacgtgaataacctcagcgattgccaggccctgggaaagcaggcacggtggaaaaacgtgaaggttaactttgacaacgtgggagccggctacctggccctgctgcaggtcgcaaccttcaaaggatggatggatattatgtacgcggccgtggacagccgggacgtgaagctccaaccggtgtacgaggaaaacttgtatatgtatctatactttgttattttcattatcttcggctccttctttactctgaatctcttcataggtgtgatcatcgacaacttcaatcagcagaagaaaaagtttggaggccaagatatattcatgaccgaggagcagaaaaaatactataatgctatgaaaaaattggggtcaaaaaagcctcaaaaacctattcctagacccgctaataaattccaaggcatggtgttcgattttgttacgagacaggtctttgatatctcaattatgatccttatttgcctgaatatggtgactatgatggttgagactgacgatcaaggaaaatatatgacattggtcctgtctcgcattaatcttgtgttcatcgtgctgttcacaggcgaattcgtgctgaaactggtttcactgaggcattactacttcactattggctggaacattttcgacttcgtggttgtcattcttagcattgtggggatgttcctggctgagatgattgagaagtacttcgttagccctacacttttccgtgtaatccggctcgctagaatcggccgtatcctcagactgatcaagggagccaaggggatcagaacactcctgtttgcactcatgatgagcctgcccgccctgttcaacattggtctgcttctgttcctggtaatgtttatttacgccattttcgggatgtccaatttcgcctatgtgaagaaggaggctggcatagacgacatgttcaatttcgagaccttcggtaacagtatgatttgcctctttcagatcacaacctctgcgggatgggacggattgcttgcccccatcctgaactccgccccacctgattgtgaccccgatactatccaccccgggagcagtgtaaagggcgactgcggaaatccctcggttggcattttcttctttgtgagttacatcatcatcagctttcttgtggtggtcaatatgtacatcgctgttatcctggagaacttcagtgtagccactgaagagagcgccgaaccgctgtcggaagacgacttcgagatgttctacgaggtttgggaaaagttcgacccagacgccactcagttcatagagttttctaaactctctgacttcgctgcagcactggacccacccttgctcattgctaagcctaataaggttcagctgattgcaatggatctgcccatggtcagcggagatagaattcactgcctggatatattgtttgcattcactaagcgcgtgctgggggaaagtggcgaaatggatgccctgaggattcagatggaagatagattcatggccagtaacccctctaaagtgagctatgaaccaatcaccactactctgaagcgcaagcaggaggaagtctccgccgcgatcatacagcgcaatttccgatgttacctgctcaagcaaaggctcaaaaatatctcctccaactacaacaaagaggccatcaagggtcgaattgatcttcccatcaagcaggacatgattatcgacaagctcaatggcaatagtacacccgaaaaaaccgacggttccagctcaactacttctcccccaagctacgactccgtaacaaagcccgacaaggaaaagttcgaaaaggacaagcctgaaaaagaaagtaagggcaaggaggtgcgggaaaaccagaaatag

SEQ ID NO: 134693 - DNA, 5856 bp, Artificial Sequence
  Description of Artificial Sequence: Synthetic coding sequence
atggcacaagccctcctggttcctcccggacccgagtccttcaggctgtttaccagagaatctctggccgctattgaaaagcgcgcggccgaagagaaagcgaaaaagcctaagaaggagcaagataacgatgacgagaacaagccgaaacctaactccgacttggaagctgggaaaaatctgcccttcatttacggagatatccctccagagatggttagtgagcctctcgaagacttagacccttattatatcaacaagaaaaccttcatagtgatgaacaaaggaaaagccatttttcgctttagtgccacctccgctttatatatactgacccctcttaatcccgtcagaaagattgcaatcaaaatcctggtacatagtctgttttcaatgttgataatgtgtactattttaaccaactgcgttttcatgaccctgagtaatccacctgactggactaaaaacgtagagtacacgttcactggcatttatacattcgaaagcctcattaagattttggccagggggttttgcctggaggatttcacctttttaagggacccatggaattggttagacttctcagttatcgtgatggcttacgtgacggaatttgtatctcttggcaatgttagtgcactcaggacattccgagtgctgcgggccttgaagaccatcagtgtgatccccggcttgaagactatcgtgggcgccctaatacagtccgtgaagaaactctcagacgtcatgattctgactgtcttctgcctcagtgtatttgcgctgatcgggttgcagctcttcatgggtaacctgcgcaacaagtgcctacagtggcccccgagcgatagtgcttttgaaacaaacaccacttcatactttaacggaactatggactcaaatgggacattcgtgaatgtaaccatgagtacctttaactggaaggattatattggagatgattcccacttctatgtgctggacgggcagaaggatccgttactgtgcggcaatgggagtgatgcagggcagtgcccagaagggtacatttgcgtgaaagctggacgcaaccctaattatggatatacttcgtttgacactttctcatgggctttcttgtctttatttaggctcatgactcaagactactgggagaacctgtatcagctgacattgagagccgccggcaagacttacatgatttttttcgtgctggtcatctttcttggatctttctatctcgtcaatttgatcctggcagtcgtcgccatggcctacgaggagcagaatcaggctactttagaggaagcagagcagaaagaggcagaattccagcagatgctggagcagctcaaaaaacagcaggaggaagctcaggctgttgcagctgccagcgcagcttctagagatttttccggcattgggggcctgggcgagctgctcgagtctagctcagaggctagcaagctgagttcaaaaagcgccaaagagtggagaaaccgaagaaagaagcgcaggcagagggagcatctggagggcaacaacaaaggtgaacgggacagtttccctaagagtgaatcagaggactcagtaaagcggagtagctttctgttcagtatggatggcaacaggttgactagcgataaaaaattctgtagtccccatcagagtctgctatccattagaggatctctgttctccccccggcgcaatagcaaaacaagtatcttcagctttaggggacgggccaaagacgtcgggagcgaaaatgatttcgcggacgatgagcacagcacatttgaggattctgagtcccgccgtgattcactttttgtgccacaccgacacggagaaagacgaaactctaacgggacgactaccgaaacggaggttagaaagcgcaggctgagctcctaccagatttctatggagatgctcgaggacagttccggtcgccagcgggcagtctcaatagccagcattctgactaacaccatggaggagctggaagagtctcggcagaagtgccccccttgctggtatagatttgcgaatgtgtttcttatctgggactgttgcgacgcctggctgaaagtaaaacatcttgtcaatttgatagttatggatccattcgtggacctcgctattactatctgtatcgtactgaatacgctgtttatggccatggagcactaccctatgaccgagcagttttcgtcagtattgacagttggcaacttggtgtttactgggatatttacggcagagatggtgttgaaaattatcgccatggacccttactactacttccaggagggctggaacatttttgacggcatcattgttagtttgagtctaatggagttaggtcttagtaacgtggagggtcttagcgtgctgaggagcttccgcttgttgagagtcttcaagctcgcaaagagctggccgacccttaacatgttgatcaagatcattgggaattcagtgggggccctgggaaatctcaccttggtgctcgccataatcgtcttcatttttgccgtcgttggcatgcagctgttcggtaaatcatacaaagagtgcgtgtgtaagatcaacgacgactgcaccctgcctcggtggcatatgaacgatttctttcactcattcttgattgtcttcagagttctctgtggggagtggattgaaactatgtgggattgcatggaggtcgcaggacagaccatgtgcttgattgtgtttatgctcgtgatggttataggcaatctggtggtcctcaatctctttctggcactgctcctgtcttcattctcaagtgataacttagcagctaccgatgacgacaacgagatgaacaacctgcagattgcagtgggacgaatgcaaaagggaatcgattatgttaaaaataagatgagagaatgttttcagaaggctttcttccgaaaaccaaaggtgatagaaatccacgagggaaataaaatcgactcttgcatgagcaataacaccggcatcgagatctccaaggaactaaactatctgagagacggcaatgggactacgagcggcgtggggacgggatcttccgtggaaaaatatgtaatagacgaaaatgactacatgtcatttatcaataacccgagccttaccgtgactgtgcctattgctgtcggggagtcagattttgagaatctgaatacggaggagttctcttcagagagtgaattagaagaatcaaaagaaaagttgaacgccacctccagctctgaaggtagcaccgtcgatgtagtactacctcgcgagggggagcaggccgaaactgagcccgaggaggatcttaagccagaggcctgtttcactgaaggatgcatcaagaagtttcccttctgccaagtatccacagaggagggcaaaggcaagatttggtggaacctgagaaagacctgctatagcatagtagaacacaactggttcgagacctttattgtttttatgattctcctgtcatctggggccctggcctttgaggatatctacattgaacagcgcaagaccattaaaacaatgctagagtacgctgacaaggtgttcacatacatttttattctggaaatgctgttgaagtgggtggcttatgggttccagacttacttcacaaatgcctggtgctggctagacttcctaatcgtggacgtgagtctggtgagcctcgttgcaaacgccctgggttattccgagctcggcgcaattaaatcgctgaggacactgcgtgctctgagacccttgcgcgctctttcaagattcgaggggatgagagtcgtagtgaatgcgctggtcggtgccataccctccataatgaacgtgctcctggtatgcctcatcttttggttaatcttctccatcatgggggtaaacttgttcgctggaaagttttaccattgcgtgaacatgacaaccggcaacatgttcgatatttccgacgtaaacaatctgtcagactgccaggctctcgggaaacaggcacgatggaagaatgtcaaggtcaactttgataacgtgggtgccggatatctggctcttctgcaggtggcaacatttaaaggttggatggacattatgtacgccgcagtggactcccgggacgtaaaattgcagcccgtgtatgaggaaaatttatacatgtatttgtacttcgtgatatttataatctttggatcattctttactcttaatctctttataggggtgatcattgataacttcaatcagcagaagaagaagtttggcgggcaggacatctttatgacggaggagcagaaaaagtattacaatgcaatgaagaaactgggttccaagaagcctcagaagcctatccctcgtcccgccaataagttccagggaatggtgttcgactttgttaccagacaggtgttcgatattagtatcatgatcctcatctgcttgaacatggtcaccatgatggtagaaacagacgatcaaggaaagtacatgactctagtgctgagccgaatcaacctggtttttattgtactcttcaccggggaatttgttctgaagctagtctcactaaggcactattactttacaatcggctggaatatctttgattttgttgttgtaattttgagtatcgttggcatgttcctggcggagatgatagagaaatactttgtgagcccgaccctctttcgcgttattcggctcgcccggatcggaaggatcctccgcctgatcaagggcgctaagggcattcgcaccctgctctttgccctgatgatgagcctccccgccctctttaacatcggcttgcttctctttcttgtcatgtttatttacgctatattcggaatgtcaaacttcgcgtacgtgaaaaaggaagctggaattgacgacatgttcaattttgagacttttggcaattcgatgatctgtctgtttcaaattacaacatctgccggctgggatggattacttgcacctatactgaattcagcccctcctgactgcgatccagacactatacatcccgggtcatcagtgaagggagattgtggtaacccatcagtaggcatctttttctttgtatcgtatatcattatctcattcctggtggtggtgaatatgtatattgccgtgattctggagaatttcagtgtcgccacggaggagtctgccgagccgctcagtgaagacgattttgagatgttctacgaagtgtgggagaaatttgacccagacgctacccaatttatcgagttctcgaaactgagtgactttgcagccgcacttgatccgccactcctgatcgcaaagcccaacaaggtccagctgatcgcaatggacctgcctatggtgagcggtgatcgcattcattgtctggacatccttttcgcatttactaagcgcgtcctgggcgagtctggggaaatggacgctctgcggattcagatggaggaccgcttcatggcctcaaaccctagcaaggtgagctacgaacccatcaccactactcttaagcgcaaacaggaagaggtttcggctgcaattatccaacgaaattttcggtgttacttgctgaagcagcgcctgaagaacataagctccaactacaataaggaggctatcaaggggcggatcgatctgcccatcaagcaggacatgattatcgacaagcttaatggtaattcgacacctgagaaaaccgatggctcctcatccaccacatcacctcccagctacgacagcgtgactaaacctgacaaagaaaagtttgaaaaggacaagcccgagaaggaatcaaagggcaaggaggtgcgcgagaaccagaaatag

SEQ ID NO: 134694 - DNA, 4095 bp, Artificial Sequence
  Description of Artificial Sequence: Synthetic coding sequence
atggcccaagccctcctggtgccaccagggccggagtcattcaggcttttcacgcgagagtctctcgccgccatagaaaagcgggccgccgaggagaaggccaaaaaaccaaagaaggagcaggacaacgacgacgaaaataagcccaagcctaactctgacctcgaagctgggaaaaatcttccatttatatacggagatatcccccccgaaatggttagcgagccactggaagacctcgatccctactatattaataagaagacattcatcgtgatgaataaggggaaagctatctttcgattttcagcgacatcagccctctatatcctgacgcccctgaatcctgtgagaaagatcgccataaagattctggtgcacagcttatttagcatgttgatcatgtgcacaatcctcaccaactgtgtcttcatgactctttcaaaccccccggactggacaaagaacgtcgagtacaccttcactggaatctacactttcgaatctctcatcaaaatactggcacgaggcttttgccttgaagactttacttttctgcgtgacccatggaactggctggacttttctgtcatagtgatggcctacgtaacagagttcgtagatttgggtaacgtgtccgcactcagaacattcagggtcctgagagctctgaagactatcagtgtgattcctgggttaaagacgatcgtaggagccctcatccagtcagtgaagaaattgagcgacgtgatgatccttacagtcttttgcctgtcagtctttgccctaatcggcttgcaactcttcatgggcaacctgaggaataagtgcctccagtggccacctagcgatagtgcctttgaaactaatacaacaagttacttcaacgggacgatggactcgaacggcacatttgtgaatgttacaatgtcgacgttcaactggaaggactatatcggagacgactctcatttctacgtgctcgacggtcagaaggaccccctcctttgtggcaatggatcagacgctggccagtgtcctgagggctacatctgtgtgaaagctgggaggaaccccaattatgggtataccagtttcgatacattctcctgggcgttcctgagcctctttaggcttatgactcaggactactgggaaaacctgtatcaactgaccttgcgggcagccggaaagacatacatgattttttttgtacttgtgatattcctgggatccttttatttagtgaacctcatcctggccgtggtggctatggcttacgaagaacagaaccaagccaccctggaggaagctgaacagaaggaggctgagttccagcagatgctcgaacaactgaaaaagcagcaagaggaggcccaggccgtagctgccgcttccgctgcttctcgggacttttctggcataggggggctgggcgaactcctggagagctcaagtgaggcctccaagctatcatccaaaagcgcaaaggaatggcgtaatagacgcaaaaagcgcaggcaacgggaacatctggagggtaataacaaaggtgagcgcgactcctttccaaagtcagaatcagaagattcagttaagcgatctagtttcctatttagcatggatggaaatcgccttacatccgacaagaaattctgtagcccacatcagtctttgctgagcattagaggctccctgttctcccctagacggaatagcaaaacatccatcttttcctttaggggtagagcgaaggacgtcgggtctgagaatgatttcgccgacgacgaacatagcacctttgaagattcggagtctcgcagggacagtctttttgtgcctcatcgacacggtgaaagaagaaattctaatgggaccacaacggaaaccgaggtgcggaaacgacggctgagtagctaccagataagcatggagatgttagaagacagttctggccgccagagagcagtgtccatcgccagcattctgacaaacacgatggaagagctggaggagagcaggcaaaaatgcccgccatgctggtaccgattcgccaatgtgttcctgatctgggactgctgcgacgcctggttgaaggtcaaacatctcgttaaccttatcgtgatggacccgttcgtggacctggccataaccatttgtatcgtgctgaacaccctgttcatggccatggaacactatccaatgaccgagcagttctcctcagtgcttacagtaggcaatctggtgttcactggcattttcacagccgagatggtcttaaagattattgcaatggacccctactattatttccaggaaggatggaacattttcgatggaattatagtttcgctgtctctgatggagctcgggctcagcaatgtagaagggttgtctgtgttaaggagttttcggctgcttcgcgtttttaagctcgcaaaatcatggccgaccctgaacatgcttattaaaattattggcaactccgtgggggcgcttggcaatctcacacttgtactagcgataattgtgtttatcttcgccgtggttggtatgcagttgtttggcaaatcttacaaagaatgcgtttgcaagattaacgacgattgtaccctccccaggtggcacatgaatgatttcttccactccttcttaatagtttttagagtgttgtgtggggaatggatcgagacaatgtgggattgtatggaggtggctggccaaaccatgtgcttgatcgtgtttatgctggtgatggtgatcgggaacctggtcgtgttgaacctgttcctggcgttgttactatcttccttttccagcgataatctcgcggctactgacgacgacaacgagatgaacaatttacagatcgccgtcggccggatgcagaaaggcatagattacgtgaagaacaaaatgcgggaatgctttcagaaagctttttttaggaagccaaaggttatagagattcacgagggcaacaaaattgacagctgcatgagcaacaacactggtatagaaatatcaaaagaactgaattaccttagagacggaaatggcactacaagtggtgtgggtaccggatcctctgttgaaaaatatgtgatcgacgaaaacgattacatgagtttcattaacaatccctcccttaccgtgaccgttcccattgctgttggggagagcgacttcgaaaacttaaataccgaagaattcagctcagagtctgagctggaggagagtaaggaaaagcttaacgccacgtcatcctctgagggctcaacagtggatgtggtgctgcccagggagggagaacaggccgaaacggagcctgaggaagacctgaagccagaagcttgcttcacagagggctgcattaagaaattccctttttgccaggtgagcactgaggaaggtaaaggcaagatatggtggaacctccgtaaaacttgctacagcatagttgagcacaactggttcgagacctttatcgtgttcatgattctgctctccagcggagcactcgcattcgaagatatttacattgaacagaggaaaactatcaaaacaatgctcgaatatgcagacaaggtgtttacctatatatttatactggagatgctgcttaaatgggtcgcttatgggtttcagacttatttcaccaacgcctggtgttggctggacttcctaatcgtggacgttagcctagtctcattagtggccaacgcgcttggatactctgagctaggagccatcaagtctcttcgcacgctgagggcgttgcggccactacgagccctctccagattcgagggcatgagagttgttgtgaacgcactcgtgggcgcgattccctctattatgaacgttcttctagtgtgtctgatcttctggctgatctttagcataatgggagtcaatctgtttgctggtaagttctaccactgcgtaaatatgaccactggcaatatgtttgacatctccgatgtgaataacctgtcagactgtcaggccctcggtaagcaggctcgttggaaaaacgtcaaagtaaattttgataacgtcggagcaggttatctcgctttactccaggtgtag

SEQ ID NO: 134695 - DNA, 603 bp, Artificial Sequence
  Description of Artificial Sequence: Synthetic coding sequence
atggcccaggccctgcttgtacctccagggccagagtcttttagactgttcacaagagaaagtttagcagcgattgagaagcgggctgcagaggagaaagccaaaaagccaaagaaggaacaggacaacgatgatgagaataagcctaagccgaactctgatctcgaggcagggaagaatctgccattcatctatggggatatccccccagaaatggtcagcgagcccctggaagaccttgatccctactatattaataagaaaacattcattgtcatgaataaaggaaaggccattttccgtttctccgccacatccgccctgtacattctgacacccttaaaccctgttagaaaaatcgccatcaaaatcctggtgcattctttgttttccatgctgatcatgtgcactatcctcacgaactgcgtgtttatgacgctgtcaaatccccccgactggactaaaaacgtcgaatacactttcactggcatctacaccttcgaatcactcatcaagatccttgccaggggcttctgcctggaggactttacattcctcagggacccctggaattggctggactttagcgttatagtgatgtag

SEQ ID NO: 134696 - DNA, 1452 bp, Artificial Sequence
  Description of Artificial Sequence: Synthetic coding sequence
atggtcttcgacttcgttacaagacaggtgttcgacatatcaattatgatcctgatctgcttaaatatggttactatgatggtagaaaccgatgatcagggaaaatatatgaccctcgtcctctctcgcatcaacctggttttcatcgtgctcttcacaggggaattcgtactgaagctggtgtcactccgccattattactttactatcggctggaacattttcgacttcgttgtagtcatattgtcaatcgtggggatgttcttggcggaaatgattgagaaatacttcgttagcccaaccctgttccgggtgatccggctagcaagaatagggaggatactacgcctcataaaaggggcaaagggcatcagaaccctgctctttgcactgatgatgtccctacccgccctgttcaatataggcttgcttctctttctcgtgatgttcatctacgctattttcggtatgtctaactttgcatatgtgaagaaagaagccggtatagatgacatgtttaattttgagaccttcggtaatagtatgatttgtctctttcaaatcactaccagtgccgggtgggatggactgctggcaccaatcctaaatagtgccccgcccgattgcgatcctgataccatccacccaggatcgagcgtgaaaggagactgcggtaacccatccgttgggatctttttctttgtctcctatatcataattagcttcctcgtggtagtgaacatgtacatcgccgtgattctcgagaatttcagtgtcgctaccgaggaaagtgcggagcccctcagcgaggatgattttgaaatgttctacgaggtgtgggaaaagttcgatcccgatgcgacacaattcatcgaattttctaagctgagcgattttgcagctgccctggatccacctctgctgattgcaaagccaaacaaggtgcagttgatagccatggatcttccaatggtcagtggcgaccgaatccattgcctggatattctcttcgccttcacgaagcgggtccttggggagagcggggaaatggatgctctccgtattcagatggaggaccgctttatggcctcaaacccatcaaaagtgtcgtatgaacctatcaccactaccttgaagagaaaacaggaagaggtcagcgctgcgatcatccagcgaaacttccgatgctacctgttgaagcaaagactgaagaatatctccagcaattacaacaaggaggccattaagggtcggattgatttgcccatcaaacaggacatgattattgacaaactcaatggcaactccacacctgagaagactgacggaagctcttcaaccacttctccacccagctatgattcagtaaccaagcccgacaaggaaaaattcgagaaggataaaccagaaaaggagagcaagggcaaagaggttcgcgaaaatcagaaatag

SEQ ID NO: 134697 - DNA, 648 bp, Artificial Sequence
  Description of Artificial Sequence: Synthetic coding sequence
atgccggccttcaatcgtctctttccattggcaagtctcgtgctaatctactgggtgtccgtgtgcttcccagtgtgcgtggaagttcccagcgagacagaggctgtgcaaggcaaccctatgaaacttaggtgtatttcttgcatgaaaagagaggaggtggaagcgaccactgtcgtcgagtggttttacaggcctgagggaggcaaagatttcctgatctacgaataccgcaacggtcaccaagaggtggagtctccttttcagggacgcctccagtggaacggctctaaagacctccaggatgtgtctattacagttcttaatgtgactctgaatgatagcggactgtacacctgtaacgtgagcagggagttcgagtttgaagcccacagacccttcgtgaagacaacacgcctgattcctcttcgcgtgacggaggaggccggcgaggattttacaagcgttgtgtccgaaatcatgatgtatatcttgctcgtgttcctgacactctggctgctcatagaaatgatctactgttaccgaaaggtatctaaggccgaagaggccgcccaagagaacgcctcggactatctggccataccatctgagaataaggaaaacagtgccgttccagtggaggagtag

SEQ ID NO: 134698 - DNA, 648 bp, Artificial Sequence
  Description of Artificial Sequence: Synthetic coding sequence
atgccagcttttaataggctgtttccactagcctctttggtgcttatctattgggtgtctgtttgcttccccgtgtgcgtagaagtcccaagtgaaacagaagcagtccagggcaatcctatgaagctgcgctgtatctcatgtatgaaacgcgaggaggtggaggctactacagtggttgagtggttttataggccagaaggggggaaggattttctgatctacgaatatagaaacggccaccaggaagtagaatcaccattccaaggccgattgcagtggaatggaagtaaggatctccaggacgtttctatcaccgtacttaatgtcactctgaatgacagtgggctgtatacctgtaatgtgagtcgagaattcgagtttgaggctcacaggccgtttgtgaagactactcgcctgatcccactgagggtaaccgaggaagctggggaggactttacaagcgtggtctccgagattatgatgtacatacttctggtgttcctgaccctgtggctgctcatagaaatgatttactgctatagaaaggttagcaaagccgaagaagccgcccaggagaacgcctcagactatctcgctattccgagcgaaaataaagaaaactctgccgtcccagtggaagagtag

SEQ ID NO: 134699 - DNA, 426 bp, Artificial Sequence
  Description of Artificial Sequence: Synthetic coding sequence
atgcccgcctttaaccggctcttcccgcttgcatctttggttctaatttattgggtcagtgtgtgtttccccgtttgcgtcgaggtccccagtgaaacagaggccgtacagggtaatcccatgaagttaagatgcatttcctgtatgaaacgggaggaggtagaggccaccacagtagttgagtggttttatagacccgaaggggggaaagattttctgatatatgagtacaggaatggacatcaggaggtagagagtcccttccagggccgcctgcagtggaatgggtccaaggacctccaggacgtcagcattacagttcttaacgtgactctgaatgactcaggcctctacacttgcaacgtctcacgagagttcgaatttgaggcccacaggcccttcgtgaaaacaaccaggctcatatag

SEQ ID NO: 134700 - DNA, 648 bp, Artificial Sequence
  Description of Artificial Sequence: Synthetic coding sequence
atgccggccttcaaccggctgttcccgctggcgagtttggtcctgatatactgggtttcagtttgctttcccgtctgcgtggaagttccaagcgaaaccgaggccgtgcaagggaaccctatgaagctgaggtgtatttcttgtatgaaacgcgaagaggtggaggccaccacagtagtggaatggttctacagaccagagggggggaaagatttcctcatttatgagtatcgcaacggacaccaagaggtggaatccccattccaggggcgcctacagtggaacggaagtaaagatttgcaggacgtatccataaccgtcctcaatgtgactttgaacgacagtggcctgtacacgtgcaatgtgtcccgggagtttgaattcgaggcgcaccggcccttcgttaaaacaactcggctgatccctcttcgtgtcacagaggaggctggcgaagatttcaccagcgtcgtgtctgaaatcatgatgtatattcttctcgtcttcttgaccctgtggttactgatcgagatgatatattgctaccggaaggttagtaaggccgaagaggcggctcaggaaaatgcctccgattatcttgcaataccaagcgaaaacaaggagaatagtgccgtgcctgtcgaagagtag

SEQ ID NO: 134701 - DNA, 5511 bp, Artificial Sequence
  Description of Artificial Sequence: Synthetic coding sequence
atggccagaccatctctgtgtaccctcgtgcctctgggtcccgagtgtcttcggccatttacacgggaatctctggctgccattgaacagagagccgttgaagaggaagctagactacagcggaataagcaaatggagattgaagagccggagaggaaaccccgtagcgacttggaggcgggaaagaatctaccgatgatttacggcgacccacccccggaagttatcgggatcccactggaagacctggacccatattatagcaacaagaagaccttcattgtgctaaataagggcaaggccattttccggttcagcgctacacccgccctgtacctcttatctcctttttctgtggtgcgccgaggagcaatcaaggttcttatccatgccctctttagcatgttcataatgattaccattctgactaactgcgtgtttatgactatgtcagatccgccgccatggagcaaaaatgtcgaatatacctttactggcatttatactttcgagagcctgattaagatccttgcccggggattttgcgtggatgactttacgttcctacgagatccctggaattggctggatttctccgtaatcatgatggcatacctgacagagttcgtcgatctcggaaatatctcagccctgcggaccttccgtgttctgcgggccctgaaaacaattacggtgatccccggactgaagactattgtaggcgccttgattcagtcagtgaaaaagctgtctgacgtgatgatcttgactgtgttctgccttagcgtgtttgccttggtgggattacagttgttcatggggaatctgagacaaaaatgcgtgagatggccacccccctttaacgacactaataccacttggtatagcaacgatacttggtacgggaacgatacctggtatggaaacgagatgtggtacgggaatgactcttggtatgctaacgacacatggaatagccacgcctcctgggctaccaacgatacattcgattgggatgcctacatcagcgatgaggggaatttctacttcctcgaggggtccaatgatgcactgctgtgtggtaacagcagcgatgccggacactgtcctgaaggctacgagtgcatcaagaccggtagaaaccccaattatggatatacctcatatgacacattttcctgggcgttcctcgccctgttccggcttatgacccaggactattgggaaaacttgttccagctcactctgagagcggccggcaagacttacatgatctttttcgtggtcataattttccttgggagtttttacctcattaatttgatcttagcggtcgtggctatggcctatgccgaacaaaacgaagccacactcgcagaagataaggagaaagaagaggaatttcagcagatgctggagaaattcaagaagcatcaggaagaactggaaaaggcgaaggccgcgcaagccctggaaggaggagaagctgacggggaccccgcccacggcaaagattgtaacggatcccttgacactagccagggcgagaaaggcgccccccgccagtcttcaagcggggactcagggattagtgatgcgatggaagagctagaggaagcccaccagaagtgccccccatggtggtataagtgcgcacacaaagttctgatatggaactgctgtgccccatggttgaaatttaagaatatcattcatctgatcgttatggacccattcgtcgacctgggtattaccatctgtatagtgctgaataccctttttatggccatggagcactacccaatgacagagcactttgataatgttttgaccgttggaaacctggtcttcaccggtatattcaccgccgagatggtgcttaagttgatcgctatggacccctacgagtacttccaacaaggctggaacatcttcgactcaattattgtgaccctgtctctggtggagctggggctcgctaacgttcagggacttagtgttcttagatcttttcgcctcctaagagtatttaaactagccaaatcttggccgacacttaacatgctgattaagatcataggtaacagcgtcggcgcccttggcaatctcactctagtgctagccatcatagtgtttatttttgctgtcgtgggcatgcaactgttcggaaagagttataaagaatgtgtgtgcaaaatcgctttggactgtaacctgccgagatggcatatgcacgacttttttcattcgttcctgattgtgttcaggattctgtgtggcgaatggattgaaactatgtgggattgcatggaggtcgcgggccaggcaatgtgtctgacagtgtttttgatggtcatggtcatcggcaacctggtggtccttaatctatttttggccctgcttttatcttcatttagtgccgactcactggcggcatctgacgaggatggcgagatgaataatctccaaatcgctataggtagaatcaagcttggaatagggttcgcaaaagctttcctcctaggcctcttacatgggaagattttgtcaccaaaagatattatgttgagtttaggtgaggccgacggcgcgggtgaagcgggggaggccggggagacggcccctgaggacgagaagaaggagccaccagaggaagaccttaaaaaagataatcacatcctcaatcatatgggtctggccgatggaccgccttcctcccttgaattggaccacctgaactttatcaacaacccctacctgactattcaggtgcccatcgcaagcgaggagtcagacctggaaatgccaactgaggaagaaactgacacattctctgagcccgaggatagcaaaaaacctccgcaacctctttatgacggaaactcctctgtgtgctctaccgccgactacaaacccccagaggaagaccccgaggagcaggcagaagaaaaccctgagggcgaacagcccgaagagtgtttcacagaagcctgcgtgcaacggtggccttgcctttatgtcgatattagtcagggaaggggtaagaagtggtggaccctgcgacgggcatgcttcaaaattgtcgaacataactggttcgaaacgttcatcgtcttcatgatcctgctgagctctggcgccctcgcgttcgaggacatttacatcgaacagcgccgcgtcatccgaacaatcctggaatatgccgataaagtctttacctacatcttcatcatggagatgctgttgaagtgggttgcttacggcttcaaggtgtacttcactaatgcttggtgctggttggattttctgattgtcgacgtgagcatcatatccctggttgcgaactggttgggatactcagagctgggtccaattaagtctctcaggacgctccgggcccttaggccgctgcgcgctctttcccgcttcgagggtatgcgagttgttgtcaatgcactgctcggggccatacccagcatcatgaatgtgctacttgtttgtctgatcttttggctaatcttttcaattatgggggttaacttattcgcagggaagttctactactgtatcaataccacaacctctgaacgctttgacataagtgaggtgaacaataaatccgaatgtgagtcccttatgcataccggtcaggttcggtggctgaacgtgaaggtgaactacgataatgtgggactgggatatctgtccctgttgcaggtagccacttttaagggttggatggacataatgtatgcggcagtagactcgcgcgaaaaggaggaacaaccccagtatgaagtgaatctgtatatgtacctgtactttgtcattttcattattttcggatctttcttcacgctgaatctcttcatcggggttataattgataacttcaaccagcaaaaaaaaaaactcggaggcaaggacatattcatgaccgaagagcagaagaaatattacaacgcaatgaagaagctgggcagcaaaaaaccacaaaaacccattcctaggccgcagaacaagattcagggtatggtttacgaccttgtcaccaagcaggcctttgacataactataatgattctgatctgcctgaatatggtaacgatgatggtggagacggataatcagagccagcttaaggtggatattctatataatattaacatgatcttcattatcatctttaccggggagtgcgtcctcaagatgctcgctctgagacagtattacttcacggtcggctggaatatttttgattttgtggtggtgatcctgtccatcgtgggactcgcgctatcagatctgatccagaaatactttgtaagtcctaccttgtttcgcgtgattcgccttgcccgcatcggcagagtgcttaggttaataagaggggctaagggcatccgcaccctcctatttgcgctgatgatgagccttccggcattgttcaatatcgggctgctgctctttttagttatgtttatatatagtatattcgggatgtccaactttgcttatgttaaaaaggaaagcggcatcgacgatatgttcaatttcgaaacgtttggcaattctatcatctgtctcttcgaaataaccacctcagcaggctgggatgggttgctaaatcctatattgaattcagggccgcctgactgtgatcctaatctggaaaacccggggaccagtgtaaagggcgactgcggaaacccttctataggcatttgttttttttgctcatacattattatctcgtttcttattgtggtgaacatgtatatcgccatcatcttggaaaatttcaatgttgctaccgaagaatcttcggagcctctgggcgaggacgacttcgaaatgttttatgagacctgggagaagttcgaccccgatgccacccagtttattgcctattcccggctctcagactttgtggacactttacaagagccccttcgtattgccaagcctaacaagattaagctgattactctggatcttccgatggtgccaggggacaagattcattgtctcgacattctcttcgccttgacgaaggaagttttgggagactcaggagagatggacgccctgaaacaaacaatggaagaaaagtttatggctgccaatccctcaaaggtttcatacgagcctattaccaccacactcaaacgcaagcacgaggaggtgtgcgctattaagatccagagagcataccgcaggcacctcttacagaggagtatgaagcaggcttcttacatgtatagacatagccacgatgggtcaggggatgatgccccggagaaggagggccttttagctaatacaatgtctaaaatgtatggccacgaaaacggtaactccagctccccctcccctgaagaaaagggcgaggccggtgacgccggcccaacaatgggccttatgcccatatccccctctgacacagcatggcctccggctccccctccagggcaaaccgtgaggcctggcgtgaaggagtctctagtctag

SEQ ID NO: 134702 - DNA, 687 bp, Artificial Sequence
  Description of Artificial Sequence: Synthetic coding sequence
atgccaggggccggggatggcgggaaggccccagctcgatggcttggaacaggactgctcggactatttctattgccggttactttaagcctggaggtgtccgtggggaaagccacagacatatacgccgtaaacggcaccgagatccttctaccctgtacattctctagttgctttggcttcgaggacttacattttcgatggacctacaactcatcggacgcttttaagattctaattgaggggaccgtcaagaacgaaaagtcagatcccaaggtgacacttaaggacgacgaccgtatcaccctggtgggtagcacaaaggaaaagatgaacaacattagcatcgtcttgagggatctggaattcagcgatacaggcaaatatacatgtcatgtaaagaatcctaaggagaataatctccagcatcacgccaccatcttcctccaggtcgtggataggctggaagaggtagacaatactgtgacactgatcatcctggcggtggtgggcggggtgattggactgctgatcttaattctactcattaagaagttgattatcttcatactgaaaaagacccgggaaaagaaaaaggagtgtctggtgtcaagttccggcaatgacaatacagagaatgggctgccaggcagcaaggcggaagaaaagcctccttccaaggtttag

SEQ ID NO: 134703 - DNA, 285 bp, Artificial Sequence
  Description of Artificial Sequence: Synthetic coding sequence
atgcctggggccggcgacgggggcaaagcccctgcaaggtggctgggcacaggtctcttagtcgaggaagtggacaacacggttaccctcattattctcgctgtggtgggcggggtcatcggacttttgatcctcattttgctgatcaagaagctgattatattcatcctcaaaaaaacacgggaaaagaagaaggagtgtctcgtgtcttccagtggcaatgataacacggagaatggattgccggggagcaaggccgaggagaagccaccatccaaagtctag

SEQ ID NO: 134704 - DNA, 5970 bp, Artificial Sequence
  Description of Artificial Sequence: Synthetic coding sequence
atggcgatgttgccccctcccggtccccaatccttcgtccactttacaaagcaatccctcgcactaatcgaacaacggatcgccgagaggaaatccaaggagcctaaagaggagaaaaaggacgacgatgaggaagcacccaaaccttcatcggatctggaggcggggaaacagcttcccttcatctatggggatatcccacctggcatggtgtccgagccactcgaggacctggatccttattacgctgacaagaaaacatttatagtgcttaataagggcaagactattttccgctttaatgcgactcccgctctttacatgctgtcacctttctcgcccctcaggcggataagcattaagatcctcgtccacagcacgctgttcagtatgctgattatgtgtaccatcctcacaaattgcatcttcatgaccatgaacaacccaccagattggacaaaaaacgtggaatacacctttaccggcatctacaccttcgagtcccttgtcaaaattctggcaagaggattttgcgtgggggagttcacctttttgcgcgatccatggaattggctggattttgtcgtgatcgtctttgcctatctgactgaatttgtcaatctcggtaatgtcagcgcactgaggacatttagggttctgcgtgcactcaaaaccatcagtgtgatcccaggattgaagaccattgtgggcgctctgatccagtcagttaagaaactatcagacgtgatgatcctcaccgtcttctgcctatctgtgttcgctctcatcggtttgcagttgtttatggggaacctcaagcacaagtgcttccggaatagcctggaaaacaacgagaccctggagtctataatgaacacccttgaaagcgaggaggacttccgcaagtatttctactacctggaaggttctaaggatgctctgttgtgtgggttcagcacagactccgggcaatgtccagagggctacacatgcgttaagatcggtcgtaatccggactatgggtacacctctttcgacacattttcttgggcattcctggctctgttccgtttgatgactcaagattactgggagaacttgtaccagcagacactgagggctgcagggaagacgtatatgattttctttgtggtggtaattttcctcggctcgttctacctgattaacctaatcctcgctgtggtggccatggcctacgaagagcagaaccaggccaatatcgaggaagccaagcagaaagagctcgagtttcagcagatgttggacaggctaaagaaggaacaggaggaggccgaggcaatcgctgccgccgctgctgagtacacctctatcaggcgcagtagaattatgggcttatcggaaagctcaagcgagacctctaagctgagcagcaagtcagcaaaggaacgacggaaccggagaaagaagaaaaaccaaaagaagttatcttctggagaggagaagggggacgctgagaagctgtctaaatccgagtccgaggacagcatcaggcgtaagtcctttcacttaggagtggaaggccatcgacgcgcacatgagaagcggcttagcaccccaaaccagtcccctttgtccatccgaggtagcctcttctccgcaaggcggagtagtagaacaagcttgttctcctttaagggccgcggccgggatatcgggtcggagaccgaatttgctgatgacgaacactccatcttcggggataacgaatcacgacgagggtcactgttcgtaccgcaccggcctcaggaaagacgctctagcaatatcagccaagcttcccgtagcccccctatgctgccagtgaacgggaagatgcatagtgccgtggattgcaacggggtggtgtcacttgttgatggcagatccgctctgatgctgcccaacggacaattgttgcctgaagtcataatagacaaggccacctccgacgacagtggaacgacaaatcagattcacaaaaagagacgatgctcgtcctatctgttgtctgaggacatgctcaatgatcctaacctgcggcagcgcgccatgtccagggcgtccattctgaccaacaccgttgaagagcttgaggaatcaagacagaagtgtccaccgtggtggtaccgatttgctcacaaatttctcatatggaactgcagtccctactggatcaagttcaagaaatgtatttatttcatcgttatggacccatttgtggatttggccattacaatctgcattgtgttaaacactctttttatggccatggaacatcatccaatgacagaagagttcaaaaatgtgctcgcgatcggcaatctagtttttaccggaatctttgccgcagagatggtactgaagctgattgctatggacccgtacgaatactttcaggtgggatggaacatcttcgactctctcatagtcacactctccctagtcgagttgttcctcgccgatgtagaaggcctgtctgtccttcgttcatttcgcctgctgcgggttttcaaactggctaagtcctggcccaccctgaacatgctgattaaaatcattggaaacagcgtgggggcgctggggaacttaactcttgtgctggctattatcgtgttcatctttgccgttgttgggatgcagttgttcggcaaatcttacaaagaatgtgtttgtaaaattaatgatgattgcacactgcctaggtggcatatgaacgacttcttccattctttcctgattgtgttcagagtcctgtgtggagagtggatcgagaccatgtgggactgcatggaggtggccggccaagccatgtgtttaattgtgtatatgatggttatggtgatcggcaaccttgttgtgctgaacctgtttctcgctctcctgctgagctcattttcgtccgataaccttactgcaatagaggaggaccccgatgccaataatctgcagatcgccgtcacacgcattaagaaggggatcaattatgtgaaacagacattaagggaattcatcctaaaagcatttagcaaaaagccaaagatttcacgcgaaattcgccaagctgaagatttaaatactaagaaagaaaactacatctccaaccacaccttggcggaaatgagtaaaggacacaatttcctgaaggaaaaagataagatttccggtttcggctcgagtgttgacaaacatctcatggaggactccgacggccagagtttcattcacaatccctcactcaccgtcaccgtgcctatcgcacctggcgaatctgatcttgaaaatatgaatgccgaggaactctcatctgactctgactctgaatactccaaagtgcgtctgaatagaagctctagtagcgagtgttctactgtcgataacccactgcctggtgagggcgaggaggccgaggcggagcctatgaactctgatgagcccgaggcctgctttacagacggatgcgtttggcggttttcatgctgccaagtgaatatagaaagcggtaaaggtaagatttggtggaacatcaggaagacctgctataaaattgtggagcactcctggttcgagtcttttatcgtcctcatgattctgctttccagtggggcgctcgcgtttgaggatatttacatcgagcgtaagaagacaataaaaataatcctggagtatgctgataaaatctttacctacattttcattctggaaatgttgctgaaatggatcgcctacggatataagacctacttcaccaatgcgtggtgttggctggacttcctcattgtcgatgtgtccctggttaccctcgtggccaacaccctcgggtacagtgatcttggtcccattaagtctctccgaactcttcgcgcactccggccactccgtgctctgagtaggtttgagggcatgcgagtggtggtcaacgccctgatcggagcaatacctagcattatgaatgtgctgctcgtgtgcctcatcttctggctcatcttttccatcatgggcgtgaacttgttcgcaggcaagttttacgagtgcattaacacaaccgatgggtcacgcttccccgcctcacaagtgcccaaccgtagcgagtgttttgccctgatgaatgtctctcagaacgttcggtggaaaaatctgaaggtcaactttgataacgttggtttgggctacctctccctactccaggtggcaacttttaagggctggacgatcattatgtacgcagccgttgattcggttaacgtggataagcagcccaagtacgaatattcactttatatgtatatctacttcgtggtgttcattatctttggatctttcttcactctgaatctttttatcggggtaatcatagacaactttaatcagcagaaaaaaaagctcggcggccaggatatatttatgaccgaggagcagaagaaatattataacgccatgaaaaagctcggcagtaaaaaacctcaaaagccgatccctcgtcctggcaataaaatccaaggatgtattttcgacctggtcaccaaccaggcttttgatataagcatcatggtgctcatctgtctgaatatggtgacaatgatggtagaaaaggaaggccagtcacagcatatgacggaggtactgtactggattaacgttgttttcattattctgttcactggtgagtgtgttttaaaacttattagtttacgtcactactacttcactgttgggtggaacatcttcgatttcgttgtcgttattattagcattgtggggatgttcctcgctgacctgatagaaacgtattttgtgagccctaccctctttcgtgtgatcagattagctcgcatagggcgtattctgcgactcgtcaagggagcaaagggcattcggaccctcctcttcgccttaatgatgagcctccccgcgttgttcaacatcgggcttcttctgttcttagtgatgttcatctatgctatattcggcatgtcaaatttcgcctacgtgaaaaaggaggatggaatcaatgatatgtttaatttcgaaacctttggcaattccatgatctgcctcttccagatcacgacttccgctggttgggatggtctcctcgctcccatactcaacagcaagcccccggactgcgatccgaaaaaggtccatccagggtcaagcgtggagggagattgcggaaatccaagcgtcggaattttttattttgtgtcatacattatcattagtttcctggtagtggtcaacatgtacatcgcagttatcttggagaatttctcagtagccaccgaagagtctaccgaacccctgtccgaagatgacttcgagatgttttacgaagtgtgggagaaatttgaccctgatgctacacaattcattgagttctcaaagctgtcggactttgccgccgccttagaccccccgctcttaatcgccaagccaaacaaggtgcaactgatcgcaatggacctaccgatggtcagcggggacagaattcactgtctcgacatccttttcgcttttacgaagcgggtgctgggtgaatcaggagaaatggacagtcttcgcagtcagatggaggaacgcttcatgtccgcgaatccgtcaaaagtcagctatgagccaataacaactacactaaaaagaaagcaggaggacgtcagcgcgactgtaatccagagggcctaccggaggtacagacttcgccagaacgtgaaaaatatctcatccatctatatcaaagacggagaccgggacgacgacctcctgaataaaaaagacatggcctttgacaacgtgaatgaaaattccagtccagagaaaacagacgctactagtagtactactagtccaccttcctatgattccgtgaccaagccggataaggaaaagtatgaacaggaccgcacagagaaggaggacaaaggaaaagatagtaaagagtctaaaaaatag

SEQ ID NO: 134705 - DNA, 5970 bp, Artificial Sequence
  Description of Artificial Sequence: Synthetic coding sequence
atggccatgttaccaccgcctggtcctcagtcttttgtgcacttcactaaacagtcccttgctctcattgaacagcggatcgcagagcgcaagagcaaagaaccaaaagaagaaaagaaagatgacgatgaggaagctccaaaaccctccagcgacctggaggctggaaagcagctccccttcatctacggcgatattccaccggggatggtttctgagccccttgaggacttggatccttattatgccgataaaaagactttcattgtgttgaacaagggtaagactatcttccggttcaacgccacacccgccctctacatgctgagcccattttcccctctccggaggatttctattaagatcctggtgcactccacgttgttttcaatgctgattatgtgcacaattctgacgaactgtatcttcatgaccatgaacaaccccccggattggacaaagaatgtggaatacacgttcacagggatctatacgttcgagagcctggtaaagattctggcccgggggttttgtgtgggagagttcacgtttctgcgagatccttggaattggctggacttcgtggtgatcgtctttgcttatgtcacagaattcgttgacctcgggaacgtgagcgctcttagaacatttagagtcctgagggctctcaaaacgatatcagtgattccggggctgaagactatagttggggccttgatccagtctgtcaaaaaactgagcgatgtcatgatcctgactgtgttttgcctcagtgtcttcgccctcatcggcttgcaattgttcatgggaaacctcaagcataagtgctttagaaattcccttgagaataatgagacactagagtcaattatgaatactttggaaagcgaggaggactttaggaaatacttttattatctagagggctctaaggacgccttactgtgcggcttcagcactgattccggccagtgccccgaggggtacacttgcgtgaaaatcggacggaatcctgattatggatacactagctttgacacattttcttgggcatttctggctctctttcggcttatgacccaggactattgggaaaatctttaccagcaaaccttacgggccgccggtaaaacttacatgatcttctttgtcgtggtgattttcctggggtcattctatctgatcaatttaatccttgcggtcgtggcgatggcctatgaggaacagaatcaggcaaacattgaggaagctaagcagaaggagctggagttccagcagatgctggaccgcttaaaaaaggagcaggaggaggccgaggcaatcgccgctgctgccgctgagtatacctctatcagacggagtaggatcatgggcctgagcgaatcttccagcgagaccagcaagctgtcgtcaaagtctgccaaagaaagaagaaacaggcgaaaaaagaaaaaccaaaaaaagctaagttctggagaagaaaagggagacgcggagaaactatcaaagtcggaatcagaagacagcattcgtaggaaaagctttcacctcggggtggaggggcacaggcgagcacacgaaaagaggctgtctacgcctaaccagtcccctttatccatccgcggaagcctattttccgccaggcgcagctcgcgaaccagtctgttctcgtttaaaggcagaggtcgcgacatcgggagtgaaaccgagtttgccgacgatgaacattccatcttcggcgacaacgaatcacggaggggctccctgtttgtgccgcaccgccctcaggagcgacgttccagtaacatttcacaggcgagtcgatcccctcctatgttgcccgttaacggcaagatgcacagcgctgtcgattgcaacggagtggtaagcctggtcgacggaagatctgccctcatgctgcccaatgggcaactcttaccagaagtcatcattgacaaggcaaccagtgatgacagcgggactaccaaccagattcataaaaagagaagatgtagctcgtaccttcttagcgaagatatgcttaatgaccccaatctgaggcagagggctatgagccgggcttcgattctgactaatactgtcgaggagctggaagagtccaggcaaaagtgtcctccttggtggtatcgattcgcacacaagtttctgatctggaactgctcaccttactggatcaagttcaagaaatgtatctatttcatcgtcatggatccatttgtcgatctggccatcacgatctgtatcgtgttgaacactctctttatggccatggagcatcatcctatgaccgaggagttcaaaaatgtgctagccatcggtaacctggtcttcacgggtatctttgccgctgaaatggtactcaagttgatagcgatggacccttatgagtatttccaggttggctggaatattttcgatagtttgatcgtgactctttcacttgtggagttgttcctggcagacgtcgaaggtctaagcgtgctgaggtctttccgcttgttgagagtgtttaagcttgcgaagagctggcctactctgaatatgctgatcaagatcatcggaaacagcgtgggggcgcttggaaatctcaccctcgtcctggccatcatcgtttttattttcgcggtggtcggtatgcaactgtttggaaagtcttataaagagtgtgtgtgcaaaatcaatgacgattgcacgcttccacggtggcacatgaacgatttttttcactccttcctcattgtgtttcgggtgttgtgcggggagtggatagaaacaatgtgggattgtatggaggtcgcaggacaggcaatgtgcctgattgtgtacatgatggtgatggtgataggtaatctggtggtactgaatcttttcttggctctgctgttgtctagcttttcatccgacaacctgactgcaatcgaggaggaccctgacgcgaataacttacaaatcgccgtgaccaggatcaaaaaggggatcaactatgtgaagcaaactttacgggagttcatccttaaggcttttagcaagaagccaaaaatatctagagagatccgacaggcggaagatctaaatactaagaaggagaattacatttctaatcacaccctcgctgaaatgtcaaaaggccacaactttcttaaggagaaggataaaattagtggcttcgggtcttcagtggataaacacctcatggaggactctgacggacagtcctttatccataacccatccctgaccgtcactgtgccgatagccccaggcgagtctgaccttgagaatatgaacgctgaagagctgagctcagattctgactctgagtattctaaggtaagactgaatcgctccagcagttctgagtgtagtacagtcgacaacccattgcctggagaaggggaagaagctgaggctgaacccatgaactccgacgagccggaggcttgcttcaccgatggttgcgtgtggagattttcttgctgccaggtgaacattgaatcaggtaagggcaaaatctggtggaatatcagaaagacctgctataaaatcgtggaacacagttggtttgagtcattcattgtactgatgatcctcctgagttcaggtgcacttgctttcgaggatatctacattgagcgaaagaaaactattaagatcatcttggagtacgcagataagatttttacctacatttttattctggagatgctgcttaagtggatagcctatggctataagacgtatttcacaaacgcctggtgctggttagatttcctgatagtagatgtttcattagtgactctggtggctaatacgttagggtattccgacctggggccaatcaagtcactgcgcactcttagggctctccggcccctcagagccttgtctcggttcgagggaatgagggttgtggttaatgccctgatcggtgccatcccaagcattatgaacgtgctgctggtgtgcttgatcttctggctcatattcagtataatgggggtgaacttattcgctggcaaattctacgaatgcatcaacactacggacggctctaggtttccagctagtcaagtacctaatcggtcagagtgtttcgcccttatgaacgtgtctcagaatgtacgatggaaaaacctcaaagtcaactttgacaacgtcggattgggctacttatcgctactccaggtcgccacctttaagggatggacaattataatgtatgcagcggtggactcggtgaatgtagacaaacagccaaaatacgagtattccttgtatatgtacatttactttgtggtcttcataatctttggctccttttttaccttaaatcttttcattggcgtgatcatcgacaattttaaccagcagaagaagaaactgggggggcaagacatatttatgactgaagaacagaaaaagtactataacgccatgaagaaactgggctcaaagaaacctcaaaaacctatccctagacccggcaataagattcaagggtgcatcttcgatctggtaacaaaccaggccttcgatatctcaatcatggtccttatctgtctaaatatggtgactatgatggtggagaaagagggacagtcacagcacatgacagaggtgctgtattggattaacgtggtctttatcatattatttacaggggagtgcgtcctcaagcttatttcattgcgtcactactacttcacagtaggctggaacatctttgactttgtcgtggtgattatctccattgtcgggatgtttctggccgatctgatcgagacctattttgtgtccccaactttatttagagttattcggctagcccgtataggtcgcattcttcgacttgtgaagggcgctaaaggaattagaactcttttatttgcccttatgatgtctctccccgcactgtttaatatcggcttattgctgtttctggtgatgttcatctatgcaattttcggaatgtcgaattttgcatatgtcaagaaggaagacggtatcaacgatatgtttaatttcgagacttttgggaattctatgatctgtctcttccaaataacaacctcagctggctgggatgggcttctggccccaatacttaactcgaagccgccagattgcgaccctaaaaaggtgcatccaggttcctctgtggaaggggactgtggcaacccttcagttgggatcttttacttcgtctcctacattataattagcttcctagttgtagttaatatgtacatcgccgtgattttggagaatttcagcgtggccactgaagagtccaccgagcccctttcagaggatgattttgagatgttctatgaggtttgggagaaatttgaccccgacgctactcagtttatagagttctcaaaattatccgattttgctgcggcgctggaccctccgctgctgatcgctaagcctaacaaagtacagctaattgctatggacctcccaatggtgagtggagacagaatccattgccttgacatcctatttgcctttaccaagcgggtgctcggggaaagcggagaaatggacagcctccggagtcagatggaggaaagattcatgtccgctaacccttcaaaggtttcttacgagcccattacaaccacgttgaaacgcaaacaagaggacgtaagcgctactgtgatccaaagggcctataggagatataggctgagacagaatgtgaagaatattagctcaatctacatcaaggatggagacagagatgacgacctcctcaacaaaaaagacatggcattcgacaacgtgaacgagaactccagccccgaaaagaccgatgctacctcttccaccacatccccacccagctacgatagtgttacgaaacccgacaaagagaagtacgagcaggatagaacggaaaaagaagacaaggggaaggactccaaagagtcgaaaaaatag

SEQ ID NO: 134706 - DNA, 5967 bp, Artificial Sequence
  Description of Artificial Sequence: Synthetic coding sequence
atggccatgttgccccccccaggcccccaatcttttgtgcatttcactaagcagtcgctcgctcttatcgagcagcgcatcgccgagagaaagtctaaggagcccaaggaggagaagaaggacgacgacgaggaagcacccaaaccttcaagtgatctcgaggctggaaaacagctgccattcatttacggcgacattccccctgggatggttagtgagccccttgaggatttagatccatactacgccgacaagaagaccttcatcgtgctcaacaaagggaaaaccatttttcgtttcaatgcgacgccagcactgtatatgttgtccccattttccccgctgcgcagaatatcaataaagatcctggtgcactctctgttcagtatgctcattatgtgtactatcctgactaattgtatctttatgactatgaacaatcctcctgactggaccaagaacgtggagtacaccttcaccggcatatatacttttgagtctctggtcaagatactggcacggggcttctgcgttggggaattcactttcttacgcgatccttggaattggttggacttcgtagtcatagtgttcgcctatctgactgagtttgttaacttgggaaatgtaagcgcattgcgaacattccgtgtgctgcgtgctctgaaaacaatttcagttatcccgggactgaagaccattgtgggagcactaattcagtccgttaagaagctgtctgatgtgatgatcctaactgtattctgtctgtccgtgttcgccctgattggactgcaactttttatgggtaatctgaaacacaagtgctttaggaacagcctagaaaacaatgagactctggagagtataatgaacactctcgagagcgaggaagatttcaggaagtatttctactatctcgaggggagcaaagacgccctcctgtgtgggttttcaacggattcaggtcaatgcccagaggggtacacctgcgtcaagatcggtaggaacccagactatggatacacatcgttcgacaccttctcttgggcgttcttagccctgtttaggctgatgacacaagattattgggagaatctgtatcagcagacactgagggccgcagggaaaacatatatgatcttcttcgtggtggtgatttttctcggctccttctatctgatcaatttgatcctggcggtggtcgccatggcctacgaggagcagaaccaagcgaatattgaagaagccaagcagaaggagctcgagtttcagcagatgctggaccggctgaagaaagaacaggaggaggccgaggcgattgccgctgcagcagccgagtatacctctatcaggcgctcacggatcatgggcctttcggagtctagcagtgaaacgtccaagctgtcaagtaaaagcgccaaagagcggcggaacaggagaaagaagaagaatcagaagaaactgagtagcggtgaggagaagggagatgccgaaaagctttcaaaatcagagagcgaagattccatcagaaggaagtccttccacctcggggtcgaaggccatcgccgcgctcacgagaaaagacttagcaccccgaaccagagccccctctccattcgaggatctttgttctctgcgaggcggagcagccgcacttcactctttagttttaaggggcgtggaagggatatcgggtctgaaacagaattcgcggatgacgaacacagtatattcggtgataatgaatccagaaggggatctctgtttgtgccccaccggccgcaggagcgccggtcgtcgaacattagtcaagcctcaaggagcccgcccatgctgccggtcaacggaaagatgcactccgccgttgactgcaacggggtggtgtctctggtagatggtagatccgccctcatgttaccaaacgggcaactgctgcctgaggttataatcgacaaggctacctccgatgattctggaacgactaatcaaatccacaagaagcgtcgatgttcctcgtatctgctgtcagaagacatgttgaacgatcccaacctccggcagcgggcaatgtcaagagcttccatcctgacaaataccgtggaggagcttgaggaatcgcggcaaaagtgtcccccatggtggtatcggtttgcgcacaagtttctcatttggaactgctctccctattggattaagtttaagaagtgcatctactttatagtgatggacccctttgtggaccttgctatcacgatttgcatagtgcttaataccttgtttatggccatggagcatcatcctatgactgaagaattcaagaatgtgctagcgataggaaatcttgtttttacgggcatttttgctgcggagatggttttaaagttgatagcgatggatccctacgaatacttccaggttggatggaatatctttgactcccttatcgtaacactcagtctggtggagctctttctggcagatgtggagggcctgagcgtgctgaggtcattcaggctcctgcgtgtctttaagctcgctaaatcatggcccaccctgaatatgctgattaaaatcatcggaaattccgtgggggctctaggaaatctgacccttgtgctggctatcatcgtgtttatattcgcagtcgttggcatgcagctgttcggcaagtcctacaaggaatgtgtgtgtaaaattaatgacgattgcactctaccaagatggcacatgaacgactttttccattccttcttaattgtcttccgggtcttgtgtggcgaatggatagagaccatgtgggactgtatggaggtcgctgggcaggccatgtgtctgatcgtctacatgatggtcatggtgattggcaacctggtcgtgctgaatttattcttggcactactgttgagcagcttttcttctgacaacctgacagctattgaggaagatcctgatgctaataacttacagatcgcagtgaccagaattaagaagggaattaactacgttaagcaaactctgagagaattcattctgaaggcattctccaagaaaccaaagataagccgggagattcggcaagctgaagacctaaatacaaaaaaggaaaattatatttccaatcatacacttgccgagatgagcaaagggcacaactttctcaaggaaaaagataagattagcggttttggatcttccgttgacaagcacttaatggaggatagcgacggacagtcttttattcacaacccttccttaaccgtgactgttcctattgctccaggagagagtgacctggaaaacatgaatgctgaagaactgtccagcgattcagacagcgaatattctaaggtacgtcttaatagaagttcctccagcgagtgcagtactgtggataatcctctccccggcgagggcgaagaagctgaggccgaacccatgaacagcgacgaaccagaggcgtgtttcaccgacggttgcgtctggagattcagttgttgccaggtgaacattgaaagtggcaaaggaaaaatttggtggaatatacgaaagacatgctataaaatcgttgaacactcttggtttgaatctttcattgttttgatgattctgctttcaagcggagctctagcctttgaggatatttatatagagaggaagaagacaatcaaaataattttggagtacgctgataagatatttacttacatctttattttggagatgctactgaaatggattgcatatggctataagacttatttcacgaacgcttggtgctggctcgattttctaatagtggatgtgagcctggtgactcttgttgcaaacacacttggatatagcgatttgggccctatcaaaagcctcagaacactgagggccctgcggccattacgggctctctctcgctttgaagggatgcgggttgtggtgaacgcgcttataggagccatcccgtccattatgaatgtgctcctggtatgtctcatcttttggcttattttttctatcatgggtgtgaatttattcgcaggtaagttctacgagtgtatcaacactactgatggtagtcgattccctgcgtcacaagtgccaaatagatctgagtgctttgccctgatgaacgtgagccagaatgtcaggtggaaaaatctcaaggttaactttgataacgtgggattaggatatctatctctccttcaggttgctaccttcaaaggctggaccattataatgtatgcggcagtggattccgtaaatgtcgataagcagcctaaatatgagtatagcctttatatgtacatttacttcgtggtgttcatcattttcggaagttttttcaccctgaatctgtttatcggagtgattatcgataacttcaaccaacaaaaaaagaagctgggtggccaagatatcttcatgactgaagaacagaagaagtactacaatgcaatgaaaaagctcggcagcaaaaaaccccagaagccaataccacggccgggcaacaaaatccagggatgtatctttgatcttgtgacaaaccaagcattcgacatctccatcatggttctaatctgcttgaatatggttacaatgatggtagaaaaggagggtcagtcccagcacatgactgaagtactttactggatcaatgtggtcttcatcatcctgttcactggcgagtgcgtattgaagctgatctcccttagacattactatttcacagttgggtggaacatctttgactttgtcgtcgtcataatatccattgtggggatgttcctagcagatttgatcgagacttattttgtaagccccacacttttccgtgtcatacgtttggcccgaatcggtagaatcctgaggcttgtgaagggcgccaagggcatcagaacattgcttttcgccctcatgatgtcgcttccagcattgtttaacatagggcttctactctttctggtgatgttcatctatgcaatcttcggcatgtccaatttcgcctatgtgaaaaaggaagatggaatcaatgacatgtttaatttcgaaaccttcgggaattcaatgatatgcctattccagatcacaacaagcgctgggtgggacgggctactcgctcccatcctcaacagtaaaccaccagactgcgatccgaagaaggtccaccctggatctagtgtggagggtgattgcggaaaccctagtgtgggtattttttacttcgtctcatacatcattatcagtttcttggtggtggtgaatatgtatatcgcagtaattcttgaaaacttctctgtggctacggaggagagtaccgaacccttgtcagaagatgacttcgagatgttctatgaggtctgggagaagttcgaccctgacgcaacccagtttatagagttcagtaaattatctgactttgctgcagccctcgatccacctcttctgatcgctaagccaaataaggttcagctgatcgctatggatctccccatggtgtccggcgacagaatccactgcctcgacattttgttcgcctttacaaaaagagttctcggcgagagtggagaaatggattccctgcgctcccagatggaggaaaggttcatgtccgcaaacccctcaaaagtgagctatgaacctatcactaccactttaaagagaaagcaggaggacgtatctgctaccgtaattcaacgggcctatagacgctatcgactgcgtcagaatgttaagaatatctccagcatatacattaaggacggggacagagatgacgatctgctgaataagaaagatatggccttcgataacgtaaacgagaattcctcccccgaaaagaccgacgccaccagctccaccacatctcctccatcatatgatagcgtgaccaaacccgataaggaaaaatatgaacaggatcgcaccgagaaggaggacaaaggaaaggactcaaaggaaagcaagaagtag

SEQ ID NO: 134707 - DNA, 5934 bp, Artificial Sequence
  Description of Artificial Sequence: Synthetic coding sequence
atggcgatgctccctccaccgggaccgcagtccttcgtacactttactaagcaaagccttgcgctgattgagcagcgtatagccgagcgaaagtctaaagagcccaaagaggagaagaaggatgacgatgaggaagctcccaaaccgagctctgacctagaagcaggtaaacagctgccatttatttatggcgacataccaccagggatggtgtctgagcctctggaggacctcgacccttactatgctgataaaaaaaccttcatagtactgaacaagggcaagaccatttttagattcaacgcgaccccagccctctacatgctgagtccatttagccctctgagacgcatctccattaagattctggtgcacagtctcttttcaatgctcatcatgtgtacaatcttaaccaactgcattttcatgaccatgaataacccccctgactggacaaaaaacgtagaatatacatttactgggatttacactttcgaaagtctggttaaaatcctggcgcggggattctgtgtgggagaatttacttttttgagagatccttggaactggttggacttcgtcgtgatcgtctttgcctatttgacggaatttgtgaaccttggcaacgtttccgctttgagaacattcagggtcctgcgggcactcaaaacgatctctgtgattccggggctgaaaaccattgtgggcgcgctgattcaaagtgtgaagaagctttcagatgtaatgattctgactgtgttttgcctgagcgtttttgcgctgatcggactgcaactttttatgggaaatctaaagcacaagtgtttcaggaatagcctggagaacaacgagacccttgagagcattatgaacaccctggaatcagaagaggattttcgcaaatatttctactatttagaaggctcaaaagacgctctcctctgcggattcagcacggattcgggccagtgcccggagggctatacatgtgtaaagattgggcgcaatcccgactacgggtacacatccttcgacacattcagctgggcttttttggcgctcttccgcctgatgacccaagactactgggagaacttataccagcagacactcagggccgccggcaaaacgtacatgatattcttcgtggtggtgatctttctggggagcttctatcttattaatttgatattagcagtggttgctatggcatatgaagagcagaatcaagccaacatcgaagaggctaaacagaaagagctagagttccagcagatgttggatagactgaagaaggagcaagaagaggccgaggctatcgcggctgccgccgctgagtatactagcattcgacggtcccgcatcatgggcctgagcgagtcttcatctgaaacgtctaagttgagttccaaatctgcgaaggaacggcgcaacaggagaaagaagaagaaccaaaagaaactcagctctggcgaggaaaagggggacgctgaaaaactgtcgaagtcagaatcggaggatagcatacgtcgcaagtcttttcacctcggagtggagggccaccgccgcgcccacgagaagcgactgtcaacaccaaatcagtctcctttatccattagagggtcattgttctccgcccggaggtcaagcagaacatcgctgttctctttcaagggacggggcagagacatcggcagcgaaaccgagttcgccgacgacgaacatagcatctttggtgataatgaatctcgtcgcggcagtctgttcgttcctcaccggcctcaggaaaggcggagttctaatatttcccaggccagtcgcagtccccctatgttgcccgtcaatggcaagatgcactccgccgtggactgtaatggcgttgtctcccttgtcgacggcaggagcgccttaatgctgcccaatgggcaacttctgcccgagggcactacgaaccagatacacaagaaacgcaggtgcagttcgtatctgctgagcgaggatatgctcaacgatcctaacctaaggcagcgcgctatgtcgcgagcctccatcctgacaaacacagttgaagagctcgaggaaagtaggcagaaatgtccgccttggtggtatcggtttgctcacaagttcctgatctggaattgttcaccttactggataaaatttaaaaagtgtatttactttattgtgatggatccttttgtcgatcttgcgatcaccatctgcatcgtgctgaataccctgtttatggctatggaacatcatcctatgacagaggaattcaaaaatgtgctggcaatcggaaatctggtgttcaccgggattttcgcggccgagatggttctcaaactgattgctatggatccttatgaatacttccaggtgggctggaatatcttcgacagcctgatcgtcaccttatcactcgttgagctgtttttggccgacgtcgaaggactcagtgtgctgcggtcctttcgcctgctgcgcgtttttaagctggctaagtcctggcccaccctcaacatgctgattaaaattatcgggaactcagtgggtgctttaggaaatctcaccctggtgctcgctataatagtgttcatctttgctgtggtgggcatgcagctgttcggcaaaagttacaaggaatgcgtttgcaaaataaacgatgactgcacacttccgaggtggcatatgaatgacttctttcactcttttctcatcgtctttcgcgtcttgtgcggtgagtggatcgagaccatgtgggattgcatggaggtggccggacaggccatgtgtttgattgtatatatgatggtgatggtaatcgggaatcttgttgtgttgaatctattcctggcactcctgctgtcttctttctctagtgacaatctgacagccatcgaggaagatcctgatgccaataatcttcaaattgccgtgacacggattaaaaaaggaataaattacgtgaagcagactctgcgggagttcatcctgaaggcttttagcaagaagccaaaaatcagccgcgaaataaggcaggcagaagacctgaatactaagaaggagaactacattagtaatcataccctggcagaaatgagcaaaggccataattttctgaaagagaaagacaagatcagcggattcgggagttccgtcgacaaacacttgatggaagactctgatgggcagagttttatccataacccatccttgacagtgactgtccctatcgccccaggtgaatcagaccttgagaacatgaatgcagaggagctctcctctgattctgacagcgagtactccaaagttagattaaacagatcaagctccagcgaatgttcgacggtcgataatcctttacctggcgaaggcgaagaggccgaggccgagcctatgaattcggatgagccagaggcttgttttaccgatggctgcgtgtggcgattcagttgttgccaggtgaacatagagagcggcaagggaaagatatggtggaacatacgtaagacctgctacaaaatcgtggagcatagttggtttgaatcctttattgtactgatgattcttctgtcaagcggggcactcgcattcgaggacatttacattgaaaggaaaaagaccatcaagataatcttagaatatgctgacaaaattttcacctatatctttatactagaaatgctgctgaaatggatagcctatggatacaaaacatattttactaatgcttggtgctggctcgatttcctcattgtggacgtaagtttggtcaccttggtggctaacacactcggatatagcgatttgggccctattaagagcctcaggactctgagagcgctcagaccacttagagcgctaagtaggttcgaagggatgcgcgtggttgtgaacgccctgatcggcgccattccctctataatgaatgtgctgctggtgtgcctgatcttttggctgatcttcagcattatgggggtcaacctgtttgcgggaaaattctacgaatgcatcaatactacagacgggagcagatttcctgcatcccaggtacccaatcgtagtgagtgttttgctctaatgaacgtctctcagaatgtgagatggaagaatcttaaggttaattttgataatgtgggcctggggtacctgtccctgctgcaggtggccacattcaaaggttggactatcataatgtatgccgctgtagacagtgtaaatgtcgacaagcaacccaaatacgagtacagtctctacatgtatatttacttcgtggtgttcattatctttggctctttttttacgctgaacctcttcattggcgtaatcatcgacaactttaaccagcaaaagaagaagctcggaggtcaggacatcttcatgacagaagaacagaaaaaatactataacgccatgaagaagctaggtagtaaaaagccccagaagccaatcccaagaccaggcaacaagatccagggatgcatctttgatctcgtaaccaatcaggcttttgatattagcattatggttttaatctgtttgaatatggttactatgatggtggagaaagagggtcagtcacaacacatgaccgaggtgctgtactggatcaacgtagtttttatcatcctcttcacaggcgaatgcgtgttgaagctcatcagtctgaggcattactacttcactgtggggtggaacattttcgattttgtggtcgttatcatcagtattgtgggcatgtttcttgcagatctgatcgaaacttactttgtgagtcccacactgtttagggtgatccggctggccaggatcggaaggattcttcggctggttaaaggggccaaaggcatccggacgctgctctttgcactgatgatgtctctgccagctctctttaacataggccttctactttttttggtgatgtttatctatgcaatttttggaatgagcaactttgcatacgttaagaaggaggatggtatcaacgatatgttcaattttgaaacgttcggcaattcgatgatttgcctgttccaaattactacgtccgccggatgggatgggttgctggctccaatcttaaattccaaaccccctgactgtgatcctaaaaaagtgcaccctggctcctcagtggaaggggactgcggcaatcccagcgtgggtatcttctacttcgtttcatacatcatcatctcctttctggttgtggtcaacatgtacatcgccgtgatactagaaaacttcagcgtcgctaccgaagaatctaccgaacccttgtccgaggacgatttcgagatgttttatgaggtgtgggagaagtttgatccggacgccacccagttcattgagttcagcaaactgtccgactttgctgccgctctagatccccctttgctgattgcaaaaccaaataaagtgcagctcattgctatggatctaccgatggtttccggggatcggatccactgtctcgatattctcttcgcatttaccaagagagtgctaggagagtcaggagaaatggactccctccgtagccaaatggaggagaggttcatgagcgctaaccctagcaaagtgtcatacgagcctatcaccaccacgcttaagaggaaacaggaagacgtgagcgccactgtcattcaaagggcctacagacggtacagactgcggcagaatgttaaaaacatttcttcaatatacatcaaagacggggatcgggatgatgatctgcttaacaaaaaagatatggcattcgataatgttaacgaaaactctagcccagagaaaactgatgctaccagctctaccacgagccccccatcctacgattctgtcacaaaacccgacaaagaaaagtatgagcaggatcgaactgagaaagaagacaagggcaaggactcgaaggaatccaaaaagtag

SEQ ID NO: 134708 - DNA, 1620 bp, Artificial Sequence
  Description of Artificial Sequence: Synthetic coding sequence
atcctaacgaattgcattttcatgacaatgaacaaccccccggactggaccaaaaacgtagagtacacttttaccgggatatacacgtttgagtccctggtgaaaatcctggcacgcgggttctgcgtgggggagttcactttcttaagagatccttggaactggctcgactttgtggtcatcgtcttcgcatacgtgacagaatttgtcgacctcggcaacgtctccgcgctgcgcacattcagggtattacgggctctgaagactattagtgtcatccccggcttgaaaaccatcgtgggtgcgctgatacagtctgtcaagaagttatccgacgtaatgatactgacagtgttttgcctctccgtttttgcccttatagggctacagcttttcatgggtaacctgaagcacaaatgtttcagaaacagcctagagaacaatgaaacactggagtcaatcatgaacaccctggagagtgaagaggatttccgaaaatacttctactacttggaggggtccaaagatgctctcttgtgcgggtttagcaccgattcgggtcaatgccccgaaggctacacttgcgtcaaaattggccgtaatccggactacggctacacatcctttgatacattttcctgggcgttcctcgccttattccgtctaatgactcaggactactgggaaaacctatatcaacaaaccctgagggccgccggcaaaacttacatgatcttctttgtggtcgtgattttcttggggtccttctatctgattaatctgattctggcagtggttgcaatggcatacgaagagcagaaccaggccaacatagaagaggccaagcagaaggagttggagttccaacagatgttagatagactgaagaaagagcaagaggaagctgaggcgattgctgcggctgctgccgagtacacttctattagaaggtcaagaattatgggactttcagagtcatccagcgaaacgagcaagctctcaagcaaatccgctaaagagaggcgtaatcggaggaagaaaaagaaccagaaaaagctctcttccggtgaagagaagggcgacgccgaaaagctttcaaaatccgaatccgaggatagcatcaggcgaaaaagcttccacctgggcgtagaagggcatcgaagagctcatgagaagcgactctccactcctaatcagtctcctctcagtatacgtggttcacttttttctgccagacgtagctctcggacatctcttttctccttcaaggggcgcggaagggatatcgggtccgaaacagagtttgcggacgacgaacactctatctttggggacaatgaatcgcgccggggctcgctcttcgtcccacatagaccacaggagcgcaggagttcaaacatcagccaagccagcagaagtcctcctatgctccctgttaatggaaagatgcatagcgccgtcgactgcaacggggtcgtctcgttggtcgacgggcgttctgcactgatgctgccaaacggccaactccttcccgaagtgattattgataaagccaccagtgacgatagcggcaccaccaaccagattcataagaaaagaagatgtagctcctatctgtag

SEQ ID NO: 134709 - DNA, 198 bp, Artificial Sequence
  Description of Artificial Sequence: Synthetic coding sequence
atggcaaatttcctgctgcctcgaggaacatcaagttttcgccggtttacgcgtgaatccctggccgcgatcgagaagaggatggcagaaaagcaagcccgtggcagcacaaccctgcaggagtctcgggaaggcctgcccgaggaagaagctcctcggcctcagttggatttgcaggcgtcaaaaaagctgccctag

SEQ ID NO: 134710 - DNA, 6051 bp, Artificial Sequence
  Description of Artificial Sequence: Synthetic coding sequence
atggcaaactttcttctgcctagagggacatctagtttccgaaggtttacacgggaatcccttgccgcaatcgagaaaagaatggcagaaaaacaggctagaggctccacaacccttcaggagtctcgtgaggggttgcccgaggaggaggccccccgaccccagctggacttacaggcttccaagaaactccctgacctttatgggaacccgccgcaggagctgattggggaacctctggaggatctagatcctttttacagtacacaaaaaacttttattgtactgaacaagggtaaaacaatcttccggttcagcgccactaatgctctgtacgtcctgtcaccatttcatccaataagacgggctgccgtgaagatcctggtgcattcgctttttaacatgttgatcatgtgtactatactcacaaactgcgtgttcatggcccaacacgatccccccccgtggaccaaatacgtggaatacacattcaccgctatatacacattcgaatcccttgtaaagattttagcgcgcggcttttgcctacacgcgtttactttcttacgggacccttggaattggcttgatttttctgttattattatggcctacacaaccgagttcgtggatcttggaaacgtgagcgccctcaggacctttagggtgcttcgggccctgaaaactatttcagtgattagtggtctgaaaacaatcgttggagccctcattcagtctgtgaaaaaactggctgatgtgatggtattgaccgtgttttgtctgagcgtgtttgctctgattggacttcagctatttatgggcaatctgaggcacaaatgtgttcgcaacttcacagccctcaacgggactaacgggagcgtcgaagcagacggcctggtgtgggaatcactggatttatatctctctgatcctgaaaattatttgctcaaaaacggaacgagtgatgtcctgctgtgtgggaacagttcagacgcaggtacctgtcccgagggataccgctgtttaaaggccggggagaaccccgaccacggctataccagcttcgattcgtttgcatgggcgtttttggcgctgtttcgtctgatgacacaggattgctgggagcgcctttaccagcagaccttgcgctccgccggaaaaatctacatgatttttttcatgttagtgatattccttggctctttctacctcgtgaacctcatcttggcagtcgtagccatggcttacgaggaacaaaatcaggctaccatcgcagaaacagaggaaaaggagaagagatttcaggaagccatggaaatgctgaagaaagaacacgaagctcttactatcaggggagtggacacggtgagtcgcagctccctcgaaatgtcgccactcgctcccgtcaacagtcatgagagaaggagtaagagacggaaaagaatgagctcagggacagaggagtgcggcgaggaccgccttccgaagtctgacagcgaggatgggcctagggcaatgaaccatctctctctgacaagaggcttgagccgtacctctatgaagcccagaagcagtcggggatctatttttacatttcggaggagagatttggggagcgaagccgacttcgcggacgacgaaaacagcactgctggcgagtcggagagccatcacacttcactgcttgttccctggccattaagaagaacctcagcacaaggacagccatccccagggacatcagctccaggccatgccctccacggcaaaaaaaatagcaccgtggattgtaacggtgtagtaagtttgcttggagccggagatccagaggccacttcaccaggatcccacctgcttcggcccgtaatgcttgagcatccccccgatacgactacgccttcagaggaaccaggagggccacagatgctgacctcccaggcaccttgtgtggacgggttcgaggaacccggtgccaggcagagggccctatccgccgtgtccgtgctgacatcagctttggaagagttggaggagtctcgccacaagtgcccaccctgctggaaccggctagcacaacggtaccttatttgggagtgttgcccattgtggatgtcaattaaacagggtgtgaagctggtggtgatggaccctttcacagacctgactatcaccatgtgtatcgtcctcaataccctgtttatggcactagagcactacaatatgactagcgagtttgaggagatgcttcaggtgggcaacctcgtgttcaccggaatttttaccgccgagatgacatttaaaatcatcgccctggatccatactactactttcaacaggggtggaatattttcgatagcattatcgtcattctgagcctgatggaactgggactttcccgcatgagtaatctgagcgtactccgctcatttcgactgttgagagtctttaagctggctaagtcttggcctaccctgaataccctgataaagattattggcaacagcgtcggcgccctggggaatctcacgctcgtactggcgatcattgttttcatattcgccgttgtcgggatgcagctgtttggtaagaactattcagagttacgggactctgattctggactgctcccacgctggcacatgatggattttttccacgcttttcttataatattcagaatcttatgtggtgagtggattgagaccatgtgggactgcatggaggtctctggacaatctctgtgtctactcgtattcttgctggtgatggtaatcgggaatctcgtcgtgttgaatttgtttctggctttattactctcctccttcagcgctgacaacttgaccgctcctgatgaggatagagagatgaacaatctgcagctagccctggcgcgcatccagagaggcctgagattcgtgaagcgcactacttgggatttttgttgcggcctgcttcgacagaggcctcagaagccggctgcactcgcagcccaaggacaactgccgagttgcatagccaccccctacagccctccacctcccgaaacagagaaggtgccccccacacgcaaggagaccaggtttgaagagggggagcaacccggccagggcacaccgggagatcccgaaccagtgtgcgtccctattgcagtcgctgaaagtgataccgatgaccaagaggaagacgaggagaacagcctcggaactgaagaggagagcagtaagcagcaagagtcccagcctgtctccggcggccccgaagccccccccgactcccgaacctggagccaggtctcagccacagcaagctccgaagcggaagccagcgcatcacaggccgattggagacagcagtggaaagccgaaccacaggctcccggttgcggcgagacgccggaggacagctgttccgaagggtctaccgctgatatgacaaatacagctgagctgctcgaacagatacccgacttagggcaggacgtaaaggacccagaggactgcttcacagaagggtgtgtgcgtagatgcccctgttgtgcagtggacaccacacaggccccggggaaggtgtggtggaggttgcggaagacctgctatcatatagtggaacatagttggttcgaaacctttattatcttcatgattctgcttagttccggggccctggctttcgaggatatctatctagaggagcgcaagacgatcaaggtgctgttggagtacgcagacaaaatgtttacctacgtgttcgtgctggagatgttgcttaagtgggtcgcctacggatttaaaaaatattttaccaatgcctggtgttggctggactttctaatagtggatgttagcctcgtgagccttgttgctaatacactggggtttgctgagatggggccaattaagtccctccggacactcagagctcttcgccctttgcgcgctctttctagatttgaggggatgagagttgttgtcaacgctctggttggtgctatcccgtcaattatgaacgtgttactggtgtgcctcatcttttggttgatattcagcataatgggcgtcaacctgttcgctgggaagttcggccgctgtattaatcagaccgagggggatctgcctctgaattacaccattgtcaacaataaaagtcagtgtgaatctcttaatcttactggcgaattgtactggacaaaggtcaaggtgaactttgacaacgtcggtgcaggatacctggccctgcttcaggtggccacgtttaagggctggatggacatcatgtacgccgccgtggattctcgggggtatgaggaacagccacagtgggagtataacctttatatgtatatctatttcgtaatcttcatcattttcggtagcttctttacactgaatttatttattggcgtgatcattgacaacttcaaccagcagaagaaaaagctgggcggacaagatatatttatgacggaggaacagaaaaaatactataacgctatgaaaaaattaggatcaaagaaaccacaaaagcccatccctcgaccactgaataaatatcaggggtttatcttcgatatcgtgactaaacaggcttttgatgtgacaatcatgtttctcatttgtctcaacatggttactatgatggtcgagactgatgatcagagccctgagaaaattaacatcttggctaagattaatctactcttcgtggccatattcactggagagtgtattgtgaaactcgcagctctgagacactattactttactaatagctggaacatcttcgacttcgttgtcgttatcctctcaatcgttgggacagtcctctcagacatcatccaaaagtattttttcagcccaacactgttccgcgtgattaggcttgcccgtatcgggcgcattctgagactgatccgaggcgccaaaggcataaggaccctgctgttcgcattgatgatgtccctgcctgccctctttaacattggactactcctgtttctcgtgatgtttatttattccatctttggtatggcaaactttgcttacgtgaagtgggaagcaggcatcgacgacatgttcaactttcagactttcgcaaatagtatgctgtgtctgttccaaatcacaacctccgctggctgggacggcctgctgagtccgatcctgaataccgggcccccctactgcgatccaacacttccaaattctaatggcagccggggcgattgtggaagccccgctgtcggcattttgttctttacaacctacatcattatctctttcctgattgtggtgaacatgtacattgctatcattcttgaaaatttcagcgttgccacggaggagtcaactgagcccctcagcgaagatgattttgacatgttctatgagatctgggaaaagtttgaccccgaagccacccagtttattgaatacagcgtgctgagcgacttcgcagatgcactgagcgaaccgctaagaatcgctaaaccaaaccaaatctccttaattaatatggacctgccgatggtgagtggtgaccgtatccattgcatggacatactgtttgcattcactaaacgggtgctcggagaatccggagaaatggacgccctgaaaatccagatggaggagaagttcatggctgctaacccctccaagatttcttatgaacctattacaactacactcaggagaaagcacgaggaggtgtcagccatggtgattcagcgggcctttcgccgtcacctcctccagagaagcctcaagcacgcaagttttctgttccggcagcaggcaggttctgggctgagcgaggaagacgcaccagaacgtgaggggctgatagcctacgtgatgtccgaaaacttctctagaccgctggggcctccatcttcatcatcaatttcctcaacttcgtttccgccctcctatgactcagtaacacgcgctacctccgataacctacaggttcgaggttctgactacagtcacagtgaagatctggccgattttcccccaagcccagaccgggatcgagaaagtattgtgtag

SEQ ID NO: 134711 - DNA, 342 bp, Artificial Sequence
  Description of Artificial Sequence: Synthetic coding sequence
atggcccaacacgatccccccccttggactaagtacgtggagtatgttagtgagaatattaaacttggtaacctgtccgccctgagaacgtttagggtattacgcgctctcaagactatcagcgtcatcccaggattaaaaactattgtcggggccctcatccagtcggtcaagaagcttgctgacgtaatggttttgactgtgttctgcctctcagtgttcgcgctcatcggtctgcaactctttatggggaatctgagacataaatgcgttcgcaatttcaccgcactgaacggaactaacgggtcagtggaggccgatggactagtctgggaaagctag

SEQ ID NO: 134712 - DNA, 6051 bp, Artificial Sequence
  Description of Artificial Sequence: Synthetic coding sequence
atggcgaactttctattacctcgaggcaccagctcctttcggcgattcacacgggagtcgctggctgcgatagaaaagcgaatggccgagaagcaggctcgaggcagtaccacccttcaggaatcaagagaaggcctgcctgaggaagaggctccacgccctcagcttgatctacaggcctcaaagaaattgccagatttgtatggcaatcctcctcaagagctcatcggtgagcccctggaggaccttgatcctttttacagcacccagaaaacattcatagttctgaacaaaggtaaaaccatcttccgcttcagtgccactaacgccctctatgtgcttagccccttccacccgatacgtcgcgctgcagtgaaaattctggtgcactcattgtttaacatgttgattatgtgcacgattctcaccaattgtgtcttcatggcccagcacgatcctcccccctggacaaagtacgtggaatatactttcaccgctatctatacatttgagtcattggttaaaatcctcgcacgcggattttgtctgcacgcctttacgtttctaagagatccttggaactggctcgacttttcagtaatcatcatggcctacgttagtgagaacatcaagctcggtaaccttagcgcattgaggacttttcgggtcctcagagcattgaaaacgattagcgtaattcctggcctgaaaactatcgtgggagcccttatacaatcagtcaaaaaacttgccgacgtgatggttcttacagtgttttgcttgagcgtgtttgcactgattggactgcagcttttcatgggcaatctgaggcataaatgtgtccgcaacttcacagctctaaatggaaccaacggttctgtcgaagcagatggtcttgtttgggagtctctggacctgtacctctccgatccagaaaactatttactcaagaatggtacaagcgatgtcctgctctgcggaaattcgtcggatgctgggacctgcccagaaggttatcgatgcctgaaagctggcgagaatcccgatcacggctatacatcctttgacagcttcgcatgggcgtttttggccctttttcgtttgatgactcaggactgctgggagaggctctaccaacagactctcaggagcgctggtaagatctacatgatctttttcatgctcgtgatttttttaggcagtttttacctcgtcaacctgatcctggccgtggtggcgatggcatatgaggaacagaaccaagcaactatcgccgaaactgaggaaaaagagaagcgctttcaggaggccatggaaatgctgaaaaaagagcacgaagcactgactatacgcggagtcgacaccgtgtctcggagtagcctggagatgagccccctagcgccagtgaactctcatgagaggcgctctaaaaggcgcaaaaggatgagtagtggcaccgaagagtgcggagaggaccgcctaccaaaaagcgatagtgaggatggacctagagccatgaaccacctgtccctgaccagaggcttgtcgcgaacgtccatgaagccaagatcctctaggggttccattttcactttcagaagacgcgatctgggatctgaagccgacttcgctgacgacgagaacagcaccgccggcgagagcgaaagccaccacacttctctcctggtcccttggccactgcggcgtactagcgcacagggacagcctagccctggtacttctgcacctggccatgccctgcacggtaaaaagaatagcacagtggattgtaatggggtggtgtctctgcttggcgctggcgatccagaggcgaccagccccggttctcacctgctgcggcctgttatgctcgagcatccccccgacaccaccacaccttctgaggagccaggaggcccccaaatgctgacctcacaggcgccttgtgtggatggctttgaggagcctggcgcgaggcagcgggcattgtctgcggtgtccgtcttgaccagcgctttagaggagcttgaagagagccgtcataagtgtcccccgtgttggaaccggctggctcagaggtatctgatctgggagtgctgccctctttggatgagcatcaaacagggggttaaattggtagttatggaccccttcaccgacctgacaattactatgtgcatcgttttgaacacgctattcatggctctggagcattataatatgacttcggagtttgaagaaatgctgcaagttgggaacttggttttcaccggcatcttcactgctgaaatgacctttaaaatcatcgcgcttgatccctactactacttccaacaggggtggaatatttttgacagcatcatcgtgatcctctcccttatggagttagggctgtctaggatgtccaatctctcagtactcagaagttttcgactgttaagggtgttcaagctggccaagagctggccaaccttgaataccctcatcaagatcataggcaattcggtgggggcattgggtaacctcacacttgttctggctatcatcgtgtttattttcgccgtggttggaatgcaactgtttggaaaaaactactccgagctgcgggactctgactccggcttactgcctagatggcacatgatggatttcttccatgcctttcttatcatcttcaggatcctctgcggtgagtggattgaaacgatgtgggattgtatggaggtgagtggtcagagcttatgtctcttagtcttccttttagtgatggttataggcaacttggtggtccttaacctattcttggctcttctcctcagcagtttctcagcagataacctaacagctccggatgaagaccgagaaatgaataacctgcagctggcactcgccagaatccagcgcggtctgcggttcgttaagcgcactacatgggatttttgctgcggacttctccggcagcggccccagaagccggccgcgctagcagcccagggacagttgccttcgtgtatagccaccccttactcgccccccccacctgagaccgaaaaggtcccaccaacccgaaaggaaactcggtttgaagagggcgaacagcccggacagggcactccaggtgatcccgaacctgtgtgcgttccgattgcggtcgccgagtcagacacagacgatcaggaggaagacgaggagaacagcctgggtaccgaggaggaaagttcgaagcaacaggagtctcagccagtgtccggtgggcctgaggctcctcccgactcccgaacctggagtcaggttagtgctaccgcttcaagcgaagcagaagccagtgcaagccaagctgattggagacagcaatggaaagctgaaccccaggcacctggatgtggagaaactcccgaagatagctgcagtgaaggctcaaccgcggatatgactaacaccgccgagctgctggaacaaattcctgacctcggtcaggacgtgaaggacccagaggattgcttcacagagggatgcgtgagacggtgtccctgttgcgctgtggacaccacacaagctcctggcaaggtgtggtggcgcctacggaaaacttgctaccacatcgtcgagcattcttggttcgagacttttattatttttatgatcctcctgtcatctggggcacttgcattcgaagacatatatctggaagaacgtaagaccatcaaggtgctgcttgaatacgccgataaaatgttcacttacgtgttcgttctggagatgctgctcaaatgggtcgcctatggctttaagaagtattttacgaatgcatggtgttggctagacttcctgatcgtggacgtgagtctggtgagtctggtcgcaaatactcttggattcgctgaaatgggacctatcaagagtctgagaaccctccgcgccctgcgtcccctccgtgccctctcacgcttcgagggcatgagagtcgtggtgaacgcactggtgggtgctattcctagcatcatgaacgttctactggtgtgtctgattttttggcttatcttcagtattatgggagttaacttatttgccggcaagttcggtcggtgcatcaaccaaacagagggggacctcccacttaattacaccatcgtgaacaacaaatctcagtgcgaaagcctaaatttgacgggtgaactgtactggaccaaagtcaaggtcaattttgataacgtgggcgctggatatctggccctgctacaggtagctacattcaagggctggatggatatcatgtatgctgccgtggactcccggggctacgaggagcagccacaatgggagtacaatttatacatgtacatttattttgtcatcttcatcattttcggttctttcttcactttgaatttgttcatcggggtcattatcgataatttcaatcagcagaagaagaaactgggtggacaggacatcttcatgacagaagagcagaaaaagtattacaatgccatgaagaaactgggttctaaaaagccgcagaagccgattcccaggcccctcaacaagtaccaagggttcatcttcgatattgtaacaaaacaagcttttgatgtgaccatcatgttcctgatctgcctgaatatggttaccatgatggtggagacagatgatcaaagccctgagaagatcaatatcctcgccaaaatcaatctactgttcgtggccatctttaccggagagtgtatcgtgaaacttgcagctctgcgccattactacttcaccaacagctggaatatctttgatttcgttgtggtgattttatctatcgtgggcaccgtcctgtctgatattatccaaaaatactttttttcacccaccctgttccgcgtgatcagactggctagaattggacggattctgagactgataagaggcgcaaaggggatcaggacgctcttattcgccttaatgatgagcctccccgccctgtttaatatcggcctcttgctgtttttagtgatgttcatctacagcatcttcgggatggccaattttgcctatgtgaagtgggaagcagggatcgacgacatgttcaactttcagaccttcgcaaactcaatgttgtgcctttttcagatcacaacaagcgcagggtgggatgggctcctgagccctatcctgaatactggcccaccttactgtgatccaaccctccctaacagtaacgggtctagaggggattgtggtagccccgccgtaggcatactctttttcactacttacattattattagtttcctgattgttgtgaacatgtacattgcaataattcttgagaactttagtgtggctaccgaggaaagcacagagcctctcagcgaggacgattttgacatgttttatgagatctgggaaaaattcgacccggaagctacacaattcatcgagtactctgttctctctgactttgcggacgccctatcagagcccctccggatagcaaaaccaaaccagatttctctcattaacatggatctgccgatggtgagcggtgaccgcatacactgtatggatatcctgtttgccttcaccaagcgcgtgctgggtgaaagcggtgaaatggacgcacttaagatccagatggaggaaaaattcatggccgctaatccaagcaaaatttcttacgagccaatcactacaacactgaggagaaagcacgaggaagtttccgcaatggtcatccagcgggctttcaggcggcacctgctgcagcgttctctaaaacatgcatcctttctgttcagacaacaggccggctcaggcctgtcagaggaggatgcccccgagcgcgaaggcttaatcgcctatgtgatgtccgagaatttcagcaggcctcttggcccgccgtcaagcagctccatttcctccacatcttttccccctagttacgatagcgtgacgagagcaacatctgacaatcttcaggtccgtggatcagactatagccatagtgaggacctagcagacttcccccctagtcccgaccgagatagagagagtatcgtgtag

SEQ ID NO: 134713 - DNA, 5997 bp, Artificial Sequence
  Description of Artificial Sequence: Synthetic coding sequence
atggcaaacttccttctgccaagaggcacgagtagcttccggcggtttactagagagtctcttgcggccatagaaaaaagaatggcagaaaagcaggcacgggggtccaccacattgcaggagagtcgcgagggcctcccagaggaggaggccccccggccgcagttggacctgcaggctagcaagaaactgccagatctctatggcaaccctccccaggaactgataggggagccactggaggacttggatcctttttattccacccagaagaccttcatcgtgctgaataagggcaagaccatcttcaggttctccgcaaccaacgccttgtatgtgctgtccccattccaccccataagaagagctgccgtgaaaattctcgttcatagcctgttcaacatgttgattatgtgtaccatcttaacaaactgtgtatttatggcccaacacgaccccccaccttggacaaaatatgtggagtacacatttaccgctatttacacatttgagtcgctggtgaaaatcctcgccagaggattctgtctacatgcgtttacctttctgcgtgatccttggaactggctggacttcagcgtaatcattatggcgtatgtgagcgaaaatattaagctgggcaacctgtcagctctgaggaccttccgggtccttcgagccctgaagacgatctctgttatccctggtttaaagaccattgtgggagcactgatccagtctgtcaaaaagcttgccgacgttatggttctgactgtgttttgcctgtccgtgtttgccctgattggcttacaactttttatggggaacctgaggcataagtgtgtacgcaactttaccgcacttaacggtacaaatggaagcgtggaagcggatggactggtgtgggaaagcttagatctgtatctctctgacccggaaaattatttgctgaagaacggaacctctgacgtgctgctgtgcggcaattcatcagatgctgggacttgccctgagggttacagatgtctcaaggccggagagaacccagaccacggctatacaagcttcgattcctttgcttgggcctttctcgccctgtttcgcctcatgactcaggattgttgggagcgactttaccagcaaaccctgaggtccgctggaaaaatctacatgatcttctttatgctcgtcatctttctgggctcattttatctggtcaacctgattttagccgtcgtagccatggcctacgaggaacagaaccaagctacaatcgcagagaccgaagaaaaggaaaaacgcttccaagaggccatggagatgttgaagaaagagcacgaagccttgacgattcgtggcgtcgacactgttagtcggtcatccttggagatgtcccccctagctcccgttaattcccacgagagaagatccaaaaggagaaaacgtatgtctagcggcactgaagagtgtggcgaagatcggttaccgaagtcggattcggaggacggacctcgggccatgaaccacctgtctctaacgagaggcctcagtagaaccagcatgaagccacggagtagtagggggtccatcttcaccttcaggcgcagggatctgggatctgaggcagattttgccgatgatgagaatagcaccgccggtgagtccgagtcccatcacacaagcctacttgtgccgtggcctcttagacggaccagtgcacaagggcagccctcaccaggaactagcgccccaggccacgctctgcacggtaaaaaaaactccactgtggactgcaacggtgtcgtgtccctactgggggcaggcgacccggaagcaacatcccccgggtcccacctgcttcgccccgtgatgctcgaacacccccccgatactaccaccccgtcagaggaacctggcggcccccagatgttgacctcgcaagcaccctgcgtggatggctttgaggaacctggagcccggcaacgcgcattaagtgccgtgagcgttcttacttcagccttggaggagctagaggagagcaggcacaaatgtcctccatgttggaaccggctggctcaacggtacctaatttgggagtgctgtcccctgtggatgtccatcaaacagggagtaaaattggtagtgatggatcccttcactgacctgaccatcactatgtgtatcgtcctgaacaccctgtttatggcgttagaacattataacatgaccagcgaattcgaagagatgctacaggtgggtaatctggtgtttacagggatttttacggccgagatgacctttaagatcatcgctctggatccttactattattttcaacaggggtggaacattttcgactctatcatcgttatcctgtcccttatggagcttgggctgtctagaatgagcaatctctctgtgttacgttcctttagactgttacgcgtttttaagctagcaaagtcttggcctacattgaatacgctaatcaagattattggcaattcagtaggggccctcggcaacctgaccctggtattggccatcattgtgttcatcttcgcagtggtggggatgcagctgttcggcaaaaactacagcgaactacgggattctgattcaggacttctgccgagatggcacatgatggacttcttccatgcatttctgattatttttagaattctatgcggcgagtggatcgagactatgtgggactgcatggaggtctcaggtcagtctctttgtttgctggtgttcctgctggttatggtaattggcaacctcgtggtgctcaatctgttcttggctctccttttgtcatcattctcggccgataatctcactgcgccagatgaagacagggagatgaacaacctccagctggccttggcgcgaatccagcgtggactgaggtttgttaaacggaccacctgggacttctgctgcgggctcctgcgccagcggccacagaagcctgcagccctggcagcacaggggcagttgccatcctgcatcgccactccttattctcctcctcctccagaaaccgagaaggtgccgccaactcgcaaagagacccgttttgaggagggtgagcagcctggacagggaacacccggcgatcccgagcctgtctgtgtccctatcgctgtggccgaatcagatactgatgatcaggaggaggatgaagaaaactctctgggcacggaagaggaaagcagcaagcagcaggagtcacaacctgtctccggaggacccgaggctcctcccgactccaggacctggtcacaggtttccgccaccgcatcaagcgaggctgaggcaagcgcgagtcaagctgactggcgccagcaatggaaggcagagcctcaagcccccggatgcggtgagacacccgaagacagttgcagtgaaggatccactgcggatatgacgaataccgctgaactgctggaacagatccccgacctgggacaagacgtgaaagatcctgaagattgtttcactgaaggctgcgtcagaaggtgtccctgctgcgccgtagataccacgcaagctccggggaaagtgtggtggcgcctgaggaagacctgttaccacattgttgaacattcttggtttgaaacattcatcatcttcatgattcttctgtcatcgggagcattagccttcgaagatatctatctagaggagagaaagactattaaggttctgctagaatatgccgataagatgttcacatacgtttttgtgctggaaatgctgctgaagtgggtggcctatggattcaaaaaatacttcacaaatgcatggtgctggctggatttcctgatcgtcgacgtgtcactcgtcagtcttgttgccaatacactgggcttcgccgagatggggcccatcaaaagcctgcggacccttcgtgccctgcggcctctacgagctttgtcccggttcgaaggaatgagggttgtggtaaatgccctagtgggcgcaatcccctctattatgaacgttctcctggtctgcctcatattctggctgattttcagcatcatgggtgtgaatctgttcgcaggaaagttcggacggtgtattaaccagacagagggcgacctccccctgaattacaccattgttaataataagtctcaatgcgagagtctgaacctgaccggagagctctattggactaaggtgaaagtgaactttgataacgtgggagctggttaccttgcactcctccaggtgtatgaggagcagcctcagtgggagtacaacctctacatgtatatttacttcgtcatctttatcatctttggctcatttttcacactgaacctttttatcggtgtgataatcgacaatttcaaccagcagaagaagaagttgggcggtcaagatatatttatgactgaggaacagaaaaaatactacaatgctatgaaaaagcttggctctaagaagcctcagaagcctattccacgtccgcttaataaataccagggattcatattcgacattgtgacaaagcaagccttcgacgtgacaataatgttcctcatttgtttaaatatggtcacaatgatggtggaaactgatgatcagagccctgagaagatcaatatcctggccaagatcaaccttctatttgtcgctatttttaccggggaatgcatcgtcaaactcgcagccctccgtcattattattttacaaacagctggaacattttcgacttcgtagtagtgatcctaagcattgtgggtaccgttttaagcgatatcatccaaaagtactttttttctcctaccctgttccgggttattcgcctcgcccgtattgggcgcattctgcgcttaatccgtggcgctaaagggattaggactcttcttttcgcactgatgatgagcctgccagccctctttaatattggattactgctgtttctggtcatgttcatatactctatctttgggatggcgaacttcgcatatgtcaagtgggaagctggaatcgacgatatgttcaacttccagacctttgccaacagcatgctctgtctcttccagatcacaacatctgccggttgggatggccttctgagcccaatattaaacacgggccctccctattgcgaccccaccctacccaacagcaacgggagtcgaggcgactgcggaagtccagccgtggggattctgtttttcactacgtatataatcataagcttcctgatcgtcgtcaacatgtacatagcaattatcctcgaaaatttctctgtggccacagaggaatccaccgagcctttgtctgaggacgactttgacatgttttacgaaatctgggagaaatttgacccagaggccacacaattcattgaatatagcgtcctttcagacttcgccgacgcgctctccgaacctctgcgtatcgccaagccaaaccagatcagtctcataaacatggatctgccgatggtgtccggagataggattcattgtatggacatacttttcgcattcaccaagcgggtgctcggcgaatctggggaaatggacgcgctgaaaattcagatggaagaaaagttcatggctgccaatcccagcaaaatttcctatgaacccataactaccaccttgcggcggaaacacgaggaggtatcagccatggttattcaacgggccttcaggcgccatttgctgcagcgatcactgaaacacgcatcctttcttttcagacagcaggcaggatccggtttgtccgaagaggatgcgccagagagagagggactgatcgcctacgtgatgtccgagaacttctcccggcctctaggccctcctagctcatccagtatctcgtccacatcattcccaccatcgtatgactccgtgactcgggccacttcggacaacctgcaggtgcgcgggtccgactacagccatagcgaagatctggcggactttcccccgtccccagatagggaccgagaaagcattgtgtag

SEQ ID NO: 134714 - DNA, 6048 bp, Artificial Sequence
  Description of Artificial Sequence: Synthetic coding sequence
atggcaaattttctgctcccccgaggcacttcctcatttcgccgattcactagggaatcactcgcggcaatcgagaagcggatggccgaaaagcaggccagggggtccacaactctgcaggagagcagggagggactcccggaagaggaggcaccaagacctcagctcgatctgcaagcgagtaagaaattgccagacctgtacggcaatcccccacaggagttgatcggtgagcccttggaagacctcgatccgttctatagcacacagaagactttcattgtattgaataagggaaaaactattttccggttctcagccactaacgcgttatatgtcttgagcccatttcatccgattcgcagagccgccgtcaaaatactggtgcatagcttattcaacatgctgatcatgtgcaccatcctgacaaactgcgtgttcatggctcagcatgaccccccaccttggaccaagtatgtcgaatacacctttacagccatttatacattcgagagcctggtgaaaatcctcgcacgcggattctgtctgcatgctttcacgttcctgagagatccctggaactggctggactttagtgtgatcatcatggcttacacgacggaattcgtagacctgggaaacgtttccgccctgcggacattcagggttctgcgtgcactcaaaaccataagcgtaataagcggcctgaaaaccatagtgggcgccttaattcagagcgtaaagaaactggccgatgtgatggtgctgacggtgttttgtttgagtgtcttcgccctgatcggcctgcagctgttcatgggcaatctaagacacaaatgtgtacgtaattttactgccctgaacgggactaatggctcagtggaggcagacgggcttgtgtgggagtccttagatctgtatctctccgacccggaaaattatctgctgaagaacgggactagtgatgtgctgctgtgtggtaacagctccgacgccggcacgtgccctgagggatatcggtgtctgaaggccggcgagaatcctgatcatggctacacatctttcgattctttcgcctgggccttcttggcactgttcaggcttatgacccaagactgctgggagaggctgtaccagcagactctgagaagcgccggcaaaatctacatgatcttttttatgctcgtcatctttttaggatctttctacttggtcaaccttattctcgctgtggtggcaatggcttatgaggagcaaaatcaggccactatcgcagagacagaggagaaagaaaagcgatttcaggaggccatggaaatgctgaagaaagagcacgaggccctgaccatccgaggagtggataccgtgagcaggtcttccctggagatgagcccactggcaccagtaaactcccatgagaggagaagcaagcgtcgaaagagaatgagctctggcaccgaggagtgcggtgaagacaggcttcccaagtcagacagcgaggacggtccacgggctatgaaccaccttagtttgacccggggcttgagtaggacatcaatgaagcccagatccagtcgaggtagcattttcacttttaggcgaagggatctgggatcagaggctgatttcgctgacgatgaaaattccactgcaggcgagtctgagtcacatcacactagtcttctcgtaccctggcctctgaggcggacaagtgcacaaggccaaccctcccccggaacgtctgctccaggccatgccctgcacggcaaaaagaattcgaccgtggactgcaacggggtggtgagcctccttggagctggcgaccctgaggccacctcaccaggaagccatctgctcagacctgtgatgctcgaacacccacctgatacaactacccccagtgaagagcctgggggcccccaaatgttgacatctcaagctccctgcgtcgatggctttgaagaacctggcgcgcggcagagagcactaagcgctgtgagcgtcctgacgtctgctctggaagagctggaggaatctaggcacaaatgtcccccctgctggaatcgactggcccagagatatcttatttgggagtgctgccccctgtggatgtctataaagcaaggcgttaagttagtggtaatggatccgtttactgacctgacaatcacaatgtgtatagtgctaaacaccctattcatggccctggagcactataatatgacctccgagttcgaagagatgttgcaagtgggcaatctggtgtttactggtattttcaccgctgagatgacgttcaagattattgcacttgatccctattattacttccagcagggctggaacatctttgatagcattatcgtgatactgagtctgatggagctggggctgagcagaatgtctaatctgagcgtcctgcgatcctttcgccttttgcgcgtgttcaaattggccaaatcttggccaactctgaatacactcatcaagattataggcaatagcgtgggcgcactgggaaacttgacactggttttagctatcattgttttcatcttcgctgtggtgggtatgcagctcttcggtaagaactacagcgagcttagagatagtgatagcggtctcctgcctcgctggcacatgatggacttttttcacgcatttttaatcatatttcgcatcctgtgtggagagtggatcgagactatgtgggactgcatggaggtgagtgggcagtccctgtgcttgctagtgtttttgctggtcatggtgatcggcaatctcgtggtgcttaacctgttcctcgcacttttactgtccagtttttccgccgacaatctgactgcaccagatgaggatcgcgagatgaataacttgcaattagctcttgccaggatacagagaggccttagattcgtgaagaggacaacgtgggatttttgctgcggattattacgtcaaagaccccagaaacccgccgccctggccgctcagggtcagcttcctagctgcatcgcaacgccgtattctcccccgccccctgaaacggaaaaggtcccgcctaccagaaaagaaacccggtttgaagagggcgagcagccagggcagggtacacccggcgatcctgagcccgtctgcgtgcccatcgcagtagccgaatcagacaccgacgaccaggaggaagacgaagaaaatagtttgggtaccgaagaagaatctagtaagcaggaatcccaacctgttagcggaggccctgaggccccccccgattctcgcacatggagtcaggtctcagccaccgcaagttctgaggccgaggcttctgcctcccaggctgattggcggcagcagtggaaagctgaaccacaagcgcccggatgcggtgaaactccagaggactcctgttccgagggctccacggcggatatgaccaacacggccgagctgcttgagcagattccagatcttggccaggatgtcaaggatcctgaggattgcttcaccgaggggtgtgtgaggcgctgcccttgttgtgctgtggatacaactcaggcgccagggaaggtgtggtggcgactgcgcaagacatgttaccatatcgtcgagcactcctggtttgaaacgttcattatctttatgattttactctcttctggggccctggccttcgaagacatttacttggaggagcgtaagacaattaaggtcctgttggagtatgccgataagatgtttacatatgtcttcgtgctggagatgctgctgaagtgggtggcctacggtttcaaaaagtatttcactaatgcgtggtgctggcttgactttctaatagtcgacgtctcattggtaagccttgtggcgaacacactgggatttgccgagatgggccccatcaaatcccttaggacactgcgtgcccttcggcctctaagggcattatctcgtttcgaagggatgcgcgtagtggtaaatgcgcttgtgggcgcgatccccagcatcatgaatgtattgttggtctgcctgatcttctggctcattttttctatcatgggagtcaatttgttcgccggcaagttcggaaggtgtatcaaccagaccgagggggacttgcctctcaattatacgatagttaataataaaagccagtgtgagagcctgaatctaacaggtgaactgtactggaccaaagtgaaggtgaactttgacaacgtaggcgctggatacctggcccttctccaagtcgcaaccttcaagggctggatggatatcatgtacgctgcagttgacagtagggggtacgaggagcagcctcagtgggaatacaatctctacatgtacatttattttgtgattttcataattttcggatctttcttcacgcttaacctcttcattggagtgattatagataactttaatcagcaaaaaaagaaactgggggggcaggacatcttcatgactgaagagcagaagaagtactataatgcaatgaaaaagttaggttctaaaaagccgcagaagcctatccctagaccactgaataaataccagggcttcatcttcgatattgtgacaaaacaggccttcgatgtgactataatgttcttgatctgccttaacatggtgactatgatggtggagactgatgatcaatcccccgagaagatcaatattctggccaaaatcaaccttttgttcgtcgcaatttttactggtgaatgcatagtaaaacttgccgccctgcgacactactattttacaaattcatggaatatattcgacttcgtagtggtgatactcagcatcgtggggactgttttatcagatatcatccaaaagtacttcttctcgcctacactattccgtgtcataaggctagctcgaatcggaagaatactgcgactcatcaggggggctaaaggcatccgcacgctcctgttcgcgctaatgatgagcctgcctgccctgttcaatattggcttattattatttttagtcatgttcatttattctatcttcgggatggccaatttcgcctacgtgaagtgggaggccggaatagacgatatgttcaattttcagacattcgctaatagtatgctgtgcctgtttcagatcacaacgagcgccggatgggacggtctcctctcccccatcttgaatacaggaccaccctattgtgaccccacacttccaaacagcaatggatctaggggagactgcggatcgcctgcggtggggatcttatttttcactacgtacatcatcatctccttcctcattgtggtcaatatgtatatcgcgatcatcctggaaaattttagcgtggccacagaggagtcaaccgagcctctcagcgaagacgattttgatatgttttacgagatatgggagaagttcgatcccgaggcgacccagttcattgaatattcagttctgtccgacttcgccgatgccctttccgaaccactgcgcattgctaaaccaaatcaaatttctttgattaacatggatctgccaatggtgagtggtgatcgaatccactgtatggatatcctgtttgcattcacaaaacgggtgctgggagaaagcggcgagatggatgcgttaaagattcagatggaggagaaattcatggctgctaacccttccaagattagctatgagcctatcactactaccctgcggagaaaacatgaggaagtctccgcgatggtgatccagcgggccttcagacgacacttactccagagatcactgaagcatgcaagcttcctgtttaggcaacaagccggatccgggctatccgaggaggatgcccccgagcgggaagggctgatcgcttacgtgatgtccgaaaatttctcacgaccattgggacccccaagcagctcttccatttcttcaacaagttttccaccaagttacgactctgtcaccagagcaacgagtgacaacctgcaggtgaggggcagcgactactcgcattccgaggatctggctgatttcccaccatctccagaccgtgacagagaatccattgtgtag

SEQ ID NO: 134715 - DNA, 5997 bp, Artificial Sequence
  Description of Artificial Sequence: Synthetic coding sequence
atggcgaacttcttgctcccacgagggacctcctcgtttaggcgttttaccagagaatcactcgcggcgatcgagaagcgcatggctgaaaagcaggcccgggggagtaccaccctgcaagaatcacgcgagggcctgcctgaggaggaagccccccgccctcagttagacctgcaggcttccaaaaagttgccggacctgtacgggaacccacctcaggagttgattggagaacctctcgaggacctggaccccttctactcaacacagaagaccttcatagttctcaataagggcaagaccatttttcggttttctgccaccaacgcgctgtacgtactgtccccatttcaccctatcaggcgcgccgctgtaaaaatcttggttcatagcctgttcaacatgcttattatgtgcaccattcttactaattgcgtgttcatggcgcagcacgacccaccaccttggacaaaatatgttgagtacacctttacagccatctacacctttgaatccctggtcaaaatcttggcccgcgggttctgtcttcatgcttttacctttttacgagatccctggaactggcttgatttcagcgtgatcattatggcctatgtgagcgagaatatcaaactgggaaacttatccgcgctacgaactttccgggtgcttcgggcgctcaagactatctccgtgattcccggtttaaaaacaatcgtgggagccctgattcagtctgtcaagaaactcgcagacgttatggtactcactgtgttctgcttatccgtgttcgcactaatcggcctgcaactattcatgggcaacctgcgccacaagtgtgtgagaaacttcacagcattaaacggcacaaacgggtcagtagaggcggatgggctggtttgggagtcattggatctctacctttctgatcctgagaattacttgctgaaaaacggtacatccgacgtgcttctctgcggaaacagctcggatgctgggacatgcccagaagggtatcggtgtctcaaagccggagaaaacccggaccacgggtacacatccttcgattccttcgcctgggcattcctcgctttatttaggctgatgacccaagactgctgggagaggctgtaccaacaaactctccgctctgcggggaagatttacatgatatttttcatgctagttatttttctgggcagcttctatttggtcaacctgatcttagctgtcgtggctatggcctacgaggagcagaatcaggctaccatcgccgagacagaagaaaaggaaaagcgcttccaggaggctatggaaatgttgaagaaggaacatgaggccctgactatcaggggggttgacacggtgagccgaagcagcctggagatgtcacccctggctcctgtgaattcccatgagcggcgttctaaaaggcggaagcgaatgtccagtggcactgaggaatgcggcgaggataggctaccgaagtcggactcagaagatggcccaagagctatgaaccatctatcactcacccgcggcttgtcacgcacttcgatgaaaccacgatcttccagaggatccatctttaccttcagaaggagagacctcggtagcgaggctgacttcgctgacgacgagaattccacagcaggagaatctgagagtcatcatacttccctcttggtaccttggcccctgcgcaggacgagcgcacagggacagcccagccccggaacctcggcacctggccacgcactgcatggaaaaaagaatagcaccgtggattgcaacggagtggtcagtctcctaggcgctggtgacccagaagctacctcaccaggatcacatctgttgaggccagtgatgctcgaacacccgcctgacacgaccacccccagcgaggagccaggcggtcctcaaatgttaacctctcaagcgccctgtgtcgacgggtttgaggaaccgggagccagacagagagcactgtctgcagtgagtgtcctgacctccgcattggaggagctggaggagtcaaggcataaatgcccaccgtgttggaaccgcctggcacagcgctacctgatctgggagtgctgcccactgtggatgtcgatcaagcagggggtgaagctcgttgtcatggacccattcacagacctcaccattactatgtgcatagtacttaatacgctgttcatggccctggagcattataatatgacaagtgaattcgaagagatgttgcaggtgggcaacctggtgttcacaggaattttcacagctgagatgaccttcaagattatcgctctcgacccatattactacttccagcagggctggaacatattcgacagtatcattgtaatcctcagccttatggagttaggcttgtcccgaatgagtaatctctccgtgttaagatcttttagactgttacgcgtgtttaagctagccaagtcatggcctaccctcaataccctgataaaaataatcggtaactctgtcggcgcgctcggcaatctaacactggtactcgcaatcatcgtattcatcttcgccgtcgtagggatgcaactgttcggtaaaaattacagtgaattaagggattccgactccggtctgttgcccaggtggcacatgatggacttcttccatgcctttctcataatcttcaggatcctctgtggcgaatggattgagacgatgtgggattgcatggaggtgtccgggcaatccctttgcctgttggtgtttcttctggtgatggtgattggcaacctagtggtgttgaacctgttcctcgctttactgctgtcctcattctccgccgataacttgacagcaccggatgaggaccgagaaatgaacaacctgcaactggcgctcgctagaattcagcggggattgcggtttgtaaagcgcaccacgtgggacttttgttgcggtcttctgcgacaaagaccccagaagcccgctgcgcttgcggcccagggccaactgccgagctgtatagccacgccttattcgcccccccccccggaaactgaaaaagtgccccctactaggaaggagacccgtttcgaggagggggaacagcccggccaggggactcccggggatcctgaacccgtttgtgttccaattgccgtcgcagaaagcgacaccgacgaccaagaggaagatgaggagaattcgctggggaccgaagaagagtccagtaagcaacaggagtcacagcccgtctcaggcggtcccgaggcgcctccggactcaaggacatggagccaggtgtccgccaccgcatcctcggaagccgaagcatccgcttcacaggctgactggcggcagcagtggaaagcagaaccacaggcccccggctgtggtgagactccagaggacagttgcagtgaaggatcgaccgcagacatgaccaacacagccgaactccttgagcagatacctgatttggggcaggatgtgaaagacccggaagactgttttactgagggatgtgtccgacggtgcccctgctgtgccgttgataccacccaagcgcctggcaaagtgtggtggcgcctacgcaagacctgctaccacatcgtcgaacactcttggttcgaaacattcatcatcttcatgatcttgctgagctctggagcattggcttttgaggacatatatctggaggaacggaagactatcaaagtattgctggaatatgccgataagatgtttacctatgtgttcgttctggagatgttactgaagtgggtagcttacggctttaagaaatatttcactaatgcctggtgttggttggatttcctcatcgttgacgtctcattagtgagtctagtagccaacactctcggcttcgctgagatggggccaattaagagcctcagaaccctgagagccctcaggcccctcagggctctgtctcgattcgagggtatgagggttgttgtgaatgctctcgtaggcgctattccatcaataatgaacgtgctgctggtgtgcctgattttctggctgatattttcaataatgggcgtgaacctgttcgcagggaaattcggccgatgcatcaaccagaccgagggggacctccctttgaattacacgatagtgaacaataagagccagtgtgagagtctcaaccttaccggcgagctctattggacgaaagtgaaagtgaatttcgacaatgtaggggccggctatctggccttgctgcaagtgtacgaggagcagcctcagtgggaatacaacttgtatatgtacatctacttcgttatcttcatcatcttcggatcatttttcaccttgaatcttttcatcggcgtcattatcgacaactttaaccagcagaagaagaaactcggaggccaggacattttcatgaccgaggaacagaaaaaatattacaacgctatgaaaaaattggggtcgaagaaaccacagaagccaatcccgcgccctctaaataagtaccagggttttatcttcgatatagtgactaagcaagctttcgacgtgaccattatgttcctgatttgtttgaacatggtcactatgatggtggagaccgacgatcaatctccagaaaaaattaacatcctggccaagattaatttattgtttgtcgcaattttcacaggcgaatgtatagtcaaactggccgcactacgccattattactttactaattcttggaacatcttcgacttcgtggtcgttatcctctcaatcgtgggcacggtgttgtccgatatcattcaaaaatacttttttagtccaaccctgtttagagttatacggctcgccagaatcgggaggattcttagactgattaggggggcgaagggtatcaggaccctgctgtttgccctgatgatgtctctacccgcactgtttaatatcggtctcctgttgttcctggtaatgttcatctattctatcttcggaatggctaactttgcctatgtaaaatgggaagccggaattgatgatatgttcaactttcaaaccttcgccaacagcatgctttgtctcttccaaattacaacctctgccggttgggacgggttgctcagccccatcctcaacactgggcctccgtactgtgaccctactctccccaatagcaatggtagtaggggcgactgcgggagtcccgccgtcgggattttgttctttacaacctatataattatttctttcctgatagtggttaacatgtacatcgcaattattttagaaaatttcagcgtcgcaactgaggaaagcactgagccgctgtccgaggatgacttcgacatgttttatgaaatatgggaaaagttcgatccagaagctacgcagttcatcgaatatagtgtcctgtctgactttgccgatgcactgtcggagccgctcaggatcgccaaacccaaccagatttccttaatcaatatggatctgccgatggtcagtggcgatcgtatacattgcatggatatccttttcgccttcaccaagagagttttgggggagagcggagagatggatgccctcaagatacagatggaggaaaaattcatggcagcaaacccttctaagatttcatacgagcccatcaccaccacactgcggcggaagcacgaagaggtgagtgccatggtaatacaaagggcatttcgcagacatctactccagcggtcgctaaagcacgcgtcttttcttttccgtcagcaggccggtagcggtctgagcgaagaggatgcgcccgagcgtgaagggctgattgcctatgttatgtccgaaaacttctcccggcctctcggtccaccttcctcgtcttctatcagtagtacatccttcccgcctagctatgattcagtaactagagcaacttcagataatctgcaggtccgtggctctgactactctcattccgaagacctggctgattttccaccttcgcctgatcgcgatagggagtccatagtatag

SEQ ID NO: 134716 - DNA, 6048 bp, Artificial Sequence
  Description of Artificial Sequence: Synthetic coding sequence
atggctaatttcctcctgccccggggaacctcctccttcagaaggtttactcgggagtccctagccgcaatcgagaaacgcatggccgagaaacaggctcgtgggagtactacgctccaggagtctcgagagggactgccagaggaggaagcccctcgtcctcagttagacctccaggcgtctaaaaagctgccagatttgtatggcaaccccccccaggagttaattggagaaccactcgaggacctggatcccttctattcaactcagaagacttttattgttctgaacaaggggaaaactatctttagatttagcgctactaatgctttgtatgtactatccccttttcacccaatacgccgcgccgcagtgaagattctggtgcattcactgttcaacatgttgataatgtgcacaatcctgacaaattgcgtcttcatggctcagcatgatccgccgccttggaccaagtatgtggagtacaccttcacggcaatttatacgtttgagtccctggttaaaatattagcacgtggattttgccttcatgccttcaccttcctacgagacccctggaattggctcgacttctcagtaatcatcatggcatacacaaccgagtttgttgacctgggtaacgtcagtgccctcaggacatttcgggtgctgagggcacttaaaacaataagtgtgatctccggtcttaagacaatcgtaggagccctgatccagagcgttaaaaagttagccgatgttatggtgcttacagttttctgtctgagcgtgtttgccctgatcggactccagcttttcatgggaaatctcaggcataagtgtgtgaggaactttactgccctgaacggaacaaacggctcagtggaggccgacggcctggtgtgggagtccctggatttgtatctgtccgatcctgaaaactatctcctgaaaaatggaacctcagatgttcttctatgcgggaactcatccgacgcaggtacttgtcctgaaggataccggtgcctaaaggccggggagaatcccgatcacggttatacatcatttgatagctttgcatgggcctttctggcattgttccgcttgatgactcaggattgttgggaaaggctctatcaacagaccctgagaagcgccggtaagatctacatgatcttcttcatgttggtgatattcctaggcagcttttacctggtaaacttaattctcgctgtcgttgccatggcctacgaggaacagaaccaggccacgattgctgagactgaggaaaaagaaaagcggtttcaggaggcgatggagatgcttaagaaagagcatgaggcactgaccatccgaggtgtggataccgtgtcgagatcctcactggaaatgtcaccactggccccagtaaacagccacgagcggcggtcaaagcgtaggaaacggatgagctccgggacagaggaatgcggggaggaccgactccccaaaagtgattccgaggacggtcccagggccatgaaccacctgtcattgacaagaggactctcaaggactagcatgaagccgaggagttcacgggggtctatcttcacatttagacgcagggatctgggttcagaagctgactttgcagacgatgagaattcgaccgccggagagagtgaatcgcatcatacatctctgctcgtcccttggcctctgcgaaggacttctgcacaggggcagccctcgccaggcacgagcgcgcccggtcatgcactgcatggaaagaagaacagcactgtcgactgcaatggcgtggtaagtctgctgggagccggagatccagaggctacaagccctggttctcacctcctgcgtcctgtgatgttggagcatccaccagacaccactactccatcggaagagcctggcggcccgcagatgctcactagccaggctccctgtgtggacggattcgaggagcctggcgcaaggcaacgtgctttgagtgctgtgagcgtgctcaccagcgcccttgaggaacttgaagaatccaggcataagtgcccaccatgctggaatagactggctcaaagatacctgatctgggaatgttgcccgttgtggatgtccataaaacagggcgtgaaacttgtggtgatggatcccttcaccgatttgaccatcaccatgtgcatcgtgttgaataccctgttcatggcgctagagcactacaatatgacatccgagttcgaggagatgctgcaggttggcaatttagtatttaccggcatctttaccgccgaaatgaccttcaagataatagccctggatccctactactattttcagcaggggtggaatattttcgactccatcatcgtgatcttatctttaatggagctcggcttgtctagaatgtctaaccttagcgtgctgaggtcttttcgcctgttgcgggtgttcaagcttgctaagtcttggcctaccctgaacaccttgatcaaaattattggaaattccgtgggggcactcgggaatctgaccctggtgttagcaataatcgtatttatcttcgcagtggtgggcatgcagttatttgggaaaaactactccgagctgagggattcagattctggactgctgccacggtggcacatgatggactttttccatgctttcttgattatcttccgcatactgtgtggggaatggattgagacaatgtgggactgcatggaggttagcggccaaagtctgtgtttactggtcttcctgcttgtcatggtaattggtaatctggtagtgttgaatctgttcttggcactactgctgtcatcatttagcgccgataatttaaccgcccctgatgaggatcgggagatgaacaatttacagctggctctggccaggatacagagagggcttcgatttgttaagcgtaccacatgggatttttgttgtggtctcctgcggcaacgcccccagaaaccagccgccctggccgcgcagggacagctaccatcttgtatcgcgacaccttacagcccgcccccacccgagacagagaaggtgccccccactcgcaaggaaactcgcttcgaggaaggagagcagcctgggcagggaaccccaggcgacccagaacctgtgtgcgttcccatagctgtagctgaaagtgacaccgacgatcaagaggaggatgaggagaactctctcggcaccgaagaggaatcatctaagcaggagagtcagcccgtgtcgggcggaccagaggcacccccggattcccgtacctggtcccaggtctccgcaacagcatcttctgaggcagaagcgagcgccagccaggccgattggaggcagcaatggaaggccgagccacaggcccccggctgtggagaaacgccagaggacagttgttccgaagggtctacagccgacatgacaaacacagccgagcttctagagcagatccccgacctcggtcaggacgtcaaagatcccgaagattgcttcaccgagggttgcgttaggcgctgcccttgctgcgccgtggacacaactcaggctcctggtaaagtgtggtggcgactgagaaagacctgttatcacattgttgagcattcatggtttgaaacattcatcatattcatgatcctgctcagctctggcgctctggcctttgaggacatctacctggaagaacgaaaaacgatcaaggtgctcctggagtatgctgacaagatgtttacttacgtttttgtgctcgaaatgctcctgaaatgggtcgcctatggttttaagaaatactttactaatgcctggtgttggctcgactttctgatcgtggacgtcagcctggtcagcctggtagctaatactctaggcttcgctgagatgggacctattaagtccctgcgaaccctgcgtgcactccggcccctccgcgcgcttagtagattcgaaggaatgcgagtggtggtcaacgcccttgtgggggccattccatcaatcatgaacgttttgttggtgtgcctgatattctggctgattttcagcataatgggcgtgaacctttttgccggtaagttcggcagatgtattaaccagacagaaggtgacctcccactgaactataccattgtcaataataagtcccagtgcgagtcactgaacctcactggcgagttgtattggactaaggtgaaagtcaactttgacaacgttggggccggatatctggctctgctgcaggtcgccacgtttaaaggttggatggatattatgtatgccgccgttgacagtagggggtacgaggaacaaccacagtgggagtataatctttatatgtacatttatttcgtcatttttatcatcttcggatcattcttcaccctgaatctttttatcggcgtgataattgataattttaaccagcagaagaagaagctgggcggacaggacatcttcatgactgaggagcagaaaaagtattacaacgccatgaaaaagcttggctcaaagaaacctcagaagccgattccaaggccgttaaataagtatcaaggctttatctttgacatcgtcaccaagcaggcttttgatgttaccattatgtttctcatatgtctcaacatggtgactatgatggtagaaaccgacgaccagtcgccagagaaaattaacatcttggcgaaaatcaacctgctgttcgttgctatcttcactggtgagtgcatcgtgaagctagctgccctccgacattattactttaccaactcatggaatatctttgatttcgtcgtagtgattttaagtatagtggggacggtcctgagcgatattatccagaagtacttcttcagcccaaccctctttcgagtgatccggcttgcgcgcatcggccggatactgagactgattcgcggcgcgaagggcattagaaccttgctgttcgctctgatgatgagcctgcccgctctgttcaatataggcctactgctcttccttgtgatgttcatttactccatttttggtatggccaactttgcctatgtcaagtgggaggccggaatcgatgatatgttcaacttccagactttcgccaactcaatgctctgtctttttcagatcacgaccagtgccggctgggacggtctcttgagtccaatccttaacactggccccccttactgcgaccctacactgcctaattcgaacgggagccgcggggactgcggctccccggctgtcggcattctctttttcacaacatatatcattatcagtttcctgatagttgttaatatgtacatcgccatcattctggaaaactttagcgtggctacagaggaatcgactgaaccactgtcagaggatgattttgacatgttctatgagatctgggaaaagttcgatccggaggccacccagtttattgaatatagcgtgctcagcgacttcgcggatgctctgagcgaaccccttaggattgcaaagcccaatcagatcagtctcataaacatggaccttccgatggtgtccggggatcggatccactgtatggacattctgttcgcgtttaccaagagggtcctgggagaatccggcgagatggatgccctgaagatacagatggaggaaaaattcatggccgctaatccgagcaaaattagctacgaacccatcactaccacacttcgccggaagcacgaggaagtgtccgcaatggttatccagagggcttttagaaggcacctgctacagcgcagcctcaaacatgcatcattcctcttcagacaacaggccggtagcggtctgagtgaggaggacgcaccagaaagagaggggttaatcgcctatgtaatgtcagagaactttagcaggccactggggccaccatcctctagcagtattagttcaacatccttccccccttcctacgactccgtaaccagagccaccagcgacaaccttcaggtacgtgggtccgactactctcacagtgaggatctggcagatttcccaccttcccctgaccgggaccgcgaatctatcgtgtag

SEQ ID NO: 134717 - DNA, 5889 bp, Artificial Sequence
  Description of Artificial Sequence: Synthetic coding sequence
atggctaactttttattgccacgcggcacatcttcctttagaagatttacccgggagtctctagcagcaattgagaagagaatggcggagaagcaggctcggggatccaccaccttgcaagaatcccgggaggggctgcctgaggaagaagccccgcgtccacagttagacttacaggcgagcaagaagttgccagacctgtatggaaatccccctcaagagctgattggggagcctctcgaagatcttgatcccttttatagtacgcagaagaccttcattgtgttgaataaaggaaagacaatcttccggttctcagccaccaacgccctgtacgtgctgtctccgttccaccccattcgcagagcagctgtcaagatcctagtccacagtctctttaacatgctgattatgtgtacgatactcacaaactgcgtcttcatggcccagcatgacccacccccttggaccaaatatgtggagtatacctttactgccatttataccttcgaatccctagttaaaatcttggctcggggcttctgtttacacgccttcacctttcttagagatccatggaattggctggatttttcggtgattatcatggcctacacaactgagtttgtggatttgggaaatgtttcagccctgcgcactttccgggtacttcgggctctcaagacaatatctgtgatcagcggattgaaaacaattgtgggagctctgatccaatcagtcaagaagctggccgacgtgatggtgctgaccgttttctgtttgtccgtgttcgctctcataggactacagctgtttatggggaatcttagacacaaatgcgttaggaatttcacggctttgaacggcacgaacgggagcgtggaagcggatgggcttgtctgggagagcctggacttatacctgtccgatccggagaactatctgctgaagaatggaacgagcgatgtactgttatgcggcaacagttcggatgctggaacctgcccagaggggtataggtgcctcaaagccggagaaaaccccgatcatggatacacttcattcgactcctttgcatgggccttcctggccctatttcggctgatgacacaagattgctgggagcggctgtatcagcagaccctgcggtctgccggcaagatctatatgatcttctttatgttggtgattttcttgggaagcttctacctcgtaaatcttatcctggctgtggtggccatggcatatgaagaacagaatcaggcgactattgccgagaccgaggagaaggagaagcgatttcaggaggccatggaaatgctcaagaaagagcatgaggctctaacaattagaggcgtcgacactgtgtcacggtcctccctcgagatgagccctttggcacccgttaactcacacgaaagacgctctaaaaggcggaagcgaatgtcatcgggaaccgaggaatgcggcgaggatcgcctgccgaagtcagacagcgaagatgggccacgggccatgaaccacttgagcttaacaagagggctgtcgcgcacatccatgaagccgcggtcctctcgtgggagtatttttacgttcaggcggcgcgatctcgggagcgaggctgacttcgcagacgatgaaaactccacggccggagaatccgaaagtcatcacacttcccttctcgtcccgtggcctcttcgtcggacttcagcccagggtcaaccctcccccgggaccagcgctcctggacacgcccttcacggaaagaagaattctacagtcgactgtaatggagtcgtgagtctcctgggcgctggtgatcccgaggccacatccccaggatctcatctgctcaggccagttatgctggagcatccacccgacacgacaacaccttccgaggaacccgggggccctcagatgctgacctcacaggccccatgtgtggacggcttcgaggaacctggtgcccggcagagggccctctccgctgtgtctgtcctgacaagcgcccttgaagagctggaggagtcgagacataaatgcccaccctgctggaaccggttggctcagaggtatctcatatgggagtgttgtccactgtggatgtcaataaagcagggcgttaagctggtagtgatggacccattcaccgaccttaccataacaatgtgcatcgtgcttaatactctgtttatggcgttagagcactataacatgacgagcgaattcgaggagatgttgcaggtcggtaacctggtttttacagggatttttactgcagaaatgacctttaaaattatagccctggatccctattattatttccagcagggatggaatatcttcgattcaatcatagtgatcctgagtttaatggagctgggattgtcccgtatgtccaacctgtccgtgctcagatcttttagattgctgcgagtgttcaagctcgccaagagttggcccactttgaacacactgattaagatcattggaaacagcgttggcgcgttggggaacctgactttggtgctggcaattatcgtgttcatctttgctgtggtggggatgcagctctttggcaaaaattatagtgagttaagagattcagatagcgggctgctaccaaggtggcatatgatggacttctttcatgcatttttaatcatatttaggattctgtgtggtgaatggattgaaacaatgtgggattgtatggaagtgtctggtcaatccctgtgccttttagtcttcctgctggttatggtgattgggaatctggtggtgctcaatctattcttagccctgcttctatcaagctttagcgccgataacctaactgcacccgatgaggatagggaaatgaacaatctgcagctggccctggccaggatacagcgaggcttgagattcgtgaagagaactacttgggacttttgctgtggactgttgaggcaacgcccgcagaagcccgccgctctggctgctcagggccaactcccttcctgcatcgccacgccttactccccacctccacctgagacagagaaagtgccaccaacccgaaaagagacgcggttcgaggaaggcgagcagcctggtcaagggaccccaggggatcctgaaccagtatgcgtgcctattgccgtcgcggaatccgataccgacgaccaggaggaggacgaggaaaatagcttgggcactgaagaggaatcaagtaagcagaccccagaagattcctgttctgaggggtccaccgcagatatgactaataccgccgagttgctcgagcaaattcctgatctcggacaggatgtgaaggatcctgaggattgctttacggaagggtgtgtgcgacgctgcccatgctgtgctgtagatacgactcaggcccctggtaaagtatggtggagattacgcaagacatgttaccatattgtggaacactcctggttcgaaacgtttatcatctttatgattttgctctcatctggagcacttgccttcgaagacatctacctggaagagcgtaaaacgattaaggttcttcttgagtatgccgataaaatgtttacttatgtcttcgtgctcgaaatgcttctgaagtgggtggcttacggattcaagaagtacttcactaacgcttggtgctggttggactttctgatcgtcgacgtcagcctggtgtcactggtggctaatacgctagggtttgccgaaatgggacctattaaatctctgcgaactctgagggcactgaggcccctccgcgcactctcccggttcgaggggatgagagtggtcgtgaatgctctggtaggagcaataccctcgatcatgaacgtcttgcttgtttgcttgatcttctggttgatctttagcatcatgggggttaacctgttcgcaggtaagttcgggcgttgtatcaaccagactgaaggagacctccctttgaactacaccattgttaacaataaatcacagtgcgagtccttgaacctgactggggagctgtactggaccaaagtgaaagtaaattttgacaatgtgggagcaggatacctcgccctgctccaggtcgcgactttcaagggatggatggacattatgtacgccgccgtggactcaagaggatatgaagaacagcctcagtgggagtataatctgtacatgtatatctacttcgtaatttttatcatttttggctctttttttacccttaacctttttatcggggtgatcattgataacttcaatcaacaaaagaaaaagttgggaggacaggacatctttatgactgaagaacagaagaagtactacaacgcaatgaaaaaactgggtagcaaaaagcctcagaagcccattcctagaccattgaataaataccagggattcatttttgatatagtcacaaaacaagcatttgacgtcaccatcatgttcctcatttgtctgaacatggtgacaatgatggtcgagacagacgatcagtctccggagaagatcaacattcttgccaaaatcaaccttctatttgtagccattttcaccggagagtgcattgtgaagctggccgctctgcgacattactacttcacaaacagttggaatatatttgactttgtcgttgtcatcctatctattgttggaactgttctatccgatattattcagaagtactttttttccccaactttgtttcgcgtaatccgcctggctcgtatcggtagaattcttcggctgattagaggggcgaaggggatacggacgctactctttgcgctcatgatgtccttacctgccctctttaacatcggactcctcctgtttctcgtgatgttcatttacagtatcttcggaatggccaattttgcctatgtcaagtgggaggcagggattgacgatatgtttaattttcaaacgtttgccaattcaatgctatgtcttttccagattactacatctgcaggctgggacggccttctatcccctatacttaacactggccctccgtattgcgatccaaccctgcccaacagcaacgggagccggggtgactgtggctcccccgccgtggggatattgtttttcaccacatacatcataatttccttcctgatcgtagtcaatatgtatatcgctataatactcgaaaacttctcagtggccaccgaagagagtaccgagccgctgtccgaggacgacttcgatatgttttacgagatctgggagaaattcgatccggaggcaacgcagtttatcgaatattccgtgctctcagattttgccgatgctctctccgagcccctgaggatcgctaagcccaaccagatcagtttgattaacatggatctcccaatggtgagtggggaccggatccattgcatggacatcctgttcgccttcactaaacgggtgttaggggaatctggggagatggatgcactgaagatacagatggaggagaagtttatggctgccaacccgagcaagatatcctatgaacctattacgaccacattacgccgcaagcacgaagaagtttccgccatggtgatccaaagggctttccgtcggcaccttcttcagagaagtctgaagcacgcttcttttctctttagacagcaggcaggatctggcctcagcgaggaggatgcgccagaaagggagggactgattgcctacgtcatgagtgagaatttctcgcgcccattagggcctcctagctcgagcagcatctcctctacgagctttcctccctcctacgacagtgtcacaagggcgacatctgacaacttgcaggtgcgcggctctgattactctcatagcgaggatctggcagacttcccccctagtcctgatcgcgacagagagtcaatcgtgtag

SEQ ID NO: 134718 - DNA, 5889 bp, Artificial Sequence
  Description of Artificial Sequence: Synthetic coding sequence
atggctaacttcctgctaccccggggaacttcaagcttccgccgtttcactcgggaatccctggccgcgatcgagaaacggatggctgaaaagcaagcgcgggggtctactaccctgcaggagtcacgtgaaggtctgccagaggaggaggcccctcgcccccagttggaccttcaagcttctaagaaactgccagacctgtatggcaaccctccccaggaactaatcggcgagcctctggaggatctggaccctttctattcaacacagaagacctttatcgtcttgaacaaaggtaaaaccatttttcgcttcagcgctactaatgccctttatgtcttatccccattccatcctattcgtagagccgccgtgaagattcttgtccactccttgtttaacatgctcatcatgtgcaccattctcacaaactgtgttttcatggcacaacacgaccccccaccttggacgaaatacgtggagtacaccttcactgcgatctatacttttgaatctttggtgaagatactggcccgcgggttttgtctacatgccttcaccttcctaagggacccatggaattggcttgatttttctgtaattataatggcttatgtgtcagagaatatcaagctgggtaatttatctgcacttcggacctttagggtgcttagggcccttaagacgatttcagtaatcccagggttgaaaacaatcgtcggtgctctgattcaatctgttaaaaagctagccgacgttatggtgttgacagtgttttgcctgtcagttttcgccctgatcggcttgcaattgtttatgggaaatttacggcataaatgtgtgaggaattttactgctctgaacggaactaatgggagcgtcgaggcggatgggctcgtgtgggaatctttggacttgtacttgtccgatcctgaaaactacctgctgaaaaacggcacgtctgacgtcttgttatgcggaaattcctctgacgccggaacatgccctgaaggctacagatgtctgaaggccggcgagaatcccgatcacggctatacaagctttgattctttcgcatgggcatttttggcactgttccgtctgatgacacaggactgctgggagcgtttatatcagcagactttacggagcgcagggaaaatttatatgatattctttatgctggtgatcttcctgggcagtttctatttagtaaatctgatccttgctgtggtcgccatggcttacgaggaacaaaaccaggctacaattgcagagactgaggagaaggagaaacgctttcaggaggccatggagatgcttaagaaagagcatgaggcattgactattcgcggagtggacaccgtcagccggtccagtcttgaaatgtctccactggcaccagttaatagccatgagcggcgtagcaagagacgcaagaggatgtcatccggtactgaagagtgcggcgaggaccggctgcccaagtcggattcagaggatggcccccgagctatgaatcatctgtccctgactcgcggcctttcacgcacctctatgaaaccccggtcttcccggggatctatctttacattcagaagaagggacctcgggtccgaagccgatttcgcggatgacgagaactccacggctggcgagagtgagagccaccacacaagcctgctggtaccatggccactgcggcgcacctccgcccaaggccaaccgagcccaggaactagcgctcctggccacgccctgcacggcaagaagaattcaaccgtggattgcaatggcgtcgttagtctcctgggggccggggacccggaggcaaccagtcccggaagccatctcctgagaccagtgatgctggaacaccctccagataccacaactccctcagaagagccaggcggtccgcaaatgttgacctcccaggccccctgtgtggacggatttgaagagccaggcgctagacaacgcgcattgtccgctgtgtccgttctgacctctgccctggaggaattagaggagtccaggcacaagtgtccaccctgctggaaccggctggcacagcgctacctgatatgggaatgctgtcccctgtggatgtcaattaagcagggggttaaactggtcgtgatggacccctttactgacctcactatcacaatgtgtattgtcctaaacacactcttcatggctctggaacactataacatgacctccgagtttgaggaaatgctgcaggtggggaacctggtttttacaggaattttcacggccgaaatgacatttaagattatcgcactcgacccctactattattttcagcagggctggaacatcttcgacagcatcattgtgattctcagcctaatggagttaggccttagcagaatgagcaacctaagcgtgttgcggtcatttcgtttgctacgcgtgtttaagctagccaagagctggcccaccctcaatacacttattaaaatcattggcaatagcgttggcgcgcttggcaacctcactctggtcttagcaatcatcgtctttatctttgcagtggttggcatgcaattgtttgggaaaaattactccgaattacgcgactctgattcaggactgttacccagatggcatatgatggacttctttcatgcattcttgattatcttcagaatcctgtgcggcgagtggatcgagactatgtgggattgcatggaggtgtccgggcagtccctgtgtctgttggtgtttcttttggtgatggtgatcgggaaccttgtagtcttgaaccttttcctcgccctgctgctttccagcttcagcgctgataacttgacagcccctgatgaggacagagaaatgaataacctgcagcttgccctcgcacgcatacagcgcggattaaggttcgttaaacgtacaacttgggacttctgctgtggcctgcttcgccagcggccccagaaacccgcggcactggcagcgcaggggcaactgccttcatgtatcgccaccccatactccccaccgccaccagaaaccgagaaggtcccccctacgaggaaggagactcgattcgaggaaggggaacaacccggtcagggcaccccgggtgatcctgagccagtgtgcgttccgatagctgttgccgagagtgatactgacgaccaagaggaagatgaggaaaattcactaggcaccgaggaggaaagctcaaaacagacccctgaagattcatgctcagagggcagcactgccgatatgaccaacactgcagaactgttggaacaaataccagacctgggacaggatgtcaaggatccagaggactgtttcaccgagggctgcgtcagacgctgtccatgttgtgcagtggatactactcaagctcccgggaaggtgtggtggcgcttgcgcaagacgtgctaccacattgttgagcacagttggtttgagacgttcattatctttatgattctcctgtcttctggggcgctggcttttgaggacatctaccttgaggagcggaaaactattaaggtgttactggagtacgctgataagatgtttacttacgtgttcgtattggaaatgttactgaaatgggtcgcctacgggtttaagaagtattttacaaatgcctggtgttggctcgacttcctaattgtagacgtgtccctcgtctcactggtggcgaacacactgggatttgcggagatgggtccaatcaaatctctcaggacactccgggccctgagacctctgagggctctgagccggttcgagggcatgagggtcgtggtgaatgccctggtcggggccattccctccatcatgaatgttcttctggtgtgcttgattttctggctcatcttctctatcatgggagtgaatctttttgctggcaaattcggcaggtgcattaaccagactgaaggggatttaccattgaactacaccatcgtaaataacaagagccaatgtgagagtttaaacctgacaggggaactatattggactaaggtgaaagtgaactttgataacgttggtgctggctatctggcgctgctccaagttgcaacattcaaggggtggatggacattatgtacgcagctgtcgactcccgcggctacgaggagcaaccccaatgggagtacaacctgtacatgtacatctactttgttatcttcattattttcggtagcttctttacattgaatttatttataggagtgatcatcgataactttaaccagcagaagaagaaattaggtgggcaggatattttcatgaccgaagaacagaagaaatactacaatgcgatgaagaagctgggatctaaaaagccgcagaaacccatcccccgacctctgaacaagtatcagggattcattttcgatatcgtgacaaagcaggccttcgacgtgacaatcatgttccttatctgtcttaacatggttaccatgatggtggaaacagatgatcagtcaccagaaaagattaatatcctggctaagattaatctgttgttcgtggcgatcttcacaggcgagtgcattgttaaactcgccgcactcagacattattacttcactaattcatggaatatctttgactttgtagtggtcattcttagcatcgtgggcacggtgttgtccgatatcatccaaaagtactttttttcacctaccctgttcagagtgatcagattggctagaattgggcgcatcctgagattaatccgcggagcaaagggtatcagaaccttactcttcgcccttatgatgtctctgcctgcactattcaacatcggactgctgctgtttctggtaatgtttatttactcgatatttggcatggccaattttgcatacgtgaagtgggaggcaggcattgatgacatgttcaatttccagacctttgccaatagcatgctgtgtctattccagatcacgacttccgccgggtgggacgggcttctctcgcctatcttgaatactgggcctccgtactgcgaccctaccctgcctaattctaatggttcaaggggcgactgtggatcgcctgctgtggggatactgtttttcaccacgtatatcatcatttcttttctgatcgtggttaatatgtacatcgctatcatcttggaaaactttagcgtggcaaccgaggagtcgaccgaaccattatctgaggatgactttgatatgttctacgaaatctgggagaaatttgacccggaagcaacacagttcatcgagtactccgtgttgagtgatttcgctgatgccctgtctgaacccttaaggattgcaaaacctaatcaaatctccctgatcaacatggacttgcctatggtgtctggagatcgaatacattgcatggatatcttgttcgcgttcaccaagcgagtgctgggtgaaagcggagaaatggacgcactgaagatccaaatggaagaaaaatttatggcagccaacccttcaaagatatcttatgaacccattacaactactttacgccggaaacacgaggaagtgtcagctatggtgattcagcgcgcttttcggcggcatttgttacagcggtcgctgaagcacgcaagcttcctatttcggcagcaggcgggcagtgggctgtctgaagaagatgcgcccgagagagagggactcatcgcctatgttatgagtgagaatttcagcaggcctctgggcccaccctcgtcaagttccataagtagtacgagctttccccctagctacgatagcgttacaagggccacgagcgataacttgcaggtgaggggcagcgattacagccattccgaggacctggccgacttcccacctagtccggacagagatcgagaatctattgtgtag

SEQ ID NO: 134719 - DNA, 5889 bp, Artificial Sequence
  Description of Artificial Sequence: Synthetic coding sequence
atggccaatttccttctcccccgtggtactagttccttccgacgcttcacccgggagagtctagccgccatcgaaaaaagaatggcggaaaagcaggctcgcgggtccaccactctgcaggaatcaagggaaggacttcctgaggaagaagccccacgcccacagctggaccttcaggcctctaagaaactgcctgatctatatggcaatccaccccaggagttaattggggaacctctcgaggacctagaccccttctactctacacagaaaaccttcatcgtcctaaataaaggaaaaaccatatttaggttctccgctacgaatgctttatacgttctgtcaccctttcatcccattaggagagctgccgtgaaaatcttggtgcacagcctgtttaatatgttaattatgtgcactatacttacaaattgcgtgttcatggcgcaacacgaccctcccccatggactaaatacgttgagtatactttcaccgccatctataccttcgaaagcttggttaaaatcctcgcaagaggattctgcctccatgcctttaccttcttacgtgacccttggaattggttagactttagtgttatcataatggcgtacgtcagcgaaaatatcaagctgggaaacctttccgcccttcggacctttcgcgtgctgcgcgcgcttaagaccattagcgtgattcctgggttgaagaccatcgtcggagctcttattcagtccgtcaaaaaactggctgacgtgatggtcttaactgtgttctgtcttagtgtgttcgctttgattggactccagttgttcatgggtaacctacgacacaaatgtgtgaggaactttacagctctgaacggtaccaatggaagcgtggaagccgatgggcttgtgtgggaaagcttagatttgtatctgtccgatccagaaaactatctcctgaagaatggtacgtccgacgtccttttatgcggcaactcaagcgatgctggcacctgtccagaaggctaccgctgcctcaaggctggagaaaaccctgaccatggctacactagttttgacagcttcgcctgggcatttctggcactgttccgtttgatgactcaggattgttgggaacgcttgtaccagcagactctgagatccgctgggaagatatacatgatcttcttcatgctcgtgatctttctgggttctttctatctggtgaatttgatcttagcagtggtggctatggcatacgaggagcagaaccaggccaccatcgcggagaccgaggagaaggaaaagcggttccaggaggccatggagatgctgaagaaggagcacgaggcgctgaccataagaggagtggatactgtttcaaggagcagtctagagatgtctccgcttgctcctgtaaattcccatgagagacgaagcaagcggaggaagcggatgtctagcggcactgaggagtgcggcgaggaccggctgccaaaatctgattccgaggatggcccacgtgccatgaaccatctgtccctgacgcggggacttagtcgcacatctatgaagccacggagctctcgcggtagcattttcacattcagaagacgcgaccttggcagtgaggccgacttcgctgacgacgagaattcaacggccggtgaatctgaatctcatcacacttcgttactggtgccatggccacttcgcaggacctctgcacaaggacagccctccccaggcacctcagcgcctggccacgcccttcacggaaagaagaactccaccgtagactgcaatggagtcgtaagccttttgggcgctggagatccggaggcaacgtcaccaggctcgcatttgctccggccagtcatgctcgaacatcctcctgatacaaccacaccttccgaggaacctgggggaccgcaaatgcttacgagtcaggccccctgtgtagatgggttcgaagaaccgggtgcgcgacaaagagccttatcggccgtatctgttctcacctccgcacttgaggaactggaagaatcacggcacaaatgtcctccatgttggaatcgactggcccagagatacttgatctgggagtgctgtcctctgtggatgagtattaaacaaggggttaagttagtggtgatggatccatttaccgatttgactatcacaatgtgtatcgtcctgaatactcttttcatggccctggagcactacaacatgacatctgaattcgaagaaatgttgcaggtaggaaacctggtgtttacaggaatatttactgccgaaatgacctttaaaataattgccttggacccatattattacttccaacagggctggaacatttttgactccatcattgtaattttgagcctgatggagttgggactgtctcggatgtcgaacctgagcgtcctgcggagtttccgcctcctccgggtgttcaaactagcaaaatcctggcctacgctcaatacactgataaaaattatcggcaacagtgttggtgcactggggaatctcaccctggtcctcgccatcatcgtgttcattttcgcagtggtcggcatgcagttattcggaaagaactacagcgaattaagagattctgactcggggcttctcccacggtggcacatgatggatttctttcatgcttttctgatcatctttcgaattctgtgtggcgagtggattgaaacaatgtgggattgcatggaggtgtcaggtcagagtctgtgtctgctggtctttctgttggtgatggttattggcaatttggtagtattgaatttgttccttgctctgctactgtctagttttagcgccgacaatctgacggctcctgacgaggatagggaaatgaataatctgcagttggccctggctcgaatccagcggggcctccgctttgtaaagaggaccacatgggatttttgttgtggactcctgagacaacgacctcaaaaacctgccgcactcgcagctcagggccagctccccagctgcatcgcgaccccttatagcccgcccccgccagagacagagaaagtgcccccaacgcgcaaggaaacccggttcgaagagggcgaacagccgggacaaggcacaccgggcgatccagagcccgtatgtgtgcccatcgccgtggcagagagtgataccgatgatcaggaagaggacgaggagaattccctgggtaccgaagaagagtcctcaaaacaaacgcccgaggactcctgcagtgagggctcaactgcggacatgactaacactgccgagctattggaacagatccccgacctggggcaggacgtgaaggatcctgaagactgcttcaccgagggctgcgtcaggaggtgcccctgttgtgccgtggacacaacgcaggccccaggaaaggtgtggtggcggctgaggaagacctgttatcatatagttgaacattcctggtttgagacatttattatctttatgatcttgctaagctccggagctttagcttttgaggacatttacttagaagagaggaaaacaattaaggtgcttttagagtatgcagacaaaatgtttacgtatgtgtttgtgctggaaatgctgctcaagtgggttgcttacggcttcaaaaagtactttactaacgcttggtgttggttggattttctgatagtggacgtctcccttgtttccttagtcgccaatacactggggtttgccgagatgggccccattaagtctttgaggactcttcgcgctctgcgccctctccgcgcactctctcggttcgaagggatgcgggtagttgtcaatgccctagtgggggccattccctctatcatgaatgtgctgctggtttgtcttatcttctggctgattttctctattatgggcgtgaatctgttcgccggaaagttcggtagatgcattaatcagacagagggagatctgcctttgaactacaccatcgtaaacaataaatcgcaatgtgagtctctgaacctgacaggcgagctctactggacaaaggtcaaagtgaacttcgataatgtgggtgcagggtatcttgcactcctccaggtagccaccttcaaaggatggatggatattatgtatgcggccgtcgattcaagaggttacgaggagcagccccagtgggaatacaacctgtacatgtacatatacttcgttatttttatcattttcggaagcttttttactctaaacctgtttattggtgtgattattgacaattttaatcagcagaagaaaaaactgggcggccaagacatattcatgactgaggagcaaaaaaaatactacaacgccatgaaaaaactaggtagcaagaagccacagaaacccattccaaggcccttgaataagtatcaggggttcatctttgacattgtgaccaagcaagcctttgacgtgaccatcatgtttctcatatgcctcaacatggtcacaatgatggtggagactgatgatcagtcaccagagaagattaacatcctggccaagattaacctccttttcgtggccattttcactggcgagtgcatcgtcaaactggctgcgctcaggcactattactttaccaactcatggaacatcttcgatttcgtagtcgttattctgtctattgtcggcactgttctttctgacataatacagaagtattttttctctcccaccctttttcgggtgatccgcttggcgagaatcgggcgcatcctcaggcttattaggggggccaagggaatcagaacactgctgttcgcgctcatgatgagtcttcccgcattgtttaacatcgggttactactgttcttggttatgttcatttattctatctttggtatggccaatttcgcgtatgtgaaatgggaggccggcatagacgacatgttcaactttcagacctttgccaatagtatgctgtgtctatttcagataaccacaagtgcggggtgggatgggttactgtcaccaatattgaataccggcccaccctactgcgaccctactctacctaattctaacggatccagaggagattgcggttccccagcagtgggcattctgtttttcacaacctatatcattatatcattcttaatagtggtcaacatgtacatcgctatcatcctggaaaacttctctgtggcaacggaggagagtactgagcctctgagcgaagacgatttcgacatgttctatgagatctgggaaaagttcgaccccgaagccacccagtttatcgaatattccgtgctttcagatttcgctgacgccctgtctgaaccactgcgaatcgccaagccaaatcaaatttcccttattaacatggacctgcccatggtttcgggggataggattcattgtatggatattttattcgcctttaccaaacgagttctgggagaatccggtgagatggacgccctgaagattcagatggaggaaaagttcatggctgctaacccttcgaaaatttcttatgaacccataaccacgaccttgcgccggaaacatgaagaagtgagtgctatggtgatccaacgcgccttcagaaggcatctgctccagagaagtctgaaacacgcaagcttcctgttcagacagcaagccggttccggcttgagcgaggaggatgcaccagagcgcgagggtctgatcgcttatgtgatgtccgagaatttttcaagaccgcttggaccaccttcaagcagttccatcagctccaccagcttccccccatcttatgatagtgtgacacgcgccacctccgacaacctgcaagtgagaggaagtgactactctcactctgaagacctggcggacttcccacctagtcctgaccgcgacagggagagcatagtgtag

SEQ ID NO: 134720 - DNA, 5952 bp, Artificial Sequence
  Description of Artificial Sequence: Synthetic coding sequence
atggcaaattttctgcttcccagaggtacctcctctttcagaaggtttactcgggaaagcctggccgctatcgaaaaaaggatggccgaaaaacaggcccgtggatccaccaccttacaggagtcacgggaaggtttgcctgaagaagaagcgccacggccgcagctggatttgcaggccagtaaaaagctccctgacttatacggtaatccccctcaagaattgatcggagaacccctggaggacttagaccctttctacagcacccagaaaacattcattgtcttgaacaagggtaagactatcttccggttttccgctacgaatgccctgtacgtgctaagcccttttcatcccatccggagggcggccgtcaaaattctggtgcactccctgtttaacatgctgatcatgtgtactatcttgactaactgcgtctttatggcccagcatgatccccccccctggaccaaatacgtcgagtataccttcacagcgatttacacgtttgagtcactagtcaaaatcctcgctaggggtttctgcctacacgcttttacctttctcagagatccatggaactggctagacttttccgtgatcatcatggcgtacgtcagtgagaatataaagctcggcaatttatcagctctcagaacgttcagagtcttgagggccttgaagacgattagcgtgattcccggacttaaaacaatagtcggagcccttattcagagcgtcaagaagctcgccgacgtaatggtcctgactgtgttttgtctcagcgtgttcgccctgatcggattgcagttgttcatggggaatttaagacacaaatgtgttagaaacttcacagctctaaatgggaccaatggatcggtcgaggccgatggactcgtgtgggaatctttagacctgtacctctccgatcccgagaactatctgctaaaaaacgggacgagcgacgtcctcctttgcgggaacagtagcgatgccggtacatgccctgagggatatcgatgtctcaaagccggcgagaatcccgatcacggttacaccagtttcgattccttcgcttgggcgttcctcgccttattcaggctgatgacccaagattgctgggagagactctaccagcagaccttgcgatccgccgggaaaatctacatgattttcttcatgttggttatatttctgggctctttctacctcgtgaacttaattttggccgttgtcgccatggcctacgaggaacagaatcaggctaccatcgcagagacggaagagaaagagaagcggttccaggaagcaatggagatgctcaaaaaagagcatgaagccctgacaatcagaggcgtggatacagtatctcggtcatctttagaaatgagtcctttagccccggtaaacagccacgagcgcaggagcaaacgtaggaaaagaatgtcaagtggaacagaggagtgcggtgaggacaggctgccaaagagcgactctgaggacggtccccgtgcaatgaaccacttgagtctcacccgagggctgagtaggacttctatgaagcccagatcctcgcgaggttccatttttactttcaggcggcgagacctggggtccgaggccgacttcgccgatgatgaaaactcaacagcgggtgagagtgaaagtcatcacacctccctgcttgtaccttggccactcaggaggacctctgctcaggggcagcccagcccaggtacctctgccccaggccacgcccttcacggcaagaaaaattcaaccgtagactgcaatggtgtggtgtctctgctgggggccggtgatcctgaggctaccagcccggggtcccatctgttgaggccagtaatgttagaacatccacccgacactacaacacccagcgaggagcccggcggtcctcaaatgctcaccagccaggcaccttgcgtggatggtttcgaggagccgggggcaagacagcgggctctgagcgctgtgagcgtgctcaccagcgcactggaggagttagaagaaagtcggcacaaatgtcctccttgttggaatagattagctcagagatacctgatatgggaatgctgtcctctgtggatgtctatcaagcaaggagtaaagctcgttgtgatggacccattcacagatttgacaataacaatgtgcattgtgctgaatacactatttatggccctggaacattacaatatgacttccgaatttgaagagatgctgcaggtcgggaatctggtttttaccggaatcttcacagccgaaatgacctttaagattattgcccttgacccgtattactatttccagcaggggtggaatatttttgatagcattattgtaattttatccctgatggagctcggcctttcccggatgtctaatctctccgtgctgcggtcctttcggctacttcgcgtctttaagctcgccaaatcatggccaacgctgaacaccctgattaaaatcatcggaaacagtgtgggagccctgggaaatctgacactggtgctggccattattgtcttcatctttgcggttgttggcatgcaactgttcgggaaaaactacagcgaacttcgcgactccgacagcggcctgttgccacgctggcatatgatggattttttccacgccttcctgattatttttagaattctgtgcggggaatggatcgaaacgatgtgggattgcatggaggttagcggccagagcttatgccttctggttttcttgctggtgatggttatcggtaacctggtggtgcttaatttgtttctcgccttgttgctgtccagcttttccgcagacaatctgaccgcacctgacgaggatagggaaatgaataatctccagttagcactggctcgtatacagcggggacttaggttcgtgaagcggacgacatgggatttctgctgcgggctgctgaggcagcggccgcagaaacctgcggccctggctgctcagggacagcttccaagctgtattgccactccttattcccccccacctccagaaacggaaaaggtgccccctacgcgcaaggaaactcggttcgaagaaggcgagcagccgggacaagggaccccaggagaccccgagccagtatgcgttcctatcgcagtcgctgagtccgataccgatgaccaggaggaggatgaggaaaattccctgggtactgaggaggagagcagcaagcaagagtcccagcctgtgagcggaggccctgaggccccacctgattctaggacgtggtcacaggtcagcgctacagccagctctgaggcagaagccagcgcaagccaagcagattggcggcaacagtggaaagctgagccccaggcccccgggtgcggcgagacccccgaagattcttgtagtgagggatcaacagccgatatgaccaataccgctgagctgctcgaacagattccggacctggggcaggacgtgaaggatccagaagattgcttcaccgagggatgcgtgcgaaggtgcccgtgctgtgcggtagatacaacccaggcaccaggcaaggtctggtggagactacgtaaaacatgctatcatatagtggaacactcttggtttgagacttttattatttttatgattctccttagcagcggcgccctggccttcgaggatatctacctagaggagagaaagactatcaaagtgttgctggaatacgccgacaagatgttcacctacgtgtttgttctggaaatgctgcttaagtgggtggcttatggatttaagaagtatttcaccaatgcatggtgttggcttgactttctgatcgttgatgtcagtctcgtgtctttggtggcaaatacattgggctttgcagagatgggacccattaagtcccttcgcacgctacgcgcattgcggcctcttcgtgcactgtcacgttttgaaggtatgcgggtggtggtgaacgccctggttggagccattccaagcatcatgaacgtgctgctggtctgcttaattttctggctgatcttttccattatgggagttaacttatttgccggcaaatttggtcgctgcataaatcaaactgagggcgaccttcctcttaattatacaatcgttaataacaaatctcaatgtgaatctctcaatctgactggtgaactgtattggacaaaggtcaaagtgaattttgacaacgtgggagccgggtatctcgccctgttgcaggtcgccaccttcaaaggatggatggatattatgtatgcggccgtggattcacgagggtacgaggagcagccgcagtgggaatacaacttgtatatgtacatttactttgtgattttcatcattttcggatctttcttcactctgaacctgtttatcggcgtgataatcgacaacttcaaccagcaaaagaagaagctggggggccaggacatttttatgaccgaagagcaaaaaaagtattacaacgccatgaagaagttgggaagcaaaaagccacagaaaccaatcccaagacccctgaataagtatcaaggctttatctttgacattgtgaccaagcaagcctttgacgtgaccattatgtttttgatctgtttgaatatggtgaccatgatggtggagactgacgaccagtcacctgagaagatcaacattctggcaaaaataaatcttctgttcgttgccattttcacaggaaccgtgttatctgacattatccagaaatacttctttagcccaactttatttcgagtcattcggctggctagaattgggcgaatcctccgcctcattcgaggggcaaagggtatcaggacccttttgttcgccctaatgatgtcactacccgcactttttaacattggacttctgctgttcctcgttatgttcatttatagtatattcggtatggctaactttgcctacgtaaaatgggaggctggaatcgacgatatgttcaactttcagaccttcgcaaattctatgctatgcttattccagattaccacctccgcgggctgggacgggctcctgtcccccatcctcaacacaggtccgccctactgtgatcctacactcccgaattcaaatgggagccgtggcgactgtggctcaccagctgttgggatcctgttcttcaccacctacatcatcatctcatttctaatcgtggtgaacatgtatattgccattatactcgaaaacttctcagtggccaccgaggaaagcacagagcctctgagtgaggacgattttgatatgttctatgagatttgggagaaattcgatcctgaggcaactcaatttatcgagtacagtgtgctctcagacttcgccgacgctctcagcgagcctcttaggattgccaaaccaaaccagatttccctcattaacatggatctccctatggttagtggggatcgcatacattgcatggacattctgtttgcctttactaagcgggttctaggcgagtcaggggagatggatgctctgaagatccagatggaggagaaattcatggctgctaatccaagcaaaatctcatatgagcccattactaccaccctccggagaaagcatgaggaggtttcagctatggtcatccaacgcgcattccggcggcacttgctgcagcggtctttgaagcacgcaagcttcctgttccggcagcaagccgggtctggcctgagcgaggaggacgcgccagaacgagagggccttattgcgtatgtgatgagtgaaaacttttctcgaccattgggaccgccatcaagcagttccatcagctctaccagcttccctcccagttacgacagcgtgacacgggccacaagcgacaatctacaggtgagggggagcgactattctcattccgaggacctggccgatttccccccgtcaccggatagagaccgagaatcgatcgtatag

SEQ ID NO: 134721 - DNA, 5049 bp, Artificial Sequence
  Description of Artificial Sequence: Synthetic coding sequence
atgttggcttcgcctgagccaaaaggcctcgtgccttttacaaaggaatcctttgagctgataaaacaacacatagctaagacacacaatgaagaccacgaagaggaggatctgaaacctacaccggacctagaggtgggcaaaaaactgccattcatctacggtaacctgtcccaggggatggtcagcgaacccctcgaggacgtcgacccttattattacaagaagaagaatactttcatcgtcctgaataaaaatcgaaccatctttcgctttaatgccgccagcatactatgcacactcagtccgttcaattgcatccggcggaccaccatcaaggtgttagtgcatcctttcttccaattgttcatactgatttctgtcctgatcgactgtgtctttatgtccctgacaaatctccccaagtggcggccggtgttggaaaacactctgttgggcatatataccttcgaaattctggtgaaactgttcgcgcgaggagtgtgggctggatcgtttagcttcttgggcgatccatggaattggctggatttttcggtcaccgtcttcgaggttattatcaggtactcccctctggatttcatcccaacactgcagaccgcaaggacactcaggattttaaaaataatccccctaaatcaaggcctcaagtcactggtgggggtactgattcattgtctgaaacagctgattggagtgattatcctcactctctttttcctgtcgatttttagcctgatcggaatggggctgtttatgggcaatctcaagcataaatgttttcgatggcctcaggagaatgagaacgaaactctgcataatcgaaccggtaacccctactatatacgcgagacggaaaatttctattatctggaaggcgagagatatgcccttctctgtggaaacaggactgacgccggtcaatgtccagaggggtatgtgtgcgtgaaagcgggtataaatccggatcaagggtttacaaacttcgacagtttcggctgggccttatttgcactctttcgcctgatggcgcaggattatccagaagtgctctatcaccagatactgtatgcaagtggaaaggtgtatatgattttcttcgtcgtagtttccttcttgttctctttttatatggctagcttgtttttggggatcctggctatggcttacgaggaagaaaaacagagagtgggcgagatttccaaaaaaattgaaccaaagtttcagcagacaggtaaagaactccaggaggggaacgaaactgacgaagctaagactatccagattgagatgaagaaacgatctcctatctcgaccgacacttccctcgacgtgctggaagatgctacgctgaggcacaaagaggagctcgagaaatcaaaaaaaatatgccccctttactggtacaaattcgccaagaccttcctaatctggaactgtagcccctgttggcttaagctcaaggagtttgtgcaccgtatcataatggcccctttcacggatctgttcctaatcatttgcatcatcctgaacgtctgcttcctcaccctcgaacattaccccatgagcaagcagacaaataccctgctgaacattggcaacctagtgtttatcggtatattcacggcggagatgatttttaaaataatagctatgcatccttatggctactttcaggtgggctggaacattttcgattctatgatcgtgttccacgggcttatcgaactttgtctggctaatgtggcgggcatggctctgctgaggctcttccggatgctgaggatttttaaattgggcaagtactggcccacattccagatcctgatgtggagcttaagtaatagctgggtcgctctgaaggatttggtcctgctgcttttcacctttatctttttcagtgctgcttttggcatgaagctgtttggcaagaattatgaggagttcgtctgccatatcgacaaagattgccagctcccccggtggcacatgcatgatttctttcattccttcctgaacgtgtttagaatactatgcggtgaatgggtcgaaacactctgggattgcatggaagtagcggggcaaagttggtgcatccccttctacttgatggtcatcttaattgggaacctactggtactttaccttttcctggccctggtatctagctttagttcttgcaaggacgtcactgctgaggaaaataacgaggccaagaatctgcagctagcggtggctcggatcaagaagggtatcaactatgtcctgctgaagatcctgtgtaagacacagaacgttccaaaagacactatggaccatgtcaacgaggtgtatgtgaaggaggatatttccgaccacacactgtctgagctttcaaatacacaggacttccttaaagataaggagaagtctagcgggactgagaaaaacgctactgaaaatgagtcacagagcttgatcccatccccctcagtgtccgagactgtccccattgccagcggagagagcgatattgagaacttggacaataaagagattcagtcgaaatcaggagatggcggctctaaggagaaaatcaagcagtcatcctcatcagaatgtagtaccgtagacatcgctattagtgaggaagaggagatgttctatggcggagagcggtctaagcacctaaagaacgggtgccgtagaggcagcagcctgggacagatttcaggagcatccaaaaagggcaaaatctggcagaacattagaaagacctgctgcaagatcgtggaaaacaactggttcaaatgcttcattgggctggtcacactcctgagcaccggaactctggcttttgaagacatctatatggaccaacggaagaccatcaaaatcctcttggagtacgcggacatgatatttacctatattttcatattggaaatgctattgaagtggatggcgtatggcttcaaagcctacttctccaacggatggtatcgactggactttgtggtggttatcgtcttttgccttagcctcatcgggaagaccagagaggaactgaaaccactgatttcgatgaagttcctgcgaccgctccgggtactgagtcagttcgaacggatgaaggtggtggtcagggccctcatcaaaacaactctcccaaccctcaacgtgtttttggtttgtctaatgatttggcttatattctcaataatgggcgtcgatttgttcgccggccggttttacgagtgcatcgatcccactagtggcgaacgcttccctagctcggaggtgatgaataaatcccgctgcgagtccctgctcttcaatgagagtatgctgtgggagaatgctaaaatgaactttgataacgtcggcaacggcttcctctctctactgcaagtggccacattcaatgggtggatcacgatcatgaacagtgcaatagatagcgttgcggtgaatattcagcctcacttcgaagtgaatatttacatgtattgttatttcatcaatttcatcatcttcggcgtctttctccccttatcgatgttgatcaccgttatcattgacaacttcaataaacacaagattaagctgggcgggtcgaatatttttatcacagtcaagcagcgcaaacagtatcgcagactgaagaagctcatgtatgaagattctcaacggccagtgccaagaccacttaacaagcttcagggatttatcttcgacgtagtgacctctcaggcctttaacgtgatcgtgatggtcctaatctgttttcaggccattgcgatgatgatcgataccgacgtgcagagtctgcagatgagcatagcactgtattggattaattccatcttcgtcatgctctataccatggaatgcatattgaagctgatcgccttccgctgcttttattttaccatcgcttggaacatctttgactttatggtggtgatcttttcaatcacaggtctctgcctaccaatgactgttggatcatatctggtgcccccatctctggtgcagctgatcttgctgtctagaattatacacatgctgaggttgggaaaaggcccgaaagtgtttcacaacctcatgcttcccttgatgctttctctgccagctctacttaacatcatcctgctgatattcctcgttatgtttatctacgctgtgtttgggatgtacaatttcgcgtatgtgaagaaagaagcaggaattaatgatgtaagcaattttgagacattcggcaattccatgttgtgtttgtttcaggtcgctatttttgctggatgggatggaatgctggacgcaattttcaactcaaaatggtcagattgcgaccctgacaaaattaacccgggtacacaggtccggggagactgcggcaatccttcggtgggaatattctatttcgtctcatacatactcatttcttggcttatcatcgtaaacatgtatattgtcgtggtgatggagttcctgaacatcgcctccaaaaagaaaaataagaccctttctgaagatgacttcagaaagtttttccaagtgtggaagcggttcgacccggacaggacccagtacatagacagctctaagctctccgactttgcagccgcactcgacccacctctgttcatggccaaaccgaataaaggccagcttatcgccctggacctgccaatggcagtgggggaccgcattcattgcctggatattctcttagctttcaccaagcgcgtgatgggccaggatgtcaggatggaaaaggtggtctccgagatcgaatcgggcttcctgctagcaaacccattcaaaatcacctgcgagccgattactaccactctcaaacggaagcaggaggccgtctcggccactataatacaaagagcctataagaactacaggctgagacgcaatgacaaaaacacttctgatatacatatgatcgatggggaccgggatgtgcacgctacaaaggagggagcctactttgacaaggctaaggaaaaatcccctatacaatctcagatctag

SEQ ID NO: 134722 - DNA, 5049 bp, Artificial Sequence
  Description of Artificial Sequence: Synthetic coding sequence
atgctggccagccctgaaccaaaaggactagttccttttaccaaggaaagcttcgaattgatcaagcagcacattgccaaaactcataatgaagaccacgaagaggaggatctgaagcctaccccagatctcgaggtcgggaagaaactgcctttcatctatggaaacctgtcccaggggatggtaagtgagccgttagaagatgtagacccatattactacaaaaagaagaacacgttcatagtgctgaataagaatcgaacaatttttagatttaatgctgctagtatcctgtgcacattgtccccatttaactgtattagacggacaactatcaaagtcctcgtccaccctttctttcaactgttcattctcatctccgttctaattgactgtgtattcatgagtttaacaaatctccctaagtggaggccagtccttgagaacaccctcctcggtatctatacctttgaaatcctcgttaaactgttcgctcgaggtgtttgggcagggagctttagtttcctcggcgatccctggaactggctcgatttctcagtgactgtgtttgaggtgataattcgctactctcctctagattttatacccaccctgcagacagcgcgtacactgcgcatcctcaagatcattccattgaatcaggggctgaaaagtctggtgggggtgctaatacattgtttgaagcagcttattggggtgataatactaacactgtttttcctttctatttttagcctcattggcatggggttatttatgggaaatctcaaacacaaatgctttagatggccccaggaaaacgagaacgaaactctgcacaatcggactggcaatccttactatatacgcgagacagaaaatttttactacctggaaggagagcggtacgcactgctgtgcggaaatagaaccgacgcaggacagtgtcctgagggttacgtctgtgtgaaagccggaattaaccccgatcaggggtttactaattttgactcatttggttgggccctctttgccctgttccggctgatggcccaggactaccccgaagttctgtatcaccagatactatacgcgtcaggcaaagtgtatatgattttctttgtggtcgtgtccttcctcttctccttctatatggcttccctgtttctcggcatcctggccatggcctacgaggaggagaagcagcgagttggagaaatcagcaagaaaattgaacccaagttccagcagaccggcaaagaactgcaggaggggaatgagaccgatgaagccaaaactatccaaattgagatgaaaaagcggtccccaatttcaacagacacctcactcgacgttctggaagatgccaccttgcggcacaaggaggaacttgaaaaatctaaaaagatctgtcccctttattggtacaagtttgctaagacatttttgatctggaactgtagcccgtgttggttgaaactgaaggaatttgtccaccgtattataatggctcccttcactgacctgtttcttattatctgcataatccttaatgtttgcttcctcaccttagaacattatccaatgagtaaacagactaataccctgctgaatataggaaatctcgtgttcataggaatattcaccgctgaaatgatctttaagatcatcgcaatgcacccctacggttatttccaggtcgggtggaacattttcgatagtatgattgtgtttcacggcctgatcgagctgtgccttgccaacgtagctgggatggcactgctgcggctgttccgtatgcttagaattttcaagcttggcaaatactggccaacattccagattcttatgtggagcctctctaacagctgggtggcattgaaagatttggtcttgcttctgtttacgttcatatttttcagcgctgcgtttggcatgaagctcttcggcaaaaactacgaggagtttgtgtgtcatattgacaaggactgtcagttaccacgctggcacatgcacgatttttttcattctttcttaaacgtatttcgtatcctgtgtggcgaatgggtggagaccctttgggattgtatggaagttgccggacaatcgtggtgcattcccttttatcttatggtcatcctcattggcaacttgctcgtcctgtacctcttcctggctctcgtatcgtcattttcatcatgcaaggatgtaacagctgaagagaacaacgaagctaaaaacctgcagttggccgtggcacgtataaagaagggcatcaattatgtcttactgaagatcctctgcaagacccaaaacgtgcccaaggataccatggatcacgtcaatgaggtttacgtgaaggaggatattagcgaccacactctctccgagctgtccaacacccaagatttcttgaaggataaggagaagtcctcaggcaccgaaaagaacgcaaccgaaaacgagtcgcagagcctcatcccatcgccctctgtatccgagacggtccctattgcctctggcgaatctgatatagaaaacctcgacaacaaggagatacagagcaaaagcggtgacgggggttccaaagagaaaattaaacagtcgagttcctctgaatgtagtacggtcgacatagccattagcgaggaagaggagatgttctatggtggagagcgctcaaagcatttaaaaaatggctgtagaagaggatcaagcctgggacagatctccggcgcctccaaaaagggtaaaatctggcaaaatatcaggaaaacctgctgcaaaatagtcgagaataattggtttaaatgctttatagggttggtgaccctgctgtctaccggcacactggcattcgaggatatctacatggaccagaggaaaactatcaaaatcctcctggagtatgccgacatgattttcacttacatcttcattctggagatgctgttgaagtggatggcttacggttttaaggcatatttctccaacggttggtataggctcgacttcgttgttgtgatcgtcttttgcctcagcctcatcgggaagaccagggaggaattgaaaccccttatatctatgaaatttctgcggccactgagagtcctgagccagttcgagcggatgaaggtagtggtgcgcgctcttataaagacgacgctccctaccctgaacgttttcctcgtgtgcttgatgatttggctgatctttagcataatgggcgtcgatctgtttgctggtcgattctatgagtgcatagacccaacgtctggtgagcggttccccagcagcgaggtaatgaacaaatcacgctgtgaatcactcctttttaatgaatccatgctgtgggagaatgccaaaatgaattttgataacgtcggtaacggcttcctaagccttctgcaggtggccactttcaatggatggatcaccattatgaattcagcgattgactcagtcgctgtgaacattcagcctcattttgaagtgaacatctacatgtactgttattttattaactttatcatattcggcgtgtttttaccattgagcatgttgatcaccgtcattatcgataacttcaacaagcacaagatcaagctgggcgggagcaacatctttataaccgtaaaacaacgaaagcagtacaggaggttaaaaaaactcatgtatgaggatagccagcggcctgtgcctcgtccactcaataagttgcaggggttcatttttgatgtggtgacaagtcaagcttttaacgttatagttatggttttaatttgttttcaggccatagccatgatgatcgatacagatgtgcaatctttacagatgtccattgccttgtattggataaactctatctttgtcatgctgtataccatggagtgtatccttaaactaatcgcttttcgctgcttttatttcacaattgcctggaatatttttgattttatggttgtgatatttagtatcaccggactgtgcctgcctatgactgtgggttcatatcttgtgcctccatccctggtccaactcatccttctatcgcgcatcatccatatgttgcgacttggtaaagggcccaaggttttccataacctgatgctgcccctcatgctctctctccccgccttactaaatatcatcttgttaatcttcttggtgatgttcatttatgctgtgtttggcatgtacaactttgcttatgtgaaaaaggaagccgggattaacgatgtaagtaattttgaaacctttggcaactcaatgctgtgcctgtttcaggtggccatctttgccggatgggatggtatgctcgacgctatcttcaactccaaatggagcgactgcgatcccgacaagatcaatcctggcacacaggtcagaggcgactgtggtaatccctccgtggggatcttctattttgtgagttacattctgatttcatggcttataattgtgaatatgtacattgtggtcgtgatggagttcttgaacatcgcttccaaaaaaaagaacaagacacttagtgaagatgatttccgaaaatttttccaggtgtggaagcgcttcgatcctgataggacacagtatattgattccagcaagctgtccgattttgctgccgcgctcgatccccctttgttcatggcgaaaccaaataaggggcagctgattgccctcgacttacccatggcggtgggcgaccggatccactgccttgatatcctgctggcatttaccaagcgagttatgggccaagatgttcggatggaaaaagtggtgtcagaaatcgaatccggattcctcctcgctaacccatttaagatcacttgtgaacccataaccacaaccttaaaaagaaagcaggaggccgtgagcgctacaatcatccagcgtgcgtacaagaactataggcttcgcagaaacgataagaatacctcagatatacacatgatcgatggggatagagatgttcacgccactaaggagggggcctatttcgataaagcaaaagaaaaatctcctattcaatcacagatctag

SEQ ID NO: 134723 - DNA, 2592 bp, Artificial Sequence
  Description of Artificial Sequence: Synthetic coding sequence
atgttagccagcccggagccgaaaggcctggtcccctttaccaaggagtcgtttgaactaatcaaacaacatatcgccaagacacacaatgaagaccatgaggaagaggacctcaagccgaccccagaccttgaggtggggaaaaaattaccctttatttatgggaacctctcacagggcatggtgagtgagcctttagaggatgttgacccctattattataaaaagaaaaacactttcattgtgttaaacaagaacaggactatatttcggttcaatgccgcgtctatcctatgtaccctctcgccattcaattgcattcgccgcaccacaatcaaagtgcttgtgcatcccttttttcagcttttcatcctgattagcgttctgatcgattgtgtttttatgtccctgactaacctgccaaagtggcggcctgtgttagagaataccctgctcgggatctacaccttcgagatcctggtcaagttgtttgcgaggggggtatgggccggctcctttagttttctgggcgatccttggaactggctcgactttagcgtgaccgtgtttgaggtgataataagatattccccccttgatttcattcctactctgcagacggctcgcacactaagaatcttgaaaatcattcctttgaaccaggggctcaagagtctagtaggcgtgctgatccattgcctcaagcagttgatcggcgtgatcatcctcacgttgttcttcctgagtattttttcccttataggcatgggtctctttatggggaacctgaaacataagtgtttcagatggcctcaggagaatgaaaatgaaactctgcataacagaactggcaacccctactatattagagaaaccgagaacttctattacctggagggagaaagatacgccctgctctgcggcaacaggactgatgccggccagtgccccgagggctacgtctgcgtgaaggcggggataaacccagatcagggatttaccaattttgacagtttcggttgggcactatttgctctgtttcgccttatggctcaggattatcctgaggtactgtatcaccaaatcctttatgccagcggcaaggtctatatgattttctttgtggtcgtatcgttcctcttctctttttacatggcttctctgttcctggggattctcgcaatggcctatgaggaagaaaaacagcgcgtcggcgagattagcaaaaaaatagagcctaaattccaacagaccggtaaagagctccaagaaggtaatgagactgatgaggccaagactatccagattgaaatgaaaaagcgttcacctatatccacagacacttctcttgacgtgttggaggacgctaccctcagacacaaggaggagttggaaaagagcaagaagatttgtcccctgtattggtataagtttgctaaaacttttttgatctggaattgctctccgtgttggctgaagttgaaagaatttgttcaccgcataatcatggcaccgtttacagatctctttctgattatctgtattattctgaacgtgtgcttcttgaccttagaacactaccctatgtcaaagcagaccaacaccttgctgaacattggcaatttggtttttatcggcatctttactgctgagatgatatttaagataatcgctatgcatccctatggatatttccaggtggggtggaacatattcgattcgatgatcgtgttccacggcctgatcgaactctgtctagccaacgtggccggcatggctctgctcaggttatttcgcatgctccggatttttaaactgggcaagtactggcccacatttcagattttgatgtggtctctatccaactcatgggtagctctgaaagatctcgtgctgctgctgtttacgttcatatttttcagcgctgcctttggaatgaagttattcgggaaaaattacgaggagttcgtttgtcacatagacaaagattgtcaactccctcgatggcatatgcatgacttctttcatagtttcctcaacgtatttaggattctttgtggggagtgggttgaaaccctttgggattgtatggaggtagcaggtcagtcctggtgtatccctttttacctgatggttatcctgatcggcaacctactggtattgtacctcttcctcgcacttgtttcctccttctcctcctgtaaagacgtgactgccgaggagaacaatgaggccaaaaatctccaattggcagtggccagaatcaagaagggcatcaattatgtgctcctgaaaatcttgtgcaaaacacaaaacgtcccaaaagatacgatggaccacgtcaatgaagtgtacgtgaaggaagacatctctgaccacacacttagtgaactgtctaacacccaggactttctgaaagacaaagaaaaatcatcaggaactgaaaaaaacgcgactgagaacgagtcacagtccttaataccgagcccgagtgttagtgaaacagtgcctattgccagcggagaaagtgacattgaaaatttggacaacaaggaaattcagtcaaagtcgggcgacggcggttccaagtag

SEQ ID NO: 134724 - DNA, 1209 bp, Artificial Sequence
  Description of Artificial Sequence: Synthetic coding sequence
atgctagcctcaccggaacccaaaggactggtgccttttaccaaagagtcttttgagttgatcaaacagcatattgccaaaactcacaatgaggaccacgaagaggaggacctgaagcccacgcccgacttggaggtgggaaaaaaactgccctttatttacggcaacttatcccaaggaatggtaagcgaacccctggaggatgtggatccatattactataaaaagaaaaataccttcattgtactcaataaaaacaggaccatcttccggtttaacgccgcctcgattctgtgtacactttctccatttaactgtatcaggagaacgacgattaaggtcctggtgcatccattcttccagctctttatccttatcagtgtgcttattgactgcgtgtttatgagcctcaccaacctccccaagtggagacctgttctggaaaatactctgctgggcatctacacctttgagatactggtgaagctgttcgctagaggcgtgtgggccgggagcttctcctttctgggcgatccatggaactggctcgattttagtgttacagtgtttgaagtgatcatacggtatagccctctggactttatccctacactgcaaacagcgcgcactctcagaatcctgaagatcattcctcttaatcaaggcctcaagagcctcgtcggtgtgctcattcactgtctaaaacagctgattggagtaatcattcttactttgttcttcctgtctatctttagcctgattgggatgggtctcttcatgggcaatctgaaacacaaatgctttagatggcctcaggagaacgaaaacgagacactccacaacaggactgggaacccgtattacatcagggagaccgaaaacttctactatctggaaggggagcgatatgctctcctgtgcggtaacaggacagatgcgggacagtgccctgaaggttacgtgtgtgtgaaagccggtattaaccctgatcaggggttcacaaatttcgactcgttcgggtgggcgttgttcgccttgtttagacttatggcccaggattacccagaggttctgtatcaccagattctctatgcaagcggtaaggtttacatgatttttttcgtggtggtgtcctttctgttttcattctatatggccagtctttttttgggcattttggccatggcatacgaggaggagaagcaatag

SEQ ID NO: 134725 - DNA, 5871 bp, Artificial Sequence
  Description of Artificial Sequence: Synthetic coding sequence
atggaattccccatcggtagtctagagacaaacaatttcaggcgcttcacacctgaatctttagtcgagatagaaaagcagattgcagctaagcaggggacgaaaaaggccagagaaaaacatcgagagcaaaaagaccaggaggagaaaccaaggccacagttggaccttaaagcatgcaatcagctacctaaattctacggtgagctccccgctgaattgattggcgagcccctagaggatctggatcccttttatagcacccaccggaccttcatggtgctaaacaagggcagaacgatatcccggttctctgccacacgggcactttggctgttctccccattcaatctcatccggagaactgcaatcaaagtgtccgtccactcatggttcagcctgtttattaccgtgaccattttagtgaattgcgtgtgtatgacacgcaccgacctgcctgagaagatcgagtacgtttttaccgttatttacacgttcgaagccttgatcaagattctggccagaggcttctgcctcaatgagtttacctaccttagagacccctggaactggctcgacttctccgtcattacgctcgcctacgtaggaacagccattgacctgaggggcataagtggtttgcggaccttccgcgtgctccgggcgttaaagacagtcagtgtgatcccagggctaaaagtcattgtcggggcgcttatccactccgtgaagaagttagccgacgtcacgatcctcacaatcttttgcctgagcgtgttcgctcttgttggcctgcagctgtttaagggcaatctaaagaataagtgtgtaaagaatgatatggctgttaatgaaactacaaattattccagtcaccgcaagcccgatatatatattaacaagagaggcaccagcgatccactcctatgcggaaacggaagtgacagcggccactgcccagatggctacatctgtcttaagaccagcgacaatcctgattttaattatacttcgtttgattccttcgcttgggcctttctttctctgtttcgcctcatgacccaggattcttgggaacgtctttaccagcagactctgcgaacttccggaaagatctatatgatattctttgttctggtcatttttctcggatctttttacctggtgaacctgatcctggccgtcgtgacaatggcctatgaggagcaaaaccaggccacaacagacgaaattgaggctaaagaaaaaaagtttcaggaagcgctggagatgctccgcaaggagcaggaagtgctggccgcactgggcattgatacgaccagcctgcattctcacaacggttctccccttacgtccaagaacgctagtgaaaggcggcacaggatcaaaccaagggtcagtgaggggtccactgaggacaataagtctcctagatccgacccatacaaccagaggcgtatgagcttcctcggactggccagcgggaagcgaagagcttctcacgggtccgtctttcacttcagatctccgggcagggacataagtctgcctgagggcgtcactgacgacggagttttcccaggagaccacgaatcacacagggggtccctgctgctggggggaggagccgggcagcagggtccactgcccaggagccccctgccccagccatctaatcctgacagccggcacggagaagatgagcatcagcctccacccacatctgaactcgcgcccggtgctgtggacgtgtcagcgttcgacgccggccaaaaaaaaaccttcctgtcagcagaatacctggacgaaccttttagggctcaaagggcgatgtcggtggtcagcatcatcaccagcgtgctggaagaactcgaggaatccgagcagaagtgcccgccttgtttgacctctctgtcacagaagtatctgatatgggattgctgccccatgtgggtcaaattaaagaccatcctgttcgggctggtcacggaccctttcgcggagttaaccataacactctgtattgttgtcaataccatcttcatggcaatggagcatcacgggatgagccctacattcgaagccatgctgcagattggaaatattgtgtttacaatttttttcaccgcagaaatggtgtttaagattatcgcattcgacccatattactacttccaaaaaaagtggaatatatttgactgcataattgtgactgtgagtctgctggagcttggcgtcgctaaaaagggcagcttgtcagttcttaggtctttcagactgctacgagttttcaaactggccaaatcgtggcctacactgaacactctcataaagatcatcggtaacagtgttggagccctgggcaacctgaccattatcctcgctatcattgtatttgtgtttgcactcgtcggcaaacaattgctcggagagaactataggaacaatcggaaaaatatcagtgctcctcacgaagactggccccggtggcacatgcacgacttttttcactcttttctcatcgtctttcgaatcctctgtggcgaatggatcgagaatatgtgggcttgcatggaggttgggcaaaagtctatttgcttgattctgtttctcactgtgatggtgctcgggaatctggtggtgttaaacttgtttatcgctctgctgttgaactctttctcggctgataacctcaccgctccggaggatgatggtgaggtcaataatctgcaggtcgctcttgcaagaatccaggtgtttgggcaccggacaaaacaagctttatgttcttttttttcgcggtcctgtcctttccctcaacccaaagctgaacctgagcttgtggtgaagcttcccctgagcagctccaaggcagagaatcacatcgccgccaatactgctcgcggatcatccggaggattacaagcccctagagggccacgcgacgaacacagcgattttatcgccaatcctactgtgtgggtgtccgtgccgatcgcagaaggtgaatccgatcttgatgatctcgaagatgacgggggcgaggacgctcagtctttccagcaagaggtcatcccaaagggtcagcaggagcagcttcaacaagtggaacgttgcggtgaccatctcactccgaggtctccagggacaggcacttcctctgaagacctggctccatccctgggcgaaacttggaaggacgaaagcgtccctcaggtccctgccgagggagtcgacgatactagttccagtgaaggtagcacagttgactgtctggaccccgaagaaattctgagaaaaatcccagagctcgccgatgatctggaggagcctgatgattgcttcacagagggttgtatacgccattgtccttgttgcaaacttgacaccaccaagagtccttgggacgtcgggtggcaagtaagaaagacttgctaccggatcgtagaacattcctggttcgagtcttttatcatcttcatgatcctgttgtcatccggatccttggccttcgaggattactatctggaccagaagccaacagttaaggctctcttggagtacacagatcgagtgtttacattcatatttgtgttcgagatgctgctcaaatgggtcgcctatggcttcaaaaaatatttcacaaatgcctggtgctggctagattttctgatcgtgaacatctcgctcatcagtctgacagcaaaaatcctggaatactctgaggtggcccccatcaaagccttgcgcacacttagggcactaagaccacttcgggccctctcccgatttgaaggtatgcgtgtagtagtggacgccctggttggcgccatcccatccattatgaatgtgctgctagtatgcctgattttttggctcatattctcaatcatgggcgtgaatctgtttgcgggtaagttctggagatgcatcaattacacagacggagagtttagcctagtgccgctctccatcgttaacaacaagtccgattgcaaaatacagaactctactggctctttcttttgggtcaacgtgaaggtgaactttgacaacgtggctatggggtacttggctctgttgcaagtggcaactttcaagggctggatggacattatgtacgctgcggtagactctcgcgaggtgaatatgcagccaaagtgggaggacaatgtatacatgtacctctacttcgtcatcttcatcatttttggggggtttttcaccttaaacctttttgtcggggtgattatcgacaactttaatcagcagaaaaaaaagttaggcggacaggacattttcatgactgaagaacagaagaaatattataacgccatgaagaagctgggatcaaagaaacctcagaaacccattcctcgcccactgaacaagtttcaggggttcgtgtttgacattgtgacccggcaagctttcgatatcacaataatggtgcttatctgtttgaacatgatcacaatgatggtcgaaactgatgaccaatccgaggaaaaaacaaagatcctaggaaaaattaatcaattttttgtggccgtgtttacgggcgaatgtgtcatgaagatgtttgccctgcggcagtactatttcaccaacggctggaacgtgttcgactttatagtcgtagtcctgtcaatcgcctctcttattttttcggcaattttaaaaagtctgcagtcatacttctcaccgactctgtttcgtgtaattcggctggcacgtatcggcaggatattacgtctgatacgggctgccaaaggaatcaggaccctgctcttcgcactgatgatgtcgttaccagcgctatttaatatcggtttgctactgtttctcgttatgtttatatattccattttcggcatgtcaagctttccacacgtgaggtgggaagctgggattgacgatatgttcaattttcagacttttgcgaattccatgctgtgcctgttccagatcacaacgagcgccgggtgggacggcctcctgagccccatactcaatactggccccccttactgcgaccccaacctccctaactcaaacgggacgcgaggagattgcgggtcaccagccgtggggatcattttttttacaacatatattattatttcttttctgattatggtgaacatgtacatagccgtgatcctcgaaaacttcaatgtggccacggaagagtccactgagccattgagcgaagatgatttcgacatgttctacgaaacatgggagaaattcgatcctgaagccacacagtttataacgttcagcgccctcagcgactttgcagatacactgagtggcccacttaggattccgaaacccaaccgaaatattcttatccaaatggacctgccgctggtccctggagataaaatacactgcctggatatcctctttgctttcaccaagaatgtcctcggggaaagtggcgaactagattccttgaaagcaaatatggaagagaagttcatggcaaccaatctcagcaaaagctcctatgaacctatcgccaccaccctgagatggaaacaagaagatatttccgccacggtgattcagaaagcataccgaagctacgtgcttcatcggtctatggcccttagcaacacgccttgtgtgccacgggcagaagaagaggcagcttcactgccagatgaggggttcgttgcatttactgccaatgagaattgcgtactgcccgacaaaagcgaaacagccagtgctacgagctttcctccttcttatgaatctgtgaccaggggtcttagcgatagagtgaatatgcgcacctcgagtagcatacagaacgaagacgaagcgacgtctatggagcttattgccccaggcccttag

SEQ ID NO: 134726 - DNA, 5376 bp, Artificial Sequence
  Description of Artificial Sequence: Synthetic coding sequence
atggacgatcggtgttatcctgtgatattccctgatgaaaggaattttcgaccattcacgtccgactcactggcagctatcgagaagcgtatcgctatccagaaggagaaaaagaagagcaaggatcagacaggtgaagttccgcagccacgtccccagcttgatctaaaggccagccgaaaattgcccaagctttacggggatatcccgagagaactcattgggaaaccactggaggatctcgatcccttctacaggaaccataagaccttcatggtcctcaaccggaagagaacaatctatcgcttcagcgccaaacatgctctgtttatctttggaccctttaacagtatccgaagtttggccatacgggtgtctgtgcactcgctattctctatgttcataatcggcacagtgatcattaattgtgtcttcatggctacagggcctgccaaaaattcaaactcgaataatactgacattgcagagtgtgtttttaccggcatctacatttttgaagctctgatcaagatcctggcgcgtggttttatacttgacgagttttcctttcttcgtgatccgtggaattggctggatagcatcgtgattggcatcgcaatcgtgtcctacattccaggaatcacaatcaaactactgcccctaagaactttccgcgtattccgtgcccttaaggccatctctgttgttagccgcctaaaagtgattgtgggagccctgctgcggagcgttaagaaattagtgaacgtgatcatacttaccttcttttgtctgagcatcttcgccctggtaggccagcagctcttcatggggtctctgaatctgaaatgtatcagtcgtgactgtaaaaacatttcaaacccggaggcatatgatcactgtttcgaaaagaaagagaacagcccagagtttaagatgtgcggtatatggatgggcaacagcgcttgctccattcaatatgagtgcaagcacacaaaaatcaacccggattacaactatacaaatttcgacaattttgggtggtcctttttggctatgttccgactcatgacccaagatagttgggaaaaactgtaccagcaaacactgagaactacaggtctgtattccgtattctttttcatagtagtcattttcctcggcagtttttacctgataaatctcactctcgccgtggtgaccatggcttatgaagaacagaataagaacgtcgcagccgagattgaagccaaagagaagatgttccaggaggcccagcaacttctaaaagaggagaaggaagcgctagtggcaatggggatagatcggagctctctcacttctttagaaactagttacttcactccaaaaaaacggaagttgtttggcaacaagaagcgaaagtcgttcttcttgcgggagtcagggaaggatcagcctccagggtccgacagtgacgaggactgtcagaagaagcctcaactcctggaacagaccaagcgcttatctcagaatctcagccttgatcatttcgacgaacatggcgatcccctgcaacgacagcgggccctgagtgcggtttccatactgacaataacaatgaaggagcaggaaaagtcgcaggagccatgtctgccttgtggagaaaacctcgcctccaaatacttagtctggaactgttgcccccagtggctgtgtgttaagaaggtcctgcggactgtgatgaccgatccattcacggagctggccatcacaatctgcattatcatcaacacagtcttcctcgcaatggagcaccataagatggaagcctcattcgagaagatgttgaatatcggcaatttggtgttcacctcaatcttcatagctgaaatgtgtctgaaaatcattgctctcgacccttaccactattttcgccgggggtggaatatctttgatagtatagtagccctgttgtcctttgctgacgtaatgaactgcgttctgcagaagagaagctggccttttttgagaagtttcagagtattacgagtattcaagctggccaaatcctggcctacacttaacaccctaattaagatcatcggaaacagtgtgggggccttgggatctttgacagtcgtcttagtgatcgttattttcatattctccgttgtaggaatgcaactcttcgggagatcatttaattcacagaagtcccctaagctgtgcaacccaacagggccgacggtttcatgccttaggcactggcacatgggggacttttggcacagttttcttgtggtcttccgaattctgtgcggggaatggatcgagaatatgtgggagtgcatgcaggaggccaacgcttcctcctcactatgcgtgatcgtgttcatcctcatcacagtgattggcaaactggtggtgcttaatctgttcatcgctctactgctcaactcgttttccaacgaggagaggaacggaaatcttgaaggagaagctcgcaaaacaaaggtgcagttagccctggatagattccgcagagccttctgttttgtcaggcacacactggagcatttttgccataagtggtgtagaaaacagaatctgccccaacagaaagaagtggcaggcggatgcgccgcacagtccaaggacatcatccctctggttatggaaatgaaacgaggcagtgagacgcaggaggagcttggcatactgacctcagtgccaaaaacattaggagtgaggcacgactggacgtggcttgcccctctagcagaagaggaggacgatgtcgaattttccggcgaagacaacgctcaacgtatcacccagcccgagccggaacagcaggcctatgagctgcaccaggaaaacaagaaacccaccagtcagagagtccagtctgtggagatcgatatgttctctgaggatgaacctcacctcacgattcaagatcctaggaaaaagtcagacgttacctcgattctttccgagtgcagtactatcgacctgcaggatggtttcggctggctgccagaaatggttcccaaaaaacagcctgagcgctgcttgcccaaaggatttgggtgctgcttcccgtgctgctccgtggataaacgtaaacccccatgggtcatttggtggaatctgcgtaaaacttgctatcaaatagtgaaacactcctggtttgagagttttattatcttcgtgatcttgctatcttctggtgcgctcatttttgaagatgtacacctggagaaccagcctaaaatccaggaactcctgaactgtaccgatattatattcacgcatatatttatcctcgagatggtcctcaagtgggtggccttcggttttgggaaatatttcacatctgcatggtgttgtttagacttcatcatcgtaatcgtctctgttacgacacttattaacctgatggaactcaaaagcttccggaccctgcgggccttgcggcctcttagagccctgagccaattcgaaggaatgaaagttgtggttaacgctctcatcggggcaattcctgccatactgaacgtgctgctcgtctgtctgatattttggttggtattctgcattcttggtgtctacttcttctcaggtaaatttgggaagtgtataaacggcacagattcagtaattaattacaccattattactaacaaaagtcagtgcgaatcaggaaacttttcgtggattaaccagaaagtgaatttcgataatgtgggaaacgcatacctggcacttctgcaggtcgcaacattcaagggttggatggacatcatctatgctgccgtcgactctaccgagaaagagcaacaacccgagtttgagtctaattctctgggttatatttactttgtggtgttcatcattttcggttcttttttcactctcaatctgttcattggggtgattatcgataacttcaaccagcagcagaagaagctgggggggcaagacattttcatgaccgaggagcagaaaaaatactataatgccatgaagaagctgggaagtaaaaaaccacagaaacctattcctcgacccttaaacaagtgccaaggtctggtcttcgacatcgtgacttctcagatatttgacatcataatcatatccctgattatactcaacatgattagcatgatggcagaaagttacaaccagcctaaggcgatgaaaagcatcctcgaccatctcaattgggttttcgtagtgattttcactctcgaatgtctcattaagatctttgcccttaggcaatactactttaccaacggctggaatctgtttgattgtgtcgttgtcctgcttagtatcgtcagcaccatgatatcgaccttggaaaaccaagagcacatcccctttccaccaaccttgtttcgtatagtgcgccttgcgaggatcggtagaatactgcgcctggtgcgagctgctagaggcatccggactctgctattcgccctgatgatgagcttgccttccttgtttaacatcgggctgctgcttttccttattatgttcatttacgcgattttgggcatgaattggttctccaaagtcaacccagagtctggtattgatgacatcttcaatttcaagacattcgcctcaagcatgctgtgcctgttccaaatttcgacttccgccggctgggacagtctcctgagccctatgttgcgctcaaaggaatcatgtaacagctcttctgaaaattgtcatttgcccgggatagcgacaagctacttcgtctcctatattattatctcctttttgatcgtagtgaacatgtacatcgctgtgatcctcgagaacttcaatactgccaccgaagagtcggaggacccccttggggaggacgacttcgacattttctacgaagtctgggaaaagttcgatcctgaagctacacaattcatcaaatacagtgcgctctcggatttcgccgacgctcttcctgagcccctaagagtggccaaacccaacaaataccagttcctcgtgatggaccttcctatggtctctgaagacaggttacattgtatggatatcctcttcgcctttactgccagggtcctcggcggaagcgacggcctagatagcatgaaggcaatgatggaggaaaagtttatggaggccaatccgctgaaaaaactgtacgagcctattgtgacgaccactaagagaaaagaagaggaacggggagccgccattatccagaaggccttccgcaagtacatgatgaaggttacaaaaggtgatcaaggcgaccagaatgatcttgaaaatgggccacactcgccgttgcagacgctatgcaacggagatctgtctagttttggagtggcgaaagggaaggttcattgcgactag

SEQ ID NO: 134727 - DNA, 4335 bp, Artificial Sequence
  Description of Artificial Sequence: Synthetic coding sequence
atggacgatagatgctacccagtgatatttcctgacgagcgcaactttcggcccttcacgtccgattccctggcggctatcgaaaagcgcatcgctatccaaaaggagaaaaagaagtctaaggatcagacaggggaagtcccccaacctcgtcctcaacttgacttgaaagcaagccggaagctgcctaagctgtacggggacatacctcgtgagctgattggcaagcctctcgaggacttggatcctttctaccgtaaccacaagacctttatggtgctcaacaggaaaaggaccatttatcgcttcagtgctaagcacgcattattcatatttggacccttcaattcgatacgctcgcttgctatccgggtttcagttcactccctatttagtatgttcatcatagggacggttatcataaattgcgtgtttatggccactggacctgcaaagaatagtaattccaacaatacagatatcgccgaatgcgtgtttaccgggatctatatttttgaggcacttatcaagatcttagcgagggggtttatattggacgaatttagcttcctacgggacccctggaattggttagattctatagtgataggaattgcaattgtgtcctacatccctggtattaccataaagcttctgcctttgagaactttccgcgtgtttagagccctgaaagccatatcagtggtgagtaggctgaaagttatagtcggagccctgcttcgtagcgtcaaaaagctcgtcaatgtgattatcctcacctttttttgcctgtctatatttgccctggtaggtcagcagctgtttatgggtagcttgaatctgaaatgcatctccagggactgtaaaaacattagcaacccagaagcatacgaccattgcttcgagaagaaggagaattccccagagtttaaaatgtgtggcatctggatgggaaactccgcctgtagcattcagtatgaatgtaaacatacgaagattaatcccgactacaactataccaatttcgacaatttcgggtggtcctttttggctatgtttcggctgatgacccaagattcatgggagaagttataccaacagaccttgaggactacggggctgtacagtgtgttttttttcatagttgttatctttctgggatcattttatctcatcaatcttaccctggcggttgtgactatggcttatgaggagcagaataagaacgtggccgccgaaattgaggccaaagagaagatgttccaggaagcccagcagttgctgaaggaagaaaaggaagcccttgtggctatggggatcgacaggtcttcactgacctcactggagacttcgtatttcacacctaaaaagagaaaactgtttggaaataagaagaggaagtcatttttcctgcgcgagtccggtaaagatcagccaccaggatccgacagcgatgaggactgtcagaaaaagccccaactgctcgaacagactaaaagactgtcccaaaatttgtcactggatcattttgacgaacacggtgaccccctgcagaggcagagagctctcagtgctgtgtcaatcctgaccatcacaatgaaagaacaagaaaagagtcaggagccctgcctcccctgtggtgaaaacctggctagcaaatatttagtgtggaactgctgtccacaatggctgtgcgtaaagaaggtcttgcgcaccgtaatgacagaccctttcactgagctggccatcactatctgcatcattataaatacagtgttcctggccatggaacatcataaaatggaggcgagtttcgagaagatgctgaacatagggaatttagtgtttacctctatttttattgcagaaatgtgcctcaagatcatcgctctggatccataccactatttcagacgtgggtggaacattttcgactctatcgtagcactgctgtcctttgccgatgtaatgaactgcgttttgcagaagaggtcctggccctttctcagatccttcagggtactgcgggtattcaagctggcgaagagctggcccacccttaacactctcatcaaaatcatcggaaatagtgttggcgctctgggctcccttacggtggtacttgttatcgtgatttttatattcagtgtggtcggaatgcaattgttcgggagaagcttcaatagtcaaaagtccccaaagctatgtaatcccaccggtccaacagtatcctgtcttcggcactggcatatgggagatttctggcacagcttcctggtggtctttcgcatactgtgtggtgagtggattgagaatatgtgggaatgcatgcaggaggctaatgcatcgtcgagcctatgcgtgattgtgttcattttgatcacggttatcggcaagcttgtggtgctgaacctgtttattgcattattgctgaacagtttttctaacgaagaaaggaatggcaacctcgagggcgaagccaggaaaaccaaggtgcagctggcactcgacagattcagaagagccttctgctttgtcaggcataccctcgagcatttctgtcataagtggtgtaggaaacagaacctgcctcagcagaaagaagttgctggggggtgcgccgcccaaagcaaggatattatcccactggtgatggagatgaagcgaggttcagagacccaagaggaactgggcattctcactagtgtacctaagacattgggggtgagacatgattggacttggctggcgccactcgctgaagaagaggatgacgtcgagtttagcggcgaagataacgcccaacgtattactcagcctgaaccggaacagcaggcctacgaactgcatcaggagaacaaaaagccaactagccagagagtgcagtccgtggagatcgatatgttctcagaggacgaaccccacctgaccattcaagacccaaggaaaaaatcagacgtgacttcaattttgtctgagtgcagtactatagaccttcaggacgggtttggctggctgcctgagatggtccccaagaagcagcccgaacgttgcttgccaaagggcttcgggtgctgctttccttgctgcagcgttgataaacgcaagcccccatgggttatttggtggaacctcagaaagacctgctatcagattgtgaagcactcatggtttgaatctttcattatttttgtgattctgctatcctccggagctctgattttcgaggatgtgcacctggagaatcaacccaagatccaggagctcctgaactgtacagacattatctttacacacatctttattctcgagatggttcttaaatgggtggcttttggctttggaaagtacttcacatccgcctggtgctgcctggacttcattatcgtcattgtgagcgtgacaaccctgataaatctgatggagctgaagtctttcagaactcttcgtgccctgagaccccttcgtgcactctcccagttcgaaggcatgaaagtggtggttaatgccctgataggagcaatcccagccatactgaacgtgctgttagtgtgtctcatattctggttggtgttttgcatcctgggcgtgtattttttttccggcaaattcggcaaatgtattaacggaacagattcagttattaactacaccattattacgaacaagagtcagtgcgagagtggcaactttagctggatcaatcaaaaagttaactttgacaatgttgggaacgcgtatctggcactgttgcaggtagcgaccttcaaaggatggatggacataatttacgcagcggtcgacagcaccgagaaagagcaacagccagagttcgaatccaatagcctcggctatatctattttgtggtgtttattatcttcggctctttcttcaccttaaatctgtttattggtgtgatcattgataactttaatcagcagcagaaaaaattgggtggccaggatattttcatgacagaggaacagaaaaaatactataatgccatgaagaagctgggctcaaaaaagccgcagaagccgatccctagaccacttaacaaatgccaaggtctggtcttcgatattgtaacttctcaaatattcgacattatcatcattagcctgataatcttgaacatgatctctatgatggccgagtcttacaaccaaccaaaagctatgaagagcatcttggaccatctgaattgggtgttcgtggttatcttcaccttggagtgccttataaaaatcttcgccctcagacaatattactttacgaatgggtggaatttatttgactgtgtggtggtgttgttgtcaattgtcagcaagtag

SEQ ID NO: 134728 - DNA, 5376 bp, Artificial Sequence
  Description of Artificial Sequence: Synthetic coding sequence
atggatgatcgctgctacccagtgatcttccctgacgagaggaattttcgacctttcacaagcgactcccttgccgcgatcgagaaacgcatcgccattcagaaggagaaaaagaagtcaaaagatcaaacgggcgaggtgccacagccccgcccccagctggatctcaaagcatcacgaaaacttcccaaactgtacggagacatacctcgcgagctgattggaaaacctttagaggacctggacccattttatagaaaccacaaaacctttatggttctaaacaggaaaagaaccatttatagattttcagccaagcacgctctttttatctttggacccttcaacagcattcggagcttggccatcagggtcagcgtgcacagtcttttctccatgtttattattgggactgtcataatcaactgtgtgtttatggccaccggcccggccaaaaatagcaatagcaacaataccgatatagctgagtgtgttttcaccggcatctacatttttgaagccctgatcaaaatcttggcccgggggtttattctggacgaattttcattcctgcgagacccttggaattggctggactctatcgtgatcggcatcgctatcgtgagctatattcctggaatcactatcaaactgctgcccttaaggacctttcgtgtgttcagggcgctgaaggcgatctccgttgtctcacgcctgaaagtgatagttggtgctctgctcagatctgttaagaaactggtcaacgtgatcattcttacctttttctgtttatccatattcgcgttggttgggcaacagcttttcatgggatctctgaacctgaaatgcatcagtcgggattgcaaaaatattagcaacccggaagcctacgatcattgctttgagaaaaaagaaaatagccctgagtttaaaatgtgcggaatttggatgggaaactcggcctgctctatccagtacgagtgcaagcatactaaaattaacccggactataactacaccaattttgacaattttggttggagtttcctggctatgtttcgactcatgactcaggactcttgggaaaagctgtatcagcagacactgagaaccacggggctgtacagcgtctttttcttcatcgtggtgatattcctgggcagtttctacctcattaacctgactcttgccgtggtgaccatggcgtacgaagagcagaataagaatgtcgccgctgaaatcgaggcaaaagaaaaaatgttccaggaggcccaacagctgttgaaagaggaaaaagaggccctcgtggctatgggaatcgatagaagctccctaacgtccctggagacctcttactttactcccaagaagaggaagctttttgggaacaaaaagcgaaaaagtttcttcttgcgtgaatcagggaaggaccagccaccgggatccgactctgatgaggactgtcagaagaagccacagctgttggagcagaccaaacgactaagtcagaacttgagcttagaccactttgatgagcatggtgatcctttacagcgccagcgggctctaagtgctgtgtcaattcttacaattactatgaaagaacaggagaagagccaagaaccctgcctcccatgcggagaaaacctcgcttctaaatatctggtctggaactgctgcccacagtggctctgtgttaagaaggttctgaggactgttatgacagacccctttaccgaacttgccatcacaatctgtatcatcatcaatacagtctttctggccatggaacatcataaaatggaagcttccttcgaaaaaatgctcaatatcggcaatttggtgttcacctccatttttatcgccgagatgtgtctgaaaatcatcgctctggatccctatcactattttaggcgcggttggaatatcttcgatagcattgtggctctgttatccttcgccgatgtcatgaattgtgtgctgcaaaagcgctcatggccctttttacgatcttttagagttctaagagtgttcaaactggcgaaaagctggcccacactgaacaccctgataaagattattggaaattctgtgggtgccctcggctctctaacggtggttcttgttatcgtgatttttattttttcagtcgtcggcatgcagctgttcggccgaagtttcaatagtcagaagagccccaaactctgtaacccaactggacctactgtgagctgtctgcgccactggcatatgggcgacttttggcactcatttttagtagtgttcaggattctgtgcggggagtggatcgagaatatgtgggagtgcatgcaggaagctaatgcttcaagtagcttgtgtgtgatagtgttcatccttattaccgtgatcggcaaacttgtagtcctgaacctgttcatcgctctgctgttgaatagctttagcaacgaggagaggaacgggaatctggagggcgaggcccggaagacaaaggtgcagctcgcgctcgaccgcttccgccgggctttctgctttgttcgacataccctggaacacttttgccacaagtggtgcagaaaacagaacctcccacagcaaaaagaggttgcaggtgggtgtgccgcccaaagtaaggacattattccactcgtaatggagatgaaacggggaagcgagacccaggaggagctgggaattctaacttccgtgcccaagaccctaggtgtgaggcatgattggacgtggctggcccctctggcggaagaagaagacgatgtcgagttttccggagaggacaacgctcagcgcataactcaaccggagcctgagcagcaggcctacgagctgcaccaggagaataagaagccaacctcacagagagtccaaagcgtggagattgatatgttctccgaagacgaaccccatctaacaatccaggatcccagaaagaaatccgacgtgaccagcatactgtcagagtgcagcaccatcgacttgcaggacgggtttggttggcttcccgaaatggttcctaaaaagcaacctgagcggtgtctgcctaaaggctttggctgttgctttccgtgctgcagcgtggacaagagaaagcccccctgggttatatggtggaaccttcgcaaaacatgttatcagatcgtcaagcactcatggttcgagtcttttattatattcgttatactgctgagcagtggagctctaatatttgaggacgttcacttagaaaaccagcccaagattcaagaattgctgaattgcaccgatataatctttacacatattttcattcttgagatggtgctgaaatgggttgcttttggtttcggtaagtattttacctctgcctggtgttgtctggattttattattgtcatcgtgtccgtaactacactgattaacttgatggaattgaaatcttttcgcactctgcgggcactccgccctcttcgcgctttatcccagttcgaaggaatgaaagttgtggtaaatgctctgatcggtgcaatccccgctattctcaatgttctgctggtctgtctgatattttggttagtcttctgtatcctcggcgtgtactttttctccgggaaatttggaaaatgcataaacggcacagactcagtgattaactacaccatcattactaacaaaagtcagtgtgaatcaggtaatttctcctggatcaaccaaaaggtgaatttcgacaatgtgggcaatgcctacttagctctgcttcaagtggcaacctttaaaggatggatggacatcatctatgctgcggtggattcgaccgagaaagagcagcagcctgagttcgaatctaactccctgggctacatctatttcgtggtatttatcatcttcgggagctttttcactttgaatctgtttataggcgtcattatcgacaattttaaccagcaacagaaaaagcttggggggcaagacatattcatgacagaggagcaaaagaaatattataacgctatgaagaagttaggatcaaagaagccccagaagccgatcccgcgcccccttaacaagtgtcagggtctagtgtttgacatcgtgacttctcagatattcgatatcatcattatttctctgataattctaaacatgatatccatgatggccgaaagctacaaccagcctaaagccatgaaatcaatcttagaccacctgaattgggtttttgtcgtaatattcactctcgagtgtctcatcaaaattttcgccctccgccagtactatttcacgaacggatggaatctgttcgactgcgtcgtggtgttactcagcatcgtcagcaccatgatctctaccctggagaaccaggagcatattccattcccgcccacactgttcagaatcgtccgactggccaggataggccgaatactgagactcgtgagggccgcgagaggcatcaggacgctgctcttcgcgctcatgatgagcttacccagcttgttcaacatcgggctccttctattccttatcatgtttatttacgcaatattagggatgaattggttctccaaggtgaaccctgagtcaggaattgacgacatatttaacttcaagacgttcgcctcgagcatgctgtgcctgttccagatttctacatccgctggctgggattccctcttgagccctatgctcagaagtaaggagtcatgcaattcatcgtccgaaaactgtcatctcccaggtatcgctacgagttacttcgtgtcatatataatcatttccttcctgatcgtggtcaacatgtatatcgcagtgattctcgaaaactttaataccgccaccgaagaaagcgaagacccattgggcgaggatgactttgacattttttatgaagtttgggaaaaattcgatccagaggcaacccaattcatcaagtacagtgccctctccgacttcgccgacgccctgcctgaaccactccgagtggctaaacctaacaaataccagttcctcgtgatggacctgccgatggtgagcgaggatcgacttcactgtatggacatcctattcgccttcacagcccgcgtgttgggaggttccgatggcctcgatagcatgaaagccatgatggaagagaagttcatggaggccaaccctctgaagaagctgtatgaaccaatcgtgaccaccaccaaacgtaaagaagaggagcggggggcagccattatccagaaggctttccgaaagtatatgatgaaagtgaccaagggcgaccagggcgatcaaaacgacctggagaacggtccccactcacctctccagaccctctgtaatggcgacctcagctcctttggagtggcaaagggcaaggttcattgcgactag

SEQ ID NO: 134729 - DNA, 5217 bp, Artificial Sequence
  Description of Artificial Sequence: Synthetic coding sequence
atgctgaaacgcaaacagtcttcaagagtggaagctcagccagtgaccgattttggacctgatgaaagtctgtcagacaacgccgacatcctctggattaacaagccttgggtgcactctctcctgcgcatttgcgccatcatctctgtcatctccgtttgtatgaacacgccaatgaccttcgaacattatcctcccttacaatatgtgactttcactctcgataccctgctgatgttcttatacaccgctgagatgattgcgaagatgcacatccgtgggattgtcaaaggagattcatcctacgtgaaagatcggtggtgtgtgtttgatggctttatggtgttctgcctgtgggtcagtctcgtgcttcaggttttcgagattgccgacattgtggaccagatgagtccatggggcatgcttaggattcctagacctttgatcatgatccgcgcattcaggatttacttcagattcgaacttcccaggacaaggatcacgaacatcttgaagcgcagcggcgagcaaatttggtcagtgagtatctttctgctcttcttcctactgctatacgggattttaggcgttcaaatgtttggcactttcacctaccattgcgtagtaaacgataccaagccaggcaatgttacttggaactccctcgccatacctgacacacattgttctcctgagctggaggaagggtatcagtgtccccccggatttaagtgtatggatctggaagacctaggattatctcgccaggaactgggctatagcggattcaatgaaattgggactagcatctttacagtgtacgaagccgccagccaggagggctgggtttttctgatgtaccgagctatcgactctttcccgcgatggcggtcatacttctactttataaccctcattttctttctggcatggttggttaagaacgtcttcatcgcggtgattatcgagacttttgcggaaataagagttcagttccaacagatgtggggaagccgcagttctactacgagtaccgccactacgcagatgttccatgaagacgcagccgggggttggcagctcgtagccgttgacgtcaacaagccccagggccgggctccagcctgtctgcagaagatgatgcgctcatccgtgtttcacatgtttatccttagtatggtaaccgtggatgtgatcgtcgcggcctcaaattactacaagggtgaaaattttcggagacagtacgatgagttctacctcgcggaggtcgcttttacggtgttgtttgatctcgaggccctgctgaagatttggtgtctcggttttactggctatattagttctagcttacacaaattcgagctgcttcttgtcataggcaccaccttgcatgtctaccccgacctttatcattctcaatttacttatttccaagttcttcgagtcgtcaggctgattaagatttcccctgccctggaagattttgtctataagatcttcgggcctggaaagaaactcggaagtctggtggtgtttacagctagcttgctaattgtcatgagtgccatttcccttcaaatgttttgtttcgtcgaggaattagaccgatttacaaccttcccacgcgcattcatgtctatgttccaaatcctgacccaggaaggctgggttgatgtgatggatcaaacccttaatgccgtgggccatatgtgggctccggtggtcgctatatacttcatcctctatcacttgtttgccaccctgatcctgttatccctgtttgtggccgtgattttggataatctggaactggatgaagacctgaagaagctaaaacaattgaagcagtctgaagccaacgctgacacaaaagaaaaactgccgctgagactccgcattttcgagaaatttcctaaccggcctcagatggtgaaaataagcaagctgcccagtgatttcactgtaccgaagattcgggagtcatttatgaagcagttcatcgatagacagcagcaggacacttgctgtctgcttaggtctttgcccaccactagctcttcatcttgcgatcattccaaacgatccgccatcgaggataacaaatacatcgatcagaagcttcgcaaatcagttttttccatcagagctaggaatctgctagagaaggaaaccgctgtaacaaaaattcttagagcctgtactcgccaaagaatgctatctggcagttttgaaggtcagcctgccaaggagcgatccatcctaagtgttcagcatcatattcgtcaggaaaggcggtcattgaggcacggctcaaatagtcagagaattagtcgcgggaaaagccttgagactctgacccaggatcatagcaacacagtgcggtaccgaaacgcacagagagaagacagcgagatcaaaatgatacaggagaagaaagaacaagccgaaatgaaacggaaggtacaggaagaagaactacgggagaaccatccctactttgacaagcccctctttatagttggtagagaacaccggttcagaaacttttgtcgcgtggtggtgcgcgctcggttcaatgcatcaaagacagatccagtaaccggcgccgttaaaaataccaaataccaccagctgtacgacctgttgggtcttgtaacctatctcgactgggtgatgatcattgtgaccatttgctcctgcatctcaatgatgttcgagtccccgtttcgccgggtgatgcacgctcccactctacagattgcggaatacgtcttcgtgatctttatgtccatcgagctcaatctgaagatcatggccgacggacttttcttcacccccacggctgtgatcagggattttgggggggtgatggacatttttatttacctggtgagcctgatctttctgtgctggatgcctcagaacgtccccgcagagagcggagcacaactgctgatggtcctgaggtgtctccgacctttacggatttttaagcttgtgccacagatgcggaaagtggtacgcgaattgtttagtggctttaaggagatcttcctggtcagtatcctgctccttaccctaatgctggtgttcgcctccttcggggtgcagctgtttgccggcaagctggcaaaatgcaacgaccctaacattatccgcagggaggactgtaacggcatctttcgtatcaacgtgagcgtcagtaaaaacctgaatctcaagctccggcctggggaaaaaaagcccggcttttgggtgccacgagtttgggcaaacccccgcaactttaacttcgacaatgtcggcaacgctatgctcgcactttttgaggtcctgtccctgaaaggatgggtggaagtgagggacgtgatcatccaccgggtcggccccatccacggaatctacatacacgtctttgtatttctaggttgcatgatcggcctgactctctttgtgggcgtagtcattgcaaatttcaacgagaataagggaacagcccttctcacagtggatcagcggagatgggaggacctgaaatcgcgtctgaaaattgcccagcccctacacttgccacccagaccagacaacgacggattccgggccaaaatgtacgacattacacagcacccatttttcaagaggaccattgctctcctcgtgttggcccagagcgtgctgttgtcagttaagtgggacgtagaagacccagtgaccgtccctctcgccactatgagcgttgtattcacctttatattcgtcctcgaggtcaccatgaagattatcgccatgagccccgccggcttctggcaaagtcgtaggaatcggtacgacctgctggttacctctttaggggtggtatgggtggtcctgcatttcgctttgctgaatgcctacacatacatgatgggcgcctgtgtgatagtgttccgcttctttagcatctgcggcaaacacgtcactctcaaaatgctcctcctcacggtcgtagtgagcatgtataagtccttctttatcatcgtggggatgttcctgctcttactgtgctacgcattcgcgggcgtcgtcctattcggtacagttaaatacggtgaaaatataaacagacatgccaacttcagctctgccggcaaagctattaccgtgctgtttcgcatcgttacgggagaagactggaataagatcatgcatgattgcatggtgcaaccccccttctgcacccccgacgagtttacatattgggctacagattgtggcaactacgccggggcccttatgtacttttgttcattctatgtgataattgcctacatcatgctgaatttacttgtcgccattattgtggagaacttttccctcttctattcaaccgaggaggatcagctgctgtcatacaacgatctccggcacttccagatcatttggaacatggtggacgacaaaagggaaggagtcatcccaacatttcgggtcaaatttctgttacggttgcttcgcggccgcctggaggtggatctggataaggataagttactgtttaagcacatgtgttatgaaatggagagattacacaatggaggcgacgtcacattccacgacgtgctatcaatgctgtcgtacagaagcgtggacatcaggaagagtctccagctggaggagctgttagctagagagcagctggagtacaccatagaggaagaagtggctaaacagaccattcgcatgtggcttaagaaatgtttgaaacgtatacgagccaaacagcaacaatcatgcagcattatccacagtctgcgggagagccagcagcaagagttgtcccgattcctgaacccaccctcgatcgagacaactcagccttcagaggacacgaatgctaacagccaggataactctatgcagcctgaaacaagttcccagcagcagttgctaagcccaactctgagcgaccgaggcggcagccggcaggatgccgctgatgcgggcaagccccaaagaaagtttggtcaatggcgcctgccttccgcacccaaacccatttctcattcagtaagttctgttaatctccggtttgggggtagaaccacgatgaagtctgtggtgtgcaagatgaaccctatgacagatgcagcatcctgcggcagcgaagtcaagaagtggtggacgcgtcagctaacggtcgagtccgacgaatctggcgatgatttactcgacatatag

SEQ ID NO: 134730 - DNA, 2007 bp, Artificial Sequence
  Description of Artificial Sequence: Synthetic coding sequence
atgttgaagcggaagcagtcatctcgtgtggaagcacaaccggttaccgacttcggtcctgacgagagcctttcggacaacgctgatattctctggattaataagccttgggtgcatagcctgttgaggatctgcgccataatttccgtgatctccgtgtgcatgaatacacccatgacgtttgagcattatccacctctgcagtacgtcactttcactctagacaccttattgatgttcctctatactgcggagatgatcgctaagatgcacatccgcggaatcgtaaaaggggactccagctacgtgaaagaccgatggtgcgttttcgacgggttcatggtcttctgcctgtgggtgagcctggtcctccaggtcttcgaaattgctgacattgtggatcaaatgtccccttggggtatgctccggatccctaggcctctgatcatgatcagagcctttagaatctattttcggttcgagctaccccggacaaggataactaatattttgaaacggagcggtgagcagatctggtccgtgtcaatctttctgttgttctttcttttgctctacgggatcctgggagtgcagatgttcggcacatttacatatcattgcgtggtgaacgacactaaaccaggaaatgtcacatggaactccctcgcaattcctgatacacactgttccccagagcttgaggaaggttaccagtgtccacccggctttaagtgcatggacctcgaagatcttggacttagccgccaggagcttggttacagtggatttaacgagatagggactagcatctttacagtctacgaggctgcaagccaggaaggatgggttttcctgatgtatagggccattgactctttcccccgatggaggtcgtacttctatttcatcacccttatcttcttcctggcttggcttgtaaaaaatgtgttcatagctgtaatcattgagacctttgcagagatccgggtccagtttcagcaaatgtgggggagccgctcctctaccacatcgactgctaccacccagatgtttcacgaagatgccgccggggggtggcagcttgtagcagtagatgttaataagcctcagggacgcgcccccgcttgcctacagaagatgatgcggtcctcagtgttccatatgttcattttgtctatggttacggtcgatgtgatagtggctgcttctaattattacaagggcgaaaactttaggaggcaatatgatgaattttacctagcagaggtggcattcaccgtgctgttcgacttggaggccctcctgaagatctggtgtcttggatttactggatacattagtagtagtctacacaaattcgaactgttgctggttatcggcacgaccctgcatgtgtaccccgatctataccactctcagttcacgtatttccaggtcctgcgggtggtgcggttgataaagatatcacctgcactggaggacttcgtatataagatcttcgggcctgggaagaagttgggatctctggtggtattcaccgcatcactactcattgtcatgtcggctattagtctccaaatgttttgcttcgtagaggaactggataggtttacaacttttcctagagccttcatgtccatgtttcagattctgacccaggagggatgggtggacgtaatggaccaaactcttaatgctgttggtcacatgtgggcccccgttgtggcaatttacttcatcttataccacctgttcgcaactctcccaccttccctaattcgtgatttatgtggcacgcaggacgcgtgtcccagctgcctgcctctgcagccaccaaacccacttcccggatcccagaccctggctagactaacgcaccaggcactcacaacacccccaggcatgcggtccagtcagctctttagtaagatatcactactactcggtatctgtgttgcgtgggaatcaattttgggatccctttcactgagccacaacttgagatag

SEQ ID NO: 134731 - DNA, 657 bp, Artificial Sequence
  Description of Artificial Sequence: Synthetic coding sequence
atgctgaagcgtaaacagtctagtagggtcgaagcacagcctgtaacagatttcgggcccgacgaatccctcagcgataatgccgatatcttgtggatcaacaaaccgtgggttcactccctgctgcgaatttgcgccatcatatctgtcatctccgtgtgcatgaacacccctatgacattcgagcactatcctccattgcagtacgtgacctttacactcgacacactgctgatgtttctttatacggccgagatgattgccaagatgcatatacgcggcattgtgaagggcgacagcagctatgtcaaagataggtggtgcgtttttgatggcttcatggtcttttgtttgtgggtcagcctcgtactgcaagtgtttgagattgccgatatcgtcgatcagatgtcaccatgggggatgttgcgaatccccaggccccttattatgattagagctttccggatctactttcggttcgaactgccgcgaaccaggataactaatatactgaaaaggagcggagagcagatctggtctgtgagcatcttcctgctctttttcttgctgctgtacggaattctcggtgtacagatgttcggtacatttacttaccattgcgtggtgaacgataccaagccaggcttatcgctttag

SEQ ID NO: 134732 - DNA, 657 bp, Artificial Sequence
  Description of Artificial Sequence: Synthetic coding sequence
atgctaaagcgaaaacagtcctctcgggtggaggcgcaacctgttaccgattttggcccggacgagagcctttcagacaatgctgatattctgtggataaacaagccctgggtgcacagcctgcttcgtatttgtgccatcatcagcgtgatctccgtgtgtatgaatacacccatgacctttgaacattacccacctctgcagtacgttaccttcacactggatacgttgcttatgttcctctataccgccgaaatgattgccaaaatgcatatccgcggcattgtgaagggtgactcttcgtacgtgaaggatcgatggtgcgtgttcgacggcttcatggtgttctgcctgtgggttagcctcgtgctgcaggttttcgagattgctgatattgtcgatcagatgtccccctggggcatgctacgcataccacgccccctaataatgattagagccttccgcatttattttaggttcgaactcccaaggacgaggataacaaatatactcaaacggtcgggggaacagatatggtccgtcagtatctttctgctcttctttctgctgctttatgggattttaggggtacagatgttcggcactttcacataccattgcgtggtcaatgatacgaaacccgggctcagcatctag

SEQ ID NO: 134733 - DNA, 1725 bp, Artificial Sequence
  Description of Artificial Sequence: Synthetic coding sequence
atggcttctaccgaaggagctaataacatgcccaagcaagtggaagtcaggatgcacgattctcacctaggaagtgaggaacccaaacaccgacaccttggactgcgtctctgcgacaaactagggaaaaacttgctgctgacactgacggtttttggcgtaatactgggcgctgtgtgtgggggtctgttgcgtctcgcttcacctatccacccggatgtggtcatgttgatcgcattccctggtgacatcttgatgcgcatgctcaagatgttaatcctgccccttatcatcagtagtcttatcacgggacttagcggtctcgacgcaaaagccagcgggcggttggggacacgtgccatggtgtattatatgtctactaccataatcgccgccgtcctgggagtgattttggtgctggccattcatcctggcaacccaaagcttaaaaaacagctgggtccaggtaagaagaatgatgaggtgtctagcctcgatgcctttctggatctaatcagaaacctattcccagaaaatcttgtgcaggcttgcttccaacagatccagaccgtaactaaaaaggtcctcgtggccccgccccccgacgaagaagccaatgccacttccgcagtggttagcctgctcaatgagactgttacagaggtgcctgaggagacaaagatggtaatcaagaaagggctcgaatttaaggacggaatgaacgtcctgggtctcatcggcttctttatcgcttttgggattgcaatggggaagatgggtgaccaggcgaagttgatggtcgacttctttaacattctcaatgagatcgtcatgaagctggttattatgatcatgtggtattcccccctcggcattgcctgcctgatttgcgggaaaataatcgccattaaggatctggaagtggtggctcgccagctggggatgtacatggtgactgttattattgggttgataatacatggtgggatctttctccccctcatctatttcgtggttacccgcaaaaatccattttccttcttcgcaggaatattccaggcatggattaccgccctcggaaccgccagctcggccgggaccttaccagtgacgttcaggtgcctagaggagaacctcggtatagataaacgcgtaactcgctttgtcctgccagtcggggcaacaataaacatggatggcaccgctctatacgaggccgtagctgctattttcatcgcccagatgaatggcgtggtccttgacgggggtcaaattgtcactgtgagtctgacggccactctcgcttctgtaggggcagcatcgatccccagtgcagggctcgttactatgctgcttatcctcaccgccgtgggtctgcccacggaggacatctctctgttagtggcggtagactggctgctggatcgaatgagaacctccgttaatgtcgtgggtgatagctttggcgccggcattgtgtatcacctgagcaaaagcgagctcgataccattgacagtcagcatagggtgcatgaagacattgagatgacgaaaacccaatctatatacgatgatatgaaaaatcatagagagtccaactcaaatcaatgtgtgtacgccgcccacaacagcgtcatcgttgatgaatgcaaggtcacgctggctgccaacgggaagagtgccgactgcagcgtagaagaggaaccctggaaaagagagaagtag

SEQ ID NO: 134734 - DNA, 1698 bp, Artificial Sequence
  Description of Artificial Sequence: Synthetic coding sequence
atgcccaaacaagttgaagttagaatgcatgatagccatttagggagtgaagagccaaagcatcgccatctgggccttcggctctgtgacaagcttgggaaaaacttgttactaactctgaccgtgtttggggtgatcctcggcgccgtttgtggaggactgctgaggctcgccagtcctattcaccctgacgtcgtcatgctgattgctttccccggggacatccttatgcggatgctgaagatgcttattctccctctgattatctcctcacttattacaggcctgagtggactggatgctaaagctagtggaagactcgggacccgtgccatggtctactacatgtctactaccatcattgcagccgtcctcggcgtgattctggttctggcaattcacccagggaaccccaaactgaagaagcagcttgggccaggcaaaaaaaatgacgaagtaagctctctggacgcctttctggacctcattcggaacctgtttccagagaacctggtgcaggcgtgtttccaacaaattcagacagtcaccaagaaagtgcttgtcgccccaccacccgacgaagaggcaaacgccacttccgcggttgtttctctgcttaatgaaaccgtaacagaagtgccagaagagaccaaaatggtcattaaaaaagggctagagttcaaggatggaatgaacgtgctgggactcatcggtttctttatagcgttcggcatagccatgggcaagatgggcgaccaggcaaagctgatggtcgacttcttcaacatcctcaatgagatcgttatgaaactggtgattatgattatgtggtacagccccttgggtattgcgtgtttgatctgcggtaagataatcgctattaaggatctcgaggttgtggcgaggcagttaggcatgtacatggtaacagttatcatcgggttgataatacacggtggaatctttcttccgttgatctatttcgtagtgacacggaagaaccctttctcatttttcgctggaattttccaggcttggatcaccgctctcggcactgctagctcagcaggtactctacccgtgacctttcgctgtctagaagaaaacctgggcatcgataagcgagtcaccaggttcgtcctcccagtgggcgcaactatcaatatggacggtaccgctctgtacgaggcagtagccgctatttttatcgcgcaaatgaatggagttgtcctagatggaggccagatcgttaccgtgtccttaacagccacattggcttccgttggcgcagcttcaatcccctcggccggcctagtcacaatgctcctaatcttgactgcggttggactgccaacggaggatattagtctgctcgttgcagtggactggctgctggacaggatgcggactagcgttaatgttgtcggcgactcttttggcgcaggcatagtctaccacctgagtaaatccgagctagatacaatcgattctcaacaccgggtccacgaagacattgagatgacaaaaactcagtccatctacgacgacatgaaaaatcatcgggaatccaatagcaaccaatgcgtgtacgcagcccacaactctgtgattgtcgacgaatgtaaagtgaccctagctgcaaacggcaagagcgccgattgctccgttgaggaggagccctggaagagagagaaatag

SEQ ID NO: 134735 - DNA, 1698 bp, Artificial Sequence
  Description of Artificial Sequence: Synthetic coding sequence
atgcccaaacaggtggaagttcggatgcatgacagtcacctcggctctgaagaaccgaagcatagacacctcggcctacgcctgtgcgataaactcggaaaaaatctactacttactttaacagtgttcggggttatccttggcgctgtttgcggcgggctgctcaggctcgcttctcctatccatccggacgttgtcatgctgattgctttccctggcgatatcctaatgcggatgctgaaaatgttaatcttgcccctgatcattagcagtttgattacagggttgagcggccttgacgctaaggcaagtggccggctcggtacgagagccatggtttactacatgtccactaccatcattgccgcagtgctgggcgtcattcttgtgttagccattcatcccggaaaccctaagctcaaaaaacagctaggacctgggaaaaaaaatgacgaagtcagttcactggatgcatttctggacctgattcggaatcttttccccgaaaaccttgtacaggcatgcttccagcaaatccagactgttactaagaaggtgttggtggcaccgcccccggatgaggaggctaacgccacttcggcagttgtgtcactcttaaatgagaccgttaccgaagtgccggaggaaaccaagatggtgattaagaagggcttagaatttaaggacggcatgaacgttctgggtctgatagggtttttcattgcctttggaatagcgatgggcaaaatgggggaccaagcaaagcttatggttgacttttttaatatcctgaatgaaatcgtcatgaaactggtgatcatgattatgtggtattcgcccctggggatcgcatgccttatctgtggtaaaataatcgctataaaggatctggaggtcgttgctaggcagctgggtatgtatatggttactgtcatcataggtttgattatccatggcggcatatttctgcctctgatttactttgttgtcacccggaaaaatccgttcagtttctttgccggaatattccaggcctggataacagctctgggcaccgccagtagtgctggtacccttccggtgacattccggtgcctcgaagagaaccttggcatcgacaagcgtgttacccgttttgttttgcccgtcggggcaactatcaatatggacggaaccgccctgtatgaggcggtggccgccatattcatagcacagatgaatggagtggtccttgatggcggacaaatcgttacagtttccctgactgcgaccttggccagtgtcggtgcagcaagtattccatcagctggcctggtgactatgttgcttattctgactgccgtgggcctgccaactgaagatatctcattgctggtggccgtcgactggctgctggatcgtatgcggacctcagttaatgtcgtgggagactctttcggagccggtatagtgtatcatctgtctaagtcagagctggacacaatcgacagccagcacagggtgcacgaagatatcgagatgactaaaacgcagtctatctacgacgacatgaaaaaccaccgggagagcaactccaaccagtgcgtgtacgctgcccacaattctgtgattgttgacgaatgcaaggttacacttgccgcgaacgggaagagcgcagattgttctgtggaagaggaaccttggaaacgagaaaagtag

SEQ ID NO: 134736 - DNA, 1629 bp, Artificial Sequence
  Description of Artificial Sequence: Synthetic coding sequence
atgacgaaatctaacggcgaggagcctaaaatggggggccggatggaaagattccaacaaggcgtacgcaaacgcacactcttggctaagaagaaggtgcagaacatcactaaggaggatgtgaaaagctatctgtttagaaacgcatttgtgctgctgaccgtaacagcagtgatcgtggggaccattttaggctttacactgagaccatacaggatgagctaccgggaggtcaagtatttcagctttccgggagagctgctgatgcggatgctccagatgctggtgcttccactcattatctccagtttagtgactggaatggccgccctggactcaaaggcaagcgggaaaatgggtatgcgtgcagtggtttattatatgacaacaacaatcattgcagttgtcattggaattataatcgtgattataatccatcctgggaaggggacaaaggagaatatgcacagggaaggcaaaatcgtgagagtaacagctgcggacgcttttttggatcttattcggaacatgtttccacccaatctggtggaagcctgcttcaagcaattcaaaactaactacgagaagcgcagtttcaaggtcccgattcaggccaatgaaacattagtgggcgctgtgatcaataacgtgagcgaggcgatggaaaccctcaccagaattaccgaggaactagtgccggtgcctgggtcggtgaacggtgtcaatgcactgggcttggttgttttttctatgtgcttcggcttcgtaatcgggaacatgaaagagcagggtcaagcgctcagagaatttttcgactccctgaacgaggcaattatgcgtctggtcgccgtgataatgtggtatgcccctgtgggtattttatttctcatcgccggaaagatcgtggaaatggaggatatgggcgtgatcggggggcagctggccatgtacaccgtaacagtcattgtgggcctgctgatacacgcagtcattgtcttgcccctgctttacttccttgtgacaaggaagaacccatgggtctttatcggtggtctgttgcaggccttgatcaccgctttagggaccagtagcagctctgccaccctacccattacctttaagtgcctggaggagaacaacggagtagacaagcgcgtgacgcgattcgtgctgccagtgggggctactataaacatggacggtactgcactgtacgaagcattggctgcaatctttatcgcccaggtaaacaacttcgaactgaactttggccagataataactataagcataaccgccaccgcagctagcataggggccgccggtatcccccaggcagggctcgttacaatggttatcgtgctgacatccgtcggtctcccaaccgacgacataacactaataatcgccgttgattggtttttggataggctacgcaccacgacaaacgtgttgggcgacagtctgggtgcaggtattgtggaacacctctcacgccacgagctcaaaaatcgggacgttgagatgggaaatagcgtcattgaggagaatgagatgaagaaaccttatcagctgatcgctcaggataatgagaccgagaaacctattgattccgagacgaaaatgtag

SEQ ID NO: 134737 - DNA, 1494 bp, Artificial Sequence
  Description of Artificial Sequence: Synthetic coding sequence
atgaccaagtcaaatggggaggagccaaagatgggtgggcggatggagagattccagcagggcgtccgaaaacgcacactgctggccaagaagaaagtacagaacatcaccaaagaggatgtcaaaagctatcttttcaggaacgccttcgttttgctgactgtgaccgctgtgatagtgggaaccattctcggtttcactctgaggccttatcggatgagctatcgcgaagttaagtatttttccttccctggagaactgctcatgcgcatgctccagatgttagtgttgcccttgatcatctcttccttggtcacaggcatggcagcactggacagcaaggcctccggaaagatgggaatgagggctgtcgtgtactatatgacgaccaccatcattgcagttgtgatcggaatcattattgtgattattattcacccagggaagggcacaaaggaaaatatgcatagggaaggtaagatcgttcgagtaacggctgccgacgccttcctggacctcatccgcaacatgtttccccccaatctcgtcgaggcctgcttcaaacagttcaaaacaaactacgaaaaacggtctttcaaagtccccatccaggctaatgaaaccctggtgggggccgtcattaacaatgtaagcgaggctatggagaccctgacgaggatcactgaagaactggtcccggttcccgggtccgttaatggcgtgaacgcgctcggcctcgtcgtgttctccatgtgctttgggtttgtgatcgggaacatgaaggagcagggacaggctctgagagaattctttgacagcttgaatgaggcaattatgcgtcttgtggccgtcataatgtggtatgcccctgtggggatcctgtttttgattgcagggaagattgttgaaatggaggacatgggtgtcatcggtgggcagctcgctatgtatactgtcacggtgatagtaggccttctgatccacgcagtgatcgtcctgccgctcttgtacttcctggtcacacggaagaacccctgggtattcatcgggggtttactgcaggcattaatcactgccctaggtacgtcatcctcttctgccacactgccaatcacgtttaagtgtctcgaggaaaacaatggggttgacaagcgggtcactcgctttgttctgcccgtaggcgctacaattaacatggacggaacggccctgtacgaggcgctggccgctattttcatagcacaggtaaataatttcgagcttaacttcggtcagatcatcactatcagagatagactgcgcaccacaactaatgtcctgggggactcccttggagcgggtattgtagaacatctatcacgacacgagctgaagaatagagatgtggaaatgggtaactctgtaatagaggagaacgagatgaaaaagccgtatcagctgattgcgcaagataacgagactgagaagccaatcgacagcgagaccaaaatgtag

SEQ ID NO: 134738 - DNA, 348 bp, Artificial Sequence
  Description of Artificial Sequence: Synthetic coding sequence
atgaccaagtcgaatggagaagaacccaaaatgggtggccgcatggagcggtttcagcagggggttcggaagcgcacccttctggccaagaaaaaagtccaaaacataacaaaagaagatgtcaagagttatctctttagaaatgcctttgtgctgctgactgtgaccgcagtgattgtggacgaaaagaccgaggcacagatcctgaccactcagttgatgaacaccgagtgggactctaaccccccattccggctgcaagtactgatccaccacaccgtgctgggagcaataacaccgatccttgccctgctgcagcagtttgctgagggtctgcctgaggtgtag

SEQ ID NO: 134739 - DNA, 1473 bp, Artificial Sequence
  Description of Artificial Sequence: Synthetic coding sequence
atgactaagagtaatggcgaggagcctaagatgggcgggcgcatggaacgattccaacagggtgtccggaaacgcaccttgctagcaaagaagaaggttcagaatataactaaagaagacgtgaagtcttatttgtttaggaacgcgttcgttctgctcacgggaatggctgctctggacagcaaggctagtggaaagatgggcatgagagctgtcgtctattatatgaccaccacgataatagctgtggtgatcggcatcattatagtgattatcattcaccccggaaaggggaccaaagaaaatatgcacagggaggggaagatagtcagggtgactgccgcagatgcgtttctggacctgatacgcaacatgtttccacccaacttggtcgaggcctgtttcaagcagttcaaaacaaactacgaaaaacgatcgttcaaagtgcccattcaggctaacgaaacgctggttggagcagtgatcaacaacgtttctgaggcaatggagaccctgaccagaatcacagaagagctggtgcccgtgccagggagtgtgaacggagtcaatgccctgggcctcgtcgtatttagcatgtgctttggcttcgtaattgggaatatgaaggaacagggacaggcacttcgcgaatttttcgatagtcttaatgaagctatcatgcggcttgtggccgtcattatgtggtacgcacccgtgggaatcctgtttctgatcgcagggaaaatcgtggaaatggaggacatgggcgtgatcggaggccagctcgccatgtacactgttaccgtgatcgttggacttttaatccatgcagtgatcgtgctcccccttctttacttcctcgtgactcggaaaaatccatgggtattcattggagggttgctgcaggccctcattactgcgcttggaaccagcagctcgagtgctacgctccccattacattcaagtgtcttgaggagaataacggcgtggacaagcgcgttaccagatttgttctgcccgttggcgctaccataaatatggatgggactgccctgtatgaagccctggcggccatatttatcgctcaggtcaataacttcgagctgaactttggccagatcatcacaatttctataaccgcaactgccgcctcaataggtgctgctggcatccctcaggccggcctggttactatggtcattgtgcttacctccgtcggcctccccacagacgatataactctcatcatcgctgtggactggttcctggatcggctgcgcactacaacaaatgtgctgggtgacagtcttggagcggggatcgtagagcacctgtctcgacacgagttgaagaacagagacgtagagatgggaaattcagtaatcgaggaaaatgagatgaagaagccttatcagctaattgcacaggataatgaaacggagaagccaattgattccgaaactaaaatgtag

SEQ ID NO: 134740 - DNA, 324 bp, Artificial Sequence
  Description of Artificial Sequence: Synthetic coding sequence
atgacaaaatcgaacggagaagagccaaaaatgggtggcagaatggaaaggtttcagcagggggttagaaagagaaccctgctggctaaaaagaaagtgcagaacataactaaggaggacgtaaagtcctacctgttcagaaacgcctttgtactgctgaccgtcactgcagtcattgtaggaaccatcctgggattcaccttacgaccctaccggatgtcttacagggaagtgaagtacttcagctttccaggcgaacttctgatgagaatgctgcagatgcttgtcttacctttgatcatctctagtctagtcactgggtag

SEQ ID NO: 134741 - DNA, 324 bp, Artificial Sequence
  Description of Artificial Sequence: Synthetic coding sequence
atgacaaagagcaacggcgaggaacccaagatgggagggaggatggaacggtttcagcagggggtaagaaagcgcactctactggccaagaaaaaagtccagaacattaccaaggaggacgtaaaaagttatctgtttcggaatgcattcgtgctattgaccgtgaccgctgtgatcgtcggtacaatcctcggcttcaccctgcgtccttacagaatgtcctaccgcgaggtaaaatacttctcttttccaggtgagctgctgatgagaatgctccagatgctcgtactgcccctgatcattagcagccttgtaaccgggtag

SEQ ID NO: 134742 - DNA, 306 bp, Artificial Sequence
  Description of Artificial Sequence: Synthetic coding sequence
atgactaagagtaacggtgaggaaccaaagatgggggggagaatggaacggtttcagcagggcgtgcggaagcgtacacttcttgcaaaaaaaaaagtgcagaatattacgaaggaagatgtgaaatcttatttgtttaggaacgctttcgttctgctgactgtgaccgcggttatcgtggggacgattctgggattcactcttcggccctatagaatgtcttatagggaagtaaagtatttctcgttcccaggcgaactactgatgcgcatgctgcagatgctggttctgccgcttattatttag

SEQ ID NO: 134743 - DNA, 987 bp, Artificial Sequence
  Description of Artificial Sequence: Synthetic coding sequence
atgaccggtgtgttcgactcattggtggcggatatgcatagtactcagatcgccgcgtcctccacatatcaccaacatcagcaaccccctagtggcggcggcgccggcccaggaggaaactcatcctcctcctccagcttacataaaccgcaggaatccccaaccctaccagtgagcaccgcgacagacagctcctactatactaatcagcaacaccccgctggcggaggcgggggtggtggatcgccatacgctcacatggggtcataccaataccaagcctctggactgaacaatgttccttattctgccaaatcctcctatgatctgggctatacagccgcttataccagctacgctccttatggaacatcttcatcccccgccaacaacgaaccagaaaaagaggatcttgagccagagatacggatcgtgaacggcaagccaaaaaaggtgaggaagcctcgtacaatttactctagcttccaactcgccgctcttcagcgtcgttttcagaagacccagtatcttgccttgccagagagggcggaactcgcagcctctctgggacttactcagacccaggtcaaaatttggttccagaaccggcgatccaaatttaaaaagatgtggaagtccggcgagatcccatctgaacaacatcccggcgcatccgcatccccaccatgcgcttccccccccgtttccgcccccgcctcctgggactttggtgtgccacagaggatggccggcggcgggggacctggctccggagggagtggcgcaggctcttctgggtctagcccttcctctgccgctagcgcattcctgggcaactatccatggtaccatcagacatcaggctcagcgtcacatctgcaagctacagcgcctcttctccacccaacccaaactcctcaaccgcaccaccatcatcatcaccacggcggcgggggcgcacccgtctcagctgggacaatattctag

SEQ ID NO: 134744 - DNA, 1359 bp, Artificial Sequence
  Description of Artificial Sequence: Synthetic coding sequence
atgctgcttaggatgctcagaatgataatcctcccactagttgtgtgttcattggtgtctggtgcggctagccttgatgcctcttgtcttggacgattgggaggaatcgctgtggcctatttcgggctcacaacgttatcagccagcgcgctggctgtcgccctggcctttataataaagccagggtccggcgcacagaccctccagagcagcgacctggggttggaagatagtgggccgccgccggtgcccaaggagaccgtcgacagcttcctggacttggctaggaatctgtttccctccaatttagtggttgctgcattcagaacatacgccaccgattacaaggtcgtgacgcagaactcgtcctcaggaaatgttacgcatgaaaagatcccaatagggactgaaatcgagggcatgaacattctgggactggttctgttcgccctggtgctgggtgtggcattaaagaaacttggttccgaaggcgaagacttaatcaggttttttaactctttaaatgaagccaccatggtgttagtgagttggattatgtggtatgtgcctgtgggaattatgttcctggttggatcgaaaattgtcgagatgaaagacatcatcgtgctggtgacatcgctgggaaaatacattttcgcgagtatccttgggcatgtcattcatggagggattgtgcttccgcttatttactttgtgttcactagaaagaacccttttcgcttcctcctggggctgctggccccatttgcaaccgcgttcgctacctgcagtagtagcgcaacccttccctccatgatgaagtgtattgaggagaacaacggcgtggataaacgcatcagcaggttcattctgcccatcggcgccacagtcaacatggacggagcagcaatattccaatgcgttgcagctgtattcattgcacagcttaataacgtagagctaaatgcgggccagatcttcaccatcctcgtcactgccaccgctagctccgtgggcgcagcaggagtccccgctggcggcgtgttaacaatcgccatcatcctagaagccatcgggctgcccacccacgacttgccactgatattggccgtggactggatcgtagatagaaccacaaccgtcgtgaacgtcgagggagacgctctgggggctggtatactgcaccatctgaaccaaaaggctacaaagaaaggcgaacaggaactggccgaagtaaaggttgaggctatccccaactgtaaaagcgaagaagaaaccagtcccttggttacacaccagaatcctgctggcccagtggcttccgcccccgaattggagagcaaagaatcggtcctttag

SEQ ID NO: 134745 - DNA, 705 bp, Artificial Sequence
  Description of Artificial Sequence: Synthetic coding sequence
atgaacattctgggattggtcttgttcgccttagtcctgggggtcgctctcaagaagctcggtagcgagggtgaggatttaattcggttttttaatagtctgaacgaagcaacgatggttttggtgagctggataatgtgttctgccaccctgccaagcatgatgaaatgtatcgaagagaacaatggggtcgacaagcggattagcaggttcattctgccaatcggggccaccgttaatatggatggggctgccatttttcagtgtgttgccgctgtattcatcgctcagctcaataatgtggaacttaatgccggacagatcttcacaattctggttactgccacagcttccagcgtgggcgcggccggtgtccccgcggggggtgtgctaacaatagcaatcattctcgaggctatcggtctaccaacccacgacctccctttgatccttgctgttgattggattgtggacagaactacaactgtcgtgaacgtggaaggggatgcattaggagctggaatattgcaccacctcaaccagaaagccaccaaaaagggggaacaggaactagccgaggtgaaagttgaggccatccccaactgtaaatcggaagaggaaacgtcacccctggtgacccaccaaaatccggcaggacccgtagcctccgcacccgagctagaaagcaaggagtcagtgttgtag

SEQ ID NO: 134746 - DNA, 1575 bp, Artificial Sequence
  Description of Artificial Sequence: Synthetic coding sequence
atgggaaagcctgccaggaaagggtgtgaatggaagaggttcctgaagaataactgggtgctactctctacggtcgctgcagtagtgctcgggattactactggagtgcttgtcagggaacactcgaacctgtccaccctggaaaaattttactttgcctttccaggtgaaattctcatgcgaatgcttaaacttatcatactccccctgattattagttccatgatcaccggagtggccgccctagactctaacgtgtccgggaagattggcctgagagcagtcgtttattacttttgcactacgcttattgccgtgatcctaggaatcgttctggtggtgagtatcaaacccggcgttacccaaaaggtgggagagattgcgagaactggttctactccagaggtgtccaccgtagacgccatgctggatctgatccgcaacatgttcccggaaaacctcgtgcaagcttgctttcaacaatacaagacaaaacgtgaggaggtcaagccacctagcgatcctgagatgaacatgaccgaggagtcctttacagccgtaatgaccactgctatctcaaaaaataagacaaaggaatacaagatcgtgggaatgtactccgacgggatcaacgtgctaggtttaatcgttttttgcctggtgttcgggctggttatagggaaaatgggggagaagggccagatcctggttgactttttcaacgccttgtctgatgctacaatgaagattgtccagatcatcatgtgttacatgcctctggggatactgttccttattgccgggaaaatcatcgaagtggaagattgggagatattccgcaaactaggcctgtatatggcaactgttctgactggtttggccatccactccatagtcattttgccgcttatttactttatcgtggtcaggaaaaatcccttccggttcgccatgggcatggcccaggccctgctgacagcattgatgatttcttccagtagtgcgacgctacctgtgacttttcggtgcgcagaagaaaacaaccaagtggacaagcggattactagatttgtgttacctgtcggcgccacaatcaacatggatggcaccgcactgtacgaggccgtggccgccgttttcatcgcccaacttaacgacctcgatctgggtataggacagatcattaccatctccattactgccacaagtgcgagtataggggcagcaggcgtgccacaggccgggctggtgacaatggtgattgttttatcagctgttggtctcccagcagaggacgtgaccctgatcatcgcggtggattggcttctagacaggttccgaacaatggtcaatgttctcggtgatgcttttggaaccgggattgtggagaagctgagcaaaaaggagctggagcagatggacgtgagttccgaggtaaatatagtgaacccttttgccttagagtctaccattctggacaatgaagacagcgacaccaagaagtcctatgttaacggaggattcgcggtggacaaaagcgacaccatctcatttacccagaccagccagttttag

SEQ ID NO: 134747 - DNA, 729 bp, Artificial Sequence
  Description of Artificial Sequence: Synthetic coding sequence
tgatttttcaacgcactgagcgacgccactatgaagatcgtccagattattatgtgctacatgccgctgggtatcttatttctgatagccggcaaaattatcgaggtcgaagactgggagatctttcgtaagttgggcctatatatggctactgtgttgacaggtctggcaatacattccattgttatcctgcctctgatttacttcatcgttgtccggaagaacccgtttcgtttcgccatggggatggctcaggctcttctaacagctctgatgatctcgagcagcagtgcaacattgcctgtgacatttaggtgtgctgaggagaacaaccaggtggataagaggataacaagatttgtgcttcccgtgggagccaccatcaacatggatggcaccgccctctatgaggctgtcgcagccgttttcattgcccagttgaatgacctggacctggggattggacagataatcaccatccgggatcgttttaggacaatggttaatgtcctaggagacgccttcggaacgggtatcgtagagaagttgtctaagaaggagctggagcagatggacgtttcctctgaggtgaacatcgtcaacccgttcgccctggaaagcactatcctagacaacgaggactcagacaccaagaagtcttacgtgaatggagggttcgcggtggacaaatccgatactatatcatttacccagacctcccagttctag

SEQ ID NO: 134748 - DNA, 1647 bp, Artificial Sequence
  Description of Artificial Sequence: Synthetic coding sequence
gagactccagtgcttccaattatggttgccgatcctcccagggattccaaggggcttgctgccgctgagccaaccgcgaacggcggcctcgccctggcgagcatcgaggatcagggagctgcagccggagggtactgtggcagtcgagatcaggttaggcgatgcctgagggcgaacctcctggtgctactcactgtggtggcagtcgtggctggagtcgccctcggccttggggtatcgggcgctggcggggccctcgctctggggcctgagcgtctgagtgcttttgtgtttccaggagaactgctgctgcggctgctccggatgattattttaccactggtggtttgtagcttaattggcggcgccgctagcctcgatcccggcgctctggggcggttgggggcttgggccttattgttctttctggtcacaacgcttctggctagcgcactgggcgtaggcctggcacttgctctacagcctggcgctgcttccgctgcaattaacgcctcagtgggggccgctgggtccgccgaaaacgcaccctctaaagaagtgctggatagcttcctcgatctcgcacgaaatatcttcccgagtaatctggtcagcgccgcctttcgaagctactcaactacatacgaggagcggaacatcacaggtaccagagtgaaggtccctgtcggacaggaagtggaaggaatgaatatcttagggctggtagtgttcgccattgtatttggagtggctcttagaaaactgggcccggagggcgaattgctcatccgcttctttaactcatttaatgaagccactatggtattggtttcttggataatgtggtatgcccctgtgggaatcatgttcttggtggcgggaaaaatagtggagatggaggatgttggcctcctcttcgcaagattaggtaaatacatcctttgttgcctcctggggcatgcgatccatggacttctcgtgctacctctaatctactttctattcactcgcaaaaatccctaccgatttctgtggggtattgtaacacccctggccacagcattcggtacctcaagttcgagtgcgaccctgcctcttatgatgaagtgcgtcgaagaaaacaatggcgtggctaaacacatttctcgatttatactgcccattggggcgacagtaaatatggacggtgctgccctgttccagtgtgtcgccgccgtgttcatagcccagttatctcaacaatctcttgattttgtgaagataatcaccatacttgtgacggccacggctagcagcgtaggagccgccggcattcctgccggcggcgtgcttaccctcgctatcattctggaggcagtgaatttgcccgtggaccatatcagtctgattcttgctgtagattggctggtcgatcgcagctgtactgtgctgaatgtggagggcgacgccctgggcgccggcctactgcagaattacgttgaccgcaccgaatcacgtagcactgaaccagagctgattcaggtaaagtcagaattaccccttgaccctctaccagtgccaaccgaagagggaaatcctctgttaaagcactacagagggccagccggggacgcaacggttgctagcgaaaaggaatcagtgatgtag

SEQ ID NO: 134749 - DNA, 942 bp, Artificial Sequence
  Description of Artificial Sequence: Synthetic coding sequence
atgaacatactggggttagtggtgtttgctatcgtgtttggagttgctcttaggaagctgggacccgaaggtgagctgctcattcgcttctttaacagcttcaacgaggctaccatggtgcttgtgtcttggatcatgtggtatgcccctgttggcattatgtttctagtagctggcaaaattgtggagatggaggacgtgggcttgctctttgcccgactagggaaatacattctgtgctgtcttctcgggcacgcaatccatggtctgctggtgctccctctcatatatttcctgttcactcggaaaaacccgtacagattcctgtggggcattgtgactcccctggctaccgcctttggaacatcatcctcttccgccaccctgccactgatgatgaaatgtgtggaggaaaataatggggtcgccaagcacataagccgcttcatcctcccaataggggcgacggtaaacatggatggggcagcactgttccaatgcgtggccgctgtgtttattgcccagctctcccagcagtctctggattttgtaaagattattaccatcctcgtgaccgcaacggccagcagcgttggcgcagccggaatcccagccggcggagtcctcactttggctataattctggaagcggttaatttgccagtggaccatatctcacttatattggctgtagattggttggtagatcggtcctgtaccgtgctgaacgtggagggcgacgctctcggggcaggtctgcttcagaattatgtggatcgcacggagagtcgatccactgaacctgagcttattcaggtaaaaagtgagctgcccctcgatcctctgccagttccaactgaggaggggaaccccctgctcaagcattatagagggcccgccggcgacgccacggtcgcttctgaaaaggagagcgtgatgtag

SEQ ID NO: 134750 - DNA, 1020 bp, Artificial Sequence
  Description of Artificial Sequence: Synthetic coding sequence
atgtattccaccacctatgaggaacgaaatattacaggaacccgcgtgaaggtgcccgtgggtcaggaagtagaaggtatgaacattttggggttggtcgtcttcgccatcgtcttcggggttgcacttaggaagctcgggcctgaaggggaattgctgattagattcttcaactctttcaacgaggctacaatggtgctcgtgtcctggatcatgtggtatgctcctgtgggtatcatgtttctcgtggccggcaaaatcgtggaaatggaggacgtgggtctgttgtttgcacgtttgggtaaatatatcctgtgttgccttctcggtcatgccatccacggccttctagtgctaccccttatttacttcctttttacccgcaagaatccttacagattcctttggggtatcgttacacctttggcaactgccttcggtacatcgtcgagttcagccactttgccgttgatgatgaagtgcgtggaagagaataacggagtggccaagcacatttcgcggtttattttaccaataggcgcaacagtgaatatggatggagccgccctcttccagtgcgtggccgcggtctttatcgcccaactgtcccagcagagtctggacttcgtgaagataatcaccattttagttactgctaccgcctccagtgttggtgccgccggcattcctgcaggaggcgtcctaacacttgctatcatcctggaggcagtgaatcttcccgtggaccacatctccctgatcctggccgttgactggctggtcgatcggtcttgtacggtccttaatgtggagggtgacgcactgggagccggcctcttgcagaattacgtggacaggacagaatctaggagtactgagcctgaattgatccaggtcaagtccgagctacccttggatcccctgcccgtaccaacagaggaaggaaatccactgctaaaacattacagaggaccagcgggagatgcaacagttgcgtcagagaaagagtcagtgatgtag

SEQ ID NO: 134751 - DNA, 1626 bp, Artificial Sequence
  Description of Artificial Sequence: Synthetic coding sequence
atggtggcagatcctcctagagacagcaaaggtctagccgccgctgagccaactgccaatggcggtctggcactcgcaagcatcgaagaccagggagcagccgcaggtgggtattgtggctctagagatcaggtacggaggtgtttgagagctaacctgcttgtgctgttgaccgtagtggcggtggtggccggcgtggcactcgggcttggggtgtcaggcgccgggggggccctggcactggggccagagaggctatccgcatttgtatttcccggagaacttctcctgcgcctcctgcgaatgattatattgcctctggtcgtctgttccctgattggaggagcggccagtcttgacccaggggccctgggtcgactgggagcatgggcccttctttttttcttggtaaccactctgttagcaagtgctctcggggtgggcttggctctggcccttcagccgggtgcggcctcagctgccatcaacgcctctgtaggggccgcgggcagcgccgaaaacgccccgagcaaggaagtgctggactccttcctggatctagccaggaacatatttccaagcaacctcgtctccgccgctttcaggtcttactctacaacatacgaggaacgcaacattaccggcacacgggtcaaagtgccagtagggcaagaggtggagggcatgaatattctgggcctggttgtctttgccattgtgttcggtgtggcccttaggaagctaggccccgaaggggagctcctcatccggttctttaacagctttaacgaggctaccatggtcctagtctcctggatcatgtggtatgcaccagtcggaattatgttcctggtcgctgggaaaatagttgaaatggaggatgtcggattgttatttgcccgcttgggaaagtacattctctgttgtctgctgggtcacgccattcatgggctgctggtactgccactgatttattttctgttcacacgcaagaacccatatagattcctgtggggaattgtgacacccctggcaactgcctttggcacaagctcctcctcagccacgctccctcttatgatgaagtgtgttgaagaaaataatggggtcgctaagcatatcagtaggtttattctcccaatcggggcaaccgtcaatatggacggtgccgcactgtttcagtgtgtggcggctgtgtttatcgcgcagctcagccagcagtccctggactttgttaaaatcatcactattcttgtcactgcgaccgcaagctctgtgggtgctgcaggcatcccggccgggggagtgttaactctggcaattatactggaagccgttaatcttcccgtcgatcatatcagcctgatcctcgccgtcgactggcttgtggatcggtcttgcactgtcctgaacgttgagggcgacgcccttggcgctggcctcctccagaactacgtggacaggaccgagagccggagtaccgagcctgaactgattcaagtgaagtcagaactgccgctcgaccctcttcctgtgccaaccgaagaaggcaatccactgttgaagcactatagagggcccgccggtgacgctacagtggcttcagagaaagaaagcgtgatgtag

SEQ ID NO: 134752 - DNA, 1308 bp, Artificial Sequence
  Description of Artificial Sequence: Synthetic coding sequence
atggccgagtcttctagcgagagcgaccattttcgttgtagagatagacttagtccatgggcagcccgctctacacatcgcggcacaagaagtctacccaccgtggaagtgactgagaaagtgaacaccataacctccactctccaggatacgtcgcggaacctgaggcaggtggaccagatgctggggcggtatagagaatattcgaatggacaagccggggccatcgaacacctgaaagagtccctggaacaatctatcgatcaactgagatctcagcgtctcctgcgcaatagcggcggccgaagcattagtgtaacgagcttgagcgccagcgacctggatggggggactggatctgaattgcaccacttccctcctacttccccgttgaaggactacggagacccacaaggcataaagcgcatgagaagccggactggtgtaagattcgtccaagagacagacgatatgacccaactccatggctttcaccagagcctgagagacttgtcctctgagcaaatacggctgggcgatgacttcaatcgggagttgagtagacgctcacgctcagatgcagaaacaaagagagctctcgaagagctgacagaaaaactgaatgaggcacagaagcaggaagtggttagcgatcgtgttgaacgacgcctacaggagcttgagcgagaaatgagaacagagcgagagctggtggagaggaggcaagatcagctgggactcatgtccctgcagctccaggaagcattgaagaagcaggaggccaaagctgatgagcacgagggagctatcaagaataaactaagacagactgagacagagaaaaatcagctcgaacaggagttagagctgagccggagattgctaaatcagagtgaaggatcccgtgaaactctgcttcaccaggtagaggagctgaggacacagcttaccaaagccgaaggcgacagaaaaggattgcagcaccaggtatctcaaatatctaagcagcagtcaaactatcaggatgagcagggggaggattggcgattccgtcggggtgtggagcgcgaaaaacaggacttggaaaagcagatgagtgacttacgggtgcaactgaacttctccgctatggctagcgagcttgaagaggtaaagagatgcatggaacggaaggacaaggagaaggcccatttggcgtcccaggtagaacacatcaatagaaagtgtctgctgaacctggttcaggatctcgactgtaaagataacgagattctcacatatagcttgcagagcccactgcatgtctag

SEQ ID NO: 134753 - DNA, 1047 bp, Artificial Sequence
  Description of Artificial Sequence: Synthetic coding sequence
atgaatgaccccaattcttgcgttgacaatgccactgtgtgctccggagcttcatgtgtggtgcctgaatccaattttaataacattttaagtgtggtcctcagtactgtgctaaccatactcctagcactcgtgatgttttccatgggatgcaatgttgagattaagaagttcctcggtcacatcaaacgaccatgggggatctgtgtggggtttctgtgtcagttcggcattatgcccctaactgggttcatccttagtgtcgcctttgatatcttgcctctccaggctgtagtcgtgctaattatcggctgctgccctggggggacagcctctaacattctggcttactgggtcgacggagatatggatctgagcgtgtctatgacaacctgtagcaccctgctggctctgggaatgatgccgctctgtctgttgatatacaccaagatgtgggtggactcgggaagcatagtgatcccatacgataatattggaactagcctggttagccttgtggtccccgtcagtattggcatgttcgtcaatcacaaatggcctcagaaagccaagataatcctgaaaataggttctatcgccggtgccatcttgatcgttcttatagctgttgtgggcggaatactgtatcaaagcgcctggattatcgcacctaagttatggatcatcggtaccatcttccccgtcgcggggtactcactagggttcttactcgcacggattgcaggactgccatggtaccgctgtcggacagtggccttcgagactggtatgcaaaacactcagctgtgctccacaatcgtgcagctgtcattcactcctgaagagctgaatgttgtcttcacctttcccttgatttacagtatcttccagcttgccttcgccgcaatctttctcggtttttatgtcgcttacaagaagtgccacggtaagaataaggctgaaatccccgagtcaaaggaaaatgggaccgagcccgagagttccttctacaaagccaatggcggattccagcctgatgaaaagtag

SEQ ID NO: 134754 - DNA, 1434 bp, Artificial Sequence
  Description of Artificial Sequence: Synthetic coding sequence
atggtgttaatgcaggacaagggcagctcgcagcagtggcctggactcggcggagaaggaggcggtacaggacctctgagtatgctgagagccgctctcttgttaatcagcctcccttggggagcacagggaaccgccagcacctcgttgagtacggctgggggccacactgtcccccctaccggcggccggtacctgtcaattggggacggctcagtcatggaatttgagttccccgaagacagcgagggcatcatcgtgatatccagccagtatcccggccaggcaaacaggactgcaccaggaccaatgctgagggtcaccagcctggatacagaggtcctgacgatcaagaacgtgtccgctatcacttgggggggtgggggtggtttcgttgtgtctatccatagtggtctcgccggactggcgcccctacacattcagctcgtggatgcgcacgaggccccccctacacttatcgaagagagacgagatttttgtatcaaagttagtcccgccgaggatactcctgcaaccctgtcagcagacttagcccacttctctgagaatcccattctgtacttactgctacctctgatttttgtcaacaaatgttctttcggttgcaaggtggaactagaagttctgaaaggattgatgcagagcccacaacctatgctcttaggcctccttgggcagtttctggtgatgcccctgtatgcttttttgatggcaaaagtcttcatgctccctaaggcattggccctgggcctgatcattacgtgcagctcacctggggggggtggtagttacttattttccctgttgctggggggagacgtaaccttagcaatctctatgacttttctgtctaccgtggccgctacgggcttcttgccactgtcaagcgctatctactcccggctgctgtccattcacgaaaccctgcatgtgcccatcagtaaaatcctgggaaccctcttgtttatcgccatccctattgcggtgggcgtgctcatcaagtccaaactgccgaagttttcccagttgctcttacaagtggtcaaacccttctcctttgtgttactccttggcgggctctttttagcatatcgcatgggagtgttcatcttagctggaattaggctgcccatcgtgctcgtagggattacggtacctctcgtgggactactggtcggatactgcctggccacctgtctcaagctgcctgttgcccagcgtagaaccgtgagcatcgaggtgggagtacagaattcgttattggcgctagccatgctgcagctaagcctccggaggctccaggcggattacgctagtcaggcaccattcatcgttgctctaagcggcacatccgagatgctcgcgctggtgattggccacttcatttatagtagtctttttccagtcccatag

SEQ ID NO: 134755 - DNA, 1347 bp, Artificial Sequence
  Description of Artificial Sequence: Synthetic coding sequence
atggtgttaatgcaggacaaagggtctagccaacagtggccaggcctcggaggggagggcggggggaccggacccctcagtatgctgcgtgccgccttactgctgatctcgctcccgtggggggcacagggcactgcgtccacctctttgagtacggccggcggacacacggtcccgcccactggcggcagataccttagcatcggagatgggtcggtcatggagttcgagtttcccgaagactctgaggggattatcgtgatctcctcacagtatcccggacaagctaatagaacagctcctggaccaatgttaagagtgacatccctggacacagaggtgctgaccattaaaaacttagtcgacgctcacgaggctcctcctactctgatagaggagcgcagggacttctgcatcaaggtaagcccggcggaagatactcccgccacactgtccgctgatttggcccatttttccgagaacccaatcctgtatcttctattgcccctcatctttgttaacaagtgttcttttgggtgcaaggtagagctggaggtgttgaaaggcctgatgcagtccccccagcccatgttactgggtctccttggtcagttcctggtcatgccactgtacgcatttctcatggccaaggtttttatgttgcccaaagccctggctctcgggctaatcataacttgtagctctccaggtggcggtgggagctatctattttcattactgttagggggcgatgtgaccctcgccattagtatgacgtttttgagcacagtggccgccactggtttcctgccgctgtcttcagcaatttattcgcggctcctgtctatccacgagaccctgcatgtgccaatcagtaaaatactcggaactctcttgttcatcgccataccaattgccgtgggcgtcctcatcaaaagcaagctgccaaagttctcccagttgttattgcaggtggtgaagcccttcagttttgtgctgctcctgggcgggctgttcttggcgtaccggatgggcgttttcattctcgcaggcatccgcttgccaatagtactggtggggataaccgtgcctctggttggtctgctggtcggctactgcctcgccacctgtctgaaactccccgtggctcagcggcggacagtgtctatcgaggtcggcgttcaaaattccctgctggcccttgccatgctccagttgtcactcaggcgacttcaggctgattacgcctcccaggccccattcattgtggctttgtctggaacttccgagatgctggccttagtgattggtcacttcatttatagtagcctctttccagtaccttag

SEQ ID NO: 134756 - DNA, 1599 bp, Artificial Sequence
  Description of Artificial Sequence: Synthetic coding sequence
atggcaggacctagaccacctggagactctccagcaataaaagaagacagtaccgggctgggtcccacccacgaacctttcagtgggcagcctaactccacttcaggagacgtactgctatcgcggcgggggccggggcacgcaatccgccctccaggccgggccatggtattgatgcaggacaagggctcttctcagcagtggccaggattggggggtgagggtgggggaacgggccccctgagcatgctgcgagccgccctcctgctcatctctcttccctggggcgctcaaggcactgcctccacgagtctttccaccgcaggggggcacacggtgcccccaactggaggaaggtatctgtccattggagacggctccgtgatggaattcgagttccctgaggattccgaaggcatcatcgtgatctctagccagtaccccggacaagctaatcgtacagcgccaggccctatgttaagagtcaccagcctggatacagaggtcctgacaatcaagaacgtgtcagctatcacatggggaggcggaggaggttttgtggtgagtattcatagtggccttgccgggctggctccccttcacatacagttggtggatgcccacgaggccccccccactctgatcgaggagagacgggacttctgtattaaagtgtctcctgccgaagataccccggctacactgtcagccgatctggctcacttctccgaaaacccaatcctgtatctgctcctgcctctgatcttcgttaataaatgctcatttggttgtaaggtggagctggaggtgctgaaggggcttatgcagtcccctcagcctatgctgctgggcttattagggcagtttctggtgatgcccctgtacgcctttctgatggcaaaggtcttcatgttgccgaaagccctggccctgggcctgattatcacctgcagcagcccgggcggtggcggctcttacttgttcagtctgctgttaggtggcgatgtcacgttggccataagcatgactttcctttcaacggtggccgcgacaggcttcctgcccctgtcctccgcgatctatagtcgattactgtcaatacatgaaacgctgcacgtcccgattagcaagatactgggcacactgttgtttatcgctatacccatcgcagttggcgtgctgatcaaaagcaagttgcctaagttctcacagctccttctgcaggtggtgaaacctttttcctttgttcttctcttgggaggcctatttttggcgtaccgaatgggggtgtttatacttgccgggatacggttgcccatagtgctggtcggtatcacggtccctctggtcggattgctcgtagggtattgccttgcaacctgcctcaaactaccagtcgcacaacgccgaaccgtatcaattgaagtgggcgtgcagaactcattgttggctctggcgatgctgcagctgtccctccgaagattgcaagcggattacgcatcccaggctccttttattgtcgctttaagcggaacctctgaaatgctggcccttgtgattggacatttcatttactctagcttattccccgtcccatag

SEQ ID NO: 134757 - DNA, 1434 bp, Artificial Sequence
  Description of Artificial Sequence: Synthetic coding sequence
atggtgcttatgcaggacaagggctccagccaacaatggcctgggttgggtggcgaagggggaggcaccggtccgctctctatgctcagagccgcactgctacttatctccttgccatggggggcccaaggcactgcgagcactagtctgtccacagccggaggtcacacagtgccacccaccggagggagatacctctcaataggcgatggatccgtcatggagttcgagtttcccgaggattctgaaggaataatcgtaatctcctcccagtatccaggccaagcaaaccgcacggccccaggacccatgctgcgcgtcactagccttgatactgaggtgctgaccattaagaatgtgtctgcaatcacatgggggggagggggtggctttgttgtcagcatccactctggattagctggcctggcacccctgcacatccagttggtggacgcccacgaggcacccccgactctgatcgaagagaggcgggatttctgcattaaagtgtcccctgccgaagatacccccgccacacttagtgcagatctggcccatttttctgagaaccccattctttatctgctgctcccattaattttcgtgaacaagtgtagcttcgggtgcaaagttgagttagaagttttgaaaggactgatgcaatctccacaaccaatgctgcttgggctgttgggacagttcctcgtgatgccattatatgcttttctaatggcgaaagtctttatgctgcccaaggcactcgccctagggctgattatcacatgctcgtctcctggaggcggaggaagctacttgtttagcttgttactaggcggcgatgtgacgcttgcaataagcatgaccttcctctccacagtcgccgccaccggatttttgcccctcagctctgctatatatagtagactgctgtctatccatgaaacattacatgttcctatatccaagattttaggaaccctcctgttcattgccattccgatcgcagtgggggtgttgatcaagagcaaactgcccaaattcagtcagctgttattacaagtcgtaaagccgttttcatttgtgcttcttctgggagggctctttttggcttatagaatgggggtgtttatcctagcgggtattcgactgcctattgtactagttggaattaccgttccattggtgggactgctggtggggtattgtctggctacatgcctgaaactccccgttgctcagaggagaaccgtgtccattgaagtgggcgtccagaactccctgcttgctttggctatgttgcagctgagtttgaggaggctgcaggcagattacgcttcacaggctccctttattgtagcgctctccggcaccagcgaaatgctggccttggttattggccatttcatttacagtagtctgtttccggtaccatag

SEQ ID NO: 134758 - DNA, 657 bp, Artificial Sequence
  Description of Artificial Sequence: Synthetic coding sequence
atggtgttgatgcaggacaaggggtccagccaacaatggcccgggctcggcggggaagggggtggcaccgggcctctgtccatgctgagggcagccttgctactgatctctctgccatggggcgcccagggcaccgctagcacatcgctttccacagccggtggccacacggtgccgcccaccggtgggcgctacttgtctatcggagatggtagcgtaatggaattcgaatttcccgaagatagtgaaggaataatcgttatcagctcccagtaccccggacaggccaataggacggctcctggcccaatgttacgggtgacatccctcgatactgaagtgctaactattaagaatgtttctgccatcacctggggggggggggggggctttgttgtgtccattcattcagggctcgctggactggcacctctccacatccagctggtggacgcacatgaggccccgccgaccctgatagaagaacgaagggacttctgtataaaagtctctcccgcagaagatacgcccgctaccctctctgctgacttagctcatttcagcgaaaatccgattctgtacctgctcctgcccctgatttttgtgaataaatgtagcttcgggtgcaaggtggagttggaggtcctgaaagggtag

SEQ ID NO: 134759 - DNA, 1314 bp, Artificial Sequence
  Description of Artificial Sequence: Synthetic coding sequence
atggacggtaacgataatgtgaccctgctgttcgctcccctcctcagagacaattatacattagctccgaacgccagctccctgggaccgggaactgatctggctctggcacccgcatcttctgccgggcctggaccaggcctgtcacttggccctggaccctcattcgggttctctcctggccccacaccgactccagaaccaactacatcaggtctggcaggaggggctgcatcacatggaccgagtccgttcccgcggccgtgggcaccgcacgcgctgccattttgggacacaccccttaatcatggcctcaacgttttcgtgggagcggcactgtgcataactatgcttggactaggatgcacagtcgacgtgaaccatttcggtgcccatgttcgccgtccagttggcgctttgctggccgctctttgccagtttgggttactcccattactcgcgttcttgctggcactggcatttaaactggatgaggtggctgccgtggccgtcctgctctgtggttgctgccccgggggcaatttgagtaacctcatgagtctcctggttgacggagacatgaatctctccatcataatgacaatctcgagcaccttactcgcactggtattaatgcctttgtgcctgtggatttactcctgggcttggatcaatacccccatcgtccaactcttacccctgggaaccgtcactctgaccctctgtagcacattgattcctatcggtctgggtgtgttcataagatacaaatactctcgcgttgcagactatatcgttaaagttagcctctggtccctgcttgtgaccctggtggtgctcttcatcatgactggaactatgctcggtcccgagctcctggcgagtattcctgctgctgtttacgtgattgcgattttcatgccgctcgccggctacgcatctggctatggtcttgccacgctgttccatctgcccccaaactgtaagcgcactgtttgtctagagaccgggtcccagaatgtgcagctttgcacagccattttaaaactggctttcccgccacagttcataggatcaatgtacatgttcccactcttatacgcactctttcagtctgcagaagcaggtatcttcgtactcatctataagatgtatgggagcgagatgctgcataaacgtgatcccttagatgaggacgaagatacagatatttcttataaaaaacttaaggaagaggagatggctgatacctcatatggcactgtgaaagccgagaatattatcatgatggagaccgcccagacatccctgtag

SEQ ID NO: 134760 - DNA, 1134 bp, Artificial Sequence
  Description of Artificial Sequence: Synthetic coding sequence
atgagggctaattgctcaagttcctccgcatgccccgctaacagctcggaggaagaattacccgtcggactggaggtccacggtaacctggaactcgttttcacagtcgtgtcaacagtaatgatgggcctgctgatgttcagtttgggttgcagcgtcgagatcagaaagttatggtctcatattcggagaccctgggggatcgccgtagggctgctgtgtcagttcggcttgatgccatttacagcttatctgttagccatctctttcagccttaagcctgtgcaggccatcgcagttctgatcatgggatgttgtccaggcgggacaatcagtaatatctttaccttctgggtcgacggagacatggacctgtcgatcagcatgaccacctgcagcaccgtagcagcacttggaatgatgcccctgtgcatatatttgtacacctggagctggagcctgcaacagaatcttacaatcccataccaaaacataggcatcacacttgtttgcctgacgattcctgttgcatttggagtatatgtaaattaccggtggccgaaacagtccaaaataatattgaaaatcggcgcagttgtggggggggtactcctcctggttgttgcagtggccggcgtggtcttggcaaaagggagctggaatagtgatattaccctgttgaccatttcatttatcttcccactgatcggtcatgtgacggggtttctgctcgcacttttcacccaccagagctggcagagatgccgaactatttccctggaaacgggagcccaaaatattcagatgtgcatcaccatgctccagctgtcattcactgccgaacacctggtccaaatgttgtcctttcccttggcatacgggcttttccaacttattgacgggtttctgatcgtggccgcataccaaacttacaaacgccgtctcaagaataaacacgggaagaagaactctggttgcaccgaggtttgccatacccgtaaaagcaccagctcaagagagactaacgctttccttgaagtgaacgaagagggagccatcactccaggacccccgggccccatggattgtcaccgcgctttggaacctgtcggacatatcacatcgtgtgaatag

SEQ ID NO: 134761 - DNA, 2184 bp, Artificial Sequence
  Description of Artificial Sequence: Synthetic coding sequence
atgctgcgcatccctgtgcgaaaagctctggtcggtctcagtaaatctccaaagggttgcgtgaggaccaccgctaccgctgcttcgaatcttattgaagttttcgtggacggacagagcgtaatggtggagcccggcacaacagtgcttcaggcttgtgagaaggtcggtatgcagattcctaggttttgctaccacgaaaggctgagcgttgctgggaactgtcgtatgtgtttagtagaaatcgaaaaagcacctaaggtagtcgctgcctgcgccatgccagttatgaaaggatggaacatcctgacaaactcagaaaagtcgaaaaaggctcgtgaaggggtgatggaattccttctggctaaccacccattagactgccctatctgtgaccagggcggagagtgtgatctacaggatcaatccatgatgtttgggaacgatagatcacggttcctggagggtaagagagctgtggaagacaagaacataggtccactggtgaagactatcatgacccgctgtatccagtgtacgagatgtattcggtttgcctccgagatcgccggagtggatgacctcggtacaaccggacgcggaaatgacatgcaggtcggaacctacatcgagaagatgttcatgtcggaactgtcaggcaacatcattgatatttgtccagtgggcgcactaaccagcaagccctacgcatttactgcccgaccttgggagacacggaagaccgagagcatcgatgtcatggacgctgttggctctaacattgtcgtttcaaccagaactggagaagttatgagaattctcccacgcatgcacgaggacattaacgaggagtggatcagtgacaaaacccgcttcgcctacgacgggttgaagagacagagactgaccgaaccgatggtaagaaatgagaaaggactgctgacgtataccagctgggaagatgccctgtctcgggttgccggtatgctgcagtcctttcaaggcaaagacgtggcagctatcgctggaggcctggtcgatgcagaagcactcgtggctctgaaggatctattgaacagagtagacagcgatactctgtgcaccgaggaggtgttccctacagccggcgctggaacagatctccgctccaactacctgctcaacacaaccatcgctggcgtcgaggaggccgatgttgtcctgctggtcggaacgaatccgagattcgaggcacctctgttcaacgcgcgtatacggaagtcttggctgcataacgatctgaaagtggcactgattggcagtccagtggacctaacatacacgtatgaccacctaggcgacagcccaaaaatcctccaggatattgcgtccggctcccacccattcagccaagtgctcaaagaggcaaaaaaaccaatggtcgtcttgggctcatctgcgctgcaacggaacgacggcgccgctatattggctgcagtctcttctattgcccagaagatccggatgacctccggcgtgaccggcgactggaaagtcatgaatatcctccatcggatcgcctcccaggtcgccgccctcgaccttggatacaaaccaggcgttgaggccatcagaaaaaatcctcctaaagttctgttcctgttaggtgccgacgggggttgtataaccaggcaggatctacccaaagactgcttcatcatataccaaggccatcacggcgacgtgggcgcccccattgctgatgtgattttgcccggtgcagcttatacagagaagagtgccacatatgtaaatacggagggacgcgcccagcagactaaagtggctgtgactcctccaggactagctagggaagattggaagatcattcgggcactctctgaaattgctggtatgactcttccctatgacaccctggaccaagtaaggaacaggttggaagaagtgagccctaatctcgtccggtacgacgatatagaaggagccaactattttcagcaagcaaatgagctctccaaattagtaaaccagcagctcctggctgaccccctggtgccaccacagctgacgatcaaggatttctatatgactgactctatctccagagcctctcaaacgatggccaagtgtgtgaaagcagtcaccgagggtgcgcaggccgtggaggagccttccatctgctag

SEQ ID NO: 134762 - DNA, 492 bp, Artificial Sequence
  Description of Artificial Sequence: Synthetic coding sequence
atgaccggcgacaaaggaccacagcgtctctccgggtctagctatgggagtatatcttcccccaccagtcctacatcccctgggccccagcaagcgcccccaagagaaacatacctgtcggagaaaatccccatccccgacaccaaaccaggtacattctccctgaggaaactgtgggccttcacaggtccaggatttctgatgtcaatcgcatttctggaccccgggaacatcgaatcagatctccaggccggagcggtggcgggtttcaaactcctatgggtgttgctgtgggcaactgtgctcggtttgctgtgccagcggctagcggcacgcttgggagtcgttacaggcaaggatttgggcgaggtgtgccatctctattatcccaagagcgagtcacgttctgtcgcacagtccggggtacaatggtgtgacgtctccagcttacagcctttaccaccgcggtgtcctgccccctcgtcaggctag

SEQ ID NO: 134763 - DNA, 1299 bp, Artificial Sequence
  Description of Artificial Sequence: Synthetic coding sequence
atggtgcggtgtcagctgacagcaacatccacttcacaagtcccccggactgtcctgtggctgacaatagaattggctatagtgggaagtgacatgcaggaagtaatcggcacagccatagcattcaatctgctctctgctggacggattcctctttggggaggcgtactgataactattgtcgatacttttttcttcctgtttctggataactacggactgagaaagttggaggctttctttggactgttgattacgatcatggcgttgacgtttgggtacgaatacgtggtggcacgtccagaacagggcgccctgttacggggacttttcctgccatcctgcccgggctgcggacacccagagcttttacaggccgtaggtatcgtgggcgcaatcattatgcctcacaatatctatctgcatagcgcactggtaaaatccagagaaatagatagagcgagacgagctgacattcgtgaggccaacatgtatttcctcatcgaggctaccatcgcactgtcagtttccttcattatcaacctgtttgtcatggcagtgttcggtcaggccttctatcagaaaaccaatcaggcagcctttaacatatgcgccaatagttctctgcacgactatgcaaaaatcttccctatgaataatgcaacagtagcagtggatatctaccagggtggcgtcatcctgggttgtctgtttggacccgcagctctgtatatctgggccatcgggctgttggccgccggtcagtctagcacaatgactggcacgtacgcgggccagttcgtcatggagggatttttgcggctgagatggagtaggtttgctcgagtactgttgacaaggagctgcgcgatactgcctaccgtcctcgtcgccgttttccgtgatttgagagacttgagcggcttaaacgacttgctgaacgtgctgcagtcactgctgctcccttttgcagtgctccccatcctgacttttacaagcatgccgacgttaatgcaggagttcgcaaatgggctacttaacaaagtagtaacatcgtccatcatggttctcgtttgcgccatcaatctctattttgtggtgtcctaccttccttctttgccacaccccgcatacttcgggctggcggctctgctggcggctgcttacctaggcttaagcacatatttggtgtggacttgctgcctggctcacggggcgacttttttagcacattcctctcaccaccactttctgtacggcctccttgaagaggaccagaagggtgaaacatccggttag

SEQ ID NO: 134764 - DNA, 3351 bp, Artificial Sequence
  Description of Artificial Sequence: Synthetic coding sequence
atgctgaataatctgaccgactgcgaagacggagatgggggtgcaaatccaggagatgggaaccccaaggaatctagtcctttcatcaactctaccgatactgaaaaggggaaagaatacgatggcaaaaatatggcactattcgaggaagagatggacacatcccctatggtgagctccctgcttagcggactcgccaactacaccaatttgccccagggaagccgggagcacgaagaggctgaaaataatgagggcggcaaaaagaagccagttcaggcccctagaatgggcacctttatgggggtgtatctgccttgtcttcagaatatcttcggcgtaatcctgtttctcagactgacttgggttgtagggatcgctggaatcatggaatccttttgtatggtgttcatttgctgtagctgcacaatgctgactgccatctctatgtccgcgatagccacgaatggcgtcgtgccggctgggggctcctattatatgatctctaggtcactcggtcctgagtttggcggagcggttgggctgtgcttctacttgggcaccactttcgccggagccatgtatatccttggcaccatcgagattctgctggcttatcttttcccagctatggccattttcaaagcagaggatgctagcggagaagcggccgccatgcttaataatatgcgcgtgtacggcacttgcgttcttacgtgcatggctaccgtcgtattcgtgggcgtgaaatacgtgaacaagttcgccttagtgttcctggggtgcgtcatcctttcgatccttgctatctatgctggagtcattaaaagcgccttcgacccacccaacttcccgatttgcctccttgggaatcggaccctgtctcgccacggcttcgatgtctgcgctaagctggcctgggaagggaacgaaaccgtgacaactcgcctgtgggggcttttctgctcctcaagatttttgaacgcgacttgtgacgagtattttactcgcaataacgtgacagagatccaggggatccccggtgccgcctcaggactgattaaagagaacctgtggtcatcttacttgaccaaaggagtgattgtcgagagaagcggtatgacatcagtgggactggccgatggcacccccattgacatggaccacccatatgtgtttagcgacatgaccagctactttaccctcctcgtcggcatatactttccttctgtgaccgggattatggctggcagtaacagatctggagacttacgggacgcccagaagtctatcccaaccggaacaatcttggcgatcgcgaccaccagcgctgtctatatttcttctgtcgttctgttcggtgcctgtattgagggcgtggtgctcagagacaaattcggagaggctgtgaacgggaaccttgtggttggaacattggcgtggccatccccctgggtgatcgtaatagggagcttcttctctacatgcggtgcgggtctacagagccttacaggggccccgcgactgctccaagctatcagtagggacgggattgttcccttcctgcaggtgtttgggcacggcaaggccaatggtgagcccacatgggccctgctcctgacagcctgtatctgcgagataggaatattgattgcctcgctggatgaagtcgcaccaatactgagtatgttcttcctaatgtgctacatgtttgtgaacctggcctgtgccgtgcaaactttgttacggacaccgaattggcgtccccggtttcggtattatcactggaccttgtctttcttgggtatgagcctctgtttagcactcatgtttatttgctcctggtactatgctctggtggctatgctgattgctggcctgatatacaaatatatcgagtacagaggagctgaaaaggagtggggtgatgggatccgaggcctgagcctgtctgccgctagatacgccctgctacggcttgaggagggacctcctcatacaaagaattggcgcccgcaactccttgtattggtgagagtggatcaggatcagaacgtagttcatccacagttgctgagtctaaccagccagttaaaggccggcaagggactcacaattgtaggaagtgtcttggaaggcacttttctcgaaaaccacccacaagcccagcgggccgaagagagcattagaagacttatggaagcagagaaggtgaaggggttctgtcaagtggtgatctccagcaacttgagggacggcgtgtctcaccttatacagtccggggggttggggggcttacaacataacaccgtgctcgtgggatggccaagaaactggaggcaaaaggaggatcatcagacttggaggaatttcatcgaactcgtcagggaaacaaccgcgggtcatctcgcgctgctggtcaccaagaatgtgagtatgttccctggaaacccggaacggtttagcgaaggttcaattgacgtgtggtggattgtccatgacggggggatgctcatgctgttgccattcttattgcgccatcataaagtatggcgtaaatgtaaaatgaggatatttaccgtcgcccaaatggacgataattccatccagatgaagaaagatctgacgacattcctctatcatcttcgcattacggcggaggtggaagtcgtcgagatgcacgagtcagatattagcgcttacacatacgagaaaacactggtcatggagcagaggagccagattctgaaacagatgcacttgactaaaaatgaacgcgagcgtgaaatccagtcaattactgacgagtcccgagggtccatcaggcgcaaaaatccagccaacaccaggttaaggctaaatgtccccgaggagactgctggggactccgaagagaaaccagaggaggaagttcaactcatccatgatcagtctgccccttcctgcccatctagcagccccagccccggggaggaaccggaaggagaaggagagacagaccctgaaaaagttcatttaacttggacgaaggacaaatcagttgcggagaaaaacaaagggccatctcccgtatcttccgaaggaatcaaagatttcttctccatgaagccagaatgggagaacctcaaccaatctaatgtgagacggatgcacacagctgttcgcctgaacgaggtcattgtgaagaaaagccgagatgcaaagttggttctgctgaacatgccaggacctcctcgaaataggaatggcgacgaaaactatatggaattcttagaggtcctgaccgagcatctggatagggtgatgctagttaggggaggggggcgcgaggttattaccatatatagctag

SEQ ID NO: 134765 - DNA, 858 bp, Artificial Sequence
  Description of Artificial Sequence: Synthetic coding sequence
atgctcaataacctgactgactgcgaggatggcgatggaggggccaaccccggcgacgggaaccccaaggagagctcgcccttcatcaatagcactgatacagaaaagggaaaggaatacgatgggaaaaatatggccctgttcgaggaagagatggacactagccccatggtcagcagcttactctcagggttggccaactacactaacctcccgcaaggatctagggagcatgaagaagcagaaaacaacgaagggggcaaaaaaaagccagtgcaggctcctcgcatgggaacattcatgggggtctatctcccctgcctgcagaacatcttcggcgtgatcctttttctcaggcttacttgggtggtcggcatcgccgggattatggaatccttctgtatggtttttatctgctgcagctgcaccatgctcactgcgatttcaatgtccgcgattgcgaccaatggagtggtcccggcaggagggtcctactatatgatatcgcgatcacttggcccagagttcggcggcgcggtgggcctgtgtttttacttggggacgaccttcgcaggtgctatgtacatactggggacaatcgagattcttttggcgtaccttttcccagctatggcgatctttaaagccgaagatgccagcggtgaggcagccgccatgcttaacaacatgagagtgtacggaacatgtgttttgacatgcatggccactgttgtgttcgtcggggtgaaatacgtcaacaaatttgccctggtatttttaggatgtgtgatccttagcattctggcgatttacgccggcgtaataaagagcgcatttgatcctcccaattttccctag

SEQ ID NO: 134766 - DNA, 3420 bp, Artificial Sequence
  Description of Artificial Sequence: Synthetic coding sequence
atgagccgccgttttacggtgacctcattaccccccgcaggcccggcgcgctcacccgatccagagagccgccggcactccgtggcggatccaagacacctgccgggcgaagacgtaaaaggcgacgggaacccaaaagaatccagtccctttattaacagcacggatactgaaaaaggaaaggaatatgacgggaagaacatggccctgtttgaagaagagatggatacttcaccaatggtgtcttctctgctttcaggactggcgaactataccaatctgccacagggttctcgcgagcacgaggaagccgagaacaatgagggcgggaagaagaaacccgtgcaggcaccaagaatgggcacttttatgggagtgtaccttccatgcctgcaaaatatattcggtgtcatcttattcctgagattgacttgggtggtaggtatcgcagggataatggaaagcttctgcatggtgttcatttgctgcagctgtaccatgctgactgccatttccatgagtgctatcgccacaaacggcgttgtgcccgccggtggttcctactatatgattagccggtccctgggtccagagtttgggggggctgtgggcctgtgtttctacctaggaaccacctttgctggcgcaatgtacatactgggaaccattgaaattcttctggcttatttatttcctgctatggccatctttaaagctgaagatgcctccggggaagccgctgctatgctgaataacatgcgagtctacggaacctgtgtgttgacttgcatggctactgtggtgtttgtgggcgtaaaatatgtaaacaaattcgcgctggtcttccttggctgtgtcatactctccattttagccatctacgccggggtgatcaagtccgccttcgatcctcccaactttccaatctgtctgctgggtaataggacattatctagacacggatttgatgtctgcgcgaagctggcgtgggaaggcaatgagaccgtcaccacgcgtctgtgggggttgttctgcagtagtcggtttttgaacgctacatgcgacgagtattttacacgcaacaacgtcacagaaatacaaggaatacctggagctgcgtcgggactaataaaggagaacctctggagcagttacttgacaaaaggggtgatcgtggagcgatccggaatgacgtccgtgggtctcgcagatgggacgcccatcgacatggatcatccgtacgttttctcagacatgacctcttactttacactgctggtcggcatctatttcccttcagttaccggaatcatggccggatccaatagaagcggagacctgagggacgcccaaaaaagtatccccacgggaacgatcctggccatcgcgactacatctgctgtgtatatttcaagcgtggtgctctttggcgcatgcatcgagggggtggtattgcgagacaaatttggcgaagctgtgaacggtaatctggtcgtgggcacattggcctggccatctccttgggttattgttatcgggtcttttttttctacctgtggggccggactccagtctctgacaggcgcacctcggctcctccaggccatctcccgggacggcattgtcccattcctgcaggtgtttgggcatgggaaagctaacggcgagccaacctgggcccttctgctgaccgcctgcatttgtgagattggtattctaatagctagtttggatgaagttgccccaatcctttctatgttttttttgatgtgttatatgtttgtaaatttggcctgcgccgtgcagaccttgctccgaacgccgaattggcggcctcgctttagatattatcactggactctgagcttccttggcatgtcgctgtgtctagcattgatgtttatttgttcctggtattacgcattggtcgccatgctgatcgcggggttgatatacaaatatatcgaatatcgtggtgccgagaaagaatggggtgacgggatacgggggctatccctgtcagccgcccgctatgccttgctccgccttgaagagggaccccctcacactaagaattggcgtccacagctgttggtccttgtaagagtcgaccaggaccagaacgtagtgcacccccagctgctcagtctgacctcccagctcaaggccggaaagggtcttacaatagttggaagcgtcctggagggaacatttttagagaaccaccctcaagcacagcgcgctgaggagtcaattcgtcgcttgatggaggctgagaaagtaaagggtttttgccaagttgtcatttctagtaatctacgggatggcgtctcacatctgatacagagtggcggtctggggggactacagcacaacacagtgctggtgggctggcccagaaactggcggcagaaagaagaccatcaaacttggcggaacttcattgaacttgtgcgggagaccaccgccggtcacctggccctacttgtcactaaaaatgtttcaatgtttccaggcaatcccgagagattcagtgaaggcagcattgacgtctggtggatcgttcacgacggcggcatgctgatgttgctgccctttctcttgcgccatcacaaagtttggaggaagtgtaaaatgagaatctttaccgtggcgcaaatggacgacaactctattcagatgaagaaggatctgaccacttttctctatcatttgagaatcacagcagaagtcgaggttgttgaaatgcacgaatctgacattagcgcttatacttatgagaagacactggtgatggaacagagatcccagatattgaaacagatgcatctgacaaagaacgaacgcgagagggagatccaaagcataacagacgagtctaggggatctatcaggcggaaaaaccctgctaatactaggctgagattgaatgtcccagaggagactgctggagactctgaagagaagcctgaagaagaggttcaactcattcatgatcagtcagcccctagttgcccttctagctccccatcaccaggtgaggagccagaaggggagggggaaacagatcctgagaaagtccacttgacctggacgaaggacaagtccgtggctgagaaaaacaagggaccatcacccgtgagtagcgaaggaataaaagactttttttcgatgaaacctgagtgggagaatctgaatcagtcaaacgttagaaggatgcataccgccgtgagactgaacgaggttatcgtgaagaagtcccgcgatgctaagctagtcctcctgaatatgcccggccctccaaggaacagaaatggtgatgagaattacatggagtttctagaggtgctcaccgagcacttggaccgagtgatgttggtacgtgggggtggacgggaagtgatcaccatttactcatag

SEQ ID NO: 134767 - DNA, 561 bp, Artificial Sequence
  Description of Artificial Sequence: Synthetic coding sequence
atgctcaacaatctgaccgattgcgaggatggagacgggggcgctaatccaggtgacggtaacccaaaggagagttctccctttataaactccactgacaccgaaaagggaaaagaatacgatggaaagaacatggcattgttcgaggaagagatggatacatcacccatggtgtcctccctgctgtcggggctcgcaaactacaccaacctgccacaggggtcgcgtgaacacgaggaagcggaaaacaatgagggcggaaagaagaaacccgtccaggctccccggatgggaacattcatgggggtctaccttccgtgccttcagaatatcttcggcgttatcctgttcctgaggctaacctgggtggtgggaattgcaggaataatggaaagcttctgcatggtattcatttgttgcagctgtaccatgctgactgcaatctcaatgtccgctatcgccactaacggggtagtgcccgccggcggaagctactacatgatttcgcgtagtctggccatggcaagacctatggagagtaggccaggtccctgttcctag

SEQ ID NO: 134768 - DNA, 3258 bp, Artificial Sequence
  Description of Artificial Sequence: Synthetic coding sequence
atgcctcacttcactgtggtgccggtggacggtccaaggcgcggagattacgacaaccttgaaggactctcctgggtggattacggagagagagccgagctggatgattctgatggccatggaaaccaccgcgaaagctccccattcctctcccccttagaggcatcacgtgggattgactattatgatagaaacctggcccttttcgaggaagaactggacattaggccaaaggtgtctagcctgctgggaaagctggtgtcatataccaacctaacacaaggcgctaaggagcacgaggaagcagagagtggtgagggtactcggcgcagggccgcggaggccccgagcatgggaaccctcatgggcgtctacctcccctgcttgcagaatatatttggcgtaatcctgttcttgcggctgacatggatggtgggcaccgccggagtgctccaggcgttgttgatagtactcatttgctgctgttgtactttgctcacggccatcagcatgtccgctattgccacaaatggagtggtgccagccggaggatcctatttcatgattagccgctctctcggtcctgagttcggcggagctgttggattgtgcttctacctgggaaccacattcgccgccgcaatgtatatcctaggcgcaatcgagatactacttacctatattgcgcccccggctgcaatcttctatccctccggggctcacgatacatctaatgccactctcaataacatgcgggtgtatggaacaatattcctgaccttcatgacgctagtagtgtttgtaggcgttaagtacgtaaacaaattcgcttcattattcctggcatgtgtaatcatttctatcttgagcatttacgccggggggattaaaagcatctttgacccacctgtgttccccgtctgcatgttgggaaacagaactctgtctcgcgaccagttcgatatttgtgctaagactgccgtcgtcgataatgaaacagtagccacacagctgtggtctttcttctgccacagtcctaatttaactacagactcttgcgacccttatttcatgctcaacaacgtaaccgaaattccaggaatccccggagccgcagcaggagtgctgcaggagaatttatggtcagcatatctggaaaaaggcgacattgttgagaagcacgggctcccatctgctgatgcaccctctctaaaggaatccctgccgctgtatgtggttgccgatatagccacctccttcaccgtgctggttgggatcttctttccaagcgtgacaggcatcatggccggctccaataggtccggggacctgagagatgctcagaaatctattcctgttggaacaatcctcgcaataattactacatcattggtctatttctcatccgtggtcttgttcggcgcctgcatcgagggcgtcgtgctacgggataaatatggcgacggcgttagtcggaacctggtcgtgggcacactggcttggccctcgccctgggtcatagttattggctctttttttagtacttgcggtgccgggttgcaatctctgaccggcgcgccccggctgctacaagcaattgccaaggataacattatcccctttctcagggtgtttgggcacgggaaggttaacggtgagcccacctgggcccttctcttaacagccctcatagcggagctggggatcttaattgccagcctcgacatggtcgctccaatactgtctatgttctttctgatgtgttatctgtttgttaacttagcttgtgctgtccagacgcttctccgcacaccaaattggcggccacggttcaaatactaccattgggcactgagcttcttaggcatgtctctttgcctcgcacttatgttcgtctcttcatggtactacgccttagttgcaatgctgatcgctggcatgatatataagtatatcgagtatcaaggagctgaaaaagagtggggagacggaatcaggggactgagcctttcagccgcaagatacgcactgctgagactagaggagggccctccccacacaaaaaactggaggccacagctcctggttctgctgaagctggacgaggacctccatgtcaagtaccccaggctgctgacattcgcctcacagctcaaagcagggaaagggctcactatcgtgggatcagtgatccagggttccttcctggagtcttacggcgaggcccaggcggcagaacaaactatcaaaaacatgatggaaatcgagaaggtcaaaggattctgtcaggtcgtggtcgcctctaaagtcagagaaggactggctcaccttatacagagctgtggcctgggtggaatgcgccataacagcgtggttctgggctggccgtacggttggaggcaaagcgaggatccacgggcatggaagacttttatagacaccgtcaggtgcacgaccgcagctcatctggcactcctcgtcccaaagaacatcgcattttatcccagtaatcacgagcgctatttagaaggccacattgacgtctggtggatagtgcacgacggcggcatgcttatgctccttcccttcctgctgaggcagcacaaggtctggaggaagtgccgcatgcgtattttcacagttgcccagatggatgataactctatacaaatgaagaaagacctggccgtgtttctgtaccacttacgcctggaagctgaagtggaagtggtcgaaatgcataactccgacatatcagcctatacatacgaaaggaccctcatgatggagcaacgtagccaaatgctgcgacagatgaggctgactaagaccgagcgggagcgggaggctcagctggtgaaggataggcatagcgctctgaggctggagagcctctattccgatgaagaggatgaaagtgcagtgggggcagacaagatccagatgacatggaccagggataagtacatgacagagacttgggacccaagccacgccccagacaactttcgagagctggtccacatcaagcctgatcagagtaatgtccggagaatgcacacagcagttaaactgaacgaagtgattgtaactcggagccacgatgcccggttggtgttacttaacatgccaggcccgcctcgcaacagtgagggcgacgagaattacatggaattcctggaggtgctgacagagggacttgaacgggtgcttctggtacgcggcggcgggcgcgaggtgatcactatttactcttag

SEQ ID NO: 134769 - DNA, 2343 bp, Artificial Sequence
  Description of Artificial Sequence: Synthetic coding sequence
atgccacattttacagtggttcctgtcgatggacctcgtagaggggattatgataatctagaaggtctcagttgggtggattacggggagagggctgaacttgatgacagcgatgggcatggcaatcacagagagtcttcccccttcctgtcccctcttgaagcttctagagggatagattattacgacagaaacctcgccctcttcgaagaggagctagacataagacctaaagtcagttccctcttgggcaaacttgtctcctacacaaatctgacccaaggggccaaggagcatgaggaggctgaaagcggggagggcacaagacggcgcgccgccgaagccccctccatgggcaccctaatgggggtgtaccttccatgccttcagaacatatttggtgtgattttatttctacgcttaacctggatggtcgggaccgctggcgttctccaggccctactgatcgtcctcatttgttgttgttgtaccctgcttaccgccatctccatgtcagcaatcgcaaccaatggggtggtccccgcgggcggctcctacttcatgatatcgagatctctgggccccgagttcggtggggcagtcgggctgtgcttttatctcggaaccacatttgccgccgccatgtatatcctcggagcaattgagatcctgctaacttatatcgcaccccctgctgcaatcttctacccatccggggcacacgacacctctaacgcgaccctgaacaatatgcgggtgtacgggacaatcttcctcacctttatgaccttggtcgtcttcgtcggcgtgaagtacgtgaataagtttgcttcgcttttcttggcatgtgttatcattagcattctgagtatatacgccggcggaattaagagtatctttgatcctcctgtgttccctgtttgtatgctgggaaacagaaccctgagtagagaccagtttgacatttgcgccaagacggctgtcgtggataatgaaaccgtcgccacccagctgtggagctttttctgtcactcaccaaacctgacaacagactcttgcgatccgtacttcatgctgaacaacgtgacagaaattccgggcatcccaggagcagccgccggggtgcttcaagaaaatctctggagtgcttatttggagaaaggagacattgtcgagaagcatggactgcccagtgcagatgccccatcactgaaggaaagtctgcctttgtacgtggtggctgacatcgccacttcctttacagtcttagtgggtattttttttccaagcgttaccggcatcatggcaggttctaaccgctccggagatttgcgggacgcccagaaatccattcccgttggcaccatcctcgccatcataactacgagcctggtgtatttttcctcagtggtcctgtttggtgcctgtattgagggagttgttttgcgggataaatacggcgacggcgtcagccgcaatctggtcgtagggactctggcctggccttcgccttgggtgatagttatcgggtcctttttttctacctgtggcgccggcctacagagcttaacaggcgcccccaggcttctacaagccattgcaaaagataatattattccctttctcagagtgttcggacacggcaaagtcaatggtgaacccacatgggccctcctgcttacagccctgatcgcggaactgggaatccttatagcctcgctggacatggtggctcctatcttgtccatgttctttttaatgtgctatcttttcgtcaacctggcgtgtgccgtacagacccttctaaggactccgaattggcggcctcggttcaagtattaccattgggcactttccttcctcggaatgtctctctgcctcgctcttatgtttgtttcaagttggtattacgctctggttgcaatgctcatcgcgggtatgatctataagtatatcgagtaccaaggtgctgaaaaggagtggggagacgggatacggggcctttctctgtcggccgcgcgatacgctctactgcgtttggaggaaggccccccccacacaaaaaattggcggccgcaactgctcgtcctgttgaagctggatgaggatctgcacgttaaatatcccaggttgctgacctttgcctctcagctgaaagccggaaaggggttaaccattgtcggctctgttatccagggcagttttctcgagtcttatggagaagctcaagctgctgaacagaccccatgtgctgcattgcgattgcccacctggccttgctcttgtcctcgaacaagtccaagcaccccggccactacaagtgccacttggcgcgccacctag

SEQ ID NO: 134770 - DNA, 3264 bp, Artificial Sequence
  Description of Artificial Sequence: Synthetic coding sequence
atgcgtgccgggggcgcctgccggccgggtgctgcgggcactgctgccgggaccgcagctggaggttgggacgggggctgtgggggtgcagagcctgcaaggtgtttgaccagcccttggtgccagtggacaggccgtggtgcggccacaatgacaaccagcaggggatcggttggttggactacaggaagcgcaccgagttggatgacacgaactgaggagctggacattcggcctaaagtgagtagcctgctggggaaactggtctcgtataccaatcttacccaaggagcgaaagagcatgaggaggccgaaagtggggaagggacaaggaggagggccgccgaggctccgagcatgggcactctgatgggggtctacctcccatgtctgcagaatatctttggagttattctctttctacgcttaacctggatggtcgggacagccggagttctgcaggcattgttaatagtgctgatatgctgttgttgtaccttgctgactgccattagtatgagtgctatcgctacaaatggcgtggtgccggccggaggctcatattttatgattagcagaagtctgggacccgaatttggaggcgcggttgggctttgcttttacctcgggactacgttcgccgccgccatgtacatacttggagctatagagatcctgttaacttacattgcgccccccgccgctattttctacccctcaggagcccatgacaccagtaacgccaccttgaataacatgcgggtgtacgggaccatcttcctgaccttcatgactctcgttgtctttgtgggagttaagtacgtgaataagttcgcttcactgtttctggcgtgcgtgatcataagcatcctgtccatttatgccggaggcatcaaaagcatcttcgatcctccagtctttccggtctgcatgttggggaaccgtaccctgagtcgagaccagtttgacatatgcgcgaagaccgcagttgtggacaacgagactgtggcaacacagctctggtctttcttctgccactcaccgaacctaacgacagatagctgcgacccatatttcatgcttaataatgtgaccgaaattcccggcatccccggagccgctgccggggtgctgcaggaaaacctgtggtcagcgtatctcgagaaaggtgacattgtggaaaagcatgggcttcctagcgccgatgcaccgagtttgaaagagagcttaccactttacgtggtggccgacatcgctacatcatttactgttcttgtcggcatttttttcccttcggtaaccggtatcatggctgggagcaatagatctggagatctgagggacgctcaaaagtcaattccagtcggcacaatcctggcaatcataacgacttccctggtgtatttctcttccgtggtgctcttcggtgcatgtatcgaaggcgtggtgttacgagataagtatggcgacggggtatcgcgaaacctggtggttgggacactcgcgtggccctctccctgggtcattgtgatcggtagttttttttcaacctgcggcgcaggcctgcagtcattgacaggggctccaagattactccaggccattgctaaggacaatataattccttttcttagagtattcggccacggaaaggtgaacggcgaacctacatgggccttactcctgactgcactaatcgcagaactcggaatcctcattgcatctctagacatggtggctccaattctgagcatgttctttctgatgtgttatctattcgtgaacctggcttgtgccgtccagaccctgctaaggactccaaactggcgaccgcggtttaaatactaccactgggccctgtcctttttaggtatgtccctctgcctggcactgatgtttgtttcttcatggtactatgcacttgtggctatgctaattgccgggatgatctacaagtacattgagtaccagggcgcagaaaaggagtggggggacggaatcaggggcctgagcctttccgctgctcgctacgcactgctacggctggaagagggtcccccacacacaaaaaactggaggccccagctgttagtgctgctgaaactggatgaggatctgcacgttaagtatcccagactgctgacgttcgcttctcagcttaaggccggcaagggattaacaatcgtcggctccgtgattcaggggtcatttcttgaaagctatggggaagctcaagccgcagagcagaccatcaagaacatgatggaaatcgagaaagtcaaggggttctgtcaggtggtcgttgcttccaaggtcagggaaggactcgcccacctgatccaaagttgtggcttgggcggtatgcggcacaactccgtggtactcggctggccatacggatggagacaaagcgaagaccctagagcttggaagacgtttattgacacggttcggtgcactaccgccgcccacctggctctcctagtacctaaaaacattgccttctacccgtctaaccacgaaagatacctggaaggtcatatcgatgtctggtggatagtccatgacggaggaatgctgatgctgctgcctttcctgttacggcagcacaaagtgtggcgcaaatgtcgcatgcggatattcactgtggcccagatggacgacaatagtattcagatgaagaaggacctcgctgtgtttctttaccacctgagactggaagctgaggtggaagtagttgagatgcacaacagcgacatttccgcctacacatatgaaagaacactgatgatggaacaacgctcacagatgctccgccagatgagacttacaaaaaccgaacgtgaacgggaagcccaattggtaaaagacagacactctgctctgcgtctggagtcactctattctgacgaggaggatgagagcgcagtgggggccgacaaaatccaaatgacctggacccgcgacaaatacatgactgagacgtgggatcccagtcacgcacccgacaatttccgagaactagtgcatattaagcccgatcagagcaacgtgcgacgcatgcacaccgcagtgaagctgaacgaggtgatcgtgacccgctcccacgatgctcgcttagtgctgctcaacatgcctgggccgccacgcaattccgagggtgatgaaaactacatggaatttctggaggtgcttacagagggcctggaacgagtgttactggtccggggaggcgggcgagaagtcattacaatctatagttag

SEQ ID NO: 134771 - DNA, 3240 bp, Artificial Sequence
  Description of Artificial Sequence: Synthetic coding sequence
atggccgccgaaggggctgtgtgcggcttcgtgtatttagaaggcactgcttgggccgtccctgaagatacggagcctcttgcttcctgcaccttagggcatgggaatcaccgcgagtctagcccattcctatcccctctggaagcctcccgaggaattgactattacgatcgcaatctggctctcttcgaggaggagctcgacatacgccccaaggtgtcctcccttcttggcaaactagttagctacacaaatcttactcagggtgctaaggaacacgaagaggccgagtcaggagagggcacacgccgcagggcagctgaggccccgtcaatggggacactcatgggcgtatatctcccttgtctgcagaatatcttcggagttatcttgtttctgcgcctaacttggatggtaggcactgctggcgtcctccaggccctcctaatcgttctaatttgctgctgctgcactctgttgaccgcgatctcaatgtccgctattgccactaacggagtggtacccgctggaggcagctactttatgatcagccgctccctgggcccagagttcgggggcgcggttggactgtgcttttatctgggcacgacattcgccgctgcgatgtatattttgggcgccatagagatcctgctgacatacatcgcaccccccgctgcaattttttacccctcgggagcgcacgacacttctaacgccaccctgaataacatgcgggtctacggaactatctttttgacttttatgactctggtagtgttcgtgggagtcaaatatgttaataaattcgcctccctctttcttgcctgtgtcatcatatcaatactctctatatatgcaggtgggataaaatcaatattcgacccgcccgtttttccagtttgtatgcttggcaacaggacattgtcccgggatcagtttgacatttgtgccaagactgccgtcgtcgacaatgaaaccgtcgccacccagctgtggagcttcttttgtcactctcccaacctcactaccgattcatgtgacccctactttatgcttaataacgtgaccgagattccgggcattcctggggccgctgccggagtgctccaggagaacctctggagcgcatatctggagaagggtgatatcgtcgagaaacacggtcttccttctgcagatgcccctagtctgaaggaaagtctcccgctttacgttgtggccgatatcgccacgagcttcacagtattggtcggaatcttctttccatctgtcacaggaataatggcagggagtaataggtccggcgatttgagggatgcccaaaagtctatacccgtgggcactattctggcaattattaccacgagccttgtctacttcagctcggtggtgctatttggcgcctgtatcgagggcgtggtattaagagacaagtatggggacggtgtaagcagaaaccttgtggttggaaccctggcatggccttcaccttgggtgatcgtgatcggatccttttttagtacctgcggtgctggtctgcagtctctcacaggtgctccgcggctactgcaagctatcgctaaagacaatatcattcctttcttaagagtgttcggtcacggcaaagtgaatggcgagcccacatgggcactgctgctcactgccttgatcgcagagctcggaattttaatcgcttcacttgacatggttgcgccaatcctgagtatgttctttcttatgtgttatctgttcgtcaacttagcctgtgcagtgcaaacactgttgaggacccccaactggaggccccggttcaaatactatcactgggcccttagcttcttaggcatgtctttgtgcctggccctgatgtttgtttcaagctggtattacgcccttgtggcgatgctcatcgccggcatgatttataaatatatcgagtaccaaggggcagaaaaagaatggggagatggcatacgtggcctgagcctgtccgcagctaggtatgcgctgttaagactggaggagggccctccacacaccaagaattggcgcccccagctgctcgtactcctgaaactggacgaagatctgcatgtgaagtaccctagactgctgaccttcgcgtcccaactaaaggccgggaagggcctgactatcgtggggtccgtcattcaaggcagctttcttgaatcttacggcgaggcacaggccgccgaacagaccattaagaacatgatggaaatagaaaaagtcaaggggttctgtcaagttgtggtggcaagtaaggtacgggaggggttggcccatctcatacagtcttgtggccttggtggaatgcgtcataacagcgtagttctgggctggccttatggctggcggcagtcggaggatccgcgcgcctggaaaacatttattgatactgtacgttgtaccacagcagcacacttagcccttctagtccctaaaaatatcgctttttaccccagcaaccatgaaagatacctggagggccatatcgatgtgtggtggattgtgcacgacggaggaatgctgatgctgctgcccttcctgctaagacagcataaggtgtggagaaaatgtagaatgcgcattttcactgttgcacagatggacgataattcaattcagatgaagaaggatctggctgtattcctgtatcacctgcggctcgaagctgaggtagaggtcgtagaaatgcacaactctgacatcagtgcatatacttacgagagaacattgatgatggagcagcggagtcagatgcttcgacagatgcggctgaccaaaacagagcgcgagcgggaagcacaacttgtcaaggaccggcactcagccctaaggctggaatcactctactctgacgaagaagacgaatctgccgtgggagccgataagatccagatgacctggactagggataagtacatgactgaaacttgggatccttcccatgctccggacaactttagagaactggttcacattaaaccagaccagagcaacgtgcgacggatgcatacggcagtgaagctgaatgaagttatagtgaccagatcccacgatgcccggctggtattgctgaatatgcctggtccccccaggaattccgaaggtgacgagaattacatggaattcttagaggttctcaccgagggcctggaaagagtcctacttgtgcggggcgggggccgtgaagtaataactatctattcttag

SEQ ID NO: 134772 - DNA, 3165 bp, Artificial Sequence
  Description of Artificial Sequence: Synthetic coding sequence
atgggagacactctctcaccaggacacggtaaccaccgagagtcctctcctttcttgagccctctggaagctagtcggggcattgattattacgatagaaatctggcactttttgaggaggagctcgatattcggcctaaggtgtcgtctctcctcggtaagttagtgtcctatacaaatttaactcaaggagcaaaggaacacgaagaggcggagtctggcgaaggcactcgacgcagagctgcagaggcaccgtcaatgggcaccctcatgggggtatatctgccctgtcttcagaacatattcggggtcatactgtttctgaggctcacctggatggtggggaccgccggggtgctgcaggcgcttcttatcgttctaatatgttgctgctgcacactcctgaccgctatttcaatgtcagccatcgccacgaatggagtcgtaccagctggcggctcctacttcatgatttcgcgaagcttgggccctgagttcggaggtgcagtgggtctttgcttctatttagggactacgttcgcggccgcaatgtacattctgggggccatcgaaatactgctgacatacattgctcccccggccgccatcttttacccatctggagctcacgataccagcaacgccaccttgaataatatgagagtgtacggcacaattttcctgactttcatgactttggttgtgttcgtaggggtgaagtacgtcaataagttcgcttctcttttcctagcctgtgttataatttcgatcctgtctatttatgcaggagggatcaagagcatcttcgacccacctgtgttcccagtatgcatgctggggaacagaacgctgtctagagaccagttcgacatctgcgctaagaccgctgtagtggacaatgaaactgtggctacccagctttggtcgtttttttgtcacagccccaatctgacgaccgacagctgtgatccgtactttatgttaaataacgtgacagaaatccccggaatccccggggctgctgcgggagtcctgcaggaaaacttgtggagtgcttacctggaaaagggtgacatcgttgagaaacatggacttccaagcgctgacgccccatctctaaaggaaagccttccgctgtatgtggtggctgatattgctacgtccttcacggtgttggttgggatcttctttcccagtgtgactggcataatggctggctccaacagatcaggcgacttaagagatgcgcaaaaatcaattccagttggcaccatactggccatcattacaacaagcttggtgtatttctcatctgtggtactgttcggggcctgtatcgagggagttgtcttgcgcgataagtatggagatggcgtgtcgagaaacttggtggttggtacgcttgcttggccgtcaccttgggtgatcgtcattgggtcctttttcagtacttgcggtgccggtctgcagtcattgactggcgccccacgcttgctgcaagctatcgccaaagacaatatcattccgtttctccgggtgttcggccatggaaaggtcaatggggagcccacctgggccttgttactgaccgccctcattgctgaactcggcatactcatcgccagccttgatatggtagccccaatactatctatgtttttcctgatgtgctatctttttgttaacctcgcctgcgccgtccagaccctcctgaggacacctaactggaggccgcgcttcaaatactaccactgggctctgagctttctgggcatgtccttgtgcctcgccctaatgttcgtttcgagctggtactacgctctggtggcaatgctgattgctggaatgatctacaagtatattgagtaccagggcgcggaaaaggagtggggcgatgggatacgcggactctctctctcagccgccaggtatgcattgctgagactggaggaaggccctccacataccaaaaattggagaccacagctgctggtgctcctcaaactggacgaggacttacatgttaagtatccccgcttgctcaccttcgcctcccaactaaaggcaggtaagggcttgacaattgtaggatctgtgatacaaggttcatttctcgagagttatggcgaggctcaggcagcagaacagaccattaagaacatgatggagatcgagaaagtgaaaggcttctgtcaggtcgtcgtagcgagcaaggtccgcgaggggctggctcatctgatccagtcgtgtggacttggcggaatgagacacaatagcgtcgtactcggctggccctatggttggcgccaatccgaggacccacgtgcctggaagaccttcatcgacaccgttcggtgcaccaccgcggcccaccttgctctgctagtgcccaaaaatatcgctttctatccatcaaaccacgagcggtaccttgagggccatatagacgtgtggtggattgtgcatgacggggggatgctgatgttactgcctttcctcctgcgccagcataaggtgtggaggaagtgcaggatgcgcatttttaccgtggctcagatggacgataactcaattcaaatgaaaaaggacttagctgtatttttgtatcacctgaggctggaagccgaagtcgaggtggtggagatgcataacagcgacatctctgcttatacttatgagcggactctgatgatggagcagcgcagccagatgcttagacaaatgaggctgaccaaaacagaaagagaacgggaggcgcagttggtcaaggataggcattctgctctgcggcttgaatctctttattccgatgaggaagacgagagcgctgtgggcgctgacaaaatacaaatgacttggacccgggataagtatatgaccgagacttgggatccctctcatgcacccgacaacttccgggagttagttcacattaagcctgaccaaagcaatgtgaggcgtatgcacaccgcagttaagctcaacgaagtgatcgtcacccggagtcatgatgccaggctcgttttgctgaatatgcctggccctcctaggaattctgagggagacgagaactacatggaatttcttgaggttctgacagaaggacttgagcgggtcctgctggtgaggggcggtggtagagaggttatcaccatctatagctag

SEQ ID NO: 134773 - DNA, 3300 bp, Artificial Sequence
  Description of Artificial Sequence: Synthetic coding sequence
atgcctcacttcacagtgaccaaagtggaagaccctgaagagggcgctgctgcctcaatttctcaggaaccctcattagcagacataaaagcccgaatccaggatagcgacgagcctgacttaagtcagaactctattactggggaacattcccagctgctggatgatggtcataagaaagcgaggaatgcgtacctaaacaattcaaactatgaggaaggcgatgaatacttcgataaaaacctggccctgttcgaagaagaaatggacacacgtcccaaggtcagcagcctgctcaatagaatggccaactacaccaacctgacccagggagccaaagaacacgaagaggcagaaaacatcaccgaaggcaaaaagaagccgacaaaaaccccccagatgggcactttcatgggagtttatctgccctgccttcagaacatattcggtgtgattctctttcttagacttacttgggtagtcgggaccgcaggcgtcctgcaggcattcgccatagtgcttatctgttgctgctgcacgatgcttactgccatttccatgtccgcgatcgccactaatggcgtggtgccggcaggtggcagctatttcatgatcagcagggctctgggacccgagttcggcggcgctgtggggctgtgcttctatttggggactacgttcgctgccgctatgtatatcttaggagctatcgagatatttttggtctacatagtacccagggccgcgatttttcattctgacgatgctctgaaggagtccgctgctatgcttaacaatatgcgcgtgtacggaaccgcctttctagtgttgatggtgttggtggtcttcatcggagtccgctacgtaaacaagttcgcttccctctttttggcctgcgtcattgtatccatccttgcgatatatgccggcgccattaaatcctcctttgctccaccccactttccggtctgtatgctgggcaacaggaccctgagcagtcgccacattgacgtctgttcaaaaacgaaggaaattaacaacatgaccgtgccatcgaaactgtggggtttcttctgtaactcttcacagttttttaatgcgacctgcgatgagtattttgtgcataacaacgtcacgagcattcagggcattcccggcctggcttctggtatcataacagagaacctgtggtctaactaccttcctaagggtgagattatagaaaagccgtcggcaaagtccagcgatgtgctcggctcacttaatcatgagtatgtgcttgtggatatcactacatccttcacgctgctcgttggaatcttcttcccctctgttaccggtatcatggccggatccaaccgctctggagatttaaaagatgcacagaagtccataccgatcgggacaatactcgcaatcttaactactagcttcgtgtatttgtctaacgtcgtgctgttcggtgcctgtatcgaaggagtcgtgctgagagacaagtttggcgacgcagtcaagggcaatcttgtcgtgggaactctgtcatggccctcgccttgggtgatcgttatcggcagcttttttagcacatgcggagccgggcttcagtccctcactggagcccctcggctgttgcaggcaatcgcgaaagataatattattccattcctgcgtgtcttcggacattccaaagcgaatggggagcctacctgggcactactgttaacagccgccattgcagagctggggatcctgatcgcgtcccttgaccttgttgcccccatacttagcatgtttttcctcatgtgttacctcttcgtcaatctggcttgcgccctgcagacactgcttcgtacccccaattggcgacctaggttccggtactatcactgggctctgtcatttatgggcatgagcatctgccttgccttgatgttcatatcaagctggtactacgccatcgtcgccatggtcatcgcaggcatgatatacaaatacattgaataccaaggagcagagaaagaatggggggatgggatcagaggcctgtctctctccgctgctcggttcgccctcctgagattggaggagggtccacctcacacgaaaaactggcgtcctcagttgctagtccttctgaaactcgacgaggacctgcacgtgaaacacccaagacttcttaccttcgcatctcagctcaaggctgggaaagggttgaccatcgtcggatccgttattgtcggaaactttttggagaattacggcgaagctttggccgccgagcagactattaaacatttaatggaggctgagaaggttaaaggcttctgtcaactggttgtggctgccaagctgagagaagggataagccatctgattcagtcctgtggcctgggcggaatgaaacataataccgtagtgatgggttggcctaacgggtggcgtcagtccgaggatgctagggcctggaagaccttcattggcacggtgcgagtgaccaccgccgcacacctcgcgctccttgtggcaaaaaacatttctttcttcccatcaaatgtagaacagttcagcgaagggaatatagacgtgtggtggatcgtccacgacggggggatgttgatgctcctccccttcttgctaaagcagcataaggtgtggagaaagtgttccatacgcatttttaccgtggcccagctcgaagacaattccatccagatgaaaaaagatctcgccacattcctctaccatctgcgcattgaagccgaggtggaggtggtagagatgcacgactccgacatcagtgcctacacctatgagcggaccctaatgatggaacaacgttcacagatgcttcgtcatatgagacttagcaagactgagagggaccgagaagcacaactggtgaaagacagaaatagtatgctgcggctcacaagtattggctccgacgaggacgaggagaccgaaacttatcaggaaaaggtgcacatgacgtggacaaaggataagtacatggcatcacgagggcagaaggccaagagtatggaggggtttcaggatttgcttaatatgcggcccgaccagagcaacgttcgtaggatgcatactgccgttaaattgaacgaggtcatcgtaaacaagtcacacgaggccaaattggttttactcaacatgccgggcccacccagaaacccagaaggtgatgagaactacatggagtttctagaagtcctcacagagggactggaaagggttctgctcgtccgaggtggcggcagcgaagtgatcacaatctactcatag

SEQ ID NO: 134774 - DNA, 3453 bp, Artificial Sequence
  Description of Artificial Sequence: Synthetic coding sequence
atgcacccacccgaaactaccaccaaaatggctagtgtgcgcttcatggtcacacccactaagatcgacgatatccccggcttgagcgacacatcgcccgacctgtcttcgcggtcatcctcacgcgtacgattctcaagtcgagaatctgtaccagaaactagccgaagcgaaccaatgtccgagatgagcggggccaccacatctctggccaccgtggcattagaccctccttcagatagaaccagccatcctcaagatgtcattgaggacctctcgcagaatagtattacaggtgagcactctcagctgctggacgacggtcacaaaaaagcccgcaatgcctatctcaacaactcaaactatgaggagggggacgagtattttgacaaaaacttggctttattcgaagaagaaatggacactcgtcccaaggtgagtagcctgcttaatcggatggctaattacacaaatctgactcaaggtgcaaaagaacacgaagaggcagagaacattaccgagggtaagaagaagcccaccaagacccctcagatgggtacttttatgggtgtgtacctgccatgcctgcagaacatatttggagtgattctcttcctgcggttaacttgggtcgtgggtactgccggcgtcctgcaggcctttgctatcgttcttatctgctgctgctgtacaatgctgaccgcaatttcgatgtcggccatcgccaccaatggggtggtccccgccgggggatcctatttcatgatctcaagagcactgggtccagagttcggaggggccgttggactctgtttttacctaggcaccacctttgcagcagctatgtacatcctcggagccatcgagatttttctggtgtacatcgtgcccagagcagcaatttttcactcggatgatgccctcaaggaatccgccgccatgttgaacaatatgcgagtctacgggacagcgtttctggttttgatggtgcttgttgtgttcattggcgttcggtacgtgaacaaatttgcttcgctcttcctggcatgtgtcatcgtgtccatcctcgcaatctacgccggtgcaataaaatcctcatttgccccccctcatttccccgtgtgcatgctaggcaaccgcacgctgagttcgcggcatatcgatgtttgcagcaaaactaaggagataaataatatgacagtgcctagcaagctgtggggcttcttctgtaatagttcccagttttttaacgcgacatgcgatgagtattttgtgcacaataatgtgacttccatccagggcatcccagggttggcctcaggaatcattacagagaatctctggagcaactatctaccaaaaggcgagataattgagaaaccatcagctaaatcctccgacgtgctgggatcattaaatcacgaatatgtcctggttgacattaccacctccttcaccttactggtcggcatcttttttccatccgtgactggtatcatggcgggctctaaccggtcaggcgacctcaaagacgcccagaagagcattcccattggcactatcctcgcaatactgactacatccttcgtgtacctgtccaatgttgtgctcttcggtgcatgcattgaaggcgttgtgttacgagataagtttggcgatgcggtcaaaggcaacttggtagttgggacactgagctggccttcaccatgggtgattgtcatcggcagctttttttcaacatgcggagccggcctgcagtctctgacgggcgcccctcgcctgctccaggcaattgccaaagacaatataatcccattcttacgggtctttggtcatagtaaggcaaatggggagcccacttgggccctgcttctcaccgccgccatagccgagttggggatcttgatagcgagccttgatctagtagcaccgatcttgagtatgtttttcctgatgtgctacctcttcgtcaaccttgcatgtgctctacagaccctgctccgcacccctaattggagacccaggttccgctactatcactgggcactgtctttcatggggatgagtatctgtctggctttgatgtttatcagttcctggtactatgccattgtcgctatggtgatcgcgggtatgatttataagtatatagagtaccaaggcgcggagaaggagtggggcgacgggattagggggctttcgctctctgcagccagatttgctttgctgaggctcgaggagggacccccccacacaaaaaactggagaccacagttgctagtcttgttgaaactggacgaagatctgcacgttaaacacccacgattgctgacatttgccagtcagctcaaagcaggcaagggcttgacgattgtcggctccgtaatcgtgggtaattttctggagaattacggagaggccctcgccgctgaacagactataaagcacctcatggaagctgagaaagttaaaggtttttgtcagctagtggtggccgccaagctgcgcgagggtattagtcacctcattcagtcatgtggtctaggagggatgaagcataatactgtggtgatgggatggcccaacgggtggcggcaaagcgaggacgctcgggcttggaagacatttatcggcacagtgagggtaaccacagcagcccacctcgctctcctggtcgcaaaaaatatctcttttttccctagtaatgtagagcagttcagtgaggggaacatcgacgtgtggtggattgtccacgatggaggcatgctgatgcttctcccctttctccttaaacagcataaggtgtggaggaaatgctctatcaggatttttaccgtagcccagctggaggataattccatccagatgaaaaaggacctggccaccttcttgtatcatctcagaattgaggcagaagtggaggtcgtggagatgcatgacagcgacatctctgcttatacatacgagcgcaccctgatgatggaacagcgcagtcagatgttgcgacatatgcgcctgtcgaaaacagaaagagaccgggaggcacagctcgtgaaagaccgaaacagcatgctgcgcctgacatccatcggttccgacgaggacgaggagacagaaacttatcaggagaaggtacacatgacatggaccaaagataagtacatggcttcccgaggacagaaggccaaaagcatggaggggttccaagacttgctcaatatgcgccccgaccaatcaaatgtccgccgcatgcataccgccgtaaagctcaacgaggttatcgtgaacaagtcacatgaagccaagctcgttttgcttaacatgcctggcccgcctagaaatcccgagggagatgaaaactacatggaattcctcgaagtcctgacagaagggttggagcgcgtgctgcttgttaggggcgggggcagcgaggttatcacaatttattcgtag

SEQ ID NO: 134775 - DNA, 3276 bp, Artificial Sequence
  Description of Artificial Sequence: Synthetic coding sequence
atgagcgagatgagcggcgccaccacttccctcgccaccgtcgcactggaccccccttcagataggaccagccaccctcaggacgtgattgaggacctttctcagaatagtatcactggcgagcatagccagctcctggatgatgggcacaaaaaggcacggaacgcctacctcaataacagtaattatgaagagggtgacgagtattttgacaaaaacctggctttatttgaagaggaaatggatacgagaccgaaggtgtcatccctgttaaatcgcatggccaactacaccaacctaacacagggcgctaaggagcacgaggaagcagagaacatcactgaagggaaaaaaaaaccgaccaagaccccccaaatgggcacgtttatgggggtgtatctgccctgtctgcagaatatttttggagtaattttattcctgcgcctgacatgggtggttggtacagcaggtgttctgcaggcctttgctatagttctcatatgttgctgttgtaccatgctgaccgccatttcaatgagcgccatcgctacaaatggcgtggtgcctgccggaggaagttattttatgatctcccgagcactgggccccgaatttggtggtgccgtcggcctgtgcttttaccttggcacgaccttcgcagccgccatgtatatcctgggtgctatcgagatcttcctggtttatattgtgcctagggccgccatcttccattccgatgatgcactgaaggaatccgccgccatgctcaataacatgagggtctatggcaccgccttcctggtactgatggtcctcgtggtattcattggcgtccgctacgtgaacaaatttgcatctcttttcctggcctgcgttattgtaagcatccttgctatctacgctggtgctattaagtccagttttgcacccccgcatttccctgtctgcatgttggggaataggaccctgtccagccgccatatcgacgtatgttccaaaactaaggagattaacaatatgaccgttcccagtaagctgtggggatttttctgtaatagctcccagttctttaacgccacctgtgatgaatatttcgttcataataacgtgacaagtatccaaggaattcctggcttggcttctggaatcatcaccgagaacctgtggtccaattacctgccaaaaggcgaaataatagagaaacccagtgccaaaagcagcgacgtgctcggatctctcaatcatgagtacgtcctggttgacataaccacatcttttactctgctggtgggaattttctttccttcagttaccggtatcatggccggaagtaaccgatctggtgatcttaaagacgcacagaaaagcattccaatcggcactatactcgcaatccttactacaagcttcgtttacctttccaatgtagttctgttcggcgcttgcattgagggggtcgtgctgagagacaaattcggcgatgcagtgaaggggaatttagtggtcggcacactgagctggcccagcccctgggtgattgttataggatctttcttctccacctgcggagccggtctacagtccctgaccggtgcacccaggcttcttcaggctatcgcgaaggataacataatcccatttctccgcgtcttcggccattcaaaagccaacggggagcctacatgggcacttttgcttactgctgcgattgctgagctcgggattctaatcgcctccctggatctggtggctcctatcctctctatgttcttccttatgtgttatttgttcgttaacctagcgtgcgccctgcagacccttttgagaacacctaactggagaccccggtttagatattaccattgggctttatccttcatgggtatgtccatttgcctcgctcttatgttcatttccagctggtattatgccattgtcgcgatggtgatcgcagggatgatctataagtatattgaatatcagggcgccgagaaagagtggggtgatggaatcaggggcttaagcctcagcgcggcccggtttgcactcctccgactggaggaaggacctccccataccaagaattggcgaccccagctacttgtgctgttaaagcttgatgaagatctgcacgttaaacacccccggttactgaccttcgccagtcagttaaaggctggcaagggcctgaccattgtgggaagcgtaatcgtgggcaactttctcgagaactacggcgaagcgcttgcagccgagcaaacgattaagcacttgatggaagcagagaaggtaaaaggcttctgccagttagtggtcgctgcaaagctgagggaaggaatatcccatcttatccagtcttgtggactgggaggcatgaagcataacacagttgttatggggtggcccaatggatggcgccagagcgaagacgctcgagcatggaagaccttcatcgggaccgtgcgcgtcaccacagctgcccacttggccctgctggtcgctaagaacatttcgttctttcctagcaatgtggaacagttcagcgaagggaacattgatgtgtggtggattgtacatgacggcggcatgctaatgctcctcccttttctacttaaacaacacaaagtctggagaaaatgtagtatccggatttttacagtggcgcagttggaggacaacagcattcagatgaagaaagatttagccaccttcctgtatcatctgaggattgaggccgaagtcgaggtggtggaaatgcacgatagcgacatcagtgcctacacctatgaacgcaccctcatgatggagcaaagaagccagatgttacgccacatgagactgtcaaaaacggagcgagatcgggaggctcagctcgttaaagatcgcaattccatgctcagactgaccagtatcggatcagatgaggacgaggaaactgagacatatcaggagaaggtgcacatgacgtggaccaaagacaaatacatggcttctagagggcagaaggcaaagagtatggaaggattccaggatcttcttaacatgaggcctgaccagtctaacgtccgaagaatgcacacagctgtgaaactgaacgaagtgatagtcaataagtcccatgaagccaagctcgtgctgctcaatatgcctggaccaccacgcaatcccgaaggcgacgagaactatatggagttcttggaagtgctgaccgagggcctcgagagagtgcttctggttcgaggaggggggtctgaggtgattactatttactcatag

SEQ ID NO: 134776 - DNA, 3408 bp, Artificial Sequence
  Description of Artificial Sequence: Synthetic coding sequence
atgcatcccccagaaaccacaaccaaaatggcgtcagttcgcttcatggttacaccaactaaaattgatgacattcccgggctctcagacacaagccctgacctgtcctctcgcagttcttcccgggttagatttagttcccgtgagtcagtccctgagacaagtcggtcagaacccatgagtgaaatgagcggcgctaccacgtcacttgccacggttgcactcgatcccccttcagataggacgtcacacccccaagacgttatcgaggacgacggtcataaaaaggcgagaaatgcatatctgaataattcaaactatgaggaaggcgacgaatatttcgacaaaaatctggcgttattcgaggaagaaatggatactcggcctaaagtctctagcctgctgaaccgtatggcaaattacaccaatttaacacaaggagctaaagagcacgaggaagctgaaaacatcacagaaggcaagaaaaagccaacgaagacaccccagatggggactttcatgggcgtttatctcccctgtcttcaaaatattttcggggtgatccttttcctcaggctaacctgggtggtgggtacggccggggtcctgcaagcctttgctatcgttctcatatgctgttgctgcaccatgttaacggcaattagcatgtcagcaatagccaccaatggggtggttcccgctggtggctcatattttatgattagcagagcgttgggtcctgagtttggaggcgctgtcggactttgcttctatttgggtaccaccttcgccgcagcgatgtacatcctcggagccatcgagatctttcttgtgtacatagtgccgcgcgctgccatcttccattccgacgatgcgctcaaggagagtgctgcgatgctcaataacatgcgggtctacggaactgcttttcttgtgctcatggttttagtggtcttcattggcgttagatacgtgaataagtttgcatcactcttcctggcttgtgtcatcgtctccatattggccatctatgccggagcaattaagagcagctttgcccccccccactttcctgtatgcatgctggggaaccggaccctgagctccagacacattgacgtgtgcagcaagacgaaggagattaacaacatgacagtgccttctaaattatgggggttcttctgtaatagttcacaattttttaacgcaacctgtgacgaatactttgtacacaataatgtaacctcaattcagggtatcccaggcctcgcttcaggaataattacagaaaacctctggagtaattacctgcctaagggtgagatcatcgaaaaaccttcagcaaagagcagtgatgtcttgggttccctgaaccacgagtatgttcttgtcgacatcacaacttcttttacactgcttgtggggatattcttccctagcgtgaccgggatcatggccgggagcaacaggagtggtgacctgaaagacgcccagaagagcattccaattggtaccattttggccatactgacaacaagttttgtttacttgagcaacgttgtgttatttggggcctgcatcgagggtgtggtgctcagggataagttcggcgacgccgtcaaaggcaacctggtggttggaaccctttcatggccctccccatgggtcatcgtaatcggcagctttttctctacatgtggtgcaggtctgcagtcattaaccggcgcacccagacttttacaggccattgccaaggacaacatcattccatttcttagggtgttcgggcactctaaggcaaacggagaaccaacctgggccctgctgctcacagcagctatcgctgagctggggatcctcatcgcaagcctggacctcgtcgctcctatcctttctatgtttttcctaatgtgctacctcttcgtcaaccttgcctgcgctctgcagaccctacttaggacccccaactggcgaccaagattcaggtactatcactgggctctgagcttcatgggtatgtccatatgtctagctctgatgttcatttcatcctggtactatgccatcgtcgccatggtgattgctggaatgatttacaaatacatcgagtatcagggagccgagaaggaatggggggacggaatccgcggattgtccctgtcagcagcccgctttgccctgctcaggctggaggaagggcctccgcacacaaagaattggagaccacagctgctcgtgctgcttaagttagatgaggacctccatgtgaagcacccgcgcctgcttacgttcgcttcccagctgaaagctgggaaggggttaacgattgttggctctgtgatagtcggtaatttcttggagaactacggcgaggctctggctgcagagcaaactattaagcacttgatggaggcagaaaaggtcaaaggcttttgtcagctcgtggtggcagcaaagctccgtgaggggatcagccacttaatacagagctgtggtttagggggtatgaaacacaatacagtggttatgggctggccaaatggttggcggcaatctgaggatgcacgcgcctggaagacatttattggaactgtacgggtcactacagccgcccacttagctttgctcgttgccaagaacatttcattcttcccctcgaacgtcgagcagttttcggaggggaacatcgacgtgtggtggatcgttcatgacggcggcatgctcatgttacttccttttttacttaaacagcataaagtctggcggaaatgtagcatccgtatcttcactgtggcacaattggaagacaactcaatccagatgaaaaaagatctggcgacatttctgtaccatctgcgtatagaggctgaagtcgaggtggtggagatgcatgattccgatatttccgcttatacatacgagagaactttgatgatggagcagagatcacagatgcttagacacatgcgcctgagtaagacggaaagggaccgagaagcccagcttgtgaaggatcgaaattcaatgctgcgactcacgtccatcggatctgatgaggatgaggagaccgagacttatcaggaaaaggtacacatgacctggacaaaagacaaatacatggccagccggggccaaaaggccaaatcaatggaaggcttccaagacctgctgaacatgagaccagatcagtcaaatgtgcgcagaatgcacacagcggttaaactgaatgaggtgatcgtgaacaaaagccatgaagcaaagcttgtgctgctgaacatgcccgggcctcctaggaacccggagggcgacgagaattacatggagtttttggaagtcctgaccgagggactggagagagtgctgctggtacgcggaggtgggagtgaggtcatcacaatctatagctag

SEQ ID NO: 134777 - DNA, 2889 bp, Artificial Sequence
  Description of Artificial Sequence: Synthetic coding sequence
atggatacgcggccgaaagtgtcgtcgctcctaaatcgtatggctaactacaccaacctcacacagggggccaaagaacacgaggaggcggaaaatattaccgaaggaaagaaaaagccaaccaaaacaatgctcacagctatttccatgtccgccatagccaccaacggtgttgtgccagccggaggcagctactttatgatttcgcgtgcactcggcccagagttcggcggcgccgtggggctgtgcttctacctcgggactacattcgcagctgccatgtacatcctgggcgcaatcgagattttccttgtttacattgtgccccgcgccgccattttccatagtgatgacgcccttaaagagagcgcggcgatgctaaacaatatgagagtgtacgggacggccttcttagtgctgatggttctggttgtcttcatcggcgttaggtatgtaaacaaattcgcaagtctgtttttagcatgtgttattgtgtccatcctggctatctatgccggagccatcaagtcatccttcgcccctccccattttcctgtgtgcatgctcggaaatcggactctctcgagtcgacatattgacgtgtgctctaagactaaggagattaacaacatgacggttcccagcaaactatggggattcttctgtaattctagtcagtttttcaatgcaacctgtgatgaatacttcgtgcacaataatgtgacttcaattcaaggcatcccaggcctggccagtggcatcataacagaaaacctctggtcaaactacctccccaagggagagattattgagaagccaagcgccaaatcttcggacgtgctgggaagcctaaaccatgaatatgtgctggttgatattaccaccagtttcacactgctcgtggggatcttcttcccttctgtaacgggtataatggcagggtccaatcggtccggcgatttaaaggatgcccaaaagtctattcccatcgggaccatattggctatccttacaaccagctttgtttacctgtccaatgtggttttgtttggtgcctgcattgaaggcgttgtactgagagataagttcggagatgctgttaaagggaacttggtggtgggaaccctttcttggcccagtccatgggtgattgtgatcggctcctttttcagtacctgcggcgctggtctgcagagcctgactggggcccctaggttgctgcaagctatcgccaaagacaatatcattccattccttcgagtgttcggtcatagtaaggccaatggtgaacccacctgggctctcctgcttaccgcagctatagccgaactgggcatcctgattgcgagcctcgacctagtggcacctatcttgtctatgttcttcctgatgtgttatctattcgtgaacctggcgtgcgccctccaaacactcctccggacaccaaattggagaccccggttccggtattaccactgggccctaagttttatgggtatgagcatctgcctggccctcatgttcataagttcctggtactacgcaatcgtagcgatggtgattgctgggatgatctacaaatatattgaataccagggggccgagaaagagtggggcgatggtatcagagggctgtcgctgtcggccgctcgcttcgccttacttcggctcgaggaaggcccccctcatactaagaactggaggccacagctgctggtcctgctgaaactagatgaagacctccatgtgaaacacccgaggctcctcacattcgccagccagctgaaggctggcaaaggcctgactattgtgggatccgttattgtgggcaatttccttgaaaattacggggaagcattggcagcagaacagaccatcaagcacctgatggaagctgagaaggtgaaaggattttgtcaactggtggtggcggctaagctgagagagggcatctcacacctgatccagagctgcgggctaggcggcatgaaacataacaccgttgtcatgggctggcccaatggctggagacagagcgaagacgcaagggcctggaagaccttcatcggcacggtgcgcgtgacaaccgccgcccacttggccctcctagtggcgaaaaatatctctttcttcccctctaacgtggagcagttctccgaggggaacattgacgtgtggtggatagtgcacgacggggggatgctcatgctgcttccattcctgctgaaacagcacaaggtctggagaaagtgcagcattagaatttttaccgttgcacagcttgaggataacagtattcagatgaagaaggatctcgcgacatttttgtaccaccttcggatcgaagccgaagtcgaggtcgttgagatgcacgacagcgatatatccgcatacacatacgagaggaccctcatgatggaacagaggtcccagatgctgcgccacatgcgtctgtctaagaccgagcgagatagagaggcacaactggtgaaagatcggaacagcatgctgagacttacgtcaatcggctctgatgaagatgaggagacagaaacctaccaggagaaggtacacatgacttggaccaaggataagtatatggcaagccgaggccaaaaggcaaaatctatggagggattccaggacctgcttaatatgcggcctgaccaatcgaatgttaggcggatgcatacagcagtgaaactgaatgaggtgatcgtgaataaaagtcatgaagccaagttggttttgctcaatatgccaggccctccccggaatcctgagggcgacgaaaattatatggagtttctggaagtcctgaccgaaggtctggagagggtattgctggtgaggggcggaggatcggaggtgattacgatatacagttag

SEQ ID NO: 134778 - DNA, 3276 bp, Artificial Sequence
  Description of Artificial Sequence: Synthetic coding sequence
atgtcggagatgtcaggcgccacgaccagcctggcaaccgttgcactcgaccccccatcagatagaaccagccaccctcaagacgttattgaagatttatcccaaaattccattactggagaacacagccagcttctggacgatggacacaaaaaagctcgcaacgcctacctcaataatagtaactacgaagaaggagacgaatacttcgataagaatttagccctcttcgaagaggaaatggatactagacccaaggtgtcatcgcttttgaataggatggcaaactacacaaatctgacccaaggcgccaaggagcacgaggaggctgagaatattacagaagggaaaaagaaaccaacaaagacaccgcagatgggaacttttatgggcgtgtatctgccctgtttgcaaaatatttttggcgttatcctatttctgcggctgacttgggtcgtgggtacggccggcgttcttcaagcctttgccattgtcctcatttgctgctgttgtacaatgctcaccgccatttcaatgtcagcaatagcaacgaatggagtagtacccgctggcggttcctattttatgatttcccgggcacttggtcctgagtttggaggcgctgtggggctgtgtttctatctgggaactacttttgccgccgctatgtatatcttaggagctattgagatattcctggtgtatatcgtgcctagagccgccatctttcactcagacgacgccctcaaggagtcagcagcaatgcttaataacatgagagtatatgggaccgcatttcttgtccttatggtgctggtggtatttatcggtgtccggtatgttaataagtttgcctcactgttcttggcctgtgtcatcgtcagcatactcgccatctacgccggagcgatcaagagctcctttgccccacctcacttccccgtctgcatgctgggcaacagaacacttagctctcgacacattgacgtgtgttccaaaacaaaggagattaacaatatgaccgtaccgagcaagctgtggggattcttctgtaacagctcccaatttttcaatgctacatgtgatgagtatttcgtccacaataatgttacatcaatccagggaatccccgggcttgccagcggaataatcaccgaaaatttgtggagcaactatctccctaaaggcgagatcattgaaaagccgtcagccaaaagctccgacgttttgggaagtctgaatcacgagtacgtgctggtcgatatcactacatctttcacactgctcgtcggcatcttctttccatctgtgacaggaatcatggccgggagcaatcgaagcggggacttaaaggacgcccagaaaagcatccccatcggaaccattctcgctattcttaccactagttttgtgtacctgagcaatgtcgtgctcttcggtgcctgtattgaaggggtggtcttgagggacaagttcggcgacgccgtgaaaggaaatttggtggtggggactctctcttggccatctccgtgggtgattgttattggctccttctttagcacttgcggcgctggacttcaaagtctgacaggggccccccgattgctgcaggcgatcgcgaaggacaacattattcctttcctgagagtctttggccactccaaagctaacggcgagcccacttgggcattgcttctgacggcagccattgccgagttaggaatcttaatcgcttcactggacttagtcgctcccatcctgtccatgtttttcctaatgtgttacctcttcgttaacctggcctgtgccttgcagaccctgctacgaactccaaactggcggcctaggttccggtactaccactgggccctgtcatttatgggtatgtcaatatgcctggccttgatgttcatctccagttggtattacgcaatcgtggctatggttattgccgggatgatttacaagtatatcgaataccagggagctgagaaggagtggggtgatggcatccgtgggctctcactctcagcagccaggttcgcgctgctgcgcctggaagaagggcccccacacaccaaaaactggcgtccacagctcctggtgttgctcaagttggacgaagacctgcacgtcaaacacccacggcttcttacatttgcttctcagcttaaagcaggcaaaggactcaccattgtgggctcagtgattgtgggcaattttctggaaaactacggcgaagctctggctgctgagcagactatcaagcatctaatggaagcagagaaggtgaaggggttctgtcagctggtggtggctgccaaactgcgtgagggaatatcacatttgatacagtcctgcggcttgggcggaatgaagcataataccgtggtgatgggctggcccaacgggtggcgtcaaagcgaggacgcccgcgcctggaaaaccttcatcggaacggtaagagtgaccaccgcagcacatctggccctgttagtcgctaagaatatcagcttcttcccaagcaacgtggaacagttcagcgaaggaaatattgacgtttggtggatcgtgcacgacggtggaatgcttatgctcttgccattcctgctcaaacagcacaaagtgtggcgtaagtgtagcatccggatctttaccgtggcccaactggaggataattctattcagatgaagaaggacctggccacatttttataccatctgaggatcgaagcagaagtcgaggtggtcgagatgcacgactccgacatctctgcatacacctacgagcgtacccttatgatggagcaacgctcacagatgttgaggcatatgcggctctctaagaccgagagagatcgggaggcacagcttgttaaagatagaaacagcatgctgcgactgacctctataggaagcgacgaggacgaggagactgagacttaccaggagaaagtgcatatgacctggacaaaggataaatacatggcttcaaggggtcagaaagccaagagcatggaggggtttcaggatctcctaaatatgagaccagatcagtccaatgtgagacggatgcatacagccgtgaagctaaacgaggtcattgtgaacaaaagccatgaagcaaagcttgttctgctaaacatgcctgggcccccacgcaatccagagggcgatgaaaattatatggagtttctggaagtgctgacggaagggctcgagcgagtgctcctagtacgtggcggaggctctgaagtcatcactatttactcctag

SEQ ID NO: 134779 - DNA, 3426 bp, Artificial Sequence
  Description of Artificial Sequence: Synthetic coding sequence
atggcatctgtgaggtttatggtcacacctactaagattgacgacattcctgggctaagtgacacctctccagaccttagcagcaggagcagctcacgggtcagattctcttcacgagaaagcgtgccggagaccagtcggtctgagccaatgagcgaaatgtctggtgcgactacctcccttgctaccgtcgcactggatcctccatccgacaggacatcccatcctcaggatgtgatcgaggatctaagccagaattcgattaccggggaacatagtcagttgcttgacgatggccataagaaggcccgtaacgcctatttgaacaatagtaattatgaagaaggcgatgagtactttgacaaaaatctcgctcttttcgaggaagagatggacactcggcccaaagtctcctccctgcttaatagaatggccaactacacaaacctgacccagggggccaaggaacacgaggaggccgagaatattacggagggaaaaaaaaagccaactaaaacacctcagatggggacatttatgggcgtctatctcccctgtctccagaacatcttcggcgtgattctgtttttacgcctaacgtgggtagtgggaaccgccggagtgctgcaagcatttgctattgtgcttatttgttgctgctgcacgatgctgactgctatctctatgtctgccatagctaccaatggtgtggtaccagccggaggatcttatttcatgattagccgagctttggggccagagtttggaggggcagtgggactttgcttttatctcggaacaactttcgctgcggccatgtacatcctcggcgcaatcgagatctttctggtgtatattgtgccacgggctgcaattttccacagtgatgacgcccttaaagaatcggccgccatgctgaacaacatgcgcgtatacggcactgctttcctggtgctcatggtgctcgtcgtattcataggtgtgcgctatgtaaacaagttcgcctctctatttctggcctgtgtgatcgttagcatactggccatctacgctggagcaataaagagcagtttcgcccccccgcacttccctgtgtgcatgcttgggaacaggaccctgagctctcgtcacattgacgtctgcagcaagaccaaggagatcaataatatgaccgtgccatcgaagttgtgggggttcttctgcaatagttcccagttttttaacgccacatgcgacgaatattttgttcataataatgtgaccagcattcaaggcatccctgggctggcctctggtattatcacagagaacttgtggagtaattatctgcccaaaggcgagataatagaaaagccaagtgccaaatcctctgatgtgctggggagtctgaatcacgagtacgtcttagtggatattacaacctccttcacactgttggtcgggattttctttccctctgttactggcattatggcaggcagcaataggagcggcgacttgaaggatgcccagaaaagcatccccatagggactatacttgcaatcctgactacttctttcgtttatctgagcaatgtcgtgctcttcggcgcttgcatcgagggcgtggtattacgagataaattcggggacgccgttaagggcaatctcgtggtgggaacactaagctggccgtctccgtgggtgattgtgatcgggagtttcttcagcacctgtggagctggactgcagagtctgactggagccccccgactgctgcaggctattgccaaggataacattattccctttcttcgagtttttggccattctaaggcaaacggagagcctacatgggccttactactaaccgccgccattgcagaactgggaatactgatcgcgagcctcgatctggtcgcaccgattctgtcgatgttcttccttatgtgctatttgttcgtcaatctggcttgcgccctccagactctcttacggacccctaactggagaccgagattccggtactatcattgggccctcagcttcatgggaatgtcaatctgcctggccctgatgtttatttcttcatggtattacgcaattgtggctatggtgatcgccggaatgatctacaagtatatagagtaccagggtgccgagaaagagtggggggacggcattaggggtctaagcctaagcgccgcccgcttcgccctcctgcgcctcgaagaagggcctccacatactaagaactggaggccgcagttacttgtactgctgaagctagacgaggatctccacgtgaagcatccaagattgctgacattcgcatcacagcttaaagccgggaaggggttaaccattgtgggctctgtaatcgttgggaatttcctggagaactacggagaagcactggctgctgaacaaaccattaaacatcttatggaggccgaaaaagtgaagggcttttgccagctggtggtggccgcaaagttaagagaagggattagccacctgattcagtcttgcggtctcgggggaatgaaacacaataccgtggtcatgggctggcccaacggatggagacaatctgaggacgcccgagcctggaagacattcatcggcacggtgcgagttactactgcggcacatttggctctgctggtggcaaaaaatattagtttttttccgagcaatgtggagcaattttccgaggggaacattgacgtatggtggatcgtccacgacggaggtatgctgatgctcctgcctttcctactcaagcaacataaagtctggaggaagtgttcgatcagaatcttcaccgtggcacagttggaggacaacagcattcagatgaagaaagacctggctaccttcttatatcaccttcggatcgaggcggaagttgaagtcgtggagatgcacgactccgatatctcagcctacacatacgaacggaccctgatgatggagcagcgctctcaaatgcttcgccacatgcgtctctccaaaactgagagagaccgcgaggctcagctggtaaaggaccggaactccatgctgcgcttaacgtctattggctcggacgaggatgaggagaccgaaacctaccaagaaaaggttcacatgacctggacgaaagacaaatatatggccagtagggggcagaaggcgaaatcaatggaaggattccaagatctgctgaatatgcggccagatcagagtaatgttaggcgcatgcacacagccgttaagctgaatgaggtgatcgtgaacaaatcacatgaggccaaactggtcctcctaaatatgccagggccaccccgcaaccccgagggagacgagaactacatggagtttttggaagttcttacagagggccttgaaagagtgctcttggttaggggtggtggttccgaagtgattacaatctactcctag

SEQ ID NO: 134780 - DNA, 3453 bp, Artificial Sequence
  Description of Artificial Sequence: Synthetic coding sequence
atgcacccccctgagaccaccaccaaaatggccagcgtccggttcatggtaacacctaccaaaatcgacgatattccaggtttaagtgatacctcgcctgaccttagcagcaggtctagctctcgagtgcggtttagctctcgggaaagtgttccagagacatcgaggtccgagcccatgagcgagatgagtggcgctacgacctcccttgccaccgtggccttggatcccccttccgatcggacatcacacccacaggacgtgatcgaggatctcagccaaaacagcattacaggggagcatagtcagctgctcgatgatggtcataagaaggcacgaaacgcatacctgaataactctaactacgaggagggggacgagtactttgacaagaacctggccctgttcgaagaggaaatggatactcgccccaaagtaagttccttgctaaatagaatggccaactatacaaatctaacccagggtgctaaggagcacgaagaagccgagaatataactgaaggcaagaagaagcctaccaagacaccgcagatgggaactttcatgggagtatatctgccatgtttgcagaatatttttggcgtaatcctgttcttacggctaacctgggttgttggcacagccggagttttgcaagcattcgctatcgttctgatttgctgctgttgcactatgcttaccgcgatatccatgtctgcgattgctaccaacggggttgtgccagccggtggatcctattttatgatctctagggcccttggccctgaattcggcggcgcagtcggattatgcttttacctggggacaacattcgctgctgccatgtatattctgggggccatcgagatcttcctggtgtacatcgtacccagagccgccattttccacagtgatgatgcacttaaagagtcagcagctatgttgaataatatgagggtgtatgggactgcgttcctagtgctcatggtgttagtggtcttcattggcgttagatacgtgaataagttcgcttcactgttcctcgcctgcgtgattgtgtctattctggccatttacgccggtgcaatcaagtctagttttgctccaccccactttcctgtgtgtatgctcggaaacagaacgctgtcttcccgtcacattgacgtatgcagcaaaaccaaagaaatcaataatatgaccgtccctagtaaactgtggggctttttttgcaactcttcccagttctttaacgcgacttgtgatgaatatttcgttcacaataacgttacttcaatccaaggtattccaggtctggcctccggaattattacggagaacttatggtctaattaccttccgaaaggagagatcatagagaaacccagcgcgaaaagttcggatgtgcttgggagcctcaatcatgagtatgtgctggtagatatcaccacgagtttcaccctcctggtgggtatcttcttcccaagcgttacagggataatggcaggatcaaaccggtccggtgacctaaaggatgcccagaaaagcatccctattggtacgatccttgcaattttgaccacctcattcgtgtacctcagcaatgttgtcctctttggcgcttgcattgaaggtgtcgtgctgcgcgacaagttcggggacgctgttaaggggaatctagttgttggaaccttgtcctggccctccccatgggtgattgtgatcggctcatttttctcaacatgtggcgccgggctccagtccttgacaggcgcccctaggttgttgcaggcaatcgctaaggataatattatacccttcctccgggtcttcggtcacagcaaagcgaacggcgagcccacctgggctttactgctcacagctgcgatcgctgagctgggcatcttaattgcctctctagatttggtcgctcctattctctcaatgttcttcctcatgtgctatctgtttgtcaacctggcctgcgcactccagacactgctgagaacccccaattggagacccaggtttcggtactaccactgggccttatcctttatggggatgagcatatgcctcgccctcatgttcatcagctcatggtactacgcaatagtagctatggtaattgccgggatgatatacaagtacatcgaataccaaggtgccgaaaaggagtggggggatggcatcaggggactaagcttatccgccgcaaggtttgcactcctccggctcgaagaaggccctccgcataccaaaaattggagaccgcagctgctggttttgttgaaacttgacgaggacttgcatgtcaagcatcctagactgctgacttttgcctctcagctgaaagctggcaaggggctgacgattgtaggctcagtaatcgttggcaacttcttggagaactatggggaagcactggcagcagaacagaccataaagcacctgatggaagctgaaaaggtaaaaggcttctgccaactagttgtggccgctaagttgcgcgagggtatcagccacctgatccaatcctgtgggctgggcggtatgaaacacaacaccgttgtgatgggctggccgaacgggtggcggcagagcgaggacgcaagggcatggaaaactttcattgggactgtgagggttactactgccgcacatctggccttgttagtcgccaaaaacatctccttcttcccgtccaatgtcgagcaattctctgagggcaatattgatgtgtggtggattgtgcacgacggaggcatgttgatgcttcttcctttcctgctcaaacagcataaagtctggaggaagtgctccatcagaatcttcactgtggctcagcttgaggataatagcattcagatgaagaaagacctcgccacttttctgtaccacctccggatcgaggccgaggtggaggtggtggaaatgcatgacagtgatatctcggcctatacttatgagagaaccttgatgatggagcagaggtcccagatgcttcgccacatgcgactttctaagactgaaagagatcgggaggcccagttggtgaaagatcgcaattctatgctcagattaacctcgattggttcagacgaggatgaagaaaccgaaacttatcaggagaaggtgcatatgacatggactaaggacaagtacatggccagcagagggcagaaagccaaatctatggaggggtttcaagatttactgaatatgcgcccagatcagagtaacgtgcggcgcatgcataccgccgtaaagttaaacgaggtgatcgtgaataaatcacatgaggccaagctcgtccttctgaacatgccaggaccaccccgcaaccctgaaggggacgaaaattacatggagtttttggaggttctcactgaaggtttagagagggtacttctggtgcgaggtggcggatccgaagtcattactatctattcctag

SEQ ID NO: 134781 - DNA, 186 bp, Artificial Sequence
  Description of Artificial Sequence: Synthetic coding sequence
atgagtgagatgtcaggcgctaccactagcctcgccacagtggctcttgatccccctagcgaccgtacctcccacccgcaagatgtcatagaggacctgagtcagaattctatcacgggcgaacactcgcaactgttagatgacgggcataaaaaggcccgcaatgcatacttgaacaacagctag

SEQ ID NO: 134782 - DNA, 2889 bp, Artificial Sequence
  Description of Artificial Sequence: Synthetic coding sequence
atggacaccaggcctaaggtctcaagtctgttgaacagaatggccaactataccaacctcacacagggtgctaaagagcatgaggaggccgaaaacatcaccgaaggcaagaaaaaacccactaaaacgatgctcactgctattagcatgagcgccatcgctacaaatggggtggtgcctgcaggagggagctacttcatgattagccgcgccctggggccggaattcggtggtgccgtgggcttgtgtttttacctcggcacaacatttgctgcggctatgtatattttgggagccatcgagattttcttagtttacatcgtaccccgcgctgccatcttccactccgacgatgctctgaaagaatctgccgctatgctgaataacatgcgcgtctatggcactgcctttctggtgctgatggttctcgtggtcttcattggcgtacgttacgtgaacaagtttgcctcactttttctggcttgcgtcatcgtgtcgatcctggccatctatgctggcgccatcaagagcagctttgccccgccacatttccctgtgtgtatgctgggcaaccgcaccctgtcatcgagacacatagatgtgtgctcaaaaactaaggaaatcaacaatatgactgtgcctagtaaactgtgggggttcttttgcaactccagccaattctttaacgctacttgcgacgagtactttgtgcataacaatgtgacctctatacagggcatacctggtctggcatcggggatcattaccgagaacctgtggagcaattacttgccaaagggtgaaataatagaaaaaccgagcgctaaaagcagcgacgtcttgggctccttaaaccacgagtacgtcttggtggatattactacctcttttacgctactagtcggcatttttttcccatcggtgacaggtatcatggctggctcaaaccggagtggtgatctcaaggacgcgcagaaatcaatccctatcggtaccattctcgccattttgactacctcattcgtatacctatcaaacgtcgtgctgttcggagcttgtatagaaggggttgtactgagagataaattcggcgacgcggtcaagggcaacctagttgtgggcacattatcatggcccagcccatgggtgattgttataggtagctttttcagcacgtgcggcgccggattacagtcactgactggagcacctaggctgcttcaggcaatagctaaagacaatattatcccattcttacgcgtctttggtcacagtaaagcgaacggggaacctacttgggcactgctcctcaccgccgccattgcagagctcggaatcctgatagcttccctggatctggtggctcctatcctgagtatgttcttccttatgtgctatttgttcgtcaatttggcctgtgcactgcagacactccttagaacgcccaattggcggccacgctttcggtactaccactgggccttgtcttttatgggtatgagcatctgtctggcgctgatgttcatatcctcctggtattacgcaatcgtcgctatggtcattgctggcatgatttataaatatatagagtatcaaggcgcggaaaaagaatggggagacggcattagaggcctctcactatctgctgctcgattcgcacttctgaggttggaagaggggccaccgcataccaagaactggaggcctcagcttctggtcctgctcaaactggatgaggatctgcacgtgaagcacccaagactcttgacatttgcttcacagctcaaggctggaaaaggcctgaccattgtgggctcagtcatagtgggcaacttcctggaaaactatggagaagctctggctgctgagcagactataaaacacctgatggaagccgagaaagtcaaagggttttgccaactggttgtggccgcaaaactccgggaagggattagccacttgatccagtcatgcggcttgggaggaatgaaacacaacactgtcgtcatgggctggcccaatggatggcgtcaatccgaggacgcccgcgcatggaagacattcattggaacagtacgcgtcactaccgccgcgcatcttgccctgctagtggccaagaatatctcattcttcccctccaatgttgaacagttctccgaggggaatatcgacgtgtggtggatagtgcatgatggaggcatgcttatgctgctgcccttcctgctgaaacagcataaggtctggcgcaaatgttctatccggatttttactgtggcccagcttgaagacaatagtattcagatgaaaaaagaccttgccaccttcctatatcacctgcgtatcgaagctgaagtggaggtcgtggagatgcacgattccgacatcagcgcctatacttacgagcggactctcatgatggagcagcgcagtcagatgctgcgccacatgagactgagcaaaactgagagggatcgggaagcgcagctagtgaaagaccggaactcaatgctccggctcacatccatcggctccgatgaagacgaggagaccgagacttaccaggaaaaggtccacatgacatggactaaggataagtacatggctagcagagggcaaaaagctaagagcatggaggggttccaggacctgctgaacatgagacctgatcagtcaaacgtccgacgaatgcacaccgccgttaagctcaacgaagtcatcgtcaacaagtctcacgaggcaaaactggtcctgctgaatatgccggggccaccgaggaatcctgaaggagacgagaattacatggaattccttgaagtcctaaccgaaggtcttgagagggtgttgcttgtgaggggtgggggcagcgaggtgatcacgatttattcatag

SEQ ID NO: 134783 - DNA, 3453 bp, Artificial Sequence
  Description of Artificial Sequence: Synthetic coding sequence
atgcatccaccagaaacaacaacaaagatggctagtgtaaggttcatggtgacaccaaccaagatcgatgacatacccggactgtccgatacatccccagatttgtcatctcgatccagtagcagagtcagattctctagcagggaatctgtccctgagacatcaagaagcgaacccatgtccgagatgtcaggagccaccacgtctctggccaccgtcgccttggaccccccttcagaccgcacttcccatccgcaggatgtgatcgaagacctatcacagaactcgataacaggcgaacactcccaactgttggacgacgggcataagaaggctagaaatgcatacctgaacaactccaactacgaagaaggagatgaatattttgataaaaacttggctctcttcgaagaggaaatggacacccggccaaaggtcagttctctactcaatcggatggccaactacacaaacttgacccagggagccaaggagcacgaagaggctgaaaacattactgagggcaagaaaaagcccaccaagacccctcagatgggaactttcatgggcgtgtacctgccatgtctgcagaatatcttcggagtgatcttgttcctccgcctgacatgggtcgtggggacggcaggggtgctccaggctttcgctatagtgctcatctgttgctgttgtacaatgctcaccgccatttcaatgagtgccattgcaactaacggcgtggtgccggccggcggcagctactttatgatttctcgggcgctcggacctgaattcgggggcgcggttgggctctgcttttacctgggcactacctttgcggctgcaatgtatatcctgggagccattgaaatattccttgtctacatcgtgcctcgggccgcaatatttcattcggatgacgccctcaaagagagcgccgctatgctgaataacatgagagtgtatggaaccgccttcttggtgctcatggtcctggtcgtcttcatcggcgtacgctacgttaataaattcgcctccctcttcttggcatgtgtgatcgtctcaattctggcgatctatgctggagccattaagagcagctttgccccgcctcacttcccagtatgcatgcttggcaatcgcactttgagtagtcggcatatcgatgtgtgctcgaaaacaaaggagattaacaacatgactgtacctagcaagctgtggggttttttctgtaacagcagccagtttttcaatgcaacctgcgacgaatactttgtgcacaacaacgttaccagcatccagggcataccagggttagcttcaggcatcatcacagaaaacctgtggagcaactatcttcctaaaggggaaatcatcgagaaaccatccgcaaaatcctcagatgttctgggcagtctcaaccatgagtatgtactggtggatataaccacttccttcactcttctcgtgggaatcttttttccatcagtcaccgggatcatggctggctccaataggtcgggtgatctgaaggacgctcagaagtcaattccaatcggcacaattctggctattcttacaacatctttcgtgtatctgtccaatgtcgtgctgttcggggcctgtattgaaggcgtcgttctgcgcgacaagtttggcgatgccgtgaagggaaacttggtcgtgggcactctatcctggccctcaccctgggtgatagttatcgggtcctttttttctacttgtggtgctggtctgcaaagcttaacgggagcgcctaggctgctccaggcgatcgccaaggacaacattattccgttcctgagggtctttggccatagcaaagctaatggagaacccacctgggccctgctgctcacagccgctatagcggagctgggcattctgatagctagccttgacttagtagcacccatactctctatgttttttctaatgtgctacctgttcgtgaatctggcatgtgccctccagacacttctgcgtacacccaattggagacccagattccgatattaccattgggccctgagtttcatgggcatgtcaatctgcttggcgctcatgttcatcagttcttggtactatgcgattgtcgctatggtgattgctggcatgatatacaagtatattgaataccagggtgccgaaaaggagtggggtgacgggatccggggactgtccctgagcgcagctcggttcgcccttctccggttggaagaaggacccccccacacaaagaactggcgaccacagctcttggtattgttgaagttggacgaagacctgcatgtgaaacacccacgccttctcacgtttgcctctcagcttaaagctgggaagggcctcactatagtcggttcggtcatcgtagggaactttctggagaattacggggaggctctggctgccgagcagacgatcaaacatctgatggaagctgagaaggtaaaaggattctgccagttagtggtggccgctaaacttagagaagggatcagtcacctaatccaatcctgcggcctcgggggcatgaagcacaacaccgtggtcatggggtggcctaacggttggcgccaatccgaagatgcccgcgcatggaagaccttcataggtaccgttagagtgacaaccgccgcccatctagctctgctcgtagctaaaaacatctctttcttcccttctaatgtggagcagtttagcgagggtaacattgatgtgtggtggatcgtacacgatgggggaatgttgatgctgttaccctttcttctgaagcagcataaggtgtggagaaagtgctccattcggatttttaccgtggcgcagctggaggataactctatccagatgaaaaaagacttggccacctttttgtaccatttgaggatcgaggctgaggttgaagtggtggagatgcatgactcggacatttctgcgtatacctatgaacgcacactgatgatggaacaacgctcccagatgctgagacatatgcggctgagcaaaacagagagagaccgggaggctcaattggtcaaggaccgaaactcaatgctgcggctgacatctatcgggagcgatgaggacgaggagactgagacataccaggagaaggtgcatatgacttggacaaaggataagtacatggcatctcgcggacagaaggctaagagtatggagggatttcaggacctgcttaacatgcgccctgaccagtccaacgtaagacgtatgcacacggccgtcaaattgaatgaagtcattgtaaataaatctcacgaggctaagttggtcctcctgaatatgcccggacccccacggaaccctgagggcgatgaaaattatatggaattcctggaggtcctgaccgagggtcttgaaagagtactgcttgtgcgaggtggagggtccgaagtcattacgatctatagttag

SEQ ID NO: 134784 - DNA, 459 bp, Artificial Sequence
  Description of Artificial Sequence: Synthetic coding sequence
atggcctccgtgagatttatggtaacgccgacgaagattgacgacatcccagggctgtccgacacttcccctgacctctcgtcacggagcagtagtagggtgcggttcagtagcagggagtctgtacctgagacctcccggtctgagcccatgtctgagatgtctggggcaaccaccagcctcgcaaccgtggcgctggacccacctagcgacaggacctctcaccctcaggatgtgatcgaggatctctctcaaaacagtataacaggtgagcatagccagcttctcgatgacggccataaaaaagctcgcaatgcttatctgaacaattcaaactatgaggaaggtgatgagtacttcgacaagaatctggccttattcgaggaggaaatggataccagaccaaaagtgagctcccttctgaacaggatggctaattacactaacctcacgcagtag

SEQ ID NO: 134785 - DNA, 3252 bp, Artificial Sequence
  Description of Artificial Sequence: Synthetic coding sequence
atgcctactaatttcacggtggtgccggtggaagcccacgcggacggtggtggggacgaaacggctgaacgcactgaagcacccgggacccccgaggggcctgaacccgagcgtccgagcccaggagatggtaacccgcgggagaatagcccatttctaaacaacgtcgaggtggaacaggagtctttcttcgagggaaaaaatatggccctcttcgaagaagagatggactcgaatcccatggtctcttctttgttaaacaaactagccaattatacgaatctctctcagggtgttgtagaacacgaggaggacgaggagtcccgcagacgcgaagcaaaagcacctcgcatggggacatttatcggcgtgtacctgccatgtctccagaatattcttggtgttattttgttcttacggctgacctggatcgtgggcgtagcaggggtcctggaatctttcctcattgtggccatgtgttgcacatgtactatgttaactgctattagtatgtccgcaattgcaaccaacggagtcgtgcccgccgggggatcgtattacatgatttcacggagtctgggcccagagttcggtggcgctgtgggtctatgcttttacctggggacaactttcgccggggccatgtatattctcgggacaatagaaatctttctgacatacattagtcctggagccgccattttccaagccgaagccgccggcggggaagctgccgcgatgctgcacaatatgcgcgtctacggtacatgcaccctggtcttaatggctctcgtggtgtttgttggtgtaaagtacgtgaataaactggccttggtgttcttagcttgcgtggtcctcagtattctggctatttacgccggtgtaattaaatcagcctttgacccgcccgatatcccagtgtgcctcttaggcaatcgcaccctgagtcggcgcagcttcgacgcatgcgtgaaggcgtacggcattcacaacaatagtgcgacttccgccttatggggtctgttctgcaatggcagccagccaagcgccgcctgcgatgagtatttcattcagaataacgtcaccgagatccaagggattcctggggcagcctctggcgtctttctggagaatctctggtccacttatgcccatgcaggggctttcgtcgagaagaaaggtgtgccatcagtgccggtggctgaggagtcccgagcctcggctctaccctacgtcctgacggacattgcagcatcgtttacactactggtgggcatttactttccatccgtaactgggatcatggctggctctaacagatctggggacttaaaggacgctcagaaaagcataccaaccggaacaatccttgcaattgttacaacttctttcatctatctgagctgtatagtcttatttggtgcatgcatcgagggcgtagtgctccgggacaaattcggcgaggctcttcagggcaatctggtgatcggaatgctggcttggccgagcccgtgggtgatcgtcattgggtcattcttcagcacttgcggagctggtctccagtccctgacgggcgctccaagacttcttcaagcaatcgcccgggacggaatagtaccttttctgcaggtatttggacatggcaaggctaacggggagccgacatgggcactgcttttaactgttttgatttgcgaaacaggaatcctaatcgcctcgttggattctgtggcacctatactgtccatgttcttcttgatgtgctacctgttcgtcaatctcgcctgcgccgtgcagactctgctgcgaaccccaaattggcgtcccaggtttaagttctaccattggactctgagttttttggggatgagcctgtgtctggcccttatgtttatttgcagctggtactatgctttaagcgcaatgctcattgctggctgcatctataagtatatcgagtataggggtgccgaaaaggagtggggagatgggattcggggactgagcctaaatgccgccaggtatgccctcctgcgtgtcgagcatggccctccgcacactaaaaactggaggcctcaggtgctggtcatgctcaatctcgacgcggaacaggctgtgaagcacccgagactgttgtcctttacaagccagctgaaggctggcaaaggtctgacaattgttgggtcggttttggaggggacctacctcgacaaacacatggaggcccagcgcgcagaggaaaatatccggtcactcatgtctacagagaagactaagggattttgccaactagtggtaagttcgtctctgcgggacgggatgtcgcatctcatacagtcagctgggcttggcggtctgaagcataataccgtgctgatggcctggcctgcctcctggaaacaagaggacaatccgttctcatggaaaaacttcgttgacacagtgcgcgacacaacggccgctcaccaggcactgttggtcgcaaagaatgtcgactcctttccacagaaccaggaacgcttcggtggggggcacattgacgtgtggtggatcgtgcacgatggtggcatgctcatgctactgccctttttgcttagacaacataaagtgtggaggaaatgccgcatgcgcatttttacagtggcccaggtcgacgataactctatccaaatgaagaaagatcttcaaatgttcctctatcatctcaggatctccgcagaggtcgaggtcgttgaaatggtggagaatgatatctccgccttcacttatgaacgcactctcatgatggagcagcggtctcaaatgctgaaacagatgcaactgtctaagaacgagcaggaaagagaagcccagctcatccatgatcgcaacacggccagtcataccgcagcagcagctcggacccaggcaccacctactccagataaagtgcagatgacctggacccgcgagaagctgatagctgagaagtaccgttcgagagacacctccttgtccggcttcaaggacctttttagcatgaagccggatcagagcaatgtccgcaggatgcatacggccgttaagctgaacggagtggtactgaataagtctcaagacgcccagctggtcctactaaacatgcccggcccacccaagaacagacagggggatgagaactatatggaatttctagaggtgttgacagaaggccttaaccgggtcctgcttgttagaggcgggggtagggaggtaattacaatatacagctag

SEQ ID NO: 134786 - DNA, 801 bp, Artificial Sequence
  Description of Artificial Sequence: Synthetic coding sequence
atgcctaccaacttcactgtggttccagtggaagcccacgccgacggagggggcgatgagactgctgaacggactgaagcccccggcactcctgaaggtcctgagcccgaacgaccttcgcctggtgatggcaacccacgtgagaacagtccttttttaaacaatgtggaggtcgaacaggagtctttctttgagggaaagaatatggcgctgttcgaagaggagatggattccaatcctatggtctcatccctgctcaataagctggcaaattatactaatttgtcccagggagttgttgagcatgaagaggatgaggagagccggcgccgtgaggccaaagctccacggatgggcacctttattggtgtctatctgccttgcttgcagaatattctgggtgttatcctcttcttaaggctcacttggatagtcggagttgccggggttctggaatcattcctgatcgttgcaatgtgctgtacatgcacaatgcttactgcaatatcgatgtctgccattgcaactaatggagtcgtgcccgccggggggagctactatatgatcagccgatctctgggacccgagttcggaggcgctgtagggttatgtttttaccttggaactactttcgcaggcgcaatgtatattctgggcaccatcgagatatttttaactgggacagaggacggagttggcagcctgggattaggtctggcccaaggaaatcgcaggcagacccacttaagtccaagcgatgccgcccaggcagcacacggggcctcttacggatctttctag

SEQ ID NO: 134787 - DNA, 3066 bp, Artificial Sequence
  Description of Artificial Sequence: Synthetic coding sequence
atggctgaacttcccaccacagagacaccgggtgatgccacactctgctcaggtcgcttcaccattagcactctgcttagcagcgatgagcctagccccccagccgcctacgactcgtcacatccttctcacctgacacacagttccacattttgtatgagaaccttcggctacaacactattgatgtggtaccaacttatgaacattacgcgaactcaactcagcccggtgagcccagaaaagtgcgcccgaccctagcagacttgcattccttcttgaaacaggaagggcgtcatcttcacgctctggcatttgatagtcggcccagtcacgagatgactgacggactggtggagggtgaagccggcacatctagcgagaaaaacccggaggaaccagtgcgatttggctgggtcaagggggttatgatacgatgcatgcttaatatctggggcgtcattctctatcttcgcctgccctggatcaccgcccaggcggggatcgtgctgacctggatcatcatcctcctgtctgtgaccgtgacatccatcacaggtctatcaatttccgctatatccactaacgggaaggttaaatcaggtgggacgtattttcttatttcccgaagcctcggcccagagctgggcgggagcattggtctgattttcgccttcgccaacgccgtgggcgtcgccatgcacactgttggtttcgctgaaaccgtacgcgacctgctccaggagtatggagctcctatagttgatcctattaacgatatccggattatcgctgttgtatccgtcacagtgctgctggccatttccctcgcaggaatggagtgggagtcaaaagctcaggtcctgttcttcctcgtgataatggtgtcatttgcaaactacctggtcggcacgcttattccccctagtgaggataaagcctcaaaaggatttttttcttacagggctgatattttcgtccaaaacctcgtgcctgactggagggggccagatggtacgtttttcggcatgttctcaatatttttcccctccgcaacaggaatcctggctggcgccaatatatctggagatcttaaagaccctgccatcgctattcccaaaggaacccttatggcaatcttttggacaacgatatcatacctcgctatctctgccactatcgggagctgcgttgtgcgggacgcttcaggcgtcttaaacgacacagtcactcctgggtggggtgcatgcgaggggcttgcttgcagttacggctggaatttcacagaatgcacacaacagcactcgtgccattatggactgataaattactaccagacaatgagcatggtgtctggctttgctcccctgatcactgccggaatctttggggcaactctctcctccgccttagcctgcctcgtgtccgccgccaaggtgtttcagtgcctgtgtgaggaccaactgtatcccttgattgggttttttggcaaaggttacggcaaaaacaaggagccagtcagaggctacctgcttgcgtacgccattgccgtggctttcatcatcatagctgagctgaacacgattgcgccaattatttcaaacttttttctgtgctcatatgccctgattaatttcagttgtttccatgctagcattacaaattcccctggatggaggcctagtttccagtactacaacaaatgggctgctctgtttggagctatcatcagcgtcgtgattatgttcttgctgacctggtgggctgccttgattgccattggcgtcgtgctgtttctcctactctatgtgatctacaagaagcccgaggtcaattgggggtccagtgtgcaagccgggtcatacaatctggcgctgtcctatagtgtcggacttaatgaagtggaggaccacataaaaaattatcggccccagtgtttggtgctgactggccccccgaactttaggcctgctttggtggactttgttggaacattcacgcgcaatctgagccttatgatttgcggccacgtgcttatcgggcctcacaagcagaggatgcccgaacttcaactgattgccaatggccacaccaaatggctgaataaaaggaagatcaaggcgttctacagcgacgtgattgctgaagacctcagaagaggagtgcagattttaatgcaggccgccgggctgggtcgcatgaagccgaacatattagtcgtgggcttcaagaagaactggcagtcagcccatcctgcaacagttgaagattacataggaattcttcacgatgcttttgattttaactacggagtctgcgtcatgcggatgagagaagggctgaacgtttccaagatgatgcaggcacacatcaatcccgttttcgaccctgccgaggatggaaaagaggcctctgcccgcgtggaccccaaggccctcgtcaaggaggagcaggcaacaacgatttttcagtccgagcagggcaaaaagaccatcgacatttactggcttttcgatgacggtggactcactcttcttatcccttacctgctgggacggaagcgccgctggtcgaagtgcaaaattagagttttcgtcggcgggcagattaacagaatggaccaggagcgcaaggctatcattagtttgcttagcaaattcagactgggatttcacgaggtccacatcttgcctgatataaatcaaaatcccagagctgaacacactaaacgcttcgaagacatgattgccccattccggctcaatgatggcttcaaggacgaggccacagtgaatgagatgaggagagattgtccctggaagatatcagacgaggagatcaccaaaaaccgtgtgaaaagcctgagacaagtcaggctcaatgaaattgtcttggattatagtcgggacgccgctcttatcgtgattacactgccaatcggaaggaaggggaaatgcccttcaagtctgtatatggcgtggttggagacgctttcacaggatttacgacctcctgtaatcctaatcagggggaaccaggagaatgtactcactttctactgccagtag

SEQ ID NO: 134788 - DNA, 3090 bp, Artificial Sequence
  Description of Artificial Sequence: Synthetic coding sequence
atggccgagctacccaccacggaaacaccaggggacgccacattgtgttcaggacgtttcaccatttcgacactcctttcaagcgatgagccctcccctccagccgcctatgacagctcacatccctctcacctgacccactccagcactttttgcatgcgaacctttggctataatacaatcgacgtggtacccacctacgaacattacgcaaatagtactcaaccgggggagccccgaaaagttcggcctactctggctgatctgcactcatttctcaaggagggtcggcatttgcatgcattagcttttgatagtcgccccagtcacgaaatgactgacggcctcgtagagggagaagccggaacgtccagcgaaaagaacccagaagaacccgtgcgcttcgggtgggtcaagggcgtaatgattcggtgtatgctgaacatctggggagtcattttatacctacggttgccttggatcaccgcgcaagcggggatcgtgctgacctggatcattattctgcttagcgtgactgtcacatccatcactgggctgagcataagcgctatctctacaaacggtaaggtcaaaagtggtgggacctatttcttgatctcacgttccctcgggcctgagcttggagggtctatcggcctgatttttgcattcgcgaatgccgtgggcgttgcgatgcacacagtggggttcgccgaaacagtgagagatctcctgcaggagtatggggcacccatcgtggaccctattaacgatatcagaatcattgcggtcgtgagcgtgaccgtactgctcgctattagccttgctgggatggagtgggaatccaaagctcaggtgctcttctttctggtgatcatggtgagcttcgcaaattaccttgtgggaaccctcatccctccatcagaggacaaggcatccaagggctttttcagctaccgggcggatatctttgtgcagaacctcgtgccggattggcggggaccagacgggaccttctttggtatgttcagcatcttcttcccttctgccacaggcattcttgcaggggcaaatatatcgggagacctcaaggatcctgccatcgcaatcccgaagggcacactgatggcaatattctggaccaccatcagctacttggcaatcagcgcgaccatcggcagctgcgtggtacgcgacgcctcgggcgtgcttaatgatacagtcacccccggctggggtgcctgcgaaggtcttgcctgtagttacggctggaacttcacagagtgcacccagcagcattcctgccactatggcctgattaactattatcaaacaatgagcatggtttccgggttcgcccctctgattacagctggaatctttggagccaccctgagtagcgctctagcttgtctagtgtctgcagccaaggtgttccagtgcctgtgcgaggatcagttgtaccctctgattggtttcttcggtaagggatatggaaagaacaaagagcccgttaggggatatctcctagcctatgctatcgccgtggccttcatcattattgcggaattgaacacaattgcccccattatctcgaattttttcttgtgttcctacgctctcataaacttcagctgttttcatgcaagtatcaccaactctcccggttggcgccctagtttccagtattataataaatgggctgctctctttggtgcaatcatttccgtcgtgataatgttcctgttgacttggtgggctgctcttattgcaatcggggtggtattgtttctgttgttgtacgttatctacaaaaagcctgaggtgaactgggggagttcagtccaagccggaagttataaccttgctctgtcctacagtgtcggactgaatgaagttgaagatcatattaaaaattaccgtccccagtgccttgtgctcaccggaccccccaacttcagaccagcactggttgacttcgttggcacgttcacccggaatctgtcattgatgatttgcggacacgtcctgattgggccccacaaacagaggatgcctgagttgcaactgattgctaacggccacacgaaatggctgaataagcggaaaataaaagcattctactctgatgtgattgctgaggatctgagaagaggagtgcaaatccttatgcaggctgctggtctgggacggatgaagccgaacatcctggtggtgggcttcaagaaaaattggcagtctgcacatccagccacagtggaggactatatcggcattctccacgacgcctttgacttcaactacggggtgtgtgtcatgaggatgagagaaggattaaacgtcagtaagatgatgcaggctcatattaatccagtttttgaccctgccgaggacggaaaagaggcatccgcacggggcgcacgaccttccgttagtggcgccctcgatcctaaggccctggtcaaagaagagcaagccacgaccatcttccagagtgagcaaggtaagaaaactatcgacatctactggctgttcgacgacggtgggctgacgctacttatcccttaccttcttgggcgtaagcggcgctggtcaaagtgtaaaataagggtgtttgtcggcggccagatcaaccgaatggatcaggagcggaaggcaatcatctcactgctaagcaaatttaggcttggattccacgaagtccacatcctgcctgatattaaccagaatccccgggcagaacatactaagcggtttgaagatatgatcgctccgttccgccttaatgatgggttcaaggacgaagctaccgtgaatgaaatgaggagagactgcccttggaaaatctccgatgaagaaattacgaagaatagagttaaatcgctgcggcaggttcggcttaatgaaattgtcctggactacagtcgcgacgccgctctaatcgttattaccctgccaataggaagaaagggtaaatgcccaagctcattgtacatggcctggcttgagacactcagccaggatcttaggccccccgtgatcttgattcggggtaaccaggaaaacgtgctcacgttctattgccagtag

SEQ ID NO: 134789 - DNA, 3093 bp, Artificial Sequence
  Description of Artificial Sequence: Synthetic coding sequence
atggcagaacttcccaccaccgaaactccgggtgatgctactttgtgctcaggccgcttcactatcagtacactgctgtcaagcgatgaaccatccccacccgcagcatacgatagctctcatccaagccatttaacgcactccagtactttctgcatgcgcacatttggatacaataccatagatgtggtacccacatacgagcattacgcaaactccacacaaccaggagagccaagaaaggtccggcccaccctggcggatctccattctttcctcaagcaggaaggaaggcatcttcatgcgctggctttcgacagccgcccttctcatgaaatgactgatgggcttgtggaaggggaggcagggacatcctccgagaaaaaccctgaggaacccgtcaggtttggttgggttaagggggtgatgatccgatgtatgctcaatatttggggtgtaatcctgtatctcaggttgccatggattaccgcccaggcgggaatcgttctgacttggatcataattcttctctctgtgacagttacttctatcaccgggttatcaattagtgccatctcaacaaacggtaaggtgaagtcaggcggcacttactttttaatctctaggtctctggggccagaactgggaggtagtattggcctgatcttcgcctttgccaatgcagttggggttgcaatgcacacggtcgggttcgcagagaccgtgcgcgacttgctgcaggaatatggggcccctatcgtggaccctataaacgacattcggatcatcgccgtggtgagcgtgaccgtgctgctcgccatttctctcgctggtatggagtgggaatcaaaggcccaggtgctgttctttctggttatcatggtgtcttttgctaactacctcgtcggtaccctgatcccgcctagtgaggataaagctagtaagggctttttcagttaccgagccgatatcttcgtccagaatctagtaccggattggcgggggccggatgggacatttttcgggatgtttagtattttctttccttctgcgaccggtatcctggctggggctaatattagcggggacttgaaagatccggccatcgccatccccaaggggacactgatggccatcttctggacaacgatctcctacctagctattagcgccaccattggttcatgcgtggttcgcgatgccagcggtgtgctgaacgacaccgtcactcccggctggggagcctgtgagggtctcgcttgtagctatggttggaattttacagagtgtacccagcagcactcatgtcactatggtctaataaactactaccagaccatgtccatggtatcggggtttgctcctctaattacagcggggatcttcggggctacattaagctctgccctggcatgcctggtgtccgccgccaaggttttccaatgcttgtgtgaagaccagctgtatccattaataggttttttcggtaaaggatatggaaagaataaagagcctgtgcgtgggtatctgctagcttacgctatagctgtcgcgttcattattattgccgagctcaacacaatcgcacctatcataagcaacttttttctgtgctcatatgccctgatcaacttttcatgttttcacgcttcaatcacgaactcaccagggtggagaccttcttttcagtattacaacaaatgggccgccctgttcggcgcaataataagtgtggtgattatgtttctgctaacatggtgggcggccttaatagcaatcggggtggtgcttttcctcctcctctacgttatttacaagaaacctgaagtcaactggggatccagtgtgcaggccggtagctacaacctggctctcagttactctgtgggtctaaatgaggtggaggaccatattaagaattatagaccccagtgtttagtgctgaccggcccccccaacttcaggccggctctggtcgattttgtggggacatttacgagaaatttgtccctcatgatatgtggtcacgtgttgattgggccccataagcagcggatgcctgaactgcagttgattgcaaacgggcatacaaaatggctgaataagcgtaagattaaggctttctactcagacgtgattgcggaagaccttcggagaggagttcaaattcttatgcaggcagccggtcttggtagaatgaagcccaacatactcgtcgtgggttttaagaaaaattggcagtcggcccatcccgccaccgttgaggactacataggcatcttgcatgacgctttcgatttcaattacggagtgtgcgtgatgcgcatgcgtgagggcctaaacgtgtctaagatgatgcaagcacatatcaatcctgtgttcgaccctgctgaggacggcaaagaagcatctgccaggggtgcacggcccagcgtctctggtgctcttgatcccaaagccttggtgaaggaagaacaagcaacaactatctttcagagcgagcagggaaaaaagaccatcgatatttactggcttttcgacgatggcggcctgacgcttttaatcccctacctgctgggacgaaaaagacggtggtccaagtgcaagatccgggtttttgtcggcggccagattaatcgtatggaccaagaacggaaggccattatctccctcctgtctaaatttcggctcggcttccacgaggtccacatccttccagatatcaatcagaacccacgtgcagagcatactaagaggttcgaggacatgattgccccctttagactcaacgacggatttaaggacgaagcaaccgtgaatgaaatgcgaagggattgtccctggaaaattagcgatgaggaaattaccaaaaacagagtgaaaagcctgcgccaagtgaggctcaatgagatagtattggattattcacgggatgctgcccttatcgttattaccctgcccatcggccgtaaaggaaaatgcccttcttccctgtacatggcgtggctggaaaccctatcacaggacctccgtccacccgttatacttataagaggcaaccaagagaacgtcctaacattctactgtcagtag

SEQ ID NO: 134790 - DNA, 3090 bp, Artificial Sequence
  Description of Artificial Sequence: Synthetic coding sequence
atggccgagttacctacgacggaaacgccgggtgatgccactctgtgctctggtaggtttactatttccacattactcagtagtgatgagccatcacctcctgcggcatacgactcctcacatccctcccatctgacacatagcagtacgttttgcatgaggacctttggctataataccattgatgtagtgcctacatacgagcattacgctaactccacccagcctggcgagccacgaaaagtgaggccgaccctggccgacttacattcctttctgaaggaaggcagacatttgcacgccctggctttcgatagcagaccctcacacgagatgactgatggccttgttgagggagaggccggaacatcgagcgagaagaatcccgaagaacctgtgcggtttggctgggtgaagggcgtgatgatccggtgtatgctgaacatctggggagttatcctgtatctccggctcccttggattactgcccaggccgggatcgttctgacctggattattattctgttgtccgtgacagtgacttctattaccggactgtccatctctgccatcagcacgaacggaaaagtgaagagcggcggtacttacttcctgatatctagatctcttggccccgagctgggcgggtccattggattaatcttcgctttcgccaatgctgtgggcgtcgcaatgcataccgtgggatttgcggagacagtgcgcgatttgctccaggagtatggtgcaccaattgtcgatcctatcaacgacattaggattatcgcagtggtgtcggttactgtgctgttggctatctcattggccggcatggagtgggagagtaaggctcaggtcttgttcttcctggtgatcatggtcagttttgccaattacctcgtgggcacactcatccccccgtcagaagataaagcttctaaagggttcttttcttaccgggccgacattttcgtgcaaaacctggttcctgactggcgcggccccgacggcacttttttcggcatgttctctatttttttcccatcagccaccggaattttggccggcgcaaatatctccggggatctgaaggaccctgcaattgccatccccaagggcaccctgatggcaatattctggaccaccatatcctatctggctatttctgcaaccatcgggtcttgcgtggtaagagatgccagcggcgtcttgaacgacaccgtcacgcctggatggggtgcctgcgaaggtctcgcctgttcgtacggttggaatttcacagagtgcacccaacagcactcatgccactacgggctgatcaactattatcaaaccatgtctatggtcagcggattcgcaccactgattacggctggcatattcggcgccactctcagcagcgctctcgcctgcttagtgtccgccgccaaagtgttccagtgtttgtgtgaggaccagctatatccgctaatcggattctttggaaagggatatggcaagaataaagagccagtgaggggctacctgctggcctatgctatcgccgtggcatttattatcattgccgagcttaatactatcgctcccattatcagtaattttttcttgtgcagttacgctctaatcaacttctcttgttttcacgctagcattacaaattctcccgggtggagaccctctttccagtattataataagtgggccgcactgttcggagccataatcagtgtggtaatcatgttcctactaacctggtgggcggccctgatcgccatcggcgtggtgctgttcctactcctctatgtgatctataaaaagccagaggtgaactggggttctagtgtacaagctggcagttataatctcgcactatcatattctgtcggtttgaacgaagtggaagatcacatcaaaaactataggccccaatgtctggttctcacagggcccccgaacttcagacctgccctcgtggatttcgtcggaaccttcacgcggaatttaagtttgatgatttgtggacatgtgctgatcggtccccataaacaaagaatgccggaactccagttaattgcgaatggccacacaaaatggctgaacaagcgcaagatcaaggctttctacagtgacgtgatagctgaagatttgaggcggggggtccaaatacttatgcaggcagcgggactagggagaatgaaaccaaacattctggtggtgggatttaaaaagaactggcagagtgcacacccagctacggtagaggactacatcgggatcctacatgacgcatttgatttcaactacggagtatgtgtaatgcggatgcgggaaggcctaaacgtcagcaagatgatgcaagctcatatcaatcccgtttttgaccccgccgaggatggtaaagaagcgtctgcccggggggccagacctagtgtctctggcgctcttgaccctaaggccctggtcaaggaagagcaggcaaccacgatctttcagagcgagcagggcaaaaaaacaatcgacatctactggctgtttgacgacgggggtttgaccttgctgattccctacctgctggggagaaaacgtaggtggagcaaatgcaagattagagtatttgtgggcggccaaatcaatcggatggatcaggagagaaaggctatcatttccctgctctccaaattcagattgggttttcacgaggtccacatcttacctgatattaaccagaacccccgagcagaacataccaagcggttcgaggacatgattgctccatttaggctcaacgatggttttaaagatgaggcgacggttaacgagatgaggagagactgtccatggaaaatttccgatgaagagattactaaaaatagagtgaaaagcctgagacaggtccgattgaacgagattgttctggactactcgcgcgatgccgccctgatcgtgatcacactgcccatcgggcgcaagggcaaatgtcctagctcactttacatggcctggttggaaactctaagtcaggacttaaggccaccagtcatactgatccgcggaaatcaggaaaacgtcctgaccttttactgccagtag

SEQ ID NO: 134791 - DNA, 1293 bp, Artificial Sequence
  Description of Artificial Sequence: Synthetic coding sequence
atgagcctaaacaacagctctaacgtgttcctggactcggtaccatcaaataccaacagattccaggtttcagtcatcaacgaaaatcacgagtcatccgccgcagcagacgataatacagacccaccgcactatgaggaaactagtttcggagatgaggcccaaaagcgcctccgcatctcatttcgtcccgggaatcaggaatgttacgacaactttctccaatctggcgaaacagccaaaaccgatgcgagctttcacgcctacgacagccatacaaatacatactatctgcagacttttgggcacaacacaatggatgccgttcctaagatagaatactatcggaacacgggctcgatcagcggaccgaaggtgaaccgcccgtcgctgttggaaatccatgagcagctcgccaagaatgtagctgtcacgccgagctccgccgaccgcgtggccaacggcgacggcatccccggggacgagcaggccgagaataaggaggatgatcaagctggcgtggtgaagttcggatgggtcaagggagtcctggtgcggtgtatgttgaatatctggggggtcatgctctttatcaggttatcctggattgtgggtgaagctggcatcgggttgggtgttttgatcatactgctctccactatggtgacgtcaatcaccgggctgtccacaagcgccatcgcaactaacggcttcgtgcgcggcggtggggcgtattacctgattagtagatccctgggacccgagtttgggggcagcattggcttgatcttcgcatttgccaatgctgtcgctgttgcaatgtacgttgtcggattcgccgagactgtcgttgaccttctgaaggagtccgactccatgatggtagacccaacgaacgacattcggataatcggctctattaccgtggtcattctccttggcatctccgtggcggggatggagtgggaagctaaggcccaggtgatattgctcgttatccttctcatcgctattgccaacttcttcatcggcactgtgattccatccaacaacgaaaaaaaaagtcgcggtttctttaattaccaagcttccatctttgcggagaacttcgggcctcgcttcaccaaaggcgaaggatttttttccgtctttgcaatattcttcccagccgctactggaattctcgctggcgctaatatttctggggatcttgaggccttgcggaaacagggcgctagcccccttccacagggcgctcagtcccgtcggagaaggcagaccagccttatttag

SEQ ID NO: 134792 - DNA, 3300 bp, Artificial Sequence
  Description of Artificial Sequence: Synthetic coding sequence
atgtcgttaaacaattccagcaacgtatttcttgacagtgtacctagcaataccaacagatttcaggtgagtgtaattaacgaaaaccacgaaagctccgctgcagctgacgacaacactgacccaccccactatgaggaaacctcatttggagacgaagcgcaaaagcgacttcggatctctttcaggccggggaatcaagagtgttacgacaatttcctacaaagcggcgaaactgctaagaccgacgccagctttcatgcctatgactcacacactaacacctactacttgcagacctttgggcacaacactatggacgccgtgccgaagatcgagtactaccgcaacacaggctcaatcagtggccctaaagtaaaccggccctcccttctggaaatacatgaacagctggctaagaacgtcgccgtgacacctagctccgcggacagggtcgccaatggagacggcattcccggcgacgaacaagccgaaaataaagaagacgatcaggccggggtggtgaaattcgggtgggtcaagggtgttctggtgaggtgcatgcttaatatatggggagtgatgcttttcatccggctctcttggatcgtaggcgaagctggcatagggctgggagttcttatcatcttgctatccacaatggtcacaagcattactggcctgagtacatccgcaattgcgacaaatggctttgtgcgaggtgggggcgcttactatctaatcagtagatcactaggcccggaattcggcggctcaattgggctcatcttcgccttcgcaaacgctgttgccgtggctatgtacgttgtcgggttcgccgaaacagtcgtagacctgcttaaagagtccgattccatgatggtggacccaactaacgatatcaggatcatcggatccattacagtagtgatcctgctggggattagtgttgccggaatggagtgggaagccaaagcccaggtgatcctgcttgttatccttctgatcgccattgctaacttcttcatcggcactgtgatacccagtaacaacgagaaaaaatcaagggggtttttcaattaccaggcctccatctttgcggagaattttgggccaagatttacgaaaggcgagggctttttctctgtctttgctattttttttccagccgccaccgggatactggccggagccaacatctcaggcgatctcgaagatccccaagatgccattcccagaggcactatgttggccatctttattacgaccgtggcgtatttgggcgtggccatttgcgttggagcttgcgtcgtccgggatgcaacagggaatatgaatgatacaataatatctggaatgaattgcaatggttctgctgcttgtggtctggggtacgacttcagccggtgccgccacgaaccatgccagtatgggctcatgaataacttccaggtaatgtccatggtgtcaggatttgggccactgattactgccggcatttttagtgctactctgtcctccgcattagcgagcctggtcagcgccccaaaggtcttccaagccctgtgcaaggataacatttacaaggcgctgcagttctttgccaagggctatggtaagaacaatgagccgctgcggggatatatccttacattcctgattgcaatggccttcattctgattgccgagctgaatactattgcccctatcatctcgaacttctttctggcctcctacgcccttattaattttagctgtttccatgcaagctatgcaaaaagcccaggctggaggcctgcctacggaatctataacatgtgggtgtccctgtttggggccgtactgtgctgtgcagtgatgttcgtcatcaactggtgggctgcagtgattacttacgtcattgaattcttcctgtatgtttatgtcacctgcaagaaaccggacgtcaactggggctcgagcactcaagccctctcttacgtttccgccctcgataatgccctggaactaaccactgtggaagatcacgttaaaaatttccgtccacaatgcatcgttcttaccgggggccccatgacacggccagctttattagacatcacgcacgcgtttactaagaatagcggtctctgtatctgctgtgaggttttcgtgggtcctcggaaactttgtgtaaaggagatgaattcgggcatggccaagaagcaggcctggctcatcaagaacaagattaaagcgttctatgctgcagtggccgctgactgcttcagagatggcgttcgctccttactgcaggcgtctggactcggtagaatgaaacccaacacacttgtgattggctacaaaaaaaactggagaaaagcaccactgacggagatagagaactatgtaggcattatccatgatgcctttgacttcgaaatcggggtggtaattgtccggatcagccaggggtttgacattagtcaggttttgcaagttcaagaagagttagaaagactcgagcaagagcgcctggcactggaagcaaccatcaaggataatgagtgcgaggaagagtctggcgggatccgaggactatttaaaaaagctggaaagctgaacattaccaagacgacaccaaaaaaggacggtagtataaacacctcccagtcgatgcatgtaggggagttcaaccagaaactggtcgaggcctccacgcagttcaagaaaaaacaggaaaaagggacaattgacgtctggtggctattcgatgacgggggtttgaccctgctgattccatatatcctgacccttcgtaaaaaatggaaagactgtaaactgcgaatatacgtcggcggaaagatcaatcgcattgaggaggaaaagatcgtcatggcatcattgctcagtaagtttcgcattaagttcgctgatatacatatcatcggtgacataaacatcaggccgaataaggagagctggaaagttttcgaagagatgatcgagccctaccggctccacgagtcctgcaaagaccttaccacagcagagaagctcaagcgcgaaaccccttggaagattactgacgctgagctggaagctgtaaaagagaagagctacaggcaagtaagattgaacgagctgcttcaggagcactccagagctgccaacctcatcgtgttaagcttgccagtcgctcggaaaggctcaatttccgatttgctgtatatggcctggttggagattttaaccaagaacctccccccagtgctcttggtgagagggaaccataagaacgttctgacattctactcctag

SEQ ID NO: 134793 - DNA, 3300 bp, Artificial Sequence
  Description of Artificial Sequence: Synthetic coding sequence
atgagcctcaacaacagttccaacgtgttcctggatagcgtgccatctaacacaaatcggttccaagtatctgtgatcaatgagaaccatgaatcatccgctgcagctgacgataatactgacccaccacattatgaggagacatcctttggcgatgaagcacagaaaaggctcagaatttcttttagacctggcaatcaggaatgctatgataacttcctccagtcaggagaaaccgccaagactgacgcctcgttccacgcatatgactcccacacgaacacctattatctgcaaactttcggacataacacgatggacgctgtccctaaaatagagtactatcgaaacactggttccatttccgggcccaaagtgaaccggccgtctttgctcgagattcacgagcagttggcaaagaacgtggccgttactccatcgtcagcagatcgagtcgccaacggcgatggaataccaggggacgaacaggcagaaaacaaagaggatgatcaggcgggggttgtcaagttcggctgggtcaagggggtcttggttagatgcatgttaaacatatggggagtcatgctgtttattagactatcttggattgtgggtgaggctggcattggactgggggtcatcatcattggactctccgtggttgtcaccaccctgaccggcatctctatgagcgccatctgtaccaacggagtcgtgcgcgggggcggagcctactatttaatttccagatccctcggcccagagttcggtggctccatcggcctcatattcgcctttgcaaacgcagtggcggtggctatgtatgtagtgggcttcgctgaaaccgtagtggacctccttaaagaaagcgatagcatgatggtcgacccaacgaacgacatccgaattataggcagcattacagtggtgatactgctcgggatcagcgtagccggaatggagtgggaggccaaagctcaggttatcctgttagtaattctcttaatcgctatagccaacttctttataggaactgtgattcctagtaataacgaaaagaaatctagaggcttctttaactaccaggcctcaatcttcgcggagaattttggcccaagatttacaaagggggagggctttttctccgtgtttgccatcttcttccccgccgcgaccggcatcctcgcaggggcaaatatctccggggatcttgaagatcctcaggacgccattcctcgcggtacaatgctagcaatttttatcaccaccgtggcttatctcggtgtagcgatctgtgttggcgcttgcgtggtgagggacgcaacaggcaacatgaatgacacaataattagcggcatgaactgcaatggctccgcagcgtgcggactggggtatgacttttccaggtgccgacatgagccctgtcagtatggtctcatgaataattttcaagtgatgagcatggtcagtgggttcggtcccttgatcactgcaggcatcttttcagcaacgctatcaagcgccctcgcctcactcgtgagcgctccaaaggtgtttcaggcactgtgcaaggacaatatctataaagctctgcagtttttcgctaaggggtacggcaagaataatgaacctctgcgcggctacattctcacattcttgatcgctatggctttcattttgatcgccgaactaaacacaatcgctccaattatttccaatttctttcttgcctcctatgctcttatcaacttctcatgctttcatgccagctatgcaaaaagtccaggatggagacccgcatacggcatttataacatgtgggtgagtctgtttggagccgtactttgctgcgccgtcatgttcgtgattaattggtgggcagccgttattacctatgtgattgaattctttctctacgtgtatgtgacctgcaagaaacctgatgtgaattggggatcttcaactcaggcgctgtcttatgtgtcagcacttgacaatgccctcgaactcactaccgtggaagatcacgtgaaaaacttcaggcctcagtgcattgtactcaccgggggcccgatgacaaggcccgcacttcttgatattacgcacgccttcaccaagaattctggactctgcatctgctgcgaggtgtttgtgggacccagaaagttatgtgtgaaggagatgaattccggtatggcaaaaaagcaggcatggctgattaagaataagatcaaggcattttacgccgctgttgctgcggattgtttcagggacggcgtaagaagtcttcttcaagcttccggtctgggacgcatgaaaccaaatacattagttatagggtacaagaaaaattggcggaaggcacccctcacagagatcgagaattacgtgggaatcatacacgacgcattcgatttcgaaataggagtggttatcgtgaggataagccagggctttgatatttcacaggtcctgcaggtgcaggaagagctggaacgactggagcaagaaagactcgccctggaggccacaattaaagacaacgaatgcgaggaggagagtggtggtattagaggactgttcaagaaggccggcaagctgaatatcaccaagactaccccaaaaaaggacggaagtataaacacctcccagtcgatgcatgttggagagtttaaccagaagttggtggaagcgtcgacacagttcaaaaaaaaacaggagaagggcactattgacgtatggtggctgttcgatgacggtgggttaactctgctgatcccttatattctaaccctgagaaaaaagtggaaggactgtaaacttagaatctatgtggggggaaaaattaaccgcatcgaggaggaaaaaattgtaatggctagtttactctccaaattccggattaaatttgccgacattcacatcatcggcgacataaatattagacctaataaggaaagttggaaagtttttgaggagatgattgagccttataggctgcacgaaagctgtaaggacctgactacagctgaaaaactgaagcgcgaaactccatggaagataacagacgctgagctagaggcagttaaggagaagtcctacaggcaggtgcggctgaacgaactgttgcaggaacacagcagagcggccaacctcattgtgctttcattacctgttgcacgaaagggaagtatttccgacctcctatatatggcctggcttgaaatcctgacgaagaacctccctccggtccttctggtgaggggcaaccacaaaaatgtgttgactttttactcttag

SEQ ID NO: 134794 - DNA, 1782 bp, Artificial Sequence
  Description of Artificial Sequence: Synthetic coding sequence
atgctgaatatctggggagttatgctgtttataaggttaagttggatcgtaggagaggcgggaattggcttgggagtcttgattatcctgctgtcgactatggtgaccagtattaccggtctttctaccagcgccatcgcgaccaatggatttgtccgtggaggcggagcgtattatttgatcagcaggtccctcggcccagaatttggtgggtcaatcggcctgatctttgctttcgccaatgccgttgccgtggctatgtatgtagtgggcttcgccgaaacagtcgttgatctgctcaaggagtccgattccatgatggtggacccgactaacgatatacgaatcatcggatccatcaccgtcgtcattctcttaggaatcagcgtggcaggtatggagtgggaagctaaggcccaagtgatcctactggtaattctgctcattgcaattgccaattttttcatcggtacagtgattcctagcaataatgagaagaagtctcggggattctttaattaccaagcctccatttttgcggaaaattttgggcctagattcaccaagggcgaaggattcttctcagtctttgcaattttttttccagctgcaacagggatccttgccggggctaacatctcgggagatctggaagatccccaggacgccatacctaggggtactatgttggccatctttattaccaccgtcgcttacttgggagtcgctatttgtgttggcgcctgcgtggtgcgtgatgccactggaaatatgaacgataccataatcagtggtatgaattgcaacggcagtgcggcctgcggacttgggtacgatttttcaagatgcaggcacgaaccctgccagtatgggctgatgaataactttcaagttatgtccatggtaagtgggttcggcccacttattacagctggaatcttttctgcaaccttgtcttctgcattggcgagtcttgtgtctgccccgaaggtcttccaggctttgtgcaaggataacatctacaaggccctccagtttttcgcaaagggttatgggaaaaataatgagccactgcgtggatatatcctcacatttctgatcgccatggcctttattcttattgccgaactaaataccatcgcaccaatcatcagtaactttttcctggcctcttacgcgctgattaatttctcttgctttcatgccagctacgctaagagcccgggctggcgacccgcttatggtatctacaatatgtgggtcagcctgttcggagcagtgctgtgctgtgctgtgatgtttgttatcaactggtgggccgcagtaatcacttatgtgattgagtttttcttatatgtgtatgttacttgtaaaaagccggatgtcaactggggctctagcactcaagccctcagctatgtctccgcccttgataatgcactggaactgaccaccgtagaggatcacgtgaagaattttcgaccccagtgcattgtgcttacaggcgggccaatgacgcgacctgcccttctggacattacacacgcttttacaaaaaactcagggctttgtatctgctgtgaggtgtttgtcggtcctcgcaaattgtgcgtgaaagaaatgaattctggtatggctaagactggcctggcctataaggagcagaatcaggggtttctgtgttgctcaggcggccggttattccagggatggtgccctaaatcaagttctgggttgaggttacgcaagaatgagacaaagcactctggtgattggatctag

SEQ ID NO: 134795 - DNA, 540 bp, Artificial Sequence
  Description of Artificial Sequence: Synthetic coding sequence
atgagaacaatgcgagcagtacagctgcaaatgactatcctgacacaccatatcatgaagaaaccccttctaggcatgaaactccggaaggatagcgagtcggcattgggcttaggaatccgtagtgcgatgacaataagttctaagcaagcactgtcatacgtgtcagccttggataacgctctcgagctgaccaccgttgaggaccacgtgaagaatttcagaccccaatgtattgtcttgacgggagggcccatgactaggcccgccctgctggacattacccacgccttcaccaagaattccggactgtgcatttgttgtgaggtcttcgtgggtcctcgcaagctgtgtgtgaaggagatgaactctgggatggccaaaaaacaagcttggttaatcaagaataagatcaaagctttctacgctgccgttgcggctgattgtttcagggatggcgtaagaagcttgttacaggcctccgggctgggtaggatgaagcctaacaccttggtgatcggatacaagaagaactggtag

SEQ ID NO: 134796 - DNA, 3300 bp, Artificial Sequence
  Description of Artificial Sequence: Synthetic coding sequence
atgtcattgaataacagttcgaacgtttttctagactctgtcccgagtaacaccaatcgatttcaggtgtcagtgatcaacgagaaccacgaatcaagtgcagcagctgatgataacaccgacccaccacattacgaggagacgtcctttggcgatgaggcgcaaaaacggttgaggatttcctttcggccaggaaatcaggagtgctatgataactttctgcagagcggggagaccgctaagaccgatgcctcattccacgcgtacgactcccacactaacacttactatctgcagacgtttgggcataacacgatggacgccgtaccaaagattgaatactaccgcaatactggttccattagcggacccaaagttaaccgcccctctctcctggaaatacatgagcaattggccaaaaatgttgctgtgacaccaagcagcgcagatcgcgttgctaatggcgatgggattcccggagatgagcaggcagagaacaaggaggatgaccaggctggcgtggtcaaattcggctgggtcaaaggggtgctggtgcgctgtatgctcaatatatggggtgtgatgttgttcatccgcctctcctggatcgtgggcgaggcggggataggtttgggagttctgatcattttgcttagcacgatggtgactagcatcacggggctgtccacaagtgccatagctactaacggcttcgtgagagggggcggtgcatattatctgataagcaggagccttggcccggagtttggaggtagtataggtctgatcttcgcctttgccaatgccgtcgctgtggccatgtacgtggtgggattcgctgagactgtggttgacctgctgaaagagtcagattcaatgatggtggacccgactaatgacatcaggatcatcggaagcatcactgttgtgattctcctgggtataagtgtggcaggcatggagtgggaagcgaaagcccaggtgattctgctagttatcttgctgatcgcaattgccaatttttttatcggaacagtgattccatcaaataatgagaaaaaatcacgggggtttttcaactatcaggcctccatcttcgctgaaaactttgggccaagatttacaaaaggcgagggcttcttttctgtatttgctattttttttccagcagccacaggaatcttagccggcgcgaacatcagcggagatctggaggatccccaggacgccattccaaggggaaccatgctggccatttttatcactacagtggcttacctgggggtggcaatttgcgttggagcttgcgtagtgagggacgccactggaaacatgaatgacaccattatcagcggcatgaattgcaatggttcagcagcatgtgggttgggctacgatttctcccggtgtcggcacgagccctgccagtacgggttgatgaacaatttccaggtaatgtcaatggtgagtggttttggaccactgattaccgcaggtatcttctcagctactctcagttctgcccttgccagtcttgtgtcagccccaaaagtgttccaggccttgtgtaaagataacatctacaaggcactccagttcttcgctaaaggttacggtaagaataatgagccactgagaggctacattctgacattcctcattgcaatggcgtttatcctaattgcagagctgaatactattgctccaatcatttctaacttcttcctggcttcctatgcgctcatcaatttcagttgttttcacgccagctatgcaaagtcaccaggctggagacctgcatacggaatctataacatgtgggtatccttatttggcgcagtgctgtgttgcgcagtcatgtttgtgattaactggtgggcagccgtcatcacttacgtgatcgaattttttctttacgtgtacgtgacttgtaagaagccggatgtgaattggggcagctctacgcaggcgctgtcttacgtatccgcactggacaatgctctggaactcacaactgtggaggaccacgtgaagaatttcaggccgcagtgtatagtgctgaccggtggacctatgacaagaccagctctgcttgacataactcatgccttcactaagaactctggcttgtgcatttgctgcgaggtgtttgttggcccccgaaagttgtgtgtcaaggagatgaactccggtatggcaaagaagcaggcatggttaataaaaaacaagataaaggcattttatgcagccgttgccgctgattgtttcagggacggcgtcagatcacttctgcaagcctctggcctgggccgaatgaagccaaataccctagtaatcgggtataagaaaaattggaggaaggcacctctgaccgagatagaaaattacgtgggcataatacatgatgcctttgattttgaaataggcgtggtgattgtgcggatatcccagggcttcgacatctctcaggttctccaggtacaggaagagttggagcgcctggaacaggagagactggcactggaggcaactatcaaggacaacgaatgtgaagaagaaagcggcggcattaggggactgttcaaaaaagccggcaaattgaatatcactaagactacaccaaagaaagacggatcaatcaacacctctcaatccatgcacgtgggcgagttcaatcagaagcttgttgaggcgtccacacaattcaagaaaaagcaagaaaaagggaccatagacgtctggtggctattcgacgatgggggccttaccttactcattccctacattctgacgttgcggaaaaaatggaaagattgtaagttgcgaatctacgtaggcgggaagattaatagaatcgaggaggaaaagatcgttatggcaagtttgctgagcaagtttaggatcaaatttgccgacatacatatcatcggtgatataaatattcgaccaaataaagaatcttggaaagtgttcgaagagatgattgagccttaccggctccatgagagttgcaaagatctcaccaccgccgagaaactaaagcgtgagactccttggaagatcacagacgccgagctggaagccgtgaaagaaaaaagttatcgacaagtacgcctgaacgaactgctccaggagcattcccgggctgctaatcttatcgttctatcactgccggtggccagaaaagggtctatctcagacctgctatatatggcctggctcgaaattcttactaagaacctgccaccagtgctgttagtgcgaggaaatcataagaatgtgcttaccttttactcctag

SEQ ID NO: 134797 - DNA, 1947 bp, Artificial Sequence
  Description of Artificial Sequence: Synthetic coding sequence
atgctaaacatttggggggttatgctctttattaggctgtcctggattgttggcgaggcaggcatcggccttggcgtgctcatcatccttctgagtaccatggttacatccattaccggcctctcgacctccgcaatagccactaatggcttcgtgcgcggaggcggggcttactacttaatttctagaagtcttggccctgagttcggcgggagtatcggattaatctttgcctttgctaatgctgtggctgtagccatgtacgttgttgggttcgccgagactgtagttgatctgctgaaggagtccgattcgatgatggtggatccgacaaatgacattaggatcattggaagcattacagtggtgatccttcttggtatttccgttgccgggatggagtgggaagctaaggcacaggtgatactgctggtaatcctgttgattgcaatcgccaacttctttattggaactgtaatcccctctaataatgaaaagaagagtaggggtttctttaactatcaggcctctatcttcgctgagaattttgggccaagattcacaaaaggagaaggctttttttccgtttttgccatttttttccccgccgccacaggtattttagccggggctaatatatccggtgatctggaagatcctcaggacgcaatacctcgaggcaccatgctggccattttcattaccaccgtcgcttacctcggcgtcgccatctgcgttggcgcatgcgtcgtgcgagatgccacgggaaacatgaatgataccataatctcgggaatgaactgcaatgggagcgcagcctgtggcctcggatacgatttctcccgctgtcgccacgagccatgtcagtacggcctgatgaacaattttcaagttatgagcatggtctccggattcggccccttgataactgcagggatttttagtgcgacgctgtcttccgccttggcttctctcgtgtccgccccgaaagtgtttcaggcactttgtaaggacaatatctataaggccctccagttcttcgctaagggctacggtaagaataatgaaccactccgcgggtatattctaacgtttttaatagcaatggcgtttatcctcatcgcggagctgaacactattgctcctattatctcaaacttctttctggcttcatatgcactaattaacttttcatgctttcatgccagctacgctaaaagtccaggctggcgccccgcatacggaatttacaacatgtgggtcagcttgttcggcgccgtcctatgctgcgccgtcatgttcgtgatcaactggtgggccgccgtgattacctatgtcatcgagttctttttgtacgtttacgtcacctgtaaaaagccagacgtgaactggggtagttcaacacaggcactaagctatgtttcagcactagataacgctctcgaactgacaacagtggaggatcacgtaaagaattttagaccccaatgtatcgtcctaaccggcggccccatgacaaggcctgcccttttggacatcacacacgccttcacaaagaacagcgggctgtgtatatgttgcgaagtattcgttggaccacggaagttatgtgttaaggagatgaactctggaatggccaagaaacaggcctggctgattaagaacaaaatcaaggccttttacgccgcagtggctgccgattgcttcagagacggggtgagatcacttctccaggcttccggcctggggaggatgaagcccaataccttagtgatcggttacaaaaaaaactggcggaaagcccctttgacagagattgaaaattatgtcggtatcatccacgatgcctttgacttcgagataggcgtcgtgatcgtccgcattagccaggggtttgatataagtcaggtcctgcaggtccaggaggagctcgaacgcctggagtag

SEQ ID NO: 134798 - DNA, 3639 bp, Artificial Sequence
  Description of Artificial Sequence: Synthetic coding sequence
atggaacctagacccactgcccccagttcaggggccccaggtctggctggagtgggtgaaacacccagcgcagccgcattggcagcagcgcgagtggaactgcccggtactgcagtgcctagcgtgcctgaggacgccgcccccgctagccgtgacggcgggggcgtcagagacgaggggcccgcagcagccggcgacggtctggggagacccctgggacccaccccatcacagtcacgcttccaagtcgatctggtatcagaaaatgccggtcgtgccgccgcagccgctgcagcagcagcagccgccgcagccgcagctggtgctggggctggggcgaagcagacccctgcagacggcgaggcgagtggagaaagcgagcccgcaaagggatccgaagaggccaagggacgtttccgcgtgaattttgtggatccagctgcctctagcagcgcagaggattcactgtcggatgcagctggagtgggtgtcgatggcccaaacgtgtcctttcaaaacggcggcgataccgtcctctctgagggcagctctttacactctggagggggtggaggctctggacaccatcagcattactactacgatactcacactaatacatactaccttcgcacattcggacataacactatggacgccgtccctagaattgatcactatcgacatacagccgcccagctgggcgagaaattgctaaggccctcactggcagaactccacgatgaactggagaaggaaccttttgaggacggctttgccaacggggaagaatctactcctactagagacgcggtcgttacgtacacagctgagtcgaaaggcgtcgtaaaattcggctggattaaaggcgtactcgtgcggtgcatgctgaatatatggggggttatgcttttcattcgactgtcctggatcgtgggccaggccgggattggtctctccgtcctggtgattatgatggcaaccgtagtgaccactattaccggtctgagtacctccgcaattgcaacaaacggtttcgtaagggggggcggtgcctactacctcatcagccgttctctggggcctgagtttggcggggcaattggcttgattttcgcattcgccaatgcagttgctgtggcaatgtatgtggtggggtttgctgaaaccgtggtcgagcttctcaaagagcacagcattctgatgatcgatgagatcaatgacatccgcattatcggagcaattacagtagtgatcttgctaggaatcagcgtggcaggaatggagtgggaggccaaagcccaaatcgttctcctggtgattctactcctcgctattggagattttgtgataggcaccttcatccctctcgaatctaaaaagcccaaggggttctttggttacaaatctgagatttttaatgagaacttcggacctgattttcgtgaagaggagacgtttttctccgtcttcgccatctttttccccgctgccactgggattctggccggggctaatatttcgggagacctggcagaccctcagtccgccattcctaaaggtaccctgctggctatcctgattacaacgctggtgtacgttggaatcgctgtttcagtgggcagttgtgtggtgagagacgctacagggaatgtaaacgacaccatcgtgaccgaattgaccaattgtacatccgccgcatgcaagcttaacttcgacttcagtagctgcgagagctcaccctgttcttatggcctcatgaacaactttcaggtgatgtctatggtttcaggctttaccccgctcatctcagccgggatttttagcgctaccctatctagcgccctggcaagccttgtcagcgctccaaagatctttcaggcgctgtgcaaagacaatatctatcccgcctttcagatgttcgcgaaagggtacggaaagaataacgaaccacttagggggtatattctaacattcctcatagctctaggctttattttaatcgccgaactcaacgtcatcgcccctattatttccaacttttttctggcctcctacgctctcatcaatttctccgttttccatgccagcctggccaaaagcccaggttggcggcccgcctttaaatattataacatgtggatttcgctcctcggagccatcctgtgttgtatcgtcatgtttgtcatcaactggtgggcagccttgttgacatacgttattgtactaggactctacatttacgtgacatataagaaaccagacgttaattgggggagctctactcaagctctgacatatctcaatgccctgcaacatagcattaggctgtcaggggtggaagaccatgttaagaactttcgcccccagtgcctggtcatgactggtgctcctaacagccgacctgcgttactgcatttggtccacgacttcactaagaacgttggcctgatgatttgcggccacgtgcatatggggcctcgcagacaggcgatgaaagagatgtccatcgaccaagccaagtaccagagatggcttatcaagaacaagatgaaggcattttacgcgcctgtgcacgccgacgatttgcgcgagggtgctcaatacctgatgcaggctgccggactcggacgcatgaagccgaataccctggttttaggattcaaaaaggactggcttcaggccgacatgcgggatgtggacatgtacattaatcttttccatgacgcctttgacattcagtatggtgtggtggtcatccgactaaaagaaggtttggacatctcccatctgcagggtcaggaggaactgctatcttctcaggagaaaagtcctggcacaaaggatgtagtggtgtcagtagagtactcaaagaagtcggatcttgacacatccaaacccctgtctgagaagcccattacccacaaagtggaggaagaggacggcaagaccgctactcagcccttattaaaaaaagaaagcaagggacctattgtcccattaaacgttgcagatcagaagctgctggaggcctcaactcagttccagaagaagcagggcaaaaataccatcgatgtatggtggctctttgatgacggcggactcaccctgctgatcccttatctgttgacgaccaaaaagaagtggaaggactgcaagattcgggtgttcatcggcggcaagatcaatcgaattgaccacgatcgccgcgccatggctacactgctaagtaagttcaggatcgattttagcgacataatggttttaggagacattaataccaagcctaagaaggaaaacatcatcgcattcgaggagatcatcgagccatacaggctgcacgaagacgacaaggaacaggacattgccgataaaatgaaggaagacgagccttggcgcattaccgataatgagctggaactgtataagactaagacataccgtcagattaggctcaatgaattgctcaaagaacattccagtaccgccaatattatagtcatgtctctacctgtggctaggaagggcgctgtatcttccgccctctatatggcatggctggaggcattgtctaaagatctgcctccgattctattggtccgcgggaatcaccagagcgtgctgacattttattcttag

SEQ ID NO: 134799 - DNA, 3591 bp, Artificial Sequence
  Description of Artificial Sequence: Synthetic coding sequence
atggagccccgccccaccgcgccctcttcgggcgctccaggcctggcgggtgttggtgagacaccttctgccgccgctctcgcggctgctcgcgttgagctccctgggaccgcagtgcctagtgtgcccgaagatgctgccccagcctctagggatgggggcggagtaagggacgaaggacccgcagctgctggtgatggactcggacgccccctgggccctacgccctctcaaagccggttccaggtggacttagtttccgagaatgccggccgggccgccgccgctgctgctgctgccgccgccgctgcggcagcagcaggcgctggcgcaggggctaaacagactcctgcagacggggaagcatctggcgagtctgaaccagcaaagggctctgaggaagccaagggccggtttcgagtgaattttgtagaccctgctgccagctcaagtgctgaagactctctcagtgatgccgcaggagttggggtggatggcccaaacgtaagtttccagaacgggggcgacactgtgctcagcgaggggtcctcattgcatagtggcggtggcgggggctccgggcaccaccaacattattattacgatacgcacacgaacacctattatttgcggacatttggacacaacacgatggatgcagtcccaagaatcgaccattatagacacaccgctgcacagctgggggagaagttactccgcccctccctcgctgaattgcacgatgagcttgagaaggagccttttgaagatggctttgctaatggcgaggagagtacccctacaagagacgccgtcgtgacctatactgcggagtctaaaggcgtggtgaaattcggctggataaaaggcgtactggtgagatgcatgctgaatatttggggtgtaatgttgttcataagactgagctggattgttggccaggccgggatcggactcagcgtgctcgtgatcatgatggcaacagtagtgaccactatcactggcctcagcacaagcgccatcgccacaaacggctttgttagaggggggggagcctattatctcatctcaagaagcctggggccggaattcggcggcgctattggtctgattttcgcattcgcaaacgcagtcgcggtcgcgatgtacgttgtgggcttcgccgagaccgtggtcgagctgctaaaagagcacagcattctgatgattgacgaaattaacgacatccgaattattggagccataacagtggtgattttgctgggcatttctgttgctgggatggaatgggaagcaaaggcacaaatcgtattgctggtaatccttttattggctattggcgatttcgtgatcggcacatttataccactggagagcaagaagccgaaaggtttttttggttacaagagcgagatattcaacgaaaactttgggccggactttcgtgaggaggaaacattttttagcgtctttgctatcttttttcccgcggctaccggcatactcgccggagcaaacatctctggagatttggctgacccacagtcggccattccgaagggcacgctactcgctattttgattacaaccctggtttacgtcgggatcgccgtgagtgtcgggtcatgcgttgtccgagacgccacaggcaatgtgaatgacacaatcgttaccgaactgactaactgcaccagtgccgcgtgtaagttgaatttcgattttagtagttgtgagtcttctccctgcagctacggactgatgaacaactttcaggttatgtccatggtcagcggatttactccgcttatcagtgccgggatcttcagcgctacgttatcatccgctctggcttctttagtgagtgcaccgaagatttttcaggccctttgcaaggacaatatctaccccgcctttcagatgttcgccaaagggtacggcaaaaataacgagcccctccgtgggtatattctcacattcctgatcgcactgggtttcatccttattgcagagctcaacgtcattgctccaattatctccaattttttcctggcaagttatgcacttataaatttttcagtgtttcacgccagtctggcaaagtcaccgggctggcgccccgccttcaagtattacaatatgtggatttctctgttaggcgccattctgtgctgcatcgtgatgttcgtaattaactggtgggccgctcttttgacctacgtgatcgtgctgggtttatatatttacgtcacctacaagaagccggatgtcaactggggttccagtacccaggccttaacctacttgaatgccttgcagcactcgatcaggctttccggagtggaggatcacgtgaaaaacttcagacctcagtgcttagtgatgacgggagccccaaacagcagacccgcgcttctgcatctggtccatgacttcacaaagaatgtgggcctcatgatttgcggacacgtgcacatggggcccaggagacaggccatgaaagaaatgagcatagaccaggcaaaataccaacgctggcttatcaaaaataagatgaaggctttttatgctccagtccatgcagacgatttgcgagaaggagcacaatacctgatgcaggcggctgggttgggaaggatgaagccgaatacattggtgctgggattcaaaaaggactggctgcaggctgacatgagggacgttgacatgtatatcaatctttttcacgacgcatttgatattcaatatggagtggtggttatcagactgaaggaaggcctggatatctctcacctgcaaggacaggaagagctcttgagctcacaggagaaatccccaggaacgaaggacgtcgtcgtcagcgtcgagtacagcaagaaatctgatctggacacgagtaaacctctgtccgagaagccaatcacacataaagagtccaagggcccaatcgtgcctctgaatgtggccgaccagaaacttctcgaagctagtacacaatttcagaagaaacaaggtaaaaatacaattgacgtgtggtggctgttcgatgatggcgggctgaccctcctgatcccctacttgctgaccaccaagaaaaagtggaaagattgtaagatcagagtgtttatcgggggtaaaatcaaccgcatcgatcacgaccgcagagccatggccacactcttatccaagtttcgaatcgacttttccgatattatggtgctgggtgatattaacaccaagcctaaaaaggagaacatcattgcatttgaggagataattgaaccatacaggcttcatgaggatgataaagaacaggatattgccgataagatgaaggaggatgagccatggcgaatcactgacaacgagcttgagctctacaaaactaaaacttacagacagatcagacttaatgagttgctgaaagaacacagctcgactgccaacattattgtaatgagcctgccggtcgcaaggaagggagctgtaagttccgccctgtatatggcatggctcgaggctctctccaaggatcttcctccaatcctgcttgtgcgtgggaaccaccaaagcgtgctgacattctatagttag

SEQ ID NO: 134800 - DNA, 1788 bp, Artificial Sequence
  Description of Artificial Sequence: Synthetic coding sequence
atgaagttctttagctacatattggtttatcggcggtttttgtttgtcgtcttcactgtgctggtacttcttcctctcccaatagttctccatactaaggaggccgagtgcgcctacacactgttcgtggtcgctacattctggctcaccgaggctctgcccttgtcggttactgcgctattgccgagtctcatgctgccaatgtttggcataatgccaagtaaaaaagtggcatccgcatactttaaagacttccaccttctcctgatcggagttatctgtctggctaccagtatcgagaaatggaaccttcacaaacgtatagctctgaaaatggtaatgatggtaggtgtcaatccagcatggcttaccttaggcttcatgagttcaaccgccttcttgtccatgtggctgtcaaacacctcgacagccgccatggtgatgcctattgccgaggctgtcgtccagcagatcattaatgcagaggccgaagtcgaggcaacccaaatgacctacttcaatgggagcacaaaccatgggctggagatagatgagtccgttaatgggcatgagattaacgagcgtaaagagaaaaccaaaccagtgcctggctacaacaacgacactgggaagatatcgtctaaagtggagctcgagaaaaactccggtatgcgtaccaaataccgcacgaaaaagggacacgtgacacgcaaactcacgtgcctgtgcatcgcctacagtagcaccatagggggactgacgacgattacaggcacaagtactaacctgatctttgccgaatactttaatacccggtaccccgactgccggtgcctgaacttcgggagctggttcactttcagctttcccgcagcgcttattatattgttattgtcctggatatggctccagtggctattcctgggcttcaactttaaggaaatgttcaaatgtgggaaaactaagactgtccagcagaaggcatgtgcagaagtgattaaacaagaatatcagaagctggggcccatccggtatcaggaaattgtcactttggtcctctttatcatcatggcattactctggttcagcagggaccccggattcgtgcctggctggagcgcattattctcagaatatcctggcttcgccacagattcaacagtcgcactgctgatcggcctgctgttcttccttatccccgctaaaactttgactaaaacaactccaacaggggaaatagtcgcgtttgattatagccccctcattacgtggaaagagttccagtccttcatgccctgggacattgcgattttggtcggaggcggttttgctctggcagatggttgtgaggaatccggtttgagcaagtggattggaaacaaacttagtcctctgggctccctgccagcctggctgattatcctcatttcaagcctcatggtgacaagcctcacagaagtggcatccaaccccgccaccatcaccctgtttctccccattctttctccgctggcagaagccatccacgtgaaccccctttacattctcatacccagcacactgtgtacatccttcgcgttcttgctcccagtggctaaccctcccaatgcaattgtgttctcctacggacacctcaaagtgatcgacatggttaaggccggcctcggggttaacatcgtgggcgtggcagtggtcatgctgggaatctgcacgtggattgtgcccatgttcgatctttatacataccccagctgggctcccgcaatgagcaacgaaacgatgccttag

SEQ ID NO: 134801 - DNA, 486 bp, Artificial Sequence
  Description of Artificial Sequence: Synthetic coding sequence
atgctgcctatgttcgggataatgccatccaaaaaagtggccagcgcttacttcaaggacttccatctgctgctcattggcgtgatatgtctggctacgtccatcgaaaaatggaacttacacaagcggattgctttgaagatggtcatgatggtgggagttaatcctgcctggttgactcttggattcatgtcatcaactgcctttctctctatgtggctttcaaacactagcactgcagcaatggttatgccgattgcagaggctgttgtgcagcagattatcaacgctgaggctgaagttgaagcaacacagatgacgtacttcaacggctccaccaaccacggtcttgagattgacgaatcagtgaacgggcatgagattaacgagaggaaggaaaaaactaagcccgttcctggctataacaacgacaccggaaaaattagctcaaaagttgaactggagaagtacctccaggtaagatag

SEQ ID NO: 134802 - DNA, 1881 bp, Artificial Sequence
  Description of Artificial Sequence: Synthetic coding sequence
atgggtctgcttcaggggctccttcgtgtcaggaagctgctgttggtggtttgtgtccctttgctcctgttgcctctgcccgtcctacacccctcttcagaggcatcatgtgcgtacgttctaatcgtaacagcagtctattgggtaagtgaagccgtcccccttggtgccgccgcgctggtgccagcattcctatatcccttttttggtgtgctgcgaagcaacgaggttgcagcggaatactttaaaaacacaacactgctcctcgtaggtgtgatatgcgtcgccgccgcagttgagaagtggaacctgcacaagcgcatcgcactgcgaatggtgctaatggcaggcgcgaaacctggtatgctgcttctttgtttcatgtgttgtacgacattgttgtccatgtggctgtctaatacatcaaccactgcaatggtgatgccaatcgttgaggctgtgctccaggagctggtaagtgccgaggacgaacagctggtggctggaaacagcaacaccgaagaggccgagccaatcagtcttgacgttaagaacagccagccttctctcgagctgatcttcgtaaacgaggagtcgaatgctgatttgactacgctgatgcacaacgaaaatcttaatggcgtgccctctatcacgaatccaataaagacagctaatcagcatcaaggtaaaaaacagcatccatcacaggagaagccacaggtgttaaccccatctcctaggaagcagaaactgaaccggaagtacagatcgcaccacgatcagatgatctgtaaatgtcttagtctttcgatctcctatagcgccacaatcgggggtctgactacgatcataggcacaagtacgagcctcatctttctggaacatttcaacaaccagtacccagccgcagaggtagttaactttggaacctggttccttttcagtttcccaatatcactgattatgctagtcgtgagttggttctggatgcattggttgttcctagggtgtaacttcaaagagacctgttccctgagtaagaagaaaaaaacaaagagggagcaactgagcgagaagcgcatccaggaagagtacgagaaattaggcgacatttcctaccctgaaatggtcaccggttttttttttattctgatgaccgtgttgtggttcacccgcgagcctgggttcgtacctggctgggattccttcttcgagaaaaagggctacagaaccgacgctaccgtgagtgtgttcttaggattcctgttattcttgattccagcgaagaagccctgctttggaaagaaaaacgatggcgaaaaccaggagcattctctggggactgagcccattattacttggaaagacttccagaagacgatgccttgggagatcgtgattctggttggaggcgggtatgccctggcctctggatccaaatcaagtgggctgtcaacctggatcggaaatcagatgttgtcattatcttcactccctccctgggccgtgacccttctggcctgtatactcgtatccattgtgaccgagttcgtgtccaaccctgccaccatcaccatcttccttcctatcctgtgctccctatccgagaccttgcacattaaccctctatatacgctcatccccgtcacaatgtgcatttcctttgccgtgatgctgccagtgggcaatcctcctaacgcaatcgtattcagctacggacattgccagataaaagacatggtgaaggctgggttgggcgtaaatgtcatagggttagttatcgtgatggtcgctattaacacatggggggtgtctcttttccatctggacacctacccagcgtgggcccgggtctccaatataacggaccaggcatag

SEQ ID NO: 134803 - DNA, 1569 bp, Artificial Sequence
  Description of Artificial Sequence: Synthetic coding sequence
atggcctccgctcttagttacgtatccaaatttaagtcatttgtgattttatttgtaacgccattgttgctgctgccactagtcattctgatgccggccaaattcgtcagatgtgcgtacgtcattattctaatggccatctattggtgcactgaggttattccattagccgttacttctctcatgcctgtgctgctgtttcccttattccagattttggatagtcgccaggtctgtgtacagtatatgaaggatacaaacatgctgtttctgggcggtcttatcgtcgcggtggcggtcgagcgctggaatctgcacaaacgaatagccctcaggaccttgctctgggtgggagccaagcccgctcgcctcatgctgggctttatgggagtgaccgccttgctgtccatgtggatctcaaacactgcaaccacagcaatgatggtacccatagtggaagccattcttcagcaaatggaggcaacatcagctgccacagaggccggactggaactggtggataaaggtaaagccaaagagctgcctggctcacaggttatttttgagggccccactctcgggcaacaggaggaccaggagcgcaaaagactgtgcaaagccatgacactctgtatttgctacgcagcttccatcggaggcactgctactttgaccggaacagggcccaatgtggtgctgcttgggcagatgaatgagttgtttccggactctaaggacctcgtcaatttcgcatcttggttcgccttcgcctttcctaacatgttagtgatgctgttgttcgcatggttatggctgcagttcgtttatatgcgtttcaactttaaaaagagctggggctgcggcttggagagtaagaagaatgagaaggcggcactcaaagtcctgcaggaggaataccggaagctgggcccactcagctttgccgagattaatgtgctgatctgcttcttcctgcttgttatcctttggttttcacgcgatcctgggtttatgccaggctggctgacagttgcgtgggtcgaaggggaaacgaagtacgttagcgatgccaccgtcgccatcttcgtcgccacactccttttcatcgtaccttcccaaaagcctaaatttaactttcggagccagaccgaggaggagcgcaagactccattctatccaccacctttactggactggaaagtgacacaagaaaaagttccttggggaatagtgttgcttctggggggcggatttgccctggccaaggggtcagaggcgagcgggctctctgtatggatggggaaacagatggagccactccacgccgttccaccagcagcaatcactctgattttatcacttcttgtggcggtctttacagaatgtacgagtaacgtcgcaacaaccacgttgttcttgcctatttttgcatccatggtaaagaccggagtgattatgaatataatcggcgtgttctgcgtgttcctggctgttaatacatggggcagggccattttcgacctggaccattttcctgattgggccaacgtaacccacatcgagacctag

SEQ ID NO: 134804 - DNA, 1707 bp, Artificial Sequence
  Description of Artificial Sequence: Synthetic coding sequence
atggcgtcagccctgagctatgtctccaagtttaagtcctttgtaatattgtttgtgacccccttactgctgctccctctggtgatcttgatgccagccaagttcgttcggtgtgcctacgtgatcatcctcatggcgatctactggtgcactgaagtcatccccctggccgtcacatctctgatgcccgtcctgttattccccctgtttcagatattggatagtcgtcaggtttgtgtgcaatacatgaaagacaccaacatgttatttcttgggggcctgattgtggctgtagcagtggaacgctggaatctgcacaaaaggatagccctcagaactctcctttgggtgggcgcgaaacctgcacgtcttatgctggggtttatgggagtgacagccttgctgtccatgtggatctccaacaccgccactaccgccatgatggtgcccattgtcgaggcaatcttgcagcagatggaggcgacctctgcagctaccgaggcaggcttggagctggtggacaagggaaaagctaaagagttgcctggctcgcaagttattttcgagggccctactctgggccagcaggaagatcaggagaggaaaaggctgtgtaaagccatgaccctatgcatttgttacgcagcctccatcggtgggaccgcgacgctaaccgggacggggcctaatgtggtgcttttagggcagatgaacgagctgttcccagactctaaggatttggtaaacttcgcatcctggttcgccttcgcctttcccaacatgctggtgatgctcctctttgcctggctgtggctgcaatttgtgtatatgagatttaactttaagaaatcctggggctgtggtttggaatcgaagaagaatgagaaggcggcactgaaggtgttacaggaagaatacaggaagctcggtcccctgtcctttgccgagataaacgtgctaatttgcttcttcttgttggtgatcctctggtttagtagggatcccggattcatgccaggctggctgactgtcgcgtgggttgagggcgagaccaagtacgtatccgacgctactgtggcaattttcgtagccacattactttttattgtgccgtcgcagaagcccaaattcaactttcgttcgcagacggaagaggaacggaaaactcctttctatccccccccgctgcttgattggaaggtcacccaggaaaaagtgccttgggggatcgtccttcttttaggcggcgggtttgccttggccaagggatccgaggcctctggcttaagtgtttggatgggcaagcagatggagccgctgcacgcagtgcccccagccgctatcacactgatattatcgctgcttgtggcagtctttaccgaatgcactagtaatgtcgcaactaccacgcttttcttaccaattttcgcctcaatgagcaggtcaatcggtctgaatcccctttacatcatgcttccctgcacactttctgcttcgttcgcttttatgttgccggtagctacaccacccaatgcgattgtgttcacatatgggcacctcaaagtggccgatatggtcaagacgggcgtgatcatgaatatcataggtgtgttctgtgtgttcttggctgttaatacctggggccgtgctattttcgacttggatcacttccctgattgggccaacgtcacacatattgaaacctag

SEQ ID NO: 134805 - DNA, 1578 bp, Artificial Sequence
  Description of Artificial Sequence: Synthetic coding sequence
atggcatccgcactgagttatgtctccaaatttaagagctttgtcattctgttcgttacacctctcctgctgttgccccttgtcattctgatgcccgccaaagtttgcgttcagtatatgaaggatactaacatgctgttccttggggggcttattgtagccgtagcagtcgagagatggaacctgcacaagcgaatcgcacttagaactctgctgtgggtgggagcaaaacccgctaggcttatgctgggtttcatgggggtaacagcactcctgtcaatgtggatctccaacacagccactactgcgatgatggtccccatagtggaagctattctgcaacagatggaggccacttcagctgccaccgaagccggcctggagctcgtggataagggaaaagccaaagaactgcccgggagccaagtgattttcgaggggcctaccctcggccagcaggaggaccaggaaaggaagcggctgtgcaaagcaatgaccctgtgtatatgttacgccgctagcattggagggaccgccaccctgactggaaccgggccaaacgtcgtcctgttagggcagatgaacgaattgttccctgatagcaaggaccttgtgaacttcgcaagttggtttgcattcgcttttccaaacatgctggtaatgctgctctttgcgtggttgtggttgcagttcgtatatatgaggtttaattttaagaaatcctgggggtgcggcttggagagtaaaaagaacgagaaagcagcactcaaagttctgcaggaggaatacagaaaattggggccactaagtttcgctgagattaatgttctgatttgttttttcctgctcgtgatcttgtggtttagccgagatcccgggtttatgcccggttggctgacagtcgcctgggtggagggagagacaaagtatgtctctgacgccacagtggctatattcgtagctacgctactgtttattgttcccagtcagaagcccaagtttaactttagaagccaaacagaagaagagagaaagactcctttttatcctccacccctgctcgattggaaggttacccaagagaaagtgccttggggaatagtgcttttactaggaggaggttttgcactggccaagggctctgaagcatctggcctctcggtgtggatgggcaagcaaatggaacctttgcatgctgttccccctgctgcaatcactttgatacttagcttgctcgtcgcagtctttaccgagtgtacctccaatgtggctactaccacgctgttcctgcctatattcgctagcatgtctcggtctatcggactgaatcctttgtatatcatgctgccatgtactctctctgcatcgttcgcctttatgctcccagtggccactccaccaaacgccatcgttttcacctatggccacctcaaagttgccgatatggttaaaactggtgttataatgaacatcattggtgtgttttgtgtgtttctagctgtgaacacttggggacgggctattttcgatttggatcactttcccgattgggccaacgttacccacattgaaacatag

SEQ ID NO: 134806 - DNA, 1569 bp, Artificial Sequence
  Description of Artificial Sequence: Synthetic coding sequence
atggccagcgctttgtcatatgtatcgaaattcaagagcttcgttattctgtttgtcactcctctcctgttgcttcctttggttatcttgatgcccgcaaagttcgtgagatgtgcatacgtgattatcttaatggccatctactggtgcactgaggtcatcccgctggccgtcacatccctcatgcccgtgttgttgttccccctgttccagatcttggatagtcgccaagtatgcgtgcagtatatgaaggacaccaatatgctatttctaggaggactgatcgtcgccgttgccgtagagcggtggaacctgcacaagcgcatagccctgagaaccctgttgtgggtgggggcaaagcctgctagactaatgctcggttttatgggcgtgacagctctgctctctatgtggatttctaatactgccacaactgcgatgatggtcccgattgtcgaagccatccttcagcagatggaggccacctccgcagccactgaagcggggctggagttagtggacaaaggtaaagcaaaagagctgccagggtcacaggtcatatttgaaggccccacactaggacagcaggaggatcaggaaagaaagcgcctctgcaaggcaatgaccctgtgcatttgctacgccgcctctattggcggaacagccaccctgacaggtacgggtccaaatgttgttttgttagggcagatgaatgagctgttccccgattcaaaggatcttgtgaattttgcaagctggttcgcctttgccttcccgaatatgctggtaatgctgctcttcgcctggctgtggttacagttcgtgtacatgcggttcaattttaagaaatcgtggggctgcgggctggagtcaaaaaagaacgagaaggctgcactcaaggtgctgcaagaggagtatcggaagctgggtccgctgtcatttgcagagatcaacgtgctgatctgcttcttcctcctcgttattctgtggttttccagagatcccgggtttatgcccgggtggctcacagtagcttgggtggaaggcgagaccaagtatgtaagcgatgccacagtcgcaatttttgtggccaccctgctttttatcgtgcccagccagaaacccaaatttaactttcggagccagactgaggaggagcggaaaacaccgttttaccctccccccctcttagactggaaggtgactcaggaaaaagtgccttggggtatcgttttgctcctgggtggcggcttcgctctggcaaaagggagcgaggctagtgggctatccgtttggatggggaaacagatggaacctttgcatgctgtgccaccagctgccattacactgatattgtctcttttagtggccgtttttaccgagtgtacttccaatgtggctacgaccacactgtttttaccaatcttcgcctccatggtgaagacaggggtgattatgaacatcatcggagtcttttgtgtgttcctcgctgtcaatacctggggccgagcaatcttcgatctagatcatttccccgactgggctaacgttacacatatagagacgtag

SEQ ID NO: 134807 - DNA, 1779 bp, Artificial Sequence
  Description of Artificial Sequence: Synthetic coding sequence
atggctacttgttggcaggccctatgggcataccgatcctacctgatcgtgtttttcgtgccaatcttgctgctgcccctccccatcttagtacccagtaaggaggcgtattgcgcttatgctattattctcatggcactcttctggtgtaccgaagctctgcccctggccgtgacggctttgtttccactgattctatttcccatgatgggtatcgtggatgcaagtgaagttgccgtggagtacctcaaggactccaatctgctgttcttcgggggtctgctggtggcaatagctgttgagcactggaacttacacaagagaattgccctgcgggttcttctcatcgtgggagtgagaccagcccctttgatcctgggattcatgttggtcacggcgtttctctctatgtggatctccaacactgcaacttccgccatgatggtgcccattgcccacgccgttttagaccaactgcacagctcacaggctagtagcaacgtagaagaaggttccaataaccccacttttgagctccaggagccaagtccacaaaaggaagtgacgaaattggataacggacaggcactgcccgtgaccagcgcgtcctctgagggcagagcccacctcagccagaaacacctccacttgacgcaatgcatgagcttatgcgtctgttactctgcatctattggaggtatagcaacccttacgggaaccgcccctaacttggtgctgcagggacaaattaactctctgttcccgcagaacggaaacgtggtgaatttcgcttcatggttttcattcgctttccctaccatggtcatcctgttgctcctcgcttggttgtggctccaaatcctattcctggggttcaatttccgaaagaacttcggaatcggtgagaagatgcaggagcaacagcaggccgcctactgcgtgattcaaacagagcacaggctgttagggccaatgacatttgccgagaaggccatctccatcctcttcgttatccttgtgctcctatggttcaccagggaacctggcttcttcctcggctggggtaacctggcatttcccaatgccaagggcgaatcaatggtgtccgacggtaccgtggcaatctttatcggcatcatcatgttcatcattccctccaagtttccaggtctgacccaagaccccgagaacccaggcaaactgaaggcccccctcggtctgcttgactggaagaccgtcaaccaaaaaatgccttggaacatcgtgctgctgctgggtggtggttacgcattggccaaaggttccgagagatccggcttatccgagtggctgggaaacaagttaactcctctccagagtgtccctgcccctgcgattgccatcatcctgtcgctgctagtggctacgtttactgaatgcacctcaaatgtagcaacaaccaccatcttcctgcctatactggcctcgatggcccaggccatctgcttgcaccctctgtacgtgatgttgccctgtaccctagcgacgtcattggccttcatgttgccagtagctactccgccgaatgctatcgtcttttcattcggcgatctgaaagttctggacatggcaagggccggctttctgcttaacataattggtgttttgatcatcgccctagccattaattcttgggggattcccctcttttctctccattcgttcccctcttgggcccagagcaacactactgcccaatgtttgccatccctcgctaatacaaccacgccctctccctag

SEQ ID NO: 134808 - DNA, 1926 bp, Artificial Sequence
  Description of Artificial Sequence: Synthetic coding sequence
atggctacctgttggcaagctctgtgggcgtatcgttcttacctgattgtcttcttcgtccctattctgttattgcctttacctattctggtgccatctaaggaagcttattgtgcttatgccatcatcttgatggcgctgttctggtgcaccgaggccctgcccctcgccgttactgccctttttcctctgattctgttcccgatgatggggatcgtggatgcatcagagatcatccaaaggcccttcccctcgtctttcgagtccccgggcgagtgccagtctgtggggatgtcagtgacagcctcgcacaacctgggaggaacagtgggcgatagtcgggtatttccccctttgtcccacgtgtccacttgccaggtagctgtcgaatacctgaaagattcaaatctgcttttcttcggcggactcctcgtggcgatcgccgtggaacactggaatctgcacaagagaatagcccttcgcgtgttgctgattgttggggtgcgtcccgctcccctaattttgggcttcatgctggttactgccttcctctccatgtggatttcaaatacagcaacctctgccatgatggtccccattgctcatgctgtgcttgatcagctacatagcagccaggcctcttctaacgtagaggagggttccaacaacccgacctttgaactacaggagccatcccctcagaaagaagtgacgaagctggacaacgggcaggccttgcccgtcacttcagcctcaagcgaaggccgagctcacctctcccagaaacaccttcatcttactcagtgcatgagtctttgcgtctgctactctgcctcaattggtggcatcgctacgttaacgggaactgctcctaatctcgtcctgcagggacaaatcaatagtctgttcccccaaaatggcaatgtggttaacttcgcttcatggtttagcttcgctttcccgacaatggtaatactactgctgttggcctggctctggctgcaaatcctctttttgggttttaattttaggaaaaactttggcatcggcgaaaaaatgcaggagcagcaacaggccgcctactgcgtgatccaaacggaacacagattgttaggcccaatgacctttgccgagaaggccattagcatcttgttcgtcatccttgtgctgctctggttcactagggaaccgggttttttcctgggctggggaaacttggctttccctaacgccaagggcgaaagcatggtctctgatggcactgtcgctatatttatagggatcatcatgttcattatccctagtaagttccctggactgacccaagaccctgaaaatcctggcaaattaaaagctccactgggtctcttagattggaagaccgtcaaccagaagatgccctggaatattgtgctcctcctgggcgggggttacgccctggccaagggatctgagcgctcaggcctgagcgaatggctcggtaacaagttaactcccctccagagcgtgccagccccagcgatcgcaattattctgtccctcctggtcgccacattcacagaatgcacttcaaacgttgccacgacaaccatattcctcccaatcttggctagcatggctcaggccatttgcctccatcccttgtacgtaatgctgccatgtacgttggcaacaagcttggcatttatgctgcccgtggccacgccacctaacgcaattgtttttagctttggcgatctgaaagtgctcgacatggcccgggccggcttccttctgaacataatcggcgtgctgatcattgctctggcaatcaactcatggggaattccactgttcagcctgcacagctttcctagttgggctcagtctaacactacagctcaatgtctaccttctctggccaatactactacacccagtccgtag

SEQ ID NO: 134809 - DNA, 1566 bp, Artificial Sequence
  Description of Artificial Sequence: Synthetic coding sequence
atgccagtttgtggcaatgtcgcagtggaatacttgaaagactcaaacctgctctttttcggggggcttctagtggccattgctgtggagcattggaaccttcacaagcgaatagctctgcgtgtgcttttaatagtgggcgtgcgcccagctcccctgattctggggttcatgttggtcacagcattcctaagtatgtggatctccaatacagccaccagcgcaatgatggtgcccattgcccacgctgtgcttgaccagcttcacagttcacaggcatcatctaacgtggaagagggttccaacaaccccaccttcgaactgcaggaaccctcaccacagaaagaagttaccaagcttgataacggccaggctctgccggttaccagcgcttcgtctgagggacgggcccacttatcccagaagcatcttcacctcactcaatgcatgtctctctgtgtgtgctactcagcaagtataggaggcattgctaccttgacggggacggcacctaatctggtcttacaaggacagattaactccttatttccccagaatggaaacgttgtaaatttcgcttcctggttcagcttcgccttccctaccatggtgatcctgctcttattggcctggctgtggctgcaaattctttttcttggattcaacttccgtaagaattttggcattggcgaaaagatgcaagaacagcaacaggccgcctattgcgtgatccagacggagcatcgtctgctggggccaatgaccttcgcggaaaaggcaatctcaatcctctttgtgattttggtcctgctctggtttacgagagaacccggcttctttcttgggtgggggaacctggcatttcccaatgctaaaggagaatctatggtctccgacggaacggtggccatctttattgggataatcatgttcattatcccatccaaatttcccggcctgactcaagatcctgagaatcctggaaagctcaaggcccctctgggcttactggattggaaaactgttaaccagaagatgccgtggaatatcgtgctcctccttgggggcgggtacgccctcgccaaaggttccgagagaagtggattgtccgaatggttaggcaacaaactgacccccctgcagtctgtgccggctcccgctattgccatcattttgagtttgctagtggccacctttactgagtgtacgtccaatgtggccactactaccatctttctgcctatcttggcctctatggcgcaagcaatatgcttgcatccactttacgtgatgctgccgtgcactctggccacatcattggctttcatgttgcctgtggcaacccctccgaatgccatagtgttttcgttcggggatctcaaagtgttggacatggccagagcagggttccttctgaatatcatcggggtgctgattatagctctggctataaacagctggggaatccctctgttctctctccactcattcccttcatgggcccagtccaataccactgcccagtgcctaccgtctctcgcaaacaccaccactcccagcccttag

SEQ ID NO: 134810 - DNA, 1035 bp, Artificial Sequence
  Description of Artificial Sequence: Synthetic coding sequence
atggccctgttttggtgcactgaggcactgcctctggcggtgactgcactctttcccctgatcctattcccaatgatgggaatagtcgacgcaagtgaagtcgccgtcgagtacctcaaggattccaacctgctttttttcggggggctgctagtcgcgatcgccgtcgagcattggaacttgcacaaaagaattgcgttgcgggtcctactgatcgtcggcgtgcgaccagccccactgatcctggggttcatgctggtgacggccttcctcagcatgtggatctctaatactgcgacatctgcaatgatggtccctatcgcgcacgcggtgctcgatcagctgcattccagtcaggcttctagcaatgtggaggagggctcaaataatcccaccttcgagttgcaggagcctagcccacagaaggaagtgaccaagcttgacaacggccaggcactgccagtgacttctgcctcttccgagggcagagcccacctttcccagaaacacctccacctgacacagtgcatgtctctgtgtgtctgctattcggcatccatagggggaattgcaactctaaccgggactgccccaaaccttgtgctgcagggacagataaatagcctgtttccgcaaaatggcaatgtggtgaactttgcgagctggttttcctttgcctttcctacgatggtaattctgctcctcttggcctggctttggctacagatcctattcctgggattcaattttagaaaaaactttggtatcggagagaagatgcaggagcaacagcaggctgcctattgcgtgatccagaccgagcaccgcttgctcgggcccatgacctttgccgagaaagctatttcaatcctgtttgtgattctggttttgctgtggtttactagggaaccggggttcttctggcttgggcaatttgggttctcccaatgccaaggcggggaagtcagggtcgctggggtgggccgacggactcacctgggcttgacctgctcgggccggagagagggttattag

SEQ ID NO: 134811 - DNA, 1650 bp, Artificial Sequence
  Description of Artificial Sequence: Synthetic coding sequence
atggcaacatgttggcaagctctttgggcttaccggtcttaccttatcgtgtttttcgtgccaattttactcctgccactgcctatcctcgtgccgtcgaaggtggccgttgaatacctgaaggattcaaacttgctgtttttcggaggactgctggttgccattgccgtcgagcattggaacttgcacaaacgcatcgccctgagagttcttctaatagtgggtgtaagacccgcccctctgattcttggtttcatgctggtcacagctttcctatccatgtggatatctaatacggcgacctctgccatgatggtgcccatcgcccatgccgtgctggaccaacttcacagctcccaggcgtcgagcaatgtcgaagaagggagcaacaaccctacctttgagctccaggagcccagccctcagaaagaggttacaaagctggacaatggacaggcactcccagtgacgtctgcctcatctgaagggagagcgcaccttagtcagaagcacctgcacctcacccaatgtatgagcttgtgcgtctgttattctgcttcaatcgggggtattgccaccctcacaggtaccgcacctaatctggtgttgcaagggcagatcaatagtctgtttccacagaacggcaacgtggtgaacttcgcaagctggttcagctttgcgttccccaccatggtgatcttgttgctgctggcctggttgtggctgcaaatattattcctgggcttcaacttcagaaagaacttcggaattggggaaaagatgcaggaacagcagcaagccgcatattgcgtgatccagacagagcaccgactcttaggacctatgacctttgctgaaaaggcaatctctatattgtttgtgatactcgtccttctctggtttaccagggagcccggctttttcctcgggtggggaaaccttgccttccctaatgcaaaaggagaatctatggtgagcgatgggacagtggccatttttatcggtattattatgttcattatccccagtaaattcccaggcctgactcaggatcccgagaaccctggtaagcttaaagctccactgggcctactggattggaaaaccgtcaaccagaaaatgccctggaatatagtgcttctactggggggcgggtatgctttggcgaagggcagtgaaagatctggcctgtcagaatggcttggaaataagcttacaccactgcaatcagtgcctgctcctgccattgcaatcattctaagcctcttggttgctacatttaccgagtgtacgtccaacgtcgctaccactaccatttttctgcctattctcgcatctatggcacaggccatttgccttcaccccttatatgtgatgcttccgtgcacattggccacttcactggctttcatgcttccagtcgctaccccaccaaatgctatcgtgttttcatttggcgatctgaaggttctcgatatggcacgggcaggcttcctcttgaatatcattggcgtgttgattattgcattggctattaattcctgggggattcctctattcagcctgcattcattcccttcctgggctcagtccaatacaactgcacaatgcctgccctcactcgcaaatacaacgacccctagcccatag

SEQ ID NO: 134812 - DNA, 1809 bp, Artificial Sequence
  Description of Artificial Sequence: Synthetic coding sequence
atggccgctctggcggctgcagccaaaaaagtgtggtcagccaggcgactgctcgtcctgctgttcacccctctggctcttcttcccgtggtattcgctttaccccccaaggagggacggtgtctattcgtcattctgctgatggccgtgtactggtgtaccgaagccctgcctctgagtgtaacagctctgcttccaatcgtattgttccccttcatgggtattcttccgagtaataaagtatgtccccagtattttttagacactaacttcctatttttgtctgggttgatcatggcctccgctatcgaggaatggaacctgcacaggcgcatcgcactcaaaatactgatgttggttggcgtgcaaccggctaggctcattctgggaatgatggttaccacttcctttctctctatgtggcttagcaatacagcctcaactgccatgatgcttcccatcgccaacgccattctgaaaagtctcttcggccagaaggaggtgaggaaggacccttcacaggaaagcgaggaaaacactgctgccgtgcggcgcaacggcctccacaccgtccccaccgaaatgcaattccttgccagcactgaagccaaggatcaccccggagaaacagaggtgcccctggacttaccagctgatagcagaaaagaggatgagtacagacgcaatatatggaaaggctttctgatctcaattccgtattctgcctcaatcgggggaaccgccaccctgaccggtacagctcctaatctgattctcctgggccagctgaaatccttcttcccacaatgcgatgtggtgaacttcggatcatggttcatctttgcatttcctctgatgttgctgtttcttctcgccggatggttgtggatttcttttttgtatggaggactcagtttccgggggtggaggaagaataagtccgagatccgtaccaatgccgaggaccgcgctcgcgctgtcattagagaagagtatcagaacctcggccctattaaattcgccgagcaggccgtgtttattctgttctgtatgtttgccattctcctattcacacgggacccaaaattcatccccggatgggcctccttattcaaccccggttttctgtcggatgccgtcacaggtgtggccatagtaactatactgttttttttcccctcacagcggccctccctgaagtggtggttcgactttaaggcgcctaacacagaaacagagcctctgttgacctggaagaaagcccaggagacagtcccctggaatatcattctactcctagggggaggattcgctatggctaaaggatgcgaggaatcgggactgtcagtctggataggcggccaactccacccattagaaaacgtgccccctgctctggcagtgctgttgatcactgtggttatcgccttctttacggagttcgctagcaacacggctacgattatcatattcctcccagtcctagccgaattggctatcaggcttagagtacatcctctatacctgatgatcccgggcactgttggttgtagttttgcgtttatgctcccagtgagcacacccccaaactccattgctttcgcctcagggcacttactggtaaaggacatggttaggaccgggttattgatgaatctgatgggcgtgctgctgttgtcactcgccatgaatacctgggcacagacaattttccagctgggtacattccccgactgggctgatatgtattcagtgaacgtgacggccctgccaccgacactggccaatgacaccttcagaacgctgtag

SEQ ID NO: 134813 - DNA, 1668 bp, Artificial Sequence
  Description of Artificial Sequence: Synthetic coding sequence
atggctgtgtattggtgcacagaagccctgcccctgtcagttaccgccctgctgccaattgtgctcttcccatttatggggattctgccctcaaataaggtatgtccccagtattttctagacactaacttcttgttccttagcgggctcatcatggccagcgcgatcgaggagtggaatctacaccggaggattgctctgaagatccttatgttggtgggcgttcaacccgcgagattgattctcggaatgatggttaccacaagtttcctgtcaatgtggcttagtaacaccgcatcaacagctatgatgctgcctatcgccaacgccatccttaaatctttgttcggacagaaggaggtccgcaaggacccctctcaggaatccgaggagaacacagctgcggttaggcgcaacggtttgcataccgtcccaacagagatgcagtttcttgcctcaactgaagccaaggaccatccaggagaaaccgaagtcccactggatttaccagctgactctaggaaagaagacgaatacaggcggaatatctggaaaggctttctgatcagcatcccttactccgcttccatcgggggcactgccacattgacaggaaccgcaccaaatctgattctgctcggacaactgaaaagcttctttcctcagtgcgacgtcgtgaacttcggaagctggttcatctttgcgttcccacttatgttgctattcctattagccggttggctctggatttcctttttgtatggtggactgagttttcgcggatggcggaagaataagagcgaaattcgaacgaacgccgaggatcgggccagagctgttattagagaggaatatcaaaacctcggtcccatcaagtttgccgaacaggcagtatttatccttttctgcatgtttgccatcctgctttttacaagagaccccaaattcatccccgggtgggcatctctctttaatcccggcttcctctcagacgctgtgacaggcgtggccattgtcacaatcctgttcttttttccatcgcaaagacctagtcttaagtggtggttcgatttcaaggctccaaatacagagactgaacccctgttaacgtggaagaaagcccaggagacagtcccttggaatatcatcctgctcctcggaggtggcttcgctatggcgaaaggttgtgaagaatcaggcttgagcgtgtggatcggtggacagctgcatcctctcgagaatgtgccacccgcgctggcagtccttttgatcacagtggtcatcgctttttttacggagtttgccagtaacacggcaacaattataattttcctcccagtgcttgccgagctcgccattagactgcgggtacatcctctatatctgatgatccctggaacggtgggctgctccttcgctttcatgttacctgtgtccacacctccgaacagcattgcattcgcatctggacatttgctggtcaaggacatggtccgtactggcctgttaatgaatctgatgggggtgctcctcttgagcctggcaatgaacacgtgggcccagacaatcttccagttaggtacattcccagattgggcggatatgtacagcgtgaatgtgacggcactgccacctacacttgcaaacgatacatttcgaaccctttag

SEQ ID NO: 134814 - DNA, 699 bp, Artificial Sequence
  Description of Artificial Sequence: Synthetic coding sequence
atggctgctcttgcggcggcggctaagaaggtgtggtctgcgagaaggctgctggtgctactctttactcccctcgctctgttaccagtcgttttcgctttgccccccaaggagggaaggtgcctcttcgtgatcctgctcatggctgtttactggtgcaccgaggccctccccctgtctgtgaccgccttgcttccaattgttctgttcccgtttatgggcattctgccttccaataaagtgtgcccgcagtacttcttggatactaactttttgtttctatccggcctgatcatggcatctgccattgaggagtggaatctccacaggcggattgcccttaagattttgatgctggtgggcgtacaacctgcaaggctcatcttgggcatgatggtgactacttctttcctgtcaatgtggcttagcaacacagccagtacagcgatgatgctgccaattgccaacgccattttaaaatctctattcgggcagaaggaggtcagaaaggatccaagtcaggagagtgaagaaaataccggaatcgaacctaacacctttctgtcagaggagcgcctcaagctgcaggcgcctctggtaattcgactgggccagatcactgagtccggccagtggaatatgagcggcaacgatgtttgcaatttccgtgtgttaagttttctgcccgggggcatgtag

SEQ ID NO: 134815 - DNA, 1017 bp, Artificial Sequence
  Description of Artificial Sequence: Synthetic coding sequence
atggccgcgctggcggcagccgccaagaaggtctggagtgcaaggcggcttctcgtcctgctttttacacccctcgcactgctgcccgtcgtgttcgccctgcctccgaaagaagggcgctgcctgttcgtgatactacttatggccgtgtactggtgcactgaggctttgccgcttagcgtcactgcattgctacccatcgtgttatttcccttcatgggcattctgcccagtaataaagtgtgcccccagtattttttagatactaacttcttgtttctgagcggtcttattatggcttctgccatcgaggaatggaaccttcaccggcggatcgccctcaaaattctaatgctagtgggggtgcagccagctcgattaattctggggatgatggtgactacctcatttctctcaatgtggctgtccaacaccgcttctaccgctatgatgctaccaatcgcaaatgccattcttaagtcgcttttcgggcaaaaagaagtgcgcaaggacccctcacaggagagcgaagagaataccgccaagacaacactcggaagacaacggtttcactggatatgcagactgacgccgggcaggcgcatgaatatcgtggggacctccggtcgtgctagttcttctccttctccaacacagcccgttcttggggcccagcctcacagccgggcccagcctttgacttcatcctgtcttgctagttctagagggtggctgtggatttctttcctgtatgggggacttagcttccgtgggtggcggaaaaacaagtctgagataaggaccaacgctgaggaccgggcccgcgctgtgatcagggaagagtaccagaacctgggcccaataaaatttgccgaacaagccgtattcatcctgttttgcatgtttgctatcttgctgttcacgcgggatcccaagttcataccaggttgggcctcattgttcaatcctggatgtaaaatggggatcattagtatttccactattcagaaaatgtag

SEQ ID NO: 134816 - DNA, 1563 bp, Artificial Sequence
  Description of Artificial Sequence: Synthetic coding sequence
atggctgtgtactggtgcacagaagctttacctctcagtgtcaccgcccttctgccgattgtcctcttccctttcatgggaatactgcccagcaataaggtctgcccccagtactttttagacacgaacttcctgtttctctcaggattgataatggcttcagcaattgaggaatggaacctgcatcgacggattgccctgaaaattctgatgcttgtgggggtccaacctgccaggttaatcttgggcatgatggtcactacaagttttttgtcgatgtggctctccaacacagcctccacggccatgatgctgccgattgcaaacgccatcctgaagtcattgtttggacaaaaggaggtccggaaggatccttctcaagaaagtgaggagaacactgctgccgtgagacgaaacggcctgcatacggtgccgaccgagatgcaatttctcgcctcaacagaggctaaggaccatcctggtgaaactgaggtgcctcttgacctccctgcggactccagaaaggaagatgaatacaggcgcaatatatggaagggcttcctgatctcaatcccctattccgcctccatcggcgggacagcgacattgactgggacagcgcctaacctcatccttctgggtcaactgaagagcttttttccacaatgcgacgtggtcaatttcggttcctggttcatcttcgcgttcccccttatgctcctgtttctcctggctggatggctgtggattagcttcctttacggcggtctttcatttagggggtggcgcaaaaacaagagcgagatcagaactaacgccgaggatcgcgcccgagccgtcatccgcgaggagtatcaaaatctggggcctatcaagtttttgagtgacgctgtgactggggtcgccatcgtgactattctcttcttctttccgtctcagagaccctccctcaaatggtggttcgattttaaggccccgaacactgagacagagcctcttttgacgtggaaaaaagcccaggagaccgtcccatggaacatcatactgctgcttggcggaggcttcgcgatggccaaaggctgtgaagaatccggtctttccgtttggattggcggacagctgcaccccctggagaatgtcccacctgccctggctgtgctgttaataactgtggtgatcgcattcttcaccgagttcgcctctaacaccgctaccattatcatctttctacctgtactggccgagcttgccattcgattacgcgtccacccactctatttaatgatccccggcaccgtcggctgctccttcgcctttatgctgccagtatctacaccaccaaatagcattgcatttgccagcggacacctgctcgttaaggatatggtgagaactggattgctgatgaacttgatgggagtgcttctcctctcccttgccatgaatacctgggctcagacaatctttcaactggggaccttcccagactgggctgacatgtattctgtgaatgtcaccgcattacctcccaccctggccaatgataccttcagaactctctag

SEQ ID NO: 134817 - DNA, 1659 bp, Artificial Sequence
  Description of Artificial Sequence: Synthetic coding sequence
atggctgcccttgccgcggcagcgaaaaaagtctggtcagcccgtcgactgctggtgctactgttcacacctctagccctgctgcctgtcgtttttgctctcccccctaaagaaggaaggtgcctgtttgtgattctcttgatggccgtatactggtgcaccgaagcactccccctgagcgtcaccgccttgttgcccatcgttctctttccttttatgggcattctcccttcaaacaaggtgtgcccacagtatttccttgacaccaattttctgttcctgagtgggttgattatggccagcgcaatcgaggagtggaatcttcatcgtaggatcgccttgaaaatcctgatgctcgtgggagttcagcctgcccggttaattctcggtatgatggtcaccactagctttctctctatgtggctctccaacactgcatcaaccgccatgatgctgcccatcgcaaacgccatcctgaagagcttatttggccagaaagaagttcggaaagacccctctcaagaatcggaggagaatactgctaagacaaccctcggccgacagagattccattggatatgcaggttaactcccggtcgccgaatgaacatagtcggaacttcgggtagagcatcttcatctccgtccccaacccagccagtgctaggtgcccaacctcactctagagcccagccgttaacctcctcttgcctggcatcatcccgtggttggctctggatcagctttttatacggaggactatccttcagggggtggcgtaagaataagtccgaaatacgcacaaatgccgaggatagagcccgtgccgttatacgggaagaataccaaaacttgggccccatcaagttcgccgaacaagccgtttttattctgttctgtatgtttgcaattttattgtttacacgagaccccaagttcatcccaggatgggccagtctgttcaatccgggctttctctccgacgccgtgaccggcgtcgctattgtgaccattctgtttttcttccctagccaacgcccaagcctcaaatggtggttcgactttaaagccccgaacactgagaccgaaccattgttaacttggaagaaagcacaggaaacagttccatggaacatcattctgctgctgggcgggggcttcgctatggccaagggatgcgaggaaagcgggctttctgtatggatcggcggacagttgcacccgttggagaacgtgcccccagcgctggccgtgctgcttatcacagtagtcattgccttcttcaccgaattcgctagcaatacagccacgatcataatcttcttgcctgtgctggcggagctcgctataaggttaagagttcatcccctgtacctgatgattcctggcacggtgggctgttcctttgcatttatgctaccagtcagcacacctccgaacagcatcgcttttgcaagcgggcacctcttggtgaaagacatggtgagaacagggctcctgatgaacctcatgggggtgctactcttgagcctggccatgaacacctgggctcagaccatctttcagttaggaactttccctgattgggccgacatgtattcagttaatgtgactgctctaccacccacactggccaacgacacatttcgaactctgtag

SEQ ID NO: 134818 - DNA, 558 bp, Artificial Sequence
  Description of Artificial Sequence: Synthetic coding sequence
atggccgtctattggtgtaccgaggcactgccgctttccgtgacagcccttctcccaatcgtcttgtttccttttatggggatcctgcctagtaataaggtttgtccccagtacttcctggatacaaatttcttgtttctctccggattaattatggcatcagccatcgaagagtggaacctccatcgccgaattgccctgaagattctgatgctcgtaggtgtccaacctgctcggctcatcctcgggatgatggtaactacgagctttctcagcatgtggctaagcaatactgcatctaccgccatgatgctccctatagccaacgccatccttaagtctctgttcggccagaaggaggtgcggaaggacccctctcaagagtctgaagaaaacactggtatagaacccaacacctttcttagtgaagagaggttgaagttgcaagcacccctcgtcataagactggggcagattaccgagtcgggtcagtggaacatgtctggcaacgacgtctgcaacttcagggtgttgagcttcctcccaggtggaatgtag

SEQ ID NO: 134819 - DNA, 564 bp, Artificial Sequence
  Description of Artificial Sequence: Synthetic coding sequence
atgctcagccccgcctggcttctttctcctagctgcagctcatcaaggcccaagggccctctctcttccgggggcctcacttccaaggaaagtggtttgagcgtctggatcggtgggcaactacatcctcttgagaacgtaccaccggccctggccgtgctcctgatcaccgtcgtgattgccttcttcacagagtttgcaagtaacaccgctacgatcataatctttctcccagtgttggctgaactggctatcaggctgagggtgcacccactctacctgatgattcccggaaccgtggggtgctcctttgcattcatgctgcccgtctccacaccacctaattccatagctttcgcatctggacacctactcgtcaaggacatggtgcggaccggcctgttaatgaatctgatgggagtgctgctcttgtcattagctatgaacacatgggcacaaacgatcttccagctgggcaccttccccgattgggccgatatgtattctgtcaacgtaactgctctaccaccaacactggctaatgacacctttagaacattatag

SEQ ID NO: 134820 - DNA, 1230 bp, Artificial Sequence
  Description of Artificial Sequence: Synthetic coding sequence
atggctgtctactggtgcactgaggccctaccgctctctgtgactgccttactgccgatagttctttttccctttatggggatccttcctagcaataaggtgtgcccacagtactttctggacacgaattttctttttttgagcggacttatcatggcaagtgccattgaggagtggaaccttcaccggaggattgcccttaaaattttgatgctggtgggcgtgcaaccagcgcgcctaatcctaggcatgatggtcacaacatcttttctatccatgtggttatccaataccgccagcaccgccatgatgctacctattgccaatgcgatacttaagtcgctgttcggccagaaggaggtgagaaaagaccctagccaggagtctgaagagaacacagctgccgtccgccgaaatggtcttcacacagtgccaaccgaaatgcagtttttagctagtacagaggctaaagaccaccccggcgagactgaggtgcctctagatctgccagccgatagccgcaaagaggacgaatatcgacgaaatatttggaaagggttcctcatctctattccctatagcgcttctattggtggcacagcaacccttaccggaaccgctcctaatctgattttactgggccagctgaaatcatttttcccccagtgcgacgtggttaacttcggctcttggttcatctttgctttccccctcatgcttctgttcctcctcgccggatggctttggatctcattcctgtatggagggctgagttttagagggtggaggaagaataagtcagaaatccggactaatgcggaggaccgggccagggcggtcatacgggaggagtaccaaaatcttgggcccatcaagtttgccgaacaggcagtttttattctgttctgcatgttcgccatcctcttgttcacccgcgaccccaagttcatcccggggtgggcatctttgttcaaccccggctttctgtctgatgccgtgactggggttgcgatagtcactatattatttttttttccctctcagagacccagtctcaagtggtggtttgattttaaggctcctaatactgagactgagccattgctcacctggaaaaaggcccaggaaacagtgccatggaacattatcctgctgcttggcgggggattcgccatggctaaagggtgcgaagaatctggattgagcgtctggattggcggtcagctgtag

SEQ ID NO: 134821 - DNA, 1668 bp, Artificial Sequence
  Description of Artificial Sequence: Synthetic coding sequence
atggccgtatattggtgcaccgaagccctgccgctgagcgtgacagccctgctcccgatcgtgctttttcctttcatggggattctccccagcaacaaggtttgccctcagtacttcctggataccaattttctgtttttatctggattaatcatggctagcgcgatcgaggagtggaatctgcatagaaggattgcgcttaaaatcttgatgctcgtaggcgtgcagcccgcccgtcttatattaggtatgatggtaaccacctccttcttgagtatgtggctgagtaacactgcttccaccgccatgatgttgcctatcgccaacgccatcttaaagtcccttttcggccaaaaagaagtgaggaaagaccccagccaagaaagtgaagaaaacaccgcggctgtcagacggaacggacttcataccgtaccgaccgaaatgcagtttcttgccagcaccgaggcaaaagaccacccaggggagacagaagtcccgttggacctccctgccgactcgcgcaaggaggacgaatatcgccggaatatctggaaagggtttctgatctctatcccatacagtgcctcaatcggcggcaccgcgacactcacaggcacagcaccaaatctgatacttcttggacagctgaagagcttctttccccaatgtgacgtggtaaacttcggatcctggtttatctttgctttccccttaatgctactgttccttctcgctgggtggctttggatatctttcctttacggtggcctgtctttccgtggctggcggaaaaataagtccgagattcgcactaacgcagaggatagggcccgcgcagtgattcgggaggagtaccagaatctagggccgatcaaatttgccgagcaggctgtcttcattttattttgcatgtttgcgatactcctcttcactagagacccaaagtttatccccggatgggcttccctgttcaatccaggattcctctccgatgcggtgactggggtcgctattgtcacaattctattcttttttcctagccaacgcccaagcttgaagtggtggtttgatttcaaggccccgaatactgagactgagccccttctgacgtggaagaaggcacaggagactgtgccatggaacatcatcctgttgctgggcggaggatttgccatggcaaaaggttgtgaggaatctggcttatccgtttggattggaggacagctgcatccccttgaaaacgtccctcctgccctagccgtgctactgattacggtggttatcgcattcttcaccgagtttgccagcaatacagcgaccattatcatcttcttgccagttctggccgagctcgcaatacgactacgtgtgcaccctctgtacctgatgatacccggaactgtggggtgttcctttgctttcatgctacctgttagcacccccccaaatagcatcgccttcgcctcaggacacctgcttgtgaaggatatggtgcggaccggtctgctcatgaatctgatgggagtgctgctcctgtccttggccatgaacacatgggctcagaccattttccagctcggcacctttccagattgggcagacatgtactcagtgaacgttaccgcactgcccccaaccttagctaatgatactttccgcactctgtag

SEQ ID NO: 134822 - DNA, 2763 bp, Artificial Sequence
  Description of Artificial Sequence: Synthetic coding sequence
atgagcgatccacactcttcccccttgctacccgaacccctcagcagccgctataagctgtatgaagccgaattcactagcccatcatggcccagcacctcaccagatacccatcctgcgttgcctctcctggagatgcctgaggagaaggatctgcgctcgagcaatgaggactcacatattgtgaagattgagaaactcaatgaacgcagcaaaaggaaggacgatggggtggctcatagagactccgcaggccagcgctgtatctgtctcagtaaggccgttgggtatttaacaggagacatgaaggaatacagaatttggctgaaagataagcacttggccctacagttcatcgactgggtcctgcgtggtaccgcacaagttatgttcatcaacaatccattgtcaggtcttattatcttcattggtctgctgatacagaacccttggtggacaattaccggtggactgggcactgttgtgagtacactgacagcactcgctctcggccaggatcgaagcgccatcgcatctggactacatgggtacaatggcatgcttgtaggattgctgatggccgtttttagtgagaagttagactattattggtggttgctgttccccgtcaccttcaccgccatgtcatgtccagtgctcagttcagccctgaactccattttctcgaaatgggacctcccagtgtttacactgcctttcaacatcgctgtcacactttacctcgcagcaacaggtcattataacttgttttttcctaccaccctcgtggaacctgtgtcctccgttcctaatataacctggaccgaaatggaaatgccgctactgcttcaggccattcccgtgggggtgggtcaggtctatgggtgtgacaacccttggacaggtggcgtgttcctggttgccctgtttatcagtagtccccttatatgcttgcacgctgcgattggtagcatagtaggtttgttggcagccttaagcgtcgccacacccttcgagacaatctacaccgggttatggtcgtataattgtgtactcagctgcattgccatcggcggcatgttctacgcgttgacatggcagacccaccttctcgctttgatctgcgccttattctgcgcgtacatggaggccgctatcagcaatattatgagcgtcgtcggagtaccccctggcacctgggccttctgtctggccaccatcatttttctgttactcaccaccaataatccggccatctttcgattgccgttaagtaaagtcacgtacccagaggccaaccgcatatattatctaacagttaaatccggggaggaggaaaaagccccatccggcggaggaggcgaacaccccccaaccgccggccccaaggttgaagaggggtccgaggcagtcctcagcaaacacaggagcgtgttccatatagaatggtcctccatccggagaagatctaaggtcttcggcaagggtgaacaccaggaacgccagaacaaggatcccttcccctaccggtatcggaagcctacagtcgagctgctggatctggatactatggaagagagctccgaaatcaaagtcgagacaaacatttccaagacaagctggatcagaagcagtatggcagcgtcaggcaagcgggtgtccaaggcgctaagctacattactggggagatgaaagaatgcggagaaggcttgaaggataagtcccctgtgtttcagttcttcgattgggtgctgagaggcacgtcccaggtgatgtttgttaacaatcccctgtctgggattctgattatcctcgggctcttcatccaaaatccgtggtgggcaatttctggctgcctgggcactattatgtctactctgacagcgctcatacttagccaggacaagtctgcaattgccgccggattccatggctataacggtgtcctggtgggcctactgatggcggtgttcagcgacaagggggactactactggtggctgctgcttcccgttataatcatgtctatgagctgtcctattctgtcatccgctttgggtacgatcttctccaagtgggatctgcctgttttcaccctgccattcaatatcaccgtcacactatacctcgcagctactggtcactataacctcttcttcccgaccaccctgctccagcccgcaagtgccatgccaaacataacttggtctgaagtgcaggttccactcctgttgagagcgatccctgtggggattggccaagtttatgggtgtgacaacccctggactggaggcatattcctgattgctctgttcattagttctcccttaatctgcctacacgctgcaataggcagcaccatggggatgctggccgccctaaccatcgccactcctttcgactcaatctatttcggcctctgtggattcaattctactcttgcctgcattgccattggagggatgttctacgtgatcacctggcagactcacctgctggctattgcatgtgcactgttcgcagcatacctcggcgccgccctcgccaacatgctatccgtgttcggtttgcctccttgcacgtggcccttttgcctctcagctctcactttcctcctccttaccacaaataacccagccatctacaagttacctctcagcaaggttacctacccggaagctaaccgcatctattacttgtctcaggaacgaaatcggcgtgcttccatcataaccaagtatcaggcatatgacgtatcttag

SEQ ID NO: 134823 - DNA, 1170 bp, Artificial Sequence
  Description of Artificial Sequence: Synthetic coding sequence
atggaagacagccctaccatggtcagagtggatagccctaccatggtgagaggcgagaatcaggttagcccatgtcaggggcggcgctgcttccccaaggccttgggatatgtaactggtgatatgaaggagctggctaatcagctgaaggataagcccgtggttctacaattcatagactggatcctgcgcggaatctcccaagtggtgtttgtgaacaaccctgtctcaggaatcctcatcctcgtgggtctcctggtgcagaatccctggtgggccctgacagggtggctcggcacagtggtctctaccctgatggccctcctgctgagccaagaccgctccctcatcgcctccggtctgtacgggtacaacgcaaccctggttggggtactgatggcggtgttctccgataaaggtgactatttttggtggctccttctcccggtgtgtgccatgagtatgacgtgtcctatctttagcagtgccctcaactccatgctgtctaaatgggacctgccagtgttcactcttcccttcaatatggcactttcaatgtacctgtccgcaacaggccattataaccccttcttcccagctaagcttgtgatccctattacaacggcacctaacatatcatggtccgacctgagtgccctggaacttctgaaatccataccagtgggcgtgggtcagatttacgggtgtgataatccttggaccggggggatcttcctgggcgctatattgcttagctcccctctcatgtgccttcatgccgcaatcggaagtctgttggggatcgccgctggactttctctgagcgccccatttgaagatatctattttggactttgggggttcaatagcagcctagcttgtatcgcaatggggggcatgttcatggccctaacctggcagacacatctgttggctctgggctgcgcccttttcacggcctacctgggagtaggtatggcaaactttatggccgaggttgggcttcccgcgtgtacctggcctttttgtctcgcaaccttgctgtttctgatcatgactacaaagaacagtaatatctacaaaatgccactgtccaaggtcacttatccagaagagaatcgtatattttatctacaggcaaagaaaaggatggtggaatcccccctgtag

SEQ ID NO: 134824 - DNA, 855 bp, Artificial Sequence
  Description of Artificial Sequence: Synthetic coding sequence
atggcgctgctgctgagtcaagatcggagtctgatcgcatccggcctatacggttataacgctacgctcgtcggcgtcctgatggccgtgtttagcgacaagggagattacttctggtggcttctccttcctgtttgcgctatgtcaatgacctgtccaatcttcagttccgccctgaactcaatgctgtctaagtgggacctaccagttttcacactgccatttaacatggcactgtctatgtacctatctgccacaggccattataacccattttttccggcgaaattggttattcccatcacgacagcacccaatatatcgtggagtgacctctctgcactcgagctgctcaagtctatacccgtgggtgttggacagatctatggatgcgacaatccctggaccggaggaatctttctgggagctattctgctgtcaagtcccttaatgtgtctacatgcagcaatcggcagcctactcggcattgctgcaggtctaagcctgtctgcccctttcgaggacatctatttcgggctttggggattcaacagcagcctcgcatgtatcgcaatgggaggaatgttcatggcactaacgtggcagacacacttgcttgcgctgggatgtgctctgttcaccgcctacctcggagtgggtatggctaacttcatggcagaggtcgggctgccagcttgtacatggccattttgcctggccactttgctgttcctgataatgacaacaaagaacagcaacatctacaagatgcccctgagtaaggtgacttaccccgaagagaacaggattttctatcttcaggcaaaaaagaggatggtggagtcccctctgtag

SEQ ID NO: 134825 - DNA, 1338 bp, Artificial Sequence
  Description of Artificial Sequence: Synthetic coding sequence
atgaacggccggtccctgataggcggagctggcgatgctcggcacggtccagtatggaaggatccctttggcaccaaggctggagatgccgcccgccgcggcattgccaggctgagtttggcactggcagatggatctcaggagcaggaacccgaggaagagatcgccatggaagatagccctactatggtgagagtcgacagtccaaccatggtgcgcggggaaaaccaagtgtcaccatgccaaggtaggcgatgctttccaaaggcactcgggtatgtgacgggagacatgaaggagctggcgaaccagctcaaggacaaacccgtcgtgttgcagtttatcgactggatcctgagggggatcagccaggtggtgtttgtgaataacccggtttcaggtatccttatccttgtgggtcttttggtgcagaatccgtggtgggccctgacgggatggctggggacggtcgtgtctacactgatggcactcctgctgtctcaggatcgcagcctgattgccagtggcttgtacggatataatgcaaccttggttggcgttctcatggccgtctttagtgataaaggagattatttctggtggctcctcctgcctgtatgtgccatgagcatgacctgcccaattttctcctcagccctgaatagtatgctgtccaaatgggaccttcctgtatttactcttccctttaacatggctttaagcatgtacctctccgccacaggacactacaaccctttctttcctgctaagctggtcatccctattacaactgcaccgaacatctcttggtccgacctcagcgccctcgaactgctgaaaagcatccccgtcggtgtcggccaaatctacggatgcgataacccctggactgggggaattttcctgggtgccatactgctgtcctcaccgctgatgtgcttgcacgccgctattggctcactgttgggaattgcggccgggttgtctttatctgctcctttcgaagacatttatttcggcctatggggctttaacagttctctggcctgtatagcaatggggggcatgtttatggctttgacatggcagacacacctcttggcactggggtgcgcactcttcacagcctacctgggcgtcggcatggcaaatttcatggctgaggtaggcctgcctgcctgcacctggcccttctgcctcgcgaccctgctgtttcttatcatgactaccaaaaatagcaatatttataagatgccactgagcaaggtgacctatcccgaagagaaccgcatcttttaccttcaggccaaaaagcggatggtggagtcacccttatag

SEQ ID NO: 134826 - DNA, 1338 bp, Artificial Sequence
  Description of Artificial Sequence: Synthetic coding sequence
atgaatggccggagtcttatcggaggagccggggacgctaggcacggtcccgtgtggaaggatccattcggtacgaaggccggtgacgcagctcggcggggtattgcaaggctctctctggctctggctgatggaagccaggagcaagagcctgaagaagagatcgcgatggaagatagcccgaccatggtgagagttgactctccaaccatggtccgcggcgaaaaccaggtgtctccttgccaggggcgtcgttgtttccctaaagcactcggatacgtcactggtgacatgaaagaacttgctaaccagttgaaggataaacctgtggtgctccagtttattgactggatcctaagagggatttctcaagtcgtattcgtcaacaatcccgtgagcggtatcctgattcttgtcgggctcctggtccagaacccatggtgggctttgaccggctggctcggtaccgttgtgagcaccctcatggccctgctgctctcgcaggatcgctccctgattgccagtggactgtacggctacaatgcaacactggtcggcgtcctgatggccgtgtttagcgacaagggagactacttctggtggcttctgcttccggtttgcgcaatgtcaatgacttgccccattttttcctctgcccttaattcgatgctgtctaagtgggacctgccggtgttcacactgcctttcaatatggcactttcgatgtatctgtcagccaccggacactataaccctttcttccccgccaagcttgtcattcctatcacgacagcccctaacatttcatggagcgacctcagtgccctggagctgctgaaaagcatccctgtgggcgtggggcaaatttatggctgtgacaacccatggactggaggcatcttcctaggcgcaatcttgctgtccagtcccctgatgtgtctgcatgcagccatcggaagtctgctcggtatcgctgcagggctttcactgtctgccccgtttgaagacatctactttgggctatggggatttaattccagcctagcctgcatcgctatgggcggtatgttcatggccctgacatggcaaacccatcttttggctctcggttgcgcgctcttcacagcctatctgggagttggtatggccaatttcatggccgaggtaggacttccggcttgcacttggcccttttgtctggcgaccctgctctttctaatcatgacaacaaagaacagcaatatttacaagatgccacttagcaaagtgacttaccctgaggagaatcgaattttttatttgcaagccaagaaaagaatggtggaaagccctctctag

SEQ ID NO: 134827 - DNA, 645 bp, Artificial Sequence
  Description of Artificial Sequence: Synthetic coding sequence
atgaatgggagatccctgattggtggagcgggcgacgccagacacggcccagtgtggaaagacccgtttggaactaaagcaggggatgcagctagacgcggaatcgctcggttaagtctggctctcgctgatgggtctcaggagcaggaacctgaggaagagatcgctatggaagacagcccaaccatggtccgtgtagattctccaaccatggtaagaggagagaatcaggtgtccccttgccaggggaggcgttgtttccccaaagccctggggtacgtcacgggggatatgaaagaactggctaatcaattaaaggacaagcctgtagttctgcagttcattgactggattctgcgcgggatctcccaagttgtgtttgtaaacaatcctgtgtctggaattctcattctggttggactgttggttcaaaatccttggtgggcgctgacagggtggctcggcacggtcgtcagcaccctgatggccctcctgctgtctcaagatcgatccctcatagctagcggcctctatgggtacaacgcaacccttgtgggcgtgctgatggccgtcttcagcgacaagggcgactatttttggtggttgttactacctgtgtgcgctatgtctatgacatgttgttag

SEQ ID NO: 134828 - DNA, 846 bp, Artificial Sequence
  Description of Artificial Sequence: Synthetic coding sequence
atgggcaggcgtaatcgctcccttatcgcctctggcctttatggctacaatgcaaccctcgtgggcgttctcatggcagtcttctccgacaaaggagattacttttggtggctactcctccctgtgtgcgccatgtctatgacctgcccaatcttttccagcgctttgaattctatgttatctaagtgggacctgccggtttttaccctgccgttcaacatggcacttagcatgtacctgtccgctaccggtcactacaatcccttctttcctgcaaaacttgttatccccatcaccacagcccccaatatctcatggagcgatctgtccgccctggaactcctgaaaagcattcccgtgggcgtcgggcagatctatggttgtgacaatccctggacagggggcatcttcctcggggccatactgctatcctctccattgatgtgcttgcacgcggcaattggtagcctgttaggtattgccgcaggactttccctatctgccccattcgaggacatctactttgggctctggggattcaatagctccctcgcatgcattgccatgggaggcatgttcatggccttgacatggcagacccaccttttagctcttggctgtgctctgttcaccgcttatttgggagtcggcatggccaactttatggcagaggtcgggctcccagcctgcacctggcccttctgtctcgctacgctcctgttcttaattatgacaacgaaaaactctaacatctataaaatgccactgtctaaggtgacctaccctgaggagaatcggattttttatctgcaagctaaaaagcgaatggttgagagcccattatag

SEQ ID NO: 134829 - DNA, 774 bp, Artificial Sequence
  Description of Artificial Sequence: Synthetic coding sequence
atggctgtgttcagtgacaaaggtgactacttctggtggctgttgctgcctgtgtgtgcgatgtcaatgacctgtcccatatttagttcagccctcaatagtatgctcagtaagtgggatcttcccgtatttacactgcctttcaatatggccttgagcatgtatctgtctgccactggccactataatccgttctttccggctaaacttgtcatcccgatcaccactgctcctaacatctcttggtccgatctgtctgcgctggagctgctaaagtctatccccgtaggcgtaggccagatttacggatgtgataatccttggactggcgggatttttctgggtgctattctgctgtctagcccactgatgtgtctgcacgctgcaatcggaagcctgctgggcatcgcagcaggcctgagtttatcagcccctttcgaggacatttactttgggctctggggctttaactccagcctagcttgcatcgcaatgggaggaatgtttatggccctcacatggcaaacacacctgctggcgctgggatgtgctctattcacggcatatctcggtgtgggaatggcaaattttatggcggaggtggggcttccagcctgtacatggccattctgtttggcgactctgttattcctgataatgaccaccaagaactcaaatatttacaagatgccccttagcaaagtgacctaccccgaggaaaaccggatcttttatctacaagcgaaaaagagaatggttgagtctcccctgtag

SEQ ID NO: 134830 - DNA, 2763 bp, Artificial Sequence
  Description of Artificial Sequence: Synthetic coding sequence
atgtccgaccctcatagttctcccttactgcctgaaccactgtcatcccgctacaagctttatgaagccgagttcacttccccttcttggcctagtacatcccccgacacccaccctgcattgccactcttggagatgcccgaagaaaaagaccttagaagcagtaatgaagatagccacatcgtgaagatcgagaaactgaacgagagatcgaaacgcaaagatgatggcgtagcccatagagactcagccgggcagagatgcatctgcctctctaaggctgttggttacctgactggcgatatgaaagaatatcgcatctggctcaaagacaaacacctggccttgcagttcatcgattgggtcctgcggggtacagcgcaggtgatgttcataaataatcccctgagcggcctgatcattttcatcgggttgcttattcagaatccatggtggaccattaccggcggactggggacggtggttagtaccttaactgcactcgcactcggccaggaccgaagtgccattgcaagcggtcttcacggttacaatggtatgctggttggccttctgatggcagtcttcagcgagaagcttgactattactggtggctgctatttccggttacatttacggccatgtcctgtccagttttatccagcgcactgaactccatcttctcgaagtgggacctgccggtgttcactctgccattcaacatcgccgtgaccctgtacctcgcggcaaccgggcactacaacctgttttttcccacaactctcgttgagcccgtctcctccgttccaaacatcacgtggacagagatggagatgccgctgctacttcaggcaatccctgtgggcgtggggcaggtgtatggatgcgacaatccttggactggcggtgtgttcctcgtcgccctttttatctcctcgccactcatttgtctgcatgccgctattggcagcatagttggtttgctagccgcactttccgtcgccacgcccttcgagactatctataccggtttgtggtcttacaattgtgttctgtcatgtatcgccatcgggggaatgttttacgcactgacctggcagacccatctgcttgctttgatttgtgcccttttttgcgcctatatggaagcagctatttccaacataatgtccgttgtcggtgtaccccctggaacttgggccttttgtctcgcaactataatttttctgctgttgaccaccaacaatcctgcgatcttccgcctccctttgtccaaagtcacatatccagaggccaacagaatttactacctcacagtgaaatcaggcgaggaggagaaagcccccagtggcgggggaggagaacatcctcctactgctggaccaaaggtcgaggaggggtctgaggccgttctgtctaaacatcggagcgtattccacatcgaatggtcgtcgattagaagacggtctaaggtgttcggcaagggtgagcaccaggaacgccaaaataaggatccatttccttatcgctaccggaagcccaccgtagagttactcgatctggatacaatggaagaatccagcgaaataaaggttgaaacaaacatcagcaagacgagctggattaggtctagtatggccgcaagcggaaagagggtgagtaaggccctgagctatatcacgggagaaatgaaggaatgtggcgagggcttgaaggacaaaagcccggtcttccaatttttcgattgggtgcttcgggggacaagccaggtaatgttcgtgaacaatcctctcagtggcattctcataattttgggccttttcattcagaatccctggtgggccatctccggatgtttgggaacaatcatgagtacacttactgctctgatattgtcccaagataaatccgctatcgctgctggctttcatggatacaatggcgtacttgtggggctgcttatggctgtattttcagataaaggcgattactactggtggttgttgttaccagtgatcatcatgtcgatgagttgcccgatcttgagttccgccctggggaccatttttagtaaatgggacctccccgtctttactttacctttcaacatcacggtgacactgtacctggcagcaactggccactataaccttttcttcccaactaccctgttacagcccgcaagcgctatgccaaatatcacatggtctgaagtgcaggtaccactgctgctgagggcaatccccgttgggatcggccaagtctatgggtgtgacaatccctggacaggagggattttcctgatcgccctgttcatttcatcccccctaatctgccttcacgcggcaattgggagcactatgggaatgctggctgcacttacgattgcaaccccctttgatagcatctacttcggtttgtgcggattcaacagcaccctggcatgcatcgccattggcggaatgttctacgtgatcacctggcaaactcacctgctcgcaattgcttgcgccttatttgcagcctatctgggtgcagctctggccaatatgctctctgtgttcgggttgccgccatgcacctggcctttttgtctcagcgctttaacgtttttgctcttgacaaccaataaccctgctatttacaaacttccgcttagcaaagttacctatcccgaggctaataggatctactatctcagccaggaaagaaacaggcgagcttccataattaccaagtaccaggcatacgatgtatcctag

SEQ ID NO: 134831 - DNA, 708 bp, Artificial Sequence
  Description of Artificial Sequence: Synthetic coding sequence
atgtcggatccgcattcaagcccactgcttccggagccactttcctcacgatacaaattatacgaagcggaattcaccagccccagttggccctctacgagcccggacacacacccagctctgcccctgcttgagatgcctgaagaaaaagatctgcgcagtagcaatgaggatagtcatatcgtgaagatcgaaaagctaaacgaacggagtaagcgcaaggatgatggggtcgctcaccgcgacagtgccgggcagcgatgcatttgtctctccaaagcagtcggttatctgacaggcgacatgaaggagtacagaatctggctgaaagataaacacctggctctccagttcattgactgggtactgcggggtacagctcaagtgatgtttattaataatccgctgtcgggactaattatcttcattggtctgctgattcagaatccttggtggactattacaggtggtctgggcacagtggtgagcacactgacagctctggctctcgggcaggatcggagcgccatcgcatcgggcttgcatggatacaacgggatgttggtcggtctcctgatggccgtcttcagtgaaaagctggactattattggtggctgctgttcccagtgacatttactgcaatgagctggatggagacagacttcaactggtctaagtctggttgttggaaacacctgctacagtag

SEQ ID NO: 134832 - DNA, 627 bp, Artificial Sequence
  Description of Artificial Sequence: Synthetic coding sequence
atggaccaatggggtgtgtacttcaacccagttctcgttagtttttgccagtccttttttggctatcccttatccatcttctttatcgttgtcaatgaattttgtgaaagatttagctactatggcatgagagctattctgatcctctactttaccaattttatctcctgggatgataacctctccacggccatctatcatacctttgtcgctctgtgctatctgacacccattctgggtgccttgatagctgactcctggttgggcaaattcaaaaccatcgttagtctgtccatcgtatacaccatcggtcaggccgtgacttctgtgagtagcattaatgatctcaccgaccacaatcatgatggaaccccagactctcttccggtccacgtggtgctgagcctaattgggctagccctcattgccctcgggaccggcggcattaagccttgtgtgagtgcattcgggggtgaccagttcgaggaagggcaagagaaacagcgaaatcgattcttttccatcttttatctcgccatcaatgccggatcattactttccaccatcattaccccgatgcttagaggaaagagatacctgaaagggacgagtgtgggcctgttctag

SEQ ID NO: 134833 - DNA, 849 bp, Artificial Sequence
  Description of Artificial Sequence: Synthetic coding sequence
atgcgggctatcttaatcctctacttcactaactttatctcctgggacgacaacctatccacggccatctatcatacctttgtggccctctgctacctgacacccattctgggagctttaatcgcagactcttggctgggaaaatttaaaactatagtgagtttgtcgatcgtgtacacaatcggacaagcggtgaccagcgtctcttcaataaacgatctgacagatcataatcatgacggtacccctgactctctccctgttcacgtggttttgtccttgattggactggctctgattgctttaggcacgggaggcatcaagccctgtgtgagcgcattcggaggcgaccaatttgaggaaggacaggaaaaacagcggaatcgcttcttctccatcttttatctggccattaatgctgggtccttattgtccaccatcattacccccatgctgcgggggaagcgctacctgaaaggtacctctgtgggtctttttcttgtgcgaccgtccccatgtttacttagattcgtcctcttctttcccagtgcactcttctcatcctgtcagctccatgcagggatgcatgtgggcatctggtctaagtgtttccttccgtgcgagttccacctgttattcgtgctatttaaatctctgattcccgtcaccacgggggagtctaagcccagcctggcctgggcatctatcttcctgaactgctattcctgtaaggtgatgctggttgttagaggcaaacgccaggaaagatgcctgggctcccaggcgggaggccgtagttgtcatttcagcctccaagcccttctcccatccgatatctctgtgacgtag

SEQ ID NO: 134834 - DNA, 2127 bp, Artificial Sequence
  Description of Artificial Sequence: Synthetic coding sequence
atgggtatgtctaaaagtcatagcttctttgggtaccccctgtcaatctttttcatcgtagtgaatgagttttgtgaacggttctcgtactatggaatgcgcgctattctgatactgtatttcacaaacttcatcagttgggatgataacctgtccactgcgatctaccacacgttcgtggccctgtgttacttaactcctattttgggggctctgatcgccgacagctggctcggaaagttcaagacaattgtgtctctctcaatcgtgtatacaatagggcaagccgtcacaagcgtgagctcaatcaacgacctgaccgaccacaatcacgatgggacacccgactcattacctgtccacgtcgtcttatcccttattggactggccctaatcgctctgggcaccggaggtatcaagccatgtgtgtcagcttttggaggagatcaattcgaagaggggcaggaaaagcagaggaatcgattcttttccatcttttaccttgcgataaacgctggctccctgctcagcacgatcattacaccaatgttacgagtccagcagtgcgggatccacagcaagcaggcttgctaccccctcgcctttggagtgccagcagctctcatggccgtggccttaatcgtgttcgtccttggcagcggcatgtacaaaaaattcaaaccccaggggaacattatgggaaaggttgctaagtgtatagggttcgccataaaaaacagatttcgacacagaagtaaggcattcccaaaacgtgagcattggctagactgggcaaaggagaagtacgatgagcgcttgataagccagataaaaatggtgacccgcgtgatgtttttgtatatccctcttcccatgttttgggctctcttcgaccaacaggggtcgcgctggaccctccaggctaccaccatgtccggcaagatcggcgctcttgagatccagcctgaccaaatgcaaaccgtgaacgctatcctgatagtaattatggtccccattttcgatgctgttctataccccttaatcgccaaatgtggatttaattttactagtcttaagaagatggccgttgggatggtgctggccagtatggccttcgtggtcgccgctattgtccaggtggagatcgataagaccctgcccgtgttccctaagggtaatgaagtgcaaattaaagtcctcaatatcggcaataatacgatgaatatcagcctccctggcgagatggtaactcttggcccaatgtctcagaccaacgcctttatgaccttcgatgtgaataaattgacgaggattaatatcagcagccctgggagccccgtgacagccgtgacagatgatttcaagcaagggcagagacacactctgctggtttgggcccctaaccactaccaggtcgttaaagacggactgaatcagaagcctgaaaagggcgagaacggaatacgcttcgtgaacactttcaatgagcttattaccatcaccatgagcggcaaggtgtacgctaacatctccagctacaacgcaagcacttaccaattctttccttccggcataaaaggcttcactattagcagcacggagattccaccccagtgtcagccgaacttcaatactttttacctggagttcggatcagcctatacctacatcgtgcagagaaagaacgattcttgtccagaggttaaagtttttgaggatatctccgcaaatactgtgaacatggctttacagataccccagtacttcttactgacctgtggggaggttgtgtttagcgttacaggactggagtttagctactcacaggccccctctaatatgaaatcagtgctccaggccgggtggttgttgaccgttgctgtgggcaacatcattgtgttaattgtggcaggggccgggcaattctccaagcagtgggccgaatatattctctttgctgcactattactggtggtatgcgtgattttcgccatcatggccaggttttatacatacataaatcccgctgaaattgaggcacagttcgatgaagacgaaaagaaaaatcggctggagaaaagtaatccatactttatgtctggggcaaattcccagaagcagatgtag

SEQ ID NO: 134835 - DNA, 1503 bp, Artificial Sequence
  Description of Artificial Sequence: Synthetic coding sequence
atgccaccagccgtcggaggacctgttggatacacaccacctgatggaggctggggttgggctgtcgttatcggcgccttcatcagcatcggtttctcttatgccttcccgaagagcattactgtcttcttcaaggagatcgagggaatcttccacgccaccacctctgaggtgtcatggatctcatctattatgcttgccgtaatgtatggggggggacccatctcctcaattctggtgaataagtacggcagtcggatcgtcatgatcgtggggggatgcctttcaggatgtggcctgattgccgccagcttttgcaacacggttcagcagttgtatgtgtgcattggcgtgataggcggcctcggtctggcctttaatttgaacccagccctcactatgatcggaaagtacttttacaagcggaggccccttgctaatggactcgccatggcagggagtcccgtattcctgtgtacgttggctccgttgaaccaggtgttttttggcatttttgggtggcggggctccttcttgatcctgggcggccttctgctgaactgttgtgttgctggagcactcatgcggccaatcgggcccaaacccacaaaagctggaaaggacaaatccaaggccagcttggaaaaagctgggaagagtggcgtcaaaaaagacctacacgacgcgaatactgacctcattggccggcatccaaagcaggagaagcgaagtgtcttccagacaatcaaccagtttcttgacctgactctattcacccatcggggtttcctgctttatctgtcaggtaatgtcatcatgtttttcgggctgttcgcaccattggtgtttctctcaagctacggcaaatctcagcactattcttccgaaaagagcgccttcttactgagcatcctggcgtttgtcgacatggtggcgcgtccaagcatgggactcgtggcgaacaccaaacccattcgtcctaggatacagtactttttcgccgctagtgtggtcgccaatggagtgtgtcacatgttagcgcctctaagcaccacctacgttggcttttgcgtgtacgccggatttttcggatttgcctttggttggttgtcctcggtactctttgaaacactgatggacctggtgggccctcagcgctttagttccgcagttggactggtgaccatcgtcgagtgctgtccagtgctgttaggaccaccattgctcggacgcttaaacgacatgtacggggactacaaatatacctattgggcatgtggagtcgtgctcattatttcaggcatttacctgttcattggtatggggattaactaccgtctgctcgccaaagagcagaaggctaatgaacagaagaaggaatctaaggaagaggagacttctattgatgtggccgggaagccaaacgaagtaacaaaagcagccgagtcacccgatcagaaagacaccgatggaggacccaaggaggaagaatccccggtttag

SEQ ID NO: 134836 - DNA, 648 bp, Artificial Sequence
  Description of Artificial Sequence: Synthetic coding sequence
atgccacccgccgtgggtggtcccgtcggctatacaccccctgatggaggatggggctgggccgtagtcattggggcgttcatatctattggtttttcttacgcctttccaaaatcaataacagtgttcttcaaagagattgagggcatttttcatgctacaacatcagaggttagttggatctccagcataatgttggcagtgatgtatggcgggggacctatatctagtatacttgtcaacaagtatggcagccggatcgtaatgattgtaggcggatgtctctctgggtgcggcctgattgccgcttcattttgtaacacagtgcaacagctctatgtgtgtatcggagtgatcggcggactcggcctggcatttaatctgaaccccgcattgacaatgataggaaagtacttctataagaggaggcccctggctaatggccttgccatggctggttcacccgtgtttctgtgcaccctggctcctctcaatcaggtgttcttcgggatctttggatggagagggagttttcttatcctgggggggctgttgttgaattgctgcgtcgcgggtgcacttatgcgtcccattggtcccaagcccactaaggctgggaaagataaaagtaaggcatccctggagtag

SEQ ID NO: 134837 - DNA, 1293 bp, Artificial Sequence
  Description of Artificial Sequence: Synthetic coding sequence
atgcccccagctgtcggcgggcccgtgggttacaccccaccagatgggggctggggttgggccgtggtgattggtgcctttattagtatcggcttttcctatgcctttccaaaaagcattacggtgttcttcaaggaaatcgaaggcatatttcatgcgactacatcagaagtcagttggatctcctctattatgcttgcagtgatgtacggcgggggcccaatctctagtattctggtgaataagtatggttcgagaattgtgatgatcgtggggggctgtttgtccggctgcggccttatcgcagcttctttttgcaacacagtgcaacagctttacgtatgcatcggggttatcggtgggctaggcttagcatttaacctcaatccagcactaaccatgatcgggaagtacttctataagcgccgccctctggccaatgggctcgctatggcggggtcacctgttttcttgtgcacactggctccattaaatcaggtcttctttggaatctttggctggcgcggatctttcctcattttgggcgggctattgttaaactgttgtgttgcaggcgccttaatgaggccaatcggcccaaagccgactaaggccgggaaagataagtccaaagcctccttagaaaaggccggcaagtcaggagtcaaaaaagatctgcatgacgcaaatactgatctcatcggcagacatcctaagcaggaaaaaagatcagtgtttcagaccattaaccagttcctcgatctcaccctgttcactcatcgtggctttctcctgtacctgtctggtaatgtgattatgttcttcggactattcgcaccattagtgtttctcagcagttacgggaagtcccagcattactccagcgagaagagtgctttcctgctgtccatactggcatttgtggatatggtggcgcgcccctcaatggggctagtcgccaacaccaaacccatccgcccccggatacaatactttttcgctgcgagtgttgtggccaatggcgtttgtcatatgctcgccccactgtccaccacatatgtagggttctgtgtgtacgccggttttttcggtttcgcatttgggtggcttagctccgtcttgttcgagaccctcatggacctcgtcggcccccagcgattttcaagcgccgtcggattagtgactatcgtcgaatgttgccccgttcttctcggccccccgctgttaggaatagtgtatctacccactaacgtgggtctcctacaaaataagcatgtcagatgggagtgttag

SEQ ID NO: 134838 - DNA, 891 bp, Artificial Sequence
  Description of Artificial Sequence: Synthetic coding sequence
atgccacccgccgtgggagggccagtggggtatacacccccagacggcggctggggctgggcggttgttataggagcgttcatcagcataggatttagctacgcgttcccaaagtccattactgtgttcttcaaagaaatcgagggaattttccacgccactacgtctgaggtgtcatggataagttccataatgctcgcagttatgtacggcggtggacccataagtagtattttggtcaataagtacgggtcacggatcgtaatgatcgtgggtggatgcttatccgggtgtggtttgattgcagcgtcattctgcaatacagtacaacagctctacgtgtgcattggagtcatcggcgggctcggtctggcctttaacctcaaccccgcactcacaatgatcggcaagtatttctataagaggaggccactagccaacggccttgccatggccggctctcccgtgttcctttgcacccttgctccgttgaaccaggtgttttttgggatcttcggatggcgtggcagcttcctgatcctcggtgggctgctcctgaactgttgcgtcgccggtgcactgatgcgacccattggtcctaagcctactaaagctggaaaagataagtcaaaggccagcctggaaaaagcgggtaagtctggagtgaaaaaagacctgcacgatgcgaataccgatctcatcgggcgccatccaaagcaggagaagcgctccgtctttcagaccataaatcagttcctggatctcactctgttcacacatcgcgggttcctgctgtatctcagcggcaatgtgatcatgttcttcgggctcttcgctccattagtgttcttgtccagttacgggaagtcacagcactactcaagtgagtag

SEQ ID NO: 134839 - DNA, 1371 bp, Artificial Sequence
  Description of Artificial Sequence: Synthetic coding sequence
atgccccctgctgtcggcgggcccgtggggtacaccccacctgacggaggctggggctgggctgtcgtgatcggcgcatttatctccatcgggttctcatacgcctttcctaagtctattaccgtgttctttaaagagatcgagggtatttttcacgccacaacatcggaagtctcatggatttccagcatcatgctggccgtgatgtacggcggaggccctatttctagcattctggtgaacaagtatggcagccggattgtgatgattgtgggaggttgtttgagcggctgcggcttaatagccgccagcttttgcaacacggtgcaacagttgtatgtttgcatcggagtgatcggcggactaggattggctttcaatctgaatcccgctctaacaatgatcgggaagtacttctacaagcgccggccgcttgccaacgggctggccatggctgggtctcctgtattcctgtgtacattagcacccctaaaccaagtgttctttgggatctttgggtggaggggatcgtttctcatcctgggggggttgctcctgaattgctgcgttgctggcgccctcatgcgccccattggccccaagcctaccaaggccgggaaggataagtccaaggctagtctggaaaaggcagggaaaagcggcgtcaaaaaggatctccacgatgctaacacagacttgataggtcgccacccaaaacaggagaagcgaagtgttttccagactatcaaccagttcttggacttaactctgttcacgcaccgggggtttctgctttatctgagcggaaatgttattatgttcttcggtctgtttgcacccctcgtgttcctgtcctcctacgggaagtcccagcattattcctccgagaaaagcgcctttctcctgagtattcttgcgttcgtagatatggttgcgcgcccctcgatgggcttggttgcaaacacaaagcccattaggccccggattcaatatttttttgccgcaagtgtggtggctaacggagtttgccacatgctcgcacccctctctacgacctacgtcggcttttgcgtatacgccggtttcttcggcttcgcatttggatggcttagcagtgtgctctttgagaccctgatggacctggtcgggcctcagagattctcaagcgccgtggggcttgtgactattgtagaatgctgtcctgtgcttttgggcccccccctcctaggcaggctcaacgacatgtatggggactacaaatatacatattgggcctgcggagttgttcttattatttcagggatctatctgtttatcggtatggggattaactacagattattagcaaaggagcaaaaagcaaatgagtag

SEQ ID NO: 134840 - DNA, 1503 bp, Artificial Sequence
  Description of Artificial Sequence: Synthetic coding sequence
atgccacccgctgtcggaggccccgtcgggtatactcctccagacggtggatggggctgggctgtggttatcggggcgttcatatccatcggcttttcatatgccttccccaaaagcataactgtattttttaaggagatcgagggaattttccacgccaccacttccgaggtgagctggattagctctattatgctggccgtgatgtacgggggaggtcccatcagctctatcctcgtaaacaaatacggttctaggatagtgatgatcgtaggcggatgcctatcaggatgcggcttgattgccgcttcattctgcaataccgttcagcagttgtatgtctgtattggtgtgattggcggcctgggactggccttcaacctgaaccctgcattgaccatgattgggaagtatttttataaacgcaggccactggctaatgggctggccatggccggatctcccgtgttcctctgcacactcgccccactgaaccaagttttcttcggtatcttcggctggcgtggttcattcctgatactgggaggtttactgttgaattgctgtgtggccggggcgctgatgcgacctattgggccaaagccaacaaaagccgggaaagataagtctaaagccagtcttgagaaggccggaaagagcggcgtgaagaaagatctccatgatgctaatacagacctcattggaaggcaccccaaacaggagaagcgaagcgtattccagacgattaaccaatttctggacctaacactctttacacacagagggttcctcctgtatctctcgggcaacgtcattatgttctttgggctctttgcgccgctggtcttcttgtcctcatacggcaaatctcagcactactcatcagagaaaagcgccttcttgctaagtatactagcatttgtggacatggttgcgagaccctccatgggcttggtggctaatacaaaacctatcagaccccgtatccagtatttctttgcagctagcgtcgttgcgaatggcgtgtgtcacatgctggctccactgtctacgacgtacgtggggttctgcgtctatgcaggctttttcgggttcgctttcggttggctgagctcagttctgtttgagacgctgatggatctcgtggggccccagcggttctctagcgcagtgggtttggttacaatcgtcgaatgctgcccagtgctcctgggccctccacttcttggtcggttaaacgacatgtacggcgactacaagtacacttactgggcatgcggggtggtgctcataatctccggaatctacttgtttatcggcatgggtatcaattatcgcttgctcgcaaaggaacagaaggctaacgagcaaaagaaggagtccaaagaggaggagactagcatcgatgtcgcagggaagcccaacgaagtgactaaggctgccgagagtcctgaccagaaagatacggacggcggacccaaggaagaggaatcccctgtgtag

SEQ ID NO: 134841 - DNA, 606 bp, Artificial Sequence
  Description of Artificial Sequence: Synthetic coding sequence
atgaaacatgtaaacgaacggtttcaggacgagaagaataaggaagtggtgttaatgtgcattggggtgaccagcggcgtgggcagactgctattcggacgtatcgccgactatgtgccaggcgtgaagaaggtctatctgcaagtactctcttttttttttattgggctcatgtcaatgatgatacctctgtgcagcatcttcggggcgctgattgcggtctgcttgataatgggactatttgatgggtgtttcatatcgataatggcgcccattgcctttgaactggtgggagcccaggatgtctctcaggcgatcggattcctgctgggcttcatgtccatccccatgactgtgggaccccccattgcagggctactgcgagacaagcttggaagctatgacgtcgcgttctatctggctggtgtacccccactaatcgggggcgccgttctctgttttatcccctggattcactctaaaaaacagcgggagatctccaaaacaaccggcaaggagaaaatggaaaagatgctcgagaaccagaatagtttactgagcagtagcagcggaatgtttaaaaaggagtctgacagtattatctag

SEQ ID NO: 134842 - DNA, 1548 bp, Artificial Sequence
  Description of Artificial Sequence: Synthetic coding sequence
atggttctatcccaagaggagcctgacagcgctaggggtacaagtgaggcacagcctctcggaccagctccaaccggtgccgcgccacctcctgggcccggcccctcagactcacccgaagcagcagtggagaaggtggaggttgagctagccgggcctgctacggcagagccccacgaacccccggagccgccagaagggggctggggctggctggtaatgctggctgccatgtggtgcaatggaagcgtgttcggaatccagaatgcttgcggggttctatttgtcagtatgctggaaacatttggtagtaaggacgacgacaagatggtatttaaaactgcttgggtcggaagcctctccatgggtatgattttcttttgctgccctattgtgtcagtgttcacagatctttttggttgccgtaagaccgcagtcgttggcgctgctgtgggctttgtgggcttgatgtcatcttccttcgtgagctccattgaacctctctacttaacttatggcattattttcgcctgtgggtgtagtttcgcatatcagccgtccctggttatactgggccactacttcaagaaacgattgggtctggtgaacggtatcgtgactgctggctcatctgtgttcactatcctgctgcccctgctgctccgggtgctcatcgattccgtgggtttattctacactctgcgcgtgctgtgtatctttatgtttgtgctcttcctcgccggattcacataccgccctcttgcaacaagtactaaagataaagagtccggcgggtccgggtcctcactcttcagccggaagaagttttcaccgccaaagaaaatctttaacttcgctatcttcaaggtgacggcttacgctgtgtgggctgtgggtattcccctggcccttttcggctacttcgtcccatacgtgcacctcatgaagcacgtcaacgaacgttttcaagacgaaaagaacaaagaggtggtgctgatgtgcatcggggtcacctctggtgtgggccgccttttgttcgggcgcattgctgactatgtgcctggcgtcaaaaaagtgtacctgcaggtcctctctttcttcttcattgggctgatgagcatgatgattcctttgtgctcgatttttggagctttaatcgccgtatgtcttatcatgggcctctttgacggatgttttatctccatcatggcgccaatcgcctttgaactcgtaggcgctcaggacgtcagtcaagcaatcggtttcctcctgggctttatgtccattcccatgactgtcggaccccctattgctggcctcctgcgggataaactcggcagttatgacgttgccttctaccttgcgggtgttcccccactcatcggcggtgccgtgctgtgctttatcccctggattcatagtaagaagcagagagagatctcaaagaccactggcaaggagaaaatggaaaaaatgctggaaaatcaaaactcgctgcttagtagtagcagtgggatgtttaaaaaagaaagcgacagtattatctag

SEQ ID NO: 134843 - DNA, 651 bp, Artificial Sequence
  Description of Artificial Sequence: Synthetic coding sequence
atggtttttaaaacggcttgggttggtagcctgagcatggggatgatatttttctgctgccccattgtcagcgtctttactgatttgtttggctgtaggaaaactgccgtggtgggggctgccgtgggttttgtcggcttaatgagtagttcctttgtgagttccattgagccgctctacttaacgtacggcattatcttcgcctgtggctgcagtttcgcttatcaaccctctctggtgattctcggccattatttcaaaaagcgactgggccttgtgaacgggattgtcacagccggatcttctgtctttactatactcctcccactgctcctcagagtgctaatcgattctgtgggcctgttctatacactgcgagtcctctgcattttcatgttcgtgttattcctcgccgggttcacatataggccacttgccaccagtacgaaggacaaggagagtggcggctctggctcatcactgttcagcagaaagaagttctccccacctaaaaagatcttcaactttgctattttcaaggtgacagcatatgctgtgtgggcggttggaataccactagccctatttggatactttgtgccatatgtccacctggcgaagttttcattcgtgattctaaagtatgaatag

SEQ ID NO: 134844 - DNA, 636 bp, Artificial Sequence
  Description of Artificial Sequence: Synthetic coding sequence
taatgggtggggtccctgtccatgggcatgatcttcttctgttgtccaatagtgtcagtgtttacagatctgtttggatgtcgcaagacagcagtggtgggggccgcagttggattcgtcgggttaatgagctcaagcttcgtttcctccatcgagccgctgtatctgacctacggcataatattcgcctgcggctgcagcttcgcctaccagccaagcctggtgattctcggccactattttaaaaaaagacttggccttgtcaatggaatagtgactgccggatctagcgtgttcaccatacttcttcctcttttactcagagtcctgattgatagtgtcggtcttttttacacactgagggtgctgtgcattttcatgttcgttctctttctggcgggttttacgtacaggcccctggccacttctacaaaggacaaagaatcaggagggtccggctcctcgttgttctcacggaaaaaattctcccctcctaagaagatttttaacttcgctattttcaaagtcaccgcatacgccgtctgggctgtagggatcccattagcactgtttggttacttcgtgccatacgttcacctagcgaagttcagctttgtgattctgaaatacgagtag

SEQ ID NO: 134845 - DNA, 621 bp, Artificial Sequence
  Description of Artificial Sequence: Synthetic coding sequence
tgatgggtcggtagccttagtatgggaatgatttttttctgttgtcctatagtcagcgtttttacggacctgttcggctgccgcaagactgccgtggtcggcgccgctgttggatttgtggggcttatgtctagtagctttgtctccagcatcgagcctctctatctgacgtatggcatcatcttcgcctgtggatgttcgttcgcttaccaaccctccctggtgatcttaggccattatttcaaaaagaggctaggactcgtaaacgggattgtgaccgctggctcctctgttttcactatcctgctgcccctcctgctgcgagtgctcatcgactctgttgggttgttttacactctaagagtgctgtgcatctttatgttcgtgctgtttctggccgggttcacttaccgccctctggctacaagcacgaaggataaagagtcaggcggctctggttccagcttgttctccaggaaaaagttcagcccccctaaaaaaatctttaacttcgctatattcaaggttacggcctacgctgtgtgggcagtgggtattcctctggctctgttcgggtactttgtcccttacgtccatctggtgagcatgttacttcactag

SEQ ID NO: 134846 - DNA, 981 bp, Artificial Sequence
  Description of Artificial Sequence: Synthetic coding sequence
atggttctgtcacaggaagagccagacagtgcaagagggacctctgaggctcagccccttgggcccgcccctacaggtgcggccccacctcctggtccaggaccttctgactctcccgaggctgcagtggagaaagttgaggtggaattggctggtcctgcaactgcagaaccccacgagccccccgaaccacctgaaggcgggtggggctggttagtgatgctcgccgcaatgtggtgcaatggttccgtgtttggaattcagaacgcatgtggggttctgtttgtatctatgcttgaaacattcggtagcaaagatgatgataagatggtctttaaaaccgcatgggttggaagcctgagcatgggtatgattttcttctgctgccctatcgtgtcagtgtttactgacttgttcgggtgtaggaagactgcagtggttggcgcagcagtgggctttgtagggctgatgtccagctcttttgtgtcttctatcgagccgctatacctgacttacggcatcatttttgcttgtgggtgctcttttgcataccagccatctctggtgattctggggcactacttcaaaaagaggcttggtttggtgaatggcatcgttaccgctggatcttcggtgtttaccattctgctgcctttgctgctacgcgtcctcatcgactctgtgggacttttctataccttacgcgtattatgcatcttcatgttcgtgctttttcttgcaggcttcacctacagacccttagccacatccactaaggataaagagagcggcggcagtggttcctccttattctctcgtaagaaattctctccacccaaaaactttcagttttgccatctgcagggggattcattgtgcagcgtcgggtcgtggaataccacctgtaccttctggatattgtgtgccttgtgcagtttaggggagtacgctcccagcctcatcatgaacatcaccatatag

SEQ ID NO: 134847 - DNA, 1461 bp, Artificial Sequence
  Description of Artificial Sequence: Synthetic coding sequence
atggccaaggtcaaccgtgcacgatcgaccagtccacctgatggtggttggggctggatgatcgtggccggatgtttcctcgtcaccatctgcacccgtgcagtgaccaggtgcattagcatctttttcgttgagtttcagacatattttacccaagactacgcccagaccgcctggattcactccatcgttgattgtgtcaccatgctctgcgcacctctgggcagcgtagttagcaatcacctcagctgtcaggtggggattatgcttggcggcctgcttgccagtactgggcttattcttagcagcttcgccacttctctcaagcatctgtacttaacactgggagtccttaccgggctgggatttgccttatgttattctccagcgattgcaatggttggcaagtactttagccggcgcaaggccctagcttatggcatcgcaatgagcggtagcggtattggaactttcatcctggctccagtagtgcaactgctaatcgaacagttcagttggcgaggcgctttactgattctgggtggcttcgtgctcaacttatgcgtctgcggcgccctcatgcgacccataacacttaaggaggaccataccacgcccgaacagaaccacgtgtgcagaacacagaaagaagatatcaagagagtgtccccatacagtagtctgactaaggaatgggctcagacatgtctctgttgctgcctccagcaggagtacagctttttgttgatgtccgactttgtggtgctggccgtgtccgtgctcttcatggcatatgggtgtagtcctctttttgtgtacctggtgccttacgccctgtcggtgggggtttcacaccagcaggccgccttcctgatgagcatccttggggtgatagacatcatcggaaatatcaccttcggatggctgactgacagacgttgtttgaaaaattaccaatatgtatgctacctcttcgctgtgggtatggatggcctttgctacttgtgccttcctatgcttcagtccctgcctctgctggtgccctttagctgcacatttggctacttcgatggcgcctatgtgacactcatcccagtggtaactaccgagattgtaggaaccacatccctatcatcagccctgggagtggtatatttccttcacgcagtgccatatctagtgtccccgcctatcgctgggagattggtggatacgacaggatcatataccgctgcatttctactgtgcggcttttcaatgattttctcttccgtgctgctaggctttgccagacttattaagaggatgcgaaagactcagctgcaatttattgctaaagaatcggatcctaaactccaactctggactaatggtagcgtggcttactccgtcgctcgagaacttgaccaaaagcacggcgagccggtggctacagcggtgcccggatatagtcttacctag

SEQ ID NO: 134848 - DNA, 1551 bp, Artificial Sequence
  Description of Artificial Sequence: Synthetic coding sequence
atgccctctggaagccactggactgcgaattcaagtaagataatcacctggcttttggagcagcctgggaaggaagaaaaaaggaagaccatggccaaagtgaatagggcacgctctaccagtccaccggatggaggatgggggtggatgatcgtggccggctgcttcctggtcacaatctgtacccgggcagttaccaggtgcattagcatcttctttgtagaattccagacatatttcacacaggattatgcccaaactgcctggattcactctatcgtggactgtgtgacgatgttatgcgctcccctgggatctgttgtgtccaaccacctttcctgtcaagtagggatcatgctagggggccttctcgctagcaccggcctgattctgtccagtttcgctacttctctgaagcatctctacctgactttgggcgttctgacaggtctcggcttcgctctgtgctacagccccgctatcgctatggtgggaaaatacttttctaggaggaaggccctggcctacggaatcgctatgagcggatctgggatcggcacttttattcttgcccccgtcgtccagctgttgatcgagcagttcagttggaggggagctctccttatcctgggcggctttgtcctaaatctttgtgtatgcggagctttgatgcgccctatcactctgaaggaggaccacacaactcccgagcagaatcatgtgtgccggacccaaaaagaggatattaagcgggtgagcccatactcctccctcaccaaggagtgggctcagacctgcctatgctgttgtcttcaacaagaatattcttttctgttaatgtctgacttcgtggttttagccgtgagtgtgctgttcatggcttatggctgttcacccctgttcgtgtatctggtgccatatgcgctatctgttggagtgagccaccagcaggctgccttcttgatgtctatacttggcgtaattgatataatcggcaatatcaccttcggttggcttaccgaccgccggtgcctcaagaactaccagtacgtctgttacctgtttgctgtaggaatggacggcctatgttatctgtgtctccctatgctgcagtcactgcccctccttgtgcctttctcttgtacatttgggtactttgacggagcctacgtaaccctgatcccagtcgtcactacagaaatcgtgggcacgactagccttagcagtgctctcggcgtggtctacttcctgcacgctgtgccttatctcgtcagtccgcccattgctggtcggctggtagacaccaccggttcctacacagccgcattcttgttgtgcggcttctcaatgatcttctccagcgttcttctagggttcgcacggctcatcaagaggatgcggaagacacagttgcaattcatcgcaaaggagtcagacccaaagctgcagctatggacgaacgggagcgtggcatattctgttgcacgggagctcgaccagaaacatggagagcctgtagccactgccgtcccaggttattctctaacatag

SEQ ID NO: 134849 - DNA, 78 bp, Artificial Sequence
  Description of Artificial Sequence: Synthetic coding sequence
atgccaagcgggtcacattggacggccaattcctctaagatcattacatggctgctggagcaacctgggaaagagtag

SEQ ID NO: 134850 - DNA, 453 bp, Artificial Sequence
  Description of Artificial Sequence: Synthetic coding sequence
atgagacccatcaccctgaaagaggaccataccaccccggaacagaaccacgtctgccggacacagaaggaagacataaagagggtctccccttatagcagcctcactaaagaatgggcccagacgtgtctttgttgctgcctacaacaagaatatagtttcttactgatgtccgattttgtggtcctcgccgtctccgtattgttcatggcttatgggtgctccccactgtttgtttacctcgtaccctacgcacttagcgtgggagtgagtcaccagcaggctgcctttctcatgagcatactgggcgtaatagatatcattgggaatattaccttcggctggttaaccgatcggagattctgcatcaagaccttcggaatctttagaaagagcgtcagaaagatgtacatcctgcgatctacaatcctgcacttctacactgaattttag

SEQ ID NO: 134851 - DNA, 1842 bp, Artificial Sequence
  Description of Artificial Sequence: Synthetic coding sequence
atgggcagggggggcgggggcctcgatgttggaggaggaggcgaaggctcacgggaccgcctgagccgagacggccttgcctcatggggggccgaaccggggggcggtggttcaggaagcggttcctcttcaccaccatcctcatcctcttgttccagccggaacaaatatcagccacaaagcggttcttctgggccgtcatctcactccccccccgccgccatggcactccaatcacaggccagcgaggaggccaaagggccgtggcaggaagccgaccaggagcagcaggaacctgtgggttcccctgaaccggagagtgaacccgagccagagccagaaccagagcctgtaccagtaccccccccggaaccacagccagaaccccagccccttcctgatcctgcacccctccctgagcttgagttcgagtctgagcgggtccatgaacccgaacccacacccactgtggaaacccgggggactgcccgcggatttcagccacccgagggcggattcgggtgggtagtggtctttgcagccacgtggtgcaacggcagcatcttcggtattcataatagtgtcggaattctgtacagcatgctgcttgaggaggagaaggaaaaaaaccgccaggtggagttccaggctgcgtgggtcggggccctggcaatggggatgatctttttctgttcaccaatagtttctatattcacagacaggctcggctgccggattactgcgaccgccggagcggccgttgctttcatcggacttcatactagttccttcacttccagtcttagtctgcggtactttacttacgggatcctgttcggttgcggatgctcgttcgcctttcagccttcccttgtcattttgggccactatttccagcgtagactgggcctcgcaaacggtgtggtcagcgctgggagctccatatttagcatgtcttttccctttcttattcgtatgctaggtgataaaatcaaattggctcagaccttccaagtactgagtactttcatgttcgtgctgatgctcctaagtttgacatatcggcccctcctaccttcatcacaggacaccccttccaaacggggggtacgtaccctgcaccagaggttcctggcgcagcttaggaagtactttaatatgcgcgttttcagacagaggacatatcggatatgggccttcgggattgccgccgcagccttggggtatttcgtgccatatgtgcatctgatgaaatacgttgaagaggagttcagtgagattaaagagacatgggtcctcctggtgtgtatcggcgctaccagcggattgggaaggctggtttcagggcacatctctgattctatccccgggcttaaaaaaatatacctgcaggttctgagttttctactgctcggcctgatgtcgatgatgataccgctctgcagggactttggaggccttatagtggtttgcttgttcctcggcctctgcgacgggtttttcattacgatcatggcacctattgcctttgagctggtgggtcccatgcaggcctcacaggccatcggatacctgctgggcatgatggccctgccaatgatcgctgggcctcctatcgccggcctcctgagaaattgttttggagactaccacgtggcattttacttcgctggtgtgccaccgatcatcggggccgttattctgttttttgtgccgcttatgcatcagcggatgttcaagaaagagcagagagatagctccaaagacaagatgctcgcccctgatccagaccccaacggagaacttctcccaggatcacccaatccagaggagccaatctag

SEQ ID NO: 134852 - DNA, 1437 bp, Artificial Sequence
  Description of Artificial Sequence: Synthetic coding sequence
atgccccccatgcctagcgcaccccctgtccaccctcctcccgacggcggatggggctggattgtggtcggagccgcctttataagtatcggcttttcatatgcattccccaaggcagtgacagtcttcttcaaggaaatccagcaaatcttccacacaacctattcggaaatcgcttggatttctagtattatgctcgctgtaatgtacgccggaggacctgtgtcatcagtgctcgtgaataaatacggatccaggcccgtagtaattgccggcggactgctgtgttgcctgggcatggtgctggcgagctttagcagcagtgtcgtacagttgtacttgacaatgggtttcatcaccgggcttggactggcattcaatctgcaaccagctctgaccatcatcgggaagtacttttatcggaagcggcctatggctaatggcctggcaatggcgggatcaccagtgttcctgagtagcttggctcctttcaatcagtacttgttcaacacttttggatggaaggggtcgtttttaatcttggggtcccttctgcttaacgcatgtgtagccggaagcctgatgaggccgttgggcccaaatcagaccaccagtaagtcaaagaacaagactgggaaaacagaagacgactcaagtccaaaaaagattaaaacaaagaagtctacttgggagaaagttaacaagtacctggacttttcactgttcaagcaccgcggcttcctcatatatctgtccgggaacgtcatcatgtttctgggcttcttcgctccaattatcttccttgcaccttatgctaaggatcaggggatagatgaatacagtgcagcttttctgctatccgttatggcttttgtggacatgttcgctaggccatcagttggcttaattgccaactcgaagtacatccgaccgcgcatccagtatttttttagctttgcgatcatgtttaatggggtgtgccatcttttgtgtcctcttgcccaggactacacctcgctcgttctctatgcggttttcttcggccttggatttggatccgtgtccagtgtactctttgagaccctaatggatctggtgggcgccccccgcttctcctcagccgtgggcttggttaccattgtggagtgtgggcccgtactcctcggcccgccgttggccggtaaactcgtggaccttaccggggagtacaagtacatgtacatgtcgtgtggagctattgtggtcgctgctagcgtatggctccttatcggaaacgcgatcaactaccgactgctggcaaaggaacgcaaggaagaaaacgcccgacagaagacacgagaaagcgagcctctaagtaagagcaagcactctgaggacgtaaatgtaaaggtgtcaaacgctcaaagtgtcacgtccgaacgagagacgaatatctag

SEQ ID NO: 134853 - DNA, 1140 bp, Artificial Sequence
  Description of Artificial Sequence: Synthetic coding sequence
atggtcctggctagtttctcatccagcgtggttcagctgtatctgaccatgggcttcataacaggcctgggcctggctttcaacctgcagcctgccctgactataatcggcaaatatttctaccgaaagaggcctatggctaacggcctggccatggccggaagcccagtatttttgagctcattggccccttttaatcagtacctcttcaacacctttgggtggaaaggcagttttctgatattaggctctctgctgttgaatgcatgtgtagcaggtagcctgatgaggccactgggtccaaatcagacaacgagcaaaagtaagaacaagaccggtaaaacagaggacgacagcagtcctaaaaaaataaagactaagaagtccacttgggagaaggtcaataagtatctggatttcagcctgtttaaacatagaggatttctcatctatctgtctggaaacgtgataatgttcctgggattcttcgcacccatcatctttttagctccttatgctaaagaccaggggatcgatgaatactcggctgcttttctcttatccgtaatggcctttgtcgacatgttcgcaaggccatcagtcggcctcatcgctaatagcaagtatatacgtcccagaatacaatacttcttttctttcgccataatgttcaacggagtgtgccacctgttatgcccgctagcccaggactatacatccctcgtgctctatgccgtgttttttggactgggattcgggtcagtgagtagtgtcctgtttgagactcttatggatttagtcggggcaccaaggttttcctcagccgtgggacttgtgactattgttgagtgtgggccagtattgttgggtccccccctcgctgggaaattggttgacctgaccggggaatacaagtatatgtatatgagctgtggcgcaatcgtcgtggcagcctcggtgtggctactcatagggaatgccataaactatcgcctgttagccaaagaacgcaaggaggaaaacgccaggcagaaaacccgagagtctgagccattaagcaaatctaaacattctgaagatgtgaacgttaaggtgtcaaatgcacagtccgtcaccagcgagagagaaacgaacatatag

SEQ ID NO: 134854 - DNA, 1437 bp, Artificial Sequence
  Description of Artificial Sequence: Synthetic coding sequence
atgccgccaatgccatctgcccctccagtgcaccctcccccggatggcgggtgggggtggattgttgtgggggccgcctttataagcattggcttttcctacgcgttccccaaggctgttactgtgttctttaaagagattcagcagatttttcacaccacatactccgagatcgcctggattagcagcatcatgctggcagtgatgtacgctggcggcccagtttctagcgtgctcgtgaataagtacggatcacgacctgttgtgatcgccggagggctgctgtgttgcctagggatggtgttagcttcctttagcagttccgttgtgcaactatacctgaccatggggtttataacaggcctgggtctggcgttcaaccttcagccagcactgaccatcattggtaaatatttttatcggaagcggcccatggccaacgggctggcaatggccgggagtcctgtttttctgagctccctggccccattcaatcagtacctttttaatacatttggatggaagggatcatttctcatcctggggtccctgttactaaacgcttgcgtggccggatcgctcatgagaccattaggtcccaaccaaaccaccagcaagagcaaaaataaaaccggtaagaccgaggatgactcttcccccaaaaagataaagacgaagaagtccacctgggagaaagttaataagtacctcgatttctctctgtttaaacaccgcggatttctcatctatctgagtggcaacgtcattatgttcctgggcttttttgcccctatcatttttctggcgccctatgccaaagaccagggaatcgacgaatatagtgctgccttccttttatctgtgatggcattcgtggacatgtttgcacggccaagcgtcggcttgattgctaactcaaaatacatccgccccaggatccagtactttttctcctttgcaattatgttcaatggagtgtgccatctcctctgtcctttggcccaggattatacatcgctcgtgctgtacgctgtattcttcggtctcggcttcggtagcgtgtccagtgtactgtttgagacactgatggacctagtgggagctcccaggttcagcagcgccgtagggctggtcactatcgtggagtgcggaccagttctactgggccccccactggccgggaaactcgtggatctgaccggagagtataaatatatgtacatgagctgtggtgcaatcgtggtggccgcctctgtttggctgcttatcggtaacgccattaactatcggctgctcgcaaaagagcgtaaggaagagaatgcaaggcagaaaacaagggaaagtgagcctctgagcaagtctaagcacagcgaagacgttaacgtgaaggtttctaatgcccaaagtgtaacatctgaaagggagactaatatttag

SEQ ID NO: 134855 - DNA, 1437 bp, Artificial Sequence
  Description of Artificial Sequence: Synthetic coding sequence
atgcctccaatgccttccgcaccgcccgtgcatcctcctcctgacgggggttggggatggatagtggtgggcgcagcgtttatttctattggtttttcttacgcctttcccaaagcggttacagtattttttaaggaaattcagcagattttccatacaacatactcagagattgcatggatttcatccattatgctggcggttatgtacgccggaggtcccgtgagctcagtgttagttaataaatatggctcgcgtcccgttgtgattgcaggtggcctcttatgctgtctggggatggtattggcctcattttcttctagtgttgtccaattgtaccttacaatgggcttcatcaccggcctcggactggctttcaacctccaacctgctctgactatcatcggtaagtatttttataggaagaggcccatggcgaacggcttagcaatggccggcagccccgtgttcttatcctctctagccccctttaatcagtatctatttaatacttttgggtggaagggttcttttttgatcctgggctccctcctgcttaacgcttgtgttgctggcagcctgatgaggcctctcggacccaaccagacaacatcaaaaagcaaaaacaagacggggaagacagaagacgattcctcgccaaagaaaataaaaacaaagaagagtacatgggaaaaagtgaacaagtacctcgatttcagcttgtttaaacatcggggttttctcatttatctttccggcaatgtgattatgttccttgggtttttcgcccctattattttcttagctccatacgcgaaagaccaaggaatcgacgaatattctgccgcttttctgctgtcagtcatggcctttgtggatatgttcgctcgccctagtgtcggactgatcgctaattccaaatacatccggccccgcatacagtacttcttcagcttcgcaatcatgttcaatggggtgtgccacttgctgtgtccattggcccaggactacaccagtctggtgctctatgcggtgttttttggcctgggtttcgggtccgtctcatcagtgctctttgaaactcttatggatctggtcggagcccctcgattcagcagcgcggtgggcctggtgactattgtggaatgtggacccgtgctgttgggccccccgctcgctgggaagctggttgacctgactggtgaatataaatacatgtacatgtcctgcggtgccattgtggtggctgcctccgtctggttgttaatcgggaacgccataaattaccgcctcctcgcaaaggagcggaaggaagaaaatgcccgacagaaaactcgggaatccgaacccttgtcaaaaagcaaacactctgaggacgtgaatgtcaaggtgtctaacgcacagtctgtgactagcgagcgggagactaatatctag

SEQ ID NO: 134856 - DNA, 1437 bp, Artificial Sequence
  Description of Artificial Sequence: Synthetic coding sequence
atgcccccgatgcccagcgctccacccgtccacccaccacccgacggagggtggggctggatcgtggtcggtgctgctttcatcagtattggcttctcctatgcattccccaaagctgtcacggtattttttaaggaaatccagcagatcttccacactacatacagtgagatcgcttggatcagtagcatcatgctcgcggtcatgtatgctggcggtcctgtgtcctcagtgctcgtcaataaatatggctcccgcccggtcgtgatcgccggaggcttattatgctgcctcggcatggtgctggcatctttctcatctagcgttgtacagctgtaccttactatggggttcatcacgggcctaggtctagcattcaatctccagccggctctaacaatcatcggaaaatacttctataggaagcgccccatggccaacggcctcgctatggcggggtccccagtgttcctgtccagccttgcaccttttaaccagtatctgtttaatacatttggctggaagggatcctttttgattctgggatcacttctgctgaacgcgtgcgtagccgggtcgctaatgcggcctctcggccctaaccagaccacctctaagtctaagaataaaaccggcaagacggaggatgacagctcaccaaagaagattaagactaaaaagtctacctgggaaaaagttaacaagtacttagacttttctctattcaagcatagaggttttttgatctacctcagcggcaacgtgatcatgtttctcggatttttcgcccccataatcttcctggcaccatacgctaaagaccagggcatagacgagtattcggccgccttcctgctgtcagttatggcctttgttgacatgtttgcccggccatcagttggactaatagccaattccaagtacatcaggccaaggatccagtactttttttcttttgctatcatgtttaatggcgtgtgtcacctcctctgccccttagctcaggattatacgagcttggtgctctatgctgtattcttcgggctaggctttggatcggtttcctccgtgctttttgagaccttaatggatctcgtaggggcaccccggttttccagcgcggtaggacttgtgaccatcgtggagtgcggaccagtcctgctcggtccaccactcgcaggaaagctagtggatctcacaggagaatataagtacatgtatatgtcctgcggggccatcgtggtggctgcatctgtctggctgttgatcggcaatgccattaattacagattgctggcaaaggaacgaaaggaggaaaatgctaggcagaagacacgcgagagcgagccgctttccaagtcgaagcacagtgaggacgtgaatgtgaaagtgagcaacgcgcagtcggtgacaagcgaacgcgaaaccaatatatag

SEQ ID NO: 134857 - DNA, 1530 bp, Artificial Sequence
  Description of Artificial Sequence: Synthetic coding sequence
atggaactcaagaagtcccctgacggaggttgggggtgggtgattgtgtttgtgtcatttctgacacagttcctgtgttatgggtctcccctggcagtgggagtactctacattgaatggctggacgccttcggcgagggaaagggaaagactgcctgggtcgggtctctggcctccggggtggggctcctcgcctctcctgtctgtagcctctgcgttagcagcttcggcgccaggcctgtgactatcttcagtggctttatggtcgccggcggactgatgctgagttcatttgcgccaaatatctatttcctgtttttttcctacggcattgttgtaggcctgggttgtggactcctgtacacagctacagttacaataacctgccaatactttgacgatcgcagaggattggcgctgggcttgatttctactggatccagtgtcggtctctttatatacgccgccctacagagaatgcttgtagaattttacgggttggatggttgtctcctgatcgtcggggccttagcattgaacatactggcctgcggctccctaatgaggcccctgcaatcaagcgactgtcccttacctaaaaagattgcacccgaagacctaccagataagtatagcatctataacgagaaagggaagaacctagaggagaatatcaacattttagacaagtcatattcaagtgaagaaaaatgtcgcattacattggctaacggcgactggaagcaagacagcctgctccataaaaatcccactgtcacacacacaaaggagcccgagacctacaagaagaaggtcgccgagcagacctacttctgcaagcagctcgctaaaaggaagtggcagctgtacaaaaactattgtggcgaaaccgtggctctttttaagaataaagtttttagcgcactgttcattgccattttgctattcgacattggaggctttccgccgtcactgttaatggaggacgtcgctagatcatccaatgtcaaagaagaggagttcatcatgcctctgatctccattattggcattatgactgccgtcggcaagctgctattaggtatcctcgctgattttaaatggatcaatacactgtatttatacgtcgccacactgatcattatgggcctggctctgtgtgcaatcccctttgccaagagttatgtgacactggccctgttatccggcattctaggatttctgaccggtaactggagcatcttcccatacgttaccacaaaaaccgtgggcatcgaaaagctcgctcacgcctacggaatactaatgttttttgccggactgggtaatagtctaggcccacctatcgttgggtggttttatgactggacgcagacttacgacattgccttttacttcagcgggttttgcgtcctcctcgggggctttatcttgctcctagccgcactgcccagttgggatacctgcaataagcagctcccgaaacccgctccaaccacattcctgtacaaggtggcttctaacgtgtag

SEQ ID NO: 134858 - DNA, 1530 bp, Artificial Sequence
  Description of Artificial Sequence: Synthetic coding sequence
atggagttgaagaaatcccctgatggaggctggggctgggtgattgtcttcgtaagtttcctgacacagtttctatgttatgggtccccgctcgcggtaggcgtgctctatattgaatggctggacgcgttcggtgaaggcaagggtaagacagcctgggtagggtcactggcaagcggcgttggcctgctagccagcccggtgtgctctctgtgcgtctcctctttcggggctaggcccgtcaccattttctccggatttatggtggccgggggcctgatgctatcatctttcgcacctaacatctattttttgttcttttcctatggcattgtggttgggttaggatgcggtttactatacaccgcaaccgtgaccatcacctgtcaatactttgacgacagaagagggttggccctggggctgatctctaccggaagcagcgtgggtttgttcatctacgccgctctgcagaggatgctggtggagttctatggactcgatggatgcctgttgatcgtgggggcccttgctctgaacatcctcgcttgtggctcgcttatgcgaccgttgcagtcatccgactgccccctgccaaaaaagatcgctcccgaggatctgccagacaagtactccatttataacgagaagggaaaaaacttggaggagaatataaatatcttggacaagtcttactcctctgaagagaagtgtcgcatcactctggccaacggggattggaaacaggacagtctgttgcacaaaaacccaaccgtgacacataccaaggagcccgaaacatacaaaaagaaagtggccgagcaaacctatttttgtaaacagcttgccaagagaaagtggcagctgtacaagaattattgtggggagactgtggcgctcttcaagaacaaagtcttctctgctctcttcattgccatcctactgttcgacatcgggggctttccaccctctctgctgatggaagacgtcgccagatcgtctaacgtcaaagaggaggaattcatcatgccacttatctcgattattggcatcatgacagcagtcgggaaacttctcctggggatcctggcagatttcaaatggataaatactctgtacctgtacgtggccaccctgataatcatgggcctggccctgtgtgctattcccttcgcaaagtcatacgtgacactggccttactaagtggaattctgggtttcctgaccggtaactggagcatctttccgtatgtcaccacaaaaacggtcggtatcgagaaattggctcacgcctatgggatcctaatgttttttgccggacttgggaactcactcggccctccgatagttgggtggttctatgactggacccagacgtatgacatcgcattttattttagcggattctgtgtgttgctgggtggttttatcttgctattggccgctctcccctcttgggacacgtgcaacaagcaacttcccaaacctgcgcccacaacattcctctacaaggttgcttctaatgtgtag

SEQ ID NO: 134859 - DNA, 198 bp, Artificial Sequence
  Description of Artificial Sequence: Synthetic coding sequence
atggaactcaagaagtcacctgacggcgggtggggatgggttatcgtctttgtgtcatttctgacccagtttctttgctatggttctcctctggccgtgggcgtgctttatatcgagtggttagacgcctttggcgaggggaaagggaagacagcttgggtcggatccctcgcgagtggggtcggactgctagcttag

SEQ ID NO: 134860 - DNA, 1488 bp, Artificial Sequence
  Description of Artificial Sequence: Synthetic coding sequence
atgaggtcccctgtgagggacctggcaaggaatgatggtgaggagtccacagaccgaacccctcttctccccggggcgcccagggcggaagccgcaccggtgtgttgtagcgccaggtacaacctcgctatcctggccttctttggattcttcatcgtgtatgcattgcgggtgaaccttagcgttgctttagtcgatatggtggactctaacacgacattagaggataataggactagtaaggcctgcccagaacacagtgctcccatcaaggtgcaccataaccagaccgggaaaaagtatcagtgggatgcagaaacgcagggatggattttgggttccttcttctatggctatattatcacgcagattcctggcggatatgtcgcaagtaaaattggcggtaagatgctgcttggatttggcatccttggtacagctgtgctcaccttattcacccctattgcagcagacttgggagtcggccctttaattgtcctccgggcgctggaagggctgggtgagggtgtcacgttcccggccatgcatgctatgtggagcagctgggcacctcctctggaacgatctaagctcctatctatcagctatgctggcgcccagctagggaccgtcatctctctgcccctaagtggaataatctgttattatatgaactggacttatgtgttctactttttcggcaccataggaatcttttggttcttgctttggatctggctggtctcggacacaccccagaaacataagcgcatcagtcactacgagaaggaatacattttatcatctctgagaaatcagctgagttctcagaagtctgtgccctgggtccctatcctcaagtcgctgcccctttgggccatcgtagtagctcatttttcatacaattggacgttctacacattgctgaccctgctgccaacgtacatgaaggagattctgagattcaatgtccaggagaatggttttctgagctccctgccctacctgggctcttggctgtgcatgatcctatccggccaagcagctgacaaccttcgtgccaagtggaatttcagcaccctctgcgtcaggagaatctttagtctgattggtatgatagggcccgctgtgtttctggtggctgccggattcattggctgtgattactctttggctgtggccttcctgacaatcagtaccacattaggtgggttctgctcttccgggttcagcatcaaccacctggacatagcacctagctacgccggcatactcctgggcatcacaaacacgttcgccacaattccgggaatggtcggtccagtgatcgcaaagagtttgacacctgataacacagtgggcgaatggcagaccgtgttttacatcgccgctgccattaacgtgttcggagcgatctttttcactctgttcgccaagggggaggttcaaaattgggccctgaacgatcaccacggccacagacattag

SEQ ID NO: 134861 - DNA, 546 bp, Artificial Sequence
  Description of Artificial Sequence: Synthetic coding sequence
atgaggtcccccgttcgcgatcttgcaaggaacgacggggaggagagtaccgacaggaccccacttttgcctggcgcgccaagagccgaggcggcacccgtgtgttgctctgcccgttacaacttggccatcctggcttttttcggctttttcattgtgtacgccctccgcgtgaatctctcagtcgcccttgtggatatggtcgattccaataccactttagaagataaccgtacctcaaaagcttgcccggaacactccgccccaatcaaagttcatcacaaccaaacaggcaagaaataccagtgggatgccgaaactcagggctggattctcggaagctttttctacggatatattatcacccaaattcctggcgggtacgtggcaagtaaaatcggtggcaaaatgctgctgggcttcggtattcttggcacggctgtcctgacattgttcacacctatcgcagcagacttaggggtggggccgctcattgtgcttagggccttggagggactgggcgaggaacactccctgggccagtag

SEQ ID NO: 134862 - DNA, 1404 bp, Artificial Sequence
  Description of Artificial Sequence: Synthetic coding sequence
atgcagatggacaatcgactacccccaaagaaggttccggggttttgctcttttaggtatggactgagttttctcgtgcattgctgtaatgtcatcatcacagcccagcgcgcctgtctcaatctcactatggttgtgatggtaaatagcaccgacccccatgggctccctaatactagtactaaaaaacttcttgataatataaaaaacccaatgtataactggtcacccgacatccagggaattattctctcctcaacttcttacggagtgatcatcatccaggtccccgtcggctatttctcaggcatttattcaaccaaaaaaatgatagggttcgcactgtgcctctcctccgtcctgtccttgctgataccaccggccgctggaataggcgttgcatgggtagttgtctgccgtgctgtgcaaggtgccgcacaaggaattgtggccactgcccagttcgaaatctatgtgaaatgggctccacctctcgagcgtggtcgcctgacatcaatgtccaccagcggattcctgctgggccctttcatcgtgctgctggttacgggcgtgatatgtgaaagcctgggttggcctatggtgttctatatatttggagcttgtgggtgtgctgtttgcttgctctggttcgtcctgttttacgacgatccgaaggatcatccctgtatatcaatttcggaaaaagagtacatcacttcctcgctcgtgcagcaggtgagcagttcccgccagagcctcccaattaaggccattctcaagagcctgccagtatgggcaatcagtactgggtcctttaccttcttctggtcccataacattatgacactgtacactcctatgtttattaactcaatgctgcatgtaaatattaaagagaatggattcctgagcagcctgccatacctgtttgcatggatctgtggtaatctcgccggccaactgtccgattttttcctaacacgcaatattcttagcgtgatcgccgtgaggaagctattcaccgcagcaggattcctgctgcccgctatattcggagtctgcttaccctatttatcatctacattctactcaatagtgattttcctgattttggccggtgccacaggctcattttgcttagggggcgtgtttattaatggcctggacatcgctccccggtatttcgggttcataaaggcttgtagcaccttaacaggcatgataggtgggttaattgcatctacacttacagggctgatcttgaaacaagaccccgagtctgcatggtttaagaccttcatcctcatggctgcaattaacgtgacaggactgatcttttacctcattgtcgcaactgccgagatccaagattgggccaaggaaaagcaacatacccgattgtag

SEQ ID NO: 134863 - DNA, 630 bp, Artificial Sequence
  Description of Artificial Sequence: Synthetic coding sequence
atgcagatggacaaccggctgcctcctaaaaaagtccctggattctgctcgtttcggtacggactatccttcttagtccactgctgcaacgttattattaccgcccagcgggcttgcctcaatctgacgatggtggtgatggtgaatagtacagacccccatggcctgccaaacaccagtacaaagaaactcctggataacatcaagaaccccatgtacaactggagtccagacattcagggaataattttgtcgagtacttcatatggcgtgatcatcattcaagtgcctgtcggctatttcagtggcatttatagtaccaagaagatgattgggtttgcactctgcctgagctcagtgctgtccctactgatccccccggccgcaggaataggggtggcctgggttgtcgtctgtagagccgtccagggggcagcgcaagggattgtggccaccgcacaattcgaaatctatgtgaagtgggccccacctctcgagcgtggacgtctcacttcaatgagtacgtcgggattcctgctaggtccattcattgttttactggtcactggggtgatatgtgaatcactgggctggcccatggttttttatatcttcggacaattcaaatag

SEQ ID NO: 134864 - DNA, 1242 bp, Artificial Sequence
  Description of Artificial Sequence: Synthetic coding sequence
atgcagatggacaataggctgcctcctaaaaaggtgcccgggttctgttcattccggtacggtctttctttcctggtgcactgttgtaacgtgataatcactgcccagagagcttgcctgaacctgacgatggttgtcatggtcaacagcaccgacccccatggacttccaaatacgtccacaaaaaagttgctcgataatatcaagaatcctatgtacaattggagtccagatattcagggcatcattctcagcagtacctcctatggtgtaattatcatccaggtccctgtagggtatttcagtggcatttactctaccaaaaagatgatcggctttgcactgtgcctcagttcagtgttgtctctgttgattccacctgctgcaggaatcggagtggcctgggtcgtggtgtgcagagctgtgcagggggcggctcagggcatcgtcgccaccgcccagttcgagatctatgtgaagtgggcaccaccattagagcgaggacgcctgacaagcatgagtacctcaggcttccttctcggaccctttattgtcttgcttgtgacgggagtgatttgcgagtctctcggctggccaatggttttttatattttcggcgcatgcggatgtgctgtttgtctcctgtggttcgtgcttttctacgacgatcctaaggatcatccttgtattagcatcagcgagaaggaatatattacttccagtctagtgcagcagaacggattcctgagctcccttccgtatctgttcgcgtggatatgtggcaatttggccggtcagctgtcagacttttttctgacaaggaatattctctcagttatcgccgttaggaaacttttcaccgccgccggattcctgctgcccgctattttcggtgtgtgtttgccttatttgtcaagcaccttctacagcatagtcatcttccttatactagccggggcaacaggaagcttttgtctaggaggcgtgttcattaacggattagacattgcaccgagatacttcgggtttattaaggcctgcagcacgctcacaggcatgatcggaggtttaattgcttcaaccctgacggggctgatacttaagcaggaccccgaatcagcttggttcaaaaccttcattctgatggccgctatcaatgtcactggactgatcttttatctcatcgtagctaccgccgagatacaggactgggccaaggagaagcaacacactcgactgtag

SEQ ID NO: 134865 - DNA, 1242 bp, Artificial Sequence
  Description of Artificial Sequence: Synthetic coding sequence
atgcaaatggacaatagactgcctcccaaaaaagttcctggattctgttccttccggtatggcctaagtttcctagtacactgctgcaacgtaatcattacagctcagcgggcctgtttgaacctaacaatggttgtgatggtcaacagcaccgacccccatggtttaccaaataccagcaccaaaaaactgctggacaacataaagaaccccatgtacaactggtcccccgacatacagggaattatcttaagcagcacgtcctatggcgtgattataattcaggtacctgtgggatatttcagtggcatatacagcaccaagaaaatgatcggcttcgcattgtgcctctctagcgtgctgagtctgctgatccctcccgcagccggaattggagtggcctgggtggtagtgtgcagggccgtacagggtgctgcccagggaattgtcgctaccgcccaattcgagatctacgtgaaatgggcaccccccctggagaggggtagactcacttccatgtcgacaagcggcttcctcctgggcccttttattgtgctgctcgtaacgggagtgatctgtgaaagcctagggtggcccatggtgttctatatctttggtgcttgtggttgcgcagtgtgcctgctctggttcgttctcttttatgatgatcctaaagatcacccatgtatttctatcagcgagaaagaatatatcacttcctctctggttcaacagaatggattccttagcagtctcccctacctgttcgcttggatatgtggcaatttagctgggcagctctccgactttttcctgactcgcaatattttgagcgtgattgcagtcaggaagttgttcacagccgccggctttctactgcctgcaatcttcggggtttgtctgccatatctaagtagcacattttactcaatcgtcattttcctgatcctggccggagccaccgggtctttctgtctgggaggggtgtttattaatgggctggacatcgcccctcggtattttggtttcatcaaggcctgcagtactctgacaggtatgatagggggcctcatagcctccaccctcacaggtctgatcctcaaacaggaccctgagtcagcgtggtttaaaacattcattctcatggctgccattaatgtgacggggctgatcttttacttgatcgttgctaccgccgagatacaggactgggccaaggagaagcagcatacccgcctctag

SEQ ID NO: 134866 - DNA, 1404 bp, Artificial Sequence
  Description of Artificial Sequence: Synthetic coding sequence
atgcagatggacaataggctgccaccgaagaaggtacccggcttttgctcttttcgctatgggctgagtttcctcgtgcattgctgcaacgtcattatcaccgctcagcgggcctgtctcaacctcacgatggtggtcatggtaaactctacagatccgcatgggcttcccaatacaagcaccaaaaaactgctcgacaatatcaaaaacccgatgtataattggtcacctgacatccagggcatcatcctcagttctacgagctacggggtgatcatcattcaggtgcccgtagggtatttttccgggatctatagcaccaaaaagatgattggcttcgctctgtgtctgtcctctgtactgtccctgctaataccaccagcggccggtattggtgttgcttgggtggtggtttgccgcgcagtgcagggagccgcgcaaggcatcgtcgctactgcccagttcgagatctacgttaaatgggccccccctctagagagaggccgacttaccagcatgtctacaagcgggttcctcctgggaccattcattgtgttactcgtgaccggggtgatatgcgagagccttggttggcccatggtgttctacatcttcggagcttgcggttgcgctgtgtgcctactgtggttcgtgctcttttacgatgatccgaaggaccatccttgcattagtatctctgagaaggaatatatcacttcctctctggttcagcaggtgtcatctagtcggcagtccctgcccattaaggccatactaaaatccctccccgtttgggcaatcagtacgggatcctttaccttcttctggtctcacaacattatgactctatatacccctatgtttataaactccatgctgcatgtgaatattaaggaaaacgggttcctgtcctcgcttccttatctcttcgcctggatatgcggcaacctcgctggacagctgtccgactttttcctgacccggaatatcctgtcggtaatagcagtgcgcaagctattcaccgcagccggatttcttcttccagctattttcggcgtttgtttgccatatctcagctcgacgttctacagcatagtgattttccttatcctggcaggcgctaccgggtccttttgccttggcggggtttttatcaacgggttggatatcgcacctcgctattttggtttcattaaagcttgctcaacactcaccggaatgataggtgggcttattgcaagcactctgacagggcttatactgaagcaggacccagagagtgcctggttcaaaacattcattttaatggcggctattaatgtcactgggttgatcttttacctgattgtggccaccgctgagattcaggactgggcgaaggaaaagcagcatacccgactgtag

SEQ ID NO: 134867 - DNA, 1320 bp, Artificial Sequence
  Description of Artificial Sequence: Synthetic coding sequence
atggatggcaagcctgccacaaggaaaggcccagacttttgctcactgcgctatggcctggcccttatcatgcacttctcaaactttacgatgatcacacagcgagtgagcctgagcatcgccatcatcgccatggtgaatactacccagcagcaaggcttatcgaacgccagcaccgagggacccgtggcagatgccttcaacaacagtagcatatcaatcaaggaattcgacacaaaggccagcgtataccaatggtcgcccgaaacccaggggattatcttttcgtctataaactacggaatcattctgactctgattccctcaggatacttggccggaatttttggtgcgaaaaagatgctgggagccggactcctaatttctagccttctgaccctcttcacgccacttgcggcagactttggggtcatactggtgatcatggtgaggactgttcagggtatggcccagggaatggcctggactggacagtttaccatctgggccaaatgggcccctccactagagcggtcgaagctgacaacaatagcgggtagcggtagcgctttcggcagcttcatcattctgtgcgtcggagggttgatctctcaggcattatcctggcccttcattttctacatattcggctctaccggttgtgtgtgttgtctgctctggttcactgtgatatatgacgacccaatgcaccatccctgtatctccgttcgagagaaagaacacatactgagctctctagcacaacagccaagctccccgggtcgcgccgtacccattaaggctatggtaacctgcctgcccttgtgggccatatttttaggttttttcagccatttctggctgtgcactattatcctgacctatctgcccacctacatctctaccctcctgcatgtcaacatccgggactccggtgtgctctcttctctgcccttcatcgcagccgcctcctgcaccatcctggggggacagcttgcagatttcctactgtcaaggaacctcctccgcctcattaccgtaaggaagctgtttagtagcctggggctccttctgccatccatttgcgctgtggctctgcctttcgtggccagcagctatgtaattactatcattttgctcatcctgatccctgggacttcaaatctctgcgactctggcttcatcattaacactttggatatagctccaagatacgcttcattcctgatgggtatctctagaggttttggcctgatcgctggcatcattagcagtactgcaactggatttttaattagtcaggttggcccggtctattag

SEQ ID NO: 134868 - DNA, 1311 bp, Artificial Sequence
  Description of Artificial Sequence: Synthetic coding sequence
atggacggcaaacctgcaactcggaaaggccctgacttttgtagcttgcggtatgggctcgcactaataatgcacttctcgaatttcaccatgatcacccaaagagtctccttgtccatcgccattatcgccatggtgaacactacccagcagcagggcttaagcaacgctagcaccgaaggtccagtggccgatgcatttaacaacagcagcatttcaatcaaggagtttgacacgaaggccagcgtctaccagtggagccccgaaacacagggtatcattttcagctcaatcaactacgggattatcttgactctgatcccaagcggctatcttgcgggaatatttggcgccaaaaaaatgctcggggctggcttgctcattagttcccttctcacactcttcacaccacttgctgccgattttggggttatcctggttatcatggtgagaacagtgcaggggatggcacagggaatggcctggactgggcaattcacaatttgggctaagtgggctccacccctggagaggtctaaattaactaccatcgctggtagcggatccgcattcggcagctttatcattttatgcgttggcggtctgatttcccaggcactctcctggcccttcatcttttatatttttggtagcacagggtgcgtttgctgtctcctctggtttacagtgatatacgatgatccaatgcatcacccatgcatctctgtgagggagaaggaacacattctgtcaagtctggcccagcagccttcctcccccggtcgcgcagtgcctatcaaggcgatggtgacatgcctgccactgtgggccatttttctggggttcttcagtcatttctggctgtgcacaataatcctcacttacctgcctacctatattagcactcttttacacgtcaacattcgcgattccggcgtcctcagcagccttccattcattgccgccgctagttgtaccatcctgggtgggcagctcgctgattttttgttgagccggaaccttcttcggctcataacggtccgaaagctcttctcctccctggatatgcaggtttccagctgggaatcacagggcgatctcggaagcagccaggaatcttcgctgcccttacctctggacagctcctcagttagaattctcagcttggttggaggcatgagcttttcctgtctcctccagagcacatgcttggcttggtcctttacaagcaggctcgataagcagaattttaagaccggacccaaacgaggccccctgcctgcatcagaggacatcaaactgcaaacctag

SEQ ID NO: 134869 - DNA, 1437 bp, Artificial Sequence
  Description of Artificial Sequence: Synthetic coding sequence
atggacggcaaaccggccactcgtaagggccccgatttctgctccctgcgctacgggcttgcactgattatgcacttctctaattttaccatgatcactcagcgtgtatccctgagcattgccattatcgctatggttaatacaacacagcagcaaggtctctccaatgcttccacagaggggccagtcgctgacgcctttaacaattcctctatttctatcaaagagttcgatacaaaggcttctgtgtatcagtggtctccagaaacacaagggatcattttcagctccatcaactatggaatcatcctgacgctaatccccagcggatacctggctgggatttttggcgctaaaaagatgctgggagccgggctcctgatctccagcttattgacactctttaccccgctggcagcggacttcggggttatactggtaatcatggttcggacggtgcagggaatggcccagggcatggcctggaccggccagttcactatttgggccaagtgggccccccctttggaaaggagtaagctgactactatcgccggaagcggctcagcttttggctctttcatcatactgtgcgttggggggctcattagccaagcactgagttggccgttcattttctatatctttggctccactggatgtgtctgttgtttgctctggtttacagtgatatacgacgatcctatgcatcatccttgcatttctgtcagggagaaagagcacattctcagctccttggcccagcaaccgtcaagtcctgggagggccgtcccgattaaagcgatggtgacttgtttgcccctttgggctatcttccttggattcttttctcatttttggctttgcaccatcatactaacctaccttcccacgtacattagcaccttgttacatgtgaacattcgggattcaggcgttctctctagccttcctttcatcgctgctgcttcgtgtaccatccttggaggacagctggccgatttcctcctcagtcgcaacttactgcggctgataacagtgcgcaagctatttagcagtctgggactgttactgccttcaatctgtgctgtggcccttccgtttgtggccagctcctacgtcattacaattattctgttgatcctaatacctggtacttcaaacctttgtgatagcggcttcattattaacaccctggatatcgcaccaagatatgcatcatttctcatggggatctcgaggggctttggactgatcgctgggattataagcagcacagccacaggcttcctgattagtcaagactttgaaagtgggtggcgaaacgtcttttttctgtcggcagcggtgaacatgtttggactggtgttttatttgaccttcggtcaggccgaactgcaggattgggcaaaagagaggaccctcacccgtctctag

SEQ ID NO: 134870 - DNA, 1263 bp, Artificial Sequence
  Description of Artificial Sequence: Synthetic coding sequence
atggccactaaaaccgagctatctcccaccgctagagagtctaaaaatgcccaagatatgcaggttgatgaaactttaattcctaggaaagtcccatccctctgctcagccaggtatggcatcgccctcgtcttgcatttttgcaactttactaccatcgctcaaaatgttattatgaatattaccatggtcgcaatggtaaattcgactagtccgcaaagtcagttaaatgactccagtgaggttctgcccgtagactccttcggcggcttgtctaaagcccctaagagcctacctgccaaatcttctatcctgggtggacaatttgcaatctgggaaaagtgggggcccccccaggaaaggagtcgcctctgttccattgctctttcaggcatgctacttggctgtttcaccgcaattctcatcgggggtttcatctctgagactcttgggtggcctttcgtattctacatatttggcggagtgggatgtgtttgctgtctgctgtggttcgtggtgatttacgacgaccctgtgagctacccgtggatctccacttcagaaaaagagtatattatcagtagcctgaagcaacaggtcggatctagcaagcagccgctgcctatcaaagcaatgcttaggtccttgcctatctggtcaatatgtctcggctgctttagccatcagtggttggtgtcaactatggttgtgtacatccccacatacatctcaagtgtgtaccatgtcaatatcagagacaacggattacttagtgccttaccgttcatcgtcgcatgggtgataggcatggttgggggttacctcgccgattttctcttgactaaaaagtttcgtttaattaccgttagaaaaattgctaccatcttgggcagtttaccatccagcgcccttattgtttcccttccctacttgaactcaggttatattactgccacagctctgcttactctgagctgcggtttgagcacattatgtcagagtggaatatacattaatgtgctagatatcgcaccaaggtactcctcgtttttaatgggagcctctcgcggctttagctctatcgctccagttatcgttccaaccgtatcaggattcctcctgagccaggaccccgagttcggctggcgcaacgtgtttttcttactgtttgcggtgaatttgctcggactcctattttatcttatttttggggaagctgacgtgcaggaatgggccaaggaaaggaagctgaccaggctttag

SEQ ID NO: 134871 - DNA, 1263 bp, Artificial Sequence
  Description of Artificial Sequence: Synthetic coding sequence
atggctacaaagactgagctttcaccaactgctcgtgagtccaagaacgcgcaagacatgcaggtggatgagaccctgattccgcgaaaagtcccatcactttgctccgcccgctacggcattgctctggtcttgcacttctgtaacttcactacaatagcccagaatgttattatgaatattacaatggtggcgatggtcaactctactagcccccagtctcagttaaatgactcaagtgaagttttacctgttgactcttttggaggactttctaaggccccgaaatctctgcccgctaaatcctcaatattggggggccagttcgcaatttgggagaagtggggcccaccccaggagagatctaggctgtgtagcattgccctgtccggtatgctgttaggatgtttcacagctatcctgattggaggtttcatctccgagacactgggctggccttttgtattttacatttttggcggagtcggctgtgtctgctgcttgctgtggttcgtcgttatttatgatgacccagtcagttacccttggatctccacctccgaaaaggaatatataatctccagcttgaagcagcaggttggttcatccaagcagccacttcccataaaggctatgctgcgcagtctgccaatctggagcatctgcctgggctgttttagccatcaatggctcgtgtctacaatggtggtgtatatccccacatacattagctctgtgtaccatgtgaacattagagacaatggtctgctgtctgcgttgccatttattgttgcctgggtcataggaatggtcggagggtacttagctgacttcctgctgaccaagaaattccgcctgataactgtccggaagattgccactattctggggtctctccccagtagtgccctgatagtcagcctaccctacctgaattccggctatatcactgctacagcccttctcacactctcatgtggactctcaaccctatgtcagagcggtatctacattaatgtactcgacatagccccccgatacagcagcttcctcatgggagcctctcgcggattctccagtattgctccagtcattgtgcctaccgtctccgggtttctattgtcgcaggatccagagtttggttggcggaacgtgttcttcctcctttttgccgtgaatctactcggattgctgttttatctcatctttggtgaagcagacgtccaggagtgggccaaagagaggaaattaacccgcctttag

SEQ ID NO: 134872 - DNA, 1497 bp, Artificial Sequence
  Description of Artificial Sequence: Synthetic coding sequence
atggctactaagaccgaactgtcgccgaccgctagggagagcaaaaatgcccaggacatgcaggtggacgaaaccctcatccccagaaaagtacctagtctttgttctgcccggtacggcatcgccctcgttttgcacttttgtaacttcactaccatcgctcagaacgtaattatgaacatcacaatggtggcaatggtgaactctacgagtccacagtcacaactcaatgattcttctgaggtccttccagtggattctttcggaggtctgagcaaggcacccaaatccctgccagctaaagccccggtctatgattggtctccacagatccagggcattatattcggcgctgtaggttatggggggatcctcaccatggcaccaagcggttatcttgctggcagggtgggtactaagagggtcgtcggcattagtctgtttgccaccagcttccttaccctctgcattccgcttgccacggattttggcatcgtcttgctgatagtgacgcggattgtgcaaggcctctctcagtcctctatactaggcggtcaattcgccatatgggaaaaatggggccccccacaggagcggtcccgtctatgctccatcgctctgtctgggatgttactagggtgttttacggctattctgattggtggattcatctctgagactctgggctggcccttcgttttctatatcttcgggggtgtgggctgtgtgtgttgtctgctgtggttcgttgtaatctacgacgacccagtgagctatccctggatcagtacttcggagaaggagtatatcattagttctttgaagcagcaggtgggatctagcaagcagccactgcctatcaaagcaatgttgcgctctcttccaatctggtccatctgtttaggctgtttctcacaccagtggctcgtgagcacaatggtggtgtatatacctacttacatctcaagtgtgtatcacgtaaacattagggataatggcttgctaagcgctctcccatttatcgtggcgtgggtaatcggcatggttggcgggtacctggccgacttccttctgaccaagaagttccgccttattacagtccggaagatcgctactatcttgggctctcttccctcttccgccttgatcgtgtctttaccctatctaaacagtggatatatcacagcgaccgcgttactcacactgtcctgcggcctctctactctctgccagtctggtatctatattaacgtgctggacattgcgcccaggtactcttctttcttgatgggcgcttctcgcggcttctcgtctatcgcccctgtgatcgtgcctaccgtgtcaggtttcttactgtcccaggatcctgagttcgggtggagaaacgttttttttcttctcttcgccgtgaatctgcttggcctccttttttatctgatcttcggcgaggcggacgtgcaggaatgggcaaaagaacgaaagctaacccggctctag

SEQ ID NO: 134873 - DNA, 300 bp, Artificial Sequence
  Description of Artificial Sequence: Synthetic coding sequence
tgaactttgtcttgcggattaagcacactctgtcagagcggtatctacatcaatgtgctggacattgcccctaggtatagcagtttcctgatgggtgcctcaagagggttctccagcatcgcgcccgtcattgtacctactgtttccgggttcctgctatctcaggaccctgaatttggatggagaaatgtttttttcttactgttcgctgtgaacctgctcgggctgctgttctacctgatcttcggcgaggctgacgtgcaagagtgggccaaggagcgaaaattgacaaggctatag

SEQ ID NO: 134874 - DNA, 156 bp, Artificial Sequence
  Description of Artificial Sequence: Synthetic coding sequence
tctggattcctactctctcaagatccagaattcggctggaggaacgtcttctttttgcttttcgcagtgaatctgctgggactcctgttctacttaattttcggtgaagctgacgtccaagagtgggccaaagaacggaagcttacaaggctctag

SEQ ID NO: 134875 - DNA, 1494 bp, Artificial Sequence
  Description of Artificial Sequence: Synthetic coding sequence
atgtcaaccgggcccgatgtgaaagcaaccgtgggcgatattagcagtgatggtaacctgaacgtggctcaagaggaatgtagcagaaaaggattttgctcggtccgacacgggttggctttgattttacaactgtgcaacttttccatctacacacagcagatgaacttaagtatcgcgatcccagccatggttaacaacacagctcctccctctcagccgaacgcgtccacagagcgccctagcaccgattcccagggctattggaacgaaaccctgaaagaatttaaggcaatggcccccgcttacgactggtcccccgaaatacagggaataattctcagctcactcaactacggctcctttctggcccctatcccgagcggctatgttgctggaattttcggagctaagtatgtggtgggggctgggctgttcatcagttcttttttaactctgttcatcccacttgccgccaatgccggcgtggctcttctgattgtcctgagaatagtgcagggcatcgcacaggtgatggttctcactggccagtatagtatctgggtgaagtgggcccctccactggagaggtcccagctgacaaccatagctgggagcggcagtatgctcggctcttttatagtgctacttgctgggggactgctgtgccaaactatcggatggccctacgtgttttacatatttggcggaattggttgtgcctgttgccctctgtggtttcccctcatctacgacgatcccgtgaatcatccttttatctcagccggcgagaagcgatacatagtgtgtagtttagcccaacaagattgcagccctggatggagcctgcccatacgcgccatgattaagagtttgcccctgtgggccattctggtcagctacttctgtgaatactggctgttctacaccattatggcgtatacccccacctacatttcaagcgtactccaggctaacctgagagatagcggcatcctcagcgcccttccctttgtcgtaggctgtatttgcattatactgggaggcctgcttgcagattttctgttgagtcgtaagattcttcggcttattacgattcgcaagctctttactgccatcggcgtgctgtttccttcagtcattctggtgagcctgccatgggtgcggtccagtcacagcatgacaatgacatttctcgtactgagcagtgcgatttcatcattctgcgaatccggtgctctcgtgaacttcctggacatagccccaaggtatacaggcttcctgaagggcttgctgcaagttttcgcacacattgccggcgccatcagtcccactgccgccggattcttcatctcacaagacagcgagtttggttggcgcaatgtgtttctgcttagtgcagctgtgaacatttccggtctggtcttttacctgatttttggtcgggcggacgtccaggactgggctaaggagcagactttcacgcacttgtag

SEQ ID NO: 134876 - DNA, 666 bp, Artificial Sequence
  Description of Artificial Sequence: Synthetic coding sequence
atgaatctctctattgctatacctgcgatggttaataacaccgctcctccgagccagccgaacgcctctaccgagaggcctagtacagacagtcaggggtattggaacgagacgcttaaggaattcaaagctatggactgctccccaggctggtcactgcctatccgcgccatgatcaaaagcttgcccctgtgggcaatcctggtgagctacttctgcgagtattggcttttctacacaataatggcctatacgcctacttacatttcatctgttctgcaagctaacctccgcgattccgggattctgtccgcacttcccttcgtcgtcggttgtatttgtattatcttggggggtctgctggccgactttctgttgtcacgtaagatactcaggctgattacaattagaaagctgtttaccgcgatcgggaagggagagaccggacaccgaggagaacgagggaagctgagagcagccttcagcctcttgtgcgtatgtccaccaacccctggtgtgctgtttcctagcgttattctggtatctttgccttgggtacgttctagccatagcatgacaatgacatttctcgtgctcagctcagccatttcctctttttgcgaatctggggccctcgtgaactttcttgatattgctccacgctag

SEQ ID NO: 134877 - DNA, 804 bp, Artificial Sequence
  Description of Artificial Sequence: Synthetic coding sequence
atgtccaccgggcccgacgtgaaggcaaccgtaggcgacatcagttcagacggcaacctgaatgttgctcaggaggaatgcagtcgcaagggcttctgcagtgttcggcacgggttagcccttatattacaactgtgtaacttttccatatacacccagcaaatgaatctgtcgatcgccattcccgcaatggttaacaacaccgcaccaccttcccagcccaacgcttcaaccgaaaggccatctacagactcgcagggttactggaatgagacactgaaagaattcaaggcaatgtccggtattctgagcgctctgcctttcgttgttgggtgtatttgtattatcttgggtggattgctggcagattttctgctgagtcgcaaaatactccgcctgattactattcggaagctcttcacagcaatcggcgttctctttccatccgttattctggtgagtctgccctgggttcggagcagccattctatgacaatgaccttccttgtgctatcaagcgcgataagttctttctgcgaaagtggcgccctcgtgaactttctggacattgcaccccgctacactggttttttgaagggactgctgcaggtcttcgcccacattgctggcgcaatttccccgactgcagccggcttttttatctcacaggatagcgagttcggctggcgaaacgtgtttctgttaagcgctgccgtgaatatcagcggcctggttttttaccttatcttcggtcgcgccgacgtacaagattgggccaaagagcagacttttacccatttatag

SEQ ID NO: 134878 - DNA, 1749 bp, Artificial Sequence
  Description of Artificial Sequence: Synthetic coding sequence
atggagtcagtgaagcagcggattctcgcccctggcaaggagggcctaaagaacttcgctggaaagtcgttgggccagatttatcgggtgttggaaaagaagcaggatactggggaaactatcgagcttacagaagatggaaaaccgctggaagtgccagagcgaaaagctccgctgtgtgactgtacctgctttggcctgccccgacggtacatcattgcaataatgtctgggcttggcttttgtatttcatttgggatccggtgcaacctgggggtagctatcgtggatatggtcaacaattcaacaatccaccgcggcggaaaagtgataaaggaaaaagccaagttcaactgggacccagaaactgtcggcatgatccacggcagcttcttctggggctatataatcacacagatacccggaggctatatcgcctcacgactggcagctaacagggtgtttggcgccgcaatcctacttacgtccacactgaatatgcttattccttctgcagctcgggtgcactacggctgcgtgatatttgtgcgtatcctgcagggcctggtggaaggtgtgacctaccctgcctgccacgggatatggtcaaagtgggcacctccactggagcggtctcgactggcaaccacctctttttgtggcagctacgcaggtgcggtcattgccatgcccctcgccggaatactcgtgcagtacaccggatggagctctgttttctatgtgtacggctcctttggcatggtttggtacatgttctggttgctggtgagctacgaatctcctgcaaaacatccgactattacagacgaagagcggcggtacattgaggaaagcattggagaatcagccaatttactcggcgccatggaaaaatttaaaaccccttggcgaaagttctttacaagcatgcccgtgtacgccatcattgtggccaacttctgtcgctcatggactttctatctcctgttaatttcccaacccgcatactttgaagaagtgttcggattcgagatctccaaggtgggcatgttatcagcagtcccccacctggtaatgaccataatcgttccaattggaggccagattgccgatttcttaaggtcgaagcagatcctcagcactaccaccgtgcgcaagatcatgaactgcggcggttttggtatggaggctacactgctgttagtggtgggctacagccatacccgcggcgtggcaatttcattcctggtgctggcagtcggctttagcggctttgcaatttcaggtttcaatgtcaatcatctggacattgccccgcgctatgcctccatcttaatgggtatctcaaatggggttggaaccctgagtggcatggtatgtccaattatcgtgggggcaatgaccaaaaacaagtctagagaagaatggcagtacgtcttccttatcgcagccctcgtgcattatggaggcgtcattttctacgccatttttgctagtggggaaaagcagccttgggcagacccagaggagacctccgaagaaaaatgtggattcatacacgaagacgagttggatgaggagacgggcgacataactcaaaattacatcaactacggtaccactaagagttatggcgccacgacgcaagccaacggaggatggccatctgggtgggaaaagaaagaggagttcgtgcagggcgaggtgcaagactctcatagttacaaggaccgcgtagattactcatag

SEQ ID NO: 134879 - DNA, 1413 bp, Artificial Sequence
  Description of Artificial Sequence: Synthetic coding sequence
atgaaggcaaagttcaattgggaccccgagactgtgggcatgatccatggcagctttttctggggctatattatcacacagatcccagggggctatatcgcttcacgactggccgcaaatagggtgttcggggccgctatccttctcacaagcaccctcaacatgctgattcctagcgcagcaagagtgcactacgggtgcgtgatcttcgtgcgcatactgcagggactggtggagggtgtgacgtacccagcatgccacggcatctggtccaagtgggctccccctctggaacgcagccgcctggcaactacctcattttgcgggtcctacgccggagcagttatagcaatgccactggctggaatcctggtgcagtacaccggctggtcttcagtgttttacgtgtacggatccttcgggatggtgtggtacatgttttggcttttggtgtcctacgagagccccgccaagcatcccacaatcactgacgaggaaaggagatacatcgaggaatccataggcgaatcggcaaatcttttgggagctatggagaagttcaaaaccccttggcgcaagttttttacttccatgcccgtgtatgccatcattgtggccaacttttgtcgatcgtggaccttctacctgctgttaatatcccagccagcgtattttgaggaggtctttgggttcgagattagtaaagttggtatgttgtctgctgtaccccacctggttatgacaattatcgtcccaattgggggccagattgccgactttttacggtcaaagcagatcctgagtactactacggtcaggaagatcatgaactgtggaggatttggcatggaggcgactttgctgctggtcgtcgggtactcccatacacgaggggtggctatttccttcctagtacttgctgtggggttctcaggcttcgccataagcggatttaatgtgaaccatcttgatattgctccacgatatgcaagcatacttatggggattagcaacggcgtcgggactctttccggcatggtgtgcccaattatagtcggagccatgacaaagaacaaatcacgggaggaatggcagtatgtatttttaatcgccgcccttgtacactatgggggcgtgatcttctacgcgatttttgcatcaggcgagaagcaaccgtgggccgatcctgaagaaacctccgaggaaaaatgcgggttcatacatgaagatgaactggatgaggagacgggcgacataacccagaattacatcaattatgggactacaaaaagttatggcgcgaccactcaggcaaacggcggctggccatccgggtgggaaaaaaaagaggaatttgtgcagggcgaagtacaggattcccatagttataaagatcgcgtagattactcctag

SEQ ID NO: 134880 - DNA, 5223 bp, Artificial Sequence
  Description of Artificial Sequence: Synthetic coding sequence
atgggagagaagctggagctgcgcttgaaaagtccggtaggggctgaacccgctgtttatccatggcccctgcctgtgtacgacaaacatcatgacgctgcacacgagattatcgagacaatacgatgggtgtgtgaggagatacccgacctgaagctggccatggagaattacgttctgattgactacgacacgaagtcattcgagtccatgcagcggttgtgtgacaagtataatcgcgccatcgattctatacatcagttatggaaaggtacaacacaaccaatgaagttaaacactagaccatctactggactgctgcgccacatcctccagcaggtctacaatcactccgtgacagaccctgagaagttgaataattacgagccattctccccagaggtatatggggagacttcatttgatcttgtggcacagatgattgatgaaatcaagatgacagacgatgacttatttgtggacctgggttctggcgtcgggcaggtggttcttcaggtcgcggctgccaccaactgcaagcatcattatggagtcgaaaaggcagacattcctgctaaatatgccgagaccatggatagagagtttcgtaagtggatgaagtggtatgggaagaagcatgccgagtacacacttgaacgaggagattttcttagcgaagagtggagggagaggatcgccaatacttctgttatctttgtgaacaacttcgccttcggaccagaagtggatcaccaattgaaggagcgtttcgccaatatgaaggaaggtggaagaatcgtctcttccaagccgtttgcacctctgaattttagaatcaacagccgcaatttaagcgacataggcactatcatgcgggtagtggaactgtctcctctcaagggctcagtatcatggaccggcaagccagtgtcatattatttgcacactattgaccgtactattctagagaattatttttctagcttgaaaaaccccaagcttcgggaagaacaggaggctgccagaaggcgtcaacaaagagaatctaagtccaacgccgctacccctaccaaaggtcccgagggcaaagtagccggacccgcagacgctcctatggattcaggagccgaagaagaaaaagctggcgccgcgactgtgaaaaaaccttcaccctctaaagcccgcaagaagaagctgaacaagaaagggcgaaagatggcgggccgtaagcgagggcggccaaagaaaatgaacaccgcaaacccagagcgcaagcccaaaaagaaccagacagctctggacgcattgcacgcccaaaccgttagtcaaacagcggcgtccagccctcaggacgcttaccgaagcccccacagtcctttctaccaactgccaccaagcgttcagcgccacagcccgaatccgctgttggtcgcccctacacccccggcattgcagaaactgcttgagtccttcaaaatccagtatctgcagttcctggcatacacaaagacacctcaatataaagcgagtctccaggaactcttagggcaggagaaagagaaaaatgcacaactgttgggagctgcccaacaactcctaagccactgtcaagcccagaaggaggaaatccgccggctgtttcaacagaagctggacgagctgggcgtgaaagcattgacctacaatgacctcatccaggcccaaaaagaaatcagcgcacacaatcagcaactgcgagagcagtctgagcagcttgagcaagacaatcgcgcattacgtggtcagagcctgcagctgcttaaggcacggtgtgaggagttgcagctggattgggcaactctgagcctggaaaagctgcttaaggaaaagcaggccctgaaatcccaaatcagtgagaagcagcgacactgcctggagcttcagatctccatcgtggaactggagaaatcccagagacagcaggaactgctgcagcttaagagttgtgtgcctccggacgatgcactgtcactgcaccttcgggggaagggcgcactgggacgagaactggagccagacgccagcagattgcacctcgaactggactgcacaaaattcagtctccctcatctcagcagcatgagtcctgagctgagcatgaatggacaggcagccgggtacgagctgtgcggggtcctgtcacgaccgtcatccaaacagaatacccctcagtatttggcctccccactcgatcaggaggttgtgccgtgcactccctcccacgtggggcgcccccgattagagaaacttagtggcctggctgctcccgattacacccgattatctcccgcgaagatcgtcctgcgtcgccaccttagccaggaccacactgtgccaggccgaccagcggccagtgaactccacagccgcgcagaacacactaaggaaaacggcctcccataccagagcccaagcgtgcctgggagcatgaaattgtctccccaggaccctcgtcctctgtcccctggagcacttcaattggccggggagaagagcagtgagaaaggactgagagagagggcatacggaagcagcggcgagctcatcacatccctacctatctccatcccgctaagtactgtgcagcccaataagttgcccgtcagcattcctctggcatctgtcgtcttaccgtcgcgcgctgagcgggctcgaagcactccatctccagtgctgcaaccacgtgacccttcctcaactttagaaaagcagattggcgcgaacgctcacggagccggaagcaggagcctggcactggcccctgcaggtttttcctatgcgggttccgtggcgatttccggggctctcgccggttcaccagccagcctgacaccaggcgcagagcccgctaccctcgatgagagctcctcttcagggtctctcttcgcaacggttgggtccaggtcatccacaccccagcacccattactcctggctcagccacgaaactccctaccagcctcacctgcccaccagctgagcagcagcccgagattaggcggggctgctcagggaccgctgcccgaggcatccaagggagatctcccaagcgatagtgggttctccgatcctgagagcgaggctaagaggagaattgtgtttactatcaccaccggcgcgggatctgcgaaacagtctccctccagtaagcactctccgcttactgcctccgcccgcggagactgtgtgcccagtcatggtcaggatagtagacgcaggggcaggagaaagagagcctctgccgggaccccctccctgtccgctggcgtgagtccaaagcgccgggcccttccttccgttgctggtttgtttactcaacccagcggatctccattaaatcttaactcaatggtgtccaacattaaccagccgctggaaatcacagctatttccagtcctgagacctcattaaaatcctcaccagtgccttaccaggaccacgaccaaccccccgtgctgaagaaggaacgccccctgtcacagacgaacggcgctcactattcaccactgaccagtgacgaggagcccgggtccgaggacgaaccctcaagtgcgagaatagaaaggaaaatcgccactattagtcttgaatccaaatcacctccgaaaaccctggaaaacggcggaggcctggcaggccgaaaaccggcacccgctggggagcctgttaattcctcaaaatggaagagcacattttcacccatttctgacatagggctggcgaagagtgccgattcacctctccaggcgtccagtgccctttcacaaaacagcctcttcacttttagaccagctttagaggaaccgtccgccgatgccaaacttgccgctcaccctagaaaggggttcccagggagcttatcgggagccgacgggctctcaccaggcactaatcctgctaacggatgtacctttggaggaggcttggccgcagacttgtcgctacactccttctccgacggagccagcctgccccataagggacctgaggccgccggcctgagctctcccctgtcgtttccgagccagcgtggaaaggaaggctctgacgcaaacccgttcctgagtaagcggcagttggacggtctggctgggctcaaaggagagggcagcagagggaaggaagccggggagggaggactgcccctgtgtgggcctacagataaaacaccactcctgagtgggaaagccgccaaagcaagagacagagaggtcgatctgaaaaatgggcacaacctcttcattagcgcagccgcggtgcctcccggttctctgctctcaggccccggactcgcccctgccgcctccagcgccggcggcgctgcaagctccgcccagacacatcgcagtttcctcggcccgttccctccaggtcctcagttcgcgctcgggcccatgtcactgcaagctaacctggggtccgtggctggctcatctgtgctccagagccttttcagctccgttccagccgcagctggtttggtgcacgtgagtagtgcggcaacccggctcaccaattctcatgccatggggagtttcagtggggttgcaggtggcaccgtcggggctggtggcgtgtttaaccacgccgtcccatccgccagcgcccatccttttggagcgagggtgggtcgaggcgccgcgtgtgggagcgctaccctggggccaagtcctctgcaggctgcagccagcgcttccgccagctcgttccaagctcccgcctctgtggagacgcgtcccccgcccccaccccccccccccccacctcctctgccaccgccggcacacctcggtcggtcccctgccggcccgccagttctgcacgcaccaccgccacccaacgcggctctgccacctccaccgactctgctggcatccaacccagaaccagctttgctgcagagtctggcctcactcccaccaaaccaagctttcttgccccccacatccgctgcctcactgcctccggccaacgcgtcactgtccatcaagctgacctccctgcctcacaagggggcccgcccgtcatttacagtccatcaccaaccactcccacgtctggctctggctcaggcagcccccggaattccgcaggcgtcagcgaccggaccctccgccgtatgggtctcattagggatgcctccaccttatgctgcacatcttagcggcgtgaagcctcggtag

SEQ ID NO: 134881 - DNA, 1647 bp, Artificial Sequence
  Description of Artificial Sequence: Synthetic coding sequence
atgggttctcagctggcacttgccggacttctagaaaaaaggcaggagggggccgagactttggagctgtcagccgacggaaggccagtaacaactcagacccgggacccccctgtcgtggattgtacctgctttgggctgccccggcgctacatcatcgcaataatgagtggtcttggtttctgcataagcttcggaatccgctgtaacctgggggtcgccattgttagcatggtcaacaactctacaacccatagaggagggcacgtcgttgttcaaaaagcacagttctcatgggaccccgagaccgtaggactgatccatgggagcttcttttggggttacattgtgacacagattcccgggggatttatctgccagaagtttgccgccaatcgggttttcgggtttgccatcgtggctacctcaacacttaatatgttgattccttccgccgcacgcgttcactacgggtgtgttatctttgtgagaatcctccaaggactagtcgagggagtgacctacccagcttgtcatggtatttggtcaaagtgggcccctcccctggaaaggtctagacttgcgactaccgccttttgtggatcctatgccggagctgtggtggctatgcccctcgctggagtcttagtccagtatagcgggtggagctcagtgttctacgtttacgggtccttcggcatcttctggtacctcttttggctgctggtgtcatatgagtcccctgcgctgcacccaagcatcagtgaggaggagcgcaagtatattgaggatgccataggagagagcgcaaaacttatgaacccattaaccaagttcagcactccctggaggcgtttctttactagtatgcccgtctacgctattatcgtcgctaatttctgtcgaagttggaccttctacctcctccttatcagccagcccgcctattttgaagaagtattcgggttcgagatatcaaaagtggggctggtgagtgcactgccgcacctggtgatgactattattgtgccgatcggtggccaaatcgcagatttcctgcgatcacgacggattatgtccacgactaatgtgcgaaagttgatgaactgcggcggatttggcatggaagcgacgctgcttctggtggtcgggtactcgcattctaagggcgtggccatatcttttctggtgttggctgtgggattcagcggttttgccatctctgggttcaatgtgaatcaccttgatatcgctcccaggtatgcctctattctcatgggcatctcgaacggggtcggcacgctcagcggcatggtgtgccccatcatagtcggggcaatgacaaaacacaagactcgggaagaatggcagtacgtgttcctgatcgcctctttggtacactatgggggcgtcatcttctatggtgtctttgcctcaggagagaaacaaccctgggccgagcctgaagaaatgagtgaagaaaagtgtggcttcgtgggccatgatcagctggcgggctcagatgactcagaaatggaagatgaggcagagccaccaggtgccccgcctgctcctcccccttcttatggagcaactcattctacattccagcccccgcgtccccctccgcccgtaagagattattag

SEQ ID NO: 134882 - DNA, 1770 bp, Artificial Sequence
  Description of Artificial Sequence: Synthetic coding sequence
atgccctttaaggccttcgacactttcaaagagaagattctgaaaccaggaaaagagggggtcaagaacgcagtcggggatagcctcggtattctgcagagaaagatcgatggaactacagaagaggaggataatattgagttgaatgaggagggaagacctgtgcagacctctagaccatctcctcccctttgcgactgtcattgttgtggcttgccaaaacgctatattattgctataatgtcaggactgggtttctgtataagtttcgggatacgatgcaacctgggcgttgccatcgttgaaatggtaaacaacagcaccgtgtatgtggacggaaaaccggagattcagactgctcagtttaattgggaccctgagacagtcggtctgattcatggaagcttcttctggggttatatcatgacgcagattccagggggctttatcagcaacaaattcgccgctaatcgcgtgtttggagccgctatctttctgacaagcacactgaacatgttcattccttctgccgcccgagtgcactacggctgcgtgatgtgtgtgaggatcttgcaagggcttgtcgagggggtgacctaccccgcttgtcacggtatgtggtccaagtgggcaccgccactggagcggtctcgcctggcaacaacctcattctgcgggtcttatgccggcgccgtggtggctatgcctctggcgggcgtcttggtgcagtacatcgggtggagctccgtgttctatatatatggcatgttcgggatcatctggtacatgttttggctcctgcaagcttacgagtgtccggcagcacacccaactatttccaacgaggaaaagacgtatatagaaacaagtataggcgagggagccaatgtggtttcgttatccaaatttagtaccccatggaaacgtttttttacatccctccccgtttacgctataattgtcgctaatttctgcagatcctggacattttatctgctcctgatctcacagcccgcctactttgaagaagttttcggttttgctatctccaaggtcggcctactctccgcagtaccccacatggtgatgaccatcgtggttcccatcggcgggcagttggcggattacctgagatcaagacagattcttaccacaacggcggtgaggaagatcatgaactgcggcggcttcggcatggaggccactttattgttggtggtgggctttagccatacaaagggtgtggcaatctcattcctcgtgttggccgtgggcttctctgggtttgctattagcggattcaacgtcaatcacctagatatcgctccacggtacgcctccattctcatgggaatctctaatggcgttggcaccctctcaggaatggtgtgccccttaatagtgggggctatgacccgccataagaccagagaagaatggcaaaatgtttttctcattgccgccctcgtacactattctggtgtgatattctacggagtgtttgccagtggcgagaagcaagagtgggccgatcctgagaatctgagcgaggaaaagtgtggcatcatcgaccaggacgaacttgctgaggagatcgaactaaatcatgagtccttcgccagcccaaagaaaaagatgagttatggagcaacatctcaaaattgcgaggtccagaagaaagaatggaagggacaacgtggggctactctggacgaggaagagctgactagctatcaaaatgaggagcgaaacttttcgactatcagctag

SEQ ID NO: 134883 - DNA, 1620 bp, Artificial Sequence
  Description of Artificial Sequence: Synthetic coding sequence
atgccatttaaagctttcgacacattcaaggaaaaaatccttaagcccgggaaggaaggggtgaagaatgccgtcggcgatagcctcgggatattacagaggaagatagacggtacgactgaagaagaggataatatcgagctgaacgaagagggccgcccggtgcagacgtcacggccctcacctcctctgtgtgactgccattgttgcgggctgccgaagcggtacatcattgcgataatgtcaggtctggggttttgcatctcatttggaatacggtgcaatctcggcgtggctatcgtagagatggtgaacaactctaccgtgtacgtcgacgggaaacctgaaattcagactgcacagttcaattgggacccagaaacagtgggccttatccacggcagttttttttgggggtacattatgacacagattccaggcggattcatatctaacaagtttgccgcaaatagagtttttggcgccgcaatctttcttacctcaactctgaacatgttcattccgagtgccgcaagggtccattacggttgcgtaatgtgtgtgcggattctgcagggtctggtcgaaggagttacttatccggcctgtcatggaatgtggtctaaatgggcccctcctctggaaagatctagactggccacaaccagcttttgcgggtcctacgcaggtgcagtggtggcaatgcctctcgcaggagtactggtccagtatattggatggtcaagtgtattttatatctacggtatgtttggaattatctggtatatgttttggctcctgcaggcgtacgagtgtcctgccgcacaccctaccatttctaacgaagagaaaacttatattgaaacgtctatcggagagggcgccaacgttgttagtttaagcgtgggcttactgtccgctgtgccccatatggtcatgactatcgtggtgcctattggcggacagctcgcagactatctgaggagtcgccaaattctcactacaactgcggtcagaaaaattatgaattgcggcggctttggtatggaagccacgcttcttttggtggtcggcttcagccacacgaaaggcgttgctattagcttcctcgttctcgccgtgggctttagcggcttcgctatcagcggctttaacgtgaaccatctggacattgcccctaggtacgcgtcaatcctcatgggtatttccaatggggtgggcacgctcagtgggatggtgtgccccctcatagtgggcgccatgacgaggcacaagacgagggaagagtggcaaaatgtctttttaatagccgcactggttcactactcgggtgtaattttctacggagtcttcgcctccggtgaaaaacaggagtgggctgaccctgagaatctgagtgaagaaaaatgtggcatcattgatcaagacgaattggctgaagagatagaacttaaccacgaaagctttgcttctcccaagaaaaagatgtcctatggtgctacatcccagaactgtgaggttcaaaagaaagagtggaagggccagaggggagcgactctagatgaagaagagttgacaagttatcagaatgaagagcgtaatttctctactatctcctag

SEQ ID NO: 134884 - DNA, 1293 bp, Artificial Sequence
  Description of Artificial Sequence: Synthetic coding sequence
atgactctgacaagtcgccgccaggactctcaagaagcaagacccgagtgtcaggcctggacaggaaccttgttgctgggcacttgcctgctttattgtgctaggagttccatgcctatctgtaccgtatccatgagtcaggactttgggtggaataagaaagaggctggtatcgtgttgtcgtctttcttctggggatactgccttactcaggttgtggggggccacctcggcgataggattggaggcgagaaagttatccttttgagcgcttcagcgtggggttccattacggctgtgaccccccttttggctcacctgtcctctgcgcaccttgctttcatgaccttttccagaatcctgatgggcttgttacaaggcgtgtatttccctgccctgacatctttgctgtctcagaaagttcgagagtctgagagagccttcacttacagcatcgttggagccggaagccagttcgggactctacttacaggcgccgtgggcagtctgctactcgagtggtacggctggcagtctatcttttacttttctggagggttgacgctcttgtgggtgtggtacgtgtacagatacttgctctccgagaaagacctgattcttgcgcttggggtattggcccagtcccgtcccgttagccgccataatagggtgccatggcggaggctgttcaggaagccggctgtttgggccgccgttgtttcccagctgtccgcggcatgttccttcttcattctcctaagctggctcccaactttctttgaggaaacattccccgacgccaagggttggatttttaatgtggtgccatggcttgttgcgatcccagctagcctattttctggcttcctttcagaccatctgatcaaccaaggatatcgtgccattaccgtgcggaagctgatgcaaggaatggggttaggcctgagctccgtttttgccttatgcctcggccatacctccagcttttgtgagtccgttgtgtttgcgtccgcatccatcgggctacagaccttcaaccactctggcatctccgtgaatattcaggacctggcgccctcctgcgcaggcttcctgtttggcgtggccaacacggcgggcgccctcgcaggggttgtgggagtgtgcctgggcggctatctgatggagaccaccggaagctggacgtgtcttttcaatctggtcgctatcatctctaatctgggcctatgtaccttcttggtgtttggtcaggcccaaagggtggatctgtccagcacacacgaagatctctag

SEQ ID NO: 134885 - DNA, 1311 bp, Artificial Sequence
  Description of Artificial Sequence: Synthetic coding sequence
atgcagccaccacctgacgaagcaaggagggacatggcaggagatacacagtggagtagacctgaatgtcaggcctggacggggaccctcctgcttgggacatgcctgctgtattgtgcccgttcgagcatgcctatttgtacagtgtctatgtcccaggacttcggctggaacaagaaggaagccggaattgtcctaagcagtttcttctggggatactgtcttacacaagttgtgggaggccacctgggcgaccggattggaggggagaaggtaatcctcctgagcgcatccgcatgggggtcaatcacggcagttacacctctcctggcacatttatcaagcgcccacctcgctttcatgacgttttcacgaattcttatgggtctacttcagggcgtttattttcccgccctgacttcgttattatcgcagaaggtcagggaatctgagcgcgctttcacctacagtattgtgggcgcagggtctcaattcggtactctgctaactggtgccgtcggctctctgctgctggagtggtatggctggcagtctattttctatttcagtggaggactgactctgctctgggtctggtacgtgtacaggtatctgctctctgagaaggatttgatcttggctctgggagtactcgcgcagtctagaccagtttcccgccacaaccgggttccgtggcggaggctgtttcgcaagccagccgtttgggctgccgttgtgtcccagctgtcagctgcttgcagtttttttatcctgctcagttggcttcccaccttcttcgaagagacttttccagatgcaaaaggctggattttcaacgtggtcccctggctggtcgcgatcccagcgagtcttttttctggatttttgagcgaccatctgatcaatcagggctaccgggccatcacagtgagaaaactgatgcaaggcatgggactcggccttagttccgtcttcgcactgtgtctaggccatacttctagtttctgtgaatcagtggtgttcgcctccgccagcatcggacttcagacattcaaccactcaggtatctccgtgaatatacaagatctggcgccatcctgcgcgggttttctgttcggtgtggcgaatacggccggggcccttgctggagtggtgggagtgtgcctaggaggataccttatggagactactggttcctggacttgtctcttcaacctcgtggccatcattagcaatcttgggctctgcacctttctcgtttttgggcaagcccagcgggtcgacttgtcaagtacgcatgaggacctatag

SEQ ID NO: 134886 - DNA, 459 bp, Artificial Sequence
  Description of Artificial Sequence: Synthetic coding sequence
atgttcccaaggcctggagctcttagctggacagtgagaaggcatacacctagacaagtcgaaccgccatgtgtctgtatgactctgacctcgagaagacaggactcacaggaggcccgccccgaatgccaggcatggaccgggaccctattgctgggcacatgcctactgtactgcgcacggagttcaatgccaatctgcacagtgagcatgtcgcaggacttcggatggaacaagaaggaggccggaatagtgctgtcttcctttttctggggttactgcttgacccaggtcgtggggggccatctcggcgaccgtatcggcggcgagaaggttattctgttgtccgcgagtgcctgggggagcattaccgcagtaacacctctccttgctcatttgagtagcgcccatttagccttcatgaccttctcccgtatcttaatgggattgttgcagtag

SEQ ID NO: 134887 - DNA, 1599 bp, Artificial Sequence
  Description of Artificial Sequence: Synthetic coding sequence
atggaatctgccgaacccgcggggcaagcccgtgcagctgccacaaagctgtcagaggctgttggcgccgccctgcaagaacctagaaggcagagacggttagtgctcgtgattgtttgtgtggctctcttgctcgacaacatgctttacatggtcattgtccccattgttcccgactatatcgctcacatgcgggggggcggcgagggccccacaaggactcccgaggtttgggaacctaccctacccctccctaccccagctaatgcctctgcgtataccgctaacaccagcgcatcaccgacagcagcttggcctgctggctcagcactcagaccccgctatccgacagaaagcgaggacgttaagatcggagtgcttttcgcaagcaaagccatacttcagctgctggtaaaccctttaagtggtccgttcattgatcgcatgagttacgatgtgcccctgcttatcggcctgggcgtgatgttcgccagtactgtgctcttcgccttcgccgaggactacgctacacttttcgctgctcggagcttgcagggcctgggttctgcgttcgccgatacatccgggattgccatgatagcagataagtaccccgaggagcccgaacggtccagagctcttggggtcgcactcgccttcatctcttttggcagcttagtggctcctcccttcggaggaatactgtacgagtttgccggcaagagagtccccttcctggtgctggccgcagtgtcccttttcgacgctctgctcctgctggctgtggccaaaccattctccgccgcagctcgggcacgcgccaacctgcctgtcgggactccaatccataggctgatgctcgacccctacattgccgtcgtcgccggggctctcactacttgtaacatccctctcgcgtttcttgagcctaccatcgcaacttggatgaagcatactatggcggcttcagagtgggagatgggaatggcctggctccctgcatttgtgcctcacgtgttaggtgtgtatctgaccgtgcgcctagcggccaggtacccccacttacaatggctgtacggcgcgttaggactagccgtgatcggtgcctcctcctgcattgtccctgcttgtagatcgttcgcaccactcgtggtctctctctgcggcctgtgcttcggaattgccctcgttgacactgctctgctccctactctggcctttctggtcgatgttagacacgtgtcagtctatggctcagtgtacgcaattgcggacattagctacagcgtagcttatgcgttaggaccaatagtcgctggtcatatcgtgcacagtctgggctttgaacagctatccttagggatggggctcgccaacctgctgtatgcgcccgtgctacttttgttgcgaaatgtgggattgttgacgagatcacggtcggaaagggacgtgctcctggacgagcccccacagggcctctacgacgcagtccggctgcgggagcgacccgtgtccggccaggacggcgagccacggtctcctcccggcccctttgatgcctgtgaagacgactataattactattatacccggtcctag

SEQ ID NO: 134888 - DNA, 1482 bp, Artificial Sequence
  Description of Artificial Sequence: Synthetic coding sequence
atgcttagaaccatccttgatgccccccagaggcttctgaaggaaggcagggcctctagacagttggtgttggtggtagtgtttgtggcactgctcctggataacatgctgttcaccgtggtcgtgcccatcgtgcccacatttctgtatgatatggagtttaaggaagtgaattcttccctccaccttggtcacgcgggatcctctccgcatgcactcgcatctccagcattttctacaatattctctttctttaataataatactgttgcagtggaggagtcggtgcctagcggaatcgcttggatgaatgacacagcttctaccatcccaccacctgccaccgaggcaatttctgcccataagaataactgtctgcagggcacaggcttcttggaggaagaaattacccgggttggagtcctcttcgcaagtaaggctgtcatgcagctcctcgtcaatccatttgtcggccccttaacaaataggattggctaccatattcctatgttcgctgggttcgtgattatgtttctgtccactgtaatgtttgccttcagcgggacctacactctgctctttgtcgctcgaacccttcaaggaattggttcctccttttcgtcagtggctgggctggggatgctcgcatctgtgtatacagacgaccacgaacggggtcgggcgatgggaactgcacttggaggacttgcccttggccttctcgtgggagcgccattcggaagtgttatgtacgaatttgtgggcaagagcgctccattccttattctagcattccttgccctgctcgatggtgcgttgcagttatgcatcttgcagcccagtaaagtgtcccccgagtctgccaagggtactccactgtttatgttattgaaagatccttatatactggtggcggccggactggcatttcttccagccagcgtgtcctatctcatcgggacaaacttgttcggggttctggccaacaagatgggccgctggctttgtagtttaatcggcatgttggtggtaggtactagtctgctctgtgtgcccctcgcccacaacatcttcggcttaattgggccgaacgctgggctcggtctagccatcggcatggttgacagctccatgatgccaatcatgggccacctagtggacctccggcacacatccgtgtatggctccgtttacgctatcgcggacgtagccttttgcatgggattcgccatcggcccgtcaactggcggggccatcgtgaaggcaattggctttccttggctcatggtaataacgggcgttataaatatcgtctatgccccactgtgctactacctcaggagcccaccagccaaagaagagaagttagccatcttgtctcaggattgcccgatggagacacggatgtacgcaactcagaagccgaccaaagaatttcccctcggggaagacagtgatgaggagcccgaccatgaggaatag

SEQ ID NO: 134889 - DNA, 1578 bp, Artificial Sequence
  Description of Artificial Sequence: Synthetic coding sequence
atgcttcgcacgatcctcgacgctccacagagacttctcaaagagggtcgtgcatcacgccaacttgttctcgtcgtcgtcttcgtcgccttgttactggataacatgctctttacagttgtcgtgccgatcgttcccaccttcctgtacgatatggaattcaaagaggtgaacagttctctgcatctggggcacgcaggctcctccccccatgccctggcgagccctgccttttcgaccattttttccttctttaataataacaccgtggccgtggaggaatcagttcctagcggcatcgcctggatgaatgataccgcttctaccatccctccaccagccacagaggccatctctgctcataaaaataactgcctgcagggaacaggatttctcgaagaggaaattactagggtaggcgtactgttcgctagcaaagctgtcatgcagctgctggttaaccctttcgttgggcccctaacgaatcggatcgggtaccacattccgatgtttgccggttttgtgatcatgttcctgagcactgttatgttcgctttttctgggacctatacccttctgttcgtggctcgtacactgcagggaatcggtagctcattttcttctgtggccggcctggggatgttggcaagcgtgtatacagatgatcacgagcggggccgcgccatgggtacagcccttgggggtttagccctgggcctcttagtgggcgcgcccttcgggagtgtcatgtacgaatttgtcggcaagagtgcccctttcctcatactggccttcctcgcgctcttggacggcgccctgcaattatgcatattgcaaccctccaaggtgtcaccagaatccgcgaaggggacccctctgttcatgctcctgaaagatccttatattctggtggccgcaggcagcatatgctttgccaatatgggcgtcgcaatccttgagcctacattgcctatttggatgatgcagacaatgtgttctcccaagtggcaactgggtttggcctttttgccagcgtctgtgagctacctcatcgggaccaacctcttcggcgttctggcaaacaaaatgggacgttggctgtgttcccttatcggaatgcttgtggttgggacctctctcctgtgcgttccactggcacacaatatctttggactgattggacctaatgctggcctgggattagctattggcatggttgatagctccatgatgcctatcatggggcatctggtggacctcaggcacactagtgtttatggtagcgtttacgccattgccgacgtagccttttgcatggggtttgccattggcccaagcactggtggcgcaattgtcaaggcgattggatttccatggctgatggtgataaccggtgttattaacatcgtatatgcccccctatgctattacctccggtcacctcccgccaaggaggaaaaattggccattctctcacaggattgcccaatggagacaaggatgtatgcaacacaaaagcctacaaaagagttcccgctgggagaggattctgatgaagagcctgatcacgaggagtag

SEQ ID NO: 134890 - DNA, 1419 bp, Artificial Sequence
  Description of Artificial Sequence: Synthetic coding sequence
atgttacgaacaatcttagatgctccccagaggttgctaaaagagggcagggcctctcggcagctggttcttgtggtggtcttcgtggcccttctacttgacaacatgttgttcaccgttgtggtgccaattgtgcccacctttctctacgacatggaatttaaggaggttaactcctcactgcatttgggacacgccggctccagcccccacgccttggctagtccagctttctccaccatcttttctttcttcaataacaacaccgtcgccgtcgaagagagtgtcccttcggggatcgcctggatgaacgacacagcctccactattccccctccagcaaccgaagccattagtgcacataaaaataattgtttgcaaggaacagggtttttagaagaggagattactcgagtgggagtgctgttcgccagcaaagctgtcatgcaattactggtcaacccatttgttggccctctgacgaatcgcatcggctatcacatccctatgtttgccggcttcgtgatcatgttcttgagcactgtgatgtttgctttcagtggtacctacaccctcctattcgtggcgcgaacacttcagggaattggctcctccttctcttccgttgcaggactagggatgctggcatccgtctatacagatgaccacgaacgggggagagctatgggtactgcactggggggactggcattggggcttctcgtcggcgcgcccttcggctctgtcatgtacgagtttgttggcaagtccgcaccatttttgatcctagccttcctggcgctgctggacggcgcacttcaattatgcattctacagcccagcaaagtgtcccctgaatctgcaaagggaacccccctgttcatgttgctgaaagatccttacatccttgtggctgccggaagcatttgtttcgccaatatgggggtcgctattctcgaaccaaccctgcccatctggatgatgcagaccatgtgttcaccaaagtggcagctgggcctcgccttcctacctgcatctgtgtcctacctgatcggcacaaacctttttggtgtcctggcgaataagatgggcaggtggttatgttcactaattggcatgctggttgtggggacctcactcctctgcgtgccactcgctcacaatattttcggcctaatcgggcctaacgccggcctcggacttgctatagggatggtggattcatcaatgatgcctataatgggccacctggtcgacctgcgacacactagcgtctacggctccgtgtatgcaatcgccgatgtcgcattttgcatgggttttgcaatcgggtactcagagagcggtctgccccatggggatcccgatgtatgtaatcccgaagctcacgaagggatttccagtgggggaggacagtag

SEQ ID NO: 134891 - DNA, 1578 bp, Artificial Sequence
  Description of Artificial Sequence: Synthetic coding sequence
atgttacgtaccattctggacgcgccccagcggcttctcaaggaagggcgtgccagtagacagctagttctcgtggtggtgtttgtggcactgctcctcgataatatgttattcaccgttgtggtcccgattgtacctacgtttctctacgacatggagttcaaagaggttaacagctccctgcatttgggccacgcgggatcatcaccccatgcccttgccagcccggccttctctaccattttcagtttctttaacaacaatacagtcgcagtggaggaatccgtgccttcgggcatcgcctggatgaacgacaccgcctccacgataccccctccagcaacagaagccatttccgctcacaaaaacaattgcttgcagggtaccggattcctggaagaggaaattacaagagtgggagtgctgtttgcttccaaagcagtgatgcagctgctggttaatcccttcgtaggacccctgacgaatcgaatcggctaccatataccaatgttcgccgggtttgtgattatgttcttaagtactgtcatgtttgcttttagcgggacttacaccctgttgtttgtggccaggactctgcagggaattggaagttccttcagctccgtggcaggtttgggcatgttggccagtgtctacactgatgaccacgaacggggtagagccatgggaaccgctctcggcggtctcgcgctgggccttctggttggcgccccgtttggttcagtcatgtatgaattcgttggaaaatcagccccctttctgattctggcattcctggctctgctggatggggccttgcagttgtgtattctgcagccttcgaaagtgtcgcccgaatcggccaaagggactccgctctttatgcttttaaaggacccctacattctggtcgctgccggaagcatctgttttgctaacatgggcgtcgcaatcttagagccaaccttgcccatctggatgatgcagaccatgtgctcaccgaagtggcaactgggattggccttcctgcccgcaagcgttagttacctaattggaacgaatctgtttggggtcctggccaacaagatgggacgctggctttgcagcttgatagggatgctcgtagtcggcacttcgctgctgtgcgtgcccttggcccacaatattttcggattaatcggaccaaacgccggtttgggtctggccatcggaatggtagactcctccatgatgcccattatgggtcatcttgtcgatctcaggcatacctccgtatacggatctgtgtatgcaatcgcagacgttgccttctgtatgggatttgcaattggccctagcaccggtggcgccattgttaaagccatcggctttccttggctcatggttatcacgggcgtgatcaatattgtatatgctccgttgtgctattatctaaggtctcctccggccaaagaagaaaagctcgctattctcagccaggattgccccatggaaacccgcatgtatgccacccagaagccaactaaggagttccctcttggcgaggatagtgacgaggaacccgatcacgaggaatag

SEQ ID NO: 134892 - DNA, 1158 bp, Artificial Sequence
  Description of Artificial Sequence: Synthetic coding sequence
atgcttagaacgatactcgatgcaccacaaagactgctgaaggaaggacgagccagccgacagctggtgttagtggtggtcttcgtagcccttcttcttgataacatgctgttcacggtagtggtgcctatcgtcccaactttcttgtatgatatggagttcaaggaggtaaactcatcactccacctgggccacgccggttcttcccctcacgcccttgcttcaccagcattctcaactattttttccttcttcaataataacaccgtggctgttgaagagagcgtgccgtctgggattgcctggatgaatgataccgcttcaaccattcctccccctgcaacagaggccatctctgcacacaaaaacaattgtctgcagggtaccggctttttagaagaggaaatcactagggtcggggttctttttgcttcgaaagctgtaatgcaattacttgtcaaccccttcgtaggacccctcactaatcggattgggtatcatattccaatgtttgcaggattcgtcatcatgttcctgtcaactgttatgttcgcattctccgggacatacactctgctgtttgtggcccgtactcttcagggaatcggaagcagctttagtagtgtagccgggttaggcatgcttgcaagcgtttacactgacgatcacgagcgcggccgcgccatgggcaccgcgcttggaggcttggcgctgggactgctcgtaggtgcgccttttgggtcagtcatgtacgagtttgtgggaaaaagtgcccccttcctgattttggcattccttgctctgcttgacggcgctcttcaactatgcatccttcaaccttctaaagtttctcccgagagtgcaaaggggactccactctttatgttgttaaaggatccttacatcctcgtggctgcggggagcatctgtttcgccaacatgggcgtggccattcttgagcccactcttccaatatggatgatgcagacaatgtgtagcccgaaatggcaactcggtttggcttttctacccgcatcagtaagttaccttattgggaccaatctcttcggcgtcctggctaataagatggggcgttggctttgttcccttatcggaatgctggttgttgggaccagcctgctctgtctgccatcctag

SEQ ID NO: 134893 - DNA, 1482 bp, Artificial Sequence
  Description of Artificial Sequence: Synthetic coding sequence
atgttgagaacaattctcgatgcccctcagcggctcctgaaagagggcagggccagcaggcaactggtgctcgtcgtggtatttgttgcattactgttagacaatatgttgtttacagttgtcgtgcccatcgttccaactttcctatatgacatggagtttaaggaagtaaattcctcccttcacctgggtcacgccgggtcatctcctcacgcgttggctagccccgcgttcagcacgatctttagcttttttaacaataatacagtggctgtggaagagagcgtgcccagtggtatcgcatggatgaacgacactgccagcacgatccctccacccgccactgaggccatctctgcccacaagaacaactgcctgcagggcaccgggttcctggaagaggaaatcactcgcgttggagtacttttcgcctccaaggccgtcatgcagttactggtgaatccatttgttggccctctgacgaatagaattgggtaccacattccaatgttcgcagggtttgtgatcatgttcctgtccacagtcatgttcgccttcagtggcacctataccctgctttttgtggccagaacactacaggggataggatcatccttcagctccgtggccggtctggggatgctggcctccgtgtacaccgacgaccacgagcgtgggagggccatggggaccgctcttggtgggctagcactgggtctgctcgtaggcgctccattcgggtcagtcatgtatgagtttgtgggaaagagtgctccattcttaatattagcctttttggcactgctggacggtgcgctgcagctatgtatattacagccatctaaagtctctcccgagagcgccaagggaacccccctcttcatgctgcttaaggatccctacatcctggttgccgcggggctcgcgttcttgcctgccagcgtctcctacctgattggcactaatctttttggcgttctggctaataagatgggcagatggctgtgctctcttattggcatgctggtcgtgggcacttccctgttgtgtgtacccctggcacacaacatattcggcctgatcggacctaatgcgggactcggacttgctattggcatggttgacagcagtatgatgcccattatgggacacctggtggatctgcgtcataccagcgtctatggatcggtgtatgccattgcagatgtggccttttgtatgggctttgctatcggacccagcaccggtggagctattgtgaaggccattgggttcccatggctcatggttataacgggagtgatcaacattgtgtatgcccctctctgttattacctgcgtagcccaccggcgaaagaagagaagctcgctattctctcccaggattgcccaatggagacaaggatgtacgcaacccagaaacccacaaaagagttccctcttggcgaggactccgacgaggaacccgatcatgaggagtag

SEQ ID NO: 134894 - DNA, 1545 bp, Artificial Sequence
  Description of Artificial Sequence: Synthetic coding sequence
atggcgctttccgagctagccctcgtgcgctggctgcaggaatcacggaggtctaggaagctgattctgtttattgtcttcctggccctgttactggataacatgctactcacagtcgttgtgcctatcataccttcttatctatactccattaaacatgagaagaacgcgacagaaatccagacagctagacctgtgcacaccgcaagcattagcgactcattccagagtattttttcctactatgacaactcgacaatggtgacaggcaatgcaacaagggatctgactctccatcaaaccgctacccagcatatggtgacaaacgcttctgctgtgccctccgattgcccctccgaggataaagatctcctcaatgaaaacgtccaggttgggctgcttttcgccagtaaggcaacagtccagctgatcactaatcccttcatcggactgcttacaaatcggattgggtacccaatacccatcttcgctgggttctgcatcatgttcgtgtccaccataatgtttgctttcagcagtagctatgccttcctgctcatcgccaggagcctacagggaatcggttccagttgtagtagtgtggctggtatgggaatgctggccagcgtgtacacagacgatgaggagagaggtaacgtcatgggcatcgccttgggcggcctggccatgggggtccttgtcggacctccattcggtagcgtgctatacgaattcgtcggtaagacagcccccttcttagtgctggcagctctggtactgttagacggcgccatccaactctttgtgctgcagccttccagagtccaacctgaatcacagaagggaaccccacttacaaccctactgaaggacccttatatcttgatagcggcaggctccatatgtttcgctaacatgggcattgccatgctcgagcctgcactgccaatatggatgatggaaacaatgtgctctagaaaatggcagttgggtgtcgcctttcttccagctagcatctcctatctgatcggaactaacatctttgggatactagcccacaaaatgggacgttggctttgtgccctgctggggatgatcattgttggggtcagcattctgtgcatccctttcgccaaaaatatttacgggcttattgctcccaactttggcgtcggctttgcaatcggaatggtggactcgtctatgatgccaattatgggctatttggtagacttgcggcatgtgagcgtctacggctcagtgtacgctattgccgatgttgccttctgcatggggtatgcaatcggaccctccgcgggcggggcgatagctaaggcaatcgggtttccttggctgatgacaatcatcggcattattgatatcctgttcgcccctctgtgtttttttctgcgtagtccgccagccaaggaggaaaagatggccatcctgatggaccataactgccccattaaaaccaaaatgtatacgcagaataatattcaaagctaccccatcggggaggatgaggaatccgaatctgactag

SEQ ID NO: 134895 - DNA, 1494 bp, Artificial Sequence
  Description of Artificial Sequence: Synthetic coding sequence
atggatgtgcccgggcctgtgagtagacgcgctgccgcagccgcggctactgttctgctgcgcactgccagggttaggcgagagtgctggttcctcccaacggcgctattgtgtgcttacggattttttgcctccctgcgtccatcagagccttttttgactccgtatctgctgggccccgacaagaatctgaccgaacgagaagtgttcaacgagatctacccggtctggacctacagttacctggtcttgttgtttccagtatttctcgcaaccgattacctgcgctacaaacccgtagtgcttctgcagggtctgagcctcatcgtgacatggttcatgctgttgtatgcccagggactactggccatacagtttcttgagttcttctatggcatagccaccgcaactgagatcgcctattattcttacatttatagtgtggtggatctcggcatgtatcagaaagtgacctcttactgcaggagtgcgacattggtcgggttcaccgtcggctcggtccttggccagattctcgtaagtgtagccggatggagtctgtttagcctgaacgtaatctccctgacctgtgtgtccgtggcttttgccgtggcctggttcctgcccatgccccagaagtcccttttctttcaccacattccatctacctgccagcgggtgaacggtatcaaagtgcagaacggcggcattgtcactgacaccccagcgagcaaccatttgcccggttgggaggacattgaaagcaaaataccattgaatatggaggaaccccctgtggaagagccggaaccaaaaccggaccgtctcctcgttttgaaagtgctgtggaacgatttcctaatgtgttattcgagtcgccccttgttgtgctggagcgtttggtgggccctctccacatgtggatacttccaggtggtcaactacacacaaggcctctgggagaaggtcatgcctagtcgctatgccgcgatttataatggcggagtggaggcagtctccacactgctgggcgccgtggccgtcttcgcggtcgggtacattaagatcagttggtccacgtggggggagatgaccctctccctgttcagtctcctaatcgcagccgcagtgtatataatggatacggtggggaatatctgggtgtgctatgctagctatgtggtgtttcgaatcatctacatgctgttgatcacaatcgctacctttcagattgctgccaacctgtctatggagcgatatgcactagtcttcggcgtgaatactttcatcgccctggcccttcagacactactaacacttattgtcgttgacgcttcagggctggggctggaaattactacccagtttcttatctacgcctcctactttgctctgatagccgtggtcttcctggcctccggagcggtgtccgtgatgaagaagtgcaggaagctggaagaccctcagagcagcagccaggtgacaaccagctag

SEQ ID NO: 134896 - DNA, 1380 bp, Artificial Sequence
  Description of Artificial Sequence: Synthetic coding sequence
atggacgttcctggtccagtatcccgcagagccgctgctgccgccgctactgtgctactgcggaccgctagggtgagaagggaatgctggttcctccccactgccttactttgtgcttacggcttttttgcatccctgcgcccatccgaaccatttctgaccccttatctgttgggtcccgataagaacctgacggagagagaagtcttcaacgagatatacccagtctggacttattcctacctggtgttactgttcccagtattcttggctaccgattatctgcgctataaacctgtcgtgctcctgcaaggtctgtccctcatcgtcacatggttcatgctgttatacgcccaggggcttctcgcaattcagttcctggaatttttttatggaatcgcaaccgcgaccgagatcgcctattattcctacatttattcagtggtcgatctcgggatgtatcagaaggtgactagctactgtaggagtgcaacactcgttggcttcactgtgggctccgtattaggccaaattctcgtgagcgtcgctggttggagtttattctctttgaatgtcatctctctgacgtgtgtcagtgtcgcatttgcagtggcttggttcctgcccatgcctcagaagagcctgttcttccatcacatcccttctacctgtcagagggtgaacggtattaaggagcctaagcccgatcggctgttggtccttaaagtgctgtggaacgattttctaatgtgttacagttctcgccccctgctgtgctggagtgtttggtgggcgctgagcacatgcggctattttcaggtggtcaactatactcagggcctttgggaaaaggtgatgccgagtcggtacgcggctatttataatgggggggtcgaagcagtgtctaccctgcttggggccgtggctgtgttcgcagtgggatacattaaaatctcttggtctacctggggtgagatgacactcagcttgttctctctcctgattgctgccgccgtgtacataatggatacagtgggtaacatatgggtgtgttacgcatcttatgtggtcttccgaattatttacatgctcctgataacaattgcaacctttcagatcgccgcgaacctttctatggagaggtatgcccttgtgtttggcgtcaacacatttatagctctcgctctgcagacactgctgactctcatagtcgtggatgcctctgggttaggactcgagattacgacacagtttcttatctacgcaagctactttgcgttgatagccgtggtgttcctggcgtccggcgcagtaagcgtgatgaagaagtgtcggaaactcgaggatccccagtccagttcgcaggtgaccacctcctag

SEQ ID NO: 134897 - DNA, 891 bp, Artificial Sequence
  Description of Artificial Sequence: Synthetic coding sequence
atggatgtcccgggacccgtctcaaggcgggcggctgccgccgccgcaaccgtgctgctgcgcaccgcaagggtgaggcgcgagtgctggtttctcccgacagccttgctgtgcgcctacgggtttttcgccagcctgcggccctccgagcccttcctgactccttacctcttgggtcccgacaaaaacttgactgagagagaggagccaaaaccggacagacttctggtcttgaaggttctgtggaatgatttcctcatgtgttactctagcaggcccctgctctgttggagcgtgtggtgggcactgagcacctgtggctactttcaggtggtgaactacacacagggcctctgggagaaggtgatgccatctcgatatgccgccatttacaacggaggagtggaagctgtcagcacactcctcggagctgtagcagtatttgcagtcgggtacatcaagatttcctggtccacatggggcgagatgacgttatccttgttttccctgctgattgccgccgcagtgtacataatggacaccgttggtaatatctgggtttgctacgcctcttatgtagtctttaggatcatctacatgctgcttatcaccattgccaccttccaaatcgccgccaatctgagcatggagcgctacgccttagtcttcggtgttaacaccttcatcgcgctcgcgcttcagacactgctgactctgattgtggtcgacgcctccggattaggcctggaaattacaacgcagttcctgatctacgcctcttattttgccctgatcgctgtagtgttcctggcaagcggggcagtaagcgtgatgaagaagtgtcgaaaactggaggacccacagagtagctctcaagtcaccacatcctag

SEQ ID NO: 134898 - DNA, 1491 bp, Artificial Sequence
  Description of Artificial Sequence: Synthetic coding sequence
atggactgctatcgcacatctttgtcaagctcctggatttatcctacagttattctgtgcttgtttggcttcttttccatgatgcgcccaagtgaaccgttcctaattccatacctgtcaggccccgataagaacctgacctccgcagagatcacaaacgagatattccccgtgtggacttatagttatctggttctcttgcttcctgtgttcgtacttaccgattacgtacgctacaagcccgtcattatcctacagggaatctcgttcatcatcacgtggctgcttctcttgtttggtcagggagttaaaaccatgcaggtcgtggagtttttttacggaatggttacagccgccgaagtcgcttactacgcctatatctactctgttgtgtcccccgaacattaccaacgtgtgtcgggctactgccgaagtgtcaccctggccgcctatacagccggctcagtgttggctcagctgctagttagcctggctaacatgtcttatttctatttaaatgtcatcagccttgcttccgtctctgtcgcatttcttttcagcttattcctgccaatgcccaaaaagagtatgttctttcacgctaagccctcacgcgaaataaaaaagtcgagtagtgtgaatccagttctcgaagagacacacgaaggcgaagcccctggatgcgaggagcagaagcccaccagtgaaatactgagtacatctggtaaactcaacaaaggccagttaaatagcctgaagccttcaaacgtgaccgtggatgtcttcgtccagtggttccaggacttgaaggaatgctactcctccaagcgtctgttctattggagcctgtggtgggcgttcgccacagccggattcaaccaggttttgaattatgtgcagattctctgggattacaaagccccctcccaggactcctcaatctataacggagccgtcgaggctatcgccacctttggcggtgccgtggctgcattcgcagtgggctacgtcaaggtaaactgggatctgctcggagagcttgccctcgtggtctttagtgttgttaacgcaggctccctgtttctaatgcactacaccgctaacatatgggcgtgctacgccggctacctgattttcaaatcatcgtacatgctattgattaccatcgctgttttccagatagctgtaaatttgaacgtggaacggtacgctttggtgtttggcattaataccttcattgctctggtgattcagactattatgaccgtgatagtagtggatcagcgtggcttaaacctgcccgtgtctatacagtttctggtgtatggctcctatttcgccgtcatagccggcatcttcctcatgaggtccatgtatattacatattccacgaagtcccagaaggacgtccaatccccagcgcccagcgagaacccagacgtaagccacccagaagaagaatccaatatcataatgagtaccaagttatag

SEQ ID NO: 134899 - DNA, 165 bp, Artificial Sequence
  Description of Artificial Sequence: Synthetic coding sequence
atggactgttaccggacatccctgtcttccagctggatttaccccaccgtgattctttgccttttcggatttttttctatgatgaggcccagcgaaccctttcttatcccctacctgtccggacctgataagaatctgacctcagcggagattaccaatgagtag

SEQ ID NO: 134900 - DNA, 195 bp, Artificial Sequence
  Description of Artificial Sequence: Synthetic coding sequence
atggattgctaccgaacttcactgtcctctagttggatttaccctactgttatcctttgtctgtttgggtttttctcaatgatgcgcccatccgaaccatttctcattccctacctcagcggccctgacaaaaatttaacttccgccgagatcacaaacgagatattccccgtctggacgtattcatacctttag

SEQ ID NO: 134901 - DNA, 1491 bp, Artificial Sequence
  Description of Artificial Sequence: Synthetic coding sequence
atggactgctaccggacttctctgagcagttcatggatctaccctactgtaatcctttgtctttttggctttttctccatgatgcggcccagcgagcccttcttgatcccctacctctccggtcccgataaaaatctgactagtgctgaaatcaccaacgagattttccctgtctggacttactcttacctggttttgctcttgcctgtgtttgtcttaaccgactatgttagatacaagccagtgatcattctccaggggatctcttttataattacatggctgctgctgctttttggacagggagtgaaaaccatgcaggtagtggaattcttctacggcatggtgaccgccgcagaggtcgcatactacgcctacatctacagtgtggtatctccagaacactaccagcgggtttcagggtattgccggagtgttacactggctgcctacactgccggaagcgtgcttgcgcagctcctggtgagccttgctaatatgtcttacttttacctgaatgttatcagcctcgcatccgtctcggttgcgtttctattctccctcttcctgcctatgcccaagaagagtatgttcttccacgcgaagccttcgagggagattaagaagtctagctcagtgaaccctgtgttggaggagacccacgagggggaggcgcccggctgcgaggaacaaaagcccactagcgaaattttaagcactagcggcaagctgaacaagggacaactcaactccctcaaaccttccaacgtgactgtggacgtgtttgttcagtggttccaggatctgaaagaatgttattctagtaaaagattattctattggagcctgtggtgggcctttgccactgctggattcaatcaggtcctgaattatgtgcagattctatgggattacaaagctccgtcacaggactcaagtatatacaatggcgccgttgaggccatcgccaccttcggtggagctgttgccgcgtttgcagttgggtacgtgaaagtgaattgggatctcctgggcgaactggccctggtcgttttctccgtagtgaacgctggctctctgtttctcatgcactacaccgctaatatatgggcttgttatgcgggctacctgatatttaaatcatcctacatgctcctgattacaatcgcagtgttccagatcgccgtgaacctcaatgtggaacgatacgcgctggtgttcggaatcaacacttttatcgccctggtgattcaaacaattatgaccgtgattgtcgtggatcagaggggtctcaatctcccagtttccatacagttcctggtctatggtagctatttcgctgttatcgcgggcattttcctcatgcgttcaatgtatataacctactcaactaaatcacagaaagacgtgcagtctcctgccccttccgagaatcccgatgtgtcccatcctgaggaggagtctaacatcatcatgagcaccaaactgtag

SEQ ID NO: 134902 - DNA, 399 bp, Artificial Sequence
  Description of Artificial Sequence: Synthetic coding sequence
atggattgctaccgcacaagcctgagctcgagttggatttacccaaccgtgatcctgtgtttgtttgggttcttctcaatgatgaggccgagcgaaccgttcctgatcccgtacttatccggccctgataaaaacctcacatcggccgaaatcacaaacgaaattttcccagtgtggacctactcttacctagtcttactcttacccgtcttcgtgctgaccgactatgtacgatacaaacccgtgatcatccttcaaggaatttcattcatcatcacatggttgctgctgctcttcggccagggagtgaaaaccatgcaggtcgtggagtttttctacggcatggtaactgcagccgaggtggcatactacgcttatatctactccgtggtgtcatag

SEQ ID NO: 134903 - DNA, 1479 bp, Artificial Sequence
  Description of Artificial Sequence: Synthetic coding sequence
atgaacccactggggtccgcctcccgcgctactgtagaccagttaaccgatctcccctctaaggagcagctcagctgtgttgtgtttgcactgtggccacctgcattctctagcaatttaagcgacccaggagtcaaaattacgaacgaaattttccccgtgtggacatattcttatctggtgctactcctgcccgttttcgtgttaactgattacgtccgttataagcccgtcatcatcctgcaggggattagctttataatcacctggctgcttctgctgtttggacagggcgtgaaaaccatgcaggtggtggaattcttttatggaatggtcactgctgccgaagtagcatactatgcgtacatctattctgtggtgtcaccggaacattatcagcgggtgtccggctactgtaggagcgtgactctggcagcctataccgccggctcagtactggctcaacttctggtgagcctggcaaacatgtcatacttctatttgaatgtcatctctcttgcctccgtgagcgtggcttttctgtttagcctgttcctgcctatgcccaagaagagcatgtttttccatgccaaaccttcccgggagatcaagaaatcctccagtgtgaacccggttctagaggagacgcatgaaggggaagcacctgggtgcgaagagcaaaaacccacctcagaaattctgtccactagtggcaaactgaataaaggacaactgaacagcctgaagcccagtaacgttactgtggatgtgttcgtccagtggttccaggacttaaaggagtgttacagctctaaacggctattctactggtccctctggtgggcctttgccaccgccggcttcaaccaggttctgaattatgtgcagatcctgtgggattataaagcccccagccaggactccagcatctataatggggccgttgaggctattgctaccttcggcggggccgtggccgctttcgctgtgggctacgtcaaggtgaactgggacctgcttggggaactcgcactggtggtatttagcgtggttaatgctggctccctgttcctgatgcactacaccgccaacatatgggcgtgctacgctgggtacctgatctttaagtccagttatatgcttctgataacaattgcagtgtttcaaattgctgttaatctgaatgtcgaaaggtacgcactggtgttcggaataaacacttttatcgctctggtgatacagactattatgacagttatcgtagtcgaccaacgtggactgaacctcccagtttccattcagttcctcgtgtatggatcatattttgctgtaattgccggaatattcttgatgaggtccatgtatatcacctactccaccaaatcacaaaaggacgtgcagtcaccagctcccagtgaaaaccctgacgtgtcgcatccggaagaggagagcaatatcatcatgtcaacgaagctgtag

SEQ ID NO: 134904 - DNA, 1626 bp, Artificial Sequence
  Description of Artificial Sequence: Synthetic coding sequence
atgggacattcacctcctgtgctgcctctctgcgcttctgtcagcctactgggcggactgacgtttggttacgagctggctgtgatcagtggagcgctcctgcctttgcagttggacttcggcctgagctgcctcgagcaggaatttctagtggggagtctcttactcggcgctctgttggctagtctggtgggcggcttcctgatcgactgttatgggagaaaacaagcaatactggggtcaaacttggtcttgctggcgggcagccttacactgggtcttgcgggctctctggcgtggctggtgcttggtcgggcggtggtgggcttcgctatttctctcagtagcatggcatgttgcatctacgtctcagaactcgtcgggcctcggcagaggggagttcttgtcagtctgtacgaggcagggataactgtcggtatcctgttatcctacgccctaaattacgcacttgctggaactccttggggctggcgacatatgtttggctgggctaccgcgcctgctgtgctacagtcccttagcctgctgttccttcctgcggggacagacgagacagctacccacaaagatctgatacccctgcagggaggagaggccccgaagctgggccccgggaggccacggtacagctttctggacctgttccgggcccgagacaatatgagggggcgtactacagttggtctgggactcgttctgttccagcaactgactggccaacccaatgtcctgtgttacgcctctacgatattctctagtgtgggcttccatggaggtagctccgctgtgttggctagtgtgggtttaggcgcagttaaagtcgccgcaactttaacagccatgggcctggtggacagggcagggcgacgtgccctgctgcttgcgggctgcgcacttatggctttgagtgttagcgggatcggcttggtgtccttcgccgtgccgatggattccgggccctcctgcctggcagtgccaaatgccaccggtcagactggcctacctggcgacagtggtctcctacaggatagttccctgcctcccattcctcgcacaaacgaggaccaaagagagcccattttgtcaacagcaaagaaaacaaaaccccacccgaggtctggagatccaagcgccccccccaggctcgctctgagcagcgcattacctgggccaccactgcccgcgcgcggccatgctctcctgcgatggactgccctcctgtgtctcatggttttcgtctccgccttttcttttggctttggtcctgttacctggcttgtcctctcagaaatttatcctgttgagatcaggggaagggcctttgctttctgtaacagcttcaactgggctgctaacctctttatttccctttctttcctcgatcttatcgggacgatcggattgtcatggacattcttgctgtacgggcttacagccgttctcggtctgggcttcatatacctcttcgtaccagaaacaaagggccagtctcttgcagagatcgaccagcagttccagaaacggcgctttacactcagctttggtcaccgtcaaaattctactggaatcccctatagccgaatcgaaatctcagcggcctcatag

SEQ ID NO: 134905 - DNA, 1947 bp, Artificial Sequence
  Description of Artificial Sequence: Synthetic coding sequence
atgtcaagaaaagccagcgaaaacgttgaatacaccctgagaagtctgtcctccttgatgggagagaggcgccggaaacagcctgaaccagatgcggccagcgccgcaggcgagtgtagcttgctcgcggcggcagaaagctcaaccagcctgcaatccgccggcgccggtggaggcggtgtaggcgatctcgagcgagctgcgcggaggcagttccagcaggacgaaactccggcttttgtctacgtggttgccgtgttctctgccctgggcggcttcctcttcggctacgacaccggtgttgtctctggcgccatgctcctgctgaaacgtcagctgtccctggacgccctgtggcaggagctcctggtcagtagtacggtaggggcagcagccgtttctgctctggctgggggggctctgaatggtgtatttggtcgcagagcagccatcctcctggcaagtgccctgttcaccgcaggttctgccgtgctggccgctgctaataacaaagaaaccctcctggctggaaggctggtcgttggactcgggatcggaattgcctcaatgactgtccctgtatatattgccgaggtttcaccacccaatctacgaggacgccttgttacaataaacacactgtttataaccggtgggcagtttttcgcaagtgtggttgacggagcttttagctacttgcaaaaggacggctggagatacatgctgggactggcggctgtgcccgctgtcattcagtttttcggttttctctttttgccagaatcccctcggtggttgatccagaaggggcagacgcagaaggctaggagaattctcagtcagatgcgaggcaatcagactatcgacgaggagtacgatagtattaaaaacaacatagaggaagaggagaaggaggtcggtagcgcaggccctgtgatctgccgcatgctgagttatcctcccacccggagggcattaattgtcggttgcggtcttcagatgttccagcagctgtccgggattaacactatcatgtactactctgcaacaatcctccagatgagcggagtcgaggacgatcgcctggccatatggctcgcttccgtaacagctttcactaactttattttcaccctggtcggggtgtggttggtggagaaagtcggcaggaggaagctcacatttggctcacttgccggaaccacagtggcccttataatactggcactgggttttgtgctgtccgcgcaggtgagtcccaggatcacatttaagcctatagccccatccggtcagaatgctacttgcactcgatacagctattgtaatgagtgcatgctggatcctgactgcggtttttgttacaaaatgaataagagcactgtgatagatagttcttgcgtgcccgtaaataaagcttctacaaacgaggccgcctggggacgctgcgaaaacgagacgaaattcaagacagaagatattttctgggcatacaacttttgcccaacaccgtacagttggactgccctcctgggcctgattctgtaccttgtgttcttcgcgccagggatggggccaatgccgtggacagtgaattcagaaatctatccgctttgggctagatccactggcaatgcctgttcttccggtattaactggattttcaacgtgctcgtatctcttacttttcttcacactgcagaatacctcacttactacggggcattctttctgtacgccggcttcgctgctgtgggactcctgtttatttatggttgtcttccagaaacaaaaggaaaaaagctagaagaaatcgagagcctttttgacaatcggctatgcacatgcggcacgtccgattcagatgaaggtcgttatattgagtacatccgagtgaagggaagtaactatcacttaagtgacaacgatgccagcgacgtggagtag

SEQ ID NO: 134906 - DNA, 1074 bp, Artificial Sequence
  Description of Artificial Sequence: Synthetic coding sequence
atgtctcggaaggcttcggaaaacgtagagtatacattgcggtcactgtctagcctgatgggagaacggcgacgcaaacaacctgaaccagatgccgctagtgcagctggggagtgtagtttgctggcagctgccgaaagttccacctcgctgcagagcgcaggcgctgggggcgggggagtgggcgatcttgagcgcgctgcaaggagacagtttcagcaggacgagaccccagcgttcgtttacgtcgttgccgtgtttagcgccctcggcgggtttctatttgggtatgatacaggggttgtgtccggggctatgctactccttaagcgccaactgagtctggacgctctgtggcaggaactgcttgtcagtagcactgttggcgccgccgcagtatccgccctcgcagggggcgccctgaatggggtgtttgggcgcagggccgcgatcctgctggcatccgccctgttcaccgcaggtagtgctgtgctagcggcagccaataataaagagacactgctggcaggtagactggttgtgggcctgggaatcggcatcgcatctatgactgtgcccgtgtacatcgctgaagtttcacctccaaatctgagagggagactcgtcaccatcaacactctctttatcacgggcggtcagttcttcgcaagcgttgtcgatggggcttttagctacctccaaaaggacggctggcggtacatgctaggtttggcggcagtacccgctgtcatacagttctttgggtttctcttcctcccggagtccccaagatggctaatccaaaaaggacagacacagaaggccaggagaatccttagccagatgaggggaaaccagactatagacgaggagtacgatagcattaagaataatatcgaagaggaggagaaggaggtgggctcggcggggcccgtcatatgccgcatgctgtcttatccaccaacgagaagggcgcttattgtgggatgtggactccagatgttccagcagctgagtggcattaataccatcatgtacgtctttttatcgggcttccttcttaagagactatag

SEQ ID NO: 134907 - DNA, 1494 bp, Artificial Sequence
  Description of Artificial Sequence: Synthetic coding sequence
atggacaaccgtcagaacgtcactcctgcactgatcttcgctataacagtggctaccattggctcttttcagttcggctacaacacaggagttatcaacgcccctgaaaccatcattaaggaattcatcaacaagacattaactgacaaggcgaatgccccaccctcagaggtcttacttacaaatctgtggtctctatccgtggccatcttctctgttgggggaatgatcggatctttcagcgtgggtctctttgtgaataggttcggccgcagaaactctatgctgatcgtgaatttgctcgcagccaccggcggctgcctgatgggtctgtgtaagattgccgagtctgtggagatgcttatactgggaaggctggttatagggttgttttgtggcctgtgcacagggttcgtccctatgtatattggagaaataagtcctacggccttgcgcggggccttcggaacgcttaaccagttgggcattgtcataggtatcctcgtggcacagatttttggactggaacttatattaggaagtgaagaactctggcccgtgctgctgggcttcactattctgcccgcaatcctccagagtgcagcactcccatgctgcccggagtcacctaggtttctcctgattaatagaaaaaaagaggagaacgccacccggattctgcagcgactgtggggaactcaagacgttagccaggacattcaggagatgaaagatgaaagcgcaagaatgtctcaagagaaacaggttaccgtgctggagctgtttcgtgtttccagttaccggcaaccgatcattatcagtattgtcctacagttgagtcaacagctatccggaatcaatgccgtgttctactactcgactggtattttcaaagatgccggtgtccaacagccgatttatgccactatttctgccggcgtggtcaatacgatcttcacactgctgtctttgttcctcgtggagcgagccggtagacgcacgctccacatgattggactaggcggcatggccttctgttcgaccctcatgactgtttccctcctgctgaaaaaccattacaacggcatgagtttcgtctgcatcggagccatcctggttttcgtagcttgcttcgaaatcggaccaggccccataccgtggttcattgtggccgagctctttagtcaaggtcccaggcccgctgcgatggcagtcgccggctgttccaactggacatccaacttcttggtgggactgctcttcccgtccgcggcatattacctgggcgcctatgtgttcattatcttcacaggtttcttaatcaccttcttggcctttacattttttaaggttcccgagactcggggcaggactttcgaggacattaccagagctttcgaaggacaggcacacggtgccgatcggagtggcaaggacggtgtgatgggcatgaacagcatcgagccagcgaaagagaccactaccaatgtctag

SEQ ID NO: 134908 - DNA, 1563 bp, Artificial Sequence
  Description of Artificial Sequence: Synthetic coding sequence
atggaattccacaacggcggccacgtctccgggattggcggattcctggtctctctgacctcacgaatgaaaccacacaccctggcagtgacacccgcactgatcttcgccatcaccgtggcgactatcggttcctttcaatttggctacaacacaggcgtgattaatgccccggagaccataatcaaggaattcatcaacaagaccctgaccgacaaagcaaacgccccccccagcgaggtcctgctgaccaacctctggtccctgtccgtggcaatcttttctgtcggaggaatgattggcagtttcagcgtcggtctattcgtgaatcggtttgggaggaggaatagtatgctcatcgtcaaccttcttgcagccaccggggggtgcttgatgggattgtgcaaaattgcagagagcgtagaaatgctgatactgggtcgattggtgatcgggctgttctgcgggctttgcaccggttttgtaccaatgtatatcggagagatcagccctacagcgctgcgtggcgctttcggcacactcaatcagctggggatagtgattggtatacttgtggctcagatctttgggctagagctgatcctcgggtccgaggaactatggcctgtgctcctgggatttaccattctaccagccatcttgcagagtgccgcgctgccttgttgccctgaatctccacggttccttcttattaatcggaaaaaagaagagaacgcaacaaggattttgcaacggctctgggggacccaagatgtgagccaggatatccaggaaatgaaggacgagtccgctagaatgtcccaggaaaagcaggtaactgtgttggagttattcagagtgagtagttaccgccaaccaataattattagcattgtgttgcaactttcccagcagctctctgggattaatgctgtgttttattatagtactggcatattcaaagatgctggagtgcagcagcctatctacgcaaccatttctgcaggagtggtcaataccatttttacactgctctctctgttccttgtcgagagggcaggccgacgcacattgcacatgatcggcctggggggtatggctttttgcagtactcttatgactgtctctctgctcctaaagaaccattataatggtatgtcgttcgtctgcattggggcgatcctggtgtttgttgcctgttttgagatcgggcctgggcctattccttggttcattgtcgcagaattatttagccagggaccaaggcctgcggccatggcagttgccggttgcagcaactggacctctaatttcctggttgggctgctctttccttcggccgcgtactacctcggtgcttatgtgttcattatcttcaccgggtttctgatcacatttcttgcctttaccttctttaaggtccccgagactaggggaaggacgtttgaggacatcacacgcgcgttcgagggtcaagcacatggggcagacagatctggcaaggatggagtaatggggatgaattccattgaacccgcaaaggagaccaccacgaacgtgtag

SEQ ID NO: 134909 - DNA, 1494 bp, Artificial Sequence
  Description of Artificial Sequence: Synthetic coding sequence
atggacaaccgccagaacgttaccccggcactgattttcgcaattaccgtggcgacgatcggatcattccagttcggctacaacactggcgtcatcaacgccccggaaaccattatcaaggagtttatcaataaaactctgaccgataaggcgaacgctccaccgtcagaagtgctcctgacgaacctgtggagcctgagtgtggcaattttctctgtcggcggtatgattggcagtttcagcgtgggactgtttgtgaaccgattcggccggcggaactccatgctgatcgttaatctcctggcagcaaccgggggatgtctcatgggactgtgtaaaatcgctgaatccgtggaaatgctgatccttgggcgcctggtcattggattgttctgcggcctgtgcactggcttcgtgccaatgtacattggggagatctctccgacagcgttgcgaggtgcctttggtactcttaatcagttaggcatcgtaattgggattctggtcgctcagatattcgggttggagttaattctgggcagcgaggagctgtggcccgtgttactaggattcactatcctgccagctattttgcagtcagcagccctgccttgttgcccagaatccccccggttccttctaataaaccggaaaaaagaggaaaatgctacacgaatcctacagcgactatggggcactcaggacgtcagccaagacattcaagaaatgaaagacgagagcgcgcggatgtcccaggagaagcaggtcacagtgctagaactcttcagggtctctagctaccggcagccaattattattagcatcgtgttgcaactgtcacagcagctgtctggaattaacgccgtgttttattattcaactgggatattcaaggatgctggcgttcagcaaccaatctacgccaccattagtgcaggagtggtgaacacaatctttaccctgctgagtttgtttcttgtagagagggccggccggaggacactccatatgataggactgggcggaatggcgttttgtagcactctgatgaccgtatccttgctcctcaaaaatcactacaatgggatgtcattcgtctgcataggcgcgatacttgtgttcgtggcatgtttcgaaatagggcccgggccaatcccttggtttattgtggccgagctgttctcacaggggcccaggcctgccgctatggccgtggctggatgttctaactggactagcaactttttagttggactgttgtttcccagcgccgcatattatctcggagcctacgtcttcatcatcttcacagggtttctaatcaccttcttggcctttacgttcttcaaagtgccagagacgcgtggccgtactttcgaagatattacccgtgctttcgaagggcaggctcatggcgccgatcgcagtggcaaggatggtgtaatgggcatgaattccattgagccagccaaggagacaaccacaaatgtgtag

SEQ ID NO: 134910 - DNA, 363 bp, Artificial Sequence
  Description of Artificial Sequence: Synthetic coding sequence
atggagttccacaatggtggacatgtctctgggatcggtgggtttttagtgtcccttacctctaggatgaaacctcacactttggccgtgactcctgcgctgatcttcgccataactgtggcgaccattggtagcttccagtttgggtacaacacgggggttatcaacgcccccgagaccatcatcaaagagtttatcaacaagacgttaactgacaaggcaaatgccccccctagcgaggtgctcctgactaacctgtggagcctttccgtggcaatcttcagcgtgggaggaatgatcggttctttcagtgtggggctgtttgtcaataggtttggccgccgaaactccatgctgatatag

SEQ ID NO: 134911 - DNA, 1236 bp, Artificial Sequence
  Description of Artificial Sequence: Synthetic coding sequence
atgctcctccgacggcgcaacagtatgctgatcgtgaacctgctagccgctactggcggctgtctgatggggttatgcaaaatcgctgagagtgtggagatgctgatccttggacgactggtgatcgggctcttttgtggcctctgcaccggcttcgtgcctatgtacatcggtgaaatcagtccgacggccttgcggggcgccttcggcaccttgaaccagctcggcatcgtaatagggatcctggttgcccagatttttgggctggaattgatactgggctcagaagaactctggccagttctgttgggcttcacaatactccccgctattctccagtcagctgcactcccatgttgccccgagtcccctcgttttctgttaatcaatcgcaagaaagaggagaatgccacccgaattctgcagaggctatgggggacccaggatgtgtcacaggatatccaagagatgaaagatgaatccgctcggatgagtcaggaaaagcaggttacggtgctggaactgttccgcgtttcttcatacaggcagccaattattatctctatcgttctacagctgtcccagcagttgagcgggatcaacgccgtgttttattactcaaccgggattttcaaggatgctggggtacaacagccaatctacgcaacgatctctgccggtgtagtgaacaccatctttactttgctctcattgttcttagtggaacgggcaggaaggagaaccctgcatatgattggcctggggggcatggccttctgttcaacactgatgaccgtttctcttctgttgaagaatcactataacggcatgtctttcgtgtgcatcggcgctatcctagtgtttgtcgcgtgcttcgagattgggcctggtcctattccatggttcatcgttgccgagctgttctcccaaggaccacggccagccgccatggctgtggctggctgctctaattggacaagcaatttccttgtggggctgctgttcccatctgcggcctactatcttggggcttatgtatttatcattttcacaggttttctcatcacattccttgctttcactttttttaaggtacccgagacccgaggacgaactttcgaagacatcacacgagcttttgagggccaagcacacggcgctgaccgttcaggcaaagacggtgttatgggtatgaacagcatcgagccagccaaggagactacaaccaatgtatag

SEQ ID NO: 134912 - DNA, 426 bp, Artificial Sequence
  Description of Artificial Sequence: Synthetic coding sequence
atggataatagacagaacgtcacccctgccctcatattcgccatcactgtcgcaaccattggatcttttcagttcggatataacactggagtgatcaatgcgcccgagacaattatcaaggagttcatcaacaagacccttacggacaaggccaatgcaccaccgtccgaagttttacttactaatctttggtctctctccgtggccatttttagcgtgggcggaatgatcggttcatttagcgtgggactattcgttaacaggtttggacggcggaactccatgttaattgttaatctgctggctgctacaggcggatgtctgatggggctgtgtaaaattgccgaatccgtcgagatgttgattcttggccggctcgtgattgggctcttctgtggcctgtgcactggctttgtgccaatgtag

SEQ ID NO: 134913 - DNA, 144 bp, Artificial Sequence
  Description of Artificial Sequence: Synthetic coding sequence
atggacaaccgtcaaaacgtgactcctgcgctcattttcgccatcacagtggccaccatcgggagttttcagtttggctacaacactggcgtgatcaacgcgcctgaaaccattattaaggagtttattaacaaaaccttatag

SEQ ID NO: 134914 - DNA, 69 bp, Artificial Sequence
  Description of Artificial Sequence: Synthetic coding sequence
atggataaccgccagaatgtgacacctgcgttgatctttgctatcacagtggcgaccatcggctcgtag

SEQ ID NO: 134915 - DNA, 426 bp, Artificial Sequence
  Description of Artificial Sequence: Synthetic coding sequence
atggagttccataatggcggacacgtgagtgggattggaggctttctggtgagcctgacttcgagaatgaagccacatacactggctgtaacgccagcgctgattttcgccattaccgtggccactattggatctttccagttcggatacaatactggcgtgatcaacgcacccgagaccataatcaaggagtttatcaataagacccttaccgataaggcaaacgctcccccgagcgaagttctactgacaaatctctggagcttgtctgtagccatcttcagcgtcggtggaatgattggcagtttctctgtgggcctgttcgtgaaccgttttggtcggcgaaacagcatgctgattgtaaatctgctggccgctacaggaggttgccttatgggactttgtaagatcgccgagtcagtctag

SEQ ID NO: 134916 - DNA, 1608 bp, Artificial Sequence
  Description of Artificial Sequence: Synthetic coding sequence
atgcagaggttgcagctattgagggtagaagtgctgctgggggtcaagcaaggcgatgaaatgcggcatttttttttttccagtcagacaagcaccctagagaagagccagaacggaggagtcggtgaagaggtcacccccgctctgatctttgctatcaccgtagctactattgggtcgttccaattcggctataacacgggagtgatcaacgcacccgagacaattattaaagagttcatcaacaaaacactcaccgataaggccaatgcgcctccctctgaggtgttgctgaccaacctgtggtctctcagcgtggccattttttctgtgggaggcatgataggatccttctccgtgggcctgtttgtgaatcggtttggacggcgtaacagtatgctcattgtcaacctgctggccgctactggaggctgcctgatgggactatgtaagattgccgaaagcgtggaaatgctgatactgggtcgtctggtgattggactcttctgtgggctttgcaccggctttgttccgatgtatataggagaaatttccccaaccgcactcagaggtgcatttgggaccctcaatcagctgggaattgtgattggaattttggtagcccaaatctttggtctggagttaatcctgggatcggaggagctatggcccgttctcctggggtttaccatcctacccgcaatcttgcagtccgcagctttgccttgttgtcccgagtctccgcgcttcctcctcatcaatagaaaaaaggaagagaatgcaactaggatcttacagaggctgtggggaacgcaagatgtcagtcaagatattcaagaaatgaaagacgaaagtgctcgcatgagtcaggaaaagcaggtaacggtgttagagctgtttagggtctcctcctatcggcagcctattattataagcatcgtcctgcagttatcacagcagctgagcggaatcaatgccgtattctattattccactggaattttcaaagatgctggggtccagcagcctatttatgctactatcagcgccggggtggtcaacacgatcttcactttgctgtccctcttcctggtcgagagggctggacgaaggacactgcacatgattggactgggaggaatggcattctgttcaactctgatgaccgtgtcgttgctcctcaaaaaccactataacggtatgagctttgtgtgcataggtgccattctggtgttcgtggcatgctttgagatcggcccaggacccatcccctggttcatcgtggccgaattgttttcccagggccccagaccagctgcgatggcagtagccgggtgtagtaactggacttccaactttctggttgggctcttgttcccgagtgccgcttactacttgggggcctatgtgttcataatcttcactgggttcctgatcacctttctggcttttacattttttaaggttcccgagacgcggggcagaaccttcgaagatattacgcgtgccttcgagggacaggcccacggcgccgataggtcggggaaagacggggtgatgggaatgaatagcatcgaacctgcgaaagagaccaccacaaatgtttag

SEQ ID NO: 134917 - DNA, 486 bp, Artificial Sequence
  Description of Artificial Sequence: Synthetic coding sequence
atgattgggcttggaggcatggctttctgcagcacgctgatgacagtgtccctgctactgaagaatcactataatggtatgtccttcgtgtgcataggcgccattctagtgttcgtggcctgcttcgaaatcggccccggaccaatcccttggttcatcgtggctgaactgttctcccagggccctcgaccagctgctatggccgtcgccggttgttcaaactggactagtaactttctcgtcggattattgttcccttccgccgcctattacttgggcgcttatgtcttcatcatctttactggtttcctcatcacttttctcgcgtttacatttttcaaagtacccgagacacgcggacggaccttcgaagacattactagggcgttcgaaggacaagcccacggcgcggacaggtccgggaaagacggcgtaatgggaatgaactcaatcgagccggccaaggagactaccaccaatgtatag

SEQ ID NO: 134918 - DNA, 1236 bp, Artificial Sequence
  Description of Artificial Sequence: Synthetic coding sequence
atgctcctgagacgcaggaattctatgctcattgtgaatctacttgccgcaactggcgggtgcttaatggggctctgcaagatcgctgagagcgtagaaatgctgatcttgggtaggctggtaatcgggctcttttgcgggttgtgtactggctttgtgccaatgtatatcggggaaattagccctacggcacttcgcggagccttcggcacattgaatcagctcggcatcgtgattggcatactcgttgcccagatttttggcctggagctcatcctcgggagtgaagaactgtggcccgtgctgctcggcttcactattttgccagcaattttacagtccgccgccctgccctgctgtccagagagtcccaggttcctgctaatcaatcgcaaaaaggaagagaacgccaccaggatactgcagcgcttgtggggcacccaagacgtttcccaagacattcaggagatgaaagacgaatctgcccgaatgagtcaggagaaacaagtcactgttttggaactttttcgtgtgagcagctaccgacagcccatcattataagcatagtgctgcagttatcacaacaactgtctggaattaatgctgttttctactactccactggcatttttaaggacgccggagtccagcagccaatttacgctaccattagtgcaggtgtggtgaatacaatttttactctgctgagcctgttccttgtggagcgggctggacgccgcactttacatatgattggcctggggggcatggccttttgctctacactgatgacagtgtcactgctgctcaagaaccactataacggaatgtcatttgtttgcataggtgccatcctggtcttcgtggcttgcttcgagattggcccagggcccatcccatggttcatcgtggccgaactattctcacaaggaccaaggccggcggcgatggcagtcgccggttgtagtaactggacatctaacttccttgtgggcctactctttccatctgccgcttattatcttggcgcctatgtgtttattattttcacaggcttccttatcactttcctagctttcacgtttttcaaagtaccagagacccgcgggcgcacctttgaagatattacccgtgcatttgaaggccaggcccacggggctgacaggtcaggcaaggatggcgtcatgggaatgaatagcatcgagcccgcgaaggagactactactaatgtctag

SEQ ID NO: 134919 - DNA, 459 bp, Artificial Sequence
  Description of Artificial Sequence: Synthetic coding sequence
atggacaacaggcaaaacgtcactcccgctctcatattcgcaatcacagttgccactatcggctccttccagtttgggtacaacacaggcgtcatcaacgccccggaaaccattataaaagagttcatcaacaagaccctgacagacaaagctaatgcaccacctagtgaggttctcctcactaatctgtggagcctgtctgtggccatcttcagcgttggcggaatgatcggcagcttcagtgttggcctattcgtgaacaggttcggaaggcgaaactccatgctgattgtaaacctactagcggctacaggcgggtgcctgatgggactctgcaagatagctgaaagtgtggagatgctaatactaggtcgcttggtaatcgggctgttttgcggtctgtgcacagggttcgtccctatgtatatcggcgagatctcccccaccgccctgcgatag

SEQ ID NO: 134920 - DNA, 255 bp, Artificial Sequence
  Description of Artificial Sequence: Synthetic coding sequence
atggacaatcgccagaatgtgactccggcgctgatcttcgccattacggtggcgacaatcggaagcttccagtttggttacaacaccggggttatcaatgcccccgaaaccataatcaaggagtttatcaataaaactttaaccgacaaggcaaacgccccccctagcgaagtgttgctaactaatctttggagcctcagcgtcgccatcttttcagtgggtggaatgatcggttccttcagcgtgggactgtag

SEQ ID NO: 134921 - DNA, 1563 bp, Artificial Sequence
  Description of Artificial Sequence: Synthetic coding sequence
atggaatttcataatggcggccacgtcagcggcataggcggctttctggtgtcccttacgtcacggatgaagcctcacaccctggcagttacccccgcactgatattcgccattacagtcgcaacgatcggttctttccagtttggatacaatactggcgtgatcaacgcgcccgagacaatcatcaaggagttcataaacaagacactgactgacaaggccaacgccccgccatccgaagtattactgaccaatctatggagcctgtccgtggccatttttagtgtaggagggatgatcggatcttttagcgtggggctgtttgttaatcggtttgggcgccgtaacagtatgctgatcgtgaatctactggctgctaccggcggctgcctgatggggttgtgcaagatagccgagagcgtggagatgctcattctcggcaggctggtgatcgggctcttttgtggactgtgcactgggttcgttccgatgtatattggagagataagtcctacggctctcaggggtgcattcggaaccctgaatcagctgggcattgtcattgggatcctggtcgctcaaatttttggcttggagctgatccttggcagtgaagaactatggccagtgctgctgggctttactatcctcccggctattttgcagagtgcggcgctgccttgttgccctgaaagcccaaggttcttactcattaataggaagaaagaggagaatgccacccgtatactgcagagactgtggggaacgcaagacgtcagccaggatatccaagaaatgaaggatgagtctgctagaatgagccaggagaaacaggtcacagtattagaactcttccgagtttcctcatatcggcagccaattattatttctattgttctgcagctgtcccagcagctgtcgggcattaatgcagttttttattacagcacgggaatttttaaagatgcaggcgtccagcagcctatttatgctacaatcagcgccggagtggtgaatactatctttactctactgtcgctgtttctggtggaaagagcaggcagacgaactttacatatgatcggactaggtggcatggctttttgtagtacactaatgaccgtgagcctcctgcttaagaaccattataacggtatgtctttcgtgtgtattggggcaatactcgtgttcgttgcttgttttgaaattggtcccggtccaatcccatggtttattgtggcagaactgttttctcagggacctaggcctgcggccatggccgtggcgggctgtagcaattggaccagcaacttcttagttggactcttgtttcccagcgctgcctactacttgggcgcgtatgtattcatcatcttcaccggtttcttgataacctttctggcttttactttctttaaggttcccgagacccgcgggaggacatttgaggacattactagggcttttgaagggcaggctcacggcgccgatagaagtggcaaggacggtgtgatgggaatgaacagcatagagcccgccaaggaaaccacaacaaacgtatag

SEQ ID NO: 134922 - DNA, 510 bp, Artificial Sequence
  Description of Artificial Sequence: Synthetic coding sequence
atggataatagacagaacgtgacaccagccttaatcttcgctattaccgtagcaacaatcggctcctttcaatttggatacaatacaggcgtgatcaacgcccccgagacaatcataaaggaattcattaataagactcttactgacaaggcaaatgcacctccttcagaagtcctgctgacaaatttatggagcctgtcagtggcgatcttttctgtcggcggaatgatcggctcattcagtgtgggtcttttcgtgaacagattcggcaggcgcaattctatgctgatcgtcaatctcttagctgcaactggcggctgtctaatggggctatgcaagatcgccgagagtgtcgagatgctcatactgggccggctagtgattggcctgttctgtggcctgtgcactgggtttgttcccatgtatattggtgaaatttcccctaccgctctgaggggcgcattcggcaccctgaatcagctgggaatcgtgatcggcattctcgtgtag

SEQ ID NO: 134923 - DNA, 1491 bp, Artificial Sequence
  Description of Artificial Sequence: Synthetic coding sequence
atgggaacccagaaagtgactcccgcactaatcttcgctattaccgttgcaacgatcggcagctttcaatttgggtacaacaccggggtcatcaatgcccccgaaaagataataaaagagtttatcaacaagacactgacagacaaggggaatgctccccccagcgaagtgctgcttactagcctgtggagcctgtctgtggccatattcagtgtcgggggtatgataggaagttttagtgttgggctgtttgtgaaccggtttggtcggcgcaattctatgctgattgttaacctgctggcagtgactgggggttgcttcatgggcctctgtaaggtcgcaaagtccgtggaaatgctgatcctcggccgcttggtgatagggctgttctgcggcctgtgtactggctttgtgccgatgtatattggagagatttcccccacagcactccgcggcgcatttggcaccctgaatcagctgggcatagtcgtagggatactggtcgcccaaatcttcggtctggaattcatccttggatctgaggaactttggcccctgctgctgggcttcacaatcctccccgctatactgcagtcagctgccctccctttttgccctgagtctccgagatttctgttgataaatcggaaagaagaagaaaacgcaaagcagatacttcagcgcttatggggaacacaggacgtctctcaggacatccaggagatgaaggatgaaagcgcgagaatgtcccaggagaagcaggtgaccgttctggaactttttagagtgagttcttataggcagcccataataatatcaatcgtactgcagctaagtcagcagctcagtggcattaatgcggtattctattactctacaggtatatttaaggacgcgggcgtccaggaaccaatttacgccaccataggtgctggtgtggtgaataccatctttacagtagtgtctctgtttttggtagaaagggcagggaggaggaccttacatatgatcggtctcggtggtatggctttttgtagtactcttatgacggtgtccttgctgttgaaggacaactacaacggaatgtctttcgtgtgtatcggtgccattctggtgttcgtagccttcttcgaaatcgggccgggtcccattccctggtttatcgtcgctgaactgttttcacagggaccacgcccagctgcaatggctgtggcgggatgttctaactggacctcaaactttctagtggggctcctcttccctagcgccgcacattacctgggggcatatgtatttataatttttaccggtttcttgatcacattccttgcctttacattctttaaagtgccagaaactcggggtcgaaccttcgaggacataactagagccttcgagggccaggcccatggcgccgatcgcagcgggaaggatggcgtaatggagatgaacagtatcgaaccagctaaggaaaccaccactaacgtttag

SEQ ID NO: 134924 - DNA, 1269 bp, Artificial Sequence
  Description of Artificial Sequence: Synthetic coding sequence
atgattggctctttctcggtgggtctttttgtgaatcggtttggaagacggaactcaatgctgattgtgaacctactcgctgtgacggggggatgcttcatgggtctctgcaaggtggcgaaatctgtggagatgctgatcctgggccggctggtgatcgggttgttctgcggcctatgtactggatttgtgcccatgtacattggcgagataagcccaacggccctcagaggcgcctttggcactcttaatcagttaggtattgtcgttggcattctggtggcacagatatttggtctggagttcattcttgggtctgaggaactgtggcctctgttgctggggttcacaattctgcctgccatcctccagagtgccgcactgcctttctgccctgaatctccgcggttcctcctgatcaataggaaagaggaagaaaacgccaagcagattctgcagagattatggggcacgcaggatgtgtctcaggacatacaggagatgaaggatgaatccgctaggatgagccaagagaagcaggttaccgtgctggaactctttcgcgtcagcagctacagacagcctattattatttcaatcgtgctacagctaagccaacagctgtccggcattaatgcagtattctactactcaactgggatcttcaaagacgcaggggtgcaggagccgatctacgctacaatcggagctggcgtcgttaatacaatctttactgttgtaagcctgttcttggtggaacgcgcaggccgccgcacacttcacatgattggactcggagggatggcattttgcagcaccttaatgacagtgagcttactgctgaaggacaattacaatgggatgagttttgtgtgcattggcgcaatactggtgtttgtcgcatttttcgaaatcggcccgggccccattccatggtttattgtcgccgagctttttagccaagggccccggcccgcagctatggcagtggcaggatgttccaactggaccagtaattttctggtcggactactgtttccctctgctgcacattacttgggtgcctatgtgttcatcattttcacaggatttctgatcacttttctagctttcacattttttaaagttcctgagacccggggacgaacattcgaagacataaccagagctttcgagggacaggctcacggtgctgataggtccggcaaggatggagttatggaaatgaacagcatagaacctgcgaaggaaaccaccactaacgtatag

SEQ ID NO: 134925 - DNA, 1530 bp, Artificial Sequence
  Description of Artificial Sequence: Synthetic coding sequence
atgccatccggattccaacagataggttccgaagatggggagccaccccagcaacgagtcacaggcaccctcgtgcttgccgtttttagcgcggtcttgggtagtctgcagttcggatacaatataggtgtcatcaatgccccacagaaggtcattgaacagtcctacaatgagacatggttaggccgccagggaccggaaggcccgtcaagtatccccccaggaaccctcactacactttgggccctaagtgtggctattttcagtgtgggtggaatgattagcagcttccttatagggattattagtcaatggctcggcagaaaacgtgccatgctggtcaataacgtcctggctgtgttaggcggcagcctgatggggctggctaatgctgctgcctcttacgagatgctaatcttgggccgcttcctgatcggggcctattctggactgacctcgggcctggtaccgatgtatgtaggggaaattgcacctacccaccttaggggagcattgggcacattaaatcaactagccatcgttataggcatactgatagctcaggtactcggcctggagtcccttctcggcactgcctcgctatggccactgctgttgggccttactgtactgccagcgctgttacaactcgtcttgctccccttttgtcctgagagcccacgctacttgtacattattcagaacttggaaggaccagcccgaaaatctttgaaaaggttaactggatgggctgacgtgtcgggggtgttagccgagctgaaagatgagaaacggaagttggagagagagcgtcccctgtcactgttacaattgctggggtcgaggacccacaggcagcccctcataatcgcagttgttctgcaattgagtcagcagctctctggcataaacgcagtcttctattactcaacctctatctttgaaacagccggcgtgggtcagcccgcttatgccaccatcggcgccggggtggtaaacacagtgtttacactggttagcgttctgctggtggagcgggctggaagacgcactctccatctgctggggcttgccggaatgtgtggctgtgccatcttgatgactgtggccctccttctgttggaacgggtccctgccatgagttatgtgagcatcgtggctattttcggtttcgtggccttctttgagatcgggcctggacctatcccatggtttatcgtagctgaactgttctctcaggggcctagacccgccgctatggcagtcgcaggatttagcaattggacatccaactttatcataggcatgggcttccagtatgtcgcagaggctatgggcccctacgtgtttctgcttttcgccgtgctgttgctgggattcttcatttttacttttttacgagtcccagaaacccgcggaaggacgttcgatcagatttcagctgcgtttcaccgaaccccaagccttttggagcaggaggtaaagcctagtacagagctagagtatctcggccccgacgagaatgattag

SEQ ID NO: 134926 - DNA, 1356 bp, Artificial Sequence
  Description of Artificial Sequence: Synthetic coding sequence
atggacggcgagccaccccagcagcgcgtcacggggacgcttgtgctcgccgtgttttccgctgtcctggggtcactgcagttcgggtataacattggggtgattaatgctcctcagaaggttattgagcagtcctacaacgaaacttggcttgggcggcagggaccggagggaccctctagtataccccccggaaccctcacgaccctttgggctctgagcgtggcaatcttttccgtggggggtatgatttcttcctttctcataggaattatcagccagtggttaggcagaaagagggcaatgcttgtcaacaatgtactggcagtgctggggggaagcctgatgggattggccaacgctgctgcctcatacgagatgctgatcctggggcggtttctaatcggcgcctactctggtcttaccagcggcttggttccgatgtacgtgggggaaatcgcccccacccatcttagaggggctctcgggactcttaaccagctggcgatcgttattggtatccttattgcgcaggtcctcggattggagagcctgctgggtaccgcttctttatggccactgctgttggggctcactgtgctccctgccctgctccaacttgtactcttaccattttgcccagaaagtccccgttacctttacattattcagaacctggaggggccagccaggaaatctctgaagagactgaccggttgggcggatgtcagcggcgtactggcagaactcaaggacgagaaaaggaagctggaacgggagcgtccactgtcactgttacaactgctgggaagccggacacatcgtcagcctttgatcattgccgtcgttttgcaactgtcgcagcagctctccggaattaacgcagtgttttattacagcacctcaatttttgaaaccgctggggtgggccagcccgcatatgcaacaataggagccggggtggtgaatactgtgttcacccttgtctcggtcttgttggtcgaaagggccgggcggaggacgctgcatctgcttgggttagcgggcatgtgcgggtgtgctatactgatgacggttgccctcttgttgctggaacgcgtccccgctatgtcctacgtcagcattgtggccattttcgggttcgtggctttctttgagatcggcccgggcccaatcccttggtttatcgtggctgaactctttagccaggggcctcggcctgcggcaatggccgtcgctggcttcagcaactggaccagcaattttattattggtatgggcttccaatatgtcgccgtcggaccacccgcacccgccagccatacagtggggcaacgctgggcatcacactcatag

SEQ ID NO: 134927 - DNA, 1338 bp, Artificial Sequence
  Description of Artificial Sequence: Synthetic coding sequence
atgcaggaaccactccttggagccgaaggtcctgactacgataccttccccgaaaaaccaccgccaagtcccggcgatcgcgcacgagtggggacactgcagaacaaacgggtattcctcgctacgtttgccgcagtgctcggcaacttctcctttggctatgcactggtctatacctcacccgtgatccccgccttggaaaggtctttggatccagacctccacctgactaaaagccaagcctcctggtttggctcagtctttacgctaggggctgccgctgggggattgtctgccatgattctgaacgacctgctggggcggaaactgtccataatgttttcagctgtgccaagtgccgcaggttatgccctgatggctggggcccatggtctgtggatgctgctcttgggtcgtactctcaccggatttgcaggaggcctgacagccgcatgtataccagtgtatgtgtccgagattgcccctccgggagttcgtggcgcgctcggcgctaccccgcagctgatggctgtttttggttcgctgtcactgtacgctctcgggctgctcctgccctggagatggttggccgtggcaggcgaggcccccgtcctgataatgattctgctgctgagctttatgcctaattcccctcggtttttgctgtcaaggggccgcgatgaagaggcgctcagagcattggcctggttgagggggacagacgtggacgtccattgggagttcgagcaaattcaagacaacgttagacgacagtcctccagggttagttgggccgaggctcgggcgccccacgtttgcagacctatcaccgtggctctgctaatgcggctgttacagcagctgacaggaattacacccattctcgtgtatctgcagagtatttttgattccaccgccgtactcctgcctcccaaagatgatgccgctatcgttggagcagtgcgcctcctctctgtgttgatcgccgcgctgacaatggatctggccgggaggaaagtcctgctgttcgtgtccgggtatgccgtggggtggggaccaattacgtggctgctgatgtcagaggtgctgccactccgcgctaggggggttgctagtggtctctgcgtgttggctagttggctgacagcattcgtactaacgaagtcatttctccccgtggtgtccacttttggacttcaagtcccattcttttttttcgccgcaatttgcctggtgtccttggtttttactggctgctgtgttccagaaacaaagggccggtctttggagcagattgagtcattttttaggaccggaagacgaagctttcttagatag

SEQ ID NO: 134928 - DNA, 1524 bp, Artificial Sequence
  Description of Artificial Sequence: Synthetic coding sequence
atgcaagagccattgctgggagcggaaggtccagattacgacacctttcctgagaagcccccacccagtccgggtgacagggcacgggtggggaccttacagaacaaaagagtgttcctggccaccttcgccgctgtcttaggtaacttctcttttggttatgctctggtttacacctctcctgtgattcctgccttagagcgtagcctcgaccccgaccttcacctaacgaagtcacaagcttcatggttcggtagtgtcttcactcttggcgctgctgccggcgggctgtctgccatgatcctgaacgatctcctgggaagaaagctctcaataatgtttagcgctgtccctagcgctgccggttatgctctgatggccggtgcacacggactctggatgctgctgctaggcaggaccctcactgggtttgccggcggactgacagctgcctgcatcccagtgtacgtgtcagagatcgcaccgcctggcgtacggggcgctttgggggccaccccacagcttatggccgtgttcggatcactgtctctctatgcactcggcttactgcttccctggcgctggctggctgttgcaggagaagcacctgtgttgattatgattttgctgctctcgttcatgcccaactctcctcgcttcctattatcaagaggcagagatgaggaggccctccgggccctggcctggctgagaggtaccgacgtggacgtgcattgggaatttgaacaaattcaggataacgtgcggcgtcaatcttctagagtgtcctgggctgaggcccgagctccacatgtatgtagacctatcacagtggcactgctaatgcggctgttgcagcagctcacgggtataactcctatcctcgtgtatctccagagtatcttcgacagtacggctgtcctgctccctcccaaagatgatgccgccattgtcggcgccgtgcgccttctcagtgtgctgattgccgccctaaccatggatctggcaggaagaaaggtgctcctatttgtttcagctgccatcatgttcgccgccaatctaactcttgggttatacatccacttcggtcccaggcccctgtcccccaactcaaccgccggacttgagtccgaaagctggggggacctcgcccaacctttagccgcacctgctggttacttgaccttagtgcctcttctggcaacaatgctgtttatcatgggttacgccgtagggtggggcccaattacatggctcctcatgtctgaggttctgccgctgcgggccaggggcgtcgccagtggcctatgtgttctggcctcttggctaactgcctttgtgttgaccaagtccttcctgccggtggtgtcaaccttcggcctgcaggtgccattcttcttttttgccgccatctgccttgtaagccttgtgttcacaggatgctgcgtgcccgagaccaaaggacggtctctcgagcaaatcgagagcttcttcaggactggccgcagaagctttctcaggtag

SEQ ID NO: 134929 - DNA, 441 bp, Artificial Sequence
  Description of Artificial Sequence: Synthetic coding sequence
atgatcttgaacgacctgctcggtaggaaactctctatcatgttctccgcagttccatctgcggctgggtacgctcttatggcgggagctcacggactttggatgctacttctcggcagaaccctcaccggctttgcaggcggtttgactgccgcttgcatacctggtctgaccctcccatcccgaccagggcttggaacttccattttttccaagacctggtgcggagggtgcgtactgcaggtgtatgtctcagaaattgctccgcctggtgtgcggggggcgctgggcgcaacgccccagctcatggccgtgtttggaagtttgtccctgtacgctttagggaaggatgaggaggcattgcgggccctcgcctggttgcgtggaaccgatgttgatgtgcattgggaattcgagcaaatccaggacaacgtcagatag

SEQ ID NO: 134930 - DNA, 660 bp, Artificial Sequence
  Description of Artificial Sequence: Synthetic coding sequence
atgcaggagcctctcctgggggcggagggccccgattacgacaccttcccagaaaaacctcccccctccccaggggacagagctagagtgggaaccttgcagaacaaaagggtgttccttgccacatttgctgcagttttgggtaattttagtttcggttacgcgctggtttatacatcaccggttatccctgctttagaaaggagcctcgatccagacttgcatttgactaaatctcaggcaagctggttcggctccgtatttacactgggtgctgcagcgggaggattgagcgcgatgatcctgaatgatctgctgggaagaaagttatcaattatgttcagcgccgtaccttctgccgctggctatgccttgatggctggagcacacggcctgtggatgttgctcctgggcaggacattgacgggcttcgccggggggcttacggccgcctgcatccctgtgtatgttagcgagattgcacctcccggggttcgcggggccttgggcgcaacacctcaactcatggccgtgtttggcagcctgagtttgtatgccctaggcactaaacgaccctgcggccgatggcctggttgtgtgggccggaccagcatgagcacagggtcgtcttctagatcacgcaccactagcggagattag

SEQ ID NO: 134931 - DNA, 1539 bp, Artificial Sequence
  Description of Artificial Sequence: Synthetic coding sequence
atggagaacaaggaggctggcactccaccaccaattccgtctagggaagggcgactccagcctactctgctgcttgcaactctgagcgcagcttttgggtctgcattccaatacggttacaacctttcagtggtgaacacccctcataaggtgtttaagtcattttataatgagacctattttgagcgccatgctaccttcatggatggcaaactgatgctcttgttgtggagttgcacagttagcatgttccccttaggcgggctgttgggatccctcctcgtcggactactggtggatagctgcggcagaaaaggcactctgctgattaacaacatattcgccatcatccctgccattctcatgggcgtaagcaaagtggccaaggcttttgaactgattgtgttcagcagagtggtgctgggagtctgtgctggaatcagctacagcgctcttcccatgtacctaggagagctggctccaaaaaacctgcgtggcatggtcggcacgatgactgaggtgtttgttatcgtgggcgtgttcctcgcacagatttttagtcttcaggccattctgggaaatcctgccggctggccagtactgctggctctgaccggcgtgccagcgctgttgcagctcctgaccctgccgtttttccctgagtcccccagatactctctgatacaaaaaggtgacgaggcgaccgcccgccaggccctgaggaggctcagaggccacacggacatggaagccgagctcgaggacatgagagctgaggcccgcgcagagcgggctgaagggcacctgtctgtgctgcatctgtgcgcgctgaggagccttcgctggcagcttctctcgatcatcgtgctgatggccgggcaacagctgagtggaattaatgccataaactactatgccgacactatttacacctccgccggggtagaggcagcacatagtcaatacgtgacggtggggagcggggtcgtcaatatagttatgacaattacttccgccgttctggtggaacgacttgggagacgccatctgttactggccggatacggaatctgcggctctgcgtgcctcgtgctgacagtggtgctgctgtttcagaatcgggtgcccgaactgtcatacttgggcatcatttgcgtgttcgcctatatagcgggtcactcaatcggcccgtcaccagtgcccagcgtcgtgcgcactgaaatcttcttgcagtcatcgcgaagggccgccttcatggtcgacggggccgtccattggctgaccaatttcatcataggctttctgttcccttcaattcaggaagccattggggcctactcttttatcatatttgctggcatctgcttgctgactgccatctacatctatgtagttattcccgagaccaaagggaagacattcgtggaaatcaacagaatctttgctaagcggaatagggtcaagctgccagaagaaaaggaggagacaattgacgcaggaccgcccaccgcttctcctgctaaagagacttccttctag

SEQ ID NO: 134932 - DNA, 804 bp, Artificial Sequence
  Description of Artificial Sequence: Synthetic coding sequence
atgacgtgctccctgggcaaagtttacattagtgaaattgcctatcccgcagtgcgggggctgttagggagttgtgtgcaactgatggtggtggttggaatcctactggcatacctcgcaggttgggttttagagtggcggtggctcgcggtgctgggttgcgtgccccctagcctgatgcttctgctgatgtgcttcatgccagagacacccagatttctgttgacccagcatcgcaggcaagaggccatggccgctctcaggttcctatgggggtcggagcagggctgggaggacccccctattggtgccgagcagtcgtttcatctagcactgctgagacagcccggtatctataagccattcattatcggtgtatctctgatggctttccagcaactgtccggcgtgaacgctgtgatgttctacgccgaaaccatcttcgaagaagccaagtttaaggattcttcgttagcctcagtggtggttggggtaattcaggtcctgttcaccgcagtggccgccctcatcatggatagggccggcaggcggctgctgctggtgttgtcaggagttgtgatggtgttttccacaagtgccttcggagcatatttcaagctgacacagggggggccagggaacagctcccacgtggcgatatccgcacccgtctcggcccagcccgtggacgcaagtgttggcttggcatggctggctgttgggtcaatgtgcctgttcatcgctggattcgcagtgggctggggaccgataccttggctcctgatgtccgagatctttccatag

SEQ ID NO: 134933 - DNA, 645 bp, Artificial Sequence
  Description of Artificial Sequence: Synthetic coding sequence
atggcttttcagcaactcagcggtgtgaatgccgtaatgttctacgcagaaactatctttgaggaagccaaatttaaggactcctccctcgccagcgtcgtcgtgggggtcattcaggtcttgttcacggcagtggctgcccttattatggaccgcgccggccggcgactgcttctggtcttgtcgggggtcgtcatggtgttctcaacgtccgcatttggcgcctacttcaaacttacacagggcggccccggcaacagcagtcatgtggccatcagcgcacctgtatccgctcagcctgtcgatgcctcggtcggacttgcctggctggcagtggggagcatgtgcctcttcatagccggcttcgcggttgggtggggccctatcccatggctcctcatgtcggagattttccctttacacgtcaagggtgtggccaccgggatctgcgttctaaccaactggcttatggctttcttggtaaccaaggagttcagctctcttatggaggtgctgagaccatacggcgctttctggctggcaagcgcattttgtattttctctgttctcttcacgttattttgcgttcctgagactaagggcaaaactctcgaacaaatcaccgcccatttcgaaggaagatag

SEQ ID NO: 134934 - DNA, 1236 bp, Artificial Sequence
  Description of Artificial Sequence: Synthetic coding sequence
atgactccagaagatccggaggagactcaaccattactgggtcctcccggagggtccgccccccggggccgacgcgtcttcctggcggcttttgccgccgccctgggaccccttagttttggattcgcactcggctactcctcgcccgcaattccctcactgcaacgcgccgccccaccggcccccaggctcgatgacgccgcagcaagctggttcggcgccgtggttaccctcggagcagccgcggggggcgtgctcggtggctggttggtcgatcgcgcagggcgaaagctgtctctcctgctatgtagtgtgcccttcgtcgccggattcgccgtgatcacagcggctcaggacgtctggatgcttctcggcgggaggttactgactggactggcttgtggagtggccagtcttgtggcacccgtgtatatcagcgaaatagcttatcctgccgtgcggggcctcctgggatcatgcgtccagctcatggtcgtggtgggcattctactcgcgtatctggccggttgggttctcgagtggcgctggctggccgttttaggctgtgtgcctccatccctgatgttgttgctgatgtgtttcatgcctgagacaccacggttcctactcacccagcatcggcgtcaggaagctatggcagccctaaggtttctctgggggagcgagcaaggctgggaagacccccccattggggccgagcagtctttccatctggctctcctgcgtcagcctggaatatataagcccttcattatcggagttagcttgatggcattccagcaactgtcgggcgttaacgcagtcatgttctatgccgaaaccattttcgaggaagcaaaatttaaggactcttctcttgcatctgttgttgtgggcgtgattcaggtgctgtttacagcggtggctgcactgattatggatcgggccggacgccggctcctgctggtgctgagcggggtggttatggtattctcgacttcagccttcggagcctattttaagcttactcagggtgggccaggtaattcatcccacgtagcgatctcagcccccgtgtccgctcagcccgtcgacgcctctgtcggcctggcctggctggcagttggcagcatgtgcctgttcatcgctggaggcccccaagccctatggtctttgctcgcctgcctccgctttctacatctgcagtgtccttttcacttcgttctgtgtccttag

SEQ ID NO: 134935 - DNA, 1434 bp, Artificial Sequence
  Description of Artificial Sequence: Synthetic coding sequence
atgacgccagaggacccagaggagacccaaccgctgctcggacctcccggggggagcgctccacgcgggcgaagggttttcctggcagctttcgcagcggctctggggcctctttcatttggtttcgctctcggatattctagtcctgcaatacccagtcttcagcgcgctgcaccacccgccccaaggctggatgacgcagctgcctcatggtttggagccgttgtgaccttgggtgctgccgctgggggggtcctcggaggctggcttgtagaccgcgccggtcgtaagctgtctctgcttctctgttccgtccccttcgtagcagggtttgccgtgataaccgctgcgcaggacgtatggatgcttttgggcggtcgtctgctgaccgggctggcttgtggagtggcctcattagtggctcccgtgtacatttctgaaatagcctaccccgcagtacgcggcttgcttggaagctgtgtgcagttaatggttgtagtgggtatccttctagcctatttagcgggatgggtgttagagtggagatggcttgcagtattgggatgcgtcccccccagtctaatgttacttttaatgtgtttcatgcctgagacccctagatttctgctcacccagcataggcggcaggaggccatggctgctctgaggttcctgtggggatcggaacagggttgggaagatccaccgatcggggctgagcagtcttttcacttagctcttctccgccaaccggggatctacaaacctttcatcattggggttagcctcatggcgtttcagcagttgagcggggtgaacgccgtcatgttctacgcagagacaatctttgaagaagctaagtttaaggattcttcactagccagcgtggtcgtgggggttattcaagtgctcttcaccgccgtcgccgccctaattatggaccgggccgggcgcaggctcttgctcgttctgtcgggagtcgtgatggtatttagcacatcagcattcggtgcctactttaagctcacacagggtggccccgggaactcctctcatgtagcgatttctgctccagtctccgcccagcccgtggacgcgagtgtgggactggcctggctggccgtgggaagtatgtgtttgtttatcgcaggctttgctgttggatggggccccatcccatggttgctgatgtctgaaattttcccactgcatgtaaagggagtggccaccggcatttgtgtgttgaccaactggcttatggcctttctggtaactaaggagttctcatcactgatggaagtgctgcgcccctacggagctttttggcttgcgtccgcgttctgcatctttagcgttctttttaccctgttctgcgtgcctgaaaccaagggtaagacattggagcagatcacggctcattttgaagggagatag

SEQ ID NO: 134936 - DNA, 510 bp, Artificial Sequence
  Description of Artificial Sequence: Synthetic coding sequence
tgaggccggagagtgttcctggccgccttcgccgccgccctcggtcctctgagctttggatttgccctgggctactcctctcccgccataccctccctgcagcgggcggctccacccgcaccgaggctggatgatgccgccgcgagttggtttggcgtgtatatcagtgaaattgcatatccggccgtgcgcggtctattagggagctgcgtgcagctgatggtggttgtaggaatcttgcttgcctatctcgccgggtgggtcctggaatggcgctggctcgccgtgttgggctgcgtgcctccttctcttatgctattgctgatgtgtttcatgcctgagacgcctcgatttctcttgacacagcaccggcgacaggaggcgatggcagcgctgcggttcctgtggggatccgaacagggctgggaagatcccccaattggcgccgagcaacagctgtccggtgtgaatgccgtgatgttctatgcggagacgatttttgaagagtag

SEQ ID NO: 134937 - DNA, 771 bp, Artificial Sequence
  Description of Artificial Sequence: Synthetic coding sequence
atgaccccggaggatcccgaagagacgcagccactgctggggccacctggcggatccgcacccaggggtcggagagtgtttttggcagcttttgctgctgcactgggaccattgagctttggcttcgccctcggatactcctcgccagcaattccttccttacagagggcggcccccccagccccaaggcttgacgacgcagctgcttcgtggttcggcgtctatataagcgaaattgcttacccagcagtgcgggggctcctgggaagctgtgtgcagctgatggtggtggtgggcatattgctagcatatctcgctggctgggtcctggagtggcgctggctagcagtcctgggatgtgtgcctccaagcctaatgcttcttttgatgtgtttcatgcctgagacccctcggtttctgttaacacagcataggcggcaggaggcaatggccgctctcaggttcctatggggatccgaacaaggctgggaagatccaccgattggggcggaacagagcttccacttggctctgcttaggcagcccggcatatataaacccttcatcatcggtgtgtcactaatggcgttccagcagctgtctggggtgaacgcagtaatgttttatgccgaaactatttttgaagaggccaagttcaaggattcctctttagcatctgtggtcgtcggagtgatccaggtactctttacagccgtggccgcgctcatcatggacagggccggtaggcgcctgctgctcgtcctctcttag

SEQ ID NO: 134938 - DNA, 804 bp, Artificial Sequence
  Description of Artificial Sequence: Synthetic coding sequence
atgacctgtagcctaggaaaagtttacatttctgagattgcttatccagctgttagaggcctattaggtagctgtgtgcagctcatggtcgttgtaggcattcttctggcatacctggctggttgggtgttggagtggaggtggcttgccgtgcttggctgtgtgccgccgagtctcatgctgttactcatgtgcttcatgcctgagaccccaagatttcttctcacccagcataggaggcaggaggctatggcagctctccgtttcctttggggctcagagcagggatgggaggaccccccgatcggtgctgagcagagtttccatcttgcattgctgcggcagcctgggatctataaacccttcatcataggcgtcagtcttatggccttccagcaactatccggcgtgaacgctgtaatgttctacgcggaaacaatctttgaagaagcaaagttcaaggatagctccttggcaagcgtcgtggttggggtcatacaggtgctgttcacagccgtggctgccttaatcatggatagagccggcagaagattgctgttagtcctatcgggtgtggttatggtcttttcaacctcggccttcggcgcctattttaagctgactcagggcggccccggcaactcttcccacgtggccatatctgcccccgtgagcgcccagcccgttgatgcatcggtgggactggcatggttagccgtcggtagcatgtgcctattcatcgctggatttgcggtgggttggggaccaattccatggctgctcatgagtgagatattcccatag

SEQ ID NO: 134939 - DNA, 831 bp, Artificial Sequence
  Description of Artificial Sequence: Synthetic coding sequence
caactgatggtcgtggtgggaattctgctggcttatctagccggctgggtcctggagtggcgatggctggccgtccttgggtgcgtgcctccctccttgatgctcctgctaatgtgctttatgcccgaaacgccaaggttcttactgactcagcacagacgtcaggaggctatggctgcactaagattcctgtggggctcagagcagggttgggaggaccctccgataggggctgagcagtctttccacctggcactgttacgtcaaccaggtatatacaagccctttataatcggggtgtctctgatggccttccagcagctgagcggcgtcaatgctgtgatgttttacgcagagacaatctttgaagaagctaagtttaaagatagtagcctcgcgtcagtggtggtgggggtgatccaagttctgttcaccgccgtagccgcattgattatggacagggcagggcgccgattgctgcttgttctctctggggtcgtgatggtgtttagcacctcagcctttggcgcctatttcaaactgacacaggggggaccagggaattcaagtcacgtagctataagcgcacctgttagcgctcaacccgtagatgcctccgtgggtttggcctggcttgcagtaggcagtatgtgcctcttcatcgcaggatttgccgttgggtggggacccatcccatggctgctaatgtcagagatctttcccttacacgtgaagggcgtcgccacagggatttgtgtgctgacgaactggttaatggcgttcctggtcacaaaggaattttcttctctgatgttgttgctcctgctgtag

SEQ ID NO: 134940 - DNA, 726 bp, Artificial Sequence
  Description of Artificial Sequence: Synthetic coding sequence
atgacgtgctccttgggaaaagtctatatttctgagattgcctacccggctgtgcgcggactgctggggagctgtgtgcagctcatggtggtggtgggcattctgcttgcgtacttggccggctgggtgctggagtggcgttggctggccgtattagggtgtgtgccaccctctctcatgctactgttgatgtgctttatgccagagaccccaaggttcctgctcacccagcacagacgtcaggaggcaatggcagccctgcgtttcctgtggggaagtgagcaggggtgggaggatccaccaatcggtgccgagcagcagctcagcggtgtcaatgctgtaatgttctacgctgaaacgatttttgaggaagctaaattcaaggatagttccctggctagtgtcgttgtgggagttattcaagtgctttttaccgcagtagccgccctgatcatggatagggctgggcgcagactattgcttgttctcagtggcgtggtgatggtcttttccacttccgcctttggagcctacttcaagctgacccagggaggtcctggcaactcaagccatgtcgcgatctccgcaccggtctccgcccagccggtggatgcctcagtgggactggcctggctggcagtgggctcaatgtgcctgtttattgctggattcgcggtaggctggggcccgatcccctggcttctcatgtcagaaatttttccctag

SEQ ID NO: 134941 - DNA, 798 bp, Artificial Sequence
  Description of Artificial Sequence: Synthetic coding sequence
atggtcgtagtgggcattctgctggcttacctggcaggctgggttttggagtggaggtggctggccgtgctcggctgcgtgccccctagcctcatgcttctgctcatgtgctttatgccggagacgccacgctttcttctaacccaacatagaaggcaggaggctatggccgccctgagatttctgtgggggagcgagcagggttgggaggaccccccaattggcgctgaacagtcttttcacctggcgctattacggcagccaggcatctataagccgttcatcatcggtgtcagtctgatggcgtttcagcaactgtctggcgtcaacgctgtgatgttctatgccgaaactatcttcgaggaggcaaagtttaaagacagctctttggccagtgtcgtcgtaggagtcatccaggtgctgtttacagccgtcgccgctctgatcatggatcgtgcaggacgtcggcttctccttgtgctctccggcgtggtgatggtcttttccacgtcagcctttggcgcatacttcaagttaacacagggaggcccagggaattcaagtcacgtggccatctcagcccctgtcagtgcacagcccgttgatgcttcagtggggttggcttggctggcggtagggagcatgtgcttatttattgcgggatttgcagtgggatggggtcctatcccctggctgctgatgagtgaaattttcccattgcatgttaaaggcgtcgccaccggtatatgtgtcctgacaaattggctgatggcttttctcgtgacaaaggagttttag

SEQ ID NO: 134942 - DNA, 1623 bp, Artificial Sequence
  Description of Artificial Sequence: Synthetic coding sequence
atggcccgaaagcagaacaggaacagtaaggaactggggttggtcccactgacagacgacacatcgcacgccggtccccctggccccggcagggcgcttctggaatgtgatcacctgcggagcggggtccccgggggccggcggagaaaggattggtcttgctccttactcgtggcttccctggccggcgcgtttgggagtagcttcctgtatgggtacaacctgagcgtggtgaacgcccccacgccctacattaaagccttttacaacgaatcatgggagcgtagacatgggagaccaatcgatcccgacacactcaccctgttgtggtccgtgacggtgtcaatcttcgccataggcgggctcgtgggaacactgatagtaaaaatgattggcaaggtgcttgggcggaagcacaccctgttagccaacaatggctttgcaatctccgccgccctcctgatggcctgctccctccaagccggagcattcgagatgctgatagtaggtcgctttatcatggggattgacggcggtgtggcactctccgtcttacccatgtatctctctgaaataagccctaaggaaattcggggctccttggggcaggtgactgctatttttatctgtattggcgtattcaccggccaactgctcggtctcccagaattgttgggaaaggagagcacctggccctacctttttggggtcatcgtcgtccctgcggtcgttcaacttttatctcttcctttcctaccagactcccctagatacctgctgttagaaaagcacaatgaggcccgtgccgtgaaggcattccagaccttcctgggcaaggctgacgtctctcaggaggtggaagaagttcttgccgaatcccgggtgcaaaggtcaatcagactcgtgtccgtgctggaactcctgagggccccttatgtgcgatggcaagtggtgactgtgatcgttaccatggcttgttatcagctttgtggccttaatgctatctggttttatacaaatagtatcttcggcaaggcgggaattcctcccgccaagattccttatgttaccctcagtaccggcggtatcgagacgctggcggccgtgttttctggtctggtcattgagcatctgggccgtcgccccctccttattggcggcttcgggctcatggggttattttttggcaccctgactattaccttaaccttgcaggatcatgccccatgggtgccttacctttccatcgtcggaattctggccatcatcgcgtccttttgttctggcccaggcggcatccctttcatcctaacaggcgaattcttccagcaatcccagcgccccgccgcgttcattatagctggcacagttaattggctctctaatttcgctgtaggcctgctgttccccttcatacagaaatccctggacacctactgtttcttggtgtttgctaccatatgtataacaggagccatttatctctactttgttttgcctgaaacaaaaaataggacctacgccgaaatctctcaggctttcagcaaaagaaacaaggcttatcctcccgaggagaagatcgatagcgctgtaacagacggaaagattaacgggcgaccgtag

SEQ ID NO: 134943 - DNA, 1536 bp, Artificial Sequence
  Description of Artificial Sequence: Synthetic coding sequence
atgaaattgagtaaaaaggacaggggcgaggacgaggagtccgactcagctaaaaagaaactcgattggtcgtgctcgttactggtggctagcttggccggagccttcgggagttcatttttgtacggctacaacctgagtgttgtcaacgcgcccaccccatacataaaggcattctacaacgagtcatgggagcgaaggcacgggcgtcccatcgaccctgacaccctcacactgctttggtcagttacggtgtcaatttttgccatcggtggactagtcggaaccttaattgttaaaatgattgggaaagttttaggccgcaaacacacactgcttgctaacaacggcttcgcaatctctgctgccctgttaatggcctgttcgcttcaggcaggagcgtttgaaatgctcattgtgggccgcttcattatgggcatcgatgggggagttgccctgagcgtgctccccatgtatctttccgagatttcaccaaaggaaatcagaggatccctggggcaagttaccgccatatttatctgtatcggggtgttcacgggccagctcctgggcctacctgaactgctcggtaaagagtctacatggccctacctcttcggtgtgattgtggtgccggcagtggttcagctgctctccctgccgtttttgccagactcgccccggtacctcctgctggagaaacataatgaggcacgagccgtgaaggcttttcaaacctttctggggaaggccgatgttagccaagaagtcgaggaggtgctggcggagtccagagtacaacgatccattcgcttggtaagcgtattggagctactacgggcgccatatgtccggtggcaggtcgttaccgtgatcgtgaccatggcgtgctatcagctgtgtggactcaacgctatttggttctatactaatagcatttttggtaaagctggaatccctccagctaagatcccctacgtgacactgtccacggggggtattgaaactctcgccgcagtattttccggtctggtaattgagcatctggggcgccgccccttgctcattggtgggtttggcctgatgggcctgttctttggaaccttaacaattactctcacccttcaggaccacgcaccctgggtgccttaccttagtattgtggggatcctggcaattattgcatcattctgttccggccctgggggaattccatttatcctgacgggcgagttctttcagcagagccagaggcccgccgcatttattatagctggaactgtaaactggcttagcaacttcgccgttggactgctgttcccatttatacagaaatccctggatacatattgttttctggttttcgccacaatatgtatcacaggcgccatttacctgtacttcgtgctccctgagacaaaaaatcgcacgtatgccgagatttcccaggccttctctaaaaggaacaaggcctatcctcccgaagagaagatagacagcgcagtcacggacggcaaaatcaatggaagaccctag

SEQ ID NO: 134944 - DNA, 1536 bp, Artificial Sequence
  Description of Artificial Sequence: Synthetic coding sequence
atgaaactgtcaaagaaagaccgcggagaagacgaggaatccgattccgctaagaagaaactcgattggagctgttccctcctggtcgcttcgctggcgggggcatttggatcaagtttcctgtatggatataacctctctgtggtgaatgcaccgacaccctacatcaaagccttctacaacgagtcatgggagcggcgacacggccggccgatcgacccagatacgctgactctgctgtggagcgtcactgttagtatcttcgctatcggtggtctagtcggcactctgatagtgaagatgatcggaaaagtgctgggccggaagcacactctacttgctaataacggcttcgcaatcagcgcggctctgctcatggcttgctctctgcaagctggggcctttgagatgctgatcgtcggacgtttcatcatgggaatcgacggcggagttgccctgtccgtgttgccgatgtatctgtccgagattagcccaaaggagatccggggatctctcggacaggtgactgctatctttatctgcatcggagtgttcacaggacagctactcggcctgcctgagctgcttggtaaggagtccacctggccttatttgtttggggtgattgtcgtcccagccgttgttcaactgctctctctgcctttcctgccggacagccctagatatctcttgctggagaagcataacgaagctcgagcagtcaaagccttccaaacctttcttggaaaagcagatgtgtcccaggaggtggaagaagttttggcagagagcagagtgcaacgcagcatccgtctggtgtccgttctcgagctgcttcgagcgccatatgttcgatggcaggttgtaaccgttattgtgaccatggcctgctaccagctgtgtgggcttaacgccatctggttttacactaattcaatttttggcaaggcgggaataccacctgccaagattccctacgtgaccttgtctacgggagggatcgaaacactggccgctgtgttcagtgggctggtgattgaacacttggggaggcggcccctgctgattgggggatttggcctgatgggcttgttcttcggtacattaacaatcacacttacactccaggatcacgcgccctgggtaccctacctgagtatcgtgggcattcttgctattattgcgtctttttgttccgggcctggtggaattccctttatcctgaccggcgaattcttccaacaatctcagcgtcccgctgcattcataatagcaggcaccgttaactggctttcgaatttcgccgtcggactcctatttccattcatccagaaatccctggatacctactgcttcttggtttttgcaactatatgtataaccggagcaatctatctttacttcgtattgcccgagaccaagaatcggacctacgccgaaatttcccaggccttttccaaaaggaacaaggcttatcctcccgaggagaaaatcgacagcgcggtgacggacggaaagataaatgggagaccttag

SEQ ID NO: 134945 - DNA, 597 bp, Artificial Sequence
  Description of Artificial Sequence: Synthetic coding sequence
atgaaactgagtaagaaggacagaggcgaggacgaagagagcgactcggctaagaagaagctggattggagctgttctcttctggtcgcttccctagccggggcctttgggtcttccttcctgtatggatacaacctctccgttgtaaatgcgcctaccccctatattaaggctttctataacgaaagctgggaacggcggcacggccgtcctatcgatccagatacccttacgctcctgtggtccgtgacagtctccatcttcgcgattggcggtcttgtggggacgctgatcgtcaaaatgattggcaaggtgctgggacggaagcacacactgttggcaaacaatggattcgcaatttccgcagcccttcttatggcgtgttcccttcaggctggcgcttttgaaatgctgatcgtggggaggtttatcatgggcattgatggaggagtcgctctgtctgtgctgcccatgtatctctctgagattagtcccaaggagatcagggggtctttgggccaagtcaccgcaatattcatttgtataggtgtctttactggccagctcctcggcctccctgaactgctcggcaagtag

SEQ ID NO: 134946 - DNA, 735 bp, Artificial Sequence
  Description of Artificial Sequence: Synthetic coding sequence
atggagcagcaagaccagagtatgaaggaaggaaggctgaccttagtattagcgctcgcgacactgatcgctgcttttggcagctcatttcagtatggctataacgtcgccgccgtgaacagtccagctttgttgatgcagcaattctacaatgagacatattatgggaggactggcgaatttatggaggacttccctttgaccctgctgtggtcagtgactgtctcaatgtttccatttggggggtttattggcagcttgctggtcggccctctggtgaataaattcggcagaaaaggagcgttactgttcaacaatattttctccattgtccctgcaatcttaatgggatgctcgcgagtagcgacctctttcgagcttattattatctcccggctgctggtcgggatctgcgccggcgtcagttccaatgtcgtgccgatgtacctgggcgagttagctccaaaaaaccttcgtggagcccttggcgtggtacctcagctctttatcacagtggggatcttggtggcccaaatttttggactgcggaatttattggcgaacgtggatggtgaattccggacgagccgtgaacatcctcacccttttactaccactctgggtcccctccttgtattccaatcccaccaccaccgcaccgggctcagtgcagattggtccctgctaaccggatggatgagcctaggaggccccagctgccctgagcctacatag

SEQ ID NO: 134947 - DNA, 1506 bp, Artificial Sequence
  Description of Artificial Sequence: Synthetic coding sequence
atggagcagcaggatcaatccatgaaggagggtaggcttacactggttcttgcactggccaccctaatcgccgcgttcggttcctcgttccagtatggctacaacgtggctgctgttaactcccctgccttactcatgcagcagttctacaacgagacgtactatgggcgaactggggagtttatggaggacttccctctcacactgctttggtcagtcaccgttagtatgtttccattcggaggcttcatcggcagtttactggtaggtccactcgtgaataagtttggtagaaaaggagctcttctatttaataacatcttttcaatagtgcccgccattctgatgggatgttctagggttgcaacaagcttcgaactgatcataatctccaggttgctggttggcatctgtgctggcgtctcttctaacgtggtgccaatgtacctgggcgagttggcccccaagaatctccgcggggccctgggagtggtgccacaattgttcataaccgttggcatcttggtcgcacagattttcggactcagaaacttgctggccaatgttgacgggtggcccatcctactggggctcactggagtgcccgcagcactgcagctcctgctcttgcctttctttccagagagtcctagatatctgttgatacaaaaaaaagacgaggctgcagcaaaaaaagcgctccaaactttgcgtgggtgggactctgtggaccgcgaagtcgcagaaatccgccaagaggacgaggctgagaaagccgcgggatttatatctgtgctgaagctgttcagaatgcgctcgctgcggtggcaattgctgagcattatcgtactcatgggcggccagcagttgtctggagtgaatgctatctactactacgctgaccagatttacctaagtgccggtgtccccgaggaacatgtgcagtatgtgacagccggaactggcgccgtaaacgtggtgatgaccttttgcgccgtctttgtcgtcgaactgttggggagaaggttgctgttgttgctgggattttccatctgcctgatcgcctgttgcgtgttgactgcagcactggctctgcaggatactgtcagctggatgccgtacatctctatcgtgtgtgtcatttcctatgttatcggccatgccctggggccaagcccaatccctgccctcttgattacagaaatctttctgcagtcctcaaggccctcagccttcatggtcggggggagcgttcactggctgagtaacttcactgtaggtctgattttccctttcattcaagaagggctgggaccctactctttcattgtgttcgctgtaatttgcttgcttacgacaatttatatcttcctcatcgttccggaaacaaaagcgaaaacattcattgaaattaatcagatctttactaagatgaataaggtcagcgaagtgtacccggagaaggaagagctgaaagagttgcctccagtcacgtctgagcaatag

SEQ ID NO: 134948 - DNA, 1455 bp, Artificial Sequence
  Description of Artificial Sequence: Synthetic coding sequence
atggagcagcaggaccagagcatgaaagagggtcggctgaccttggtccttgccttggctgccgttaatagccctgccctccttatgcagcagttctacaatgaaacttattacggcagaactggcgagtttatggaagatttccccttgaccctgctgtggtccgttaccgtgtctatgttcccctttggaggcttcataggttcactgctggtaggccccctggtcaataagttcggcagaaaaggcgcacttctgtttaacaatatcttcagcattgtccctgccatcctgatgggctgctcgcgggtggccaccagttttgaactcattattatttcacggttactggtggggatttgtgccggtgtttctagtaatgtcgtgcctatgtatctaggggaactcgcacccaaaaacttacggggtgcactgggagtggtgccacagctgttcataactgtgggcattctcgtggctcagatcttcggccttcggaatctgctggccaacgtagacggatggccgattttattgggtttgacgggggtgcctgcagctttgcagcttttgctcctgccgttcttccccgagagccctcgttacctgctcatccagaagaaagacgaggctgcagcaaaaaaggcccttcagacactgcggggctgggattcagtcgaccgggaagtggctgagattcgacaagaggatgaggctgagaaagcggcaggctttatatctgtgcttaagctgttccgaatgagaagcctcagatggcaacttctgtctatcattgtgttgatgggagggcagcagctctccggagtcaacgccatatactactacgctgaccagatttacctgtcggctggagtacccgaggaacatgtgcagtatgtgactgccgggaccggggccgttaatgtggtcatgacattctgcgcggtgtttgtggtagaattattaggtcgtcgcctccttctgctgctggggttctctatctgcctgattgcctgctgcgtgctgacagcagccttggccttgcaggacaccgtgagttggatgccctatatctcgattgtgtgtgtgatttcctacgtcatcggccacgctctgggccctagccccatacctgcattgctgatcaccgagatctttttacagtcgagtagacctagcgcatttatggtcggcgggtctgtgcactggctatccaatttcacggtgggtctcatcttcccgttcatacaggaaggcctgggtccctactcatttatcgtgttcgccgtgatttgccttctaacaacaatctatattttcttaattgtcccagaaaccaaggcgaaaacatttatcgaaatcaaccagatctttacgaaaatgaacaaggtgtctgaagtgtatcctgagaaagaggaactcaaggaactgcctccagtgacctctgagcagtag

SEQ ID NO: 134949 - DNA, 1161 bp, Artificial Sequence
  Description of Artificial Sequence: Synthetic coding sequence
atgggatgttctcgcgttgcgacatcctttgagcttattattataagcaggctgttggttggcatctgtgctggcgtgagctctaatgtggtgcctatgtatctgggcgagctggcccctaagaatctgaggggcgccttgggcgttgtgccccagctgttcatcactgtgggaattctagttgcacagatatttggactgcgcaatctgttggcaaacgtggacgggtggcccattctgctaggcctgacaggcgtccccgcagccctgcagttgctcttgctgccattttttccggagagcccgaggtatctcctaattcagaaaaaggacgaagctgctgctaaaaaggccctgcaaaccctgagaggatgggactcagtggatagggaggtagcggagattagacaagaggacgaagcagagaaagcagctgggttcatctccgttcttaaactctttaggatgcgttctttgcgctggcaattactgagtatcattgtgctgatgggaggccaacaacttagcggagtgaatgcaatctattactacgctgatcaaatttatttgtctgccggcgtgcccgaagagcacgtgcaatacgtcaccgctggtaccggcgccgtcaacgtagtcatgactttttgcgctgtattcgtcgtggaattgttgggccggcggctccttctgctcctcggcttttccatctgtctcattgcttgctgtgttctgactgccgcattggccttacaggatacagtgagctggatgccatacatcagcatagtgtgcgtcattagctacgtgatcggccatgcactcggaccctcccctatccctgccctactaatcacagaaatttttcttcagtcttcaagacccagcgcctttatggtgggcggctctgtgcactggctatccaacttcacagtaggactgatctttccctttattcaggagggcctgggtccttacagtttcatcgtgtttgccgttatttgcctgcttacaacgatttacatcttcttaatcgtccccgagaccaaagctaagacatttatcgaaataaatcaaattttcacaaaaatgaacaaagtaagtgaagtctaccccgagaaagaggagttgaaggaactgccccccgtgacatccgagcagtag

SEQ ID NO: 134950 - DNA, 1329 bp, Artificial Sequence
  Description of Artificial Sequence: Synthetic coding sequence
atgctggagttgcattcactgaccgcttcctccatcatgcgggtcttgatcatgagagcgcccctccgagaagcgccaccagaaaaatttgcattgctcctgagcggcagtcccgggaaaggtgctcttttatttaataacatcttcagcatagtccccgccattctgatgggctgttccagggttgccacgagcttcgagctgataatcatatccaggcttctggtgggcatttgcgccggggttagcagcaatgtggttcccatgtacctcggcgaactggcccctaagaatcttcggggagctctcggggtggtaccacagctctttattaccgtggggatactcgtggcacagatattcgggctgcgcaatctgcttgccaacgtggatgggtggcccattcttctgggcttgaccggcgtgcccgccgccttacaacttctgctcctacctttctttccagagagcccaagatatttgctgattcagaaaaaggatgaagctgccgccaagaaagcactgcagacgctgcggggctgggacagcgtggaccgggaagtggccgagatccgccaggaggacgaggcagagaaggctgccggattcatctcagtgctgaagttatttagaatgcggtccctgcgttggcagctgctctcaatcatcgtattgatgggcgggcaacagctatccggcgtgaacgcaatctactactatgcagatcagatctatctgagtgccggcgtccctgaagagcacgtacagtatgtgacagctggcactggcgccgtgaatgtcgttatgactttctgtgcagtctttgtggtagagctgttggggcgccggctactgctgctgctgggattttccatctgtctcattgcctgctgcgtattgacagcagccctagccctccaggataccgtgtcatggatgccctacataagcatagtgtgtgtgatctcctatgtgatcggacatgctctaggaccaagcccaattccagccctgctcatcaccgagattttcctgcaatctagccgccctagtgcttttatggtaggcggctcagtgcactggctctcaaattttaccgtgggcctgatcttcccattcatccaggaagggctcggcccctactccttcatcgtgtttgcggttatttgcctgcttaccacgatttacatatttctgatcgtcccagagaccaaggccaagaccttcatcgagataaatcagatatttaccaagatgaacaaggtttccgaagtctaccccgagaaagaagagcttaaggaactgccaccggtgaccagtgaacagtag

SEQ ID NO: 134951 - DNA, 2040 bp, Artificial Sequence
  Description of Artificial Sequence: Synthetic coding sequence
atggccaccttgatcacatctaccacagcggcaaccgctgcgtccggtcctctagttgattatctatggatgctcattctaggattcatcatagcctttgttctagcatttagcgtcggcgccaatgatgtggccaacagttttggcactgccgtaggtagtggtgtggtgacattgaagcaggcatgcatcctggcttcaatttttgaaacagtcggcagtgtcctattgggggctaaagtgtccgagacaatacgtaaaggcctgatagacgtggagatgtacaactccacacaggggctgctcatggcgggttcagtgagcgcaatgttcggctcagcagtttggcagttggtggcttccttcctgaagttacctatttctggaacccactgtatagttggggccacaattggcttttcccttgtggccaaaggccaggagggcgtcaaatggagtgaactgatcaagatcgtgatgtcctggtttgtatcacccctactttccggaatcatgagtggcatccttttcttcttggtgagagccttcatcctacataaggccgatcccgtgcccaatgggctgagagcgttgcctgtattctacgcatgtaccgttggcataaatctgttctcaatcatgtatacaggcgccccgctgttgggatttgataaactgcccctttgggggacaatcctgatctctgtcggttgtgctgtcttttgcgccttaatagtgtggttcttcgtgtgcccacgcatgaagcgcaaaattgagcgagagattaaatgttccccatccgagtcccctctcatggaaaagaagaattccctgaaagaggaccatgaagaaacaaagctcagtgtcggcgatattgagaataagcaccccgtgtctgaggtagggccagctacagtgcccttgcaggccgtggtggaagaaaggactgtctcatttaagctgggggacttggaggaggctccagaaagggaaaggctgccctctgtagacctgaaggaagaaacatccatagactcaacagtcaatggggctgtgcagcttccgaacggaaacttggtgcagtttagtcaggccgtgtcaaaccagatcaactctagcggacattatcaataccatactgtgcataaagactcggggctttataaagagctcctgcataaactgcatttggccaaagtgggagattgcatgggggattccggggacaaaccgctcaggcggaacaactcatatacctcttacacaatggcgatttgcgggatgcccctcgattccttccgagccaaggaaggggaacagaagggcgaggagatggagaaactgacttggccaaatgcggacagcaagaaacgaatccggatggattcctacactagttactgtaatgcagtaagtgatctgcattccgcatcggagattgatatgtccgtaaaggccgagatgggactcggcgatagaaagggctccaatgggtcattggaagagtggtatgaccaggataaacctgaagtgagcctgctgtttcagttcctacaaattctcacagcatgtttcggttcattcgcccacggcggtaatgacgtgagtaatgccatcgggccactggtcgccttatacttggtttacgacacaggggacgtcagctcaaaggtggccacccccatctggctactcctatatgggggtgtcggtatctgtgttggcctctgggtttggggccgccgtgtcatccagactatgggaaaggacctgaccccaatcacaccttcatctggcttctctatcgagctggctagcgcccttactgtggtaattgcatcaaacatagggctgcctatctccactactcattgcaaggttgggagtgtcgtgagcgttggatggctgagaagtaagaaggctgttgattggcgcctgttcagaaatatttttatggcctggtttgtgactgtgcccatttcaggagtgatctccgccgcgattatggcaattttccgatacgtgattctacgtatgtag

SEQ ID NO: 134952 - DNA, 1137 bp, Artificial Sequence
  Description of Artificial Sequence: Synthetic coding sequence
atgggaaatccaagcgtgcccagaggaggtttcacgcagtactgtaggggcttgcttccttggggcttccaagatgccccgttttatctgctcgtgctcggattcgataaacttccgctatggggcactatcctgatctcagtcggctgcgctgtgttttgtgccctcattgtctggttcttcgtttgtccacgcatgaagcgcaaaattgagcgtgagatcaagtgcagtccttctgaatctcctctaatggagaaaaaaaacagtttgaaagaagatcacgaagaaaccaagctgtccgtaggtgatattgagaacaagcaccccgtttccgaagtgggacctgctacagtgcctttgcaagcggtggtcgaagagcgtaccgtgtcttttaagttaggcgacctggaagaggcaccagagcgggagagactgccgagtgttgacctgaaagaggaaacatccattgactctactgtaaatggcgccgtgcagctgcccaatggaaacctcgtccagttttcgcaggctgtatccaaccagatcaacagctccggccactatcagtaccatacggtacacaaagattctggcctttacaaggagcttttgcataaactgcacctcgctaaagtgggcgactgcatgggcgactctggagacaaacccttgagacgcaacaacagttatacttcctacacgatggctatctgcgggatgcccctggacagtttcagagcaaaagaaggcgagcagaaaggcgaggaaatggagaaactcacatggcccaacgcagattccaaaaagagaatcagaatggactcttacacatcttattgcaatgcggtatctgatcttcattccgcctcagagattgacatgagcgttaaggcggagatgggccttggggataggaagggtagtaatggatcattggaggagtggtatgaccaggacaaacctgaggtcagcctcctgttccaattcctgcagatcctgaccgcatgcttcgggtcctttgcacacggtggaaacgacgtgagtaatgccatcgggcctctggtggctctgtatctcgtgtacgacaccggtgacgtgtcatcaaaagtagcaactcctatctggctgttatgttag

SEQ ID NO: 134953 - DNA, 1959 bp, Artificial Sequence
  Description of Artificial Sequence: Synthetic coding sequence
atggcaatggatgaatatttatggatggttattcttggatttattatagctttcatcctggctttctcggtaggggctaacgatgtggctaactcattcggcaccgcagtggggagcggcgtcgtcacacttcgtcaggcctgtatactggcctctatatttgaaacgaccggcagcgtgttgcttggagctaaggtcggagagacaatcagaaagggtattatcgatgtcaatctctataatgagaccgtagaaaccctgatggcaggcgaagtttctgcgatggtggggtcagccgtgtggcagcttattgcgagctttttgcgattgccaatcagtgggactcattgtatcgtgggcagtaccatcggattttctttggtggcgattgggacaaaaggcgttcagtggatggagctggtcaagatcgtcgcatcctggtttatctcgccacttctgtccggctttatgagcggcctcctttttgtcctgatccggatattcatcctgaaaaaggaggaccctgtgcctaacggcttgagagccctacccgtgttctatgccgcaacaatcgcaattaacgtattctctatcatgtataccggggcccctgtgttaggtctggttctgcccatgtgggctatcgccctaatttcctttggggtggccctgctgtttgccttcttcgtatggttgttcgtatgtccatggatgaggcggaaaataacaggaaagctacagaaagagggagccctttcccgggtgtctgacgagtccctgtccaaggtccaagaggctgagagccctgtgtttaaggaattgccaggagccaaggcaaacgacgactcaactataccactgactggcgccgcgggcgaaactcttggaacctcagagggaactagcgctggctctcaccctcgggccgcctatgggcgggccctgtctatgacacacggctccgtcaagtctccaataagtaatggcacattcggattcgacgggcacacacgatccgatgggcacgtttatcataccgtccacaaggacagtgggctgtacaaggatttgctgcataagatccatatcgatcgcgggccagaagagaaacctgcacaagagtcaaattatagactgcttcggagaaataacagctatacatgctacacagcagccatttgtggactgccagtgcatgccaccttcagagccgcagactcgagtgccccggaggatagtgagaaattggtaggggatacagtgtcatactccaagaaacgactgcgttacgacagctacagttcctattgtaacgccgtcgccgaggccgagatcgaggctgaggagggcggggtcgagatgaagctcgcttccgagttagcagaccccgatcagccacgggaagacccggcggaggaggagaaagaagagaaagacgcccctgaggtgcatttgctgtttcacttcctccaggtcctgactgcctgcttcgggagcttcgcccatggcggtaatgatgtgagcaatgctatcgggccactggtggcattgtggctgatttacaagcagggcggcgtgactcaggaggcagccacaccggtttggctcctgttttatggaggtgtggggatctgtactggcctatgggtgtggggcagacgggttattcagactatgggaaaggacctcacccccatcaccccttcatctggcttcaccatcgaattagcatccgcattcacagtggtaatagccagcaatatcggacttccggtgagcaccacccattgtaaagtgggaagtgtggtggcagtaggatggatccgaagccggaaagcagtcgactggcgactctttagaaatatattcgtcgcatggttcgtgaccgttcccgtcgctggcttgttttccgctgccgttatggccctgcttatgtacggaatcttgccttacgtatag

SEQ ID NO: 134954 - DNA, 216 bp, Artificial Sequence
  Description of Artificial Sequence: Synthetic coding sequence
atggcgatggatgagtacctgtggatggttattctgggcttcatcattgcctttatactggccttcagtgtcggtgcaaacgacgtagccaacagcttcggtaccgctgtggggtcaggtgttgtgactctcagacaggcttgtatacttgcaagcatttttgagacgacgggaagcgtactcctgggggccaaggtgggagaaaccatcagatag

SEQ ID NO: 134955 - DNA, 87 bp, Artificial Sequence
  Description of Artificial Sequence: Synthetic coding sequence
atggccatggacgaatacctgtggatggtcatacttgggttcatcatcgcgttcatccttgccttctctgtgggcgctaatgattag

SEQ ID NO: 134956 - DNA, 237 bp, Artificial Sequence
  Description of Artificial Sequence: Synthetic coding sequence
atggccatggatgaatacttgtggatggtgattctgggattcatcatcgcctttatactggccttttccgtgggagcaaacgacgtggccaattctttcgggacagcagtgggcagtggagtggtgactctacgtcaggcttgtatccttgcctcaatttttgaaaccacgggcagtgtactgctgggcgcaaaggtaggggaaaccattcggaaaggtattatcgacgtgaattag

SEQ ID NO: 134957 - DNA, 1959 bp, Artificial Sequence
  Description of Artificial Sequence: Synthetic coding sequence
atggccatggatgaatatttgtggatggtgatcctgggcttcattatcgcattcatcctggccttctccgttggcgctaacgacgtggccaatagcttcggcactgcggtgggctcaggtgtggtgaccctgcgacaagcttgtatactggcttccattttcgaaacgactggctcagtgttgcttggtgcaaaagtgggggagacaatccgcaagggaatcatcgacgtaaacttatataacgaaacagtagagacgttgatggccggcgaggtgtccgccatggttggcagcgccgtttggcagttgattgcttcatttctgcgcctgcctatctccgggacccattgtattgtcggaagtactattggattctcattggttgctatagggactaaaggcgtgcagtggatggaactggttaaaattgtcgcatcttggttcatctctcccctcctcagtggcttcatgtccgggttgctctttgtgctgatacggatcttcatcctgaagaaggaggaccccgttccaaacggcctaagagcgctacccgtcttctacgccgctactatagccataaatgtctttagcataatgtacaccggggccccggtgctcggccttgtattgcctatgtgggctatcgcgttgattagctttggagtggccttgctgttcgcgttcttcgtgtggctatttgtatgcccttggatgaggaggaaaatcacagggaaacttcagaaagagggggccctgagccgggtgagtgatgaaagcttatcaaaagtgcaggaggctgagagccctgtctttaaggaactccctggcgcaaaggcgaatgacgatagtacaattcctctcacaggggcagcgggtgaaacattggggacctctgaaggtacctccgcgggttcacatccccgagctgcctatggcagggcactctcaatgacacacggctctgtcaagtctcctatcagcaacgggacctttggatttgatggacacacacgaagcgacggacatgtttatcatacggttcacaaggatagcgggctgtacaaggatctgctgcacaagattcacatcgaccgcggaccagaagagaaacccgcccaggaaagtaactaccgcctcctgcgcaggaacaactcgtacacctgttacaccgccgcgatttgcggactgcccgtccacgctaccttccgggcagctgattctagcgcccctgaagactcagagaaactggtaggcgataccgtatcctactccaaaaaacgcctccgctatgattcctatagctcttattgcaatgcggttgctgaagccgagatagaagccgaagaggggggagtggagatgaaactagctagcgagcttgccgatcccgaccaaccaagggaggatcccgccgaggaggaaaaggaggagaaagatgctcccgaggtccacctgctgtttcactttctgcaggtgctcaccgcctgcttcggttcatttgctcatggtggcaacgacgtttctaatgctatcggccctctagtagcgctatggctcatttataagcagggcggggtgacccaggaggccgctacgccagtttggttgctgttttatgggggtgtcgggatctgtacgggactttgggtgtggggtagaagggtgatccagactatgggcaaggacctgactcctattacaccctctagcgggttcactatcgagctggccagtgcttttaccgtggttatcgcatctaacattggcctcccggtttcaacaacacactgtaaggtaggcagtgtcgtggccgtgggctggatcaggagtcgcaaggctgtagactggcggttgtttcggaatattttcgtcgcatggttcgtgacagtacccgtagctggtctgtttagtgcggctgtgatggctttattgatgtatggcatactgccctatgtctag

SEQ ID NO: 134958 - DNA, 1959 bp, Artificial Sequence
  Description of Artificial Sequence: Synthetic coding sequence
atggctatggacgagtatctgtggatggttatcctaggcttcattatcgcattcattctcgcctttagtgtaggcgcaaacgacgtggccaactccttcgggacagctgtgggttctggcgtagtaacgctccggcaggcttgtatcctggcgagtattttcgagaccaccggcagcgtgctgctcggggccaaggtgggcgagacaatcaggaagggcatcatcgatgtcaatttgtataatgaaaccgtggaaaccctgatggctggcgaggtttctgccatggtcgggagtgcagtatggcaactcattgcctcattccttagacttccgatctccggcacccattgtatcgtcggatccaccatcggtttcagcctggtggcaattggaacaaagggggttcaatggatggagctggttaagattgttgcaagctggttcatctcgccactgctctccggattcatgtctggactcctgttcgtcctcattagaatttttattttgaaaaaggaagaccccgtccccaatggccttcgcgctctgcctgtattttacgccgcaacaatcgctatcaacgtgttctcaattatgtataccggcgctccagttctgggcctggtccttcccatgtgggccatcgccttaatcagttttggcgtcgccttgctcttcgccttcttcgtgtggctgttcgtctgcccttggatgcgcagaaagataactgggaagctccagaaggaaggcgctctgtcacgagtaagcgacgaaagtctatccaaagtccaagaggctgaaagccccgtcttcaaagagctgcctggagccaaagccaatgatgatagcactatacccttgacaggcgcagcgggcgagaccctggggacgagcgaagggacgagcgctgggtcccacccgagggcagcttatggtagggcgttgagtatgacccatggcagcgtgaagagccctatctcaaatggcactttcggattcgacgggcatactcgcagcgacggccacgtgtatcataccgtacataaggactctggactgtacaaagacctactccacaagattcatatagaccgtggacctgaggagaaaccagcgcaggagtcaaactacagattgctgagaagaaacaattcttatacctgttataccgcagcaatctgcggactgcccgtgcatgccacattccgagctgccgatagctccgccccagaggattccgaaaaacttgtgggggacaccgtctcctacagcaagaaaaggctgcgttacgacagttacagcagctattgcaatgctgtagccgaggctgagattgaggctgaagagggaggagtggagatgaagctggccagtgagctcgctgacccggatcagcctcgggaggatcctgcggaagaagagaaggaggaaaaggacgctcccgaagttcacttattgtttcatttcctccaagtgctcacagcttgcttcgggtccttcgctcatggaggaaacgacgtgagtaatgccatcgggcccttagtcgcactgtggctgatttataagcagggtggagtgacccaggaagcagctacacctgtgtggctcctcttctatggcggcgttggaatctgcacgggcttgtgggtttggggccgtagggtcatacagactatgggcaaggacttaacccccatcacgccctcgagtggcttcacaattgaacttgctagtgctttcacagttgtgatagcatcaaatatcggtctcccagtctcaacgacccattgtaaggttgggtctgtggtggctgtaggctggatccgatcccggaaggcagttgactggcgacttttcagaaacattttcgtggcctggttcgtcacggttcctgtggccgggcttttttccgctgccgtgatggccctgctcatgtacggcatcctgccatatgtttag

SEQ ID NO: 134959 - DNA, 144 bp, Artificial Sequence
  Description of Artificial Sequence: Synthetic coding sequence
atggctatggacgagtatctgtggatggtcatattgggattcataattgcatttattctcgcatttagcgtgggagcaaatgatgtggctaacagctttggcactgctgtaggatccggagtggtcacgctgaggcaggcctag

SEQ ID NO: 134960 - DNA, 1260 bp, Artificial Sequence
  Description of Artificial Sequence: Synthetic coding sequence
atggcccagtctatcttcatggctggtatactgatcggcggattggttctaggagacttgagcgatcgattcggacggagacccatccttacttgcagctacctattactggctgcatcaggttcaggtgcggcattctcaccaaccttccctatctacatggttttcaggttcctctgtggctttggaatttctgggattacactctccaccgtgattctgaatgtcgagtgggtcccgacacgtatgcgggctatcatgtctactgcactgggctattgttacacattcgggcagttcattttgcccgggctcgcctatgctattccccagtggagatggctgcagcttaccgtgagtatcccatttttcgtttttttcctctccagttggtggacacccgagtcaattcgatggctggtactctccggcaagagctctaaggcactcaagatccttcgacgggtcgcagttttcaatggaaagaaggaagagggcgagagactctcactcgaggagctgaaattgaatcttcaaaaggagatcagcctggccaaggctaagtataccgcaagtgacctgtttaggatacctatgctgcgaagaatgaccttttgcctgagcctggcctggtttgcaacaggtttcgcctattactctctggccatgggcgtggaagagtttggcgttaatctgtatatactccagattatcttcggaggtgtagacgtccccgctaagttcatcactatcctgtccctgtcatatctgggccgccataccacccaggcagcggcactactcctcgccgggggagcgatacttgctctgacttttgtccctctggacctacaaacagtcaggacggtgcttgctgtcttcgggaagggatgcttgagttcttcctttagttgcctgttcctttacacctctgagttgtaccctacagtgattagacagaccggaatgggggtttcaaatttgtggactagggtcggcagtatggtaagtccactggtaaagatcaccggcgaggtacaacccttcatcccaaatattatttacgggattacagcgctactgggaggaagcgcagctcttttcctccctgaaacgctaaatcagcccctgcctgagactatcgaggacctcgaaaactggtcactccgggcaaagaagcctaagcaggagcccgaggtcgagaaagcctcacaacgcatccccttacaaccacatggccccgggttaggttcttcatag

SEQ ID NO: 134961 - DNA, 1356 bp, Artificial Sequence
  Description of Artificial Sequence: Synthetic coding sequence
atggagccgtgtctcgacggttgggtttataatagcaccaaggacagcatcgttacagagtgggacttggtctgtaatagtaataagcttaaggagatggctcagagcatctttatggccggaatcctcatcggcggtcttgttttgggcgacctgagcgaccgattcgggcggaggcctatattgacctgtagctatttgctgctggctgcatccggcagcggagcagcgttttctccaactttcccaatttacatggtcttcagatttctttgtggcttcgggatcagcgggattactctgagtactgtaattctcaacgtggaatgggtgccaactagaatgagggcaatcatgtcaaccgcactgggctattgttatacatttggacaatttatcctgccgggacttgcctatgctatcccacagtggagatggctccagctgacagtttccataccttttttcgtgtttttcctgagcagctggtggacacctgaatcaattcgttggctggtacttagcggtaagagctctaaagctttaaaaattctgaggcgggtggccgtgtttaatggtaagaaggaagagggtgagcgcctttcattggaggagttgaaattgaatctccagaaggagatcagcctagccaaagctaagtatacggcttctgatctatttcgcatcccaatgctccgccgcatgaccttctgtctgagtctggcttggttcgcaactggctttgcctactatagccttgccatgggagtcgaagagtttggagtaaacctctatatcctccagataatattcggcggggtggatgtgcccgccaaattcataaccatcctgtctctgtcttacttggggcggcatacaactcaggcagctgctttgctattggctggcggcgcaatcttagctctaacttttgtccccttggatctgcaaaccgttagaactgtgctggccgtcttcggaaaaggatgcctttccagcagtttcagctgtctgtttctgtatacttctgaactgtatccaaccgtcatcagacagacgggcatgggcgtgagtaacctgtggacgagagtgggctcaatggtttcccccctggtgaagattacaggcgaagtgcagcccttcatcccgaacatcatatacggcataactgcactgctgggaggtagcgctgccctgtttctgccggagaccctgaaccagcctctccccgagaccatagaggatttggagaactggagtcttcgcgccaaaaagccaaaacaggagccggaggtggaaaaagcaagccagcggattcccctgcagcctcatggtcccggcttgggctcttcatag

SEQ ID NO: 134962 - DNA, 1653 bp, Artificial Sequence
  Description of Artificial Sequence: Synthetic coding sequence
atggcattcaatgacctgctgcagcaggttggaggcgtcggaaggttccaacagattcaggttactctggtggtgctgccactactgctgatggcctcacataacacgttacaaaattttaccgctgcgatcccgacccaccattgtcgccctcccgcagatgcgaacctgtcaaagaacggtggcctcgaggtttggcttcccagagaccgtcaagggcaaccagagagctgcctgaggtttacgtctccgcaatggggcctgccatttttgaacgggaccgaggcaaatggtaccggtgccaccgagccgtgtactgacggctggatttatgacaattccacgttcccctctactattgttacggagtgggacctggtctgttcccacagggctttacggcagcttgctcaatctctctatatggtcggtgtgctgctgggtgcaatggtttttggctacctggcagatcgtcttgggagacgcaaagtgctgattctcaactacctgcagaccgccgtgtccggtacttgcgctgccttcgccccaaacttcccgatttactgcgcctttagactgctgagcgggatggctctggccggcattagtttgaactgcatgacccttaatgtggaatggatgccgattcataccagagcttgtgttgggacgttgatcggctatgtatacagtttagggcagttcctgctggcgggagtcgcttatgccgtgccacactggcgccacctgcaactgctcgtaagcgcaccgtttttcgcatttttcatatatagttggttcttcattgagagtgcacgctggcactccagtagcgggcgtttggacctgaccttacgggcactgcaaagagtggcccgcattaatggcaaacgggaggaaggcgcaaaattgtccatggaggtgctgagagcttctctgcaaaaggagctgaccatgggaaaaggtcaagcatcggcgatggagctgcttagatgtcctactctgagacacctgttcctgtgtttatccatgttatggttcgccacctccttcgcatactacggcttggtgatggatctccagggattcggtgtctctatatacctgattcaagtgatctttggggctgtggacctgccggccaagctcgtagggttcctggtaataaactccctgggtagacgccctgcccagatggcagcccttctgctggcggggatctgtatactgcttaatggcgttatcccacaggatcagtccattgtgcgtacttctctggctgttctggggaagggctgtttggctgcaagctttaactgtatcttcctatacactggtgaattatatcctaccatgatacggcagaccggcatgggcatgggaagcaccatggcgcgcgttggcagcatagtctctcccctggtctctatgacggcagagctctacccatccatgcccctgtttatttatggtgccgtgcccgttgccgcctctgccgttaccgtgctgctgcctgagactctcgggcagcctctacccgatacagtccaggacttggagtcaagaaaaggaaaacaaacccgccaacagcaggagcaccagaagtatatggtgcccctgcaggcttccgcacaggagaagaacgggctgtag

SEQ ID NO: 134963 - DNA, 1692 bp, Artificial Sequence
  Description of Artificial Sequence: Synthetic coding sequence
atggctttcaacgatctgttacaacaagttggcggagtgggtagatttcaacagattcaagttactttggtggttctccccctgctcctcatggcaagccataacaccctgcagaatttcaccgccgccattccgacacaccattgcaggcctcccgcggatgctaacctgagcaaaaatggcggcctggaggtctggcttcctcgagataggcaggggcagccagagagttgcctgcggtttacatctccacagtgggggctgcccttcctcaacggcacagaggcaaacggcactggagccactgaaccctgtacggatggctggatttatgataacagtacctttcccagcacaatcgtgaccgaatgggatctagtgtgcagccaccgcgctttgcgccagctggcacagtctctttatatggtaggcgttctactcggggccatggtgtttgggtaccttgctgaccgattgggccgtcgcaaggtattaatcctcaattatctgcagactgcagtgtcaggcacatgcgccgcattcgccccaaatttcccaatatattgtgctttcagacttttaagtgggatggctctcgcagggatcagcctcaactgcatgacactgaatgtggaatggatgcctatccacacaagggcctgtgtgggtactctgatcggttatgtttactccttgggtcagtttcttctggctggcgtcgcatatgctgtcccacactggcggcacctgcagctgctggtgtcagcaccctttttcgcattttttatctactcttggttttttattgaaagtgcccgatggcactcaagctcaggacgtttagatcttaccttacgggcactccagcgggttgcccggatcaacggcaagagagaggaaggagccaaactgtcaatggaagtgctgagagcctctctccaaaaggaactgacgatggggaaaggacaggcatctgccatggaacttctcagatgtccgactctgcggcatttatttctttgcctgagcatgctgtggttcgcgacctctttcgcgtactatggactggtgatggacttgcagggatttggcgtgtctatttacttgattcaggtcatcttcggggccgttgacctgccagctaaactggtgggcttccttgtgatcaactccctgggcaggcggcccgctcaaatggctgccctcctgcttgcagggatttgtatcctcctgaacggggtgattccacaggatcagtcaatcgtgcggaccagccttgcagttctgggtaaaggttgcctggcagccagttttaattgtatttttctgtatacgggcgagctgtaccctacaatgatacgacaaaccggcatggggatgggctcaacaatggcacgcgttggcagtatagtgtcccctctcgtgtcgatgaccgccgaattatatccttctatgcccctatttatctatggcgcagtgccagtcgcagccagcgcagtgacggtgctgctgcccgaaacacttggccagccactgccagataccgtacaggacctcgagagcaggtgggcgcccacccagaaagaggctggcatttatcctcggaagggaaagcaaacacgacagcagcaggagcaccagaagtatatggttcctctgcaggcttccgctcaagaaaagaatggcctgtag

SEQ ID NO: 134964 - DNA, 1590 bp, Artificial Sequence
  Description of Artificial Sequence: Synthetic coding sequence
atggctttcaatgatcttctgctcctcatggcctcacataataccttgcaaaacttcaccgcagctatcccaacccatcattgccgtcccccagctgatgctaacttatcaaagaacggtggcctcgaagtatggctgccacgcgacagacaagggcaacctgagtcctgcctgaggttcacttccccccaatgggggcttccctttctgaacggaactgaggccaatggcacaggagcaaccgagccctgcactgatggatggatctacgacaattcaacattcccgagcaccattgtcacagaatgggacttggtctgctctcacagggcattgcggcagctggcgcagagcctgtacatggtgggtgtgctcctgggagccatggtgttcggctatctcgcagatagattaggacgacgaaaggtcctgatcttaaactatttgcaaaccgcggtaagtggcacctgcgccgcttttgctcctaattttcccatctattgtgctttccgcttactcagcggcatggctctggccggcattagtctgaattgtatgactctgaatgtagaatggatgcccattcatacacgcgcttgtgtgggtactctaattgggtatgtctactcattaggccagtttcttctagcaggagtggcgtatgcagtcccacattggagacacctgcagctactagtttcggctccattctttgctttttttatctactcttggttctttattgagagcgcacgctggcattcctcttcaggaaggctggatctcacattgagggctctccagcgtgtggctagaataaatggaaaacgggaagagggcgccaagctgagcatggaggtgttgagagcttctctacagaaggagctaaccatgggcaaaggacaggcctcagcaatggaactgcttaggtgccctacacttagacatctcttcttatgcctgtctatgctttggtttgccaccagcttcgcttattacggactcgtgatggatcttcagggcttcggtgtttctatctatcttatacaggtcatcttcggtgccgttgaccttccagcaaagctggtcggctttctggtgattaacagcctgggcaggcgaccagcccagatggctgccttgctgctagccggaatttgcatactcttgaatggggtcattccacaggaccagagcatcgtccggaccagcctagccgtactgggcaaaggttgtctagccgcgagtttcaattgtattttcctgtacacaggcgagctctaccccacaatgatcaggcagaccggtatgggtatgggatcaacaatggccagggtgggttccattgtttcaccgttggtctccatgaccgcagaactttacccctctatgccactgtttatctacggtgccgtgcccgtggccgcaagtgccgtgacagtcctgctcccagagaccctgggccaaccgttgcccgataccgtgcaggatctcgaatctcggaagggaaagcagacaagacagcagcaggagcaccagaagtacatggtgccgctccaagcaagcgcacaggagaaaaacggcttatag

SEQ ID NO: 134965 - DNA, 1560 bp, Artificial Sequence
  Description of Artificial Sequence: Synthetic coding sequence
atggccttcaacgatctgctacaacaggtgggcggggttgggcggtttcaacaaattcaagttacattggttgtgttacccctgctcctgatggcctcccataacacactgcagaattttacagcagccattcccacccatcactgtcgccctcctgcagatgccaatctgagcaaaaatggaggactggaagtctggctgccaagggaccggcagggtcaaccggagtcctgtctgaggttcaccagtcctcagtggggtcttccttttctcaatggaactgaagccaatgggacaggagctactgagccttgtactgatggatggatttacgacaacagtacatttccatccacaatagttaccgagtgggatctggtgtgcagccacagggccctcagacagctcgcccaaagcctttatatggtcggcgtcctgcttggcgctatggtatttgggtatctcgccgaccgactgggaaggaggaaagtactcattctgaactatcttcagacagcagtgtcaggcacgtgcgctgcctttgctcccaacttcccaatttattgcgcattccgtctactgtctgggatggccctggccgggatatccctgaactgtatgacgttaaacgtggaatggatgcctatccacacacgcgcatgcgtggggactctgataggctacgtgtactctctgggccaattcttgttagccggagtggcttatgccgttccacactggcgtcatttgcagctgctggtctccgcgccattcttcgccttcttcatatactcttggttctttattgaatccgcgcgctggcattcttccagtggccgcctagacttaactctgcgggcccttcagcgcgtggcccgcatcaatggcaaaagggaagagggggctaaactatcgatggaggttttgcgggcttccttgcagaaagaactgacaatgggtaagggccaggcctcagctatggaactcctgaggtgccctacactccgccacctgtttctgtgcttgtctatgttgtggtttgcaactagctttgcttactacggcctggtgatggacctccagggctttggcgtgtcaatttacctgatccaagtgatctttggcgcagtggacctgcctgccaagttggttgggtttctggttatcaatagcctgggacgtcgtcctgctcagatggccgctctactgctggcagggatatgtattctgctgaacggtgttattccgcaggaccagagcatagtcaggacaagtctagccgtcttgggcaaagggtgcctggccgcaagtttcaactgtattttcctttacacaggtgaactctacccaaccatgatccgcgcggtcaccgtgctgctgcctgaaacgcttggtcaacctcttcccgatactgtccaggacttggaaagtaggtgggctccgacccaaaaagaagccggcatttatccacgcaagggcaagcagacaaggcagcaacaagagcatcagaagtatatggtgccgctccaagccagcgctcaggagaaaaacgggctctag

SEQ ID NO: 134966 - DNA, 1521 bp, Artificial Sequence
  Description of Artificial Sequence: Synthetic coding sequence
atggcattcaacgacttgttgcagcaggtcggcggcgtgggcaggttccagcaaatccaggtcaccctcgtggtcttgccattgctgttgatggcgagccataacacccttcaaaattttacagccgccattccaacccatcactgccgtcctcctgccgatgcgaacctaagtaaaaatggaggtctggaggtttggctcccccgtgacagacagggacagcccgagtcctgtctgcgcttcacttcaccccagtggggattaccctttcttaacgggactgaggccaatggcaccggtgctactgaaccatgcaccgatgggtggatttacgacaacagcactttcccctcgaccatcgtcactgagtgggatctggtgtgttcgcatagagctttgcggcaacttgcgcagagcttatacatggtcggcgtactgcttggtgccatggtcttcggctatctggccgaccggcttgggaggagaaaggtcctgatcctgaattacctgcagaccgctgtgtcaggcacctgtgccgctttcgcacctaattttcctatctattgtgcgttcaggctgctcagtggcatggccctggccggaatctccttgaactgcatgaccttgaacgtggagtggatgccaattcacacccgcgcttgtgtagggactcttatcggctacgtttactccctcggacagttcctgctggcaggtgtagcttatgctgtgccacattggcgccaccttcagcttttagtgtcagcacccttctttgctttcttcatttacagctggttcttcatagaaagcgctaggtggcatagtagttccgggaggctcgacttaactttacgggctttgcagcgggtggccaggataaacggaaaaagggaagagggggctaagctctctatggaggtgctcagggcctctctccagaaagaactgactatggggaaaggacaagcttccgctatggagctgctgcgctgtcccaccctgcgccatctgtttttatgcttatcgatgctatggttcgccacctcctttgcttattatggtttagtaatggacctgcagggatttggtgtgtccatttacttgattcaggttattttcggggccgtggacctccctgccaaactggtcggctttctagtaatcaactccttgggacggcgaccagcccaaatggccgctcttcttctggccgggatttgcatattgttaaacggtgtaatcccacaggaccaatctatcgtacgcaccagtctcgcagtgctgggaaaaggctgcttagccgccagcttcaactgcatttttctgtacaccggagagctttatcctactatgatccgtgcagtgacagtactcttgcccgagacccttgggcagccccttcctgataccgttcaggacctggaaagcaggaaagggaaacagacccggcagcagcaggagcaccagaaatatatggtgcccctgcaggcgtccgcacaggaaaagaacggcttgtag

SEQ ID NO: 134967 - DNA, 1620 bp, Artificial Sequence
  Description of Artificial Sequence: Synthetic coding sequence
atgggattcgaagagctgttggagcaggtggggggctttgggccgtttcagctgaggaatgtcgcacttctggcattacctagagtcctgctgcctcttcatttcctcctgcctatcttcctcgctgcagtgcctgcccacagatgcgctcttccaggggctcctgcaaatttctctcaccaagatgtttggctagaggctcatctgcctcgggagccggatggaacattaagctcttgtcttcggtttgcctacccgcaagccctacctaatacaactctaggggaggagcggcaaagccgaggggagcttgaagatgagcccgccactgtgccatgtagccaagggtgggagtacgaccatagtgagtttagctctacaatagccaccgaatgggatttggtttgcgaacaaaaaggtctaaatagggctgcgtccaccttttttttcgccggcgtgcttgtgggtgctgttgcgttcggctatttaagtgataggttcgggcgcaggaggctgttacttgtggcctacgtttccactctggtgctgggtttagcttcggccgcaagtgtctcatacgttatgttcgcaataactagaactttgactgggtctgccctcgccggatttactatcatagtgatgccacttgagctcgagtggctggatgtggagcacagaaccgtggcgggggtgttgtcctccactttttggacaggaggggtgatgttactggctttggtaggatacctgatccgagattggcggtggttgctgctcgcggtgactctgccatgcgcccccggaatcctctccttgtggtgggttccagagtctgctagatggctgctaacgcaaggtcacgtgaaggaggcccatcggtacctactccattgcgcaaggctcaatggcaggccagtgtgcgaggattctttttcccaggaggctgtcagcaaggtcgcagctggggaaagagtcgtgcgccggcccagttatctggatttgtttcgcactcccagactgagacatatcagcctatgttgtgtcgtcgtctggtttggcgtcaacttttcctattatggcctgagcttggacgttagtggactcgggttgaatgtttatcagactcaactgctgtttggagccgtagagctgccatctaaactgcttgtgtacctgtccgtccgatatgcaggacggcgactaactcaggcggggaccttacttggcaccgccctggcctttggcacaaggctcctggtttccagtgatatgaagtcttggtcgaccgtattggccgttatgggcaaagcatttagcgaagccgctttcactaccgcctatctttttacttctgaactatatcctactgttttaagacagactggcatggggcttacagcattggtaggaagattaggcggctcgctggcaccactggctgccctactcgacggggtctggctgtcgctgccgaaactcacatatggcggaattgcgctcctggcagctgggaccgctcttctgctacccgagactagacaggctcaactgcccgagacaatccaggacgtggaaagaaaaaggtgcgtgcaccggacagtctctgtgtatgtctag

SEQ ID NO: 134968 - DNA, 1647 bp, Artificial Sequence
  Description of Artificial Sequence: Synthetic coding sequence
atggggtttgaagaactccttgagcaggtgggcgggtttgggcccttccaacttaggaacgtggctctcctggcactaccacgcgtcttgcttcctctgcatttcctgttacctatcttcttagctgccgtaccggcacaccgctgcgccttgcccggcgcgcctgccaacttctctcatcaggacgtatggcttgaagcacacctcccacgagagcctgatggcacgctgtcgagttgcctgaggttcgcgtacccccaagctctgccaaataccacattaggcgaggaaagacagtcaaggggggagttggaggatgagccagcaaccgttccttgttctcaaggatgggagtatgatcactcggaattcagctctaccatcgcaacagagtcccagtgggacttagtgtgcgagcagaagggcttgaaccgcgccgccagcactttcttctttgcgggtgtgctagtcggcgctgttgcattcggatacctgtcagataggtttggcaggagaagacttctcttagtcgcgtacgtcagcacccttgtcctgggcctagcatcagccgcctcggtgtcatacgtgatgtttgccattactagaactcttacaggttctgcattagcaggcttcaccattattgtgatgccactggaactggaatggctggacgttgagcatcggacggtggccggcgttctctctagcacattttggacaggtggggtgatgctcttggcactggtggggtacctgattcgcgattggcgttggttattgctggccgttacattgccatgcgcaccagggattttgagcctatggtgggttcccgaatctgcacgctggctgttgacgcaagggcacgtgaaggaagctcatcggtatttgcttcattgcgccagactgaacggccgcccagtctgcgaagattctttttcccaggaggctgtctcaaaggtggccgcaggggagcgggtcgtgagacgcccatcgtacctggacctgtttcggacccctaggctcaggcacattagcctgtgctgtgtcgtcgtgtggtttggtgtgaacttctcgtattacggattgtcactggatgtgagtggcctgggccttaacgtgtaccagacccagttactgttcggcgccgtggagctgccgagcaaactacttgtctatctctccgtcaggtacgcaggacgccggctgactcaagcgggaacattattggggacagctctggcttttgggaccaggctgcttgtttctagcgacatgaaatcctggtcaactgttctggcggtgatggggaaggcctttagcgaagcagctttcaccacagcctacctgttcacgagcgagctttaccccactgtgttgcgccaaactggcatggggttgaccgccttagtaggcaggcttggagggagcctggccccgctggccgccctgctggatggcgtgtggttgtcattgcctaaattaacatacggcggcattgcactactcgcagctggtacggctctcctcctgcccgagacacgacaggcacagttgccagagacgatccaggatgtggaaagaaaatctgctcccacttctttacaggaggaggagatgcccatgaagcaggtgcaaaattag

SEQ ID NO: 134969 - DNA, 1641 bp, Artificial Sequence
  Description of Artificial Sequence: Synthetic coding sequence
atgggattcgaagaattactggaacaggtcgggggctttgggcctttccagctacgtaacgtggcactccttgctctccccagggtcctcctccctctgcatttccttttaccaatttttctcgctgccgttccagctcaccgctgcgccttgccgggcgctcctgctaattttagccaccaggacgtgtggctggaggctcatttgccccgagagcccgacggcacactaagctcctgcctaagattcgcttatcctcaggccctgcctaataccacactaggggaggaaagacagtcaagaggcgaactagaggatgagcctgctactgtgccgtgttcacagggctgggaatatgatcactcggagttctcctccaccatagccacagagtgggatctggtgtgtgagcagaagggcctgaaccgggccgctagcaccttcttctttgcaggtgtattggttggagcagtggcctttgggtacctgtcagaccgctttgggaggagacggctactgctagtggcctatgttagcacgctcgtgttgggtctggcctcagccgcgagcgtgtcttatgtgatgtttgccatcacccggactcttacaggttctgccttggcgggttttaccatcatcgtgatgcccctagaactggagtggttagatgtggagcatcgcaccgtggccggagtcctttccagcaccttttggactggcggcgtcatgttgttggcccttgtggggtatctcattcgtgactggcggtggctccttctggccgtgaccttgccttgcgcacccgggattttgtcactctggtgggtaccagagtcagctcgttggctactcacacaagggcacgttaaagaagctcaccgatatttgctccactgtgcgcgacttaatgggcggccggtgtgcgaggattctttctcacaggaggctgtttctaaagtggcggccggggagagggtggttcggaggcctagttatttggacctgtttcgtacacccagactgcggcacatttccctgtgttgtgtcgtggtatggtttggcgtgaatttttcatattatgggctatccctcgacgtgagtgggctcggtctgaatgtgtatcagacgcaactcttgttcggtgccgtagagctgcccagtaagctcctcgtctatttgtccgtacgctatgcaggaaggcgcctgacccaggctggtacactgctcggtacagctcttgcgtttggcacgcgcctgctagtctccagtgatatgaaatcttggtccacggtgcttgccgttatgggaaaagccttttccgaagccgcttttacgactgcctacctcttcacgtctgagctgtatcctacagtgttgcggcagactggaatgggtcttacagcccttgtcggacgactggggggaagtctggctccactggcagccctgctggacggcgtctggctctctctgcccaagctcacgtatggaggcattgctcttcttgccgcagggaccgcgttgctccttccggagactagacaggcgcagcttccggagactatccaggatgtggagcgtaagtctgccccgacttccctacaggaggaagagatgccaatgaagcaggtgcaaaattag

SEQ ID NO: 134970 - DNA, 636 bp, Artificial Sequence
  Description of Artificial Sequence: Synthetic coding sequence
atgctgcagccccatcttctgccttatcaagccgtgtctaaggttgcagccggtgaaagagtggttcggaggccaagctatcttgacttattcaggactcctcgattgcgccacatttctctctgctgtgtcgtggtgtggtttggagtcaatttcagctactatgggctgagcctagacgtgtctggcttaggcctcaacgtctaccagactcagctcctctttggggcagttgagctgcccagcaaacttctcgtgtacctgtccgtccgttacgctggacggaggctcacacaggccggcaccctgttgggaactgcactcgctttcgggactcgcttgctagtttcctctgacatgaaatcctggtcaaccgttctggctgtcatggggaaagcgtttagcgaagcagcatttaccactgcttatctgtttactagtgaactttaccccaccgtcttgaggcagaccggaatgggacttacagccctagtgggtcgcttaggcggcagtctggcccctcttgccgcactgctggacggagtgtggctgagcttgccgaagcttacatacggcgggattgctctactagcggctggaacagccctcttactcccagagaccaggcaggcctag

SEQ ID NO: 134971 - DNA, 837 bp, Artificial Sequence
  Description of Artificial Sequence: Synthetic coding sequence
atgggctttgaggaattattagagcaggtggggggcttcggaccattccagctgcggaacgtcgccctgttggccttgccaagagtgctgctccctctccacttcttgttgcccatcttcctggccgcagttcccgcccatagatgcgccttacccggcgcacctgccaatttctcccatcaggatgtgtggctggaagcacatctgccccgggagcccgacggaaccctgtctagttgtcttaggttcgcatacccccaggctctgcctaacaccaccctgggagaggagaggcagtcacgaggcgaattagaggatgagcccgccacggtcccgtgttctcagggatgggagtacgatcatagcgaatttagcagtacaatcgccacagagtctcaggtcggcatctacataatccacttggaggtggaatgtcgatggagacagtctccctgggaagcggccggtaggggcctgccctgggaagaagcggaggccgccggactggggcgggacaaggtctcctatagcccaagctggagagaatctctagggggtctgctgagcggtatggaatgggacctggtgtgcgagcagaagggactcaatagagccgctagtacattcttcttcgcaggtgtcctcgttggggccgtcgctttcggttatctatcagatcgatttggacggcggcggctccttttagtcgcctatgtctcgactctggtcttggggctagcatcagctgcaagcgtgagctacgtgatgtttgctatcaccaggacgcttaccggctccgccctcgcgggcttcacaattatcgtcatgccactctag

SEQ ID NO: 134972 - DNA, 444 bp, Artificial Sequence
  Description of Artificial Sequence: Synthetic coding sequence
atggaatgggacctagtctgcgaacaaaaaggattgaatcgtgccgcaagcacgttcttttttgcaggtgtgctcgtaggagcagttgcctttggctacctgtcagaccgctttggccggcgaaggctcctgctcgtcgcctacgtctccacacttgtgttgggcctggcttctgctgccagcgtcagctacgttatgttcgccatcacaaggactctcactggatctgccctcgctggcttcactatcattgtgatgcctctgggcgaggcggagctggaatggctggacgtcgagcaccgtaccgttgctggcgtactgagtagcaccttttggactggaggcgtcatgttgctggccctcgtcggatacctgattagggattggcgctggttactacttgcggtgacactgccatgtgcccccggtatcctcagtctgtag

SEQ ID NO: 134973 - DNA, 1629 bp, Artificial Sequence
  Description of Artificial Sequence: Synthetic coding sequence
atgacattctctgagatacttgatagggttggatccatgggccactttcagtttctgcatgttgcgattttaggcctccccattcttaacatggctaaccataacttactgcagattttcacagccgctacgcccgtacatcactgccgcccacctcacaacgcttcaacggggccttgggttctgccgatgggcccaaacgggaagcccgaaagatgtctccggttcgtgcacccaccaaacgcaagtctgccaaatgacacacagagagctatggaaccttgtttggatgggtgggtatataacagtacaaaagacagtatcgttaccgaatgggacctggtctgcaattctaataagctcaaggaaatggcacagagcatctttatggccggcatcctgatcggcggtttagtgctcggagacctgtcggatcgcttcggccgccggcctatcctgacttgctcatacctcctcctagctgcctctggctccggtgcagctttctcccccacgttccccatctatatggtcttccgctttttatgcggattcggaatcagtggcatcacactcagcactgttatcctgaatgtggagtgggtgcctactcggatgcgagctataatgtcgacagcactcggctactgttacacctttggccagttcattctgcctggactggcctacgccatacctcaatggcgctggctgcaactgacagtgtcaatcccattctttgtctttttcctgagtagctggtggactcctgaatctattaggtggctggtgctgtcagggaaatcttcgaaagcactgaagatcctgcgcagggtggccgtatttaatggcaagaaggaggaaggagagaggctgagcttggaggaacttaagctgaatctccagaaggaaattagtttggccaaagctaagtatactgctagtgacctgttcagaatacctatgttgcgccgcatgacattctgtctttcactagcttggtttgccactggcttcgcttattactccctggctatgggtgtggaggagttcggagttaatttgtatatacttcaaattatttttggtggagtcgatgttccagccaagttcatcaccatcctcagcctgtcttaccttggacgacacaccacacaggcggccgccctgctccttgccgggggggctattctcgccctcaccttcgttcctctggacctgcagactgtccgcacggtactagcagtgtttggaaaaggttgtttatcaagcagtttcagctgtctcttcctttacacctcggaactctaccccactgtgataagacaaactgggatgggggtgtcgaacctgtggacccgggtggggagcatggtgagcccactggtcaagataacaggggaggtgcagccatttatcccaaacatcatctacgggataaccgcgcttttgggaggatccgctgcattgtttctacctgagactttgaaccaaccactgcccgagacaattgaagacctcgagaattggagtctacgcgctaagaagcccaaacaggagccagaagtggaaaaggccagccagcgcattcctctccagccacatggaccgggactcggtagcagttag

SEQ ID NO: 134974 - DNA, 1629 bp, Artificial Sequence
  Description of Artificial Sequence: Synthetic coding sequence
atgacatttagtgaaattctcgatcgcgtaggcagtatgggtcactttcagtttctccacgttgccatacttgggttacccatcttgaacatggcaaatcataatctactgcaaatcttcactgcagctaccccggtgcaccattgtagacctcctcacaacgcatcaactgggccctgggtgctgccaatgggccctaatggaaagcctgagcggtgcctgcggtttgtgcatcctcctaatgcatccctgccaaatgatactcagcgagctatggagccctgcctcgacgggtgggtctacaattcaacaaaagacagcatcgtcactgagtgggatctagtttgcaatagtaataagctcaaggaaatggcccagtccatctttatggccggcatcctcattgggggtcttgtgctgggcgatctgagcgatcggtttggccgccggcctattctgacctgtagctacctgctgctcgcagcatccgggtcaggggctgccttttccccaacatttccgatctacatggtttttcgttttttgtgcgggtttggcatcagtggcattaccttgtccacagttattctgaacgtggagtgggtccccaccaggatgcgcgccataatgtctaccgcactaggatattgctacacgttcgggcagttcatcctgcccggactggcctacgctattccccagtggagatggctgcagctcacagtctctattcccttctttgtgttctttttgagttcttggtggactccagaaagcattaggtggctggtcctgtctggaaagtcttctaaagccctgaaaatcctcagacgagtggctgtcttcaatggcaagaaagaagaaggcgaacgactgagcctggaagaattaaaacttaatctccaaaaggagatatccttggcaaaggccaaatacacagcctccgacctgtttaggattccaatgttgcgtcgcatgacattctgtctgtccctggcatggttcgccactggattcgcctactactcacttgctatgggagtcgaagagtttggtgtgaatctctatatccttcaaatcattttcggaggagtcgacgtgccggccaaattcattacaattctgagcctcagctacctcggtagacataccacacaagcagccgcccttctgttggcagggggcgcgattctggcgttgactttcgtgccgctggacttgcagactgtacggacagttctggctgtgtttggcaagggctgcctatcatcgtcatttagttgcctgtttttgtacacaagtgaactgtaccccactgtcatcagacagacgggtatgggcgtcagcaatctgtggacaagagttgggtctatggtcagtcctctggtgaagatcacaggcgaggtacagccatttataccaaacatcatctacgggatcacagctctcctcggaggcagcgcagccttgtttctccccgagactttaaatcagccactcccggaaaccatcgaggatcttgagaattggagcctacgggcaaaaaagccaaagcaggagcctgaagtcgaaaaagctagtcaacggattccactgcagccacatgggccggggttaggatccagctag

SEQ ID NO: 134975 - DNA, 1587 bp, Artificial Sequence
  Description of Artificial Sequence: Synthetic coding sequence
atgacattctctgaaatcctggaccgcgtcgggtccatgggccattttcaatttctccatgttgctattctcggcttgccgattcttaacatggccaaccattgcagaccaccccataacgcttcaacaggaccatgggtcttaccaatgggtcctaacgggaaaccggagagatgtttgagatttgtacacccaccgaacgcttcactgccaaacgacactcagcgtgccatggaaccttgcctggacggttgggtgtacaatagcaccaaagacagcatcgtcacggagtgggaccttgtatgtaatagtaataaactgaaggaaatggctcagagcatttttatggcaggtatcttgataggggggctggtccttggagatttatccgatcgctttgggcggcgcccaattctgacatgtagttacttgctactcgccgcatctggttccggagccgctttcagtcctacattcccgatctacatggtcttcaggttcttatgcggcttcgggatctcagggataaccttatctactgtgatcttaaacgtggagtgggttcctacaagaatgagggctataatgagcaccgcactaggttattgctatacctttgggcaatttattcttcctggcctggcctacgccataccacagtggaggtggctgcaattgacagtttctataccattttttgtgttttttctaagttcatggtggacacctgagagtattcgctggttagtactctccggcaagtcatccaaagccttaaagattcttcggagagtagcagtatttaacggaaagaaggaagagggggagaggctaagtttggaggaactcaagttgaacctgcagaaggagatttcattggcaaaggcaaaatataccgccagcgaccttttcaggatccccatgctcagaaggatgaccttttgtctaagcctcgcgtggtttgctacaggttttgcctactatagcttggctatgggcgttgaggagttcggtgtgaacctgtacatcctccaaatcattttcgggggcgtggacgtcccagcgaagttcatcaccattctgagcttaagttacctggggcgccatactacccaggccgccgccctcctgttggcgggcggggcgatcctggccctgacgtttgtgccactggacctgcaaaccgtccgtaccgtgctggccgttttcggtaaaggctgcctcagcagctctttctcatgtctattcctgtatacatcagaactttatcctaccgtgatccgacagacaggaatgggtgtgtccaacctttggacacgcgtgggcagcatggtttcgcctttggtgaagattacaggcgaggtccagccctttatccctaatatcatctacggcatcacggccttgctcggaggttccgccgctctgtttttacctgaaacgttaaatcagcctctccctgaaacaattgaggatcttgagaactggtctttgagggccaagaagcctaagcaggagccagaggtcgaaaaagcgtctcagagaatacccctccagccccacggccccggcctgggatctagctag

SEQ ID NO: 134976 - DNA, 1653 bp, Artificial Sequence
  Description of Artificial Sequence: Synthetic coding sequence
atggcattctccaaattgctagagcaagccggcggggttggcctgtttcaaacactgcaggtacttacctttattctaccttgtctaatgattccttcacagatgctgctggaaaattttagcgcggccattccaggccacagatgttggactcatatgcttgataacggatcagccgttagtacaaacatgacccctaaagctttgcttacaatctctattccgccagggcccaatcagggaccccaccagtgtaggcgtttcagacaaccccagtggcagctcctcgatcctaatgcaacagctacgagttggtcagaggccgacacagagccctgtgtggatggatgggtgtacgacaggtccgtgtttaccagtacgatcgtggcaaagtgggacctggtctgctcatctcaagggctgaaacctctcagtcagagcatcttcatgtcaggcattctcgtgggatcctttatctgggggctcctgtcctaccgcttcggtaggaagccaatgctttcctggtgttgcctgcagctagctgttgccgggacctctacaatattcgccccgaccttcgtgatctattgcgggctgcggttcgtcgcagcctttggcatggccggcatcttcctttccagtctgacactgatggttgaatggacgaccactagccgtcgggcggtcaccatgactgtggttggctgcgctttctccgctggacaagcagcactcggcggcttggcattcgcactgagagactggcgcacactgcagctagcggcaagcgtgcccttctttgcaatctccctgatctcctggtggctccccgagtctgcacggtggctaatcattaaaggaaagccggatcaagcgctgcaagagctgagaaaggtggcacgaattaacgggcacaaagaagccaaaaatctgacaattgaggtcctcatgagttcggtgaaggaggaggtggcctcggccaaagaaccaagaagcgtcttagacttattttgcgtccccgtgctgagatggagatcatgtgctatgttggtggtgaacttctcgctcctgatcagttactacggcctggtgtttgacttgcagagcctggggcgcgacatcttcctcctccaggcacttttcggcgctgtggactttctcggccgggccactaccgccttgctgctctcttttcttgggagacgcaccattcaggcaggatctcaggccatggctggactggccatcctggctaacatgctggtgccacaggatttacagaccttgagggtagtatttgctgtactgggtaaggggtgtttcggaatctccctcacatgccttaccatctacaaagcagaactattccccacccctgttcggatgacagccgatggaattctccacaccgtgggcaggcttggcgccatgatgggccctctcattttgatgagccgccaggctttgccactgctgccacctctgctgtatggagtcatcagtatagccagttccctcgtggttctcttttttctgccggagacccagggactacctctccccgacaccattcaggatcttgagagtcagaagagtacagcagcacaaggcaaccgacaggaggccgtaaccgtggagagcaccagcctctag

SEQ ID NO: 134977 - DNA, 1338 bp, Artificial Sequence
  Description of Artificial Sequence: Synthetic coding sequence
atggccttttctgagctgctggacctggtgggtggcctggggcgcttccaggttctccagactatggcccttatggtgagcattatgtggttatgcacacagagcatgctcgagaacttttcagccgctgttccctcacacaggtgttgggcaccgctcctcgataatagtactgcacaggccagcattctggggagtctgtctccagaggctctgctggctatctcgatcccaccagggccgaaccaacggccccaccaatgtcgaagattcagacagccacaatggcagctgctggatcctaacgctacggctacctcatggtcagaagcagatacagagccatgtgtggatgggtgggtttacgacagatcgattttcacgagcacgattgtggcgaagtggaatctggtttgcgactcccatgctctgaaaccgatggctcaaagtatatatctggccggaatcctggtcggcgctgcggcgtgcggaccggcgagcgaccgctggttagccgagagcgcacggtggctgctcactacaggacggctcgattgggggttgcaggaactgtggcgcgtcgccgctattaacggcaagggagccgttcaggacaccctgactccagaggtcttgctgtcagcgatgagagaagaactgtccatggggcagccccccgcaagtctcggcaccttgctgaggatgcctggattgaggtttagaacttgtatatccactctttgctggttcgccttcggtttcaccttctttggactcgccctggatctgcaggccctaggctcaaacatctttttgttacagatgtttattggggtggtcgatatccccgcgaagatgggcgccctgctcttactgagccatctggggagacgtcctaccttggcagccagcctacttttagccggactgtgtatcctcgccaacacccttgtcccacatgagatgggagctcttaggagtgcactcgccgtccttggtttaggcggggtcggtgccgcatttacttgcattaccatttatagctcagagctgttccctacagtactgaggatgacagccgtgggtctggggcagatggcagcaagagggggtgccatcctcggacctttggtgcgcctcttaggggttcacggcccatggctgcctctgctcgtgtatgggacggttccagttctgagcggtctcgctgccttacttctgcctgagactcagtcgctgccgctccctgacaccatacaggatgtgcagaatcaggccgtgaaaaaagcgacccacgggacgctcggcaacagcgttctaaaaagtacgcaattctag

SEQ ID NO: 134978 - DNA, 1662 bp, Artificial Sequence
  Description of Artificial Sequence: Synthetic coding sequence
atggcattttcagagctgttggatctggtcggggggcttggccgcttccaggtgctgcaaaccatggcactgatggtctctattatgtggttgtgcacacaatctatgctggagaacttttccgccgcagtgccctcccatcggtgctgggctcctcttctggacaattctaccgcacaggcgtccatcttgggctcgttgtccccggaggccttgctggcaatcagcattccacccggccctaatcagagacctcatcagtgtaggcgcttccgacaacctcagtggcagttgctggacccaaatgccacagctacctcgtggagtgaagctgacaccgaaccctgtgtcgatggatgggtctatgaccggtctatatttacgagcacaattgtggcgaagtggaacttggtctgtgactcacacgcactcaagcctatggcacagtccatctaccttgcaggaattctggttggggccgccgcctgcggccctgcctctgatcggttcggcagacgtcttgtcctcacgtggtcatatctgcaaatggctgtaatgggaacggccgctgcattcgctcccgcctttcctgtctattgtctgttcagatttttgctggcttttgccgtcgctggcgtgatgatgaataccggtaccttattgatggagtggacagctgcccgggccaggccgctggtgatgaccctgaattctctcggattttccttcggccatggactcaccgccgccgtggcatacggcgtcagagattggaccttgttacagctcgtggtctccgtccctttctttctatgttttctgtacagctggtggctggcggagagtgcacgatggcttctgaccaccggccgcctcgactggggcttgcaagaattgtggagggtggccgccataaatggcaagggggcggtgcaagacacactgacccccgaagttctactcagtgccatgcgcgaagaactctcaatggggcagccacctgcgagtctgggcactctgctgcggatgcccggcctgcgcttcaggacttgtatctcaaccctgtgttggtttgcttttgggtttactttttttggcctggccctggaccttcaagccttggggtcaaatatatttctgttacagatgtttatcggtgtggttgacatccctgccaaaatgggcgccctcctattactatcacatctgggaaggcgcccaacgcttgccgcctctctgttattagctggactgtgtatacttgccaacacactggtccctcacgaaatgggtgccctgagatcagcattagctgtgctgggcctgggtggggtgggggccgcctttacttgtataaccatttactccagtgagctgtttcctaccgtgctccgcatgacggcagtggggctcggacaaatggccgcgagaggaggggcaatattagggcctctggtgcgcctcctcggagtgcacggaccctggctgcctttgctggtgtacggtacagtgcctgtcctgtcgggactggccgctctgcttctccctgagacccagtccttgccactgcccgacacaatccaagacgtgcagaatcaggccgtcaagaaggccactcatggcacgttgggcaatagcgtccttaagtcaactcagttttag

SEQ ID NO: 134979 - DNA, 999 bp, Artificial Sequence
  Description of Artificial Sequence: Synthetic coding sequence
atggaatggacggcggctagagccaggcctctggtgatgacccttaattccctgggcttcagtttcgggcacggccttacagccgctgtcgcatacggggtgagggactggaccctgcttcaactggttgttagtgtgccctttttcctctgcttcctgtactcctggtggctggctgaaagtgcccggtggctcctgaccactggcaggctcgattgggggctccaggagctgtggcgtgtcgccgctatcaacggtaagggagctgtgcaggacacacttaccccagaagtgctactgagtgccatgcgcgaggaattaagcatgggacagcctccggccagccttgggaccctgctcagaatgcccgggctgcggttcaggacttgcatatcaacactatgttggttcgccttcggattcacattcttcgggcttgcgctcgatctgcaggctctagggtctaacatctttttgctgcagatgttcattggcgtcgtcgacatccctgccaagatgggagccctcctcctgttgagtcatttaggccgtcgtccaaccctggccgcatcgcttctactggctggcctgtgcatcctcgcaaacacactcgttccccacgagatgggggctctcagatctgcacttgcagtgctgggtcttggtggggtgggtgccgcttttacatgtataaccatttactcgtccgagctgttcccaactgtgctcaggatgaccgccgtggggctgggccagatggcagcccgtggcggggcaatcctcgggccattggtgcggctcctgggggtccacggcccctggctcccgcttctagtgtacggaaccgtacctgtgctgtctggactggccgccctgctgctgccggagactcagtccttaccacttccggacactattcaggatgtgcagaaccaggccgtcaaaaaggcgactcatggcacactggggaacagtgtcctgaaatccacccagttttag

SEQ ID NO: 134980 - DNA, 1665 bp, Artificial Sequence
  Description of Artificial Sequence: Synthetic coding sequence
atgcctacagtggatgatattcttgagcaggttggggaatcaggctggtttcagaagcaagcgttcctgatcctatgccttcttagtgcagccttcgcccccatctgtgtgggcattgtgttcttaggatttacacccgatcatcactgccaaagtcctggcgtggcggagttaagccagagatgcggttggtctcctgccgaggagctgaactacactgtgccagggcttggacctgccggtgaagccttcttaggccagtgtcggcgatacgaagtggactggaatcaatccgccctctcgtgtgtagaccctctcgcctccttggctaccaaccgctcacatcttcccctagggccttgccaagatggctgggtgtacgataccccagggtcgtccatagtgactgagtttaacctggtatgcgctgattcctggaagctcgatctcttccaatcctgcctaaatgccggttttttgttcggcagtctgggtgtgggatacttcgcagatagattcggacgcaagctgtgcctgctggggaccgtcctggtgaacgcagtctctggtgttcttatggcctttagtccgaactatatgagcatgctcctattccgcctgcttcagggccttgtgtccaaggggaattggatggccggctacactctcatcactgagttcgtgggctctgggagtagacggactgtcgcgatcatgtaccagatggccttcacagtcggtttagtcgctttgactggtttggcctatgcactgccccattggcggtggctgcaactcgcagtttctttacccacttttctctttctgctgtactattggtgcgtgcccgagagcccacgctggctgctgtcccagaagaggaacactgaggctataaagattatggaccacattgctcagaagaatggaaagctaccaccggccgacctgaagatgttatcgttagaggaggatgtcacagaaaaactgtcaccctcctttgcggatctgttccgcacccctcggctgcgcaagagaacttttattttaatgtatctgtggttcactgacagcgtcctgtatcagggcctgattttacatatgggggccacgagcggcaatctgtacctagacttcctgtattctgcccttgttgagatcccaggcgcattcatcgccctcattactattgatcgggtcggacggatataccccatggccatgtccaatctcttagccggcgccgcctgtttagtgatgatattcatctcccccgatctgcactggctgaacattatcatcatgtgcgttggacggatgggtatcaccattgccatccaaatgatctgccttgttaatgccgaattataccccacgttcgtgagaaatttgggtgtaatggtgtgttcatccttatgcgatataggtggcatcattaccccattcatcgtgtttagattacgggaggtgtggcaggccctgccgctgatcctgtttgccgtgcttggtctactcgccgctggggtcaccctgcttttacccgaaacaaagggggttgcactccctgagacaatgaaggatgctgagaatttaggccgcaaagcaaaaccaaaagagaacaccatttatctgaaggtacaaaccagtgagccatctgggacctag

SEQ ID NO: 134981 - DNA, 1005 bp, Artificial Sequence
  Description of Artificial Sequence: Synthetic coding sequence
atgttctttttgctggcactgctgagcgcaacctttgcccccatctatgtgggtattgtatttctgggatttactcctgaccatcgctgccggtccccgggagttgctgagctttcactgcgatgtggttggagtcccgctgaagaactcaattataccgtgcccggacccggccccgccggtgaggcatcacctcgccagtgtagacggtacgaagtggactggaaccagtctacattcgattgcgtggacccgctggcttctttggataccaacaggagcagacttcccctcggaccctgtcgagatggctgggtgtatgaaacacccggcagctccatcgttacggagtttaatctagtttgcgcgaactcgtggatgcttgatttattccagagcagcgtgaatgtgggcttctttatcgggtcgatgtcaatcgggtacattgccgacaggttcggacgtaaactgtgcctgctgactactgtgctgatcaacgccgccgctggtgtattgatggctatttcacccacatatacatggatgctgatcttccgtctcattcagggacttgtctcgaaagctggctggttgatcggttatatcctgattacagagttcgtaggaagacggtaccgccggaccgtagggatcttctaccaggtggcgtacacagtcggcttattggtactcgctggggtggcttatgcacttccacactggcgctggttgcaattcaccgttagtttacctaacttcttcttcttgctgtattattggtgtatccctgagagtccacgctggctgatcagccagaataagaacgctgaggctatgcgcattattaagcatatcgccaagaagaatgggaaatctctgccagcaagtctgcagagattaagactcgaagaagaaacaggcaagaagctgaatccaagcttcctagatcttgtacggactccccaaattcggaaacacacgatgatcttaatgtacaattggtag

SEQ ID NO: 134982 - DNA, 1668 bp, Artificial Sequence
  Description of Artificial Sequence: Synthetic coding sequence
atgccaactacagtagatgatgttctcgaacacggcggcgaattccacttctttcagaagcaaatgttcttcttgctggctctcctctctgcaacatttgcccccatctatgtggggatcgtgtttttgggattcacgccagatcacagatgtcggagccccggtgtcgccgaattgtccttgcgctgcgggtggtcccctgccgaggagttaaactacaccgtccctggccctggccccgccggggaggcttctccacggcagtgcaggcgctacgaggtagattggaaccagtcaacattcgactgtgtggatccccttgcttcactggataccaaccgcagcagactgcctcttggaccctgtcgagatggatgggtctacgagacacctgggtccagtattgttacagaattcaatctagtgtgcgctaatagttggatgttggacctcttccaaagtagtgtcaatgtggggttttttatcggaagtatgagtatcggttatatcgctgatcgatttggacggaaactctgcttattgaccacagtgctcataaatgcagccgctggagtactcatggcaatcagccccacttacacatggatgctgattttcaggttgatacagggcttagtcagtaaggccgggtggctgatcggctacattctgattacagagtttgtaggccgtaggtaccggcgcacagtaggaatattctatcaggttgcctacacagtgggcttgttggttctggctggcgtcgcctacgcgcttccccattggcgctggctccagttcactgtgagtctcccaaattttttctttctgctctattactggtgcattcctgagtccccccggtggttaatctctcagaacaaaaatgctgaggccatgcgcattattaaacatatcgcaaagaagaatggaaagtctctgccggccagcttgcagcggttgcgcctggaggaggagacaggtaaaaagctgaaccccagcttcctcgacctggtacggacccctcagatccggaagcacacaatgatcctaatgtataattggtttacaagttccgtgctgtaccaggggctgataatgcacatgggcttggcaggggacaatatctacttggactttttttatagcgctctcgtggaatttccggcagcattcatgatcattctaaccatcgaccggataggacggcggtacccctgggctgcgtccaacatggtggcaggagccgcctgcctcgcctcagtgttcattccgggcgatcttcaatggctcaagattatcatctcatgtctcggccgtatgggaattaccatggcctacgagattgtgtgtctcgttaatgcggagctgtatccaacatttatccggaatttgggggtacacatctgcagtagtatgtgtgacattgggggcatcataacgccgttcctggtataccggctgaccaatatctggctagagcttccactcatggtctttggggtcctcggccttgtcgctggtggtttggtcctgctcctgcccgagacgaaaggaaaggcactcccagagacaatcgaggaagccgaaaacatgcagagaccaaggaaaaataaggaaaagatgatctatttacaggttcagaagctcgacattcctcttaactag

SEQ ID NO: 134983 - DNA, 1632 bp, Artificial Sequence
  Description of Artificial Sequence: Synthetic coding sequence
atgcgaactctgcatgcagtgtcccatccatatagtaatagtatgcgctttcaaagagtcctctatttcatttgcgccttccaaaatatctcctgtgggattcattatcttgcttcagttttcatgggggtcacaccccatcacgtctgtcgccctcctggcaacctgcagaatggcgagatctgggagctgtcacgctgcagtagaaataaaagggagaatacttcttcactcgggtatgagtacaccgggagtaagaaagagttcccttgtgttgacggctatatttacgaccagaacacttggaaatctaccgcagttacccagtggaatctggtttgcgatcggaagtggctggcgatgctgatacaacctctttttatgttcggcgtgcttctgggaagtgtaaccttcgggtacttctcggatagactgggtcgaagagtggtcctgtgggctacatcatcgtcaatgttcctgttcggaatcgcagccgcatttgctgtggactactatacatttatggctgctcgcttcttccttgctatggtagccagcggatatctcgtggttgggtttgtgtacgtaatggaatttataggtatgaagtctcgaacctgggcttccgtccacctgcactctttctttgctgtgggaaccctcctcgtcgctctcactggttaccttgtgagaacctggtggctttaccagatgattctgagcaccgtgactgttccctttattctctgctgctgggtgctgccagagactcccttctggttgctgagcgagggccggtatgaagaagcccagaagatcgtggacataatggctaagtggaaccgcgctagttcttgtaaactgagtgagctgttatccctggacctacagggaccagtgtcgaatagtcctacggaagttcagaaacacaatcttagttacctgttctataattggtctattaccaagcgaactctgacggtctggctgatttggtttactggctctctcgggttctacagtttctctctcaatagcgtaaatctaggtggcaatgaatatctgaatctattcttactgggcgtggttgaaattccagcttacaccttcgtgtgcattgccatggacaaagtgggtagacgcacagtcctggcgtacagcctgttctgttccgcactcgcctgcggagtagttatggtaatcccccaaaaacattacattctgggcgtggtaacagccatggtgggcaagtttgccatcggggcagcgtttggcctgatctacctatatactgcagaactatatcccacgattgtccgaagtctggctgtgggcagcggaagcatggtatgtcgactggcatctattctggcccccttttctgtagatctttcttcaatttggatttttataccccagcttttcgtgggcacgatggctctactgagtggagtcctaacactgaagctaccagagaccttgggcaagagactggctactacgtgggaggaggcagcaaaactcgagagtgaaaatgagtccaagtcatcaaagctgttgctgaccactaataacagtgggcttgaaaagaccgaggcaataaccccacgcgattcgggacttggggaatag

SEQ ID NO: 134984 - DNA, 1734 bp, Artificial Sequence
  Description of Artificial Sequence: Synthetic coding sequence
atgggttcacgccacttcgagggcatctatgaccacgtcggacacttcgggcgtttccagagggttctgtactttatttgtgcctttcaaaatattagctgtggcattcactacttggcctcagtgttcatgggggtgaccccacatcacgtatgtagaccgccaggcaacgtctctcaagtcgttttccacaaccactccaactggtccctggaggatacaggggcccttctttcctcaggccagaaggactacgtcactgtacaacttcagaatggggagatttgggaactgagccgctgctccagaaataagcgggaaaatacatctagtctgggctacgagtacactggctctaaaaaagagtttccctgcgtggacggctacatctatgatcaaaacacctggaagagcaccgccgtgacacagtggaatcttgtgtgcgatcggaagtggctggccatgctgatccaacctctgtttatgtttggagtactgctggggtccgtgaccttcggatactttagtgaccgcctgggccgacgcgtagtcctatgggctacctcatcatcaatgtttctctttggtattgcagctgcatttgccgttgactactacacctttatggccgctcgcttcttcctggcaatggttgcctccgggtacctggtcgtcgggttcgtgtacgtcatggagttcatcggcatgaaaagtcgaacatgggctagtgtgcacctccattctttcttcgccgtcggcaccctgctggttgcccttaccggctatctggtgcgcacttggtggttgtaccagatgatactgtctaccgtgacagtgcccttcatactgtgctgttgggtactcccagaaacacccttctggctcctcagcgagggacgctatgaagaagcccagaaaatagtcgatatcatggccaagtggaatagggcctcgtcttgcaagctctccgaactcttaagcttggacctccagggtcctgtgtccaactctcccactgaagtacagaagcataatttgagctatctgttctacaactggtccatcactaagcgcaccctaaccgtgtggcttatttggttcaccgggtctctgggcttttattcgttctccctgaacagcgtgaatctgggcgggaacgagtatcttaatctctttctgttaggagtggtggaaatccccgcatatacatttgtgtgtatcgctatggataaagtggggaggcgtactgtgctagcatattcactgttttgttccgcccttgcctgcggagtggtgatggtgatcccccaaaaacattatatacttggggtcgtaacggcaatggtagggaaatttgccattggagccgcgtttggcctgatctatctgtatactgctgagctgtaccctacaatcgtgcgctcactcgctgttggtagcgggagtatggtctgtcgcctggcttcaatcctggcacctttctctgtggacctgtcctccatttggatttttattccccagttgtttgtgggcaccatggcgctgctttccggtgttttgactctaaaactgcctgagaccctagggaaaaggctggcaactacctgggaggaagccgctaagctggaatctgagaacgagtcaaaatcaagcaagctgctactgacaactaacaactctggtctggagaagacagaggccatcacacctcgggactcaggccttggggagtag

SEQ ID NO: 134985 - DNA, 525 bp, Artificial Sequence
  Description of Artificial Sequence: Synthetic coding sequence
atgggcgtaaccccacatcatgtgtgtcgaccccccgggaacgtgagccaggtggtcttccataaccacagcaactggtcgctggaagatacaggagccctgctttcatcgggccagaaggactatgtcaccgtgcagttgcagaatggagagatctgggagctgtccagatgcagtcgcaacaaaagagagaacacgtcctctctgggctatgagtacactgggtctaaaaaggagttcccttgtgtggacggttatatttacgatcagaacacgtggaaatcgacagctgtcactcagtggaacctagtctgcgaccggaaatggctcgcaatgttaattcagcccctatttatgttcggggtgttactcggctcagtgacctttggatatttctccgacagactggggcgtagggtggtgctgtgggctaccagcagttctatgtttctgtttggcattgcagccgccttcgcggtcgattactataccttcatggccgcgagattctttctcgccatgtag

SEQ ID NO: 134986 - DNA, 804 bp, Artificial Sequence
  Description of Artificial Sequence: Synthetic coding sequence
atgtcagccggcccacaggccatgctgggacgtcgagtggttctgtgggctacttccagctcaatgttcctctttgggatagcagccgcctttgcagtggattactacacctttatggccgctcgtttctttctcgcaatggtggcttctgggtatctcgtggtcgggtttgtgtacgtgatggagtttatcggtatgaagagccggacatgggcatctgtgcacctccactcattctttgcggtaggcaccctgttggtggcacttaccggatacttagtgcgcacctggtggctgtatcaaatgatcctgtccaccgtgaccgtgccttttattctgtgctgctgggtcctgccagagactccattctggcttctgtcggaaggccgctacgaggaagcgcagaagattgtggatatcatggccaaatggaatcgggcatcatcttgtaagttgtcagaactcctgagtttagacctacagggacccgtgtcaaatagcccgaccgaggtacagaagcataacctgtcctatctgttttataactggtcaataaccaagcgcaccctcaccgtgtggctcatttggtttacaggatccctcggattctattccttcagcctgaattcagtgaatctgggagggaatgaatacttaaacctgtttttgctaggagttgtcgaaatccccgcttataccttcgtgtgcattgcaatggacaaggttggccgcaggaccgtgcttgcttattcactgttctgttccgcattagcttgtggcgtggtgatggtgatcccacagtag

SEQ ID NO: 134987 - DNA, 1056 bp, Artificial Sequence
  Description of Artificial Sequence: Synthetic coding sequence
atgggggtcacacctcaccacgtatgcagaccccccgggaacgtgtctcaagttgtattccacaatcacagtaactggtctcttgaggatacaggagcgcttctgtcctctggacagaaggactacgtgaccgtgcagttacagaacggcgagatttgggaactttccagatgttcccggaacaagagagaaaataccagttcacttggctatgagtataccggctccaaaaaagagtttccgtgcgtggacggttatatctacgaccagaatacctggaagtctactgcagttacacagtggaacttagtctgcgacagaaaatggcttgcgatgcttattcagcccctgtttatgttcggcgtcctcctcggaagcgttacttttgggtattttagcgatcggcttggcagaagggtggtgttgtgggctactagtagcagcatgttcctattcggcattgccgctgccttcgcagttgactactacactttcatggcggcgagatttttcctggctatggtagcctccggatatttagtggtcggatttgtatatgtgatggagttcataggtatgaagagtaggacctgggcttctgttcacctgcactccttctttgccgtgggaacactgcttgtagctcttaccggctatctggtcagaacctggtggctgtaccaaatgattctgagcacagtaaccgtcccatttattctttgttgctgggtgctgcccgagacccccttttggctgttatctgaaggacgatacgaggaagcacaaaagatcgtcgacatcatggcgaagtggaaccgggccagctcctgtaagctcagcgagctcttatccttggatctacagggtccggtgtccaattctccaactgaggtccagaaacataatctgtcctacctcttctataattggagcattacaaagcggacactgacggtctggcttatttggttcacgggttctctgggcttctactcatttagcctgaacagcgtgaacctgggaggtaatgagtacttaaacctgtttctgctgtag

SEQ ID NO: 134988 - DNA, 1548 bp, Artificial Sequence
  Description of Artificial Sequence: Synthetic coding sequence
atgggaagtcgccattttgagggaatatatgaccatgtgggccatttcggtagattccagagggttctgtatttcatttgtgcattccagaacatttcttgcggcatacattaccttgcaagcgtattcatgggcgtgactccacatcacgtctgccgtccccctggaaacgtgtctcaagtggtatttcacaaccattcaaattggagcctggaggatactggcgcacttctgtcctcgggccagaaggactacgtgaccgtccagctgcagaatggagagatttgggagctcagcagatgctcccggaataagcgcgaaaacaccagctcgttgggatatgaatacacaggctcaaagaaggagttcccatgtgtggatggatatatttacgatcaaaacacgtggaaaagcaccgcggttacccagtggaacttagtgtgtgaccggaagtggctagcgatgttgatacaacccttattcatgttcggtgtattacttggctcagttaccttcgggtacttctccgacaggttgggccgccgtgtcgttctttgggccacaagttcttcgatgttcctgttcgggattgctgccgccttcgccgtagattattatacatttatggctgcccgcttctttctggcaatggtggcctcaggatacctggtggtgggcttcgtctatgtgatggagttcataggcatgaagtcaaggacctgggcctccgtgcatctgcactcattttttgcagtaggaaccctgctggtggctctgacaggatacttagtgcgaacttggtggttataccagatgatcctcagtacagtgacggtaccattcattctatgttgttgggtcctgccagagacacctttttggctgttgtcagagggaagatatgaggaggcgcagaaaattgttgacatcatggctaaatggaatcgggcgtcatcttgcaagctgtctgagcttctctccctagacctgcaaggacccgtttcgaactcccctacggaggtgcagaaacataacctgtcatatctgttttacaattggtccatcaccaaaaggactctgaccgtgtggctgatttggttcactggttccctcggtttctacagcttctcactcaatagcgtgaaccttggcggcaacgaatacctgaatctgttcctactcggtgtagttgagattccagcttacacctttgtctgtatagcgatggataaagtagggaggcgcacagttctagcctactctctcttttgctcagcattggcttgcggagtggtcatggtgatcccacagaagcactatattctgggcgttgtgactgctatggtcggcaagttcgcgattggggccgcctttggcctcatctacttatatacggcagagttataccctaccattgtacgctccctggccgtgggatcagggtcaatggtttgtaggctcgccagcatcttggcgccttttagcgtggacctatcatctatctggatcttcattccacagctgctggggcagcatcttcaggaatag

SEQ ID NO: 134989 - DNA, 1299 bp, Artificial Sequence
  Description of Artificial Sequence: Synthetic coding sequence
gactacgtgactgtgcagctacagaacggggagatctgggagctctcgcgttgtagtcgcaacaaacgggaaaacacaagttctttaggatatgagtacacagggagtaagaaagaatttccatgtgttgacggctacatatacgaccagaatacctggaagagcactgccgtcacacaatggaacttggtctgcgacaggaaatggctggcaatgttaatccaaccactattcatgtttggggttcttctcggaagcgtgacatttggttatttctctgaccggctgggcaggagagttgtgctgtgggccacctcatcctctatgttcctatttgggatcgctgccgcctttgctgttgactactacacctttatggcagcaagattcttccttgcaatggttgctagcgggtatctggtcgtgggcttcgtgtatgtcatggagttcatcggcatgaaaagtcgcacatgggcatcggtgcaccttcattccttctttgccgtcgggaccttgctggtcgcactgactggctacctggttcgtacatggtggctgtaccaaatgatcctctccaccgtcaccgtaccatttattctgtgttgctgggtgctgcctgagacaccattctggctcctaagtgaagggcgatacgaggaggctcagaaaatcgtcgacattatggccaagtggaatcgtgcttcctcatgtaagctctcagaactgctttcacttgacctccagggacccgtaagcaactctccgactgaggtgcagaagcacaacctgtcttacctgttctacaactggagtatcactaagagaactttaacggtatggctgatctggttcactggttcactggggttctattcattttcactgaatagcgtgaatcttggcggtaacgagtatctcaacctcttcctccttggtgtggtcgaaatcccagcgtacaccttcgtttgtattgcaatggacaaagtcggccgcagaactgtgttggcatattcactcttttgttccgctttagcctgtggagtggtgatggtcatcccacagaaacactatattctcggagtggtgacagccatggtgggaaagttcgcaatcggtgctgctttcggtctgatctatctttacactgccgaactttacccaaccatcgtcagaagcctggcggtcgggtcggggagcatggtctgtcgcctcgcctccatcttggcgccattctctgtagacttgtcaagcatctggatcttcattcctcagttactgggtcagcatcttcaggagtag

SEQ ID NO: 134990 - DNA, 600 bp, Artificial Sequence
  Description of Artificial Sequence: Synthetic coding sequence
atgggctcccggcattttgagggcatctacgaccatgtgggtcactttgggcgcttccagcgagtgctctacttcatttgcgccttccagaatatctcttgcgggatccactacttagcctctgtgttcatgggggtcactccccatcatgtttgcaggccgcctggtaatgtgagtcaggtggtcttccataaccactcaaactggagcctagaggacacgggggcactgctgagctcagggcaaaaagactatgtgacagtccaactccagaacggagagatttgggaactgagtcggtgcagccggaacaaacgagagaatacgtctagcctgggctatgaatacactgggtctaagaaagagttcccttgtgtggatggatatatttatgaccagaatacttggaagtcgaccgccgttacccaatggaacctggtttgtgacagaaagtggttggcaatgctgattcagccattgtttatgtttggcgtgttgctcggatctgtgaccttcggatatttcagcgatagggtggggtttctcaccgcgtggtacaaaactagtggatttccgactagcagcgccccccctctctag

SEQ ID NO: 134991 - DNA, 1674 bp, Artificial Sequence
  Description of Artificial Sequence: Synthetic coding sequence
atgagggattatgatgaggtcacagccttccttggggagtggggaccgttccagaggttgatcttcttcctcctctctgcctccatcattccaaacggttttaccggcctgtcttctgtgttcctgatcgcaaccccggaacaccggtgtcgcgtacctgatgctgcgaacctatcttcagcttggcggaaccataccgtccctcttagattgagggatggcagagaggtgccacactcctgtcgacgttaccgactggcaaccatcgccaatttcagtgcccttggcctcgaaccgggaagagacgttgacctgggacagctcgagcaggagtcctgccttgatggatgggaattctcacaggatgtctacctgagcacgatcgtgacggagtggaacctcgtgtgtgaggatgactggaaagcgccactcactataagtctgttcttcgtcggtgtactgctgggctccttcataagcggacagctctccgacagatttggcaggaaaaacgtgctctttgtcacgatgggaatgcaaaccggatttagctttctccagatattttcgaagaatttcgaaatgttcgtcgtgttattcgtgttggttgggatgggtcagataagcaattatgtagctgcctttgtactcggtactgaaatactgggaaaaagtgtgagaatcatttttagcaccctcggagtgtgtatcttttatgctttcggctacatggtgctgccactgtttgcttactttatccgggattggcgcatgttgcttgttgcgctgactatgcctggagttctttgcgtggccctgtggtggtttataccagaatctcctcgatggctcatatctcaaggtagatttgaagaggccgaggtaatcatacgcaaggccgctaaggcaaatggcatcgtcgtcccctccactattttcgatccaagtgaacttcaggacctctcatcaaaaaagcagcaatcccacaacattcttgacctgctcagaacctggaacatcagaatggtgacaatcatgagtatcatgctttggatgacaatatctgtgggctatttcggcctatcgctcgacacacccaatttgcacggcgacatctttgtcaactgtttcttgtctgccatggttgaggttccagcttatgtgctggcctggctgctactgcagtacctgcctagacggtatagtatggctacagctctcttcctgggggggagcgtgctcctatttatgcagctcgtcccaccagatctgtactacctggccacagtattagttatggtcgggaagttcggggtcaccgctgctttctcaatggtgtatgtttacacggctgagctgtatccaacggtggtccgcaatatgggcgtgggtgtcagctctacagcctcacgcttgggctcgatcctgtcaccctactttgtgtacctgggggcttacgatagatttctcccatacatcttgatggggagcttaacgattctcacggcaattttgacactgtttctgccagagagctttggcacccccctcccagatactatcgatcagatgctcagggtgaaaggtatgaagcacagaaaaacaccctcacataccagaatgctaaaggatggacaggagaggcctacaattctaaagagcacagccttctag

SEQ ID NO: 134992 - DNA, 1746 bp, Artificial Sequence
  Description of Artificial Sequence: Synthetic coding sequence
atgcgcgactatgacgaagtgacagccttcctgggcgagtgggggcctttccaacggctcatattcttcctcttgtccgcctcaattattccaaacggctttaccgggctgtccagcgtattcctgatcgcaaccccagagcaccgatgccgcgtgccagatgctgcaaacctctcgtctgcttggcgaaatcataccgtacctctgagattaagggatggacgcgaagtacctcactcatgccgacggtaccgactggccaccatcgctaatttctccgcgttgggacttgaacctgggagggatgtcgacctcggacagttagaacaggagagttgtctggatggctgggagtttagccaggacgtatatctgagtaccattgtgacagagcaggattccggagcatataacgctatgaaaaataggatgggcaaaaagcctgccttgtgccttcctgcgcagtggaatcttgtctgcgaagacgattggaaggctccactgacgattagcctgttctttgtgggagtcttgctgggctcgtttatttctggccagctgtccgatcgctttggacgaaagaacgtgctgttcgtcacgatgggtatgcagactgggttttcattcctccagatcttctccaagaatttcgagatgtttgtggtactgttcgtcctcgtgggcatgggccagatctcaaactacgttgctgcattcgtcttaggaacagaaattttggggaagagcgtgaggatcatttttagcaccctaggagtatgcatattttacgccttcggatatatggtccttcctttgtttgcatattttattcgggattggcgtatgcttctggttgccttgaccatgcccggggtcttgtgcgtagcgttgtggtggtttatccccgagagcccgaggtggttgatcagccaagggagatttgaggaggcggaagtaattatcaggaaggctgctaaggctaacggcatagtggtgccctccaccatcttcgatccgagtgagcttcaagatttatcaagtaagaaacagcagtctcacaacattctcgatctgttgcggacctggaatatccgaatggtcaccatcatgtcgattatgctgtggatgaccatttctgtgggttattttggtctctctctggatacccctaacctgcatggtgacatcttcgtcaactgttttctgagcgccatggttgaggtgcctgcatatgtgctggcctggctgctgctacagtacctgccacgcagatacagtatggccaccgctctgttcttaggcggatctgtcctgctttttatgcagttggtaccccctgatctctattatctggcaacagtcctggtgatggtggggaagttcggagtaacagctgccttctctatggtctacgtgtacacggccgaactctaccctacagttgtcaggaatatgggcgttggtgtttcatccaccgcttcacgtcttggatccattctgagcccttattttgtgtacctgggggcatatgatagatttttaccctatatactgatgggaagccttaccatactcactgcaattctcaccttgttcctccctgagagtttcggtacacctttgccagatacaatcgaccagatgctgagagtaaaaggcatgaagcatcgtaaaactccatctcacactcggatgctgaaagatggccaggagcgccccacaatcctgaaatctaccgcattctag

SEQ ID NO: 134993 - DNA, 1656 bp, Artificial Sequence
  Description of Artificial Sequence: Synthetic coding sequence
atgcgggactatgatgaagtgattgctttcctgggcgagtggggccctttccagcgtcttatcttctttctcctgtccgcctctattatcccaaacggattcaatggaatgagtgtagtgttcctcgcaggtacaccagaacatcgatgcagagtgccggatgctgctaatcttagctcggcctggagaaacaattccgttcccttaagactgcgcgatggaagggaagtaccccacagctgctcccgctaccggttggctacaattgccaacttcagtgctctaggcctagaaccaggccgcgatgttgatttagggcagcttgaacaggaaagctgcctagatgggtgggagtttagccaggatgtgtatctgtctacggttgtaaccgagtggaatctggtgtgcgaagacaattggaaggtgcctctcacaacatcactttttttcgtcggagtcctgctcggatcgttcgtgtccggccagttgagtgatcggttcggaagaaagaatgttttgttcgctacgatggctgtccagaccggcttttcgtttctacagatcttcagcatctcgtgggagatgttcaccgtgctgtttgtgatcgtaggcatgggccagatctctaactacgtggtcgcgttcattctgggaaccgagattcttggaaagagtgtccgtatcatattttccactctcggtgtgtgcacattcttcgccgtgggctatatgctgttgccattgttcgcttacttcatcagggattggagaatgctcctgcttgccctcactgtccccggcgtgctctgtgtacctctctggtggtttatcccagaaagccctaggtggctaatcagtcagaggagattccgggaagccgaggacattatccagaaagcagcgaagatgaacaatattgctgttcccgccgtcatcttcgattctgtggaggaattaaatcctctcaaacagcagaaggccttcatattggacctcttccgaactcggaatatagcgatcatgaccattatgagccttctgctgtggatgctgacctctgtgggttatttcgccctctccctcgatgcccctaatcttcacggtgacgcttatctgaattgtttcctgtccgcattgattgagatccctgcgtacattactgcctggctccttttacgtaccctgcccagaagatacataatagcagcagttctcttctggggcggcggcgttctgctttttatccagcttgttccagttgattattattttctctcaataggactggtaatgctggggaagtttggaatcacgagcgccttcagcatgttgtatgtgtttaccgccgaattataccctacattggtgcggaacatggcagtgggggtgacatctacagcttccagagtgggatccatcatagctccatattttgtgtatctgggcgcatacaatcgcatgctgccttacattgtaatggggagcctgaccgtgttaattggcatcctcactctgttctttccagagtctctaggaatgaccctgccagagacactggaacagatgcaaaaagtaaaatggtttcgctccggaaagaaaaccagggacagtatggagactgaggagaatccaaaagtgttaattacagctttttag

SEQ ID NO: 134994 - DNA, 1656 bp, Artificial Sequence
  Description of Artificial Sequence: Synthetic coding sequence
atgggtttcgacgttttgttggatcaggtgggcgggatgggtcggttccagatctgccttattgcctttttctgtatcacgaacattctcctgtttccgaatatcgtacttgaaaacttcacagcctttaccccctctcaccggtgttgggtgccgctgctcgataatgacactgtgagtgataatgataccggtactctgtccaaggatgatctcttgagaattagcatcccccttgactcaaaccttaggcctcaaaagtgtcagaggtttatccatcctcagtggcagttgctgcacctcaacggcacgttccccaatacaaatgaacccgacacagaaccgtgtgtggatggatgggtttacgacagatcaagctttctgtcaacaatcgtcactgaatgggacctggtctgcgagagtcaaagcctgaaatccatggtgcagtcgctgtttatggccggcagtctcttaggagggttgatttatgggcacctttctgacagggtgggcaggaagataatatgcaagctttgctttcttcagcttgctattagcaacacttgtgccgctttcgccccaacatttctggtctactgcatcctgcgctttctcgccggattctcaacaatgactattctcgggaatactttcatcttgagcctggagtggaccctgcctcggtctaggagtatgactataatggtacttctctgcagttattctgtgggccagatgctactgggcggattagcattcgctatccaagactggcacatattgcagcttacagtgagcacccctatcatcgtgctgttcctgtcgtcttggaaaatggtcgagtctgccagatggctgataatcaacaaccagctggatgaggggctgaaggagctccggcgggttgcccatatcaatggaaaaaaaaacaccgaggaaacgcttaccactgagctggtgaggtccactatgaaaaaagagttggatgcagtaaggattaagacctcaattttttcattgtttagagctcccaagctgaggatgcgcgtctttggcctgtgttttgtaaggttcgctatcactgtgcccttttatggactgatactcaacctgcagcacttaggatcgaacgtgagtttgtttcaaatcctctgcggcgcggtgacattcaccgccaggtgtgtatcgttactgactctcaaccatatgggccggaggatatcccagattcttttcacatttcccgtgggtctcttcatactggtcaacaccttcctgcctcaggaaatgcagattttgcgggtcgtcctggctacactcggaattgggtctgtcagtgcggcatccaattcagcttcagttcaccataacgaactggtgccaaccatcttgaggtcaaccgtggctggtataaacgctgtgagcgggagaactggagcggccttggctccgctcctcatgactctgatggcctattccccacatcttccatggatcagttatggagtgttcccaatcttagccgtccccgtgatcctactgttgcccgaaaccagagatctgcctttgccaaacacaatccaggatgtggaaaatgagaaagattcaaggaatatcaagcaggaagatacatgcatgaaggtcacccagttctag

SEQ ID NO: 134995 - DNA, 738 bp, Artificial Sequence
  Description of Artificial Sequence: Synthetic coding sequence
atggaggtggaggaggcttttcaggccgtgggtgaaatgggcatctatcaaatgtacctgtgcttcttactggctgtcctgcttcagctgtacgtggctactgaagcaattcttatcgccttagttggcgcgacgcccagttatcactgggaccttgccgaactccttccgaatcagtctcacggtaatcaatccgcaggcgaagaccaggccttcggcgattggctgttgaccgctaacggctcagaaattcacaaacacgttcacttttcctccagcttcaccagcatagccagcgagtggttcttaatcgcaaatcggagctataaagtgtccgccgcttcctcctttttcttttcaggagtgtttgtgggggtgattagcttcggtcagcttagcgacagattcggacgcaaaaaggtgtacctgacaggctttgctttggacatactgtttgccatagctaacggtttcagtccctcatatgaattctttgccgttacacggtttcttgttggcatgatgaacggtggaatgagcctcgtcgcctttgtccttcttaacgaatgcgtaggaacagcatattgggccctcgcaggatccataggtggattgtttttcgctgtaggaatagcccagtacgcactcctaggatattttattaggtcctggaggactcttgccatcctcgtcaatcttcagggcaccgtggtgttcctactgtccctggttgactag

SEQ ID NO: 134996 - DNA, 1644 bp, Artificial Sequence
  Description of Artificial Sequence: Synthetic coding sequence
atggaagtggaagaagcctttcaagctgtgggtgagatggggatataccaaatgtacttgtgctttttactcgccgtgctgctacagctctatgtggcaaccgaggccattcttatcgcactggtgggcgccactcccagttatcattgggacctcgctgaactgctgccgaaccagagccatgggaatcagagtgccggagaagatcaagcttttggtgactggttgctgacagccaacggcagtgaaatccataagcatgtgcactttagcagcagttttacctctatcgcttcagagtggttcctgatcgccaaccgaagttacaaggtgtcagcagccagttctttcttcttcagtggtgtgtttgtgggcgtgattagttttgggcagctgtccgatcgtttcgggcgcaagaaagtgtacctaactggattcgcccttgatatactctttgctatagccaatggatttagccctagctacgagtttttcgctgtgactcggttcctggtagggatgatgaatgggggcatgagccttgttgcgttcgtgctcctgaacgaatgtgtgggaaccgcctattgggcccttgccggaagcatcggagggcttttcttcgccgtcggaattgctcagtatgcgctattaggatactttatccgctcatggaggaccctggccattctcgtaaacttgcagggcaccgttgtcttcctgttaagcctcttcatccccgagtcaccgagatggctttattcccaggggcgcctctctgaagccgaagaagccctctatctgatcgctaaacggaaccggaagctaaaatgtacatttagcctaactcatccggcgaataggtcatgtcgggagaccggcagtttcttagatttgttccggtaccgggtgttactggggcataccctcatactcatgtttatatggttcgtctgttctttggtgtattacggactcactctgtctgccggggatctggggggatcaatatacgctaatcttgcgttatcaggactgatagaaatcccaagctaccccctctgcatctacctcataaaccaaaagtggttcggacggaagcgaacactctctgcctttctttgtcttggcggcctggcctgcctcatcgtgatgtttttgccggaaaaaaaagatacaggagttttcgctgtggtaaattctcattcccttagcctgctcgggaagttgactatatcggcagcctttaatattgtatatatttacacttcagagctctaccccaccgtcatcaggaacgtggggcttgggacttgtagcatgttttcccgcgtcggtggcatcattgccccgtttattccaagcctgaagtacgtccaatggagccttcccttcatcgtgttcggagctactggattaactagtggactcctctcactgctcctccctgagacactcaacagcccactgctggaaacctttagtgatctgcaagtgtatagttacagacggctgggtgaggaggctttatcccttcaggcgctggatccacagcagtgtgtggataaggagtctagcttaggctcggaaagtgaggaggaggaggaattttatgatgctgatgaagaaacacagatgattaagtag

SEQ ID NO: 134997 - DNA, 1008 bp, Artificial Sequence
  Description of Artificial Sequence: Synthetic coding sequence
atgcctgctgtcctgggctttgagggatccgccaataagattggagtcggtgtcgtgcgcgatggtaaagtgcttgctaatccaagaaggacatatgtgactccccccggaactggctttctgcccggcgacactgccaggcaccaccgcgctgtgatcctggatctgctgcaggaagcccttacagaaagcggactcaccagccaggatattgattgtattgcctacaccaagggtcctggaatgggcgcccctcttgtgtcagtggctgtagtggccaggacggtggcgcaactctggaacaagcccctcgtgggggtcaatcactgcatcggtcatattgaaatgggtcgtctgatcacaggtgcgacatctcctacggtgctttatgtgagcgggggtaacacccaggtgatcgcatacagtgagcatagatatagaatcttcggagagactatcgacatagcagtagggaattgtctggacagatttgccagagtgcttaaaatatcaaacgacccctcccccggctataacatagaacagatggccaagcgcggcaaaaagctggttgagctcccttatactgtgaagggcatggacgtctccttctctggcatcctctcgtttatcgaggacgtcgcccaccggatgctggcaactggggagtgtacacccgaagacctgtgtttctcacttcaggaaacggtctttgccatgctggtggagataaccgaaagggccatggctcactgcggaagccaggaggctctgatagttggcggggtgggatgtaacgtgcgccttcaagagatgatggccacgatgtgccaggaacgtggcgcgcgcctctttgcaactgatgaaagattttgcatagacaacggggccatgattgcacaggccggctgggagatgttccgggcgggccataggacacccctgagtgactccggcgtgacacagagatacaggactgacgaggtggaagtgacctggcgggattag

SEQ ID NO: 134998 - DNA, 1563 bp, Artificial Sequence
  Description of Artificial Sequence: Synthetic coding sequence
atggccagcgacccaatatttaccttggccccacccctgcactgccattatggcgcctttccgcccaacgcttcggggtgggaacagcctcccaacgccagcggagtgtcagttgcatctgctgccttggccgcatcagccgcttcaagggttgctacttctactgatccctcatgcagtggattcgcgccacccgattttaatcactgcctaaaagactgggactacaatggcctgcccgtattgacgacaaatgctattggtcagtgggatttggtgtgcgatctcgggtggcaggtcatacttgagcaaattctatttattcttggcttcgccagcggctacctattcctcggctaccccgcggaccgatttggccggcgcggcatcgtcttgctgactctgggcttagtcggcccttgtggagtgggcggtgccgcagcaggctcgagcaccggtgtgatggctttgcggttcctgctgggtttcttgctggcaggcgtcgacttgggggtgtaccttatgcgcttagagctatgtgatccaacccagcggcttcgcgttgctctcgccggggaactggttggggtcggcggacatttcttattcctcggactagccctcgtttcaaaggattggaggttcctccaaaggatgatcactgcaccttgtatactcttcctcttctacggatggcctgggttattcctcgaatccgcaagatggcttattgtgaagcggcagattgaagaagctcagtccgtgctacggatcctggctgagagaaacaggccccatggacaaatgttgggggaggaggcccaagaagccttacaggatctggaaaatacatgcccactcccagccacttcctccttttcttttgcttcgttactgaattaccgcaatatttggaagaatctgctcattctaggcttcacgaactttatcgctcacgccatcagacattgttatcagccggtcggcgggggaggttcaccttctgatttttatctttgctctctcttagcatccggaaccgcagctcttgcatgcgtgtttctgggcgtcacagtggaccggtttggacgcagaggaatccttttactgtctatgacgctgactggaatcgcttcccttgtccttctggggctttgggattaccttaacgaagccgccattacaacattctccgtactcggtttgttcagctcgcaggctgctgctattttatctactcttctcgcagccgaagtgatcccaactaccgtaagaggcagaggcctgggcctgattatggcgttaggtgctctgggtggtctctctggcccagcgcagcgcctgcatatgggacacggggcctttctgcagcacgttgtgctggccgcctgtgcactgctgtgcatcctatctatcatgctacttccagaaacaaagaggaaacttttacctgaggtgttgagggatggagagctgtgcagaaggccgagcctgcttcgccagccaccgcctacacggtgtgatcacgtcccactactcgctacaccaaatcccgccttgtag

SEQ ID NO: 134999 - DNA, 1617 bp, Artificial Sequence
  Description of Artificial Sequence: Synthetic coding sequence
atggcgtccgaccctatattcacattggccccgcccttacattgccattatggcgcattccctccaaatgcttcaggttgggaacagccacccaatgcaagcggcgtaagcgtggcgagcgcggctctcgctgcatctgcagcctctcgcgtcgctaccagtaccgatccttcatgctctggcttcgcaccgcctgactttaaccattgcctgaaagattgggattataacggcttgcccgtcctaaccaccaacgcaattggtcagtgggaccttgtctgcgacctcggctggcaggtcatccttgagcagatacttttcatattgggtttcgcaagcggctacctctttctgggatatcccgcggacaggtttggaagacgcggcattgtccttctgacccttggcctggttggtccttgtggagtgggcggagctgctgctgggtcttcaacgggcgtaatggccttgagattcttgctgggttttctcctggctggcgtcgacctgggagtttatctgatgagactcgagctctgtgacccgacccagagacttcgagtcgctctggctggagagcttgtgggcgtgggaggccacttcctttttctgggactcgcgctggtatccaaggattggcgcttcttacagcgcatgattacagccccatgtattctgttcctgttctacggctggcccgggctgttcctggagtccgcgcgttggctgatcgtgaaacgtcagatcgaggaggctcagtctgtgctgaggattctggcagagcggaaccgtcctcacgggcaaatgttgggagaagaagcgcaggaggcactgcaagacctggagaatacctgtcccttaccagctacatcatccttttcgttcgcctccctgcttaactatcggaatatctggaaaaatctcctgatcctgggctttacgaatttcatagcccatgcaatcaggcactgttatcagccagttggcggtgggggctccccctcggatttttatctctgctccctcctggcctccgggaccgccgcactggcttgtgtttttcttggtgttaccgttgacaggtttggacggcgcggaatcctactgctcagtatgacactgaccggcatcgcatcactggtgctcctggggctgtgggactgcgagcatcccatcttcccaaccgtgtgggcgcagcagggcaaccccaaccgcgacctgaatgaggctgccataactaccttcagcgtgctcggactcttctccagtcaggcagcggccattctgagtaccctgctagccgcagaagtcataccaaccacagttagaggtcggggcctgggcctgattatggcactgggggctctgggaggcctgagcgggccagcgcaacgtttgcatatgggccacggagccttcctccagcacgtagtgcttgctgcctgtgccctgctctgcatcctgagcatcatgctgctgcccgagacaaaacgaaaacttctgcctgaggtcctccgggatggggaactttgccgccgaccttctctactgcggcagcccccccccacgcgctgcgaccacgtaccccttctcgcgacaccgaatcctgctctgtag

SEQ ID NO: 135000 - DNA, 1086 bp, Artificial Sequence
  Description of Artificial Sequence: Synthetic coding sequence
atggcaatcgacagacgtagagaggctgctggcggcggtccagggcggcagcccgctcctgcagaagaaaatggatctctaccgccaggagacgctgccgcaagtgcaccactgggaggacgggcaggtcctggaggcggagcagaaattcaaccattaccaccactccacccgggggggggaccgcacccatcttgttgttccgcagccgctgcccccagcctgcttctcttggactacgacgggtccgtcctccccttcctgggaggactgggaggagggtaccagaaaactctggttctgctaacatggatccccgcacttttcatcgggttctcccagttctctgattcgtttttactggatcagcctaatttttggtgtagaggcgctggaaaaggtaccgagttggccggggtcaccacaaccggacggggcggagacatgggcaactggactagtctgcccacaaccccattcgccactgctccatgggaggcagccggcaaccggagcaatagcagcggtgctgacgggggcgacacacccccacttccatcacctcccgataaaggcgataatgcctccaattgtgattgtagggcttgggattacggaattcgagccggcctcgtacagaacgtggtctcaaagtgggacctggtttgcgataatgcctggaaagtgcacattgccaaattttccttgctggttggtttaattttcggctatttgataacaggctgtatcgccgattgggttggcagacgaccagtgctgctgttctccatcatcttcatcctgatattcgggctgaccgtagctctgtccgtgaatgttactatgttcagcacccttaggttcttcgagggcttttgtcttgccggcataatcctaacgctatacgctctccgtatcgagctgtgcccacctgggaaacgtttcatgattactatggtggccagcttcgtagccatggcgggtcagttccttatgcccgggctggctgctttatgccgcgattggcaggtccttcaagccttaattatctgtccctttctcctgatgttactgtattggtcatag

SEQ ID NO: 135001 - DNA, 1218 bp, Artificial Sequence
  Description of Artificial Sequence: Synthetic coding sequence
atgttctccaccctaaggttttttgagggcttttgtctagccgggattatcttgactttatacgcccttcgcattgaactttgtccaccaggtaagagattcatgatcaccatggtggcctccttcgttgctatggctgggcagttcctcatgccagggcttgctgctctctgtcgggattggcaagtgttgcaggcgttgatcatttgtccgtttctgctgatgcttctttactggagcatattccccgaatccttaagatggctgatggccacccagcaattcgagagtgccaaacgactgattcttcacttcactcaaaaaaataggatgaatcctgagggggacatcaagggagtcatccccgaattggaaaaggagctgtctcgtagaccaaagaaggtgtgcatcgtgaaggtggtcggaacacgcaacttgtggaaaaatattgtggtcctgtgtgtaaactcgctgacaggatacggcatccaccactgctttgcaaggtcgatgatgggccatgaagtgaaagtcccactgctggagaacttctatgctgactactatactacagcttctattgcactcgtatcttgtctcgccatgtgcgtggtcgttcgctttttgggtcgtcgcggagggctgctcctcttcatgattctgacagcactggcctcactgctgcagctaggtctactgaatctgatcggaaaatactctcagcatcctgactctgggatgtccgacagcgtcaaagataagttttcaattgcattctcaattgtcggtatgtttgcctcgcatgccgtgggctccctgtctgtctttttctgcgcagagatcacccctactgtcattcgatgtggtgggctaggtcttgtcttagcctccgctgggtttggcatgttgactgctcctattatcgaattgcataaccagaagggttatttcctgcatcacataatttttgcatgctgcacacttatttgcattatctgcatcctgctactgcccgagagtagagatcagaatctgcccgaaaatatctcaaacggcgagcattacacaaggcagcctctcctcccacataaaaagggcgaacagcccctgctgctcacaaatgctgaacttaaagactacagcggccttcatgatgcggctgctgcgggcgatacactgccagaaggcgcaacggccaatgggatgaaggccatgtag

SEQ ID NO: 135002 - DNA, 2061 bp, Artificial Sequence
  Description of Artificial Sequence: Synthetic coding sequence
atggcgatcgatagaagacgggaagcagccggtgggggtcccgggcgtcaaccggcccccgccgaagagaatggctcccttccaccgggagatgctgccgcctccgcccctctcggcgggagggccgggcccggagggggagccgaaatacagcccctcccaccccttcaccccgggggaggtccacatccttcctgttgcagtgccgcggctgctccaagtttactcctgctggactatgatgggagcgtgctgcccttcctgggtggcttgggtggggggtaccagaagacgcttgtcctgctgacttggataccagccctttttataggcttctcacaattttctgattcatttttgctcgatcagcctaacttttggtgtagaggggccgggaaggggactgaactcgcaggagtgactaccacgggcagggggggcgatatgggaaattggaccagtctgcccacgacacctttcgcaacagctccatgggaggcagcgggtaaccggagtaattctagtggagctgatggtggagacacccctcctctgccttcacctccagataagggcgataatgcctccaattgtgattgcagagcctgggactacggcattcgggcaggtctggtccagaacgtcgtctcaaaatgggatctggtctgcgacaacgcttggaaagttcatattgcaaaattttccctgttagtgggccttatcttcggatatcttataactgggtgcatagccgactgggtaggacgcagaccggttctcctgttttccattatcttcatactcatctttggcctgacggtggccctttccgttaatgtaaccatgttcagcaccctgcggttctttgaaggcttttgcctggcggggattatcctgaccttgtacgcactgaggatcgagttatgtcctcctggcaaacgattcatgattaccatggtcgccagcttcgtggctatggcggggcaattcctaatgcctgggctggccgctctctgccgcgactggcaggtccttcaggcactcatcatctgtcctttcctgctcatgttgctatattggagcatattcccggagagtttgagatggttgatggccacgcaacagtttgagtctgccaaacgcttgattctgcactttactcagaagaaccggatgaatcccgagggcgacattaagggagtgattcccgagctcgagaaagaactcagccggaggcctaaaaaggtgtgtatcgtcaaagtcgttggaaccagaaacctctggaagaacatcgtggttctgtgcgtgaattcactcacgggctacggcatccaccattgttttgctaggtcaatgatgggacatgaggtcaaagtcccactactggaaaacttctacgcagactactatactacagccagcattgccctagtgagctgcctggccatgtgcgtggtagtccgattcctgggtcggcgaggaggcctgttattgtttatgatcctgaccgccctagcttctctgttgcagctgggtctgctgaacctcattggcaaatacagtcagcaccccgacagtggcatgtctgattcagtcaaggataaattctcaatagccttttctattgttggcatgttcgcctctcacgccgttggcagcctgtcggttttcttctgtgcggaaataacacctacggtgatacgctgtggaggactgggattggtgctcgcttcagccggcttcggaatgttgacagcaccaatcatcgagctgcacaatcagaaggggtattttttgcatcacatcatattcgcctgctgcacactgatctgcatcatttgtattttacttctgcccgaatcacgagatcagaatctcccagagaacatctcaaatggggaacattacacccgtcaacctctgctgccgcacaagaagggggaacaacctctcctgcttacaaatgccgagcttaaggactactcagggctccatgacgcagctgccgccggagacactctccctgagggtgccactgcaaacgggatgaaagccatgtag

SEQ ID NO: 135003 - DNA, 1218 bp, Artificial Sequence
  Description of Artificial Sequence: Synthetic coding sequence
atgttctccacgctacgcttttttgaaggcttttgtctcgccggaattattttgacactctatgctctgaggattgagctgtgcccgcctgggaaaagattcatgatcaccatggttgcaagctttgtggccatggctggacagtttctgatgcccggcttggctgccctctgtcgggactggcaagtcctccaagccttaattatctgccctttcttacttatgctcctttactggagtatctttccggaaagcctgagatggctaatggctactcagcagtttgagagcgcaaagcgcttgatcttacattttacacagaagaatcgaatgaacccggaaggcgatatcaagggagtaatccccgaactggagaaggaattatccaggcggcccaagaaagtctgcattgtgaaagtggtgggcacccgcaatctgtggaaaaacattgtggtactctgcgtgaattctctgaccgggtatggcatccaccactgcttcgcccgaagcatgatgggtcacgaagtgaaagtgcctctccttgaaaacttctacgccgattattacaccacagcttcgatcgctctggtcagttgtctggccatgtgcgtcgtcgtccgcttcctgggtcgtcgcggaggactgttgctgtttatgattctgacagcccttgcctccctgcttcaattgggcttgttgaatctgattggcaaatatagtcagcatcctgactcaggcatgtcagactctgttaaagataagttcagtatcgcttttagtatcgtggggatgtttgcctcacatgcggtgggaagtttgagcgtgttcttctgcgctgaaatcactcccaccgtgatccgatgcggcggcttagggctggtcctggcaagtgctggtttcggcatgctaacagccccgatcatagaactccacaaccaaaagggctatttcctgcaccacattatcttcgcttgttgtactctgatatgtatcatatgtattctgctgctccctgagtcgcgcgatcaaaatctgccagagaacatttccaatggcgagcactatacccggcagcctctgctgcctcacaaaaagggggagcagcccctgctgctaacaaacgccgagcttaaagactattccggcctccacgacgccgcggctgcaggtgacacactgccagagggcgcaaccgctaacggcatgaaagccatgtag

SEQ ID NO: 135004 - DNA, 969 bp, Artificial Sequence
  Description of Artificial Sequence: Synthetic coding sequence
atggggttcgatgtgctcctggatcaggttggggggatggggcgctttcagatctgcttaattgccttcttctgcattacgaatattctattgtttcctaatattgttctggaaaactttactgctttcacgccctcacatcgctgctgggtgcctctgcttgacaacgatactgttagcgacaacgatacgggaacacttagcaaagatgaccttctcagaatcagcattccactggactccaacctccgccctcagaagtgtcagcgcttcattcaccctcagtggcagttactccacctgaatggaacctttccaaacactaacgagcctgatacagaaccatgtgtcgacgggtgggtgtatgaccgctcgtctttcctctctacgattgtcacagagtgggacctggtctgtgaaagccagtcacttaagagcatggtgcagtccttattcatggctggatctctccttggcggtttgatttacggccatctgagcgacagagtgggacgcaaaattatatgcaagctgtgtttcctgcaacttgctatcagcaacacctgcgcggccttcgcccccacttttttggtgtactgcatactgaggtttttggccgggtttagcacaatgacaattctgggtaataccttcattttgtccctggaatggacgcttccccgaagccgcagcatgactatcatggtgctgctttgttcatattcagtaggccagatgctgctgggtggcctggcattcgctatacaggactggcacatcttgcagttaactgtgtccacgccaataatcgtcctttttctctccagctggtatgagcaatcccctcactccttgccagtttccgaggcaatggtggacattgaacgtaaaatcctgacccccggcatctgctcagtctctggccttgttttgagccacgatgtacacagcacctactgtgtgacctag

SEQ ID NO: 135005 - DNA, 780 bp, Artificial Sequence
  Description of Artificial Sequence: Synthetic coding sequence
atgcgggcacaggaagatctggaaggtcgcactcaacacgaaactacccgtgatcccagtacccccctcccgacggaacccaaatttgacatgctgtacaaaatagaagacgtgcctccatggtacctctgtatattgctgggattccaacactatctgacatgtttttctgggacaatagcagtaccgtttttactcgcggaggcactttgtgtgggacacgaccagcacatggtaagtcagttaataggtacaatcttcacctgcgtcgggatgttctgtaccctctttgggatgataactgctgttggactctcgaatctgcagttcgtcgacatgaatagcagtaggaacctgtttgttttggggttctcaatgttttttggtctcactttgccgaactatctggagagtaatcctggtgcaatcaacactgggattcttgaagttgatcagatcctcatagtcctgctcacaacagagatgttcgttggcggctgtttggcttttatcctcgataacaccgttcctggctccccagaagaacgaggcctgatccagtggaaagcaggggcacacgctaattccgatatgagcagctcgctgaaatcttacgatttcccaatcggcatgggaatcgtgaagcgcatcactttcctcaaatatatccctatatgtcctgtcttcaagggtttctccagctctagcaaggaccagatcgcaatacccgaagacacccctgagaatacagaaactgcaagcgtttgcaccaaggtctag

SEQ ID NO: 135006 - DNA, 1797 bp, Artificial Sequence
  Description of Artificial Sequence: Synthetic coding sequence
atgcgggcgcaggaggacttagaaggacgcacacagcatgaaaccactagggacccaagtaccccattgcccacagagccaaagtttgatatgctctacaaaatagaggatgtcccaccctggtacctctgtatcttactgggttttcagcattatctgacttgtttttcagggaccattgccgttcccttccttctggccgaggctctgtgtgtcgggcacgaccagcacatggtctcacagctcatcggaacaatcttcacctgcgtggggattaccacactcatacagaccactgtggggatccgattgcctctgtttcaggcctctgccttcgccttcttggtgcctgccaaagccatcttggccctggagcgatggaagtgtcccccagaagaggaaatctacgggaattggagtttgccattgaacacctcccacatttggcacccacgaataagagaagtccagggcgccattatggtatctagtgtggtagaggtggtcatcggactcctcggattgccgggggcactactcaactatatagggccattgaccgtcacgcctacagtgtccctgatcggcctgtctgtgttccaggctgccggcgaccgtgccggaagccactggggtattagcgcctgtagtattctgctgattattctctttagccagtacctgaggaatcttacatttcttcttcctgtctatagatggggaaaaggattaactcttttgaggatccagatctttaaaatgtttcctattatgttggcaatcatgactgtgtggcttctctgttacgtcctgactctaaccgacgttctgcccactgatcccaaagcctacggttttcaggcacggaccgatgctcggggggatatcatggccattgcaccatggatcaggataccctacccctgtcagtgggggctgccaactgtgacagccgccgccgttctgggaatgttcagcgctacccttgccggcattattgaaagtatcggggattattatgcttgtgctcgtctggcaggggccccccccccccctgtgcatgccataaacagaggcatattcaccgaagggatctgttgtataatagctggactgctggggacaggtaacggcagtacctctagcagccccaacattggggtgttagggatcactaaggtgggaagtaggcgcgtggtgcagtatggagcagctatcatgctagtcctcgggacaatcggaaagtttaccgctctattctcgagcctgcctgatccaattctaggtggcatgttttgcactctgttcggtatgatcacggctgtggggctttcaaatctgcagttcgttgatatgaatagctctcgcaatctatttgttcttgggtttagtatgtttttcggcctgacgcttccgaattatttagaatccaaccctggagcaatcaacacaggaatcctggaagtcgatcagatcctcatagttctgcttactacagagatgtttgttggcggatgcctagctttcatcctggataatacggtccccggctcacccgaagagcggggactgatccaatggaaggctggcgcccacgccaattcggacatgtcctcatccctgaagagctatgattttcccatcggaatgggaatagtcaaacgcatcacatttctcaagtatattccaatatgcccagtgtttaagggatttagcagctcaagcaaggatcagatcgcaatacctgaagacaccccagagaataccgaaacagccagtgtttgcactaaagtgtag

SEQ ID NO: 135007 - DNA, 1809 bp, Artificial Sequence
  Description of Artificial Sequence: Synthetic coding sequence
atgcgcgctcaggaggacctggaaggcagaacccaacacgaaacaacgagggaccccagtacaccgctcccaacggagccaaagtttgatatgctttataagatcgaagatgtcccaccgtggtatctttgtattctattgggttttcagcactacctgacatgtttcagtgggacaatagcagttccttttctccttgctgaggcattgtgcgtgggacacgaccagcatatggtgtcccagctaatcggcaccatttttacttgtgtgggcatcaccacactgattcagactacggttggcataaggctgccattgtttcaggcttcggcgtttgcctttctggtgcctgcaaaggctatactggccctcgagcggtggaagtgccctcccgaggaggagatatatggcaattggagcttgcctctcaatacctctcacatttggcaccccaggatccgggaagtcggccttcacgtgcaaggtgccataatggttagttcggttgtggaggtcgtgattggactgcttggactgcccggagctctgctcaattatatcggacccctcacagtgacgccaactgtgtctttaattggactcagcgtgtttcaagccgctggcgatagggctggttcccactggggtattagtgcctgctctatcctcctgattatcctgtttagccagtacctaaggaatctgacattccttctgcccgtgtatcgatggggtaagggattgacactgctacggatccaaatcttcaaaatgtttcccattatgctggccataatgaccgtctggctcttgtgttatgtgctcacactcactgatgtgctgcctactgatccaaaggcatacggcttccaggcaaggacagacgcccgcggggatatcatggctatcgcaccctggattcggattccctacccatgtcagtgggggctgcccaccgtcacagcggcggctgtccttgggatgttcagcgcaacgctggcgggcatcatcgaaagcatcggagactattatgcatgtgcacggctcgccggcgctcctcctccaccagtgcacgctatcaacaggggcatattcactgagggaatttgctgtattatcgcagggctgctgggaactgggaacgggtccaccagcagttcaccaaacatcggcgtcttaggcatcaccaaggtgggctcccggagggttgtccagtacggggctgcaattatgcttgttttagggaccatcggaaaatttactgccctttttagttcgctgcccgacccgatcctcggcgggatgttttgcaccctgtttggaatgattacagccgtcggactgtctaacctacagttcgtggatatgaacagcagtcggaatctctttgtgctgggcttttccatgtttttcgggctgacactcccaaactacctagaaagtaaccccggcgccattaataccgggattctcgaagtcgaccagattttaatcgtgttactcacaactgaaatgttcgtgggcggctgtcttgccttcatcctcgacaatactgtccccggctcccccgaggaaaggggcttgatccagtggaaagcaggggcccacgctaactccgatatgagttctagtctgaagtcttatgattttccaattggcatgggaattgttaaacggattaccttcctgaagtacattcctatttgtcctgtgtttaagggattctcttcttcaagcaaggatcagattgctatcccggaagacacccctgagaacacagagactgcttccgtgtgtacaaaagtgtag

SEQ ID NO: 135008 - DNA, 1179 bp, Artificial Sequence
  Description of Artificial Sequence: Synthetic coding sequence
atgcgagctcaggaggaccttgaaggcagaacccagcatgagactacaagggacccttccacacctctcccaaccgagccaaaatttgacatgctttataaaatcgaggacgtgccaccctggtatctgtgtattctgttaggctttcagcattacctaacttgcttttcgggcacgatcgccgttccctttcttcttgcagaagccctgtgtgtgggacacgatcaacacatggtgtcccagcttatcggaaccatttttacttgcgtggggataacgacactgatacaaaccaccgtgggcataagacttccactgttccaggcttccgcatttgccttcctcgtcccagccaaagccattctggccctggaacgctggaaatgcccacccgaggaggaaatatacgggaattggtcactcccgctcaatacgtcccatatatggcacccacgcatccgcgaggtcgggctccatgtatcaattgaggaggctggaggctacatgggagtgagagtggcggcagagtttggcgatctgcggagatggtcgcgaagctttgttcccgcctcgagctcccaagttcagggggctatcatggtgtcttccgtggtagaagtggtcattggcttgctgggtcttcctggagcgctgcttaattatatcggacctctgaccgtcacaccgactgtgtccctcatcggactctcagtgtttcaggctgctggagatcgagccggatcacattggggaataagtgcctgctcaatcctgcttatcattcttttcagccagtacctgcgtaacttaacttttttgcttccgtgtgctcagcagagtgcgcccctgtggcaagctagcctgtccccgagtgaaattacaacccctgttcctgcctggctagtccaccatcctctccagtatatgttatccactggagccagctcacctaaagcctttgctgcgagttctagaggttactgggctcgcgcaaccgggcccccccgccccgtaccaaccctagcttcttgggaactgcctcgctgggctgcaggcgcttggtgttctatggtcaggctttcctgctggagctgggctccctccgcatcttcacggccaagttctcctaggtccctcactccttcctggggggcctgctctgcactgtcgctcgcttag

SEQ ID NO: 135009 - DNA, 1953 bp, Artificial Sequence
  Description of Artificial Sequence: Synthetic coding sequence
atgatgggaattgggaaaaataccacttccaaatctatggaggctgggtcctctacagagggcaagtacgaagatgaggccaagcacccggcctttttcacgctgcccgtggtgatcaacggaggcgcaacttcgagcggggagcaggacaacgaagatactgaactgatggccatttacacgacggagaatggaatcgcggaaaagtcttctctcgccgagactctcgatagcacggggtctctagacccgcagcgcagtgacatgatatacactatcgaagacgtccctccttggtatctgtgcatttttttaggtctccagcattatctcacctgtttctccggcactattgcggtgcccttcctgctcgcagatgccatgtgcgtggggtatgaccaatgggcgacgtcccagctaattggaactatattcttttgcgtgggaatcaccaccctgctgcagaccactttcggttgccgactgcctctgttccaggcatctgcatttgctttcttagcacctgcccgagcaatactatccctggataaatggaaatgcaatacgacagacgtctccgtagcaaatggcactgctgaattactgcataccgaacatatctggtatccgcgtatcagagaaatccaaggggccattatcatgagctcacttatcgaggtggtaatcggcctcctaggattacccggtgctctgctgaagtatatcgggccattaactatcacccctacggttgcattaatcgggctgtccgggtttcaagcggcaggagaaagggccgggaagcattggggcatcgctatgttgaccatctttctggtgctgttgtttagtcaatacgcaaggaatgtcaagttccctctgccgatctacaaaagcaagaagggctggaccgcttataagttgcagctgtttaaaatgtttcctattatactggccatcctggtctcttggttactctgctttatctttacagtcactgacgtgttccctcctgactcaacaaagtatggattttacgctcgcacagacgcaagacaaggggtactgcttgtggctccttggttcaaagtcccgtatccattccagtggggattacctaccgtttcggccgctggagtgattggaatgttaagtgccgtcgtcgcatctataatagaatcgatcggtgactactatgcttgcgcaaggctgtcatgcgcccccccccctcccatacacgcaatcaaccgtgggatattcgtcgagggactctcatgtgtgcttgatggcatctttggtacaggcaacgggagcacatcatcatcacctaatatcggagtcttggggattaccaaggtgggctcccggagggtaatccagtgtggcgctgccctgatgttagcccttggaatgataggcaagttttccgcattgtttgcctccctccctgatcctgtgcttggagccctcttctgtacacttttcgggatgatcacagctgtgggtttatccaacctgcagttcatagacttaaattcttcccggaacctcttcgttctggggttctccatcttttttggcttggtgttacccagctatcttcgacaaaatccgttggtgacagggattaccggtattgaccaggtgttaaatgtcttgcttaccacggccatgtttgttggcggatgcgttgccttcatcctcgacaatacgatccctgggacaccggaagaaaggggcataaggaagtggaagaaaggagtcggaaaaggcaacaagtctctggatggcatggaatcttataatctcccattcgggatgaatataatcaagaaatatcgctgttttagttacctccccatttcccctacgtttgtgggatatacctggaagggtctgagaaagtccgacaatagtagatcgtctgacgaggattcgcaagccaccggatag

SEQ ID NO: 135010 - DNA, 1953 bp, Artificial Sequence
  Description of Artificial Sequence: Synthetic coding sequence
atgatgggcattggaaagaatacaacctcgaaaagtatggaggccggatccagcaccgagggtaaatacgaggatgaagctaagcatcccgcctttttcactcttccagttgtgatcaacggcggcgctaccagcagcggagaacaggataacgaagatactgaacttatggcaatttacaccaccgagaacggaatcgccgagaagtcctccttagccgagactctggacagcaccgggagcctggacccacagagatcagacatgatctataccatagaagacgttcccccctggtacttgtgcatctttttaggcctgcaacactacttaacatgctttagcggcactatcgccgttcccttcttactggccgacgccatgtgtgtcggttatgatcagtgggctacaagccaactcatcggcacaattttcttctgcgtgggaattactacactgttgcagactactttcggttgccgcctaccgctgttccaggccagcgcttttgcattcctggcacccgcccgagcaattttgagcttggataagtggaagtgcaataccaccgacgtgtcagtggcgaatggcactgctgagctcttacataccgagcacatctggtaccctagaattcgtgagatccagggagcaataataatgtcttctcttatcgaagttgttatcgggttgctaggcctccccggcgctctcctgaaatatattgggcccctgaccatcacgcctaccgtggccctcattggactttcaggatttcaggcggctggggaacgcgctggcaagcactggggcatcgctatgcttactatcttcttggtattactgttcagccagtacgcaaggaacgtgaaatttcccctgcctatctataaatccaaaaaaggatggacagcctacaagcttcagttgttcaaaatgtttcctattatactggccatccttgtgtcctggctcttgtgctttatcttcacagtgacagacgtgtttccccccgacagcaccaagtacggtttttacgccaggacggatgctcgccaaggggtgctgttggtagcaccatggtttaaggtgccctacccattccagtggggattgcccacagtttcagccgccggcgttatcggcatgctgagtgccgttgtcgcttcaatcatcgaatctattggcgactactacgcctgcgccagacttagctgtgcacccccccctccaattcacgccattaatagggggattttcgtggaggggcttagttgtgtgcttgacgggattttcgggaccggcaacggtagcactagttccagccctaacattggagtcttaggaatcaccaaagtcggatccagacgtgtgatccaatgtggcgcagccttgatgctggcccttggaatgatcggcaagtttagtgcacttttcgccagtctgccagatccagtgctgggtgccctgttctgcaccctgtttggcatgattacagcagtgggcctgagtaatctacagtttatcgatctaaatagcagcaggaatctgttcgtgctcggcttttctatatttttcgggctggtgctaccaagctatctccgtcaaaatcctcttgtcactggaatcaccggcatagatcaagttcttaacgtgctgctgactactgccatgtttgtgggcggttgtgtggctttcatcttggacaacaccatccctgggaccccagaagagcggggaatccgaaaatggaaaaaaggcgtagggaaaggcaataagtccctggatggaatggagagttataaccttccctttggcatgaacataatcaagaagtacagatgcttctcttatctccctatttcgcctacattcgtcgggtatacgtggaagggcctgcggaagtccgacaacagccgttcaagcgacgaagatagccaggccacgggatag

SEQ ID NO: 135011 - DNA, 915 bp, Artificial Sequence
  Description of Artificial Sequence: Synthetic coding sequence
taagggtatgatcaatgggccacttctcagttaataggtaccatcttcttttgcgtgggcattaccactctgctacagactacattcgggtgtcggacaatttttctagtcttactgttttctcagtacgctcgcaacgtgaagttccctctgccaatctacaagtctaaaaaaggctggactgcatacaaactgcagttatttaagatgttccccatcatcctggcgatcttggtttcatggttgctgtgtttcattttcaccgtgacggacgtgttccctcccgacagcaccaagtatggtttctatgcccgcacggacgctcgccagggcgtgctactagtggcgccctggttcaaggtaccgtacccattccaatggggcctccccactgtcagtgcagccggcgttatagggatgttatccgcagttgtggcctcaatcattgaatccattggcgattattatgcctgcgctagactgtcatgtgcaccaccaccgcccattcacgccataaatcgtggaatatttgttgagggcctgtcctgcgtgttagacggcatcttcgggacgggcaacggatccacgtccagctctccaaacatcggcgtactaggcatcactaaggtcggatcaagaagagtcattcagtgtggagccgcactcatgctggctctggggatgattggtaaatttagcgccctgttcgccagtttgccagatccagtcctaggggcactcttctgcactttgttcggcatgattacagccgtgggtctttctaatctccagtttattgacctcaactctagcagaaacttgttcgtactcgggttttcaatttttttcggtctcgttctcccgtcctatctgcgacaaaatccccttgtgactgggattactggaatcgattag

SEQ ID NO: 135012 - DNA, 1611 bp, Artificial Sequence
  Description of Artificial Sequence: Synthetic coding sequence
atgatgggcattggcaagaacaccacttccaaaagtatggaagctggttctagtacggaaggtaaatacgaagatgaggcgaaacaccctgccttttttactcttccggtcgtcataaacgggggagccacttcttctggtgaacaggataacgaggacactgagcttatggcaatctataccacagagaatgggatcgccgagaaatcaagcctcgccgagaccctggacagcacaggcagtctggaccctcagcgatctgatatgatttatactattgaagacgtgccaccatggtacctgtgtatatttcttgggctgcaacattacttgacatgtttttctgggacaatcgcagtcccttttctgttagcggacgctatgtgtgtgggttatgatcaatgggctacttcacagctcataggtacgattttcttctgtgtgggaataacaacattgttgcagacaaccttcggatgtcggacgattttcctcgtgctgctcttcagccaatacgcccggaacgtgaagttcccccttcccatctacaagtctaaaaagggctggactgcttacaagctccaactgttcaaaatgttccctatcattttggccatcctcgtctcttggcttctatgcttcattttcactgtgacagatgttttccctccagactccaccaagtatggcttttatgccagaacagacgcaagacagggagtccttttggtggctccttggtttaaggtgccctatccattccaatggggactgcccacggtcagcgctgccggggtcattggtatgttgagcgccgtggtcgcctccatcatcgaatctattggcgactattacgcctgtgctagactcagctgcgccccacctccaccgatccatgccatcaaccggggcatattcgtcgagggactctcttgtgtcctggatggaattttcggtaccggcaatggatctacctcttcatcccctaatatcggagtccttggcataaccaaggtagggtcaagacgagtgatccagtgcggcgccgccctcatgttggcactgggcatgattggtaagttcagtgcactgttcgcaagcctgcccgatcctgtgctcggcgccctcttctgtacactattcggcatgataactgctgtggggctgtccaacttacagttcatcgacctgaattcctccaggaatctgtttgttctaggcttctccatttttttcggccttgtgctgccgagctatctgcggcagaatcccctggtcacggggatcacaggcatcgatcaggtgcttaatgtcctgctgaccactgccatgtttgtaggcggctgtgttgctttcatcctggataatactatcccaggaaccccagaagagcgaggcattcgaaaatggaagaaaggggttgggaaaggcaataaatcactggatggcatggagagctataatcttccttttgggatgaacatcattaaaaagtacagatgtttctcatatctgcctattagcccaacattcgtgggatacacatggaaaggcttgagaaagagcgacaattctaggtcttccgacgaggactcacaggcgactgggtag

SEQ ID NO: 135013 - DNA, 3300 bp, Artificial Sequence
  Description of Artificial Sequence: Synthetic coding sequence
atgggcaaactcatcaggatgggtccccaggaaaggtggctgctgagaacgaagcgattacactggagtcgcttactcttcctgcttggcatgttgatcatagggagcacataccagcatcttcggcgccccaggggactctcatcactatgggcggccgtcagcagtcaccagccaatcaagctggcctcccgggacctgtctagcgaagagatgatgatgatgtccagctctcccagcaagcctagtagcgaaatgggtgggaagatgctggtgccacaggctagcgttggctcagacgaagccacactctcaatgaccgttgagaacattcccagcatgcccaaacgcaccgccaagatgatcccaacaacgaccaagaataattactcaccgacagcagccggcacagaacggcgcaaagaggacacaccaactagcagccgaactcttacatactatactagcacctcctctagacaaatcgtgaagaaatacactccgactccaagaggcgagatgaagagctatagccctactcaggttcgcgaaaaggtcaagtatacacctagtccccgaggcagaagggtaggcacatacgtaccatcgacattcatgaccatggaaacttctcacgccattaccccccggaccacagttaaggatagtgacattactgcaacctacaagatattggagaccaattccctcaagcgcattatggaggaaaccacacccactaccctgaaaggcatgttcgatagtaccccaaccttcttgacccatgaagtggaagccaatgtgctcacctccccccgtagcgtgatggagaagaacaatctgttccctccccgccgtgtggagtcgaacagctcagcacatccttggggcctggtaggaaaatctaaccccaaaaccccccagggaaccgtgctgcttcataccccagccacttcggaaggtcaggtgactataagcaccatgacaggctcttcacctgcggagaccaaggctttcacagccgcttggtcccttcggaatccctcaccaaggacatcagtctcagcaattaagactgcaccagccatcgtttggaggcttgctaagaagccatccactgccccctctacctctacaacccctactgttagggccaaattgactatgcaggtccaccattgtgtggtagtgaagccaacccccgctatgctcacgacaccatcaccaagtctgacaaccgccttgttaccagaggaattaagtccttcacccagcgtgctgccaccatccctcccagacctgcaccccaagggtgagtacccacccgatctcttttcggtcgaggaacggaggcaggggtgggtggtcctgcacgtgtttgggatgatgtacgtctttgttgctctcgctatcgtgtgcgacgaatattttgtccctgcactcggggttatcactgataagctccaaatttccgaggatgtggctggggctaccttcatggccgcgggcggcagcgccccagaactgtttacttcccttattggcgtctttatttcgcatagtaacgttggcatcggcacaatagtggggagcgctgtgttcaatatactgtttgttatcgggacgtgcagccttttctctcgcgagatcctgaatttgacatggtggccattgttcagggatgtatctttttacattctggacctgattatgctgatacttttctttttggattctctgattgcctggtgggagtctctcttactcctgttagcctacgccttttacgtcttcaccatgaagtggaataagcacatcgaagtctgggtcaaagagcaattgtcgcgccggcctgtcgccaaggttatggctctcgaggacctcagtaagcctggtgatggggccattgcggtggacgagctgcaggacaataagaaactgaagctgccaagcctgctgacccgaggcagcagctccacgtcattgcacaacagcacaattcgtagcacaatctatcagctgatgttgcatagcctcgaccccctcagggaagtccgattggccaaggaaaaggaagaggaatccctgaatcaaggagcccgagctcagccgcaggccaaagctgaatctaagccggaggaggaagaacctgctaagctaccagccgttaccgtcaccccagccccggtaccggatatcaagggcgaccagaaggagaaccccggggggcaggaggatgttgccgaggccgagtccacaggagagatgccaggggaagaaggtgaaacagcaggggaaggggaaaccgaagagaaatccggcggggaaacacagcccgaaggcgagggagaaaccgaaacccaggggaagggagaagaatgcgaagatgaaaatgaagcagagggtaaaggcgataatgagggggaagacgaaggagaaattcacgccgaggacggggaaatgaagggcaacgagggagaaactgagtctcaggaactgagtgcagagaatcacggcgaggcaaagaacgacgaaaagggcgtcgaagacggcggtggaagcgatggaggtgattccgaagaagaggaggaagaagaggaggaacaagaggaagaggaagaagaggaagaacaggaggaggaagaggaagaggaggaggaggaagaggagaaaggcaacgaggagccgttgagcctcgactggcccgagacaagacagaagcaggccatctatctgttcctgttgcctattgtctttccactgtggttaacagtccctgacgtgagacgacaggaatctcgaaagtttttcgtcttcacatttctgggcagcattatgtggattgccatgttttcgtacctcatggtctggtgggcccatcaagtgggagagaccataggcatcagtgaggaaattatgggcctgactatcctggccgctgggacatccataccagatctgattacctccgtgattgtagcaaggaagggcctgggcgacatggcagtgtcgagcagtgtcgggagcaacatttttgacattactgtgggtctgcctgtgccctggctgctgttttcactaatcaacgggctgcagcccgtacccgttagctcaaatggattgttttgtgctatagtcctcctgtttctgatgctactgtttgtcatctcttcaatcgcctcctgtaagtggcggatgaacaagatactcggcttcaccatgtttctgctgtattttgtgttcctgataatttctgtgatgcttgaggacagaatcatctcctgccccgtgtcagtctag

SEQ ID NO: 135014 - DNA, 3246 bp, Artificial Sequence
  Description of Artificial Sequence: Synthetic coding sequence
atgggtaagttaattcgcatgggtccgcaggagcgctggctgttgaggaccaagagactccactggagtcggctactttttctgctaggtatgttaatcatcggcagcacatatcaacatctgcgaagacccagggggttgtctagcttgtgggctgcagtgagctcccatcagcccatcaaactggcgagtagagatttgtcctctgaggaaatgatgatgatgagtagttcccccagtaaaccaagctcagagatgggcggaaagatgctagtaccccaagcttccgtgggaagtgatgaggctaccttgtctatgacggtggaaaatatcccctcaatgccaaaacgcacagccaagatgatcccaaccactaccaaaaacaactattcacctactgccgccggcacggagcggcgtaaggaagacactcccaccagctctcgcactctaacctattatacgagcacttctagtaggcaaatcgtgaagaaatacacccccactccacgtggggaaatgaaatcttacagcccgacccaggttagagaaaaagtgaagtataccccaagccctcgaggtcggagagtcggcacatatgtgccatcaacatttatgaccatggagaccagccacgcgatcaccccgagaacaactgttaaagattcagatattacagctacttataaaatcctcgaaaccaatagcctgaaacgcatcatggaagagacaacgcctactactctcaaagggatgtttgactccactccaacctttttaactcatgaagtcgaagccaatgtactaactagcccaagaagcgttatggagaaaaataacctatttccacccaggcgggtcgagagcaactctagcgcacatccctggggtcttgtagggaagtctaatcccaaaaccccacaaggcactgtcttgcttcacacacccgctacttccgagggtcaagtcacaatatctacaatgacaggtagttcccctgccgagactaaagcctttactgccgcctggagcctgcggaacccctccccaagaacttctgtgtccgccataaaaactgcgcccgccattgtctggcggctagccaaaaagccatccacagccccgtctaccagcacaacccctaccgttcgggcaaagttgacgatgcaggttcaccactgtgttgtcgtgaagcccacccccgccatgctgacaacgccttcacctagtctgaccaccgccctgctccccgaggagttgagcccgagcccttcagttctcccaccttctctgccagaccttcatcccaagggcgagtatccaccagacttgttctctgtggaggaaagacggcagggttgggtcgtgctccatgtgtttggtatgatgtacgtcttcgtggccctggcgatcgtgtgtgatgaatatttcgtcccggcattaggggttattaccgataaactccagatctcagaggacgttgcaggtgccacattcatggcggctggaggatcagctcctgaattgttcaccagcctcatcggagtgttcatcagtcacagcaatgtagggataggcacaattgtcggctcagccgtgttcaacattcttttcgtgatcgggacctgcagtctcttcagccgcgaaattctcaacctgacttggtggccactctttcgagacgtgtctttttatattctggatctcatcatgctgatactgtttttcctcgacagcctgatagcttggtgggagtccctgctacttttgctggcatacgctttctatgtgttcactatgaagtggaacaagcatatcgaagtctgggtaaaagaacaattaagtagacgcccggtggccaaggtaatggccctggaggacctgtccaagctgccttccctcctgactcgggggagctcttctacgtccctgcacaacagtacgatcaggtcaaccatatatcagctgatgttgcacagcctggacccactgagggaagtccggctggctaaggagaaggaggaggaatccctcaaccagggggccagagcccagccccaggcaaaagctgagagcaaacccgaggaggaggagccagcaaaactccctgcagtgaccgtgacacccgctcctgtgccagacattaagggtgatcaaaaggaaaatccagggggacaagaggacgtggccgaggcggagtcaactggcgagatgcccggagaagaaggggagactgctggtgaaggagagacggaagaaaaatccggtggggaaacccagccagagggcgaaggggaaacggagacccaggggaaaggcgaggagtgtgaagacgagaacgaggctgagggaaaaggcgacaatgagggcgaagacgagggagagatacacgccgaggatggcgaaatgaagggcaacgaaggcgagaccgaatcccaggaactctccgcggagaatcatggcgaggctaaaaacgatgagaagggggtcgaggatggcggcggctctgatggtggcgacagcgaagaggaggaagaagaagaggaggaacaggaagaagaagaggaggaagaggagcaggaggaggaagaggaggaggaagaagaagaggaggaaaaaggaaatgaggagccgctgagcctagattggcctgaaactagacagaaacaggcgatatacctgtttctcttaccgatcgtgttccctttgtggctgactgttcctgatgtgcgcaggcaagagtcacgcaaattttttgtgtttactttcctgggtagtatcatgtggattgcaatgttttcatatctgatggtgtggtgggcccaccaggtgggtgagaccatcggtatttcggaagagattatggggctcactattctggcagcagggacgtccattccagacctgatcacttctgtgattgtcgccaggaagggtctgggggacatggctgtcagttccagcgttggaagcaacatattcgatattaccgtcgggctgccggtcccttggctgctgttcagcctcatcaacggcctgcagcctgtgcctgtgagtagcaatggcctcttttgcgcaatcgtgctcttgtttctgatgctgctgttcgtgataagcagcatagcaagttgcaagtggaggatgaacaaaattttgggatttacaatgttcctgctctattttgtgttcctgattattagcgtaatgctggaggatcgcattatatcttgccccgtttccgtgtag

SEQ ID NO: 135015 - DNA, 3210 bp, Artificial Sequence
  Description of Artificial Sequence: Synthetic coding sequence
atgggtaaattgattcgtatgggaccccaggaacgctggctcctgaggacaaaacgcctacattggagtcgccttttgtttttattgggaatgctgattattggtagtacttaccagcatcttagacggccacggggcctatcttctctctgggcagcagtctcatcccaccaaccgatcaagcttgcttcaagggacttgtcatccgaggagatgatgatgatgagctcatctcctagcaagccatccagcgagatgggaggtaaaatgctcgtgccccaagcttcagtagggtcagacgaagcaacgctcagcatgaccgttgagaatattccttccatgcctaagcgcacagcaaagatgatacctaccacgacgaaaaataactatagtcctacagctgcaggtactgaaagacggaaggaagatacgcctacgtcatctcggacactgacttattacacctccacttcgtcacggcagatcgtcaaaaagtacacacccacaccacgcggggaaatgaaatcatactctccaactcaggtcagagagaaggtcaaatacactccttcgcctcgtgggcgccgagtgggtacttacgtcccatccacttttatgactatggagacatcgcacgccattactccaagaaccacggtgaaggactcggacattaccgcaacatacaagatcctggagacaaatagtctcaagaggatcatggaggagacgacacctactacactcaagggcatgtttgactctacccctactttcctaactcatgaagtggaggccaacgtcctgacctcaccgcggtcagtgatggagaaaaataatctgttccccccgagacgggtagagtcgaactcgtcagcccacccttgggggttggtcggcaagtcgaatcccaaaactccacaaggcacagtgctgctgcacacccctgccacctcagaaggacaagtgactatcagcaccatgacaggaagctcaccagctgaaactaaagccttcaccgcggcgtggagtctcagaaatccatccccacgcacctctgtcagcgccataaagacagcccctgctatcgtgtggcggctcgccaagaaacctagtaccgcccccagcacatctactacaccaaccgtgcgagctaaactgaccatgcaggtacaccactgcgtggtggtgaagcctacgcctgctatgctgacaacaccctcgccatcactgactactgctcttctccccgaggagttatccccgtcaccaagcgttctgccacccagtctgcctgacctgcaccctaagggcgagtatccacctgatctcttctccgttgaagaaaggaggcaggggtgggtcgtgctgcacgtcttcggtatgatgtacgtctttgtggccctggccattgtttgcgatgaatactttgtgcccgcactgggtgtgattactgataaactgcagatcagcgaagatgtagccggggctacttttatggcagccggtgggagtgcgcctgagctgttcacgtctctcataggagtctttattagccactccaatgtgggcataggcaccattgtcgggtcagccgtgtttaacatactttttgtcatcggcacctgctctctctttagcagagagattctgaacctgacttggtggcctctgttcagggatgtaagcttctatattctggaccttataatgcttattctgtttttcctggatagtttgattgcttggtgggaaagcctactccttttgctggcctatgcgttctatgtatttacaatgaagtggaacaagcatatcgaggtgtgggtaaaagaacagctctcaagaagaccagttgccaaggtgatggccctagaggacctctctaaaccgggggacggcgccatcgccgtggacgaactgcaggataacaagaaactgaaattaccttccctcctaacaaggggcagcagctcaacatcattacacaattcaacaattaggtctacaatttatcagctgatgctgcactcactggatcccctcagagaagtccgattagccaaggagaaagaggaggaatctctgaaccagggcgcgcgtgcgcagccccaggcgaaggctgagagcaagcccgaggaagaagagcctgccaaactgcctgcagtgacggttaccccagcgccagttcctgacatcaaaggagatcagaaagaaaatccaggggggcaggaggacgtcgctgaagctgagtctactggggagatgccgggtgaagagggcgagacagccggggagggggaaacggaggagaaaagtggaggcgagactcagcctgagggtgaaggcgagacagaaacgcagggcaagggcgaggaatgtgaggatgaaaacgaagcggaggggaagggtgataatgaaggagaagatgaaggcgaaatacatgcagaggatggtgagatgaagggcaatgagggggaaaccgagtcacaggagctgagcgcagagaaccacggcgaagccaaaaatgacgagaagggggtggaggatggcggaggatccgatggcggagatagcgaggaggaagaagaagaggaagaggagcaagaggaagaggaagaggaagaggagcaggaggaggaggaagaggaagaggaagaggaggaggaaaaaggaaatgaggagcccctttcactcgactggccggagacccgccagaagcaggcaatctatctatttctcctgccaattgtttttccactctggctgactgtcccggatgtgaggcgccaggtcggagagaccatcggaatctccgaagaaattatgggcctaactattctcgccgcaggaacgtctattcctgatcttatcacaagcgtgatagtggccagaaaggggctcggcgacatggctgtgagttccagtgtgggatctaatatattcgatattactgttgggttgcctgttccgtggctcctgttcagtctgattaacggcctgcaacccgtaccagtcagttcaaacggcctgttctgcgccatcgttctgcttttcttgatgttactgtttgttatatccagtattgcgagctgcaaatggaggatgaacaagatcttgggcttcactatgtttcttctgtattttgtgtttcttatcatttccgtgatgttggaggatcgaattatttcatgccccgtgtctgtgtag

SEQ ID NO: 135016 - DNA, 3246 bp, Artificial Sequence
  Description of Artificial Sequence: Synthetic coding sequence
atgggaaaacttattcgcatgggcccccaggagagatggctgctgagaacgaaacgcctccattggagccgcctgctgttccttctcggaatgctgatcatagggagcacataccagcatctccggcggccgaggggcttgagcagtctatgggcggctgtgagctcccatcagcctatcaagctcgccagtcgcgacctgagttctgaggaaatgatgatgatgtctagcagtcccagtaaaccatccagcgagatgggcggcaagatgctcgtgccgcaggcgagtgtgggcagtgatgaagcaacattatctatgacagtagagaacatcccctcaatgcccaaacgcacagccaaaatgatcccgacaacaaccaaaaacaactacagtccgacagccgcaggcaccgagcgccgtaaagaggacactccgacatcgtcacggacgcttacctactacacaagcactagctcccgacagatcgtaaagaaatatactcccactccacgaggcgaaatgaagtcttattctcctacacaagtgagagagaaggtcaagtacactccctctcctcgcggtaggagggtgggaacatacgtgcctagcacgtttatgacgatggagacgagtcacgctattacccctcgcaccacagtgaaagactccgacattactgctacctacaaaatcctggaaactaacagcctcaagcgaatcatggaagagactacccccaccactttaaagggcatgtttgattcaacgcctacgtttttgactcatgaggtcgaggccaatgtgctcactagtccacgttctgtgatggaaaaaaacaatctgttcccccctcgtagggtggagagcaactcttccgcgcacccctggggtctggtggggaagtcaaatcccaagaccccacagggcaccgtgctcctgcacacacctgcaacgtctgagggacaggtcacaataagcactatgacgggctcctcacctgctgaaaccaaggccttcacagctgcttggtctctccggaatccttccccgagaacaagtgtgtcagctatcaaaacagcccctgccatcgtctggaggctggccaagaaaccgagtaccgctcccagcaccagcacaacacctacggtaagagcaaaactgaccatgcaggtacaccattgcgtcgttgtgaagccaacccccgctatgctgacaacaccaagtcctagtttgacaactgcgttactgcccgaagaattaagcccatccccgtccgtgctaccccccagcctgcctgatctgcaccctaagggcgagtatccccctgacctcttctccgtcgaggaaagaaggcaaggatgggtcgtcctccacgtgttcggtatgatgtatgtcttcgttgccctcgccatagtctgtgatgagtactttgtaccagccttgggagttataacggacaagcttcagatatctgaagacgtggctggcgctaccttcatggccgctggcggcagtgcccctgaactctttaccagcctgataggtgtgtttattagccacagcaacgtgggcattggcaccatcgttggcagcgcagtcttcaacattctcttcgtcattggcacctgctcccttttctctagggaaatacttaatttaacttggtggccgctcttcagggatgtgtccttctacatcctagatctcattatgttaatcttattctttctggacagcttgatcgcttggtgggaatcattactcttactgttggcctacgccttctatgtgttcactatgaaatggaacaagcatatcgaagtttgggttaaagaacagctgtctcgaaggcctgtcgccaaggtcatggctctggaggatctgtcaaaattacccagcctgctaactagaggttcgtcaagcacctctctgcacaatagtacaatcagaagcactatttaccagttaatgctgcactcacttgacccgctccgtgaggtgcgccttgccaaagaaaaggaagaagaatctctcaaccagggagccagggcccagcctcaagcaaaagctgagtctaagccagaagaagaagaacccgccaagttacccgcagtcacagtaacccctgctcccgttcccgacatcaagggggatcaaaaggaaaatcctggagggcaggaagacgtggcggaggccgagtctacgggggaaatgcctggggaggaaggcgaaacagcaggggaaggagagacggaggagaaatctgggggtgaaacccagccagaaggcgaaggtgagactgagacccagggcaagggtgaggaatgtgaagatgaaaacgaagctgagggtaagggcgacaatgagggagaggacgaaggtgagattcacgcagaggacggcgagatgaaaggcaatgaaggggagacagagagtcaggagctgtctgccgaaaatcacggtgaagccaaaaatgacgagaagggggtcgaggacggaggcgggtctgatgggggagacagcgaggaggaagaagaggaggaagaagagcaggaggaagaggaggaggaagaagagcaagaggaagaggaagaggaggaagaggaggaggaagaaaaggggaatgaggagcccctgtctctagactggcctgaaacccgccagaagcaggctatatatctgtttctactgccgatcgtctttcctctgtggcttacggtcccagacgtgcgtcggcaagaaagcagaaagttcttcgttttcactttcctcgggtccattatgtggatcgcgatgttcagctatctcatggtgtggtgggctcaccaggtgggcgagacaatcggcatctcggaagaaattatgggcctgactattctggcagcaggtacgtcgattcctgatctgattacatccgtgatcgtggctagaaagggcctgggcgacatggcggtatctagcagcgtggggtctaacatctttgacatcacagtgggtttgcctgtcccttggctactgtttagcttaatcaacggactgcaacctgtgcccgttagttctaacgggctgttttgcgcgattgtcttactcttcctgatgcttctctttgttatcagctctattgccagctgcaagtggaggatgaataagattctcggcttcaccatgttcctactctattttgtctttttgattatcagtgtgatgctagaagatcgcattattagttgtcctgtgtccgtgtag

SEQ ID NO: 135017 - DNA, 1935 bp, Artificial Sequence
  Description of Artificial Sequence: Synthetic coding sequence
atggacctgcagcagtccacgaccatcactagtctggagaagtggtgtctggatgagtcactgtctgggtgtagacgccactacagcgtcaagaagaaactcaagctcattagggttctgggtcttttcatggggctagtcgccatcagtacggtgtcttttagcatcagcgccttttccgagaccgacacccagagcacgggggaagcctctgtagtgagtggtccgcgcgtggctcaaggttaccaccagagaaccctactagatctgaacgacaaaatcttagactataccccccagccccccctgtccaaggagggcgagtccgaaaattccaccgatcatgcccagggcgattacccgaaggacatcttttctctggaggaacgacggaagggtgcgattattcttcatgtgatcggcatgatttatatgtttatagctcttgctattgtttgcgatgagtttttcgtgcccagcctcactgtgataacagagaagcttggtattagcgacgacgtcgccggagccactttcatggcagccggaggctctgcacctgaactctttacatctcttatcggagtattcatcgcccacagcaatgtaggcattgggaccatcgtagggtcagcagtgttcaacatactcttcgtgattgggatgtgcgcactttttagcagagagattctgaaccttacctggtggccacttttccgagacgtctcattttacattgtcgatcttatcatgttgatcatctttttcctagacaacgtcatcatgtggtgggagagcttactgctgctcactgcatacttttgctatgttgttttcatgaaatttaacgttcaggtggagaagtgggtcaagcagatgattaaccgtaataaagtggtaaaggtcacggcaccggaggcccaggcaaagcccagcgctgcgcgcgataaagatgaaccaactctcccagcaaaaccgaggttgcagcgcggcgggtcctccgcctcgcttcacaacagcctgatgcggaactccatctttcagctgatgattcatacactcgatcccttagcagaaggccgcttcagagagaaggcttctatcttgcacaagatagcaaaaaaaaagtgtcatgtggatgaaaatgagcgtcagaatggggccgccaaccatgtggagaagatcgaactgcctaactcgactagtaccgacgtggaaatgacaccaagcagcgacgctagtgaaccggtgcagaacggtaatttatctcataacatcgaaggggcggaagcccagacagccgacgaggaggaagatcagccactgtctctggcgtggcctagcgaaacacggaaacaggttacttttctcattgtatttccaatcgtatttccgctgtggattacgttacccgatgttaggaaacccagttccaggaaatttttcccaatcaccttttttggctccataacctggatcgctgtcttttcctacctgatggtttggtgggcacaccaggtcggggaaaccattggcatctctgaggagatcatgggtcttaccatcctggcagctggaacctccatccctgacctgatcaccagcgtgatcgtcgctcggaagggcctgggcgacatggctgtgagtagctccgtaggaagcaatatcttcgatatcaccgtcggcctgccgctcccttggctgctgtacactgtaatacaccggttccagcccgtggcggtgagttctaacggactgttttgcgcgatcgtgttactgtttattatgcttctttttgtcatcctgtccattgccttatgtaaatggaggatgaataagatcctgggcttcattatgttcggattgtacttcgttttcttggtggtttctgttctactcgaggatagaattcttacgtgccccgtatccatatag

SEQ ID NO: 135018 - DNA, 1986 bp, Artificial Sequence
  Description of Artificial Sequence: Synthetic coding sequence
atggacctccaacagagcacaacaattacttcccttgagaaatggtgcctggatgagagcctgtccgggtgtagaaggcactactcagtgaagaagaaacttaaattgattcgcgtgctcggactgtttatgggcctggtggccatctcaaccgttagctttagtatcagcgcgttctccgaaactgatacccagagcaccggcgaagctagtgttgtaagcggcccccgggttgctcaaggatatcatcagcgtacacttctggaccttaacgacaagatactggactataccccccagcctccactaagcaaggagggtgaaagtgagaattctacagatcatgcccagggggactatccgaaagatattttttccctggaagaacgaaggaaaggcgcaatcatcctgcatgttatcggcatgatttatatgtttatagcactggctattgtttgcgatgagttcttcgtgccatctcttacagtgatcacagaaaaactggggatatcagatgacgttgccggcgccacgttcatggccgccggaggctccgcccccgagctcttcacttctctgatcggcgtgttcatcgctcactctaacgtgggcatcggaacaatagtggggtcagcagtgtttaatatcctcttcgttattggaatgtgcgccctatttagccgcgagattctcaatctgacatggtggcctttatttagggatgtgtcattttacatcgtggatctcattatgctgatcatctttttcttggacaacgtgatcatgtggtgggagtctcttctactcctcacagcatacttttgctatgtggtcttcatgaaatttaacgtgcaggtagaaaagtgggttaagcagatgatcaaccggaataaggttgtaaaggtcacagcgcctgaggcccaggcgaagccttccgctgcacgggacaaggacgagcctactttgccggccaagcctcgcttgcagcggggggggtcctccgcgagcctgcataacagcctaatgcggaattccatcttccaacttatgattcacaccctggatcccctggctgaagaattgggttcttatggcaagctgaagtattatgatactatgaccgaggagggtcgttttcgggagaaggcaagtatattgcataagatagccaaaaaaaaatgccacgtcgacgaaaacgaaagacagaacggtgctgctaaccacgtggagaagattgagctgcccaatagcacatcaaccgacgtcgagatgacaccttcttctgatgcctccgagcccgtgcagaatgggaatctgagtcataacatcgagggggccgaagcacagactgccgacgaggaagaggatcagccattatccctggcatggccatccgagacgcgtaagcaggttacctttctgatagtgtttcccatagtatttcccctctggattaccctcccagatgtccgtaagccctcctcgaggaagttcttcccaattacattcttcggcagcataacatggatagctgtattctcctatctcatggtgtggtgggcccaccaagtgggggagaccatcggaataagtgaggaaatcatggggttaacaatattagccgcggggacatccatcccagacctgattacatccgtgattgtggcccggaaagggcttggggatatggcagtctcaagcagtgtgggcagtaatatcttcgacattactgtcggtcttccgctgccctggctgctctatacagtcattcaccggtttcagcctgtggcagtgtcttctaacggcttgttctgcgccattgtgctgttgtttattatgctgttgtttgttatcctatccattgcactctgtaagtggaggatgaacaagatactgggctttattatgtttggcctttactttgtgtttttggtcgtgtccgttttattggaagacaggatcctcacatgccctgtgagtatctag

SEQ ID NO: 135019 - DNA, 1935 bp, Artificial Sequence
  Description of Artificial Sequence: Synthetic coding sequence
atgcggcctagtggtgatgaagatagggctagaagaagacggcgccgaagacgtagacgtgatctgttgttgagtcagttgtgcttcctagcgagtgtcgccctgctcttatggtcactgagctccttgcgcgaacagaaagagctggatctgatggatctcgttggcgaggaccggaagtggatgatggcaaggaaactgatgcaagtcaatgatactctgacctctgaggatgcaggactacgaaactctaagaactgcactgagcccgcacttcacgaatttcccaatgacatttttaccaacgaagatcgccgtcagggagccgtcgtgttacacgtactgtgtgccatctacatgttttacgcccttgccatagtatgtgacgatttctttgtcccttccctggagaagatatgcgagcgcctgcacctcagcgaagatgttgccggagccacgtttatggcagcgggtagcagtgcaccggagctgttcacttctgtcataggggtattcatcactaagggagatgtgggggtgggaacaatcgttggaagcgctgtcttcaacatcctctgtattatcggggtatgcggcctcttcgcaggacaggtggtggcactctcgtcctggtgtcttcttcgggattcaatctattacactttaagcgttatagctttgatagtcttcatttacgacgaaaaggtgtcctggtgggagtctcttgtgttagtgctcatgtatcttatttacattgttataatgaagtacaatgcctgtattcatcagtgcttcgaacgacgcactaaaggggcaggtaacatggttaacggtctcgctaataatgctgagatcgatgacagcagtaactgtgacgctaccgttgttctgcttaaaaaggccaacttccatcgcaaagcctcagttatcatggtcgatgaattattgtcagcctacccccaccagctgagtttctctgaggccggtctgaggatcatgataacttctcatttcccacctaaaacccgactctcaatggcttcccgcatgctcatcaacgaaaggcaacggctgatcaatagcagggcctacacaaatggggagagcgaggtggccatcaaaatcccgatcaaacacaccgtcgaaaacggtaccggacctagctcagcccctgaccggggcgtgaacggcaccaggcgggacgatgtagttgcagaggccgggaatgagacagaaaacgaaaatgaagataacgaaaatgacgaagaggaagaagaagatgaagacgacgacgaggggccttatacgcctttcgacacacccagcggaaagcttgagacagtaaagtgggccttcacttggcctctgagttttgttctctattttacggtccctaactgcaataagcctagatgggagaaatggtttatggtcaccttcgctagcagtactctttggatagcagcattctcttatatgatggtgtggatggttacgattatcggctacaccctgggcattcccgacgtcattatgggcattacctttctcgcggccggaacctcggtgccggattgcatggcttctctgatcgtagcacgtcagggtatgggggatatggctgtatccaactccatcggatctaacgtgtttgatattctgatcggcctggggctaccatgggctctgcagactctagcagtcgattatggttcgtatattcgcctgaacagcagaggactgatttacagcgtgggcttgctcttggcatcggttttcgttacagtttttggcgtacatctgaataagtggcagctggataagaagctgggctgtggttgtctgctgttatacggagtgtttctgtgcttctcgattatgacggagttcaatgttttcacctttgttaatctgcctatgtgcggggaccactag

SEQ ID NO: 135020 - DNA, 1755 bp, Artificial Sequence
  Description of Artificial Sequence: Synthetic coding sequence
atggctggaagacgactgaacttgagatgggccctttctgtcctgtgcgtgctgctaatggccgagaccgtatccgggactcggggatccagcaccggggcacacatctccccccagtttccggcgtctggcgtaaatcagacaccagtcgtggactgcagaaaggtctgcggtctgaatgtatctgataggtgtgactttatccggacaaatccggattgtcacagcgatggcgggtaccttgattaccttgagggcatcttctgccatttcccccccagcctcctgcccctggctgtgaccctttacgtgtcctggctcctgtatttgttcctgatccttggggtgacagccgccaaattcttttgcccgaacttgtctgcaatcagcaccaccctgaagttgagccacaatgttgccggggttacttttctggctttcggaaacggggcccctgatattttttccgcattggtggcatttagcgatccccacacagccggccttgcgctgggcgcactattcggggccggcgtactggtgactactgtggtggcagggggcattacaatccttcatccgttcatggcagccagcagacccttctttcgagacatcgtgttttacatggtcgccgtgtttctgactttcctcatgttattccgtgggcgggttacgctggcgtgggctttaggttatttgggcttgtacgtcttctatgtagttacagtgattttgtgtacctggatttaccaacgacaaagaaggggatctttgttctgccccatgcccgtgacgcctgagatactatccgattccgaagaggatcgtgttagctccaacaccaattcttatgattatggcgatgaatacaggccattgttcttttatcaggaaactactgcccaaatactagtccgtgccctcaaccctctggactacatgaagtggcggcggaaatccgcttactggaaggcgttaaaggtgttcaaactgcctgttgaattcctgctcctgctcacagtgcctgtggtagaccctgataaagatgaccagaactggaaacggccgctgaactgcctccatctggtaattagccccctggtggtagtgctgacactacagtccggaacctacggcgtctacgaaatcgggggcttagtacctgtatgggttgtggttgtaatcgctggtactgccctggcttctgtgaccttcttcgctacgtctgacagccaaccccctaggctccactggctctttgctttcctggggttcctgacttccgctctctggatcaacgccgcagccactgaggtggtcaatatcctgcgatctctgggcgtagtattcaggctttcaaacaccgtacttggattgactcttctggcttgggggaacagtatcggggacgctttttccgattttactctggccagacaggggtatccacggatggccttttctgcatgtttcggcggtataattttcaacatccttgtgggggttggcctggggtgtttattacaaatctcaagaagtcacacagaagtcaaactggaaccagatggtctactggtgtgggtgttagcaggggcgctgggactaagcctggtcttctctctcgtcagcgtgccactgcagtgttttcagctcagtcgggtgtatgggttttgcctcctgctcttttatctcaactttcttgtggttgcactgttaacggaattcggcgtcatacacctgaaatcaatgtag

SEQ ID NO: 135021 - DNA, 1587 bp, Artificial Sequence
  Description of Artificial Sequence: Synthetic coding sequence
atggcgggaaggcggttaaacctgcgctgggccttgagcgtactgtgtgtgctgcttatggcagaaactgtgtccggtacgagagggtccagtacaggcgcccatatttccccccagtttcccgcctcaggagttaaccagactcccgttgtggattgcagaaaggtttgcggcttaaatgttagtgatagatgtgacttcatccggactaatccggactgccactctgatggtgggtacctggactatctggagggaatattctgccacttcccgccatctttactcccccttgccgtgactctctacgtctcatggctgctgtatcttttccttatcctgggcgtcacagcggccaaatttttctgtccaaatttaagcgctatcagtaccacactgaagcttagccacaacgtcgcaggcgtgactttccttgcatttggcaacggtgcccctgacatcttctcagcgctcgttgcttttagtgatccacacacagctggtcttgcgctcggggccctgttcggctacctggggttatatgtattctatgtggtcactgtaatcttatgtacgtggatctatcagcgacaacgtagaggctcactcttctgcccaatgcctgtcaccccagagatactatctgactccgaggaggatcgtgtcagcagcaacacgaatagttatgattatggggacgagtacagacccctgttcttttatcaggagaccaccgcccagattctggtcagggccctcaatccgcttgattacatgaaatggcggcggaaaagtgcctactggaaagctttgaaggtattcaaactgccggtagagttcctgctgctgctgaccgtgcccgtcgtcgatcctgacaaagatgatcaaaactggaagagacctttgaattgtctgcacctggtgatatcccctctggtggtcgtgctgactctgcaatctggtacatatggcgtatatgagattggcgggctggtcccagtatgggtggttgtggttatcgcagggactgccctggcctctgtcaccttttttgccacaagcgatagtcagcctccaagactgcactggctcttcgcctttctgggatttctgacatccgctctctggattaacgcagcagccaccgaagttgtgaacattttgagatccctcggcgtggtctttcggctcagtaacaccgtactgggcctcacactgctcgcgtggggcaactcaattggagacgctttcagcgactttacccttgctaggcagggctatcctcggatggcattcagcgcgtgcttcggcggaatcatattcaatattctggtaggggtcggtctgggctgtctgttgcagatctctcgctcccacactgaggtaaagcttgaaccagacggtcttctggtgtgggttctcgcaggtgccctcgggctcagtttggtgttcagccttgtgagtgtgcctctccagtgcttccagctgagcagggtgtatggattttgcttgctgctgttttacctgaactttttggttgtggccctacttacagagttcggggtgatccatctcaagtccatgtag

SEQ ID NO: 135022 - DNA, 1587 bp, Artificial Sequence
  Description of Artificial Sequence: Synthetic coding sequence
atggctggccgtagattaaaccttaggtgggccctctctgtgctgtgcgttcttctgatggcagagaccgtgtccggcaccagaggatcctcaaccggggcgcacatatctccacagtttcctgcatctggtgtcaatcaaacgcccgtggtggattgtcggaaagtctgcggcttaaatgttagcgatagatgcgacttcatccgtaccaaccccgactgccactccgatggaggttacctggactatttggaaggcatattctgtcacttccccccctccttactacctctggcggtcacattatatgtttcatggctcctttacctcttcttgatattgggcgtgaccgcagccaagttcttttgtcctaatctgagtgcaataagtacaactctaaaactttcccacaacgtggccggtgttacctttctcgccttcggtaatggagcgccagacatcttctcagctttggtcgcattctcggacccccatacggctggacttgcgctgggcgcccttttcggatatctgggcctttacgttttctacgtcgtcactgttattctctgcacgtggatttaccagcgtcaacgcagggggtctctattttgcccaatgccagtaacccccgaaatcctgagcgatagtgaggaagaccgagttagctccaacaccaatagctatgattacggagacgaatatcggcccctatttttttatcaagaaacaaccgcgcaaatcttagtgcgtgccctcaatcccctggactacatgaaatggaggcgcaaaagcgcatattggaaggccctgaaggtatttaagctgccggtggaattcctgctgctgctgactgtccccgtggtggatccggataaagacgatcaaaactggaaacggcccctgaattgcctacatctggtcatcagtccattggtggtcgtccttacgctgcaatcaggaacttacggggtctacgagatcgggggccttgtacctgtgtgggtggtggtcgtgatagccgggaccgctctggcctccgtgaccttttttgccacttctgactcacagccgccccggctccactggctctttgcattcctgggatttctaactagtgcactgtggattaacgccgccgcaactgaggtggtgaacatcctgcggagcctgggtgtagtgttccggctgtccaataccgtgcttggactaaccttgctggcctgggggaactccattggggacgcctttagcgactttaccctcgccagacaggggtacccaaggatggcctttagtgcctgttttggcggaataatcttcaacattctggtgggagtggggttgggatgcctcctgcaaatttctcggtcgcataccgaagtcaaactggagccggacgggctactggtctgggttctggccggagcattgggcctgagtctggtcttctccctggtcagtgttcctctccaatgttttcaactgtcgcgcgtctatggattctgtttgctgctgttttacctgaattttttagtggtcgctcttctgacggaatttggcgtgattcatctgaaatccatgtag

SEQ ID NO: 135023 - DNA, 396 bp, Artificial Sequence
  Description of Artificial Sequence: Synthetic coding sequence
atggctggtcgacgcctgaacttgcggtgggctctctcagtcttatgcgtattactgatggccgagacagtgtccggcacgagaggaagcagtacaggtgcccacatatccccccaattccccgctagcggggttaatcagactccggtggtcgattgccggaaggtgtgcggtctaaatgtctctgaccgctgcgattttatccggactaatccagactgtcattccgacggggggtacttggattacctggaaggaattttctgtcattttccaccctctctcctgccactcgcagtgactttgtatgtgagctggctgctctatctctttctcattcttggcgttacagccgcaaaatttttctgccctaatctgtctgccatcagcacatag

SEQ ID NO: 135024 - DNA, 696 bp, Artificial Sequence
  Description of Artificial Sequence: Synthetic coding sequence
atggctggcaggaggttgaatctccgatgggccctgagtgtcttatgcgttctgttaatggcggagacggtttctggtactcgcggatcaagcacaggggcccatataagcccccagtttcccgcctcaggcgtgaaccagactcccgtcgtcgactgccgtaaagtatgcggcctcaacgtctccgatagatgtgacttcatccgcacaaatccagattgccatagcgatggtgggtatttggattacctggaagggatcttttgtcactttccaccaagtctcctcccgctggctgtaacactttacgtttcttggctcctgtatctatttctgatcctcggggtcaccgccgccaagttcttttgtcctaacttaagtgctatttctacgacattgaaactgagccacaacgtggccggggtgactttcctcgctttcggtaacggcgcccccgacatcttttcagctctggttgcattctcagatcctcacaccgctgggttagccctgggcgctctgttcggcgcaggtgtcctggtcaccaccgtggtagccgggggaatcaccatcttgcatccattcatggcagcctcaaggcctttcttccgcgacatcgtcttttacatggtcgctgtctttctcacatttctaatgctgttccggggacgcgtgacgcttgcttgggcattgtag

SEQ ID NO: 135025 - DNA, 312 bp, Artificial Sequence
  Description of Artificial Sequence: Synthetic coding sequence
atggccgggagacgactcaacctgcggtgggccctgtctgtgctgtgcgtgcttctaatggccgaaacagttagcggaacacgggggtcaagtacgggcgcacatattagccctcagttcccagcctcaggtgttaatcagaccccagtcgtggattgtagaaaagtctgcgggctgaacgtaagtgaccggtgtgacttcatacgaactaatccagactgccactcagacggggggtacctcgattatctcgaaggaatcttttgtcacttccccccatctcttttgccactggcagtgacattgtactag

SEQ ID NO: 135026 - DNA, 1755 bp, Artificial Sequence
  Description of Artificial Sequence: Synthetic coding sequence
atggcgggacgcaggctgaacctgcgatgggccctcagcgttctttgcgtgcttctgatggctgaaacagtttctggtacaagaggcagtagtactggcgctcacataagtcctcagtttcctgcctctggagtgaaccagactcccgttgtagactgccggaaagtctgtggcctgaatgtgtccgataggtgtgatttcattcggacaaatccagattgtcacagtgatggcggctatctggactacttggagggtatattctgtcacttcccaccctccttgctccccctagcagtgaccttatacgtatcctggttgttataccttttcctcatcctaggagtgacagcggcaaaattcttctgcccaaacttgagtgcgatttcgacaacactaaagctgtctcataacgtggccggcgtcaccttccttgcttttggcaacggggctcccgacattttcagcgccctggtggcattttctgatccccacaccgctggtttggccttgggagccttatttggggccggagtgctggtcactacagttgtcgccggcggcataacaattcttcaccccttcatggcagcttctaggcccttcttccgcgacatcgttttctatatggtcgccgtcttcttgacgttcctaatgctgttccggggacgggtgacacttgcctgggctttgggctatttagggttgtacgtcttttacgtcgttaccgtgatactttgtacctggatctatcagcgccagcgccgaggcagcctattttgcccaatgccagtcacccctgagattctctcagattcagaagaggacagagtgtcctccaataccaacagctatgactacggcgacgagtatagacccctctttttctatcaggagacaacagcgcagatactggtacgagccctaaatccgttagattacatgaagtggcgcagaaaaagcgcttactggaaagccttgaaagtgttcaagctccctgtggagtttcttcttctgctgactgtgccggttgtagatcctgacaaagacgaccaaaactggaagagacccctgaactgtctgcatctcgtgatctcccccctagtggtcgtactgactctgcagagcgggacttacggcgtgtatgagatcggcggtttggtccctgtgtgggtggtggtcgttattgcaggcactgctctggcctccgtcactttcttcgcaactagcgatagccaaccccccagactgcattggctctttgcttttctgggttttctaactagcgccttatggattaatgctgccgcaacagaggtcgttaacatcctacgtagtctaggggtcgtcttccgcctcagcaatacggtactagggctgaccttgctggcttgggggaactctatcggggatgccttctccgattttaccctcgctagacaggggtatcccagaatggctttcagcgcatgcttcggcggtattatttttaacatactggtcggcgtggggctgggctgcctactgcagatctcccgttcacacaccgaggtgaaactcgaacccgacggtctactggtgtgggtgctagctggcgcactgggactctctcttgtgttttctttggttagcgtgcctttgcaatgtttccagctgtctcgagtatatgggttttgcctcctgcttttctaccttaattttctcgtggtagcacttcttactgaattcggagttattcacctgaaatccatgtag

SEQ ID NO: 135027 - DNA, 906 bp, Artificial Sequence
  Description of Artificial Sequence: Synthetic coding sequence
atggcggatcaacccaaacctatttcgcccctaaaaaacctgctcgccggagggtttggtggtgtgtgtctagtgttcgtgggtcacccattggacacagtgaaagtgcgcctgcagactcaacctccatctctgcccgggcagccgcccatgtactccggtacctttgattgcttccgaaagaccctttttcgggaggggatcacaggattatacaggggcatggccgcccctatcatcggggtgaccccaatgttcgcggtgtgcttttttgggttcgggcttggcaagaaattacagcagaagcacccagaagatgtgctctcatatccccagctgttcgccgccggcatgctttctggcgtattcactacagggattatgacgcctggggagaggataaagtgcttacttcagatccaggcaagcagcggcgaaagcaaatacacggggactctagactgtgctaagaagttgtaccaggagttcggaatcagaggaatctacaaaggtaccgtccttacactgatgcgcgatgttcctgcaagcggcatgtacttcatgacctatgagtggctgaaaaacatatttaccccagaaggcaaaagagtctcggagctgtctgctcctcggatcctggtcgccggggggatcgctggcatttttaattgggccgtagctatcccaccagatgtgctgaagagtcggttccagacagcccccccaggaaaataccccaacggcttcagagatgtgcttcgggaactgatcagagacgagggcgtgacttcactgtataaggggtttaacgcagtaatgatacgggctttccccgcaaacgccgcctgcttcttgggatttgaggtggccatgaagttcttaaattgggcaacaccaaacctgtag

SEQ ID NO: 135028 - DNA, 756 bp, Artificial Sequence
  Description of Artificial Sequence: Synthetic coding sequence
atgtacagtggtacgtttgattgcttccgtaagacactctttcgcgagggtattaccgggctgtaccggggaatggccgctcctataataggggtaactcccatgttcgctgtgtgttttttcggctttggcttgggaaagaagctccagcaaaagcatcccgaagatgtgctgtcctatccccagctgttcgcagccggcatgctgagcggagtgttcacaactggcattatgacgcctggcgaaagaattaagtgtttgctgcagattcaggcttctagcggtgagtccaaatacacgggaaccttagactgtgcaaaaaagctgtatcaggagtttggcataagggggatttacaagggtaccgtcctaacactcatgcgcgatgtgccggctagtggaatgtacttcatgacctatgaatggttgaagaacatcttcacacccgaaggaaagagggtgtccgagttatctgccccccgtatcctggtcgcgggaggtattgctgggatattcaactgggcagtcgccatcccccctgacgttctgaaaagccggttccagactgctcctcccggtaaataccctaatgggtttagggacgtgttaagggagctgattcgggacgaaggcgtgacgtcattgtacaagggatttaatgccgtgatgattcgtgctttccccgccaatgccgcctgttttctgggctttgaagttgcaatgaaatttctcaactgggctacaccgaacctatag

SEQ ID NO: 135029 - DNA, 948 bp, Artificial Sequence
  Description of Artificial Sequence: Synthetic coding sequence
atgacacaccaagatttgtccattacagcaaagctgattaatgggggcgtggcaggcttggttggagtcacctgtgtgttccccattgacctggccaagacaagattgcagaaccagcacgggaaagccatgtataaaggaatgattgattgtcttatgaaaacggctagagcagaaggtttctttggaatgtacaggggcgccgccgtgaacctcactctggttacaccagagaaagccattaaactggctgcaaacgatttttttaggagattgttaatggaagatggcatgcagagaaacctgaagatggagatgctggcgggctgtggggcaggaatgtgccaggttgttgtaacctgcccgatggagatgctgaagatccagctgcaggatgccggtcgcctggcagtgcatcatcaaggttctgctagtgcacccagcacttcccgatcttacacaaccggcagcgcttccacgcatcgccgcccgtctgctacactgatagcctgggagctcctgcggacccaggggctggctggattatatcgtgggctcggcgccactctcctgcgcgacataccttttagcatcatctatttccctctatttgccaacctcaacaacctgggtttcaacgagctcgctgggaaagcctcttttgcgcacagctttgtgagcggctgtgttgccgggtcgatcgcagctgtggccgtgacccctctggatgtactaaagacccggatccagaccttgaaaaaaggcctgggcgaggatatgtacagtggaattaccgattgcgctaggaaactgtggattcaagaagggccctccgccttcatgaaaggagctggatgtcgagccctggtcattgcaccactgtttggaatcgcgcagggcgtgtactttatcggcattggagagagaattctaaaatgtttcgattag

SEQ ID NO: 135030 - DNA, 948 bp, Artificial Sequence
  Description of Artificial Sequence: Synthetic coding sequence
atgacccaccaggacctgagcatcactgcaaagctgattaatgggggagtggctggcctggtgggagttacgtgtgtctttcctatagatttagccaagacaagacttcaaaatcagcatggaaaggctatgtacaagggcatgatagactgcttgatgaagacggcccgcgctgagggtttcttcggcatgtatcggggtgccgccgtcaatttgacattggtgacccctgagaaagctatcaagcttgccgcaaacgattttttcagacgtttgctgatggaggatggcatgcagcggaatttgaagatggaaatgcttgctgggtgcggagcgggaatgtgccaggtggtggtcacatgtccgatggaaatgctgaagattcagttacaggacgcaggccgcctggccgtccatcaccagggctccgcttcggccccttctaccagccgcagctataccactgggagcgcaagcacccatagacgcccctcagccactctgatcgcctgggagttgctgagaacacagggtttggccgggctttataggggcttgggagccacactgctgcgggacatcccctttagtataatatactttccactctttgccaacctgaacaacctcgggttcaacgagctggctggcaaggcgtcttttgctcacagtttcgtctctggttgcgtcgccggcagtatagctgctgtggctgtgactccattagacgtgttaaagactcggatccagaccctcaagaaggggctgggcgaagacatgtacagtggcatcactgattgcgcacgcaaattgtggatccaggaaggcccctcagctttcatgaagggcgccggctgtcgcgccctggttatcgcgcctctgtttggcatagctcagggggtatatttcattgggatcggcgagaggattttaaaatgcttcgattag

SEQ ID NO: 135031 - DNA, 1716 bp, Artificial Sequence
  Description of Artificial Sequence: Synthetic coding sequence
atggagaacgtaaaggagatttttgggcagacaattattcaccaccatataccatttaattgggattgcgagttcatccgactacatttcggtcacaacagaaaaaagcacctcaattacacagaatttacccaatttctgcaggaactacagttggagcatgcaagacaggcctttgccctgaaggacaagtctaagagcggaatgatcagcgggcttgatttttcagatattatggtcacaatcagatcccatatgttgacccccttcgtcgaagagaaccttgttagcgcagccgggggatcaatttcccatcaggtttctttctcttactttaatgctttcaattcgctcctcaataatatggaattggtgcggaagatctatagcactcttgccggcacccgcaaagacgttgaggtcacaaaagaggagtttgcacagtccgctatccgttacggccaggtgacacctctagaaattgacattctataccagctcgcggacctgtataatgcttccggcagactgacactggctgacattgagcgaattgcccctctggcagagggtgcgttaccttataatctagccgagcttcaacgacagcaatcccccgggcttggacggcccatctggttgcagattgccgagagcgcatatagattcaccctcggctctgtggccggcgctgtgggcgccactgccgtctatccaattgaccttgtcaagacccgtatgcagaatcaaaggggatcaggttcagtggtgggagagctgatgtacaagaacagctttgattgcttcaaaaaggttttgcgctacgaggggttcttcggtctgtaccgtggccttataccccagctgatcggggtggccccagaaaaagccatcaagctgactgtcaatgattttgtgcgtgacaagttcacaaggcgggacggttcagttccgctccctgccgaggtcctggcagggggttgcgcggggggtagccaggtgattttcactaatcccctcgagatcgtgaaaatccggctgcaagtggccggtgagattaccacaggacctcgggtgagcgcccttaatgtgctgagggatctgggtatctttggactgtacaagggtgctaaggcatgttttctgagagacatccccttttcagccatttactttcccgtgtatgcacactgcaaacttcttctggcagatgaaaacggccacgtggggggcttgaacctgctcgccgccggcgccatggccggagttccagctgcctccctggtgaccccggctgacgtcatcaagaccaggctgcaggttgctgccagagcgggacagacaacatactctggagtcatcgactgctttaggaaaattcttagggaggaaggaccctctgcattttggaagggcaccgctgcccgagtttttcgctcaagcccccagttcggcgtgactctggtcacgtatgagttactacagaggtggttctacatcgacttcggtggcttgaagcctgcgggttcagagcctacccctaagtctcgaatcgcagatttgcctccagcgaatccagaccatattggtggctatcggcttgctacagctacattcgctggaatcgaaaataagtttgggctgtatctacccaagtttaaaagtccatcggtggccgtggtgcaaccaaaggcagcagttgcagccactcagtag

SEQ ID NO: 135032 - DNA, 2037 bp, Artificial Sequence
  Description of Artificial Sequence: Synthetic coding sequence
atggcagtcaaagtacaaacgactaaaaggggcgacccacatgaactcagaaacatctttctgcaatacgcctctacagaggttgacggagagcggtatatgacccccgaagactttgtgcagagatatctcgggctgtacaacgaccctaactctaatcccaaaatcgtgcagctactcgcaggcgtggccgatcagacgaaagacggcctgattagctaccaggagtttctggccttcgagtccgttctctgcgcacccgatagcatgtttattgtagctttccagctgtttgacaagtcagggaatggagaggtaacttttgagaatgtgaaggaaattttcggccagactatcatccaccaccacatcccctttaactgggattgtgagttcatcaggctgcattttggccacaatcgtaagaaacaccttaattacactgagtttacacagttccttcaggagcttcaactagaacacgcccgacaagccttcgcactgaaagacaagtctaaatctgggatgatttccggcttggacttttccgatattatggtaaccatccgcagccatatgctcactccttttgtggaagagaacttggtatccgccgccggtggttccatatcccaccaagtgtccttcagctacttcaatgctttcaatagcctgctgaacaatatggaattggtgaggaaaatctactcaactctggctggtacccgcaaggatgtcgaagtcacaaaagaagagtttgcccaatctgcaattcgctatggccaggtgacacctttggagatcgacatcttgtaccaactcgctgatttgtataacgcttctggtcggctcacgctcgcagacatcgagcgcatcgcccccttggcagagggggcactgccatacaacctcgcagagctccaacgacaacaatcccctggactaggcaggcccatatggctgcagattgccgagtctgcttataggttcacactgggttctgtcgctggagcggtaggcgctacagcagtgtacccaattgatctggtcaaaacaaggatgcagaatcaaaggggctcggggtctgtggtaggggagctgatgtataaaaattctttcgattgctttaagaaggtccttagatacgaaggcttctttggtctctataggggcttaataccacagctaatcggcgtcgctcctgagaaagccatcaagctgactgtgaacgattttgtccgggataaattcactcgtagagacgggagcgtgcccctcccagccgaagtactagccggcggctgtgcgggaggctctcaagtcatttttaccaaccccctggagatcgtaaagatcagactgcaggtggccggcgaaattacaactggaccgcgtgtctcagctctgaatgtgctgagagatttaggtatatttggactgtacaagggggctaaagcgtgttttctcagggatatcccctttagcgccatatactttcccgtatatgcccattgtaaattgcttctcgctgatgagaatggccatgtgggtgggctgaatctcttggccgctggcgccatggccggagtaccagctgcgtcactcgttacccccgctgacgtgattaagacacgtctacaggttgcagcaagagccggtcaaaccacttattctggagtcatagactgctttaggaagatactccgcgaagaagggccttctgccttttggaagggcactgccgcccgggtgttccggagtagtccacagtttggagtgaccctggtcacatacgagcttttgcagaggtggttctacatcgactttggcggtctgaagccagccgggagcgaacctactccgaaaagccgtattgcagaccttccacccgcaaatcccgatcacataggtggttatagacttgccacagccacatttgcgggaattgaaaataagttcggcctctatttgcccaaatttaagtcccccagtgttgccgttgtgcagcccaaggccgctgtcgccgcaactcagtag

SEQ ID NO: 135033 - DNA, 1944 bp, Artificial Sequence
  Description of Artificial Sequence: Synthetic coding sequence
atggccgcaggccttgcgacctggttgccattcgctcgtgccgcagcagttggctggctgcctcttgcgcaacagccactgccgcccgcgcctggagttaaggcaagtaggggggatgaggtactggtggtgaacgtttccggaaggcgttttgaaacttggaaaaacaccttggatcggtaccccgacaccctgctgggatccagcgagaaagaatttttctacgacgccgactcaggggagtactttttcgatcgagatccggacatgtttcgccacgtgctgaacttttatagaacaggccgtctgcattgtccccggcaagagtgcattcaggcattcgacgaagagctggcgttctatgggctcgtgcccgaacttgtgggtgattgttgcttagaggagtacagggatcggaaaaaggagaatgctgagagactggccgaggacgaagaggccgagcaggccggggatggcccggccctgcctgccggatcctccctccggcagaggctctggcgggcctttgagaatccgcacacaagcacagccgcactggtcttctattacgtgaccggcttcttcatcgcagtgagcgttatagctaacgtcgtcgaaaccatcccctgtagaggctcggcccgaaggtccagtcgtgagcaaccttgcggtgaacggttcccacaggctttcttttgcatggatactgcctgtgtgctgatcttcacaggggagtacttactgcgcctgttcgccgcacctagccggtgccgattcctcagaagtgttatgtctctcattgacgttgtggccatcttgccctactacatcgggttgctggtccccaaaaatgacgacgttagcggcgcatttgtgactctacgcgtgtttagggtctttagaatattcaagtttagtcggcacagccagggccttcgtatactcggctatacactgaagtcctgcgcgagtgagctcggctttctgttgttttctctgaccatggcgattattatcttcgccaccgtgatgttctatgccgaaaagggaaccaacaagactaattttaccagcatccccgccgccttttggtatacgatcgtgacaatgaccacgctcggctacggagatatggttcccagtaccatcgccggtaaaatttttgggtctatctgctccctttcaggcgtgttagtgatagctcttccggtgccagtaatagtctctaatttcagcaggatttaccaccagaaccagcgggctgataagcggcgggctcagcagaaagttcgccttgcaaggatcagattggccaagagcggtaccaccaacgctttccttcagtataagcaaaatgggggactcgaagattctggatccggcgaagaacaggccttatgtgtccgcaacagatcggcctttgaacagcagcaccaccatttgctgcattgcctggagaagacaacttgccacgagttcactgatgagctgacctttagcgaagcgctgggtgctgtcagcccaggaggcagaacctctcggtctactagcgtgtcctcacagccggttggccctggaagtctcctgtcatcttgttgcccacgtagagccaaacgcagagctatcaggctcgccaactccacggcatcagtgagcagagggtcgatgcaggagcttgacatgttggccgggctgaggcggtctcatgcccctcagagtcgtagttccctgaatgcgaagcctcacgatagtctggacctcaactgcgactccagagacttcgttgctgctatcatcagtatccccacaccgccagctaacactcccgatgaaagccagcctagttcccctggaggaggtggccgcgccgggtctacactcaggaattcctcactaggcactccatgcctgtttccagaaacagtgaagatctccagcctgtag

SEQ ID NO: 135034 - DNA, 1062 bp, Artificial Sequence
  Description of Artificial Sequence: Synthetic coding sequence
atgggtatctttccgggaatcattcttatcttcctgcgagtgaaatttgcaacagctgctgtcattcaccaaaagagcaccacggtcagtcacgaaatgagtgggctgaactggaaacctttcgtctacggcggcctagcgtcgatagtagccgaatttgggacattccctgtggatctgaccaaaacgcggttgcaggtacaaggacagagcattgatgcgcgatttaaggagattaaatatagggggatgtttcatgctttgttccgcatttgcaaggaagaaggcgtcctggcactgtactcaggcatcgcaccggccctgcttcgacaggcctcttacggaacaataaagatcggaatttatcagagcctcaaaaggctatttgtggagcgactggaagatgagacgctgctgattaacatgatttgtggcgtcgtgagtggtgtcatcagcagcacgatcgctaatcctaccgacgttctgaagatcagaatgcaagcccagggaagcctgttccagggcagtatgattgggtcgttcatcgatatctaccaacaagaaggcacacggggattgtggaggtgtctctgttcaaaggctgtgacggggtgcgtgctgtggctaatgcccgtcatccctgcactgtgggaggctaatgcaggcgggagtctggagggggtggtgcctacagcacagcgggctgcgattgtcgtgggggtggagctaccagtgtacgatatcaccaagaaacacctgatcctttccggaatgatgggcgacaccatcctaacccactttgtttccagctttacttgtggcctggccggggccctagccagcaatcctgttgatgttgttcggacgcgcatgatgaaccagcgagccattgtgggacatgtggatctgtataaggggactgtcgatggcatcctgaagatgtggaagcacgaggggttctttgcactgtacaaaggtttctggcccaactggcttcggctcggcccctggaatatcatcttcttcatcacttatgaacagctgaagagactacagatttag

SEQ ID NO: 135035 - DNA, 969 bp, Artificial Sequence
  Description of Artificial Sequence: Synthetic coding sequence
atggggattttccctgggatcatcctcatcttcctaagagtcaaatttgcaaccgcagccgtgatccaccagaagagtaccactgtctctcacgaaatgagcggactcaactggaaaccttttgtgtacggggggcttgcctcaatagtcgctgaatttggaacttttcccgttgacttgacgaaaacccggctccaagtgcaggggcagagtatcgatgcacgatttaaggagattaaatataggggcatgtttcacgccctcttcagaatctgcaaggaggaaggagtgttggccctgtacagcggcattgcgccagccctccttcgacaggccagttacggaaccattaagataggcatctaccagtccctgaagcgactttttgtcgagcgcttggaagacgagactctgctcataaatatgatctgtggagttgtctctggagtgatttccagtaccatcgcaaaccctactgacgtgctgaaaatccgcatgcaggcccaaggttcacttttccagggcagtatgattggctcattcattgacatttatcagcaggaagggaccagaggattgtggcgcggagttgtcccgacggcccaacgcgccgccatagtcgtgggcgtggaactgcccgtgtacgatattacgaagaaacacctcattctcagtggcatgatgggtgatacaatcctaacccactttgtgtcctctttcacatgtggactcgccggagccctggcttccaaccctgttgatgtggtgcgaactcgtatgatgaatcaaagggcaatagttgggcacgtggatctgtacaagggaacggtcgacggcatactaaaaatgtggaaacacgagggctttttcgcattatacaaaggattctggcccaattggctcagactcggcccttggaatatcatattctttattacgtacgagcagctgaagaggctgcaaatatag

SEQ ID NO: 135036 - DNA, 597 bp, Artificial Sequence
  Description of Artificial Sequence: Synthetic coding sequence
atgggcattttcccgggcataattctgatttttctgcgggtaaaattcgcaacggctgctgtcatagtgagtgggcaccagaagtctacaacggtgtcccatgaaatgagcggactgaattggaagcccttcgtgtatgggggactggcatctattgtggctgagtttggtacgttcccagtcgatctgacaaagactcgactccaagtccagggtcagtccatcgatgcaaggtttaaggagattaagtatagaggcatgttccatgccctctttcgaatctgcaaagaagaaggagttctagcactgtattcaggcatcgctccagcccttctgcgccaggcgtcatatggcacaatcaagattgggatttaccagtcgctgaagagactgttcgtggagagactggaggacgagacacttttgataaatatgatttgcggtgtcgtaagtggggtaattagctctacaattgccaaccctaccgacgtgctgaaaattcggatgcaagcccaaggcagcttgttccagggaagcatgatcggttcttttatcgatatctaccagcaggagggaacaagaggcctctggaggtag

SEQ ID NO: 135037 - DNA, 618 bp, Artificial Sequence
  Description of Artificial Sequence: Synthetic coding sequence
atgtcaggtttgaattggaagccctttgtctatggtgggctggcaagcatcgtggcggagttcgggacatttccagtggatctaacaaaaacccgtctgcaagtgcaaggccagtcaatcgacgcccgcttcaaggaaatcaagtaccgggggatgtttcacgcgctgttccgcatttgcaaggaagaaggagtgctggctctttatagcggaatcgcccccgctctcctcagacaggcctcctacggcacaatcaaaatcggaatataccagagcctgaagcggctgttcgtcgagaggcttgaggacgagactctcctcattaacatgatctgcggagtggtctctggagtgattagcagtactatagctaaccctaccgacgtgcttaagatccgcatgcaagcccaggggagcctcttccaaggcagtatgataggctcttttattgacatctaccagcaggaaggtacacgcggcctgtggcggggtgtcgttcccaccgctcagagagccgccattgtagtcggcgtggagttgcctgtgtatgacattacaaaaaagcatctcattttaagcggcatgatgggggacaccatcctcacccacttcgtgtag

SEQ ID NO: 135038 - DNA, 723 bp, Artificial Sequence
  Description of Artificial Sequence: Synthetic coding sequence
atgggcatctttcctggtataatattgatcttcctgcgagtgaagttcgccacagctgccgtaattgtgtctgggcatcagaagagcacaacagtgtcacacgaaatgtcagggctcaactggaagccgttcgtttacggcggccttgcctccatcgtcgcagaattcggtacatttccagtggacctgaccaaaacgaggctgcaggtccagggccagtccattgacgcacggtttaaagagatcaaatacagaggcatgttccacgctctgttccgcatttgtaaggaagaaggagtacttgctttatactctggaatcgccccagcgctgttgcggcaggccagctacggtacaattaagattggcatctaccagagcctgaaacggctctttgttgaacgcctcgaggatgagacactcctgataaacatgatctgcggagttgtctcaggcgtgattagctcaaccatagctaacccgaccgacgttcttaaaatacggatgcaggcccagggcagtcttttccaaggttcaatgatcggctcattcatcgatatctaccagcaagagggaacacgcgggctttggagaggagtagtgccaaccgcacaacgcgccgctatcgtagtaggagtggagctccctgtttacgacatcacaaagaagcatctcattctcagtgggatgatgggagatactatccttacgcactttgtgtag

SEQ ID NO: 135039 - DNA, 972 bp, Artificial Sequence
  Description of Artificial Sequence: Synthetic coding sequence
atggctgataaacaaatttccctgcctgcaaagctcataaatgggggtatcgctgggctcataggcgttacttgtgtcttcccaatcgacctcgccaaaacacgtctacagaaccaacagaatggccagagggtttacacttccatgagcgattgcctcataaaaacggtgcggagcgagggttactttggcatgtatagaggtgccgctgttaaccttacactggtcactcccgaaaaagccatcaaactggcggcgaatgacttcttccgtcatcaactgagcaaggacggccagaaacttaccctgttaaaggagatgctggcaggttgcggtgcaggaacatgtcaggtgatcgtcactaccccgatggagatgttaaagattcagctccaggatgcggggagaatcgctgctcagagaaagattctggcagctcaggggcagctgtcggcccagggcggcgctcagcctagtgtggaggctccagcagctcctagacccaccgcaacccagttaacgagggacttgctcagatccagggggattgcaggcttgtacaaagggttgggcgccacgctgctaagggacgtgccatttagtgtcgtgtacttccctctttttgctaatctcaaccagctagggaggcctgcgagcgaagagaaaagccctttttacgtgtctttcctcgccgggtgcgttgctggcagcgccgctgccgtggcagtgaacccctgtgatgttgttaagacccgcctgcagagcctgcagagaggcgttaacgaggatacatactccggcatcttggactgtgcacgcaagattctcaggcacgagggaccatcagctttcttgaagggtgcttattgtcgagcccttgtaatcgcccctctttttggcattgcccaagtcgtgtattttctgggaatagcagagtcactgctaggtttgcttcaagatcctcaggcatag

SEQ ID NO: 135040 - DNA, 333 bp, Artificial Sequence
  Description of Artificial Sequence: Synthetic coding sequence
atggccgacaagcagatatccctgcctgccaagctgattaatggcgggatcgcaggcctcataggagtgacatgcgtgttccccattgacctcgcgaaaacccgattacagaaccaacagaatggtcagcgcgtgtatacttcgatgagtgactgtttgattaaaacagtgaggtccgaggggtactttggaatgtaccgcggggctgccgtgaacttgactctcgttactcctgaaaaagcaatcaagctcgccgccaatgacttcttccgacatcagctgtctaaggatggacagaagctgacattgctgaaagaaatgctggccggctag

SEQ ID NO: 135041 - DNA, 384 bp, Artificial Sequence
  Description of Artificial Sequence: Synthetic coding sequence
atggcagataaacaaatctctctcccagctaaactcataaacgggggtatcgcaggccttataggcgtgacatgtgtgttccccatagacctggcaaagacacgcttacagaaccagcagaatggccaacgggtgtatacgagcatgtccgactgtcttataaagacggtcagatccgaagggtacttcggcatgtaccggggtgcagccgtgaacctcaccttagtcacacccgagaaagcgatcaagttggctgctaacgatttcttcaggcaccaactgtcgaaggatggacaaaagttaaccctactcaaggagatgctggccggctgcggagctggtacctgtcaggtaatcgtgacgactccaatggaaatgctctag

SEQ ID NO: 135042 - DNA, 360 bp, Artificial Sequence
  Description of Artificial Sequence: Synthetic coding sequence
atggctgataaacagatttctctgcccgctaagctgattaatggaggcatcgcaggcttaattggggtgacttgcgtgttccccatcgatttagcaaaaacccggctacagaaccaacagaatggtcagagggtctatactagtatgagcgattgcttaattaaaacagtacggagcgaaggatacttcgggatgtacagaggggccgccgtgaatctcaccctggtgacaccagaaaaggctatcaaactggccgccaacgacttctttcgccatcagctgagtaaggatgggcagaaacttacccttttaaaggagatgctcgcaggatgtggcgccgggacttgtcaggtgatatag

SEQ ID NO: 135043 - DNA, 372 bp, Artificial Sequence
  Description of Artificial Sequence: Synthetic coding sequence
atggccgacaaacagataagcctgccggccaaattgattaatggcggcattgctggcctgatcggtgtgacttgcgtgttcccaattgatctcgcaaagacacgcctacaaaatcagcagaatggacagcgagtttacaccagtatgtccgattgtctcatcaaaacggtgcgctccgagggatacttcggcatgtatagaggtgccgccgtgaacctcactctcgtgacaccagagaaggctattaaacttgcagccaacgatttctttaggcatcagctgtcgaaggacggccagaaactcaccctgttgaaggagatgcttgcaggttgtggggcaggcacatgccaggttattgtcaccaccccttag

SEQ ID NO: 135044 - DNA, 342 bp, Artificial Sequence
  Description of Artificial Sequence: Synthetic coding sequence
atggccgacaagcagatatcactgccagcaaagctgatcaatggcggaatcgcagggctgatcggagtaacttgcgtttttcctatcgacctggcaaagacacgtctgcagaatcagcagaatggccagagagtctatacgtcaatgtccgactgtctcatcaagacagtaagatcggagggctacttcgggatgtataggggtgcagcagtgaatctgactctcgtaacaccagagaaagccatcaagcttgccgccaacgacttttttagacatcagctgagtaaggacggacagaagctcaccctgctgaaggaaatgcttgcaggttgtggggcctag

SEQ ID NO: 135045 - DNA, 237 bp, Artificial Sequence
  Description of Artificial Sequence: Synthetic coding sequence
atggccgacaaacagattagcctccccgccaaactaattaacggcggtatcgctgggctaataggcgtcacctgtgttttccctatagatctggccaagaccagacttcagaatcagcaaaacggtcaacgtgtgtatacgtcgatgagcgactgtctaataaagacagtaagaagcgaggggtacttcggcatgtatcggggcgcagcagtgaatctgaccctggtcactccatag

SEQ ID NO: 135046 - DNA, 180 bp, Artificial Sequence
  Description of Artificial Sequence: Synthetic coding sequence
atggccgataaacagatctccctgccagcaaaattgattaacggcggcatcgccggcttaattggggtgacgtgtgttttcccaattgacctggcaaaaactcgattgcagaatcagcagaacggacagcgggtgtatacttctatgtccgattgcttgattaaaaccgtgagaagctag

SEQ ID NO: 135047 - DNA, 972 bp, Artificial Sequence
  Description of Artificial Sequence: Synthetic coding sequence
atggccgataaacaaatctcactaccagcgaaactgataaacggagggattgctgggctaatcggtgtcacgtgtgttttccctatcgacttggcgaagaccaggcttcagaaccagcagaatggtcagcgagtttacacctctatgtcagattgcctgataaaaaccgtccgctccgaggggtattttggtatgtatcggggagctgccgtcaacctgacgctcgtgactccggagaaggcgattaagctcgctgcaaatgattttttcagacaccagctcagtaaggatgggcagaaactgactctactaaaggagatgcttgctgggtgtggggctggcacctgccaggtcatcgtgaccactccaatggagatgctgaagatccagctgcaggacgcaggtagaattgccgctcagcgaaagatactcgcagctcagggtcaactgtcggcccagggtggagctcagccgagcgtggaggcacctgcagcaccgcgcccaacggctacacaactgacccgagacctgcttaggtcccggggaattgcgggcctctataagggtctgggcgcaaccctgctgcgggacgtcccattcagcgtggtatactttcctctctttgccaacctgaatcaacttggcagacccgcgagcgaagagaaatctcccttttacgtaagttttcttgcaggctgcgtcgcaggaagtgcagccgccgtggccgtgaatccatgcgatgtggtcaagactagacttcagtcgttacagcggggcgtgaacgaggatacttactccggcattctggactgtgcccggaaaattctgagacacgagggccccagcgctttcctgaaaggcgcatactgccgagctctggtaattgcacccctctttggaatcgcgcaggtggtgtactttctcggaatcgccgaatctctcttaggcctgttgcaagatccacaagcgtag

SEQ ID NO: 135048 - DNA, 345 bp, Artificial Sequence
  Description of Artificial Sequence: Synthetic coding sequence
atggccgataaacaaattagtcttcctgccaagctgataaacggggggatcgcaggcctgattggggtcacgtgcgttttccctattgacttagcaaaaactcgactgcagaatcaacagaacggacagcgtgtctatacgtctatgtcagattgtctaatcaagacagtgaggagcgaaggatacttcggcatgtacaggggggcagctgtgaacttgactctggtgacacctgaaaaggctatcaagctggccgccaatgacttttttaggcatcaactgtcgaaggacggccaaaaattaacgctgctaaaggagatgctcgcgggctgcggggctggatag

SEQ ID NO: 135049 - DNA, 237 bp, Artificial Sequence
  Description of Artificial Sequence: Synthetic coding sequence
atggccgataagcagatttcattgcctgccaaactgattaacggggggattgctggactgataggagtcacatgtgtgtttcctattgatctcgccaaaacacgcctccagaaccagcagaacggacagcgggtgtacactagcatgtcggactgtttgataaaaacggtcaggagcgaaggatactttggtatgtataggggggccgctgtgaatctgaccctcgtgacaccttag

SEQ ID NO: 135050 - DNA, 321 bp, Artificial Sequence
  Description of Artificial Sequence: Synthetic coding sequence
atggccgacaaacagatttccttaccagctaaactgattaacggtgggatcgccggactgatcggcgtgacttgtgtgtttccgattgacctcgcgaagacgagattacagaatcagcagaatgggcaacgcgtctacacctcaatgagcgactgcctcattaagaccgtcagaagtgaggggtacttcggaatgtatcgaggagccgctgtcaacctgaccctcgtcacccctgaaaaggccatcaaattggcggctaacgactttttccgacaccagctatctaaggatggccagaaactcactctgcttaaggaatag

SEQ ID NO: 135051 - DNA, 408 bp, Artificial Sequence
  Description of Artificial Sequence: Synthetic coding sequence
atggcagataaacagatctcccttcctgccaagctgataaacggaggcattgcagggctgatcggggtcacatgcgtattccccatcgacctggcaaaaacaaggctgcaaaaccagcagaacgggcagcgggtatacacctctatgtcagattgcctgattaagacagtgcgcagtgagggctacttcgggatgtatagaggtgcggctgtgaatttgactcttgtcacccccgaaaaagctatcaagttagccgccaacgactttttcagacatcagctgagcaaagatggtcagaaacttacgttactcaaagagatgctggctggatgcggggccggaacatgccaagtcattgtgacgactccaatggagatgctgaaaattcagttgcaggacgcggggtag

SEQ ID NO: 135052 - DNA, 948 bp, Artificial Sequence
  Description of Artificial Sequence: Synthetic coding sequence
atgcaccgggagcccgctaagaagaaggccgagaagaggctgtttgatgcttcttctttcggtaaagatctgcttgccggaggagtggctgccgccgtgtccaagaccgccgtggcgcccattgagcgtgttaagctgctacttcaagtgcaggctagttcgaagcaaatatccccggaggctagatacaaaggcatggtcgattgtttggtccgcattccgcgagaacagggctttttcagcttctggcggggaaacttagccaacgtgattagatactttccgacccaagctctaaattttgcgtttaaagacaagtataaacagctatttatgagtggagtcaataaagaaaagcaattctggagatggtttcttgcaaacctcgctagcggcggagccgcaggcgctactagtctatgcgtggtctatcctttggatttcgctcgaaccagattaggcgtcgacatcggtaagggaccagaggagaggcagtttaaggggcttggagactgcattatgaagattgccaaatcagacggaattgccgggctttatcaaggattcggcgtctccgttcagggtattatcgtgtaccgcgcctcttatttcggggcttatgacaccgtaaagggattgcttccaaagccaaagaaaacaccttttcttgtctcgtttttcatcgcccaagtggtaacaacctgttctggcattctctcctatcctttcgacactgttcggaggcgtatgatgatgcagagcggcgaggcaaaacggcagtacaaaggcacactggactgttttgtaaaaatatatcagcacgaaggcatctctagctttttccggggcgccttttccaacgttctccgcggaaccggcggagcactggtgttggtgctgtatgacaaaattaaagagttttttcatattgatataggcggacggtag

SEQ ID NO: 135053 - DNA, 897 bp, Artificial Sequence
  Description of Artificial Sequence: Synthetic coding sequence
atgggagaccatgcttggtcttttctgaaagatttcttggccggaggcgtggccgctgctgtgagcaagaccgcagtagctcccatcgagcgcgtcaagctgctactgcaagtccagcatgccagcaaacagatttcagccgagaaacaatacaagggcattattgattgcgtggtcagaatccccaaggagcagggattcctctctttttggcgcgggaacctggctaatgtcatccggtactttccaactcaggccctgaatttcgccttcaaggacaaatacaagcagctgttcctcgggggcgttgacagacataagcagttctggcgatacttcgctggcaacctggcctccggaggagccgcgggcgccacgtccctgtgttttgtctatccgctggattttgcacgaaccagactcgctgcagacgttggcaagggtgctgcccaaagggagtttcatgggcttggggactgcatcataaagatcttcaagtccgatgggcttcggggcctctatcaaggtttcaacgtgagcgtgcagggaataatcatatatagagccgcctacttcggggtgtacgataccgccaagggcatgttgccagaccccaagaacgttcatatttttgtgtcatggatgatcgcccaaagtgtgactgcggttgccggtctcgtctcatatccattcgacacagtccgccgccgtatgatgatgcaatcaggccggaaaggtgcggacataatgtacacaggtacagtcgattgctggcggaaaatagctaaggatgagggggcaaaagcttttttcaagggagcatggtctaacgtgcttagaggtatgggtggtgccttcgtcctagtgctgtacgacgaaatcaagaagtacgtctag

SEQ ID NO: 135054 - DNA, 897 bp, Artificial Sequence
  Description of Artificial Sequence: Synthetic coding sequence
atgactgacgctgctgtctcctttgctaaagacttcctggcagggggggtggcagccgcgatctccaagacggcagtcgctcctattgaacgggtgaagctactccttcaggttcagcatgcctccaagcaaatcacagcagacaaacaatacaagggaattatcgactgcgttgtgaggatcccgaaggaacagggagtgctgtcgttctggcgtgggaacctagcgaacgttatcaggtattttccaacgcaggccctgaatttcgcctttaaagataaatataagcagatcttcctgggaggtgtggacaaaaggacgcaattctggctgtacttcgcggggaatctagcatcggggggagccgcaggcgctacctctctgtgcttcgtgtatcctttagacttcgctcggacgaggttggccgctgatgtaggtaaagccggtgcagaacgcgaattccgcggacttggagattgtctcgtgaagatctacaaaagcgatgggattaagggcctttatcagggctttaacgtctcagtgcaggggatcatcatctacagagccgcctactttggcatttatgacactgctaaaggaatgctccccgaccccaagaacactcacattgtcatcagttggatgatagcacagacagtaaccgcagttgctggattaacgagttatccgttcgacaccgtccgccggcgcatgatgatgcagagtggcaggaaggggacagatatcatgtacaccggaacactcgattgctggagaaagatcgcgcgggacgaaggtggcaaagctttctttaagggcgcctggtcaaacgtccttaggggcatggggggtgcctttgtcctcgtgctctacgatgagatcaaaaagtacacatag

SEQ ID NO: 135055 - DNA, 897 bp, Artificial Sequence
  Description of Artificial Sequence: Synthetic coding sequence
atgacagagcaagcaatctcatttgccaaggattttcttgccgggggcattgctgccgccatctcaaagaccgccgtcgcaccaattgagagagttaagttattactgcaggtgcagcacgcttcaaagcaaatcgctgctgataagcagtacaagggcatcgtggactgcatcgtgaggatacctaaagagcaaggggttttgtccttctggagaggcaatctggctaatgtcattaggtacttcccaacccaggccctaaatttcgcctttaaagacaaatacaagcagatctttctgggaggagttgataagcacacacagttttggcgatattttgccggtaacctggcatccggcggcgccgctggagccacctctttgtgttttgtgtatccacttgatttcgcacggacaaggttggcagccgatgtgggcaagtccggcaccgaacgtgaattccgagggcttggtgattgcttggttaaaatcaccaaatccgatgggattaggggcctttaccagggcttctctgtgtccgtgcaaggtattatcatctatcgcgctgcctacttcggcgtttacgacacagctaagggaatgctgcccgaccccaagaatacacacattgtggttagttggatgattgcgcagactgtgactgcagtcgctggtgttgtatcttaccccttcgatactgtgcgccgaagaatgatgatgcaatccggccgtaaaggcgctgatattatgtataccggcacggtggattgctggagaaaaatttttcgcgacgagggcggtaaggcattttttaaaggggcctggtccaatgtgctccgagggatgggcggcgcattcgttctcgttttatacgatgaactgaagaaggtgatttag

SEQ ID NO: 135056 - DNA, 477 bp, Artificial Sequence
  Description of Artificial Sequence: Synthetic coding sequence
atgactgagcaggccatatcttttgctaaagacttcctggccgggggcatcgccgcagccatcagtaaaaccgcagtcgctccaatcgaacgagtcaagttactccttcaggtacaacatgcttccaaacagattgcagccgacaagcagtacaaaggaatcgtggactgtattgttagaatccctaaagaacagggtgtcttgtccttttggcgcggcaatctggcaaacgtcatcaggtattttccaacacaagctcttaactttgccttcaaggacaagtacaagcagattttcctgggaggcgtggacaaacatacacagttctggcgctatttcgctggaaacctggcctcagggggtgccgctggcgcgacgtcgttgtgcttcgtgtatcctcttgacttcgccaggacccgtctggctgccgacgttgggaaaagcggcaccgaacgtgaatttcggggcttggggtag

SEQ ID NO: 135057 - DNA, 2913 bp, Artificial Sequence
  Description of Artificial Sequence: Synthetic coding sequence
atgctctgtttcctggatgatggggcaggcatggatccaagtgacgccgcctccgtcatccaattcggcaagagcgctaaaagaactccagagtctacgcagatcgggcaatacggcaatgggcttaagtccggctcaatgcggattgggaaagattttattctgtttacaaaaaaggaagatactatgacatgcttgttcctaagccgcacttttcacgaagaggaaggaatagacgaagtcatcgtgccattgccgacctggaacgcacgcactcgcgaaccagtcaccgacaatgttgaaaagtttgccatcgagactgagctgatctataagtactctcctttcagaaccgaggaagaggtcatgacccagtttatgaagattcccggcgacagcgggaccttggtaatcatctttaatttgaagttgatggataacggagaacctgagttggacattatcagtaatcctcgagacattcagatggccgagacgtctccagaggggaccaagccagaacgacggagcttccgtgcttacgcagctgtattgtacattgatccccgcatgcgaatctttattcacggtcacaaggtgcagactaagcgcctgagctgttgcctgtataaaccccggatgtacaaatatacatcaagccggttcaagacacgagctgagcaggaggtcaagaaggctgagcacgtggcccgcatagcagaggaaaaggccagggaggctgaaagcaaggccagaacactggaagtaagactcggtggcgatttgactcgagacagcagggtgatgttaagacaggtgcagaaccgggccatcacactcagacgagaggccgatgtgaaaaagaggatcaaagaagccaagcaaagagctctgaaggaaccaaaagaactgaacttcgtgttcggagtgaatatcgaacacagagatttggacgggatgtttatttataattgctccagactgatcaagatgtacgaaaaggtggggcctcagttggagggggggatggcctgtggaggagtagttggggttgtggacgtcccttatctggtgctcgaacccacacacaacaagcaagactttgctgacgctaaagagtatcgccacttgctccgcgcgatgggtgagcatctggcccagtattggaaagatatagccattgcgcagcggggaattatcaagttctgggacgaattcggatatctgagtgctaactggaaccaaccccccagcagtgaacttcgatataaaagacgccgggctatggagattccaacaaccatccagtgcgatttatgcctgaaatggaggaccctcccctttcagctgtcctcagttgagaaagattaccccgacacctgggtatgttccatgaaccccgatcccgagcaggaccgctgtgaagctagcgagcagaagcagaaagtccctctgggaacgtttcggaaggacatgaaaacgcaggaggaaaagcagaaacaactgacagaaaaaattcggcagcagcaggaaaagctcgaagcccttcaaaagactactcctatacgctctcaggcggatctgaagaaactgccattggaggttaccacacgaccctctacagaggagcccgtgcgaaggcctcagaggccccggtctccgcctctgcctgccgtgatccgcaatgctccgtcacggcctccttcactgccgacacctcgccctgcatcacaaccaaggaaagccccagtgatctccagtacccctaagcttcccgccctggcagcaagggaggaggcctcaacatcccgattactgcagccccctgaggccccgcgcaagccggccaacacattggtgaaaacagcatcccgcccagccccacttgtgcaacagctatctccaagtctgttgccaaattcaaaatctcccagagaggtgccttctcctaaagtgataaagacacctgttgtcaagaagacggaatcccccatcaagttgagccccgccacaccatctcgcaaaaggagcgtggctgtatctgatgaagaggaagtggaagaagaagccgagcgcagaaaagaaagatgcaagagaggcagattcgtggtcaaggaagaaaagaaagactccaacgagctgtctgacagcgccggagaggaggattcagcggatctgaagcgtgcccagaaagacaaggggctgcacgtcgaggtcagagttaaccgggagtggtatacagggcgtgtgaccgccgtcgaggtgggcaaacacgtggttcgatggaaagtgaaatttgattacgtgcctacagacaccacgccccgggatagatgggtcgagaagggttctgaggacgtccgcctgatgaagccgccttcaccagaacaccaatccctggatactcagcaggagggtggcgaggaagaagtggggccagtggcccagcaggccattgccgtcgccgagcccagtaccagcgagtgcttgcggatagagccagacactaccgcgttgtcgactaatcatgagactatcgatctgctcgtccagatactgcgaaattgcttgaggtatttcttacccccgtcgttccctatcagcaagaagcaactgagcgccatgaattctgacgagcttataagtttcccgctgaaggaatactttaagcagtacgaagttggactgcagaacctgtgcaattcgtaccagtctagggctgattctagagccaaggcctccgaagaatcactccgcacaagtgaacgaaaactgagagaaactgaggagaaactccagaagcttaggactaacatcgtcgcccttctgcagaaagtgcaggaagatattgacatcaatacggacgatgaactggatgcttatatagaggacctgatcaccaagggagattag

SEQ ID NO: 135058 - DNA, 627 bp, Artificial Sequence
  Description of Artificial Sequence: Synthetic coding sequence
atgttcgaatttctgtccaaccacatgcgagacgcccaaggcaggctggactccaccagggggctcttatgtggactgggggcaggtgtagcggaggctgtcgtggtggtgtgccccatggagactatcaaggtcaagtttatccacgaccaaacctcacctaacccgaaataccggggcttcttccatggagtgcgcgaaattgtgagagaacagggcctaaaagggacgtaccaaggcctgacagccaccgttcttaagcaagggagtaatcaagccatccgcttttttgtaatgacatctttaaggaactggtataggggggacaaccctaacaagcccatgaatcccctcattactggcgtgtttggagcaatcgccggagcagcctcggtcttcgggaatactccactggacgtgataaagacacggatgcaaggcttggaagcgcacaaatatagaaatacctgggattgcggcctccagatactgaagaaggaagggctgaaggctttttacaaaggaacagtgccccgcctcggccgtgtttgcctggatgtggcgattgtcttcgtgatatacgatgaagtggtcaagctgctgaataaggtctggaagacagattag

SEQ ID NO: 135059 - DNA, 999 bp, Artificial Sequence
  Description of Artificial Sequence: Synthetic coding sequence
atggcagctgccacagccgctgcggcccttgccgccgccgacccaccccccgccatgccccaggcagccggggccggaggccctacgacgcggcgcgacttttattggctgcggagctttctcgcggggggcatcgccggctgctgtgcaaagacaactgtggcccccctggatcgggttaaggtactgcttcaggcgcataaccatcactataagcacttaggcgtcttctccgcactgagggctgtgccccagaaagagggcttcctgggcctgtataagggaaacggcgcaatgatgataagaatttttccttacggtgcaattcaatttatggcttttgagcactataagactctgatcaccaccaagctcggcatatctgggcacgttcatcggttaatggcaggaagcatggctggcatgacagccgtgatctgtacatatcccctggacatggtgagggtccgactcgcctttcaagtgaaaggggaacacagctacaccggcatcatccacgcctttaaaacgatatacgcaaaagagggcggcttctttggcttttaccgcggccttatgccaactattctggggatggctccatacgctggagtctctttttttacatttggcaccctcaagagcgttggactcagccatgcacccacactgctcggaagacctagttccgataatccgaacgttctggttctcaaaacacacgtaaatcttctgtgtggaggggttgccggggccatcgctcaaactatttcttacccatttgatgtcacgaggagaagaatgcagctgggaacggttctgcctgagttcgagaagtgcctgactatgcgtgacacgatgaagtacgtgtacggacaccatggcattaggaaaggtctgtatcgtgggcttagcctaaactacattagatgtattccaagccaggctgttgccttcactacctacgaactgatgaaacaatttttccacctgaactag

SEQ ID NO: 135060 - DNA, 705 bp, Artificial Sequence
  Description of Artificial Sequence: Synthetic coding sequence
atgatgatccggatcttcccttatggcgccatccagtttatggcgtttgagcactacaaaacgctgatcaccacaaagttggggattagtggccacgttcatcgcctgatggccggctccatggcaggaatgacggccgtcatatgtacatatccactcgacatggtgagggttcgtcttgccttccaggtgaaaggagagcattcctatactggtatcatccacgctttcaagacaatctacgcgaaagaggggggattcttcggattctatcgcggtttgatgccaaccatcctgggaatggccccctatgctggcgtctccttttttaccttcggaacgctcaagtccgtgggcctttcacacgctcccactctcctgggacggccatcttcagacaatcccaacgttctggtactgaaaacacacgtgaacttattgtgtggcggggttgccggggcaatcgcccagaccatcagttatcccttcgacgtcacacggcgcaggatgcagctgggaaccgtgctgcctgaattcgaaaaatgccttactatgcgggatactatgaaatatgtgtacgggcaccatgggatccgtaagggcttgtaccgaggactgtccctcaattacatccgttgcatcccatctcaagctgtggcatttacaacttatgaactgatgaagcagttttttcatctcaactag

SEQ ID NO: 135061 - DNA, 906 bp, Artificial Sequence
  Description of Artificial Sequence: Synthetic coding sequence
atgaagagcaaccccgccatacaagccgccattgacctaactgccggagctgcgggtggtaccgcgtgcgtgctgaccggccagcccttcgacaccatgaaagtcaagatgcagaccttccccgacctgtaccggggcttgactgactgctgtctcaaaacctattcgcaggtgggattcaggggtttctataaggggacctcaccagccctgattgctaacatcgctgagaacagtgttttgttcatgtgctacggcttttgccagcaggtggtacgcaaagttgccgggctagacaaacaagctaagttgtctgacctgcaaaatgcggcagccggcagcttcgcttcggcttttgctgcgctggttctttgcccaaccgagttggttaaatgtcgattgcagacaatgtacgagatggagaccagtgggaaaatcgctaagagccagaacacagtctggtccgtaattaagtcgatcctgcgaaaggatggcccgctagggttctaccacgggctgagctctactctccttagagaagtgcctggttactttttcttttttggtggttacgaactgtcaagaagcttcttcgcgtcaggtcgctcaaaggacgagctgggtccagtacctctcatgctttccgggggagtgggtggaatctgtctttggctggcagtgtaccccgtcgattgtataaagtcccgaatccaggtactcagtatgagcggaaagcaagccggcttcattcggacattcattaatgtggtcaagaatgagggaattacagccctttactcgggcctcaagcctacgatgattcgtgcattcccagccaacggcgccttgttcctagcttatgagtattcccgaaaactcatgatgaaccagctggaggcttactag

SEQ ID NO: 135062 - DNA, 402 bp, Artificial Sequence
  Description of Artificial Sequence: Synthetic coding sequence
atgaagagcaatcccgcaattcaagccgcaatcgatctcacagcaggagctgctggtggaaccgcgtgcgtcctcaccggccaaccattcgataccatgaaggtgaagatgcagacctttcctgacctttatcggggcctgacagactgctgcctcaagacctacagtcaggtgggcttcaggggattttataagggcacctctccggccctgatagccaatatcgcagagaactcagtactcttcatgtgttacggattctgccaacaggtggttcggaaagtcgccgggctggacaagcaggctaaactgtcaacagtgtggagcgtaatcaagtctatcctgagaaaagatgggcccctcggtttctatcatggcctgtcaagcactttacttaggtag

SEQ ID NO: 135063 - DNA, 402 bp, Artificial Sequence
  Description of Artificial Sequence: Synthetic coding sequence
atgaagtcgaatcccgccatccaggctgcaatagacctgactgccggagccgctggtggtacagcatgcgtcctgacaggccagccttttgatacgatgaaggtgaaaatgcaaacatttccagatttgtaccggggactcaccgactgctgtctcaagacgtactctcaggtcggctttcgtggtttctacaagggaacatcccccgcgctgatcgccaatattgccgaaaactcagtactgtttatgtgttacggcttctgtcagcaagtggtacgtaaagtcgccgggctggacaagcaggcgaagttatcaaccgtgtggtccgtcatcaagtccatcctcaggaaggacgggcccctggggttctaccacggcctctcatccaccttattgcggtag

SEQ ID NO: 135064 - DNA, 906 bp, Artificial Sequence
  Description of Artificial Sequence: Synthetic coding sequence
atgaagtctaaccccgctattcaagctgcaatcgatctcacagcaggagccgcaggtggaaccgcttgtgttctgaccggacaaccattcgacacaatgaaggtaaaaatgcagacgtttcccgacctgtatagggggctgacagattgctgcctcaaaacttactctcaagtgggattccgtggtttctacaaggggacgtctcctgcgctaatcgctaacatagccgaaaactccgtcctattcatgtgttatggattttgccagcaggtggtacgcaaggtagccgggctcgataagcaagccaaactgagcgatttacaaaatgcagcagctggttccttcgccagcgcattcgccgctcttgtgctctgccctaccgagcttgttaagtgcagactgcagaccatgtacgaaatggaaacttctggcaagatagcaaagtctcagaacacagtctggtcagttattaagagcatactgaggaaagacgggccgctcgggttttaccacggactttctagcacgctgctgcgcgaagtgcccggctatttctttttttttggaggttatgagttgtcacggagcttcttcgctagcggcaggtccaaggacgagctggggcccgttccattaatgctctccggaggcgttggcgggatctgtctctggctggctgtttacccggtggactgtataaagtcacgaattcaggtcctttcaatgagtggtaaacaggctggctttatccgcacattcatcaacgttgtgaagaatgaaggaataacagccctgtattccggactgaaaccgactatgatccgggccttccctgcaaacggggctctgttccttgcatatgagtattcccgcaagcttatgatgaaccagctggaggcttactag

SEQ ID NO: 135065 - DNA, 726 bp, Artificial Sequence
  Description of Artificial Sequence: Synthetic coding sequence
atgaagtctaatcccgcaatccaggctgctatcgacctgacagcaggtgccgccggggggaccgcatgcgtgctgactggacagcccttcgacaccatgaaagtggctgggctggacaaacaagccaagctgagcgatttacagaatgccgccgctgggtcttttgcctctgcttttgcggccttagtcctctgtccgacagaactagtaaaatgcaggctccaaaccatgtacgagatggaaaccagcggcaaaatagccaagtcacaaaacaccgtgtggtccgtaattaagtcaatcctccgaaaggatggtcctctcggcttttatcatggcttgtcgtctactttactccgcgaagtcccagggtatttcttctttttcgggggttacgaactgagccgcagcttcttcgcgagcggacggagcaaagacgaactgggacccgtaccactgatgctttcggggggtgtgggcgggatctgtctttggctcgcagtctaccccgttgactgcatcaaatcaagaatacaagttttgtctatgtctggcaaacaggccgggtttatccgcacttttattaatgtcgtgaaaaatgaaggcataacagccttgtacagtggcctcaagccaactatgattagggcattccccgcgaatggcgcgttattcctggcatacgagtatagccgaaaattgatgatgaatcagctcgaggcatattag

SEQ ID NO: 135066 - DNA, 906 bp, Artificial Sequence
  Description of Artificial Sequence: Synthetic coding sequence
atgaaatccgggcccggcatccaggccgcaatcgatctaactgctggcgcagctggaggaaccgcatgcgttctgacaggtcagcccttcgatacaatcaaggtaaaaatgcagacgtttcctgacctgtacaagggactgaccgactgtttccttaagacatacgctcaggtcgggctgagaggcttctacaagggcacagggccagcactaatggcctacgtcgccgagaactcagttctgtttatgtgctacggcttctgtcagcagtttgtacggaaagtggctggaatggataaacaagccaaattaagcgacttacagacagccgcagctgggtcatttgccagcgcatttgctgctctggccctgtgtccgacagagctcgttaagtgtcggctgcaaactatgtatgagatggaaatgagtggcaaaatcgctaagagccataacactatttggtccgtggtgaaggggatactgaaaaaggatggcccgctggggttctaccatggcctgtccagtacccttctgcaagaggtccccgggtacttcttttttttcggcggctacgaactgagcagaagtttcttcgcctccggccgcagcaaggacgaactgggcccagttcacctgatgctgtccggaggcgtggcagggatttgtctttggctggtggtgtttcccgttgactgcatcaagtccagaatccaggtcctgtctatgtacgggaagcaagctggattcataggcaccctcctctccgtagtgaggaacgagggcatcgtggccctctactctggcctgaaagccacaatgattcgcgctattccagcaaatggagctctgttcgtggcctatgagtacagccgcaagatgatgatgaagcagttggaagcctactag

SEQ ID NO: 135067 - DNA, 423 bp, Artificial Sequence
  Description of Artificial Sequence: Synthetic coding sequence
atggcaggatggaatgcctacattgataacctgatggcagatggtacctgtcaagatgccgccatcgttggatataaagattccccaagcgtatgggccgcagtgcctggtaagacctttgtgaatatcacccctgcggaagttggggtcctggtgggtaaagaccgctcttccttctacgttaacgggcttaccctgggtggccaaaagtgctctgtgatccgagactcgctcctccaggatggggaattcagtatggacctgcggacaaagagcaccggcggcgcgcctacctttaacgtgacagtgactaaaacagataagactttggtcctcctgatgggaaaggaaggggtgcacgggggcttaattaacaagaagtgttatgagatggcatctcaccttcgccgatcccagtactag

SEQ ID NO: 135068 - DNA, 792 bp, Artificial Sequence
  Description of Artificial Sequence: Synthetic coding sequence
atggccgcaacggcctctgctggtgccggagggatcgacggtaagccccgcacatcccccaaatccgtcaagttcctgttcggtggtctggctggcctctccgctggactgctacgacaggcgacatatacgaccacaagactgggcatatatactgtcctgttcgagcgccttaccggagctgatggaactcctcctggatttttgctgaaagccgtgatcggcatgactgccggcgcaactggggcattcgtgggaacccccgcggaagtggcattgattaggatgaccgctgacggaaggctgccagctgaccagcggcggggttataagaacgtgtttaatgccttaattagaattacacgcgaagaaggggttttaacattgtggagaggttgcattcccacgatggctcgcgccgtggtcgttaatgcagctcagctggcgtcatattcacagtccaagcagttcctcttggattccggatacttctcagataacatcctgtgtcacttttgtgcctcaatgattagtggcttggtcacaactgcagcgtctatgcccgtggatatcgccaaaacccgtatccaaaacatgcgcatgattgatggaaagcctgaatacaagaacggtcttgacgtgttgttcaaagtggtccgttacgagggatttttttcactttggaagggttttaccccctactacgctagattaggacctcatacagtgctgacgtttattttcctggagcaaatgaacaaggcctacaaaaggttatttctgagcggctag

SEQ ID NO: 135069 - DNA, 678 bp, Artificial Sequence
  Description of Artificial Sequence: Synthetic coding sequence
atggagtattggtacgtggccctcaagcaacagagcctgaaggctgacattctgcccagcctattcctatccatatttctggtgaaaggcgtggtaaatgtcttgttgaccacacctctctgggtcgtcaatactcggctcaagttacagggcgccaagttcaggaacgaggatatagttcccacaaattataagggaatcatcgatgcctttcatcagatcatccgggatgaagggatttccgcactttggaacggcacattcccgtctctcctacttgtctttaacccagccattcagtttatgttttacgaaggcctgaagaggcagctgctgaaaaagcgcatgaagttgtcatcacttgatgtgttcattatcggggctgtagccaaggctattgccacgaccgtgacttaccctctccaaaccgtccagtctatcctgcggttcggcaggcataggttaaatcctgagaatcgaacactcggatcccttaggaatattctttatctgttgcatcagagggttcggcgcttcggaattatgggcctttacaagggcttggaggccaagttgctccagactgtgctgacagccgcactgatgttcctagtgtacgaaaagctgacagcagcgaccttcacggtcatgggccttaagcgagcacaccagcactag

SEQ ID NO: 135070 - DNA, 279 bp, Artificial Sequence
  Description of Artificial Sequence: Synthetic coding sequence
atgggatcagtcaccgctatgactgttttctttcctctcgatacagctcggctgaggctgcaggtggacgaaaaaagaaaatcgaagaccactcatatggtgctgcttgaaatcattaaggaagagggtcttctagccccatacaggggatggtttcctgtgatctcatctctgtgctgtagcaattttgtgtacttttatacatttaatagcctcaaagctttgtgggttaaggggcagcacagtactacgggcaaggacttggtcgtcggcttctag

SEQ ID NO: 135071 - DNA, 924 bp, Artificial Sequence
  Description of Artificial Sequence: Synthetic coding sequence
atggccagcgtgcttagttatgaaagcttagtccacgccgtggcgggcgcagtgggctcggtgacagcaatgaccgtttttttccccttggatacagcaagactgagactgcaggtcgacgagaagcggaaaagtaagactacccatatggtcttgttggagatcattaaagaggagggtctactcgccccgtacagagggtggttccctgtcatcagcagcctttgttgcagtaactttgtttatttctacacattcaattccctaaaagcgctgtgggtcaagggccaacattcaactacaggcaaagacttggttgtgggattcgtcgctggggtcgtgaatgttttactcaccacgcccctgtgggtggtgaatacacggcttaagctccaaggggcgaagttccggaatgaagatattgtgccgaccaattataagggtattatcgacgccttccaccaaattatcagagatgaaggcatcagcgccctttggaatggcacctttcccagtctgttactcgttttcaaccctgcaatccagttcatgttctatgaggggctgaaacgacagttgctcaagaagcgaatgaaattgtcgtccttggacgttttcattatcggcgctgtagccaaggctatcgccacaacagtgacttaccctctccagactgtacagtcaatccttagatttggtcgccacagactcaatccagagaatcgcacgctcgggagtctgcgaaatattctgtatctgttacaccagagggttcgaagattcggcattatgggtctgtacaaagggctggaggccaaactgctccagaccgtgctgaccgccgccttaatgttcctggtctacgagaagctgaccgccgcgactttcacagttatgggcctgaagcgagctcaccagcattag

SEQ ID NO: 135072 - DNA, 705 bp, Artificial Sequence
  Description of Artificial Sequence: Synthetic coding sequence
atggcttccgtgttaagttacgagtcactggtccatgcagtagctggagcggtcggctccgtgaccgccatgactgttttcttcccccttgacacagccagacttaggctgcaaggagttgtcaatgtgctgctgacaacacctctctgggtggtcaacactaggcttaagcttcagggtgccaaattcaggaacgaggatatcgtgcctacaaactacaagggaatcattgacgctttccaccaaataatccgggatgagggcatctccgcattatggaacggtaccttcccctccttattgctcgtattcaatcccgcgattcagttcatgttttacgagggattgaaacgccagctactcaaaaaaaggatgaaattgtccagcctggacgtattcattatcggagcagtcgctaaagcaatcgccaccacggtcacgtaccctctccagaccgtgcagagtatcctacgttttggtcgacatagactcaatccggaaaacagaacattaggttcactcaggaacattctttacttgcttcaccagagagtgcgccgctttgggatcatgggtctgtataagggtctcgaagccaaactgctacaaacagtcctaactgctgctctgatgttcctcgtctacgagaagctgacagccgcaacctttacggtgatgggattgaagagggctcaccagcattag

SEQ ID NO: 135073 - DNA, 813 bp, Artificial Sequence
  Description of Artificial Sequence: Synthetic coding sequence
atgattgatgaaaaaaggaagtctaagaccacccatatggtcctactcgagatcattaaggaggaaggtctcctggcaccctatcggggatggtttcccgtcattagctccctttgttgtagcaatttcgtgtatttttatactttcaactctctgaaagccctttgggtgaagggccagcactctaccaccggcaaagacctagttgtcggcttcgtcgccggagtggtgaatgttctcctaacaaccccactgtgggttgtgaacacacgccttaagctccagggcgcgaagttccggaatgaagacatcgtccccacgaactataaggggattatcgacgcctttcaccaaatcattagagatgagggaatcagtgctctgtggaacggtacctttccatcactgctgttagtgtttaatccggccattcagttcatgttttacgagggactgaagcgacaactgcttaagaagaggatgaaactgtcctcactggacgtatttattatcggcgctgtggctaaggccatagctaccactgtcacatatccattgcagactgtgcagtctattctccggtttggtagacatcggctgaatcccgagaataggaccctgggatccctccgcaatatcctttacctgctgcatcagagggtgagacgcttcgggattatgggattatataaaggactcgaggcaaagttactgcaaaccgttcttacagctgccctaatgttccttgtgtatgagaaattaaccgccgctacgttcactgttatgggactgaagcgagctcatcagcactag

SEQ ID NO: 135074 - DNA, 1086 bp, Artificial Sequence
  Description of Artificial Sequence: Synthetic coding sequence
atgttttcgtccgtcgcccatctggctagggcgaatccctttaatactccccacctgcagttggtgcacgatggtctcggtgatctccggagcagctccccagggcccaccggccaacccagacgtccacgcaatctggctgccgctgcagtcgaagaatactcctgtgagttcggatccgcgaaatactatgcgctttgcggctttggaggggtgctgtcatgtggcctgacacataccgccgtcgtgccattagatctagtcaagtgtcggatgcaggttgatccacagaagtataaaggtatattcaatggattctcagttactttgaaggaggatggcgtgaggggcttggctaagggttgggccccaacatttttaggctactcgatgcaaggactgtgcaagtttggtttctacgaggtctttaaggtcctttactccaacatgctcggagaagaaaacacatacctctggcgcaccagtctgtacttagctgcctctgcttcagccgaattcttcgcagacatagccctggcccccatggaggccgccaaggtgagaatccaaacacagcctgggtatgcgaatacacttcgcgacgccgctcccaagatgtacaaagaggaaggactgaaagcattctataagggcgttgcgccgctttggatgcggcagatcccatacaccatgatgaagttcgcctgcttcgaaagaactgtcgaggctctgtacaagttcgtggtgcccaaacccaggtcagaatgcagtaaacctgagcagttggtggtgacatttgtggccggctacatcgccggcgtgttctgcgcaattgtgtcacaccctgccgacagtgtcgtctccgtgcttaataaggagaagggttcgagtgcatcactcgtcttaaagcgccttggatttaaaggggtctggaaaggactttttgcccgtattattatgattggaacactgacagctctccagtggttcatttacgattccgtgaaggtgtactttagactgcctcgcccgcctccacccgagatgcctgaatctttaaagaaaaaactgggactgacccaatag

SEQ ID NO: 135075 - DNA, 1776 bp, Artificial Sequence
  Description of Artificial Sequence: Synthetic coding sequence
atggatgatctggatgcactgcttgccgacctagagtctacgacctcacacattagcaagagacccgtctttctgtccgaggagacaccgtacagttatcctacggggaaccacacctaccaggagatcgcagtgcctccgccagtacctccacccccttccagcgaggcgctgaacggcacaatcctggacccactggaccagtggcaaccgtcaagcagtcgcttcatacaccagcagccccagtcaagcagcccagtgtacggaagttccgccaagacatcctctgtctctaatccacaagactccgttggaagcccttgctctagggtgggggaagaggagcatgtttactcattcccgaataagcagaagagcgctgaaccctctccaactgtcatgtccacctccctggggtccaatttgtccgaactcgaccgcctgttgttagagttgaatgccgtgcagcacaatccacccgggtttcctgcagacgaagcaaacagttcgcccccgctcccgggggccttgtcaccattgtatggggttcccgagacaaacagccctctaggagggaaagccggcccactgacaaaggaaaagcccaagaggaacgggggtagggggctcgaggacgtccggccaagcgtggagtctctcctggatgaactcgagagttcagtcccgtctccagtcccagcaatcacagtgaatcaaggagagatgagctccccacagagagttactagcacccagcaacaaacacggattagtgcttccagtgcaacacgggagctcgatgaactgatggcatcactgtccgattttaaaatacagggcctcgagcagagggcagacggtgagcgctgctgggccgcaggctggccacgagatggaggaagatcctcacctggcggacaagatgagggggggtttatggctcagggcaagacaggctcttcctcaccaccaggggggcccccaaaacctgggtcccagttggattctatgttgggttctcttcagagtgaccttaataagctcggcgtggcaactgtggctaagggtgtgtgtggcgcctgcaaaaaaccaattgccgggcaggtagttaccgccatgggaaaaacatggcacccggaacactttgtttgcacacactgtcaggaggagatcgggtcccggaatttcttcgagcgggacgggcagccatattgcgagaaggactaccataacctattctcacccagatgctattattgcaatgggcccatcctagataaagtggtcaccgcacttgatcgtacttggcacccggaacactttttctgcgctcagtgtggagctttcttcgggcctgaaggatttcacgagaaggacgggaaagcctattgtcggaaagattattttgatatgttcgcacctaagtgcggcggttgtgcccgcgcaatcctcgaaaattacatctctgctctaaataccctgtggcatccggagtgtttcgtttgtcgggaatgcttcacgccgttcgtgaacggttcattttttgagcacgatggacagccttactgtgaggtgcattaccacgagcgccgggggtccttgtgcagtggatgccaaaagcctattactggccgatgcatcacagctatggccaagaagttccatccggagcacttcgtgtgcgctttttgccttaaacagctgaacaaaggaacctttaaagaacaaaatgacaagccttattgccaaaattgctttctgaaactcttctgctag

SEQ ID NO: 135076 - DNA, 1086 bp, Artificial Sequence
  Description of Artificial Sequence: Synthetic coding sequence
atgttttcttcagtggcccacttagccagggcaaatcccttcaacacaccgcacctccagctggtacatgatgggttgggagacctgcgctctagctctcctgggcctaccgggcagccaagaagaccacgaaaccttgctgccgccgctgtggaagagtacagttgtgagtttgggtcggcaaagtattacgccttatgcggttttggtggcgttctgtcctgcggcctgacccacacggctgtggtcccgcttgatctggtgaaatgcagaatgcaggtcgaccctcagaagtacaagggtattttcaatgggttttccgtgacgttgaaagaggatggggtccgcggactggccaaaggctgggccccgaccttcctgggctatagtatgcagggcctctgtaagtttgggttctatgaagttttcaaggttctctactctaatatgttgggcgaagaaaacacctacctgtggaggacaagcctctacttagccgcctcagcctctgcagagttcttcgccgacatcgcacttgcccccatggaggccgccaaagtcagaattcagacgcaaccaggttacgcaaatactcttagggatgcggcacccaagatgtacaaagaggagggtctcaaagcgttttataaaggggtggctcctctgtggatgcggcagattccctatacaatgatgaaatttgcatgctttgagagaaccgtggaagctctgtacaaatttgtcgtgcccaagccgaggagcgagtgcagtaagccagagcaactggtggtgacttttgtggcagggtatatcgctggagtattttgcgccatcgtgtcgcaccctgccgattcggtggtgtcggtgttgaataaggaaaaaggctcttcggcaagcctggtcctgaagcgacttggattcaaaggtgtgtggaaaggattgtttgcccgcatcattatgatcggcactctgacggctcttcagtggttcatctacgattccgtaaaagtctattttcggttgccgagaccacctccgcccgaaatgccagagtccctgaagaaaaagcttggactcacccaatag

SEQ ID NO: 135077 - DNA, 1086 bp, Artificial Sequence
  Description of Artificial Sequence: Synthetic coding sequence
atgttctcttccgtagcacaccttgcccgggctaacccctttaacacccctcacctacaactggttcacgacgggttgggggaccttagaagttcatccccgggtcccaccggacaaccccggcgccctcggaacttggccgcagctgcagttgaagagtactcatgtgagtttggatccgccaaatactatgcgctgtgcgggttcgggggcgtcttgagctgtggcttgacacacaccgctgttgttcctctcgatctcgtcaaatgtaggatgcaagtcgaccctcagaaatataaagggatcttcaatggtttctctgtgacacttaaggaagatggtgttcgtggcctcgcaaaagggtgggcacccaccttcttaggatattcaatgcagggtctgtgcaagttcggtttttatgaagtcttcaaagtcctttactcaaatatgttgggagaggagaatacatacctgtggaggaccagcctgtatctggccgcgtccgcatctgctgaatttttcgctgatattgcactagctccaatggaggctgccaaggtgcgcatccaaacccagcctggctacgccaacactctccgtgacgccgcacccaagatgtacaaggaggaggggctaaaagccttttacaagggcgttgccccactttggatgagacagatcccctacacaatgatgaagtttgcttgcttcgaacgtaccgtcgaagccttgtacaaattcgtcgtccctaagccacggtcagagtgctctaagcccgagcagctggtggtgacgttcgtggccggatacatcgccggggtgttctgtgcaattgtctcccatcccgcagattctgtggtgtcagtgctgaacaaagaaaaggggagctccgcttcactggtacttaagagactcggctttaaaggggtctggaaaggtctcttcgcccggattattatgatagggacgctgacggccttacagtggtttatttatgattctgtgaaggtgtacttcagactaccccgtccccctccgccagaaatgccagaaagcctgaaaaaaaaactgggcctcacacaatag

SEQ ID NO: 135078 - DNA, 1089 bp, Artificial Sequence
  Description of Artificial Sequence: Synthetic coding sequence
atgttcagctccgtcgctcacctggcccgggcaaatccttttaataccccccacctgcagctggttcacgacggactcggtgacttgcgctcctcctcaccagggcctactggtcagccacgcagacctaggaacctcgccgccgccgctgtcgaggagcaatactcctgtgattatgggtcaggaagattcttcatcctgtgcgggctgggggggatcattagttgcggcaccacacacaccgctttggtcccactagatctcgtcaagtgcaggatgcaggtggaccctcagaagtataaaggcattttcaatggcttttccgtcacactcaaggaagacggagtccgtggtctggccaaaggatgggcgcctacatttctgggatattcaatgcagggcctgtgtaagtttgggttttacgaggtgttcaaagtcctgtatagcaacatgctgggcgaagaaaacacatatttgtggaggacatctttatacctggctgcatctgcaagcgcggagttctttgcagatattgccctggccccaatggaggctgctaaggtgagaatccagactcaaccaggttacgcaaatacactgcgggatgccgctccgaaaatgtacaaggaagagggcctgaaggccttctacaagggcgtcgctcctctctggatgagacaaattccttatacaatgatgaaattcgcctgtttcgaacggaccgttgaagctctgtataaattcgtggtccctaagcccaggtctgagtgctccaagccagagcagctcgtggtaacattcgtggcaggatacatagctggcgtgttttgtgccatagtgtctcatcctgctgactcagttgtcagtgtccttaataaggaaaaaggttctagtgcctccttggttttaaagcgccttgggttcaaaggcgtgtggaagggattgtttgccaggataataatgatagggaccctgacagcccttcagtggttcatctacgactccgtcaaagtctatttcaggctccctcgaccccctccgcctgagatgcccgaatctctgaagaaaaaactggggctcacccaatag

SEQ ID NO: 135079 - DNA, 1086 bp, Artificial Sequence
  Description of Artificial Sequence: Synthetic coding sequence
atgttttctagcgtcgcacacctcgccagagccaacccctttaataccccacacctgcagctggtacatgacggccttggagacctccgcagctccagtccaggccctactggacaacctcgcagacctaggaacttggccgccgcagcggtggaagagtattcttgcgagtttggaagcgctaaatattacgccctgtgcgggttcgggggagtgctgagctgcggcctaacccacactgcagtcgtgccgctcgaccttgttaagtgccgcatgcaggttgatccccagaaatataagggcatatttaacggcttctctgtgactctcaaagaggacggcgttagagggctggccaagggttgggcccctaccttcttagggtactcgatgcagggtctatgcaaatttgggttttacgaggtgttcaaggtactatatagtaacatgttgggtgaagagaacacatacctgtggagaaccagcctgtatctggccgcgagtgctagtgcagaattttttgccgacatcgccctggcacccatggaagccgccaaggttcgaatccagacgcagcctgggtacgctaacactctccgcgacgccgcacctaagatgtacaaagaggaggggctcaaagcattctataagggagttgccccgctctggatgagacaaataccctacactatgatgaaattcgcctgctttgaaaggactgtggaggcgctctataagttcgtcgtgcctaaaccacgctcggagtgcagcaagcccgagcagttagtcgtgacctttgtggccggttatatagcaggggtcttctgcgccatcgtctcccatccggcggattctgtggtttctgtgctgaacaaggaaaaggggagctctgcatccctcgtgctaaagagactcggttttaagggagtgtggaaagggcttttcgctcggattatcatgataggcaccctcaccgctctgcagtggttcatctacgattccgtaaaggtgtatttccgcctgccacggcctcctccacctgaaatgccagagtctctgaaaaagaaacttgggctgactcagtag

SEQ ID NO: 135080 - DNA, 897 bp, Artificial Sequence
  Description of Artificial Sequence: Synthetic coding sequence
atgagtgcaaagccagaagtgagtctggttagagaggccagccggcagatcgtcgccggtggcagcgccggccttgttgagatctgcctgatgcatccactagacgtcgtcaagactagattccaaatacagcgatgcgcgacagacccaaactcctacaagtcgttggttgattcatttagaatgatatttcagatggagggtctgttcggcttttacaagggaattctgccacctattctcgccgaaaccccaaagagagccgtaaagtttttcacatttgagcagtacaagaagctgcttggctacgtctccctgtcacctgctctgacttttgctattgccggcctcggctctggtctgactgaagcgattgtcgtcaaccccttcgaggtggttaaagtgggcttacaagccaatagaaacacctttgccgaacaaccatccactgtcggctacgcccggcaaatcatcaagaaagaaggctggggcctccagggcctcaacaagggactcacggcgacccttgggcgccacggcgtcttcaacatggtgtattttggcttttactataacgtcaagaatatgatcccagtgaacaaagacccaattctagaattctggcggaagtttggaattgggctcctttcaggaacaatcgccagtgtaatcaatatcccttttgacgtcgcgaagagccggatccagggacctcaacccgtacctggagaaattaaatatagaacctgcttcaaaacgatggctaccgtctaccaggaagaggggattttagccctgtataagggactgttgccgaagataatgcggctgggaccaggaggggcagtgatgctgctggtttacgaatacacgtatagttggctgcaggagaactag

SEQ ID NO: 135081 - DNA, 900 bp, Artificial Sequence
  Description of Artificial Sequence: Synthetic coding sequence
atgtccgctaagcctgaagtatcactggttagagaggcgtcaagacagattgtggccgggggatccgcagggctggtcgagatttgcttgatgcaccctctggatgtggtgaagacacgtttccagattcagcgctgtgcgactgaccctaactcctataagtccctagttgattccttccgaatgatcttccagatggaaggattattcggattctacaagggaatcctacccccaattctcgccgaaacccctaaacgagcagttaaattttttacatttgagcagtacaaaaaactccttggctatgtgtcgcttagcccggccctaaccttcgctattgctggacttggctctggactcactgaagctatagtggtaaaccctttcgaggtggtcaaagtaggactgcaagccaatcgcaacaccttcgctgaacagcctagcacagtgggctacgctcgacagattattaaaaaagaaggatggggactgcaaggcctgaacaagggtctaactgccactttagggcgccacggcgtttttaatatggtgtacttcgggttttactataacgttaagaatatgattcctgtgaataaggatcccattctggaattttggcgcaaattcggtatcggtctgctgtcagggaccattgcaagcgtgatcaacatcccatttgatgtagctaaaagtagaatccagggcccgcagccagtgccgggggaaataaagtacaggacatgctttaaaacaatggcaactgtttaccaggaggagggcatcctggcactgtacaagggtttgctgccgaaaatcatgcgattggggccgggaggagccgttatgcttctagtttacgaatatacctacagctggctacaggaaaattggtag

SEQ ID NO: 135082 - DNA, 963 bp, Artificial Sequence
  Description of Artificial Sequence: Synthetic coding sequence
atggtgggctatgaccctaaaccggacgggaggaataacactaagtttcaggtggctgtggccggctctgtatctggactcgtcaccagggcgctgatttcgccctttgacgtgataaagattaggttccagctgcagcatgagcgactatcacgatccgaccctagcgccaagtatcacgggatcctccaggcatcaaggcagatccttcaagaagaagggccaaccgcattctggaaaggccacgtaccagcccagatcctttcaatcggatacggcgctgttcaatttctcagcttcgaaatgcttacagagctcgttcaccggggcagtgtttacgatgcccgcgagttctccgtccatttcgtgtgcggcgggctagctgcctgtatggccaccttaacagtgcatcctgttgacgtcttacggacacgattcgccgctcagggtgaaccgaaggtatataacacattgaggcatgcagttgggacaatgtacagatccgagggtcctcaggtgttctataaggggttggcccccacgcttatcgctatcttcccgtatgccggcctccagtttagttgctacagctcacttaagcatctgtacaaatgggccatccctgccgaagggaaaaagaacgaaaatttacaaaacctgctgtgtggaagcggcgcaggggtcatctcaaaaaccctcacttatccactggatctgtttaaaaagaggctccaggttggtgggtttgaacacgctagagccgcattcggccaggtgagaaggtacaagggactcatggactgtgcaaaacaagtccttcaaaaagaaggtgctctcggatttttcaagggtctatcaccttcccttcttaaagcagccctttctacagggttcatgttttttagctacgagtttttctgcaacgtgttccattgtatgaatagaactgcttctcagcgttag

SEQ ID NO: 135083 - DNA, 963 bp, Artificial Sequence
  Description of Artificial Sequence: Synthetic coding sequence
atggtgggatatgatccaaagccagacggcaggaataacactaaatttcaagtggctgtggcgggaagtgtcagtggtttggtcacacgcgctcttatctcaccgttcgacgtgatcaaaatcagattccaactgcagcatgaacgactttcccgttccgacccatccgcaaagtatcacggaatcttacaggcctcgcgacaaatccttcaggaggagggaccgaccgctttctggaaaggacacgtgccagcacagatcctgtcaataggctacggtgccgtgcagttcctgtcattcgagatgctgactgagctcgttcacagaggcagcgtttatgacgctcgggagttcagcgtacactttgtgtgcggcgggttggccgcctgcatggctactctgacggtgcacccagtagacgtgctccgcacgaggttcgccgcacagggcgagcccaaagtatataacactttgcggcatgccgtcggtactatgtatagatctgaagggcctcaagtgttctacaaagggctggccccaacacttattgccatttttccctatgccggcctgcagttcagttgctatagtagtctgaagcatctctacaagtgggctataccagccgaaggcaagaagaatgaaaacttgcagaacttgctttgcggaagcggggcaggtgtgatttctaagaccctcacttatcctctggacctgttcaaaaaaagactgcaggtaggaggctttgagcacgccagggccgcatttgggcaggttaggcggtataaagggctgatggactgcgctaagcaggtgcttcagaaagaaggggccttgggattcttcaagggcctctctccttctctgttgaaagcagccttaagcacaggcttcatgttcttctcttatgaatttttttgcaacgtcttccactgcatgaatcgtactgcgtcacagcgttag

SEQ ID NO: 135084 - DNA, 792 bp, Artificial Sequence
  Description of Artificial Sequence: Synthetic coding sequence
atggttggttacgatccgaaaccggacgggagaaacaacacaaaattccaggtggcagtcgctggctctgtcagtggcctcgtgactcgtgcactcatatccccttttgacgtgatcaagattagatttcagctgcagcacgaacgtctgagtaggtccgaccccagcgcaaagtatcacggaattctgcaggccagccgccaaatcttacaggaagaaggccccacggcattttggaaggggcacgtccccgcccagatcctcagtattggatatggagccgttcaggtgtataatactttgcgtcatgcagtgggcacgatgtacaggagcgaaggcccccaggtcttttacaaggggctggcccctaccctgattgccatcttcccgtacgccggactccagttttcttgctattcatcattgaaacacctctataagtgggccattccggccgagggcaagaaaaatgagaacctacagaacctactgtgtggatccggagccggagtgatttccaaaacgctcacatacccactggacctcttcaagaagcggctgcaggtgggaggtttcgaacatgctagggccgcatttggacaggtccgaagatataagggtctgatggattgcgcaaaacaagtgctgcagaaagaaggcgctcttggcttctttaagggcctgtccccctcattgctcaaagccgccctgagcacagggttcatgttcttctcatatgaattcttttgcaatgtttttcactgtatgaatcggacagccagtcagcgctag

SEQ ID NO: 135085 - DNA, 963 bp, Artificial Sequence
  Description of Artificial Sequence: Synthetic coding sequence
atggtcggatatgatccgaaacccgatggacgaaacaacacaaagtttcaagttgcggtggcaggcagcgtatccggactggtaacccgcgctctcatctcacctttcgatgtgatcaaaatcagattccagctgcagcacgaacggctatcaaggagcgacccgtctgctaaataccacgggattttgcaggcttctcgccagatcttacaggaagagggccccacagccttctggaaaggacatgtgcccgcacagatcctgagtatcggatacggagctgttcagtttctgagcttcgaaatgctcacagaacttgtccatcgaggaagcgtatacgacgctcgcgaattcagcgtccacttcgtttgtgggggacttgcagcatgtatggctacgttgacggtgcatcccgtggatgttctcaggactcgcttcgctgcgcagggtgagcccaaagtgtataatacactgcgacatgcagtcggcaccatgtatagaagtgaaggcccccaggttttctacaagggactggcccccacgctgatcgcaatattcccttacgcgggtctgcagttcagttgttacagctctctcaagcatctgtacaaatgggctatccctgccgagggcaaaaaaaacgaaaatttacagaacctgctttgtggtagcggcgcgggcgtaattagtaagaccctgacgtacccattagacttgttcaaaaagaggctgcaggtgggtggatttgaacacgctcgcgctgcattcggacaggttcgaaggtataaaggcctaatggactgtgcaaaacaggtgctgcagaaggagggggcattgggtttcttcaaaggtctgtcaccttctttgctgaaagccgccctctccactgggtttatgttcttctcctatgaatttttctgcaacgtattccactgcatgaacaggaccgcttcccagagatag

SEQ ID NO: 135086 - DNA, 963 bp, Artificial Sequence
  Description of Artificial Sequence: Synthetic coding sequence
atggtcgggtacgaccccaaacctgatgggaggaataatacaaagttccaggtcgcagtagcgggatccgtcagtggccttgtgactcgagcgctgatttcaccattcgacgttataaaaatccggttccagcttcagcacgaacggctgtcccgctccgacccaagtgctaagtatcacgggatcctacaagcatccaggcagatcctccaggaggaggggccaacagcattttggaaaggccacgttcctgctcagatcctgtccattggctacggggccgtccagttcctttcattcgaaatgctcactgaactcgtccaccggggctctgtgtacgatgctcgggaattcagtgtacacttcgtgtgcgggggccttgctgcgtgcatggctaccctcacagtgcacccagtggatgtcctgcgaacacgttttgccgcccaaggcgagccaaaagtatacaataccctgagacacgccgtcggcacaatgtatcgctccgaaggcccccaggtcttctacaagggacttgcgcccacgcttattgcaattttcccctacgccggacttcaattctcctgttattcatctctaaagcacctgtacaaatgggcaatccctgccgaaggtaaaaagaacgaaaatctgcagaatctgctgtgtggatccggagctggggtgattagcaaaactctgacctatccactggacctattcaagaagcggcttcaagtcgggggcttcgagcacgcccgggcagcctttggccaggtccggcgatataagggcctaatggattgcgcaaagcaggtgctgcagaaggaaggtgctctcggcttctttaagggactctctcccagcttactcaaagccgcgcttagcacgggattcatgttcttctcctatgaatttttctgtaacgtcttccattgtatgaatcggacagcctcccagagatag

SEQ ID NO: 135087 - DNA, 963 bp, Artificial Sequence
  Description of Artificial Sequence: Synthetic coding sequence
atggttggctatgatccgaagccagatgggcggaataatacaaagttccaggtcgccgttgctggctcagtttcaggtcttgttactcgggccctaataagcccctttgacgtgatcaagatccggtttcaactacagcacgaaaggctgtcacggtcagatccgagcgcaaaatatcatggaatcctgcaggcttcccgccagattctacaggaggagggacctactgccttctggaaggggcatgtacccgcccaaatcctctccataggctatggggccgtccagttcctctccttcgagatgttgactgagctggtccaccgaggcagtgtctatgacgctagagagttctccgttcacttcgtctgtggcggcttggccgcttgcatggccaccctgactgttcatcccgtggacgtgctgagaacaaggtttgcggcgcagggagaacccaaagtgtataacactctacgacacgctgtaggcactatgtataggagtgagggcccacaggtgttctacaagggccttgcacccactctgatcgcaatctttccatacgccggactccagttctcctgctattctagtctgaaacacctctacaagtgggctattccggctgagggtaaaaaaaacgagaacttgcagaatctgctttgcgggagtggggctggcgtcatttccaaaactcttacctatccgctggacctcttcaaaaaaagactgcaagtgggcggtttcgaacacgctagggcagccttcgggcaggtgagacggtacaaaggtctcatggattgtgcaaaacaagtgttgcagaaggagggggccctggggtttttcaaaggcctgagtccctccctgctcaaggccgcactgtcaacaggttttatgtttttttcttacgaattcttctgcaatgtgtttcattgcatgaatcgtacagctagccagcgctag

SEQ ID NO: 135088 - DNA, 2028 bp, Artificial Sequence
  Description of Artificial Sequence: Synthetic coding sequence
atggccgcagccaaggtggccctgacaaaacgcgcagacccagccgagcttaggactatcttcctcaaatatgccagtatcgagaagaatggcgagtttttcatgtcaccgaatgacttcgtcactcggtatctgaatattttcggcgaatcacagcccaaccctaagaccgttgagttgttatccggggtcgtggaccagaccaaagacggactcatcagctttcaggagttcgttgcgttcgaatctgtgctttgcgcaccagatgcattgtttatggtggcctttcagctgttcgataaagccggcaaaggggaagtgactttcgaagacgttaagcaggtgttcgggcagacaactattcatcagcatattccttttaactgggattctgaatttgtccaattgcacttcggcaaagaaaggaagcggcacttgacttatgcggaattcacacagttcctactagagatccaactggaacatgctaagcaggcgtttgtgcagcgggataacgctcgcacaggccgtgttacagccatcgatttccgtgatatcatggtgactatccggccacacgttcttaccccatttgtagaagagtgcctcgttgccgcagccggcggaactacctcccaccaggtgtctttttcgtactttaacgggttcaacagcctgctcaacaacatggagctgattagaaaaatctattcgacacttgcaggaacaagaaaagacgtcgaggtgacaaaggaagaatttgtcttggctgcccaaaagttcggccaagtaacaccaatggaagttgatatcctgttccaacttgctgatctttacgagccccgcgggagaatgaccttagccgatatcgaaagaattgccccattggaagaaggtaccttacccttcaacttggctgaggcccagcgccagaaagccagcggagacagtgccaggcctgtgcttctccaagtagccgagagcgcatataggttcgggcttggctcagtggcaggagccgtcggagccaccgcagtttatccaattgatttagttaaaactcgaatgcaaaaccagcgatctaccgggagcttcgtgggagaacttatgtacaagaactccttcgactgttttaagaaggttctgcgctacgagggattcttcggtctgtatcgaggcttgctccctcagctgcttggtgtagccccagagaaggcaattaagcttaccgtcaatgactttgttcgggataaattcatgcataaagacggtagcgttcccctggccgcagagattttggcaggcggttgcgccggtggttctcaggtgattttcactaacccactcgagatagtcaaaattaggctgcaagtagcaggagaaatcacaacaggaccccgcgtttctgccctttctgtggttcgggacttggggttcttcggtatttacaagggcgccaaggcctgctttctccgagacattccgttctcagcaatttacttcccgtgttatgcccatgttaaggcctccttcgctaatgaggacggacaagtgtccccaggcagtttgttactggccggagcgatagcaggaatgcccgcagcttccttggtgaccccagccgatgtcattaagacacgactgcaggtggcagcacgcgctggccagacgacttactcaggtgtaatcgattgtttcagaaaaattttgcgtgaagaaggccctaaggccctttggaaaggcgcaggagcacgcgtatttagatcttcaccccagttcggggtgacactcttgacctacgaactcttgcagaggtggttttatatcgactttgggggtgtcaagccaatgggatctgagcctgtgccaaaatcccggattaatttgcctgcccccaacccagaccacgtaggaggatacaagctggccgtggccacatttgccggaatcgaaaataaatttggcttatatctccccctgtttaaacccagcgtatctacttctaaagctattggcgggggcccctag

SEQ ID NO: 135089 - DNA, 2031 bp, Artificial Sequence
  Description of Artificial Sequence: Synthetic coding sequence
atggccgctgctaaagtcgcattaacgaagcgcgcggatccagcagaacttagaaccatcttcctgaagtatgcctctatcgagaagaacggtgagttcttcatgtcccccaatgattttgtgactcggtatctgaacattttcggagagagtcagcccaaccctaagaccgttgagctgttgagtggagtcgtagaccagacaaaagacggcctgatctccttccaggagttcgttgcttttgagtccgtactttgtgcccccgacgctctgttcatggtcgctttccaactctttgacaaggcaggcaaaggcgaggtgacattcgaggatgtcaagcaggtttttggacagactacaattcatcagcatatccccttcaactgggactctgagtttgtccagcttcacttcggaaaggagcgaaaacggcatttaacttatgccgaatttacccagttcctgcttgaaatccagctagaacatgcaaagcaggccttcgtacagcgagataacgctagaactggccgtgtgactgccatcgactttcgggatattatggttacaatcagaccacacgtgctaacccctttcgtggaagaatgtctggtcgccgcagccggtgggaccactagccaccaggtctctttctcatatttcaacgggttcaacagtttactgaacaatatggaacttatccggaaaatatactcaacactagctggcacacgcaaggacgtagaggtaactaaagaggaatttgttcttgccgcgcagaaatttggacaggttacccctatggaggttgatatcttgttccagctggcggacctctatgagcctcgaggcagaatgacattagccgacatagagcgcattgcgccgctggaagaggggacactgccgttcaatcttgcggaggctcagcgccaacagaaggccagcggcgatagcgcgagacccgttttactccaggtggcagagtcagcatatcgattcggccttggatctgtggctggagcagtgggcgctactgccgtatacccgatcgacttggtcaagactcgcatgcagaatcaaaggagcactgggtcgtttgtgggcgagctaatgtacaaaaatagttttgattgcttcaagaaggtactgagatacgagggctttttcggcctctacagaggtctgctgccccagctgcttggagtcgcccccgaaaaggccattaaactaacagtgaacgacttcgtgcgggacaagtttatgcacaaagatggaagtgtgcctctcgcagcagaaattttggccgggggctgtgccggtggaagccaagtaatattcaccaaccctctggaaatagtgaagatcagactacaagtggcaggggagattactaccggcccccgcgtgagtgccctcagcgtggtccgggacctcgggtttttcggtatttataagggtgcaaaagcatgcttcctgagggatattcccttctctgccatttatttcccttgttatgcgcacgtgaaagcctccttcgccaacgaagacgggcaagtgagccccgggtcactcctgctggccggggccattgccgggatgccagcagccagcctggtgacccccgccgacgttatcaagacaaggttacaggtggccgccagggcagggcagacaacttacagcggggtgatcgattgcttccggaaaattctgagagaagagggacccaaagctctctggaaaggagcgggagcgagggtctttcggagcagcccccagttcggagtgactctcctgacatacgagctattgcagaggtggttctacatcgactttgggggtgttaagccaatgggctcagagccggttcctaaaagtaggatcaacctgcctgcccctaaccctgaccatgtgggcgggtacaaactggctgtggccactttcgctggaattgagaacaagttcggtctgtatctgcctttatttaaaccttccgtcagtacatctaaggctatcggggggggaccttag

SEQ ID NO: 135090 - DNA, 1704 bp, Artificial Sequence
  Description of Artificial Sequence: Synthetic coding sequence
atggaggatgttaagcaggtattcggccagacgactatccatcagcatatcccttttaattgggatagcgaatttgttcagctacatttcgggaaggaacggaagcggcacttgacctacgcggagttcacccagttcctactggagattcagttggagcacgcgaaacaagcctttgtccaaagggacaatgcacgtaccggcagggtgacagccatagactttcgggacatcatggttacaatcaggccacacgttctcacgccctttgtagaagaatgtctggtcgcagctgccggtgggaccaccagccaccaagttagcttctcctacttcaatgggtttaattccctgctgaacaatatggagctaattcggaaaatatactcaacgctggcaggcacaagaaaggatgttgaggtgacgaaggaggaatttgttctcgcagcacagaagttcggacaggtgacacctatggaagtggacattctgttccagctagccgatctctatgaaccccgagggcgcatgacactagcggacatcgagcgcatcgcccccctggaagaaggaacccttccgtttaatctggccgaagcgcaacggcagaaggcaagcggggattcagcccgtcccgtcctgttacaggtagctgaatcagcataccgattcggcttaggtagcgtcgcaggtgccgtgggggctactgccgtttatccgattgacctggttaagacgagaatgcagaaccagcgatccactggatcctttgtcggggagctgatgtataagaattccttcgactgctttaaaaaagtgctgagatacgaaggtttttttggactgtacagaggcctcctcccacaacttttaggtgtcgcccctgagaaagccatcaaactgacggtcaacgattttgtgcgggataagttcatgcacaaggatggaagtgtgccgctggccgcagagatcctagccggggggtgcgcaggaggctcccaggtgatcttcaccaaccccctggagattgtcaaaatccggctgcaggtggccggggagataacgacaggtcctagggtgtcagcccttagcgtcgtccgggatctggggttttttggaatttataaaggggctaaagcatgctttctgagagatatccctttctctgcgatttatttcccttgttacgcgcatgtgaaggcttcgttcgccaacgaggacggtcaagtttcacctggtagcctgttactcgctggcgccatcgcaggcatgcccgccgcttccctggtgacgcctgcagatgtgattaagacaaggctgcaggtggcagcccgagccgggcagactacatacagtggcgtgatcgactgcttccggaagatcctccgggaggaaggtcccaaagccctctggaaaggtgcaggcgcccgagtatttaggagttcccctcagtttggcgtgaccctgctcacctatgaacttcttcagaggtggttctacatcgacttcggaggtgtaaaaccaatgggctccgaacctgtgccgaaaagcaggattaacttgccagcccctaacccagatcacgtggggggttacaagcttgctgtcgcgacatttgccggaatcgaaaataaattcggcctatacctacctctgttcaaaccctctgtaagcaccagcaaagccatcggtggtggtccttag

SEQ ID NO: 135091 - DNA, 561 bp, Artificial Sequence
  Description of Artificial Sequence: Synthetic coding sequence
atgaagcacatgttagcggccagcgctggcgaagtggtggcttgcctcattagggtcccttcagaagtcgtgaaacagcgagcgcaggtgagtgcatctacgcgaaccttccagatttttagcaacattttatacgaagaagggattcagggactgtacagaggatataaatcaacagtgctccgtgagatcccttttagcctggtgcagttcccgctgtgggaatccctcaaggccctgtggtcttggagacaggatcacgtcgtggactcttggcaaagtgcagtctgcggcgctttcgccgggggattcgctgccgctgttacaacgcctctggacgttgccaagacacgcataacactggcaaaagcagggagcagcactgccgacggcaatgtgctatctgtcctgcacggtgtgtggcgcagccagggactggctggacttttcgcaggagtgttccctcggatggccgcaatcagcctcggcggatttattttcctgggcgcctacgacagaacccactcactgctgttggaagtgggtaggaagtctccttag

SEQ ID NO: 135092 - DNA, 825 bp, Artificial Sequence
  Description of Artificial Sequence: Synthetic coding sequence
atggatcgaccagggttcgtggcagctttagtggccggtggcgtcgctggtgtaagcgtggatctgattctgttccccctggatactattaagactcgcctgcagtctccccaaggcttctcaaaggccggggggtttcacggcatttacgctggagtaccctctgccgctatcgggtccttccccaatgctgctgcttttttcattacgtacgagtacgtcaagtggttcctgcacgcagactcaagtagctacctaacgcctatgaagcacatgctggcagcctctgctggtgaagttgtggcgtgtttgatccgcgtaccctccgaggttgtgaagcagcgcgcccaggttagcgcttctaccagaaccttccagatatttagcaacatcctctatgaagaaggcatacaggggctgtaccgagggtacaagtcaacggtgctgcgcgagattcctttttccctggtccagttcccgctctgggaatcactcaaagccctttggtcttggagacaagaccacgtcgtcgactcctggcagtccgcagtgtgtggagccttcgctggaggctttgcagcagctgtgaccacccccctggacgttgcgaagacgcgtatcacactcgccaaagctggttcttccactgccgacggtaacgtcctcagcgtccttcacggtgtgtggagatcgcaggggcttgcaggcctttttgccggtgtgtttccccggatggccgctatcagtttggggggtttcatcttcctgggggcatatgatcgaactcatagtcttctcctcgaagtaggacgtaagagcccttag

SEQ ID NO: 135093 - DNA, 66 bp, Artificial Sequence
  Description of Artificial Sequence: Synthetic coding sequence
atggatcggcctgggtttgtcgccgcacttgtcttactgcactttctgtcaccgatgaatatgtag

SEQ ID NO: 135094 - DNA, 477 bp, Artificial Sequence
  Description of Artificial Sequence: Synthetic coding sequence
atggaggggaaaaggaagctggagggcaagcctctccggtttcgaggggtccaccacgcatttgcaaagattttggcagaaggaggcattcgcggcctttgggcggggtgggtccccaacatacagagggcggcactcgtcaatatgggtgacctgacaacctatgataccgtcaagcattacctggttcttaataccccattagaagacaacataatgacccacggcctgagttctctttgctctggtctagtcgcctccattctgggaacacctgctgacgttatcaagtctcgcatcatgaatcaaccccgggataaacaaggacgaggccttctgtacaaatccagcactgattgcctaattcaagcagtacagggtgagggctttatgtctctatacaaaggctttttacctagctggctcaggatggcagcagttatagtgaactccagccgatcacagctgaaggtttag

SEQ ID NO: 135095 - DNA, 972 bp, Artificial Sequence
  Description of Artificial Sequence: Synthetic coding sequence
atgtccgttcctgaggaagaagaacggctgcttccactcacccagcgttggcctcgcgccagtaagtttttgctctccgggtgtgccgccacagttgctgaattagccacttttccactggatttaaccaagacccggctgcagatgcaaggtgaagcagccttggcacgtctgggagacggggctcgagaatccgcgccctaccgcggcatggtgcggacggcattgggcatcatcgaggaggaaggcttcctgaaactttggcagggggttaccccggctatctacaggcacgttgtgtactccgggggccggatggttacttatgagcatctgcgcgaggtggtctttggcaaatccgaagatgagcactaccctctgtggaagtccgttattggaggtatgatggctggtgtcattgggcagttcctcgcaaatcccaccgatttagtaaaggttcagatgcagatggaggggaagcggaagctcgagggaaagcctttgcgtttccgcggggtccaccatgcattcgccaaaatactggcggagggtgggatccggggactctgggcaggttgggtgccaaacattcagcgggctgctttggtcaacatgggggatcttacaacttacgacaccgtgaaacactatctggtgctgaatactccattagaggataatatcatgacacacggactcagcagcttatgttcagggctcgtcgcctccatcctgggtacccctgctgatgtgattaagagccgtataatgaaccagcccagggacaagcagggcaggggcctgctgtacaaaagctcaaccgactgtctgatccaagctgttcaaggggaaggattcatgagtctgtataagggctttttgccctcgtggctgcggatgacgccatggagtatggtattctggctgacatatgagaagatccgtgaaatgagtggcgtgagccccttctag

SEQ ID NO: 135096 - DNA, 738 bp, Artificial Sequence
  Description of Artificial Sequence: Synthetic coding sequence
atgtctgtcccagaagaggaagaacgtttgctgccactgacccagcggtggccccgagccagcaaatttctcctgagcgggtgtgcagctacagtcgccgaactagcgacttttccgcttgaccttaccaaaacgcgtctccagatgcaaggtgaggccgcattggctcgattaggggacggggctcgagaaagcgctccgtataggggtatggttcggacggccctggggataatcgaggaggagggcttcctcaagctgtggcagggcgtaacgccagctatttataggcacgtagtgtacagcggggggaggatggttacttacgaacaccttagagaggtggtcttcggcaaatccgaggacgagcactacccactgtggaaatctgtgatcggcgggatgatggcaggagtcattgggcagtttctggctaatcctactgatttggtaaaagtccagatgcagatggagggaaaacgaaagctggaaggcaagcctctcagatttcggggagtgcatcacgctttcgccaagattctggctgagggagggatcagaggcctgtgggccgggtgggtgcctaatatccagagagcagccttggtgaatatgggggacttaacaacatatgataccgtaaaacactacttagtactgaatactccattagaagacaacatcatgacccatgggctgagctcagatctcgttggttctcacaaagctatccagtag

SEQ ID NO: 135097 - DNA, 297 bp, Artificial Sequence
  Description of Artificial Sequence: Synthetic coding sequence
tagaacatgggtgacctgactacatacgacacagtaaaacactatctggtcttgaacacccctttagaagataacataatgacacacgggctgtcaagcctctgtagcgggctggtcgcttcgattcttggtacacccgctgatgtgattaagtcccgcataatgaaccagcccagggataagcagggcagaggtctgctatacaagtctagcaccgactgcctgatccaggctgtgcagggggaaggcttcatgtccttgtataagggtttcttaccgtcctggctccgtatgtag

SEQ ID NO: 135098 - DNA, 450 bp, Artificial Sequence
  Description of Artificial Sequence: Synthetic coding sequence
atgtcggagtgccccctcattctttatattcataagcatatagacacttattctcagtcctacctgtttaatgacctgttctaccccgtgtatagtgggggcaggatggtcacttacgaacaccttcgggaggttgtgtttggaaagtccgaggatgaacactatcccctgtggaagtccgttataggaggcatgatggccggagtgattgggcagtttcttgccaatccaaccgacctggtgaaggttcaaatgcagatggagggaaagcggaagttagaaggtaagccacttaggttccggggcgtacaccatgcgtttgctaagatcttggcagagggggggatacgaggtctgtgggcaggatgggtccctaatattcaaagggccgcccttgttaacatgggtgatctcactacgtacgacaccgtcaagcactatctggtttag

SEQ ID NO: 135099 - DNA, 480 bp, Artificial Sequence
  Description of Artificial Sequence: Synthetic coding sequence
taaatggagggcaagagaaagctggagggaaaaccacttcggttccgcggagtacatcacgcattcgccaaaattctagccgaaggcggaatcaggggactctgggccggctgggtgccgaatattcagagagccgccctggtcaatatgggtgacctgacaacttatgacacagtgaagcattacttggtgttgaacaccccactagaggataatattatgacccacggcctgagtagcctttgctccgggttggtggcttctatattgggcacccctgccgacgtgatcaagtcacgcatcatgaatcagcctcgggacaagcaaggacgtggactgttgtacaaatcaagcactgattgcctgatccaggcagtccagggcgagggcttcatgtccctatacaaagggtttctcccctcctggctgcgaatggcggccgtaattgtcaactcctctagatcacagctcaaagtctag

SEQ ID NO: 135100 - DNA, 714 bp, Artificial Sequence
  Description of Artificial Sequence: Synthetic coding sequence
atgtacttgtatctgatgaagatgccagcagcctaccaggtttacagtgggggcaggatggttacgtatgagcatctccgggaggtggtgtttgggaaaagcgaggacgaacactaccctttgtggaagagcgttatcggcggaatgatggccggggtcatcggccagtttctggccaatcctacagatctagtgaaagtgcagatgcagatggagggtaagagaaagctagaaggcaagccattgaggttccgcggagttcatcacgcgtttgcaaagattctggcagaaggagggattagaggcctgtgggccggatgggtgcccaacatccagagggcagccttggtgaatatgggagacttgactacatatgacactgtgaagcattacctggtcctgaacacacccctcgaagacaatatcatgacccacgggctttcttcgctgtgcagtggactggtggcatcaatcctgggcacaccagctgacgtaatcaagagccggatcatgaatcagccaagagataaacaaggcaggggcctactgtacaaatcatccaccgactgcctgatccaagccgtgcagggagagggctttatgagcctgtacaagggcttcctcccctcttggttaaggatgacaccctggagtatggtattctggctgacctacgaaaaaatcagggagatgtccggagtcagcccattctag

SEQ ID NO: 135101 - DNA, 1095 bp, Artificial Sequence
  Description of Artificial Sequence: Synthetic coding sequence
atggagctcgaggggagaggggccggaggtgtggcaggtggcccagccgctggacccgggcgctccccaggggagtctgccctactggacggttggctgcaaagaggagtcggccgtggcgcgggggggggcgaggcaggcgcctgccggcctccagtccggcaggatccagatagcggtcctgattacgaggctttgccagccggcgccacggtgaccacgcacatggtggctggcgccgtagccggtattctggaacactgcgtcatgtatccaatagactgcgtgaaaactcgcatgcagtccttgcaacccgatcccgcagctagataccggaacgtcctcgaagctctatggagaataattcgcacagaagggctttggcgaccaatgagaggcctgaatgtgacggccaccggggccggccctgcccatgccttgtatttcgcttgctacgaaaaattaaaaaaaaccctctctgatgtaatacaccccggggggaacagccacatcgctaacggggctgcaggctgcgtcgccacgctgttacatgacgcagccatgaatcccgccgaagtggtcaagcagaggatgcagatgtataattctccatatcaccgcgtgacggattgcgtgagggccgtctggcagaatgaaggcgctggtgctttctataggagctatactactcaattgaccatgaacgtccccttccaggccattcatttcatgacctatgagttccttcaggagcacttcaaccctcagcgccgctacaatccatcctcacatgtcctttctggagcctgcgctggggccgtggctgctgctgctaccaccccactggatgtgtgcaaaaccctgctcaatacccaagagtcccttgctttaaactcccatatcaccggtcatataacgggtatggcctccgcctttagaactgtgtaccaggtcggcggggtgacagcatactttcgaggagttcaggcaagagtgatctaccagattccttcaaccgcgattgcatggtctgtttacgaatttttcaaataccttattactaaaaggcaggaggagtggcgtgcagggaaatag

SEQ ID NO: 135102 - DNA, 678 bp, Artificial Sequence
  Description of Artificial Sequence: Synthetic coding sequence
cggggcgccgctggatggtcacattgtcatcacgcacacggcggaaggcggcgggggcgggaccctggcgccttgcgcgatgtcccccataggctgcggcagggcgccgccggttgcgtagctacgttgttgcatgatgccgccatgaatccagcagaggtcgtgaaacagaggatgcaaatgtacaactctccttaccatcgggtgactgattgcgtccgggcagtgtggcagaacgaaggggcaggcgcattttatagatcatacactacacaactgacaatgaacgtaccgttccaagccattcacttcatgacttatgagttcctgcaggagcattttaacccgcaacgacgatataatccaagctcacatgtgttgtcgggcgcctgtgccggagccgtcgctgctgccgctacaacccccctagatgtttgcaaaaccttactcaacacacaggaatcgctggcactcaacagccatatcacaggccacatcactggcatggcaagtgcttttcgtactgtgtaccaggtcggcggagtgactgcttacttccggggggtgcaggcacgcgttatctaccaaatcccttccaccgctattgcctggtcagtgtacgagttcttcaaatatctcataactaagcggcaggaagagtggagggcgggcaaatag

SEQ ID NO: 135103 - DNA, 876 bp, Artificial Sequence
  Description of Artificial Sequence: Synthetic coding sequence
atgtctgccttgaactggaaacccttcgtctacggagggctggccagtattacagcagagtgtggtacatttcctatcgacctgaccaaaacaagactccaaatccaaggtcagaccaatgacgcaaagtttaaggagatccgatatcggggaatgttacatgcattagtaagaatcggccgcgaggagggtctgaaggctctgtatagcgggatagcacccgccatgctgcggcaggcaagctacggaactattaaaattggaacctaccagtccctcaaaaggctgttcatcgaacgccccgaagacgagacgcttccaatcaacgtgatatgtgggatcttgtctggagtaatctcctctacaatcgccaatcctacggacgtgctgaagatccgtatgcaagcgcagagcaatacaatccagggcggtatgatcggcaactttatgaacatttaccagcaggagggaacacgagggttatggaagggcgtttccctcacagcccagagagctgccatagtggtgggcgtggagcttccagtttacgacattaccaagaaacacctgattctctccggactgatgggcgacaccgtttacacccacttcctcagctccttcacctgcggcctggcaggtgctttagctagcaatccagtcgacgtcgtgagaacaagaatgatgaatcagagggtgttgcgggatggtaggtgttcaggctacaccggaacattggattgtctccttcaaacctggaaaaacgaaggcttcttcgctctgtacaagggattctggccaaactggttacgcctaggtccctggaacattatcttctttgtcacctatgagcaactgaagaaactggatctttag

SEQ ID NO: 135104 - DNA, 651 bp, Artificial Sequence
  Description of Artificial Sequence: Synthetic coding sequence
atgctaagacaagcttcctatgggacaataaaaatcgggacataccagtccctcaaacgactatttattgagcgacctgaggacgagaccctgccaattaatgtcatttgcggcatcctttctggagttatatctagcacgattgctaatcccacggacgtgctgaagattagaatgcaagcccagagcaatactatccagggtggaatgattggcaatttcatgaatatataccaacaagagggtactcgggggctgtggaagggtgtctctttaacagctcagagggccgctatcgtagtcggcgtagagcttcctgtgtacgacataaccaaaaagcatctgattctgtcgggcctcatgggggacacagtctacacccactttctgagttctttcacctgtgggcttgctggagccctggcatcaaatcctgtggacgttgtgaggacccgcatgatgaatcagagggtcttaagggatggacgttgttctggctacaccgggactttagattgcctgcttcaaacctggaagaatgaggggttttttgccttgtacaaaggcttctggcccaattggctccgactcggaccatggaatatcatttttttcgtgacttacgagcagctcaagaagctcgatctctag

SEQ ID NO: 135105 - DNA, 723 bp, Artificial Sequence
  Description of Artificial Sequence: Synthetic coding sequence
atgctccatgcattagtcaggattgggcgggaggagggcctgaaggcactgtatagcggtatcgctcccgccatgttgaggcaagcgagttacggtacaataaagatcggtacctatcagtcccttaaaagactgtttatcgaacgcccggaagatgaaacattgcctattaacgtcatttgcggaattttgtctggcgttattagctcaactatcgcaaatcccaccgatgtccttaagatccgcatgcaggctcagagtaacaccatccagggagggatgatcggaaacttcatgaatatttatcagcaggagggcacccgtgggctatggaagggcgtgtccctcactgcacagagggcagccattgtcgtgggcgtggagctacccgtgtacgacattactaagaaacacctcatcctgagcggtctgatgggagatactgtgtatactcattttctctctagcttcacgtgcgggctggctggggcattagcatctaatccagttgatgtcgtgaggacgagaatgatgaaccagagggtgctgagggacggaagatgttctggctacaccggaacgctggactgcctcctccagacctggaagaatgaaggcttcttcgccctttacaagggtttctggcctaattggttgcgcctgggaccttggaacataatttttttcgtaacttatgagcagttgaagaagctggatctttag

SEQ ID NO: 135106 - DNA, 948 bp, Artificial Sequence
  Description of Artificial Sequence: Synthetic coding sequence
atgacaggacaaggccagtccgcatcaggcagctccgcgtggagcacggtcttcagacatgtgcgatacgagaacctgattgccggagtcagtggtggggtgctaagtaaccttgcgctccaccccctggatttggtgaagattcgcttcgcagtgtctgatggcctggagctgcgccccaaatacaatggcattctccactgtctgacaactatctggaaactggacgggctgcgtggtctgtatcagggggtgaccccaaatatctggggcgccggcctgtcctggggcctttacttctttttctacaacgccataaagtcttataaaactgaaggaagggctgagcggcttgaggctactgagtatttggtctcagcagctgaagccggagccatgacgctgtgtatcacgaatccactgtgggtcaccaaaacccgcctgatgctgcagtatgatgcggttgtgaattctcctcacagacagtacaagggcatgttcgacacactggtgaaaatctataaatacgaaggagtaaggggtctgtacaaggggttcgtccctggcttgtttggtacaagccacggagcactgcagtttatggcctacgagctgctgaaactgaaatataaccagcacatcaatcggttacctgaggctcaactgagcacagtcgagtacatctccgtcgcagcccttagcaaaatctttgccgtcgctgctacttatccttatcaggtcgttcgcgccaggttacaggaccagcatatgttttactctggcgtaattgatgtaatcaccaaaacatggaggaaggaaggggtcggcggtttctacaaaggtattgcacccaacctgattagggttacccccgcttgttgcattacattcgttgtctacgagaatgtgtcccatttcttgctggacttacgcgagaaacgaaagtag

SEQ ID NO: 135107 - DNA, 900 bp, Artificial Sequence
  Description of Artificial Sequence: Synthetic coding sequence
atgacaggccagggccagagcgccagcggatcttccgcctggagtggaggtgttctctctaacttagctctccacccactggacctggttaaaatccgatttgccgtaagcgatggtctggaattacggccaaagtataacggaatactgcactgtctcaccacgatttggaaattggacggtctgcgcgggctgtaccaaggcgtgacccccaatatctggggcgccggattgtcatggggcctctactttttcttctacaacgctatcaagtcctacaagacggaaggccgtgctgaacggttagaagctaccgagtacctcgtctcagcggcagaggccggggccatgaccctctgcattacaaatcctttatgggtaacgaaaaccagactaatgctgcagtatgatgccgtcgtcaactcacctcaccggcagtacaaaggaatgtttgacactctggtcaagatttataaatacgagggcgtacgcggactctacaagggatttgttccagggcttttcggcacaagtcatggtgctctgcagttcatggcctatgagctcttgaaactcaagtacaatcaacacatcaaccgcctcccagaagcacaactctccaccgtcgagtacatcagcgtagcagcattatcaaagatctttgcagtggccgcgacatatccataccaggtggtccgggcaaggttgcaggatcagcatatgttctactcgggcgtgatcgatgtcattacaaaaacctggcggaaggagggtgtcggaggcttctacaaagggattgccccgaatcttattcgcgtcacccctgcatgttgcatcacttttgtcgtctacgagaatgtgtcccactttctgcttgatctgcgcgaaaagaggaagtag

SEQ ID NO: 135108 - DNA, 552 bp, Artificial Sequence
  Description of Artificial Sequence: Synthetic coding sequence
atgacactttgtattaccaatccactttgggtgacaaaaactaggctcatgctgcagtacgatgctgtcgtgaacagcccccacaggcaatataagggaatgtttgatacattggttaaaatctataagtatgagggggtcagagggctgtataaaggattcgtgccagggctgttcgggactagccacggcgcattgcagtttatggcttacgagctgttgaaactcaaatacaaccagcacattaaccgattgcctgaggctcaactctctaccgtggagtacatatctgttgctgctctttctaaaattttcgctgtcgcagctacatacccttatcaggtggtgcgagcaaggttacaagaccagcatatgttctactctggtgtgatcgacgtgataacaaaaacatggcggaaggaaggagttggcggtttttacaaaggtatagctccaaacttgattcgtgtgactcccgcatgctgcattacatttgtcgtctatgagaatgtgtctcattttttattggacttaagagaaaagcggaaatag

SEQ ID NO: 135109 - DNA, 966 bp, Artificial Sequence
  Description of Artificial Sequence: Synthetic coding sequence
atggctacaggcgggcaacaaaaggagaacaccttgctgcacctcttcgctgggggctgcggcggaacggtcggggccatctttacctgtcctcttgaggtaatcaagacccggctgcaatcgagtcggctggctctgcggaccgtgtactatccgcaggtgcatctcggaacaatttctggagctggtatggtccggcccacgagcgtgacccccggcctattccaagttttgaagtccattctggagaaggaagggccaaagagtctgtttagaggacttggccccaatttggtcggggtggccccttccagggccgtctactttgcttgttatagcaaggccaaagaacaatttaatggtatcttcgtgcccaacagcaacatcgtgcacatcttctccgccggttccgcggcctttatcaccaactcccttatgaacccaatctggatggtgaagacccggatgcaattggagcagaaagtaaggggatctaaacagatgaataccttacaatgtgcccggtatgtgtatcagacagaggggattagaggtttctaccggggactcacagcatcgtatgccggaatctccgagaccattatttgtttcgcaatttatgagtccctgaagaaatacctgaaggaggccccattggccagctctgccaacggaacagaaaagaacagcacttccttcttcgggctgatggccgctgctgccctgtccaagggttgtgctagctgtatcgcttaccctcatgaggtgatccgcactcgcctcagggaagagggcactaagtacaaaagcttcgtgcagacagccaggcttgttttccgcgaggaaggatatctcgctttctacaggggcctattcgctcaactcatcaggcagattcccaatactgccatcgtgctctccacttacgagctgatcgtgtacctgctcgaggatcggacccagtag

SEQ ID NO: 135110 - DNA, 915 bp, Artificial Sequence
  Description of Artificial Sequence: Synthetic coding sequence
atggaaactgtaccaccagcggttgatttggtgcttggggcctctgcatgctgcctggcttgcgtgttcacgaacccacttgaagtcgttaagacgcgccttcagttgcaaggcgagctgcaggcacgcggcacctaccccaggccttaccacggctttatcgcgtctgtcgctgccgtcgcaagggctgacgggctgtgggggttacaaaagggccttgctgctggtcttctctatcagggcttgatgaatggggtaagattttactgttattccttggcctgtcaagccggtctgactcagcaacctggggggaccgtggtagcaggggctgtggcgggggctttgggggcttttgttggtagccccgcgtacctaataaagacacagttacaggcccagacggtggccgctgtggccgttggacaccagcacaaccaccagaccgtgcttggcgccctagagacaatttggcgacagcagggcttgctcggcctatggcaaggcgtgggaggcgctgtgccacgagtgatggtgggctccgccgcccaactcgccacattcgcttccgcgaaggcgtgggtgcagaagcaacaatggttacccgaggattcgtggctggtcgctctggccgggggcatgattagctcaatcgccgtcgtggtggtcatgaccccctttgacgttgtatccacccggctttacaatcaacccgtggacacagctggcagaggacagttgtacgggggcctgactgattgcatggtcaagatctggcgacaggagggaccactcgctctgtataaggggctggggccagcttatctacgccttgggcctcacacgatcctctcaatgctgttctgggacgaacttcggaaactggccggacgcgcccaacataagggcacgtag

SEQ ID NO: 135111 - DNA, 888 bp, Artificial Sequence
  Description of Artificial Sequence: Synthetic coding sequence
atggatttcctcatgagcggcctggccgcatgtggggcctgtgtattcaccaacccactcgaggttgtgaaaaccaggatgcagctgcaaggcgagttgcaggctcccggtacttatcaacgccattaccggaatgtgtttcacgcttttattacaattggaaaggtcgacgggcttgccgctctgcagaagggccttgcccccgcactgctgtatcagttccttatgaatgggatcaggcttggtacctacggactcgccgaggccggcggctacttgcacactgcagaaggcacacacagcccagcccgttccgctgcagccggagccatggctggtgttatgggcgcttatctgggttctccaatatatatggtgaaaacacacctacaggcccaagcagcctccgagatcgccgtaggccatcaatataagcaccagggaatgttccaagcgttgaccgagatcggccaaaagcacggattagtcggactgtggagaggcgccctaggcggattgccgcgggttatcgttggctccagcactcagctgtgcacatttagttcaaccaaagacctgctgtcacagtgggagatcttcccgcctcagagttggaagctggccctggtggcggcaatgatgtctgggattgctgtcgtactggctatggccccctttgacgtcgcgtgtacaaggctgtacaaccagccgactgacgcccaaggtaaaaaccgggttcccaagttttccgctacctcatgttctgcttcagcgccactgttaggaactaaagatgtgcgaatcgtaaaagggcagacaggccatcagctctttaaagttacgcaggcacctggctgctctccgatcctgctcggaacacaatcctag

SEQ ID NO: 135112 - DNA, 876 bp, Artificial Sequence
  Description of Artificial Sequence: Synthetic coding sequence
atggattttcttatgtccgggttagccgcctgtggtgcctgtgttttcaccaaccctctagaggtggtcaaaacacgcatgcagctccagggcgagctgcaggcacctggaacctaccagaggcactaccgcaatgtattccacgcatttataacaatcgggaaagtggacggattagccgctttgcagaagggccttgcgccggccctgctctatcaattcctaatgaacggcataaggctagggacttatggactggccgaggctggcgggtatctgcacaccgcagagggtactcactctccagcaagaagcgcagcagctggagctatggctggcgttatgggtgcatacctaggatctccaatctatatggttaagacccatttgcaggcacaggcagcttctgagattgccgttggacaccagtataaacatcagggaatgttccaggctttaacggagatcgggcagaagcatgggttggtcggactatggaggggagcattgggtggtctgccccgggtgatcgtgggaagttctacacagctttgtactttcagctccacaaaagacctgctcagccaatgggagatattcccgccccagtcttggaagttggctctggtggcagctatgatgtctggcattgcagtagtgcttgccatggcccctttcgacgtcgcttgcacacggctgtacaaccaacccaccgacgcccaaggtaaaggtctgatgtatcgcggcattctggacgctctcctgcagactgccaggaccgaggggattttcggcatgtataaggagccatccccacaagtcctttctaatataatgcagtgcttctccgcttttaccggtgatcaaagatgttag

SEQ ID NO: 135113 - DNA, 915 bp, Artificial Sequence
  Description of Artificial Sequence: Synthetic coding sequence
atgatccagaactctcgccctagcttacttcagccccaagacgttggggataccgtcgaaacgctaatgctgcatcccgtaataaaggcctttctgtgcggatctatctcggggacatgcagcaccctgctgttccagcctctagatctcctgaagacccgcctgcagacgttgcaacccagtgatcacggaagtcggcgggtgggaatgctggccgttctgctgaaggtggttcgcacagagtcattgctcgggctttggaagggtatgagcccttctatcgtgcgttgcgtgccgggtgtgggtatatatttcggaactttgtattctttgaagcagtatttcctcagagggcaccccccgactgcactcgagtcagtgatgctcggcgtgggttctcgtagcgtcgcaggtgtgtgcatgagccccattacagtgattaaaacaagatacgagtcggggaagtatggctatgaaagcatctatgcagccctaaggtctatctaccacagcgaggggcaccgggggcttttctctgggttgacagccactctgttgagggacgccccctttagtggaatttatctcatgttttacaatcagactaaaaacattgttcctcacgatcaggttgatgcaacactaatccccataacaaacttctcctgcgggattttcgccggcatcctggcctctctggttacccagcctgctgacgttatcaagacccacatgcagctgtaccccctgaaatttcaatggattggtcaggcagttactctgatcttcaaagattatggcctccggggttttttccaggggggcattccccgcgccctgcgtaggacccttatggcagcgatggcctggacagtttacgaggaaatgatggccaagatggggctaaagtcttag

SEQ ID NO: 135114 - DNA, 1671 bp, Artificial Sequence
  Description of Artificial Sequence: Synthetic coding sequence
atgccaccagagcggcgcaggcgcatgaagctcgacagaagaacgggtgccaaaccaaagcgaaaacctggtatgagacctgactggaaagccggggctggccctggtggccccccacagaagcctgctcccagttctcagcggaagcctccagctcgtccttccgccgctgccgcagcaattgctgtagccgcggcagaggaggagcgcaggctaaggcagaggaatcggctacggttagaagaagataagcccgctgttgagcgctgtctggaagagctcgtattcggagatgtagagaatgatgaggacgccttgttacgtcgcctccgggggcccagggtccaggagcatgaggacagcggggactctgaggtggagaacgaagccaaaggcaatttccccccccagaagaaacctgtgtgggtcgacgaggaagatgaagacgaagagatggtggacatgatgaacaaccgatttcgcaaagatatgatgaaaaatgcttcagaatcaaaactgtccaaggacaacctcaaaaagaggttaaaggaggagtttcagcacgccatgggcggtgtcccagcatgggccgaaactaccaagcggaagacatcttctgacgatgagtccgaagaggacgaggacgacctgctgcagagaaccggcaactttatctccactagtacatcgctgccacggggaatcttaaagatgaaaaattgccagcacgccaacgctgagaggccaaccgtcgcccgcatatcatctgtgcagttccaccctggcgcccagatagttatggttgctgggttggacaatgcagtgtcgctcttccaggtggatggcaagacaaaccccaagattcaatccatctacctggagcgttttccaatctttaaggcttgctttagcgccaatggtgaagaggtcttggcaacgtccacacatagcaaggtgctctacgtgtacgacatgctggcaggcaaactgatacccgtgcaccaagtgaggggactcaaagaaaagattgtgcggtccttcgaagtgtcccccgatgggagctttctattgatcaacggaatcgccggttacctccacctgcttgctatgaaaacgaaggaattaatcgggagcatgaagataaacggtcgcgttgctgcttctacattctccagcgatagcaaaaaggtctatgcttcctccggagacggagaagtttatgtctgggacgtcaatagtcggaagtgtctcaacaggttcgtggatgaagggtcgttgtatggcctctccatcgcaacctccagaaatgggcagtatgtggcctgtggctcgaattgtggagtggtgaatatctacaaccaggacagttgcctccaagaaacaaaccccaaacccatcaaggccatcatgaacctcgtgacaggtgtgacttctctcaccttcaatcctactaccgagatcttggcaatcgcctctgagaaaatgaaagaagcagtgcggctagtacatctgccctcatgtaccgtgttctctaatttccccgtgataaagaataaaaatatctcacacgtccacaccatggactttagcccaagatctggctacttcgccctgggtaatgagaaaggcaaagctctgatgtacaggcttcatcattacagcgacttttag

SEQ ID NO: 135115 - DNA, 1080 bp, Artificial Sequence
  Description of Artificial Sequence: Synthetic coding sequence
atggcagaccaggacccagccggcatcagtcctttgcagcagatggtggcaagtggaaccggcgccgtcgtcacatccttatttatgaccccactcgatgtggtcaaggtgagactccagtcccagagaccgtcaatggctagtgagttgatgccttcatcccgcctttggtccctgtcatatacgaaactgccgagcagtctccagtcaacaggcaagtgccttctgtattgtaacggagtactcgagccgctctacctgtgccctaacggagctcggtgcgccacctggtttcaggatccaacaaggtttaccggcaccatggatgctttcgtgaagatcgttcgccatgaggggacaaggacgctttggagtgggttgcccgccaccctggttatgactgtgccagctactgctatatactttacagcctacgatcagctcaaagcctttctgtgcggcagggccctcacaagtgacctgtatgcaccaatggtagctggcgccctggcaaggctggggaccgtcacagtgatttcacccttggagttgatgagaaccaagctgcaggctcagcatgtgagctatagggagcttggggcatgcgtgcgaactgccgtcgcccagggaggatggaggagcctctggcttgggtggggaccgacagctcttcgcgatgtaccattttctgcactctattggtttaactacgaactggtgaaaagttggcttaatgggttcaggccgaaggatcagacatctgtgggaatgtcgtttgtggctggaggcatatcagggacagtcgccgcagttcttactctgccgtttgacgttgttaagacacagcgccaggtggccctgggtgctatggaggccgtgcgtgtgaatccactgcacgttgattcaacatggctactcctgcgtcgtattcgcgccgagtctggtacaaagggtctgtttgctggctttttacctagaatcatcaaagccgctccttcctgcgccatcatgatttctacctacgagtttggtaagagcttttttcaacggctgaaccaggaccggctgctgggggggtag

SEQ ID NO: 135116 - DNA, 1011 bp, Artificial Sequence
  Description of Artificial Sequence: Synthetic coding sequence
atggcggaccaggaccccgcagggatcagtcctttgcagcagatggtggcctccggcaccggagccgtcgttacatccctgttcatgacacccctggacgtggtgaaggtccgactacagagccagcgtcctagcatggcaagcggtaaatgtctgctgtactgtaatggcgtcctggaaccactgtacctgtgccctaatggagcaaggtgtgcaacctggttccaagacccaactcggttcacaggaacaatggacgcgtttgtcaagatagtgaggcacgagggtacgaggaccttgtggtccggcctgccagcaactttagtcatgactgttcctgctacagccatctatttcacggcctacgatcagctcaaggccttcctatgcggccgggcactaacttcagatctctacgctccaatggtcgccggagccttagcccggttgggcacagtgactgtgatcagcccactcgaactgatgcggacaaagctgcaggctcagcacgtgtcataccgcgagctcggcgcctgcgttcgtaccgccgtggcccagggaggctggaggtctctctggctgggttgggggcccaccgcactgagggacgtacccttctctgctttatattggttcaactacgaactggtgaaaagctggctgaatgggttccgtccaaaggaccaaacctcagtcgggatgtcgtttgtcgcaggcggcataagtggaactgtcgctgctgtcttaactttgccctttgatgtcgtcaagactcagagacaggtggccttgggtgcgatggaggctgtcagagtgaatcccctgcacgtcgatagcacatggctgctgctgcgacgcattcgcgccgagtctgggacgaagggactcttcgccggctttctgccccgtattatcaaagctgcaccaagttgtgctatcatgattagcacatatgaatttgggaagtcattctttcagcggctcaatcaagatcgcctgctgggaggatag

SEQ ID NO: 135117 - DNA, 1017 bp, Artificial Sequence
  Description of Artificial Sequence: Synthetic coding sequence
atggaccccgaaacccgagggcaggagatcattaaggtcacgccgctgcagcagatgttggcatcttgtacaggcgctatcttgacatccgtaatcgtaacaccgctggacgtcgtcaagatccggctccaggctcagaataacccactgcctaaaggaaagtgtttcgtatattctaacggcttgatggaccacctatgcgtgtgcgaagaggggggaaataaactatggtacaagaagccaggaaacttccagggaactttagatgcgttttttaagataatcaggaatgaaggtattaaaagcctctggtccggcctgccgcctacactcgtgatggcagttccagctaccgtaatctactttacttgctacgaccaactttctgcgcttctcagatcaaagctgggggagaatgaaacttgtattcccatcgttgctggtatcgtggcgcgttttggagccgtgaccgttatctcacctctggaactcatcagaaccaaaatgcagtctaagaagttttcctacgtggagcttcatcgcttcgttagcaaaaaggtatcagaagatggatggatctccctctggagaggctgggctcccacggtgctgcgcgatgtgccttttagcgcaatgtactggtacaattatgagatcctgaagaaatggctttgcgagaaaagcggactttatgagcccacatttatgattaactttacttccggcgcactgtctggttctttcgcggccgtagcgacgctgccgtttgatgtggtgaaaactcagaaacaaactcagctgtggacttacgaatcacataagatcagcatgcccctgcacatgtctacatggatcatcatgaaaaacatagtggctaagaacgggttcagcggcctgttctctggcctgatcccaagattgattaagatagcacccgcctgcgccataatgattagtacgtacgagttcggaaaagcatttttccagaagcagaatgtcagacgtcaacagtactag

SEQ ID NO: 135118 - DNA, 1113 bp, Artificial Sequence
  Description of Artificial Sequence: Synthetic coding sequence
atgggtgcccaaccaggcgagcctcagaacacctgcagtcggatacagacgctgttccgaagagtcaaaacattgctgattaaagccccacctcccccacaaccacccccccccccgccttcatggaaccctgggtgcacacacgtgtacggttacgcatttggccacatgcatgataacaacctggagcacctgcctagccagcaggtgcttgatacaggtgagcagctgatggtaccagtggaggtgctagaggtcgacaacaaggaagccttatggaaattcttattaagcggcgccatggctggcgcggtgagccgcacgggcacagcgccactcgaccgcgccaaagtttacatgcaggtgtattccagcaagactaacttcactaatctccttggcggattacaaagtatggtgcaggagggaggatttagaagtctgtggcgaggaaatggaatcaatgtcctaaaaattgcaccagagtacgccattaagttctccgtctttgagcaatgcaaaaactatttctgcgggatacaagggtcgccccccttccaagagaggctgctggcaggatctctggccgttgccatcagccagacactcatcaaccctatggaggtgcttaagactaggttgactttgcggcgtaccggacagtacaaaggtctgctcgattgcgcccgccagatacttcagagagagggcacaagagctctgtatcgcgggtatttgcctaatatgctgggcatcatcccatatgcctgtacagatctagcggtttacgagatgctgcagtgtttctgggtgaagagtggaagagatatgggagatcccagcggactggtctccctcagctccgtcaccctgtctacaacctgcgggcagatggcatcgtatccgctgactctggtacggactcgcatgcaggcccaggacaccgtggagggtagtaatccaactatgcgaggcgtcctccaaagaattctggctcaacagggctggttggggctgtaccgaggaatgaccccaacactgctcaaggtactacccgccgggggaatcagttatgtggtgtatgaggccatgaagaagacccttggtatctag

SEQ ID NO: 135119 - DNA, 729 bp, Artificial Sequence
  Description of Artificial Sequence: Synthetic coding sequence
atgggtgcccagccaggcgaaccccagaatacatgttcccggatccagacacttttcaggagagtgaaaactcttctgatcaaagctccccccccgccccaaccacccccaccaccgccttcttggaacccgggatgcacccacgtgtatggatacgctttcggccacatgcatgacaacaatctggaacatctgccctcccagcaggtgttggataccggagagcagcttatggtgcccgttgaagtgctcgaagtggacaacaaagaggctctgtggaaattcctcctgtcgggggccatggccggcgccgtgtcgcggaccgggacagcgccgctggatagagccaaagtgtatatgcaactgctcggtaggcttaggcaggaaaatcggttaaacctgggtggcggcgggtgttctgaaccccggtcacctgacagaacacctgcctgggccaccgagagcaccccgcctagacggacttcacctacgtgctggggcggatatcgggcctggtctcggagggctgctagtgcaccttgcggtggagccaccgctagcacctgctcccgcctccttctttccatgcctagcagttccccttactctagctcagcgagaattactagcgttgagtacaagggcccacggccatcacggagcgtcagcttgttggctccctggctttggccttcaccgcgccctagctctacaccctggaggtgttag

SEQ ID NO: 135120 - DNA, 957 bp, Artificial Sequence
  Description of Artificial Sequence: Synthetic coding sequence
atgggaaatggagtgaaagagggaccggtgcgactgcacgaagatgccgaggccgtgctgtcttcttctgtgtcctctaaacgggaccaccgacaagtcctcagcagtctcttatcaggagctcttgccggtgctttagcaaagacagctgtggcaccgctcgacaggacaaagattattttccaggtatctagcaaacgattcagcgctaaggaagcctttagggttctatactacacctacctaaacgaaggtttcttaagcctgtggcgaggcaactctgccacaatggttagggttgtgccttacgccgctatccagtttagcgctcacgaagaatacaagcgaatacttggatcgtactacgggttccgaggcgaggccttgccaccttggccacgattgtttgccggggccctggcgggcacaaccgccgcctccctcacctacccacttgatctggtccgagcccgaatggctgtcacaccaaaggagatgtattccaacatttttcacgtttttattcgcatttcccgggaggaggggttgaagacactttaccacgggttcatgcccaccgtgttaggagtcataccctatgcaggcctttcattcttcacctacgagaccctgaaaagcttgcaccgggaatacagtggcaggcggcagccttacccgttcgagagaatgatctttggggcttgcgccggacttattgggcagagcgcctcctaccctctggacgtcgtgcgtcgccggatgcaaactgccggggtcacaggatacccgcgggccagcattgcccggaccctccggacaattgtacgtgaagaaggggccgtgcgaggcctctacaaaggattgtctatgaattgggtgaaggggcccatcgcagtcggaataagttttactacattcgacctgatgcagattctgctccggcatctgcagtcatag

SEQ ID NO: 135121 - DNA, 1011 bp, Artificial Sequence
  Description of Artificial Sequence: Synthetic coding sequence
atgtcagttttgttcttttacattatgaggtacaagcaaagtgaccctgagaacccagataatgatcgcttcgtgctggccaagattgccactaggaaagcgtgtggactggcacttgccaagctgggctatgcaaataaccgagtggtggttctcgacggagacacaaggtatagcactttttccgagatatttaacaaggagtacccagagcggtttatcgaatgctttatggccgaacaaaatatggttagcgtggctctcggttgcgcctctcgaggtcgtacaatcgcattcgctagtacgttcgcagccttcctaacccgggccttcgatcatataagaattggaggcctcgccgaaagcaacatcaatatcatcggaagtcactgcggtgtgagcgtgggagacgacggcgcgtcccagatggctctagaagacatcgctatgttcaggaccataccaaagtgtacaatcttctatccaaccgacgccgtgtctaccgagcacgccgttgcgttggcagccaatgcaaagggcatgtgtttcattagaacaacccgcccagagaccatggttatctacacgccccaggagcggtttgagattgggcaagctaaggtactccgtcactgtgtctccgataaggttacagtgatcggagccggaattactgtttacgaagcactggcagcagccgacgagctgtcaaagcaggacatttttattagggttatagacctgttcaccataaagccactggatgtcgctacaatcgtgtcgagcgcgaaagctacagaaggaaggatcataaccgtcgaggaccactatccacagggcggcatcggagaggccgtgtgtgcggcggtaagcatggatccagatattcaggtgcactcgctggccgtctccggggtgcctcagtccggcaagtctgaggagctgcttgacatgtatgggatctcggctcgacacattatcgtcgccgtcaagtgcatgctgctaaactag

SEQ ID NO: 135122 - DNA, 870 bp, Artificial Sequence
  Description of Artificial Sequence: Synthetic coding sequence
atggctacctggcgccgcgacgggaggctgacaggaggtcaaagactgctttgtgcagggcttgcagggacattaagcttgtccctcacagcaccactggagctggctgcctacagaaaattcgtagttctgtttaccgacgatctcggacacatttcacagtggtcttcgatcatggcgggcagcctggccgggatggtgtctaccatagtgacatatccaacggacttaatcaaaacccgccttataatgcagaacatccttgaacctagttatagaggtctgctgcatgccttcagcaccatctaccaacaggaaggttttctagccttatataggggggtgagcctgaccgtcgtgggggcccttcctttctctgccggatccctcttggtctacatgaatctcgagaaaatctggaacggtcctagagatcagttttctttaccacagaacttcgccaacgtgtgccttgccgccgctgttacccagacactgtctttcccttttgaaaccgtcaaacgtaagatgcaggcccagtcaccctatctcccacacagcggaggagttgatgttcacttttccggcgcagtggactgcttcagacagatcgttaaagcacaaggcgtgttgggtctgtggaacggactcaccgctaatctgcttaagattgtgccctatttcggaatcatgttctctactttcgagttctgtaaacgtatctgcctgtaccagaacggatatatcttgtccccccttagctacaagttgacaccaggcgtggatcagtccttgcagccccaggagcttcgcgaactgaagaaattctttaaaacgcgcaaacccaaacccaaaaagcccaccctgtag

SEQ ID NO: 135123 - DNA, 681 bp, Artificial Sequence
  Description of Artificial Sequence: Synthetic coding sequence
atggccacctggaggcgagacggccgattgacaggcggacaaagactgctgtgtgccggcctcgccggaaccctctctcttagcctgacagcccctcttgagttggcgacagttctagcccaggtgggcgtggtaaggggccacgcccgtggcccatgggccactgggcaccgcgtttggagagcagaaggtctgcgggccctgtggaagggtaatgcagtggcgtgtctccggttatttccttgttcagctgtgcagctggccgcctaccgtaaattcgttgtgctttttacagacgatctgggccatatctcccagtggtctagtataatggcaggcagcctcgccggtatggtgtctacaatagtcacttacccaactgacctgatcaagacacgccttatcatgcagaacattttagagccctcataccgcgggttgctgcatgccttctcaactatatatcagcaggagggctttctcgccctgtatcgaggtgtcagccttaccgtcgtgggctcagaacctctcccccccacccagtggaggtcacggtgccccttcctcagaagctcgggattactgcccgccgattccgagggcccgggtggccccggcgcattagaatggattgatagccagtttacggaggactcaagtattttctggaattacgtgtag

SEQ ID NO: 135124 - DNA, 945 bp, Artificial Sequence
  Description of Artificial Sequence: Synthetic coding sequence
atggaagacaaacgcaacatccagattattgagtgggaacaccttgataaaaaaaaattttatgttttcggcgtggctatgacaatgatgattcgcgtgtctgtgtatccctttaccctgataaggactcgccttcaagttcagaaggggaaatcactctatcacggcactttcgatgcgttcattaaaatcctcagggccgatggtatcactggtctgtaccggggctttttggtaaatacttttactctcatttctggacaatgctacgttacgacttacgagttgactcggaaatttgtggctgactactcacagtctaatactgtcaaatcgctggtggccggcggaagcgcgtccctcgtcgctcagtccataaccgttcccattgatgtggtctcgcagcacctaatgatgcagcggaagggcgagaagatggggcgtttccaggttaggggaaaccccgagggccagggggtcgttgctttcggccagacaaaggatatcattcgacaaatccttcaggcagacggcctgcggggcttttaccgcggatacgtagctagcctcctgacttacatccccaattccgcggtatggtggccattttaccacttctacgccgagcaactttcctatctctgtcccaaggagtgcccacatatcgtgtttcaggcagtgtctggaccacttgctgcggccacagcctctattctgaccaaccctatggacgttattcgaacacgtgtccaggtcgagggaaagaattctattatacttacatttaggcagctgatggcagaagagggtccttggggcctgatgaaaggattgagcgcacggataatctccgccactccatctaccattgttatcgtagtaggatacgagtctctgaaaaagctgagcttgagacccgaactagtagattcgaggcattggtag

SEQ ID NO: 135125 - DNA, 489 bp, Artificial Sequence
  Description of Artificial Sequence: Synthetic coding sequence
atggaagataagcggaacatacagattatcgaatgggaacatctggacaaaaagaagttctatgtctttggagtggcaatgaccatgatgatccgcgtcagtgtgtacccatttactttgatccgcaccaggttgcaggtgcaaaaagggaaatctctttatcatggaacttttgatgccttcattaagattctcagggctgacggtattaccgggctgtataggggtttccttgtgaatacctttacactcatctccggccagtgttatgtgacaacttatgaactgacgcgcaagttcgtggcggactatagccagtccaacacagtaaagagcctcatggcggaggaaggtccctggggtctgatgaaggggttaagcgccaggatcatatccgccacaccctcgaccatcgtgatagtcgttggatatgaatctctcaaaaagctgagcctgaggcctgagctcgttgatagtcggcactggtag

SEQ ID NO: 135126 - DNA, 876 bp, Artificial Sequence
  Description of Artificial Sequence: Synthetic coding sequence
atggaggacaaacggaatattcagatcatcgagtgggagcacttagacaaaaagaagttctatgtgttcggcgtagctatgactatgatgataagagttagcgtttaccccttcacactgatccgcacaaggttgcaagttcagaagggcaaaagcctgtaccatggcacatttgacgcctttattaaaattctgcgggccgatggcataacaggactgtaccggggttttctggtcaacacatttaccctgataagtggccagtgttatgtcacgacctacgagctgacccggaagttcgtggccgactactcccagagcaatacagtcaaaagcttggttgccggaggatccgcttccctggtcgcccagtcaataaccgtgcgggggaatcccgaagggcaaggggtggtggcatttggacagactaaagacatcataaggcagatcctgcaggccgacgggctccgcggcttttacagaggctatgttgcgtctcttcttacctatatcccgaactctgccgtgtggtggcctttctaccatttctacgctgagcagctaagttatctctgccccaaggagtgtccccatatcgtttttcaggccgttagcggcccgttggccgccgctacagccagtatcttaaccaaccccatggacgttatacggaccagagtacaggtggaggggaaaaatagcatcatcctgactttccgccagctgatggccgaggagggaccatgggggctgatgaagggattgtcagctcgcattatctccgccacccctagcactattgtgatcgttgtgggctatgagtcactgaagaagttgtctctacggcccgagctggtagatagcaggcactggtag

SEQ ID NO: 135127 - DNA, 741 bp, Artificial Sequence
  Description of Artificial Sequence: Synthetic coding sequence
atggtcaagatctatagacatgagagcctattgggcttcttcaaggggatgtctttcccgatcgcctccatcgctgtggttaattccgtgctctttggcgtatactccaacacactgttggtactcaccgctacttcccaccaggagcgacgcgcgcagcctccatcatacatgcatatctttttagccggctgcaccggcggcttcttacaggcctattgcctagccccttttgaccttatcaaggttcggcttcagaatcaaactgagccaagggctcagccaggttctcctcctccgagataccagggtccagtccactgcgccgcaagtatcttccgtgaggagggaccgcggggcttattcaggggggcttgggcactgaccctgcgcgacacccctaccgtaggaatatacttcattacctacgagggtctctgccgtcaatatacgccagaaggccaaaatccaagcagcgcgacagtgctggtcgccggaggcttcgccggaatcgcaagctgggtcgctgccactccactggacatgattaagagtcgtatgcagatggacggcctgcgccggcgcgtgtatcagggaatgctcgattgtatggtctcttctataagacaggagggtctgggggttttttttagaggcgtgactattaattcagcaagagctttcccggtcaacgctgtgaccttcctgtcctacgaatatctgctccgttggtggggttag

SEQ ID NO: 135128 - DNA, 795 bp, Artificial Sequence
  Description of Artificial Sequence: Synthetic coding sequence
atgcctgtggaggagtttgttgcaggatggatctccggagccctggggcttgtcctggggcacccttttgacaccgtgaagctgcttggatttttcaaaggaatgagttttcccatagcttccatcgccgtcgtgaatagcgttctgtttggggtctatagtaatacgttgttggttctgaccgccacctcacaccaggaaaggcgtgcccagcccccatcttatatgcatattttcctggcagggtgcaccggaggcttcctgcaagcctactgcttggccccctttgacctgatcaaagtgcgcctccaaaaccaaacggagcctagggcccagcccggttcccctccacctcgataccaaggccccgtgcattgtgccgcctccatcttcagggaggaagggccacggggtctgttccggggtgcatgggccttgacccttcgtgacacaccaacagttggaatctactttatcacctatgagggcctttgtcgacagtatacacctgagggacagaatccctcctcagctacagtcctagtcgcagggggattcgctggcattgccagttgggtggccgcaactcccttggacatgatcaaatccaggatgcagatggacggcctgcggcggagggtctatcaaggcatgcttgactgtatggtgtcctccattcggcaagaggggcttggggttttttttcggggggtaacaatcaacagcgcacgggcctttccagtcaatgcggtcaccttcctgtcctacgagtatctattgagatggtggggctag

SEQ ID NO: 135129 - DNA, 555 bp, Artificial Sequence
  Description of Artificial Sequence: Synthetic coding sequence
atggtgaaaatctaccggcatgaatctgcctactgtctggcccccttcgacctgatcaaagtgagactacagaaccaaacggagccaagagctcagccggggtccccacccccacggtatcagggacctgtccactgtgcagctagcatatttagagaagaaggcccaaggggcctcttccgcggcgcttgggcgctcaccctacgcgacacacccaccgtggggatatactttatcacatacgaagggctttgccgacagtacacacctgaaggccagaatccctcctccgccactgttctcgtggccggcggctttgccggtattgcgtcctgggtggctgccactcccctcgatatgattaagtcaagaatgcagatggacgggttacgccgaagagtgtaccagggtatgctggattgcatggtgtcctctattcggcaggaggggctgggcgtatttttcaggggtgtaacaattaactcggcccgcgcctttcctgtcaatgcagtgactttcttaagttacgaatacctgctcaggtggtgggggtag

SEQ ID NO: 135130 - DNA, 867 bp, Artificial Sequence
  Description of Artificial Sequence: Synthetic coding sequence
atgcctgtggaggagttcgtcgccggatggatcagtggggccctgggcctggtcctggggcatccttttgacacagtaaaggtcaggctccagacacaaaccacatatcgtggaattgtagattgtatggtgaaaatttaccgtcacgagagtcttctcggtttctttaagggaatgagttttcccatcgccagtattgctgtcgtaaattcagtcctttttggcgtgtattccaacacactcctcgttctgaccgccacctcgcaccaggaacggcgggcccagcccccgtcttatatgcacattttcctggcgggatgcaccggaggttttcttcaagcctactgcctggctccattcgacttaatcaaagttcgtttacaaaatcagactgagccaagagctcaaccaggaagccctcccccaaggtaccaagggccagttcattgcgccgcaagtatttttcgcgaagaaggacctagaggcctgttccgaggggcttgggcactcacactcagggatacaccaactgtcgggatttacttcatcacttatgaggggttatgtcgccagtacaccccagaggggcagaacccttcttctgctactgtgctcgtggctgggggttttgccggtatagcatcatgggtggccgctaccccactggatatgatcaagtcacgcatgcagatggatggcctgcggcggcgggtttaccagggtatgctcgactgtatggtcagctctatccggcaagaagggctgggcgtgttctttagaggtgtgaccataaattctgctagagcctttccagttaacgctgtgacctttctgtcctatgagtatctactgaggtggtggggctag

SEQ ID NO: 135131 - DNA, 741 bp, Artificial Sequence
  Description of Artificial Sequence: Synthetic coding sequence
atggtgaagatctaccgacacgaaagcctgcttggattcttcaagggaatgtcatttccaatcgcctcaattgcggtggtgaactctgtgctttttggagtgtattccaatactttgctcgttttaacggcgactagccatcaagaaagaagggctcagccgccctcctatatgcacatctttctagccggatgcacaggcggctttctccaggcttattgtctcgccccttttgatctcatcaaagtaaggctgcagaaccagacagagccgcgcgcccagccgggaagtcctccaccccgatatcaggggcctgtgcattgcgccgcatccattttccgggaggaggggcctcgcgggctgtttagaggcgcgtgggccctcaccttaagggacacaccgaccgttgggatctatttcataacttacgaggggctttgccggcagtacaccccagagggacagaatcccagcagcgctactgtcctggtggcagggggctttgccggcatcgcgtcttgggtggctgcgacccccttggacatgatcaagtctagaatgcagatggacggcctgaggaggagggtttatcaaggcatgcttgactgtatggtgagctccatcaggcaagagggcctgggggtgttctttagaggcgtcactatcaatagtgcaagggccttccctgtaaacgccgtgaccttcctctcctatgagtatctcctccgctggtgggggtag

SEQ ID NO: 135132 - DNA, 867 bp, Artificial Sequence
  Description of Artificial Sequence: Synthetic coding sequence
atgccagtggaggagtttgtcgcgggctggattagtggagctctgggtctggtgctgggccatccttttgacaccgtcaaggtgaggctgcaaactcagactacatatcgcggcatagtggactgtatggtcaaaatctacagacatgagtccctgttgggattctttaaggggatgtcgttcccaattgcttccatcgctgttgtgaatagcgtcctcttcggagtctacagtaatacccttttggttctgaccgccacctcgcaccaggagagacgcgcccaacccccttcctatatgcatatatttctggcaggttgtaccggcggttttctacaagcttactgtttagcaccctttgacctgattaaggtccgactgcagaatcagaccgagccgagggcacagcctgggtcaccccccccacggtatcagggaccagtacattgtgcagcctcaatctttcgagaggaggggccacggggattatttcgaggggcatgggccttgacattgcgagatactccaacagttggcatctatttcataacatacgagggcctttgccgccagtacactccagaaggacaaaatccgtctagcgcgaccgtacttgttgcaggaggctttgctgggatcgcctcgtgggtggccgcaaccccacttgacatgatcaagtcccgaatgcagatggatgggttgagaaggagggtctaccagggcatgctggactgcatggtctcaagtattcggcaagaaggcttgggcgtattctttcgcggggtgacaattaacagcgccagggcgttcccagtgaatgcagtcactttcctgtcttatgagtacctattgcgctggtggggatag

SEQ ID NO: 135133 - DNA, 357 bp, Artificial Sequence
  Description of Artificial Sequence: Synthetic coding sequence
atgcctgtagaggaattcgtcgcaggctggatatctggagcgttgggcctcgtgttgggtcatccgttcgacaccgtgaaagtgcggttacagacgcaaacaacttatcgaggcattgtggactgcatggtaaaaatttatcgtcatgagtcattgctgggattctttaagggtatgtccttccccattgcaagtatcgcagtggttaactccgtgctgttcggagtgtattcaaatacactactggttctgaccgcgacgtcgcatcaagaaagacgggcacaacctccctcgtatatgcacatcttcctggccggttgtacaggaggctttttgcaagcttactgcctggcgtag

SEQ ID NO: 135134 - DNA, 1257 bp, Artificial Sequence
  Description of Artificial Sequence: Synthetic coding sequence
atgcacccccgcagaccagatggctttgacggcttgggctaccgcgggggcgcgagagacgagcaaggttttggcggcgctttcccggctcggtccttttccactggttctgacctcggacactgggtgaccacgcccccggacatccccggatccaggaacctgcattggggggagaagtcacctccatacggcgtacccaccacttcaaccccttacgaaggcccaaccgaggagcctttcagcagtggcggtgggggaagcgttcagggtcaaagcagcgagcaactaaataggtttgctggttttggaattggactggcatcactcttcactgagaacgtactagcgcatccatgcatagtgctcagacgacagtgccaggtaaattatcatgcccagcactaccacttgacacccttcacagtgatcaacatcatgtacagctttaacaagactcaaggccctcgcgccctgtggaaaggcatgggatctacgttcattgtccaaggcgtaacactcggagcagaaggtatcatctcagaattcaccccactaccccgcgaggtcttgcacaagtggtcaccgaaacagatcggcgagcacctgctgctcaagagcctgacttatgtcgtggcaatgccattttacagcgcctctctcattgaaacggtgcagtctgaaatcattcgagacaacaccggcattctcgaatgtgtcaaggaaggcatcgggagggtgatcggcatgggggtgcctcatagcaagagattgctgcctctcttgtccttaatatttcctacagttctccatggcgttcttcactatatcatcagcagtgtcattcagaagttcgtgcttttgattctcaagcgcaagacatacaattcccacctggccgagtcgacatcccctgttcagtctatgttagacgcatactttcctgagttaatcgcaaacttcgctgcctcactgtgttccgatgtgatcttgtacccacttgagacggtcctccaccgcctgcatattcaggggacgagaaccatcatcgacaatactgatttgggttacgaagttttgcctatcaatacccagtacgaagggatgagagattgtatcaatactattcgccaggaggaaggcgtgttcggtttctataaggggttcggtgccgttatcatccagtataccctgcacgctgccgtgttacaaataacgaagatcatatacagcacactgctgcaaaataacatttag

SEQ ID NO: 135135 - DNA, 1014 bp, Artificial Sequence
  Description of Artificial Sequence: Synthetic coding sequence
atgcatccacgccggccggatggcttcgatgggctggggtacaggggtggcgccagagacgaacaagggtttgggggcgcctttcctgcacgatctttctctactggctctgacttgggacactgggtgactacaccacccgatatccccggctcccggaacttacattggggagaaaaaagtcccccctacggtgtgcccaccacttcaactccctacgaaggtcctactgaagagcccttcagcagcggtggtgggggatccgttcagggccaaagctccgaacaactgaacagattcgcaggttttggcattggtctcgcaagtctctttaccgagaatgttctggcgcacccatgtatcgtgttgcggcgacaatgccaggtgaactaccatgctcaacactatcatctcacgccattcactgtcatcaacattatgtactcttttaacaaaacccaaggacccagggcactgtggaagggcatggggagtacatttatcgttcagggagtgacacttggggctgagggcatcatctcagagttcaccccactcccccgggaggtcttgcacaagtggagtccaaagcagattggtgaacatctactgttgaagagcctcacttacgttgtcgcaatgccattttatagcgcctcactgatagagaccgtgcaaagcatgttggacgcctatttccctgagctgatagctaatttcgctgcctccctttgctctgatgtcatactgtatccactcgaaaccgtcctccatagattgcacatacaaggtaccagaaccattatcgacaacacagatttagggtatgaggtactaccgataaatacccagtacgagggcatgcgcgattgcattaataccattcgccaggaggagggtgtctttggcttctataaaggattcggtgctgtgatcattcagtacactctgcatgccgcggtgctccagattaccaaaattatctacagtactctgctgcaaaacaatatttag

SEQ ID NO: 135136 - DNA, 819 bp, Artificial Sequence
  Description of Artificial Sequence: Synthetic coding sequence
atgtattcgtttaataagacacagggccctagggccttatggaaaggcatgggctcaacatttatagtccaaggggttacactgggtgctgaggggataatcagcgaattcacccccctgccgcgggaggtattacacaagtggagtcctaagcagattggagagcacctcctgttaaaaagtctgacctacgtggtggcaatgccattctactctgcaagccttatagagactgttcagtctgaaattattcgcgacaacacaggcattctcgagtgcgtcaaggaaggcattggacgggtcatcggcatgggcgtgccacacagcaagagattactccccttactgtcacttatcttccctacggtcctgcacggtgtgctgcactatattattagctccgtcatccagaagtttgtgctgttaattctgaagaggaagacctacaactcccacctagccgaaagtacctcacctgtgcagtctatgttagacgcgtatttccccgaattaattgctaacttcgccgcgagtttatgctctgatgtgattctgtatcctttagaaacagtcctccatagactacacattcaaggtacccgcaccatcattgacaatacagatctgggctacgaagtcctccccattaacacccagtacgagggcatgagggattgcatcaacaccatccggcaggaagaaggcgtctttgggttctataaagggttcggagctgttattatccagtacacattgcacgctgcggtgttgcagataactaaaatcatctacagtaccctgcttcaaaataatatttag

SEQ ID NO: 135137 - DNA, 618 bp, Artificial Sequence
  Description of Artificial Sequence: Synthetic coding sequence
atgccattctacagtgcctccttgatcgagaccgtgcaatcggagattatccgggataacaccgggatcttagagtgcgtgaaggagggaattggacgagttatcggcatgggagtaccccattctaaaaggttgcttcccctgctctccctgatctttccaacggtcctccacggggtgctgcactatattatttcatcggtgattcagaagttcgtattactgatcctgaaaaggaagacatataactcccacctggccgaaagtacaagtccagtccaatcaatgctggatgcttacttcccagagttgatcgcgaatttcgcggccagtctgtgtagtgacgtgatactatatccactggagacggtgctgcatcgtctgcatattcaaggaaccagaacaatcatcgacaatactgacctcggctatgaagtgctgcctatcaacacccagtatgagggtatgcgagattgcataaacaccatccgtcaggaggagggcgtcttcggtttctacaagggctttggagctgtgatcatacagtacacattacacgccgctgtcctccagattaccaagatcatctattccaccctgctgcaaaacaacatatag

SEQ ID NO: 135138 - DNA, 984 bp, Artificial Sequence
  Description of Artificial Sequence: Synthetic coding sequence
atgaagaccgagcagctcaatcgcttcgcaggctttgggatcggactcgcttccttgttcactgaaaatgtcctcgcccacccctgtatcgtgctgagaaggcagtgccaggttaactaccatgcccagcactatcacctgactccttttacagtgattaatatcatgtatagttttaacaagacgcagggacccagagccttgtggaagggcatgggatcaaccttcattgtccagggggtgacgctgggcgccgaaggcatcataagtgaattcaccccactgccgcgggaggtactacacaagtggagccccaaacaaataggagaacatttactgctgaagtctctgacgtatgtggtggcgatgcctttttattcagccagcttgattgagactgttcagtcggaaattatccgggacaataccggcatcttggagtgcgtgaaagaggggatcgggagagtcatcgggatgggcgtgccccattcaaaacggctccttcccttgctgtcgctgatcttccctaccgtgctccatggggtcctgcactatataatttcttcagtcatccagaaatttgtcctcttgattctgaaaaggaagacttacaactctcacctcgccgaatcaacatccccagttcagagcatgttggatgcctatttccccgaactcatagccaacttcgctgcctctctgtgctctgacgtcatcctttaccccctggagactgtgctgcaccggctgcatattcaggggacaagaacaataattgacaatactgatctcggttatgaagtgttgcccatcaatacccagtacgaaggcatgcgggattgcataaacacaatccgccaggaagagggcgtcttcgggttttacaagggattcggagcagtaatcattcaatacactctccacgcagccgtgctccagattacgaaaatcatttactccacactgcttcagaataacatctag

SEQ ID NO: 135139 - DNA, 771 bp, Artificial Sequence
  Description of Artificial Sequence: Synthetic coding sequence
atggggtccactttcattgttcagggtgtaacattaggggccgaaggaatcattagcgagttcaccccactgcctagagaggttcttcataagtggtcacccaagcagattggagagcacctattgctgaaatcattgacctacgttgtagccatgcctttctactcagcatcactgattgagacggtgcagagcgagatcatacgggacaacactggcatcctggaatgcgtcaaagagggcatcggcagggtgatcggtatgggtgtgcctcattccaagcgccttcttcccctgttgagcttgattttccctactgtactccacggcgtactgcattatataatttcgagtgttatccagaaatttgtcctgctgatactgaagcgtaaaacatacaattcacacctagccgaatccaccagtcctgtccaatcgatgttagacgcttatttccccgagctgatcgcaaacttcgctgcatctttgtgttcggacgtgatcttgtatcccctggagacagtgttacaccgcttgcatatccagggcacacggaccattatagacaatacagatctggggtatgaggttctgccgatcaacactcagtatgagggcatgagagattgtattaatactattagacaggaagagggggtgtttggcttttataagggctttggagcagtaatcatccagtatacccttcatgcagctgtgctacagatcacgaagatcatttattctaccttgcttcagaacaacatctag

SEQ ID NO: 135140 - DNA, 819 bp, Artificial Sequence
  Description of Artificial Sequence: Synthetic coding sequence
atgtattcgtttaacaaaacccaaggtccacgcgcgctgtggaaggggatggggtccacttttatcgtccagggagtgacgcttggtgctgaaggcatcattagcgaatttaccccattgccgagagaagtgcttcataagtggagccccaagcagatcggcgaacacctgctcctgaaatccctgacttacgtggtggcaatgccgttctactccgcctccttgatagagaccgtccagtcagaaatcattcgagataacactggcattctggaatgcgtaaaagaggggatcggccgcgtgattggcatgggagtgccacattcgaagcgactgttgcccctcttgtcactcatctttccaaccgtactccatggggtgctacactacattatttcctcagtgattcagaaatttgtacttctgattttaaagcgcaagacctacaacagccacttagctgagagcacttcacccgtgcagagcatgctcgacgcctactttccagagcttatcgctaacttcgctgcatcactgtgctcagatgtaatcctgtatcccctggaaacagtgctgcatcgtctgcatatccaggggacgaggactattattgacaatactgatttaggctacgaggtgctcccaatcaacacccaatatgagggaatgcgcgactgcatcaacacaatcaggcaagaggagggagtgttcggcttctacaaaggctttggagccgtaatcatccaatatactctgcatgccgccgtgctgcaaattaccaagattatctactcaactctcttacagaacaacatttag

SEQ ID NO: 135141 - DNA, 2220 bp, Artificial Sequence
  Description of Artificial Sequence: Synthetic coding sequence
atgagttccgagagtaaagagcagcacaatgtgtctcctcgagactccgccgaaggcaacgactcttacccttctgggatacatttggaattgcagagggagtcaagcacagactttaaacagttcgaaactaatgaccagtgccggccttaccaccggattttaattgagaggcaggagaaatccgacaccaatttcaaagagtttgtgattaagaagctgcagaaaaactgtcagtgttcccccgccaaagcaaaaaatatgatcttaggcttcttacccgttctccagtggttgcctaaatatgacttgaaaaagaatatcctcggcgatgtgatgagtggcctgatagtaggcatcctccttgtcccccaatcaatcgcctattccttgttagcagggcaagaacctgtctacggactgtacaccagtttttttgcaagcattatttacttcctgctgggcacgagccgccacatctcagtcggcatattcggcgtactgtgcttgatgatcggcgaaaccgttgacagggagctccagaaggccggatatgacaacgctcatagcgcgccgtctttgggaatggtcagtaatggctcaacactgttgaaccacacgagtgaccggatttgtgataaatcctgttacgccatcatggtcggaagcactgtgacctttattgccggtgtctatcaggtggctatgggattctttcaagttggattcgtgtccgtttaccttagcgacgcactcttatccggatttgtgacaggggcatcttttactattctgacatcgcaagccaagtatttgctcgggctaaacctgcccaggactaatggagtcggaagcctcataactacttggattcacgttttccggaatatccacaaaactaatttgtgtgacctgatcaccagtttgctttgcctgctggtgctactgcctactaaggagcttaatgagcacttcaagtcaaaattgaaggctccaattcctattgaattagttgtggtagtggccgccaccctggcaagccatttcggcaagctccatgagaactataacagctcaattgccggtcatatccccaccgggtttatgccccccaaagtgcccgagtggaacctgattccatcggttgctgtcgatgcaattgcgatctccatcattgggtttgctataactgtaagcctcagcgagatgtttgccaagaagcatggatacaccgttaaagctaatcaggagatgtacgccattggcttttgtaacattatcccgtccttcttccactgctttacaacttccgcagcgctggccaaaacactggtgaaggagtcaacgggctgccacactcagctgtccggtgtggtgactgccctagttcttctgctcgttctccttgtcatagcccctctgttctacagcctccagaagtcagtgctgggtgttattaccatcgtgaacctacggggtgccttgaggaagttccgggacttacctaaaatgtggtcaatttcacgaatggataccgtgatctggttcgttaccatgctctcatccgcccttcttagcacggaaataggcctgttagtgggagtctgttttagtatattctgcgtgattcttcgcacccagaaacctaaatctagcctgcttgggctggtcgaagagtccgaggtttttgaatctgtgagtgcgtacaagaacctccagatcaagcctggaataaagatcttccggttcgtagcacctctctactacattaacaaggagtgtttcaagtccgctctctataagcagacagtgaaccccatcctcattaaggtagcatggaaaaaagcagcaaagaggaaaatcaaagagaaggttgtgaccctgggtggtatccaggacgaaatgtctgtgcagctgtctcatgaccccttggaactgcataccatcgtaatagactgcagtgcgatccagtttttggacacggccggtatccacaccctaaaggaagtgcgccgggattacgaagcaattggaattcaggttctgctcgctcagtgcaaccctacggtgcgagattctctgacaaacggcgagtattgcaaaaaagaagaagagaacctgctgttctatagtgtatacgaagccatggcctttgcagaggtgagcaaaaaccagaagggtgtgtgtgtcccaaacggactgagccttagcagtgactag

SEQ ID NO: 135142 - DNA, 72 bp, Artificial Sequence
  Description of Artificial Sequence: Synthetic coding sequence
atgagctctgaaagcaaagaacagcacaacgtctctccccgcgactccgcggagggtaatgactcgtattag

SEQ ID NO: 135143 - DNA, 2295 bp, Artificial Sequence
  Description of Artificial Sequence: Synthetic coding sequence
atgattgaaccttttggcaatcaatacattgtcgctcgacccgtgtattccacaaatgcttttgaagagaaccataaaaagacaggaaggcatcataaaaccttcttagaccatctgaaagtctgttgttcatgcagtccacagaaagctaagagaatcgttttatcattatttcccatcgcttcatggctgcccgcctaccggctcaaggaatggctgctgtcagatattgtgagtggcatttccaccgggattgttgcagttctgcagggcctggcctttgccctgctggttgacattccacccgtgtatggtctgtacgcttcatttttccccgcaattatttacctcttctttggcacctccagacacatttcagtgggcccgtttccaatcctgtccatgatggtgggcctggccgtctccggagctgtgtctaaggcggtgcctgaccgtaacgccaccacgctgggtctgcccaataattctaacaattcttcactacttgacgatgagcgcgtccgggtcgctgccgccgcatccgttacagttttgagcgggataattcagctggccttcgggattctgaggattggatttgtcgtaatttatctcagcgaatctttaattagcgggttcacaaccgccgctgcggtgcatgtgttagtatcacagttgaagtttatcttccagctgaccgtgcccagccacaccgatccggtgtccatatttaaagtcctgtattcagtgtttagccagattgagaaaactaatatcgcagacctggtgacagctctcatcgtcctgcttgtcgtgtccatcgtcaaggagatcaatcaaagatttaaggacaagctgcctgtgcccatccccatcgaatttattatgactgtgattgccgctggtgtgtcttacggctgcgatttcaagaatagatttaaagtcgctgtcgttggcgacatgaatccaggcttccagccccccattacacccgacgtagagactttccaaaacaccgtcggagattgttttggcattgcgatggtggccttcgcagtagctttcagcgtggcctctgtgtactctttgaaatacgactaccctctggacgggaaccaggagctcatcgccctcggcttagggaatatcgtgtgcggagtttttcgaggattcgctggtagtaccgcactgagtcgtagtgccgtgcaggagtcgaccggcggcaagactcaaatcgccggtctgatcggtgctatcattgtactaatcgtggtgttggcaatagggttcctactcgctccactccagaaaagtgtgctcgctgcactagctctgggaaacttgaagggtatgctgatgcagtttgccgaaataggtcggctgtggcggaaagataagtatgactgtttaatatggatcatgacgttcattttcacaatcgtgttggggttggggctcggcctagccgcttcagttgcctttcagcttcttacaatagtgttccgtacacaatttccaaaatgttccaccctggctaacattggcaggactaatatctacaaaaacaagaaagattattatgatatgtacgagcctgagggcgttaagatcttccgctgcccttccccgatctacttcgctaacataggcttctttaggagaaaactgatcgacgcggtgggcttctcgccactaagaattctccgcaaacgcaacaaggccctcagaaagataagaaagcttcagaagcagggactcttgcaggtgacacctaaagggttcatatgcaccgtcgacacaattaaagactcagacgaagagctcgacaacaatcagatcgaggtgctcgatcagcccataaatacaaccgaccttccattccacatcgactggaacgatgacctcccacttaacatcgaagttcctaaaatttctcttcatagcctgatcctcgattttagcgccgtgagcttcctcgatgtgtcgtcagttcgtggtctgaaatccattctgcaggaattcatccggatcaaagttgatgtttatatcgtaggaacagacgacgatttcatagagaaactcaataggtatgaattcttcgacggggaggttaagagcagcatctttttcctgactatccacgatgctgtactgcacatcctcatgaagaaggattattccacaagcaaatttaatccttcccaagagaaagacggtaaaattgatttcaccatcaacacaaacgggggcttgagaaaccgtgtctacgaggtgccagtcgagactaagttttag

SEQ ID NO: 135144 - DNA, 1956 bp, Artificial Sequence
  Description of Artificial Sequence: Synthetic coding sequence
atgttattgaggaaaatcatcaaacggcaggaagatattattcgacacttctggataatttccaaatgcgtcgttgcttcatggctgccagcctaccggctcaaggaatggctactcagcgacattgtctcgggcatttcgaccggtatagttgcggtgctccagggcctggcctttgcactgctcgtcgacattccacctgtatacggactgtatgcatcgttcttcccagctattatctatctcttttttggaacatcccggcacatttcagttggaccatttcccattctgagcatgatggttggcctcgccgtttctggcgccgtcagcaaggcagtccccgacaggaacgctacgacactcggcctccccaacaacagtaataattcatctcttctggacgacgaacgggtgcgagtcgctgccgctgcctcggttacagtgctctctggcatcatccagctcgccttcggcatcctaagaatcggcttcgtggtgatatatttatctgagagcttgatttcggggttcacaaccgccgccgccgtgcacgtgttggtatctcaactcaagttcatcttccagttgacagtgccttctcatacagacccagtctccatctttaaagtgctgtactcagttttctcccagattgagaagaccaatatcgccgacctggtgacggccctcattgtcctgctggttgtgagtattgtaaaggagatcaatcagcgatttaaggataagctgccagtgcctattcccatcgaattcatcatgaccgtcatcgccgccggcgtctcgtacggctgtgacttcaagaatcgcttcaaagtggcagtggtcggggacatgaaccccggctttcagccaccaataacccctgacgtggaaactttccagaataccgtcggagattgtttcggaattgccatggttgcctttgctgtcgcgttctccgtggccagcgtgtactcactaaagtacgattatccgctggacggaaatcaggaacttatagcgctggggctcgggaacatcgtgtgcggggtgttccgaggattcgcgggttctaccgctctctctagaagcgccgtgcaagaatctaccggggggaagacacagattgcaggactcatcggggcaattattgtgctgatcgtggtcctcgccatcggattcctccttgcgccccttcagaaatcagtgttggccgcgctggctttgggaaacctgaagggcatgcttatgcagtttgccgagatcgggagactgtggcgaaaagataagtatgattgtctgatctggataatgacatttatctttactatcgtgctgggactaggtctaggacttgcagcctccgtcgcttttcaacttctcacaattgtgttcaggacccagttccctaagtgctctaccctagccaatatcggacgcacaaatatttacaagaacaagaaggactattatgatatgtatgaacctgagggggtgaagatctttaggtgcccttctccaatctatttcgctaacataggcttcttccggaggaagctcatcgacgctgtcggttttagccccctcagaatcttgcggaaaaggaacaaggccctcaggaagattcgaaagctgcagaaacaagggctgctccaggtgactcctatccttcaggagttcatccggattaaggtagacgtgtacattgtggggaccgacgacgattttattgaaaagctgaacaggtatgagttttttgacggggaggtcaagagctccatcttctttctgactatccacgacgcggtactgcacattctcatgaagaaggattactcaacttcgaagtttaacccaagtcaggaaaaagacggcaagatcgatttcacaatcaacactaatgggggtcttagaaacagggtctacgaggtgccagtggaaacgaagttctag

SEQ ID NO: 135145 - DNA, 363 bp, Artificial Sequence
  Description of Artificial Sequence: Synthetic coding sequence
atgattgagccttttggaaatcagtacattgtcgcaaggccagtgtactccactaacgctttcgaggagaatcataaaaaaacaggccggcaccacaaaacctttctggaccatctgaaagtctgttgtagctgttctccccaaaaggctaagcgcatcgttttgagtctgtttccgattgcatcctggctgcccgcctatagactgaaagaatggctgctcagcgacattgtttcaggcatatctacagggattgtcgctgtgttgcagggcctcgcgttcgctttacttgtggacatcccgccagtgtatggcctatacgccagcttttttcccgccatcatctacctgtttttcggatag

SEQ ID NO: 135146 - DNA, 2343 bp, Artificial Sequence
  Description of Artificial Sequence: Synthetic coding sequence
atggctgcgcctggaggacgctccgaacctccacagctgcccgaatatagctgtagttacatggtgagccgcccggtgtattcagagctagctttccagcagcagcacgagcgtcgtttgcaagagaggaagacgctgcgggagagcctcgctaaatgctgctcttgttccaggaagagagcatttggcgtattgaagaccctagttccaatcctcgaatggctacctaagtacagggtcaaggaatggctcctaagtgacgtcataagcggagtttcgacaggcctggtagcaactttgcaggggatggcgtatgcccttctggcagccgtaccggtgggatacggactgtactctgcgtttttccctatccttacgtacttcatctttggtacctctagacacattagtgttggccccttccccgtcgtgtcacttatggtgggatcagtagtcctatctatggccccagatgagcactttttggtctcctcctctaatggaacggtgctcaacacaacaatgatcgatactgcggcccgagacacagctcgcgtcctcattgcctctgcgctgaccctgctggtggggattattcagctcatcttcggcggccttcagatcgggttcatcgtgaggtatctagcggaccctctagttggtggatttaccactgccgccgctttccaagtgttggtgtcgcagctgaagattgtgctcaatgtgagcacaaagaactacaatggcgtgctcagtattatctacacattagtagagatatttcaaaacataggggataccaatctggctgacttcacagccgggttactcactatcgtggtctgtatggccgtgaaagaattaaatgacagattcagacataaaatccccgtccccatacccatagaagttatcgtgacaattattgcaactgcaatttcttatggcgccaacctggagaagaattacaacgcaggtatagtaaagagcatcccccggggcttcctgccacctgaattaccccctgtgtccctattttccgagatgctggctgcatcttttagcatcgctgttgtcgcgtacgcgattgcagtgtcagtgggcaaggtgtatgctaccaagtacgactacacaatcgacggaaaccaagagttcattgcctttggtatctctaacatctttagcgggttcttttcttgctttgttgcaaccacggcgctgagccgtactgcagtccaggaaagcacaggcgggaagactcaggtggcagggatcatcagtgctgccatagtgatgatcgctattctagccctgggaaagcttctcgagccactacagaaaagcgtgctagccgctgtcgtcattgcaaaccttaagggcatgtttatgcagctgtgcgatattccccgcctgtggcgccagaataagatcgacgcagtcatttgggtcttcacctgtatcgtgagtattatcttgggactggatctgggcctcctggctggcctgatctttgggttgttaaccgtagtgttacgcgtgcagtttccctcatggaatggcctgggtagtattcccagcactgacatctataaatcaaccaaaaattacaaaaatatagaagagccccagggggtcaagatactcaggttctccagcccaattttctacggtaacgtcgacggtttcaaaaaatgcatcaagagtactgtgggatttgacgctattcgcgtgtataacaaacgcctgaaagctttacgcaagattcagaagctgatcaagagcgggcaactcagggctaccaagaacggtattattagtgacgcggtgagcaccaacaacgcattcgagccggacgaggacatcgaggacctggaggagctggacatccccacaaaggagatcgagatacaagtggattggaatagtgagctgccagtaaaggtcaacgttccaaaggttcctatccattctctggttctcgactgtggtgccatttcctttttagatgtggtcggcgttcgctctctaagagtgattgtaaaggaattccagcggattgatgtgaacgtgtatttcgcatctcttcaggattacgtgatcgagaaactggagcagtgtggcttcttcgacgacaatataaggaaggataccttttttctgaccgtgcacgacgccattttgtacctgcagaaccaagtaaagagtcaagaagggcaaggtagtatactagaaacaattactttgatacaggactgtaaggatacactagagctgatagagaccgagctgacagaggaggagctggacgtgcaggatgaggctatgcgcaccctggccagttag

SEQ ID NO: 135147 - DNA, 396 bp, Artificial Sequence
  Description of Artificial Sequence: Synthetic coding sequence
atggctgctccaggtggccgctcagagccaccccagctgccggagtatagctgttcctatatggtcagccggcccgtgtatagtgaattggcttttcagcagcagcatgaaaggcggctccaggagcgtaaaacacttagagagagcctcgcaaaatgctgcagctgttcccgaaagcgagcgttcggagtcctcaaaaccctggtacctattctcgaatggctgccgaagtacagggtgaaagaatggctgctgtcggacgtgataagcggcgtctcaaccggattagtcgcaacactacagggcatggcatacgctcttctggccgctgttcctgttggttacggactctacagtgcattcttccccattttgacctactttatctttggttag

SEQ ID NO: 135148 - DNA, 1026 bp, Artificial Sequence
  Description of Artificial Sequence: Synthetic coding sequence
atgcgccacgggctggcagtaccaagtgttttagcagctgttgtgattgctaatttgaagggaatgtttatgcagttatgcgatattccacggctgtggaggcagaacaagatagacgcagttatttgggtttttacgtgtattgtgagcatcattttgggtctggaccttggcctcctagcagggcttatttttgggctcctgacagtggtactgcgggtgcagttcccttcttggaatggtctaggatcaatcccatccaccgatatatacaaaagcacaaagaactataagaacatcgaggaaccacagggagttaagatcctccgcttcagcagtcccatcttttatggcaatgtggacggcttcaaaaagtgcataaaaagcacagtgggatttgacgccattagagtgtacaacaagagactgaaggctctcaggaagatccaaaagctgataaaatcaggacaactacgtgctactaagaatgggatcataagcgatgccgtaagcaccaacaacgctttcgagcccgacgaggacatcgaagatttggaagagttggacatccccacaaaagagatcgagattcaggtggactggaactccgaactgccagttaaggtaaacgtgcctaaagtgcctatccacagcctggtcctagactgcggagccatttcattcttagacgttgttggtgtcagatctctccgggtgattgtcaaagagtttcagcgaatcgatgtgaacgtctattttgccagccttcaggattacgtaatcgagaaacttgaacagtgcgggttcttcgacgacaatatccggaaggatacgtttttcctgacagtacatgacgccatactgtaccttcagaatcaggtaaagtcccaggagggtcaagggtcaattctggaaaccatcacactcatccaggactgtaaggacaccctcgaactcatcgagacggaactgactgaagaggaactggacgtgcaggacgaggcgatgagaactctagcaagttag

SEQ ID NO: 135149 - DNA, 1050 bp, Artificial Sequence
  Description of Artificial Sequence: Synthetic coding sequence
atgatcgcaatcttagccctcgggaaacttctcgagcccttacagaagagcgtgctggccgctgtggtaattgccaatctgaagggaatgtttatgcagctgtgcgacatcccacgcctttggaggcagaacaagatcgacgctgttatatgggttttcacatgcatcgtctcaattattctcgggttggacctcggattactggctgggctgatcttcgggcttctgactgtggtgctgcgagtccagtttccatcctggaatgggctcgggtctatcccaagcaccgacatttacaagtcgactaagaactacaaaaacattgaggagccacagggcgtgaagattctgagattcagttctccaatattctacggcaatgtcgacgggtttaagaaatgcataaaaagcaccgtaggcttcgacgcaatcagggtctataacaaaaggctgaaggcacttcgaaagatacagaagctcattaagtcaggccaactgcgagccaccaagaacggaatcattagcgacgccgtctcaactaacaacgcgttcgaacctgatgaggacatcgaggatcttgaagaattggatatccctacgaaagaaatagagatccaggtggactggaactctgagctgccggtaaaagtgaacgtacccaaggtccctattcactctctggttttggactgcggcgcaatttctttcctggatgtggtaggtgtgcgcagtctgcgagtgatcgttaaagagtttcagcgcatagacgttaatgtgtatttcgctagtctgcaggattacgttatcgaaaagctcgagcagtgcggctttttcgacgacaatattcggaaagatacatttttcctaaccgtccacgatgccatactgtatctgcagaatcaggtgaaaagccaggagggccaggggtccattttggagaccatcactttgattcaggattgcaaagacacactggagctcattgagaccgagctcaccgaagaagaactagacgtgcaggatgaggccatgagaacactcgcgtcctag

SEQ ID NO: 135150 - DNA, 1104 bp, Artificial Sequence
  Description of Artificial Sequence: Synthetic coding sequence
atgaggcatggacttgcagtcccagtggcaggaataatctctgcagccatcgtaatgatcgccattttggccttgggcaaactgctcgagccactccagaaatcggtgttggcagcggtggtcatcgctaatctgaaggggatgtttatgcagctttgcgatataccacggctgtggagacagaacaagatagatgcggtaatatgggtctttacttgcattgtgtctatcatcctggggcttgatctcgggttgctggccgggcttatcttcgggctgcttaccgtcgtgctgcgtgtacagttcccttcctggaacggcctgggctcaatccccagcactgatatatacaaaagcactaaaaactacaagaacattgaagagccgcagggcgtgaagattctgcgtttttctagtcccatcttttatgggaacgtggatggttttaaaaagtgcatcaagtctactgtcggtttcgatgctatccgggtctataataaacgactaaaggccctccgcaagatccagaaactgatcaagagcgggcaactccgggcaacgaagaatgggataatttcggatgccgtatcgaccaacaatgcatttgagcctgatgaggatattgaggacctggaggagttggacatcccaactaaagaaatcgagatacaggttgattggaatagtgaactccccgtgaaggtaaatgtgcctaaagttcctatccatagtcttgtattagactgtggagctatttcctttttggacgtggtgggagtacggtcactgcgcgttatagtgaaagagtttcagcgcatcgatgtcaatgtgtacttcgccagcctgcaggattatgtcattgagaagctcgagcagtgcggattttttgacgacaacatcaggaaagacacgtttttcttgaccgtccacgacgccattttgtacctgcagaatcaggttaagtcacaggagggtcaggggagtattctcgagactatcactctgatccaggactgcaaggacacactggagctgatcgagaccgagctgacggaggaggagctcgacgtccaggacgaggctatgcgaactctcgcatcttag

SEQ ID NO: 135151 - DNA, 2235 bp, Artificial Sequence
  Description of Artificial Sequence: Synthetic coding sequence
atggatcatgctgaagaaaatgaaatcctcgccgctactcagaggtactatgtggagaggcccatcttctcccacccagtgttgcaagaacggctgcatactaaagataaggtgccagacagtattgcagacaagttgaagcaagccttcacttgcaccccgaaaaagatcaggaacattatctacatgttcctgcctattacaaaatggctgccagcctataaatttaaggagtatgtccttggcgacctggtctcaggaattagtaccggagtgctccaactcccacagggtctggcattcgctatgttggccgctgtcccccccatttttggactgtactcgtctttctatccagtgattatgtactgctttctgggaacctccagacacatctccatcgggcctttcgcggtcattagtctaatgatcgggggtgtcgcagtgagattagttccagacgacattgtgatccccggcggcgtcaatgccaccaacggaaccgaggctcgagacgcactgcgggtaaaggtggctatgtcagtgacactcctgtcaggtattatccagttttgcctgggcgtgtgtagattcggcttcgtggccatttacctcacagaacctctggtgagaggattcacaacagctgccgccgtacatgtgtttacttccatgcttaagtatctcttcggtgttaagaccaaaaggtatagtggtatttttagtgtggtctatagtacggtggcggtactacagaatgtcaagaacctgaacgtctgttctcttggcgtcggccttatggttttcgggctgttactgggcggaaaggagtttaacgagagatttaaggagaaactgccggccccgattcctttggaatttttcgccgtggtgatggggaccggtatctctgccggattcaatctgaaggaatcgtataatgtggacgtcgtggggacgctgcctcttgggctactgccaccagctaacccagacacctctctgttccatttagtgtatgtggatgcgattgcaatagctatcgtgggattttcggtgacgataagcatggcaaaaaccctggcaaataaacacggctatcaggtcgacgggaaccaggagctgatcgctttgggactctgtaacagcatcggaagtcttttccagaccttcagcatttcctgctccctttctagatctctggtgcaggagggaacaggcggcaagacacagctggcagggtgcctggccagcctgatgatcctgctggtcatccttgccaccggttttctgttcgagtctcttccacaagctgtcctgtccgcgatcgtgatcgtgaacctgaaaggaatgttcatgcagttttccgacctgcccttcttttggcgcacgtctaagatcgagctgaccatttggttaaccacctttgtgtcctcacttttcctggggctagactacggactcattacagcggtgatcattgccctgctgacagttatatatcgaactcagtccccaagttataaagtccttggaaagcttccagagactgatgtatacattgacattgatgcctacgaggaagtcaaagaaatacccgggattaaaatctttcagatcaatgcacctatctattacgcgaacagtgacctatacagcaacgcccttaaacggaagacaggggtcaatcccgctgtgattatgggcgctagaaggaaggctatgcgcaaatacgctaaggaggtgggcaacgcaaacatggctaacgcgaccgtggtgaaggctgatgcagaagtggatggcgaggacgccaccaaacccgaggaagaggatggcgaggttaagtacccacccattgttatcaagtctacctttcccgaggagatgcagcgcttcatgcctccgggggacaacgtacacaccgtgatcctggattttacccaggtcaactttatcgactctgttggcgtgaagacactcgctgggatcgtaaaggaatacggcgacgttgggatctatgtgtatttggcagggtgcagcgcacaggtagtcaacgacttgacgcgcaaccggtttttcgaaaatcccgccctgtgggagttgttgttccatagtatccacgatgccgtgttaggctcacagcttagagaagctctggcggaacaagaggcgtccgcccccccctcccaggaagacttggagcctaatgctaccccggcgaccccagaggcatag

SEQ ID NO: 135152 - DNA, 2058 bp, Artificial Sequence
  Description of Artificial Sequence: Synthetic coding sequence
atggatcacgctgaagagaatgaaattttggccgccacccaacgctattatgtggaacgacccatctttagccaccctgtgctgcaggagcgcctccacaccaaagataaagtacctgactctatcgcggataaactcaaacaggcctttacctgcactcctaagaaaattcgaaatatcatctacatgttcctgcccattactaagtggttgcccgcgtataagttcaaagagtatgtcctgggggatctggtgtctggcataagtaccggagtcttgcagctgccacaggggctagccttcgctatgttagcggccgtgccacctatttttggactttacagcagcttctaccctgtgataatgtattgcttcctcgggacttctcgacacatcagcattggccccttcgccgtgattagtctgatgataggcggcgtggccgtgcgcctggtgccggacgatatcgtgattcctggcggtgttaacgccactaacggtactgaggcgagggatgccctgagagtgaaggtagctatgagtgtgacactgctgtcaggtatcatccagttctgccttggagtgtgccgttttggattcgtggcaatttatcttaccgaacccttggtgaggggttttacgaccgccgcggccgtccacgtgttcactagtatgcttaagtacctctttggggtgaagacaaagcgatatagtggtattttttccgtggtgtactctacagtggctgtgctgcagaatgtcaaaaatcttaacgtgtgctccctgggagtgggcctgatggtgtttggactgcttctgggagggaaagagttcaatgagcggttcaaggagaaactccccgcccctattccccttgaattctttgcagtggtcatggggactggcatctcagccggtttcaacctcaaggaatcctacaatgtggatgttgtgggaacccttcccctgggcttgctcccaccagctaacccagataccagcttgttccatctggtctacgtagacgccatcgccatagctatagtgggattctctgtgactatcagtatggcgaaaacactggccaacaaacacggataccaggtggatggcaatcaagagttgatcgctctgggattgtgtaactccattgggagtctgttccagaccttcagcattagttgtagtctaagcaggtccctcgttcaggaagggactggtgggaagacacagctggctggttgtctggcctctctgatgatcctgctcgtgatcctagcaactggcttcctcttcgaaagcctgcctcaagccgtactctcagcgattgttatcgtgaacttaaaaggaatgttcatgcagtttagcgacttaccttttttttggaggacatctaagatcgaactgacaatctggttgaccaccttcgtgagctcccttttcttagggctggactacggactgattactgctgtgatcattgctctcctgaccgtaatatacaggacacaatctccaagttacaaagtccttgggaagttgccggaaacagacgtctacatcgatatcgatgcctatgaagaggtgaaagagatacccggcatcaaaatttttcagattaacgcgcccatttactacgcaaacagtgacttgtattcgaacgccttaaaaaggaaaacgggggttaatcccgctgtaattatgggagccagacgaaaagccatgagaaagtacgcaaaggaagtaggcaacgcgaacatggccaacgctaccgtagtcaaagccgatgccgaggtcgacggagaggacgctaccaaacccgaggaggaggacggagaagtgaaatatcctcctatcgtcatcaagagcacgtttcctgaggagatgcagcggttcatgccacccggtgataacgttcacactgtcatactcgattttacacaagtgaatttcattgacagcgttggagtaaagacactggccgggattgtcaaagaatacggtgacgtaggcatctacgtttatcttgcagggtgcagtgcattcattcaacgctag

SEQ ID NO: 135153 - DNA, 534 bp, Artificial Sequence
  Description of Artificial Sequence: Synthetic coding sequence
atgggagcgcggcgaaaagccatgcgcaagtacgctaaagaggtcggaaatgctaacatggcaaacgccacagttgtgaaggctgatgccgaagtcgacggggaagatgccacaaagcctgaagaagaggacggcgaagtaaagtaccccccaattgtcataaaatccacctttcccgaggaaatgcagagatttatgccgccaggagacaacgtgcataccgtgatccttgattttacacaggttaactttatcgacagcgttggtgtgaagaccctcgccgggatcgtgaaagagtatggcgatgtcgggatttatgtctatctcgcgggctgctctgcccaagtagtgaacgatcttactagaaataggttcttcgagaatcccgctttgtgggagctcctgtttcacagcatccatgacgcggtgctgggttcccaactccgcgaggcattggcggagcaagaagccagcgctcccccaagccaggaagacctggaacccaacgcaaccccagctacacccgaggcctag

SEQ ID NO: 135154 - DNA, 1008 bp, Artificial Sequence
  Description of Artificial Sequence: Synthetic coding sequence
atggatcatgcagaggagaacgagatactggcagcgactcagcgctattatgttgagcgtccaattttttcccaccctgtcctgcaggaacggctgcacactaaggataaggttcctgactctatcgcggacaagctgaagcaagcatttacttgcacccccaagaaaattcgtaatatcatttacatgttcctgcccatcaccaaatggctacccgcctacaagtttaaagaatatgttctgggcgatttagtctctgggatttccaccggagtgctgcagctgccacaggggctggccttcgctatgctggccgccgtgccgccaatcttcggcctatactcctcattttacccagtcatcatgtactgtttccttggtacgtcacggcatattagcattgggccattcgcggtaatctccttgatgatcggaggagttgcagtccgactggtccctgatgatatcgtcatacccgggggagttaacgcaaccaatggcaccgaagcccgggatgcactgagggtcaaggtcgctatgagcgttaccctcctaagcgggataattcagttctgtctgggcgtgtgtagatttggctttgtcgctatctatcttaccgagccattggtgcggggctttaccaccgcagccgccgtccatgtgtttacatcaatgctgaagtacctgttcggagttaagacaaagagatactccggaattttttcggtggtgtacagcactgtggctgttctgcagaatgttaaaaacctgaatgtctgctcattgggggtgggtctcatggtctttggcctgttgctcggaggcaaagaattcaacgagcgattcaaggaaaagctgcccgcaccaatccccctggagtttttcgcagtcgtgatgggcactggaattagcgccggattcaacctaaaggagtcttacaacgtggacgtagtggggacactgcccctaggcttccatactgaaatgacccgcaggtggagaccctag

SEQ ID NO: 135155 - DNA, 2145 bp, Artificial Sequence
  Description of Artificial Sequence: Synthetic coding sequence
atggaccacgcagaagagaatgaaattttagctgctactcagaggtactacgtggagagacccatcttcagccatccagtgctgcaggaaaggcttcacactaaagataaggtacctgactcaatagcggataagctgaagcaggccttcacttgcactccaaaaaagattaggaatatcatttacatgtttctgccaattacaaaatggcttcccgcttacaaattcaaggagtatgtgctgggcgacctcgtgtcaggcatatccacaggggtactgcagctcccccagggactggctttcgccatgctagctgcagtgccaccaatcttcgggctgtactcatccttttaccccgtgatcatgtactgcttcttaggcacatcaagacatatatctattggaccctttgccgtgatctcccttatgattggcggagttgctgtaagactggtgcctgacgacatcgtcatccctgggggagtcaatgccaccaacggcactgaggcccgagatgcgctccgcgtgaaggtcgccatgtccgtcactctgttatccggcattatacagttttgcctgggtgtgtgccgctttggctttgtggccatctaccttacggaaccactggtgagagggttcacgacagctgctgccgtgcatgtctttactagcatgttaaagtacttgttcggagtcaagacaaagcgctactccgggatctttagtgttgtctacagcacggtggcggtcctccagaatgtcaagaacctgaatgtatgctctctgggagtgggactaatggtgtttggattattgctgggtgggaaagaatttaacgagagattcaaagaaaagcttccggcacctattccacttgaattttttgccgtcgtgatgggaaccggaataagcgcgggcttcaacttaaaggagtcctacaacgtagacgttgttggaactctgcctctcggacttctacccccggcgaacccagacacatcactgttccatctcgtgtatgttgatgccattgctattgctatcgtggggttttctgtgacaatatctatggctaaaactttggccaataaacacggttaccaagtggacggcaatcaggagctaatcgcgctgggactttgcaacagtatcggctctctgtttcagacattctctatctcatgctcgttaagtcgaagcctagtacaagagggtactggcggcaaaacccagctcgccgggtgtctggcgagcctgatgatcttgctggtgatactcgcgactggctttcttttcgagtctctaccacagaccatctggctgacaactttcgtctccagcttgtttcttggcctcgactatggactcataacggccgtgatcatcgctctgctcaccgtaatatacaggacgcaaagtccctcgtacaaggtgcttggcaagttgcccgagaccgatgtgtacatcgatatcgacgcatacgaagaagtgaaggaaatccccggaatcaagattttccagatcaacgcaccaatatactatgccaattcagatctgtattccaacgctctgaaacgaaagacaggagttaatcctgctgtgatcatgggcgcccgccggaaagctatgagaaagtacgcgaaggaagtgggcaacgctaatatggcgaacgctactgtcgtgaaagcaacacaggatgccgaggttgatggagaggacgcgacgaaacccgaggaggaagatggcgaagttaagtaccctccaattgtgattaaaagcactttccccgaggaaatgcaaagattcatgccacccggcgataacgtgcacacagtgatcctcgattttacgcaagtaaacttcatcgactccgtgggagttaaaacactggccggtatcgtgaaggagtacggcgatgtggggatctatgtttacttagcaggctgttccgcacaggtagtgaatgacctaactcgcaatcgcttctttgagaatccagccctgtgggagttgctttttcactcgatccacgacgctgtcctgggctcacagctgagggaagccttggctgagcaggaggcaagtgcacctcccagccaggaagacctcgagcccaatgccaccccagccactcccgaggcatag

SEQ ID NO: 135156 - DNA, 2241 bp, Artificial Sequence
  Description of Artificial Sequence: Synthetic coding sequence
atggatcacgccgaagaaaacgaaatactcgccgccacacagcgctattacgtcgagagacccatcttttcacatcccgtgttacaggaacgcttgcatactaaagataaagtgccagactctattgcagacaaacttaaacaggctttcacctgcacgcctaaaaaaattcgtaacatcatctatatgttccttccgatcaccaagtggttgcctgcatataaatttaaagagtatgtgttaggcgacctggtatccggaataagcactggtgtgctccagctgccacagggactagcctttgccatgctggccgccgtgccacctatcttcgggctgtattcctccttctaccccgttattatgtattgttttctgggaacatcgaggcacatctccattggcccgtttgcagtgatctctctgatgatcgggggggttgctgtgcgactcgtccccgacgacatcgtgattcccggtggggtgaacgccacgaatgggaccgaggccagagatgcactgagagtgaaagtggccatgagcgtgaccttactctccgggattattcagttctgcctcggggtgtgccggttcggctttgtggccatttatctgaccgagcccctcgtgagaggctttacgacagcagcggcggtgcacgtctttacaagcatgctcaagtacctttttggtgtgaaaactaagagatacagtggcatcttcagcgtagtatactccactgttgcagtgctccaaaatgtcaaaaatctgaatgtgtgctcactgggcgttggattaatggttttcggactccttctggggggtaaggaattcaatgagcgctttaaggaaaagttacccgctccgattccactggaatttttcgccgtggttatgggcaccggaatctctgctggcttcaacctgaaagagagctacaacgtcgacgtggtggggacgctgcccctgggcctgctcccccccgccaaccctgacaccagcctattccatctcgtttatgtggatgctattgccatcgccatcgtgggtttctctgtcactattagtatggccaagactctggccaacaaacacggctatcaggtggacggtaaccaggaactcatcgctttggggctctgcaacagcataggctccctatttcagacattctccatatcctgctcattatcccggtctctggtccaggaagggactgggggcaagacacagctcgccggatgtctggcttccctgatgatcctgcttgttattctcgccactggattcctgttcgaaagtctccctcaagccgtcctatccgccatagttattgtcaatctcaagggaatgttcatgcaattttcggatctacccttcttctggcgcacaagtaagattgaactgaccatttggctgaccacctttgtcagcagtctgtttctgggactcgattatgggctgataacagcggtaatcattgcactcttgacagttatttatcgcacccagagcccaagctataaagtgttaggaaaactgcccgaaacagatgtttacatcgatatagatgcctacgaagaagtgaaagaaatccccggaattaagatttttcaaatcaacgcccctatttattacgccaatagcgatttgtatagcaacgcactgaaacgaaagaccggcgtgaatcccgccgtgattatgggcgctcggcgaaaagctatgcggaagtatgccaaggaggtgggaaatgcgaacatggccaacgccaccgtggtgaaagcaacccaggacgcagaggtggacggggaggacgcgacaaagccggaggaggaggacggcgaagttaagtacccacccatcgttatcaagtcaacattccctgaggagatgcagcgctttatgcctcctggcgacaacgtccacactgtgatcctggattttacacaggttaatttcattgattctgtaggtgtgaagactctcgcgggcatcgtgaaggaatacggcgatgtcggcatctacgtctacctcgccggttgctctgctcaggttgtgaatgaccttacaagaaataggttcttcgagaatcctgcgttgtgggagttgctgttccatagtattcatgatgcagtgctgggctctcagttacgcgaagcactggcggagcaggaggcctccgcgccacctagccaggaggacctggaacctaacgctaccccagccacacctgaagcctag

SEQ ID NO: 135157 - DNA, 2124 bp, Artificial Sequence
  Description of Artificial Sequence: Synthetic coding sequence
atggaccacgccgaagagaacgaaatcctggcagctacccaacgctactacgtggagagacccatcttctctcatccagtcttgcaagaaaggctgcacacaaaggacaaggtgccagacagcatcgccgataagctcaagcaggcattcacttgcacacctaaaaagatccgcaatattatttacatgtttctccctataactaagtggctaccagcgtataagttcaaggagtatgtgctgggcgacttggtttccggtatctctaccggcgttcttcagctgccccaggggccctttgcagtgatttctctgatgatcggaggggtggccgtgcgcctggtgccggatgacattgtaatccccgggggcgtgaacgccaccaatggaacagaggccagagatgctctgagggtgaaggttgccatgtctgtgaccctcttgagcggtattatacagttctgtctgggggtctgccgattcggatttgtagccatttatttaactgagccactggtgagagggtttactacagcggccgccgtgcacgtatttactagcatgctcaagtacctcttcggagtaaagactaagcgctactctgggatattcagcgttgtgtacagtacggtggccgtcctgcagaatgtgaagaatttaaacgtgtgtagtctgggtgttggactgatggttttcggactcctgctgggagggaaagagtttaacgaacgattcaaggaaaaactccctgcgccgattccactggaattttttgcggtggtgatgggtacaggcatttccgccggttttaatttgaaagaaagttataacgtcgatgtggtgggaacccttccccttggcctcctgcctccagccaatcccgataccagccttttccatctggtttatgtcgatgccatcgccatcgcaatcgtcggcttttctgtgaccatcagtatggcgaagactttagccaataagcacgggtatcaggtcgatggaaatcaggagctcatagctctgggcttatgtaattccatcggctctctttttcagacattctcaatctcatgctcactgagtcggtctctcgttcaagagggcaccggagggaaaacacaactcgcaggatgcctggcgagccttatgattctcttggtgattctggcaaccggattcttattcgagtcattgcctcaggcagttctgtctgcgatcgtgattgtgaaccttaaaggtatgtttatgcagttctcagaccttccttttttttggcggactagtaagattgagctcaccatctggctgacaacctttgtctcctcattattcctcggccttgattacggactgatcaccgctgtgataatcgccttgctcacagttatatatagaacccagtcaccttcttacaaagtgctggggaagttgcctgagaccgacgtgtacattgatattgacgcttatgaagaagtaaaggagattccgggaataaagatttttcagatcaacgcccccatatactatgctaatagtgacctgtattcaaacgccctaaaaaggaagactggagtgaaccccgcggtaataatgggagcccgcaggaaggccatgcgcaagtatgccaaagaggtcggtaacgccaacatggcaaacgctaccgtcgttaaagcggatgcagaagtggatggtgaggacgccacaaagcccgaggaggaggacggagaggtgaaataccctcctatcgtcattaagagtacattcccggaagagatgcaacgattcatgccccctggcgataatgtgcacaccgtaattcttgactttacacaggtgaattttattgatagcgtcggggtgaagacactggctgggatcgttaaagaatacggcgacgtcggaatttatgtgtaccttgcaggctgctccgcccaggttgtaaacgacctgactagaaatcggttcttcgagaatcccgccctctgggagttgctgttccactctatacatgatgccgtcctggggagccaactcagagaggccctcgccgaacaggaggctagtgcccccccttcccaggaagacctcgaaccaaatgctacgccagcaacaccggaagcgtag

SEQ ID NO: 135158 - DNA, 2139 bp, Artificial Sequence
  Description of Artificial Sequence: Synthetic coding sequence
atggatcacgccgaggagaatgagatattggcagctacccagcggtactacgtagaaagacccatatttagccacccagtgttgcaggaaaggctccatactaaagacaaggtgccagatagcattgcagacaagctcaaacaggcctttacttgcacacccaaaaagatcagaaacatcatctatatgtttctgcccatcacaaagtggctgccggcctataagtttaaggaatatgtgctcggcgatttggtgagcggtatctccactggagtcctgcagttgccgcaaggtctggccttcgccatgctggctgccgtccccccgatcttcggactttactcatctttttacccggtgattatgtattgctttctgggaacaagtcgccacataagtatcgggccattcgcagtgatttccctgatgataggtggggtcgccgtgcgcttagtcccagatgatatcgtcattcctggcggcgtcaatgccacaaatgggacggaggcccgtgatgccttgcgggtgaaggtagcaatgagtgtgacgctgctgagtggtatcattcagttttgtctgggggtgtgccgttttggcttcgtggctatctatttaacagagcctctcgtgaggggcttcacgaccgctgccgctgttcacgtgtttacgtcaatgctgaaatatttgttcggggtgaaaacaaaacgatattccggcatcttcagcgtggtgtattcaactgtggccgtgctgcagaatgtgaaaaatctgaatgtgtgcagtctgggagttggattaatggtgttcggtctgctgctgggtggaaaggaatttaacgagagatttaaagaaaaactgccggctccaatccctcttgagttctttgccgttgtgatgggaacaggcatcagcgcaggattcaatcttaaggaatcgtacaatgtggatgtggtgggcaccctccctctaggcttacttcccccggccaatccggacacttctctgtttcatcttgtgtacgtggacgctatcgcaatcgctatagtggggttttccgtgactatttcaatggctaaaaccctagctaacaaacacggataccaggtcgatggcaatcaggagcttatagctctaggcctgtgtaactctattgggagcttgtttcagactttctccatctcctgctccctatcgagatctctcgtgcaggagggcactggaggcaaaacacaactggctggctgcctggccagtctcatgatcctgctagtgatccttgccactggatttctgttcgagtctctgccccagaccatctggctgactacatttgtgtcctctctctttttaggcctggattacggacttattaccgcagtcataatcgctcttctgacagtgatctaccgcacgcagagcccgtcatataaggtgttaggaaaactacccgagaccgatgtgtatatcgacatcgatgcatatgaagaagtgaaggagatcccagggatcaaaatctttcagattaatgccccaatctattacgctaacagcgacctgtatagcaacgcattaaaacgtaagaccggcgttaatcccgctgtcatcatgggtgctaggcgcaaggctatgcggaagtatgcaaaagaggtcgggaacgctaatatggctaatgctacggtggtcaaagccgacgccgaggtcgatggcgaagatgctaccaaacccgaggaggaggacggcgaagtcaaatatcctcccattgtcatcaagtcaacctttccagaggaaatgcagcgatttatgccaccgggggataatgttcatactgttattctggattttacccaagtgaattttattgattccgttggagtgaagaccctggctgggatcgtgaaagaatacggagatgttggcatctatgtctacctggctggatgttctgcgcaagttgtgaacgacttgaccagaaatcgcttttttgaaaaccctgccttatgggaactccttttccactcaattcacgacgccgtcctgggcagccagcttagggaagccttggcagagcaggaggcaagtgcgcctccttcacaggaggatctggaaccgaacgcaacccctgcaacgccagaagcctag

SEQ ID NO: 135159 - DNA, 1551 bp, Artificial Sequence
  Description of Artificial Sequence: Synthetic coding sequence
atggaccatgcagaggagaacgagattctagccgcgacacagaggtattatgtggaaaggccaatattcagtcatcctgtgctgcaggaacgcctccatactaaggacaaagtccccgactccatcgccgataagctgaaacaggcttttacctgtacgcccaaaaagatccgcaatatcatttatatgtttctgccaatcacaaaatggctgcccgcctataagttcaaggaatatgtcctgggtgacctggtcagcgggatcagtaccggtgtcctgcaactgcctcaagggctggccttcgcaatgttggccgccgtcccgccaatcttcgggctctactctagcttctaccccgtgattatgtactgctttctcggcacctcaaggcacattagtatcggacctttcgccgtcatttctcttatgattggtggagtggctgtaaggctggtccccgatgacatcgttattcctggcggtgtcaatgcaaccaatgggaccgaggcacgcgatgctcttcgtgtcaaggtggcgatgtcggtcacactgctctcagggatcattcagttttgtctgggtgtctgccggtttggattcgtggcgatttatctgaccgaacccctcgtgcgcggcttcaccaccgccgcggcagtgcatgtattcacttctatgctgaaatacttattcggcgtcaaaacgaaaaggtacagcggaatcttttccgtggtgtatagtactgttgcagtgcttcagaacgtgaaaaatctgaatgtgtgttctctgggtgtggggttgatggtgtttggactccttctgggcgggaaggagttcaatgagcgcttcaaagagaagctgcctgcaccgattccccttgaattttttgcggttgtaatgggcacaggcatttcagcagggttcaatctcaaggagagctacaacgtcgacgtcgttggcaccctccctcttggcctcctccctcccgcaaaccctgatacttcactctttcacttggtctacgttgatgcaattgctattgcgatagtgggcttcagcgtgactattagtatggctaaaacattggcaaataagcatggatatcaggtggatgggaaccaagaattgatcgccctaggtctgtgtaactcaatcggcagcttattccaaacctttagcatatcctgtagcctcagtagaagcttggtccaggagggtacaggtggtaaaacgcagctggccgggtgtctagcttcactgatgatcctgcttgttatcctcgcaacaggctttctcttcgaatcgctcccacaggccgtgctgtccgcaattgttatcgtcaatctgaagggcatgttcatgcagtttagtgatctacccttcttctggcggacatccaagattgagctaactatttggctcactacttttgttagctccctctttctgggacttgactacggccttattactgccgtgattatcgccctgctgaccgtgatctaccgcacacaatcttttcacacggagatgactaggaggtggagaccctag

SEQ ID NO: 135160 - DNA, 1422 bp, Artificial Sequence
  Description of Artificial Sequence: Synthetic coding sequence
atggatcatgccgaggaaaacgaaattttggcggcgacccaacggtattatgtggagcgtcccatcttttctcaccccgtactgcaggagaggctgcacaccaaagataaggttccggacagcatcgcggataagttgaaacaggcgtttacctgcacgcctaaaaaaatcagaaacataatttatatgtttctccccattaccaagtggctgccagcttacaagtttaaggaatatgtactgggcgatctggtcagcgggatctccacaggcgtcctccagctgccgcaggggctagctttcgctatgctggccgccgtgcctcccatctttgggctgtattcctcgttctatcctgtgatcatgtactgtttcttgggcacctctaggcacatatctattgggccgttcgccgtcatatctttaatgatcggcggggttgccgtgcggctggtgcccgatgacatagtcatccctggtggagtaaatgcaactaatggcaccgaggcccgggacgcactgcgtgtgaaagttgctatgagcgtcaccctgcttagcgggatcatccagttctgcctgggcgtctgtagattcggattcgtggcaatctacctgaccgagccattggtgcgggggttcactactgccgctgctgtgcacgtcttcacgtctatgctaaagtacctgtttggggtgaaaaccaaaagatacagcggcattttctccgtcgtgtatagcaccgtcgcagtcctgcagaacgtgaaaaatctgaatgtgtgtagtttaggggtggggctcatggtgttcggcctactcctagggggcaaagaatttaatgagcggttcaaagaaaagctgccggctcctatccccctcgagttcttcgcagtagtaatgggtactggtatctccgctggcttcaacctcaaggagtcttacaacgtagatgtggtcggtacactgcctctgggactgcttcccccggccaatcctgacacttccctgttccacctggtttacgttgacgctatagccattgcaatcgtcggcttctctgttactatttcaatggcgaagacactggcaaataagcatggatatcaggtcgacggcaatcaggagctcatcgccttaggactgtgcaattctataggctccctgtttcagaccttttctatttcatgctctctgtccagatcgctggtgcaggaaggcaccgggggcaaaacccagctggcaggctgcttagcttccctgatgatcctgcttgtcatcttggccaccggctttctattcgagtctcttccacagacaatctggctgacaaccttcgtctcctctctcttcctgggtcttgactatggtttgatcacagcagtgattatagccctccttactgtgatctacaggacacagcggtag

SEQ ID NO: 135161 - DNA, 2139 bp, Artificial Sequence
  Description of Artificial Sequence: Synthetic coding sequence
atggaccatgctgaggaaaacgaaatattggctgcaacccagcgctactacgtggaaagaccaatcttcagccacccagtattgcaggaaagactacatacaaaagacaaagtacctgattctattgcagacaagctcaagcaggctttcacgtgtactcccaaaaagatccggaatattatatacatgtttttgccaatcaccaagtggctgccggcatacaaattcaaagaatacgtgctgggagatctggtcagcggcatctctactggcgttctgcagcttccacaaggccttgctttcgccatgttagctgccgtgccacctattttcggtctgtatagcagcttctaccctgtgatcatgtattgtttcttgggaacaagtcgccacatctcaatcggcccatttgcagtgatcagtctgatgatcggcggggtcgctgttagactggtgcccgatgatattgtgattccgggcggagtgaacgctaccaatgggacagaggctcgggatgctctgcgcgtgaaggtagctatgagcgtgaccctcctgtccggaatcattcagttctgtttgggcgtctgcaggttcgggtttgtggcgatttacctgacagaaccactggtgcgaggattcactacagcggctgcggtgcacgttttcacaagcatgctgaagtatctgttcggcgtgaaaactaagaggtatagtggcatcttcagtgtggtgtacagtaccgtggccgtgcttcagaatgttaagaatttaaacgtttgttccttaggcgttgggctgatggtttttggactgttgttgggaggaaaggagttcaacgaacggtttaaggaaaagctgccagcccccatccccctggagttctttgcagtggtgatgggcacaggaatcagtgctggatttaatctgaaggagtcctacaatgtcgatgtggtgggaactctcccattgggcctcttgccacctgcgaaccctgacacatcgctgttccacctagtgtatgttgatgctatcgccattgccatcgtgggattttctgtgactattagcatggccaaaacactcgctaataagcacggctatcaggttgacggaaatcaagagttgatcgcgctaggactctgcaatagcattggcagtctctttcagacctttagtatctcgtgttctctgagcagaagcctggtgcaggaggggaccggcggtaaaacacagctcgccgggtgcctcgcatctctcatgattttactagtgattctggctaccgggtttctttttgaatcactcccccaaaccatttggttgaccaccttcgtgtccagtttgttcctgggcctggactacgggctcattactgccgtaatcatcgccctgctgacagtcatttaccggacacagagcccatcctataaggtgctgggtaagctccccgaaacagacgtctatatcgatatagatgcttacgaagaggtgaaagaaattcccggtataaaaatttttcaaattaacgcacccatttactatgccaacagtgatttgtacagtaatgccttgaagcggaagacaggcgtgaacccggccgtgatcatgggcgccaggaggaaggccatgagaaaatatgcaaaggaagtcggcaatgccaacatggccaacgctacggtggtgaaagcggacgcagaagttgacggagaggacgcaactaagcctgaggaagaggatggggaggtcaaataccctccaatcgtgatcaagagtacattccccgaggaaatgcaacggttcatgccacctggcgataatgttcacacagtgattcttgattttacccaggtaaacttcattgattctgttggagttaagacacttgctggaattgtgaaggagtacggagacgtgggcatctacgtgtatttggccggctgctcagcccaggtggttaatgacttaacgcggaatcggtttttcgaaaaccccgcactatgggaactcctttttcacagcatccatgacgcagtactgggatcccagttgagagaggccttggctgagcaggaagcctctgctccacccagccaggaagacttggaaccaaacgcgaccccagcaacgcccgaggcctag

SEQ ID NO: 135162 - DNA, 1344 bp, Artificial Sequence
  Description of Artificial Sequence: Synthetic coding sequence
atggatcacgccgaagaaaacgaaatcctcgctgcaactcagcggtattatgtcgagaggcctatcttctcacatccagtcctccaggagcgactgcacacaaaagataaggtgccggactctatcgccgataagctgaaacaggcttttacctgcacacccaaaaagatcagaaacattatttacatgtttctgcccattacaaaatggctgccggcttataagtttaaggagtacgtgcttggagatctggtgtcagggataagtactggggtcctgcagctcccgcaaggactcgccttcgctatgctggcggccgtgcctccaatctttgggctttacagtagcttctatcctgtcattatgtattgctttctcggtacaagccgtcacattagcattggacctttcgcagtcatctccctaatgattggcggcgtggctgtgagactggtccctgacgatattgtgattcctggcggggtcaatgctacaaacggcactgaagcccgtgatgccctgagagtgaaggtggctatgtcagtaacacttctgtccggcatcattcaattttgtcttggtgtttgcagattcggtttcgtcgccatttacttgacagaacctttggtgcggggctttacaactgccgccgcagtgcacgttttcacctctatgcttaaatacttgtttggtgtgaaaactaagaggtatagcggcatattctctgtggtttactctaccgtggccgtcctgcaaaacgttaagaacctcaatgtttgctcactaggggtcggactcatggtgtttggactactcctcggcggcaaggaattcaacgaacgattcaaggagaaactgccagccccaatacccttagaattctttgcagtggtgatgggcaccgggatcagcgctgggtttaacctaaaagagtcatataatgtggatgtcgtggggaccctgccactcggcctgttaccacccgctaaccccgatactagcttatttcatctggtctacgttgacgccatcgccatcgccattgtgggattttctgtaaccatttccatggccaagactttggcgaataaacatgggtaccaggtggacggcaatcaggaactgattgctctgggtctgtgcaactcaattgggagtctttttcagaccttcagcatctcctgcagcctgagtcgctctcttgtccaggaaggaaccgggggcaaaacgcagaccatctggctcaccacctttgtttcgtctctatttctaggactggactacggcttgatcactgcagtgataatagcactgctcacagtgatataccggactcaacgctag

SEQ ID NO: 135163 - DNA, 1956 bp, Artificial Sequence
  Description of Artificial Sequence: Synthetic coding sequence
atggggttagctgatgcctcaggtccgagggacactcaggcactattgtctgctactcaggccatggatctgagacggagagactaccacatggaaaggcctctccttaatcaagaacacctggaagaattgggaaggtggggaagcgccccaaggacccatcagtggaggacatggcttcagtgtagcagggcccgggcctatgcgctgcttctgcagcacctgccagtgctcgtttggctccctagatatccagtccgcgattggctcctgggagatctgctctctggtttgtcggttgctattatgcagctgcctcagggccttgcctacgccctattggccgggctgccccccgtctttggcctctattcctccttttaccccgtcttcatttattttttgttcgggacgtctcgccacattagtgtcgtgttggaagtgtgttggaaactcccacagagcaaagtgggaaccgtggtcaccgccgcagtggcaggcgtcgtactcgttgtcgttaagttgttgaacgataagttgcagcagcagctgcctatgccgattccaggcgaactcctgacactgatcggcgctacaggcatatcttatggcatgggtctgaaacatagattcgaagtggatgttgtcggaaatataccggctggcctggtgccaccagttgcaccgaacacccagctcttctctaagttggttggtagtgctttcaccatcgccgtggtgggcttcgccatcgcgatcagcttgggaaaaatttttgctctacgccacggatacagagtagattccaatcaagagctcgtcgcactgggcctgtcaaatttgatcggtgggatcttccagtgcttcccggtaagctgttccatgagtaggtcccttgtccaggaatccactggaggcaattcccaagtagccggcgccattagctcactgtttattttactgatcattgtgaagttgggcgaactgttccacgacctgccgaaggccgttttggccgctataatcatcgtgaacctgaaagggatgttacgacagctctctgatatgcgctctctttggaaagccaatcgtgcggatctgcttatatggctggtgacctttacagctacaattctgctgaatctggacctagggctggtcgtcgccgtcattttttctcttctgctggtagtcgtgcgtacacagatgccacattattctgtgcttggccaggttcctgacactgacatttacagagacgtagccgagtactcagaagccaaagaggtccggggagtgaaagtcttcagaagtagcgcaacggtgtattttgcaaatgccgaattttattctgacgctctgaagcagcggtgcggtgtggacgtcgattttctgataagtcagaaaaagaaactgttgaaaaagcaggagcagctgaaactaaagcagctccagaaggaggagaagctgcgtaaacaggccgcttcccccaaaggcgccagtgtttcaatcaacgtgaacacctctttggaagacatgaggtctaacaatgtggaggattgcaagatgatggtgagttcaggagataaaatggaagatgcgaccgccaacgggcaggaagattctaaggcaccagatgggtcgaccctgaaggctttgggcctgcctcaaccagactttcatagcttgattcttgacttgggagccctgtcattcgtcgacacggtgtgtctgaagtcccttaagaacattttccacgacttccgtgagatcgaagtggaggtgtacatggccgcatgccactcccccgtcgtaagccagctcgaggccggtcacttcttcgatgcctctataactaagaaacacttgttcgcgagcgtgcacgacgctgttacctttgccctccaacacccgagaccagtgccagattcgccggtgtctgtcacgagactttag

SEQ ID NO: 135164 - DNA, 2217 bp, Artificial Sequence
  Description of Artificial Sequence: Synthetic coding sequence
atggatctgcgtcgacgcgattaccacatggaacgcccattgcttaaccaagagcatctggaagagctcggccgttggggctctgcccctcgcacgcatcagtggcgaacctggctgcagtgctcaagggccagagcctacgctctgctactgcaacatctcccagtgctcgtttggctccccagatacccagttagggattggctgttgggtgatctactgagcggcctgtccgtggcaattatgcaactgcctcagggactggcctacgcattgctagctgggctcccgcccgtttttgggttgtatagctcattttaccctgtattcatttattttctctttggaacatctcgccatataagcgtcggcaccttcgcagtgatgtccgtgatggtcggttcggtcaccgaaagtctggccccacaggcgcttaacgactctatgatcaacgagaccgccagagatgccgctcgtgtccaggtggcgtcaacattgagcgtgttagtcggtctttttcaggtcgggttgggcctgatccatttcggatttgtcgtaacatacctgtctgagccattggtgaggggctacactacagcggccgccgtccaggtgttcgtctcgcagttaaagtacgtgtttggattgcacctgtctagccatagtggtccactttccttgatttacaccgtcctggaggtgtgttggaaacttcctcagtccaaggtggggaccgtggttaccgctgcagtcgccggagtggtgctggtggtcgtaaagctgctcaatgacaaactgcagcagcaattaccgatgcctattccgggcgagcttctgaccctaattggagcaactggaatctcttacggtatgggactgaagcataggtttgaagtcgacgtggttggcaatatccccgcaggcctggtcccgccagtagcaccgaatacccagctcttcagcaagttagtgggctccgcgtttacgatcgccgtggtgggatttgcaatcgcaatctcccttggaaaaattttcgcactgcgccacggctaccgagtggatagcaaccaggaactcgtggcattagggttgagcaatttaattggcggaatttttcagtgtttcccagtgtcctgtagtatgtcccgatctttagttcaggaaagcaccgggggtaactcacaggttgcaggggcaatttcatcccttttcattctgcttatcattgtgaagttaggggagctcttccacgatctaccaaaggctgttcttgcagccatcatcatagttaacctgaaggggatgcttagacagctgtcggacatgcgctcactctggaaagccaatcgcgccgatctgctgatctggctagtgacattcacggccaccatactgttgaatctcgatcttggtctcgtggttgccgtgatattttctctgctgctggtcgtagtgcggacgcagatgccccactactcagttctggggcaggtgcccgataccgatatatatcgggacgttgctgaatatagcgaagccaaggaggtccgtggggtgaaagtgtttcgtagctctgccaccgtttatttcgcaaatgcagagttttacagtgatgcattaaaacagaggtgtggggttgatgttgactttcttatttcacagaagaaaaagctgttaaagaagcaggaacaactcaagctcaaacagctccaaaaagaagagaagctgagaaagcaagccgctagcccaaagggggccagcgtgagtatcaacgtcaacacctctctggaagatatgaggtcaaacaacgtcgaggattgtaaaatgatgcaggtctcctccggggataaaatggaggacgccaccgccaacggacaagaagattctaaggcaccagacggaagtactcttaaggctttgggcttgcctcagcccgatttccacagtctgatcctggacttaggcgccctgtcttttgtcgatactgtatgtctgaagtctctgaagaacatctttcacgattttcgcgaaattgaggtggaagtatatatggcagcatgtcactcaccagtggtctcgcagctggaagcagggcacttcttcgacgcctctattacaaagaagcatttgtttgcctcagttcacgatgctgtgacgttcgcactgcagcacccaaggcctgtgcccgactcccccgtcagcgtgacccggctgtag

SEQ ID NO: 135165 - DNA, 2223 bp, Artificial Sequence
  Description of Artificial Sequence: Synthetic coding sequence
atgggattggccgatgcgagcgggccaagagacactcaagccctcctcagcgcaactcaagcaatggacttacgcaggcgtgattatcacatggagcgccccctgctcaatcaagaacatctcgaagagctgggcagatggggaagcgcacctcgcactcaccagtggcgaacctggctgcagtgtagccgagcccgagcttatgctttgctgctacaacacctaccagtattagtttggctcccgaggtaccccgtgcgagattggcttctgggcgatcttctgtctgggctctcagtcgctattatgcagctacctcaggggctcgcatacgcgctcctggccgggctccctccagtcttcggattgtattcatccttttatcccgtgttcatttatttcctgtttggtacaagccggcatataagcgttggaacattcgcagtgatgagtgtgatggtcgggagcgtgacagagagcctcgccccccaggccctcaatgactccatgattaatgagacggcccgggacgccgctcgggtccaagtggcgagtacattaagcgtgctagtgggcctattccaggttgggttggggctgatccacttcggctttgtggttacttacttgagcgaaccactcgtgcgtggatacactactgccgcagcggtgcaggtgttcgtaagtcagctgaaatacgtctttgggcttcacctttcatcccactcaggccctctcagtttgatctatactgtactagaggtgtgctggaagttgccacagagcaaagtcggtaccgttgtgaccgctgccgtggccggagtcgtccttgtggtggttaagctactgaatgataagcttcagcaacagctcccaatgccaattccgggtgagcttttgaccctgattggtgccacggggatttcttacgggatgggactgaagcacagattcgaagtggacgtcgttgggaatatccctgctggattggtcccccctgtcgccccaaatacccagctgttctctaagctagtcggctctgctttcacgattgccgttgttggatttgccatcgcaatatctctggggaagatatttgctctgcggcacggataccgagtcgactcgaaccaagagctggtggcccttggactgtcaaacctcattggaggtatatttcagtgtttcccagtgagctgttcaatgtcaaggagtctagtacaggagtctaccggggggaattcacaggtggcaggcgccatcagttcactctttatcttgctgatcatagtgaaactgggggagctcttccacgatttgcccaaggccgtgcttgctgctatcatcatagtgaatttgaaaggtatgctccgccaactatctgatatgaggagcctatggaaagcaaaccgggccgacctcctaatatggctggtcaccttcacagccactatcctccttaacctcgatttgggacttgtggtagccgtaattttctcgctgttgctagttgttgtgcgaacacaaatgccgcactacagcgtgctagggcaggtgccggacaccgatatatatagagacgtcgcggaatattcggaggcaaaggaggtacggggtgtcaaagtgtttagatccagcgctacggtgtatttcgcaaatgctgaattttattccgatgcactgaagcagaggtgcggcgtggacgtggattttttaatctcccagaaaaaaaaactgctgaagaagcaagaacagctgaagctgaaacagctccagaaggaggaaaaactacgaaagcaagctggaccattgctgagtgcctgcctcgcaccccaacaggtatcctcaggcgataaaatggaagatgctacggcgaacgggcaagaggattccaaggcccctgacgggagtacactaaaagctctgggactaccccagccagacttccacagcctcattctggatctgggagcactctccttcgtggacactgtctgccttaaatcactgaagaatatcttccacgactttagggagattgaggtggaggtgtacatggctgcatgtcacagtccagtcgtctcccagctggaagctggtcactttttcgatgccagcattaccaagaagcacctgtttgcctccgtgcacgatgccgtgacattcgccctgcagcaccctcgtcctgtgcctgatagtcccgtttcggtgactaggctatag

SEQ ID NO: 135166 - DNA, 2280 bp, Artificial Sequence
  Description of Artificial Sequence: Synthetic coding sequence
atgggcctggctgatgcttcaggcccacgagatacgcaagctctcctcagtgcaacccaggctatggacctgcgacgaagagactatcatatggagagaccactgctgaatcaagagcatctggaggagcttggccggtggggttcggcccctcgaacacatcagtggcggacttggctgcagtgtagccgggcccgcgcttacgctctcctgttgcagcacctccctgtgcttgtttggctgcctcggtatcccgtcagggactggctgcttggagacctactgagtggcctgtccgtggctataatgcagttgcctcagggcctggcgtacgcactgctggccgggcttcctccagtctttggtttgtattcatcattctacccggtttttatctacttcctgtttggaacttccaggcatattagcgttggtactttcgccgtgatgtctgtgatggtggggtcggtcacggaaagccttgcaccccaggccctgaacgactctatgatcaatgaaacagcgcgcgacgccgctagggtacaggtggccagtactttgtcagtcttagtgggcctgtttcaggtcggactgggcctgattcatttcggattcgtcgttacctacctttcggagccccttgtgcgcggctacaccacggccgccgccgtgcaagtcttcgttagccaactgaaatacgtatttggactgcacctgtcgagccattcaggccccctcagtttgatttatacagtcttggaggtctgttggaagctgccgcagtctaaagtcgggaccgtggtaaccgccgctgtagctggcgtcgtgctggttgttgtcaaactgctgaacgataagttgcaacaacagttgcccatgcccatcccgggggaactattaactctcattggagcgacgggcatatcctatgggatgggtttgaaacacagattcgaggtggacgtcgttggtaacatccccgccggcctagtaccaccagtcgctcccaacacacagcttttctcgaagctcgttggcagcgcgtttaccattgcagtggtcggcttcgctatcgccatttccttaggcaaaatcttcgcactccgacacggatacagggtggattcaaaccaggaactcgttgcgctcggcctttctaacctgatcggcggaatcttccagtgtttcccagtgtcctgcagcatgagtaggagtctcgttcaggaatctacaggaggcaactcccaggtggccggcgctataagctctttgttcatactcttgataatcgtgaagctgggcgagttatttcatgacctgcctaaggctgtactggcagctatcatcatcgtgaatcttaaaggtatgttgcggcagctgtctgatatgcggtcgttatggaaggcaaaccgagcggatttgctgatctggctggtgacattcaccgcaaccattctcctcaatcttgatctggggctggtggtggctgtgatattttcactactccttgtggtcgttcgcacccaaatgccacattattcagttctcggtcaggtcccagacacggatatttaccgtgacgtggcagagtatagcgaggcaaaagaagtccgcggcgttaaggtttttcgctcaagcgccacagtttacttcgctaatgcggaattctattccgacgccctgaagcaacgctgcggagtggacgtggatttcttaattagccagaaaaagaagttgctgaagaaacaggaacaactgaaactgaagcagctgcagaaggaggaaaagcttagaaagcaggctgcctcaccaaagggagcttcagtgtcgatcaatgtgaacacgagtcttgaagatatgaggagcaacaacgttgaggattgcaaaatgatgcaagtgtcttccggggataaaatggaggatgctacggcgaatgggcaggaggattctaaggctcccgatggttcaacattgaaggctttgggacttccccagcctgactttcactctttaatcctggatctgggtgcactcagcttcgtagataccgtttgtctcaaatctttgaaaaatatctttcacgatttcagagaaatcgaagtcgaagtgtacatggctgcttgtcactccccagtggtgtctcagttggaggccggccacttcttcgatgcatctatcactaagaagcatttgtttgctagcgtgcatgacgccgttacctttgcattgcaacacccccgtcccgtgcccgactcccccgtgagtgtgactcgcctgtag

SEQ ID NO: 135167 - DNA, 2277 bp, Artificial Sequence
  Description of Artificial Sequence: Synthetic coding sequence
atgggcctcgccgacgcctccggaccaagggacacgcaggccctgctgagtgctacacaagctatggatctaaggcggagggattaccatatggagcggcccctgctgaatcaagagcacctggaagaactgggcagatggggctccgctcctagaacacatcagtggagaacctggttgcagtgcagcagggctcgcgcatacgctctactgttgcagcacctgcctgtcctggtttggttgccacgttatcccgtgagagactggcttctgggtgatcttcttagtgggctgagcgtggccataatgcagctgccacaaggtctggcctacgcccttctagccgggctcccacctgtgttcggactgtacagcagtttctatccggtgttcatctactttctgttcgggacgtcccgccatatatctgtgggcactttcgctgtcatgagcgtcatggtgggcagtgtgacggagtctctggccccccaggcacttaacgacagcatgatcaacgaaaccgcaagggacgccgccagagtccaggtcgcttccactctttccgtgctggtgggcctgttccaggtggggctcggcttgattcactttggctttgtggtgacgtatcttagtgagcctctggtgagagggtacacgaccgccgcggccgtgcaagtctttgtgtctcagctgaagtatgtcttcggcctgcacctctccagccatagcggccctctgagcctgatttatacagtgctcgaagtatgttggaaactcccacagagtaaggttggaacggttgtgacagcagctgtcgctggggtggttctggtcgtcgtgaaactgctgaacgacaagcttcagcagcagcttcccatgccaatacccggggaacttctgacactgataggggctactggtatttcgtatggcatgggactgaaacatagattcgaagttgatgtggtcgggaacattcccgcagggcttgtaccaccggttgctccaaacacccagctctttagcaaattggttggctcagcctttacgatcgctgtggtgggctttgctatagctattagcttaggtaaaatttttgcgctccgtcatggttatagagtcgactcaaaccaggaactggtcgcactgggactatctaatctcatcggcggtatctttcagtgcttccccgtgtcctgcagcatgtcacgaagtctggtgcaagaatctaccggaggaaatagtcaggtggccggtgcaatcagttcattatttattctgctaatcatcgtcaaacttggtgagctgtttcacgacttgccgaaggctgttctggccgctataatcatcgtgaacctgaaaggcatgttgagacaactgtctgacatgaggtctctgtggaaggcaaacagggccgatctactcatctggctggtgaccttcaccgctaccatacttctcaatctggacttgggcctggtggtcgccgtgatcttctctttactgctggtggtggtccgaacacagatgcctcattacagcgtgttaggtcaggtcccagacacagatatctaccgggacgtcgccgagtatagcgaagctaaggaagtccgaggcgtgaaagtttttcgctcctccgccaccgtttatttcgctaacgccgagttctactccgacgccctcaagcagcggtgcggggtggacgttgattttctgattagccagaagaaaaagttgcttaagaagcaggagcaacttaagctgaaacagctgcagaaggaagagaaactgaggaagcaggccgcttctccgaaaggagcgtcagtgtccatcaatgtgaatacaagcctggaggacatgcggagcaacaacgtcgaagactgtaagatgatggtgagctccggagataagatggaggacgcaaccgccaatggccaagaggactcaaaagctcccgatggtagcacattgaaagccctggggctcccacagcctgattttcacagtctgattttggatcttggggccctttcttttgtcgacaccgtctgcttgaagagtctgaagaacatctttcacgactttcgggagatcgaggtcgaggtttatatggccgcctgccactctccagtcgtttctcagcttgaggctggccacttcttcgacgccagtataacgaaaaagcatttgttcgcaagtgttcatgacgcagtgacatttgccctccagcaccccagaccagtgcccgattccccagtttctgtgacacgactgtag

SEQ ID NO: 135168 - DNA, 2262 bp, Artificial Sequence
  Description of Artificial Sequence: Synthetic coding sequence
atgggcctggcagatgccagtggtccccgcgatactcaggcactcctctccgcaacccaggcaatggacctgcggcgtcgggactaccacatggagaggccactgttgaaccaggaacatctggaggagctgggaagatggggatcggcaccacgaacacatcagtggcggacctggctccagtgcagcagggccagagcgtacgcccttcttctgcaacatctgccggttctcgtttggcttccccgttaccctgtgagagactggctgttaggggatttgctttcaggactgtctgtggctatcatgcagctccctcaggacctgctgagccgcctccactgttaccattccacacttggactcgcttatgcccttctggccggcctcccacccgtgttcgggctctattcttccttttaccctgtgttcatctattttctattcggaaccagccgtcacatctcagtgggcactttcgcagtgatgtctgttatggtggggtccgtcactgagagcctggctccacaggcgcttaatgactccatgatcaacgaaactgccagggatgcagcgagagtgcaggtcgcctcaaccctgtccgtccttgttggcctgttccaggtgggactgggcctcatccatttcggcttcgttgtgacatatctgtcggagcccctggtgcggggatatacgaccgctgcagccgtacaggtgtttgtcagccaacttaaatacgtgtttggcttgcacctgtcatcccattctggccctctgtcactcatctataccgttttggaggtctgctggaagctgcctcagtccaaggtggggaccgtcgtcaccgcggcggtggcaggagttgttctggtggtcgttaagctgttgaatgacaagctccagcagcaactcccaatgccaattcccggggagcttctgaccctgattggcgccacgggcatctcctacggtatggggctgaagcaccgcttcgaagttgatgttgttgggaatatccctgccggcttggtcccccccgtggcccctaacacacagctcttcagcaagctcgtgggctctgcttttactattgcagtggtgggcttcgccatcgccatctccctgggcaagattttcgctcttcggcacggttacagggtggactccaatcaggagctggtggctctcggactgtccaacctgataggtgggatattccaatgctttcctgtctcttgttctatgtcccggtccttggtgcaagagagcacaggtggaaattcacaggtggccggcgctatctcctctctctttattttgctgatcattgtgaagctgggagagctattccacgatcttcctaaggccgtgctagccgccatcatcatagttaatctgaagggcatgctcaggcagctttctgacatgcgatcgctatggaaagcaaaccgagccgatctcctgatctggctggtaacatttacagccaccattctgttaaacctggatttgggcctggttgtggccgtcattttttctctgcttctcgtggtcgtccgcactcaaatgcctcactatagcgtgctgggccaggtccctgatacagatatttaccgggacgttgctgaatattccgaagccaaagaggtgcggggtgtgaaagtttttagaagcagcgcaaccgtctactttgctaatgccgagttttacagcgatgctttaaaacaaagatgcggagtggacgtagattttctgatcagtcagaagaagaagctgctaaaaaaacaggaacagcttaagctcaagcaacttcagaaggaggagaagctcagaaaacaggccggcccattgctgtcggcgtgtctggctccccagcaggtgtcttccggtgataaaatggaggacgcgacagcaaatggccaggaggactcaaaggctcctgatggatccactcttaaggccctcggactgccccaacctgatttccactctctcattctggatctgggcgcccttagcttcgtggacaccgtgtgtttaaagtccctgaaaaatatatttcacgacttccgggaaattgaggtcgaggtctatatggcagcctgtcactctccggtcgtttcccagttggaagccggccacttcttcgatgcttctattaccaaaaaacatctgtttgcttcagttcacgacgctgttacatttgccctacaacatcctcggccagtcccggatagcccagtcagcgtcactagactttag

SEQ ID NO: 135169 - DNA, 2172 bp, Artificial Sequence
  Description of Artificial Sequence: Synthetic coding sequence
atggggcttgctgacgccagcgggccgagagatacccaggctttactgtcagccacacaggcaatggaccttagacggcgggattaccatatggaaagaccactgctgaaccaggaacatctggaggaattaggtcgatggggatccgccccgcggacccatcaatggagaacctggcttcaatgttcccgtgccagagcctacgcacttcttttacagcatcttccggtgctcgtgtggctccctcgctacccagtgagggactggcttctgggggatctgctaagtggtctgtccgttgccattatgcagttgcctcagggtttagcgtacgccctcctggccggcttgccgcccgtgttcggactgtacagctcattttaccccgtgttcatatacttcctgttcggcacttcacgtcacattagcgtcgccacgccaggtccactgcctctgctcaccgcaccaggccggccaacgggaggggcgggccccgatcctctgcggctcaggggccacttgccagtgcggaccagttgtccaagactttatcactcttgcagctgcgctgggctaagactgacggcacaggtttgtgtgtggcccccaagcgagcagccactgtgggccacggtgcctcacctgctccttgaggtctgttggaagcttccccagtccaaggtcgggactgttgtgaccgccgctgtggcgggcgtggtgctcgtggtggtcaaactactaaatgataaattgcagcagcaattacctatgccaatccccggcgagctccttactttaattggcgctaccggcatcagctacggaatgggcctcaagcaccggtttgaagtggacgtagtgggcaatatccctgcaggtcttgtgccgccagtcgcccctaatacacagttgttttctaaacttgttggaagtgctttcacgatcgcagtcgtgggtttcgctattgcaatatccctcggcaagatcttcgccctccgacacggctaccgagtcgactctaaccaagagctcgtggccctggggctcagcaacctgattggaggaatctttcagtgtttccctgtcagctgtagtatgtctcgctcattagtccaggagtccactggcggcaattcgcaagtggctggagccattagctccttgtttatcctgttgataatagtaaagctgggcgaattgttccatgacctccccaaggccgtgctcgccgcgatcattatagtgaacctgaaaggcatgctacgacaactgtctgacatgcgctctctgtggaaagctaaccgggcagacctcctcatatggctggtgacctttaccgcgaccatcctacttaatttggacctggggctagtggttgcggttattttttccctcctgctggtggtggtccgaacccagatgccccactattccgttctcggccaagttcctgatacagatatctacagggatgtagccgaatactctgaagctaaagaagtgagaggggtaaaggtgttccgtagctcagccactgtttactttgcaaatgccgagttctattcagatgccttgaagcagcgatgcggagtggacgtagactttctaatcagccaaaagaaaaagctattaaaaaaacaggagcagttgaaactgaagcagctccagaaggaagagaagcttcgtaagcaggccgcaagccccaaaggagccagcgtgtccataaacgtgaacacgtcccttgaggatatgaggtctaacaatgtcgaggattgcaagatgatgcaggtcagctcaggggacaagatggaggacgcgaccgccaatgggcaggaggactctaaagcaccagatggctctactctgaaggccctggggctgccccagccagattttcacagcctgatccttgatctcggtgccctgtccttcgtggacaccgtttgcctgaaaagcttgaagaacatttttcatgacttcagggagattgaggtggaggtgtatatggccgcctgtcacagccccgtggtgtcacaattagaggccgggcatttttttgacgcgagtatcacaaaaaagcatctctttgcaagcgttcacgacgctgtcacatttgccctgcagcatcccagacctgtgcctgattcaccagtgtctgtaactaggttatag

SEQ ID NO: 135170 - DNA, 1941 bp, Artificial Sequence
  Description of Artificial Sequence: Synthetic coding sequence
atgcgtgccccaggcgctggcgctgcaagtgtagtatccctagctctgctgtggctgctgggtctgccgtggacttggtcggccgctgccgccctgggcgtatatgtcggaagtggaggctggagatttctgcggatcgtgtgcaagactgccagaagagatctgtttggccttagtgtgttgattagagtgcgccttgagttgagacggcatcagcgcgcggggcataccatccctaggatcttccaagccgtagtgcagcgccagcctgaacgactggccctggtcgacgctggcacgggcgagtgctggacttttgcccagcttgatgcttattctaatgccgtggcgaacctcttcaggcagctaggattcgcccctggagacgtcgtggccatcttcctagagggccggcccgaattcgtgggactctggcttggtttggccaaggccgggatggaagcagcacttctgaacgtaaatttgcggcgggaacctctggctttctgcctgggtacaagtggtgccaaagcgcttatttttggaggcgagatggtcgcagccgtggcggaggtgtctggccacctggggaagtctctgattaaattttgcagcggtgatttaggtccagagggcattctgcccgacacccaccttttagatccgctcctcaaggaagccagcactgccccactggctcaaataccttccaaaggtatggatgacaggctcttttacatctatactagcggtacaacaggcctgcctaaggccgccatagtagttcatagccgatattatagaatggctgccttcgggcaccacgcttacaggatgcaggcggctgatgtgctctacgattgcctgcctctataccactcagcgggaaacataattggcgtcggccagtgcctcatttatgggctgactgtcgttttacgcaaaaagtttagcgccagcaggttctgggatgattgcatcaaatacaattgcactgtggttcaatatattggagagatttgccgatacctactgaagcagcctgttagggaggctgagaggcgccaccgtgtcagactggcagtcggcaatggcttacggcccgcgatctgggaagagtttactgagaggtttggagtcaggcaaatcggagaattttatggcgctacggagtgcaactgctcgatcgcgaatatggacgggaaagtgggcagctgcggattcaatagccggattctcccacatgtctaccccataagacttgttaaggtgaacgaggataccatggagctgctgcgggatgcacaggggttgtgcatcccctgccaggccggggaacctggacttcttgtgggacagattaaccagcaggacccgcttcgccggttcgatggctacgtgtccgagtccgccacatcgaaaaagatcgcacacagtgtgttcagtaagggagactccgcctatctgagcggagacgtgctggtcatggacgaactgggctatatgtacttccgtgacaggtccggcgatacgtttaggtggaggggcgagaacgtaagcaccaccgaagttgagggagtgctgtcccggctgctggggcagaccgatgttgctgtttatggtgtagcagtgccgggcgttgagggcaaagccggtatggctgctgttgccgacccccactctcttctggacccaaatgctatctaccaggaacttcagaaggtactggcgccatacgcaaggcccatcttcctgagactcttgccccaggtggacacaacaggaacattcaaaattcagaaaacacgtctccaacgagaggggtttgaccctcgacagacaagtgacagactgttctttcttgacctcaaacagggacattatctccctctcaatgaggccgtctacacccgcatatgtagcggggcattcgctctttag

SEQ ID NO: 135171 - DNA, 723 bp, Artificial Sequence
  Description of Artificial Sequence: Synthetic coding sequence
cccgagttcgtgggattgtggctgggcttggcgaaagccggcatggaagcagctctactgaacgtgaacctacggagagaacctcttgcattttgtctgggaacatcaggggcaaaagccctgatcttcggaggtgagatggttgccgccgtggccgaggtaagcggccatctgggaaaatccctgattaagttttgctcaggggacctgggccccgaaggaattctgcctgacacccatttgctggatcctctgttgaaggaagcaagtacagctccactggcacaaatccctagtaaagggatggacgacaggctgttctatatttacactagtggcactaccgggttgcccaaggcagctatcgtcgttcactcccgatattacagaatggcagctttcggccatcacgcatacaggatgcaagctgcggacgttctgtacgactgtctgcctctgtatcacagcgctggaaatatcatcggagtgggacagtgcctgatatacggattgaccgtggttcttaggaaaaagttcagcgcttccaggttctgggacgattgtattaagtataactgcacctggcacggtcctagctggacagagaagctagagccgcagcgaaacccttgcctgtcagcagctcttgtgcctctttgcttgccacccctgccggccttccagccactgtcaccaagtatccctgttccggtttggccatag

SEQ ID NO: 135172 - DNA, 1941 bp, Artificial Sequence
  Description of Artificial Sequence: Synthetic coding sequence
atgagggcacccggggctggtgccgcgagcgtggtgtctctcgctttgctttggctgctgggtctgccttggacctggagcgcggccgctgcgctaggagtgtacgtagggtcagggggctggagattcctgcgcatcgtttgtaagactgctagacgagacctcttcggcttaagtgtgctaattcgagtcaggttagaactcagacggcaccagagagccgggcataccattcctaggatctttcaggccgtcgtccaacgacagcccgagaggctagccctggttgatgcgggaacaggagagtgttggaccttcgcccaactggatgcttacagcaatgccgttgccaaccttttcaggcaacttgggttcgcccccggagacgtggtggcgatctttctcgaaggaaggcctgagttcgtcgggctctggctgggactggcaaaggcgggaatggaggcagccctcttgaatgtgaacctcaggagagaacccctggctttctgtttgggcacttcgggggccaaagcattaatcttcggcggagaaatggtggctgcagttgctgaagtgtcaggtcacctcgggaaatctctaattaaattttgctctggcgacctagggcccgaaggtatcctgcccgatacccacctcctggaccccctgctcaaagaggccagcaccgcccccctagcccaaatacctagcaaaggtatggatgacagactgttttacatctatacaagtggaactacagggctgcccaaggctgccattgttgttcacagccgctactaccgcatggcggcttttggacatcacgcataccgtatgcaggccgccgatgtgctatacgactgtttgcccctatatcatagcgcgggcaacattattggagtggggcagtgcttgatttatgggctcactgttgttctccggaagaaatttagcgccagcaggttttgggacgactgtataaagtataactgcacagtagtgcagtatattggggaaatatgtaggtacctcctgaaacagcccgtaagggaggcagagcgcagacaccgcgtgagactagctgtgggaaacgggctcagacccgcaatttgggaagagtttaccgaacgctttggggtgagacagatcggtgaattttacggagcgaccgagtgcaactgcagcatcgctaatatggatgggaaggtcggcagttgcggattcaattctcggattctaccccatgtctaccctatccgcctggttaaagttaatgaggataccatggaacttctccgcgatgctcagggcctctgcatcccatgccaagccggcgaaccaggcctcctagtggggcagatcaaccagcaggaccctctacgcaggttcgatgggtatgtaagcgagtctgcaacgtctaaaaagatagcccactctgtcttttcaaagggtgacagcgcctatctgagcggggacgtcctcgtcatggatgagcttggctatatgtacttcagagacaggtcgggggatactttccgttggaggggtgagaatgtctccacaactgaggtggagggggtgctgagccgactgctgggccagaccgatgtcgcagtatacggcgtggcagttccgggggtggaaggtaaagcgggaatggccgccgtggccgacccccactctctcctggacccaaacgcaatctatcaggaacttcagaaggtgctggcgccatacgcccgtccaatctttcttcgcctgctcccgcaggtagacactacagggacattcaaaattcagaaaacgcgcctgcagcgcgaaggattcgaccctaggcagacttctgacagattatttttcctggacctgaagcaaggacactacctccccttgaatgaggcggtgtacacacgcatttgtagcggggcctttgctctgtag

SEQ ID NO: 135173 - DNA, 1863 bp, Artificial Sequence
  Description of Artificial Sequence: Synthetic coding sequence
atgttaagtgccatttataccgttttggccggtttgctgtttctgccgctgctggtaaatctatgttgtccctatttcttccaagacataggctatttcctcaaagtggccgcagtgggacggcgtgtccgaagttacggcaagcgtcgacctgccagaaccattctgcgggcctttcttgaaaaagcccggcagacccctcacaaacctttcctcctgttcagggatgagacactcacctatgcccaggtcgatcggcgtagcaaccaggtggctagggctctacacgaccatctgggcctgagacaaggcgattgcgtggctttgcttatgggaaatgagcctgcgtacgtgtggctgtggctggggctggttaaactgggatgcgccatggcctgtcttaactacaacatccgcgccaagtcactgctgcactgttttcagtgctgcggagccaaagtcctgttggtgtctcctgagttgcaggccgccgttgaggagatactcccctcactcaaaaaggacgatgtgtccatttactacgtaagtcggacatccaacactgacggaatagactccttcttggacaaggtggatgaagtgtccaccgagcccatccctgaatcttggcggtccgaggtgaccttctctacacccgccctgtacatctataccagcgggacaactggactgcctaaggctgccatgatcacacaccagagaatctggtatggaactgggctgactttcgtcagtggcctaaaagccgacgacgttatttatattacactgcccttttaccattccgccgccctgctcatcggcatccatgggtgtattgtcgctggcgctactctggcgctaagaactaaattctccgccagtcagttttgggacgactgtcggaagtataacgtaacagtcatacaatacattggggaattgctgcgatatctgtgcaactctccccagaagcccaacgatcgagatcacaaggtcaggcttgcactggggaacgggctgcgaggcgacgtgtggcgccagttcgtgaaacgctttggcgatatctgcatttatgaattttatgcagccaccgagggtaatatcggattcatgaattatgccagaaaagtgggggctgtgggcagagttaactacttacaaaagaagatcatcacgtatgatctgattaaatatgacgtggagaaagacgagcctgtcagagatgaaaacggctattgcgtgcgtgttccaaaaggggaagtggggttattggtgtgtaagatcacacagctcacacctttcaatggatatgcaggagccaaggcccagaccgagaaaaagaagctacgcgacgttttcaagaagggtgacctctactttaattctggagatctcctgatggtcgaccatgagaactttatttacttccacgatcgtgtgggcgacacatttaggtggaagggtgagaatgtagccactacagaggtggccgatacagtgggcctggtggactttgttcaagaagttaatgtttatggcgtccacgtgcctgaccacgaaggtaggatcggcatggctagtatcaagatgaaggagaatcatgagttcgatggaaagaaattattccagcacatcgcagactaccttccaagttacgcaagaccgcgctttctgaggattcaggacacaatagagataacggggacatttaaacaccgcaagatgacactcgtggaagagggcttcaatcccgccgtcatcaaagacgccctctacttcctcgacgacacggctaagatgtacgtgcctatgacagaagatatatataacgcgattagcgctaagaccctcaaactatag

SEQ ID NO: 135174 - DNA, 1704 bp, Artificial Sequence
  Description of Artificial Sequence: Synthetic coding sequence
atgctttcagccatctacactgttctggccggccttctcttccttcctcttctcgttaacttgtgctgcccttattttttccaggacatcgggtatttccttaaagtggctgctgtcggacggcgggtgcgatcttatggtaaacgcaggcccgcaagaacaattctgcgagccttccttgagaaggctcgtcagactccgcacaagccttttcttctgttccgggatgaaacgcttacgtacgcccaggtggacagacggagcaaccaggtggcacgcgccctccacgaccatttaggcctgcgccagggtgactgtgtggcccttctgatgggcaatgagccggcatacgtgtggctctggctcggcctggtgaaactcggctgcgccatggcctgtctcaattataatatccgggccaagtctctgttacactgttttcaatgttgtggggccaaggtattactggtgtcccctgagctgcaggctgcagtggaggagatcctcccctctttgaagaaggatgatgtctccatttactacgtgtcgagaacatccaacaccgacggcatcgactcatttcttgacaaagttgacgaggtctctacagagcccataccagagtcttggcggagtgaggtaacatttagtacccccgccttatacatttacacaagtggcactaccggggccactctggccctccggactaagtttagtgcaagccagttttgggacgattgtcgcaagtacaacgtaactgtcatccagtatattggcgaactccttagatacctgtgtaacagcccccaaaagcccaacgatcgggatcataaggtgcgactcgccctcggcaacggtttgcgcggcgacgtctggaggcaatttgtaaagcggttcggggatatttgtatttatgagttctatgccgctactgagggtaacatcggatttatgaattatgctcgcaaagtcggggccgtgggaagagtgaattacctgcagaaaaagatcattacctacgatctgattaaatatgacgttgaaaaagatgaacccgtccgcgatgagaacgggtattgcgtccgggtgccaaaaggtgaagtgggcctgctggtctgtaagattacccagctcacgcccttcaatgggtatgctggggccaaggctcagacagagaaaaagaaattgcgggacgtttttaaaaagggagacctctactttaactcaggcgatcttctcatggtagatcatgagaacttcatttatttccatgatcgggttggtgatactttcagatggaaaggcgagaacgtcgccaccaccgaggtggctgacacagtggggctggttgacttcgtgcaggaggtaaatgtctacggcgtccacgtgcccgatcatgagggccggatcgggatggcttctatcaaaatgaaagagaaccatgaattcgacgggaagaaactgtttcagcacatcgcagattatctgccttcctatgcccgaccccgctttctgcgcatccaggacactatcgagataacaggcacctttaagcacagaaagatgacccttgtggaggagggtttcaaccccgctgtcattaaagatgcactgtattttctggatgatacagccaaaatgtatgtcccgatgaccgaagatatctacaacgccatctcagcaaaaacactcaagttatag

SEQ ID NO: 135175 - DNA, 2436 bp, Artificial Sequence
  Description of Artificial Sequence: Synthetic coding sequence
atgcccaagccccccaaaccacggaataatcttgaagatagacacaatcctggaatccaaggacgtagagaacaccgacctggtccaggtcgggtgagggctgccagctcacccggagggtcagcacccagagcagaacggcgcctgtggggcgaggggtgggagtctggtgctgcaccccatccccatagctctcgcgtctccgctctgaggccctgtggcgtggtgggagcatgggttggtatgggtgtgtgtcagcgtaccagagccccttggaaagaaaaatcacagcttgagagggcagccctcggtttcaggaaaggcggatctggtatgttcgcatccggctggaaccagactgtgcccatagaggaggcggggtcaatggccgcgctgctcctcctgcccttactactgctgctgcctctcctcctactgaagttgcacttgtggccacaactgcgctggctgcccgccgatctggctttcgccgtaagggccctgtgttgtaagcgagcactgagagcccgagctctggccgcagctgcagctgaccctgagggacctgagggaggctgttctcttgcatggaggctcgccgagttagcccaacagagagccgcccatacgttcctaatacacgggtctcgcagattcagctatagcgaggccgagagagagagcaatcgagccgcaagagccttcttgagagcgttgggctgggattggggaccagatggcggagacagcggagaagggagtgccggcgagggtgagcgggcggcccccggggctggcgatgccgctgcagggagcggagccgaattcgccggcggtgatggggcagctagggggggtggagccgccgcacctctcagccctggggctacagttgccttgttactgccagcagggccagaatttttgtggttgtggttcggacttgcaaaagcaggtctccgtactgcttttgtaccaacagcgctgcgaaggggacctctgctgcactgcttacgatcttgtggagcccgagccctagtcctggcacccgagtttctagaaagtttagagcccgacctgccagcgctaagggccatgggattgcatttgtgggctgctgggccgggtacgcatcctgccgggatttccgatttgctggccgaggtgagtgctgaggttgatgggcctgtccccgggtacctatcctctccccagtcaattactgacacctgcttgtatatctttacaagcggcacaactgggctccccaaggcagcgaggatttcccatttgaagattctgcaatgtcagggtttttatcagctatgcggggtgcaccaggaggacgtgatttacttggcgctcccactatatcatatgagcggatcactcctcgggatcgtcggatgcatgggcattggggccacagtggtgcttaaatcaaaattcagtgctggacagttctgggaagactgtcagcagcatagagttaccgtcttccaatacatcggagaactgtgccgttatctagtgaaccagcccccgtcaaaagcagaacgtgggcacaaggtccgcctggccgtcggctctgggctcaggccggatacctgggaacggtttgtgcggaggttcgggcctttacaggtgctcgaaacatatggcttgaccgagggcaacgtggccacaatcaactacaccgggcagagaggcgccgtcggtcgcgcttcatggttgtataagcatatcttcccgttttctcttattcggtacgatgtaaccacaggtgaaccaattcgggatccccagggtcactgcatggctacttcccctggggagcccggactgctggtggccccggtttcacaacagagccccttccttggatacgccgggggtcctgagctcgcccaggggaagctcctaaaagacgtctttcggcccggggatgtgttctttaatactggcgatctgcttgtgtgcgacgaccaaggattcctaaggtttcacgatagaaccggtgacacattccggtggaaaggagaaaacgtggccaccaccgaagtggccgaagtcttcgaagccttagacttcctccaagaggtgaatgtctatggtgtgacagtgcctggccacgagggccgggctgggatggcagccctcgtgcttcgacctcctcacgcccttgatctaatgcagctctatacgcacgtaagcgagaatcttccaccatacgcacgccctcggttcctgagattacaggagagtctggctacaaccgaaaccttcaaacagcagaaggtgcgtatggcaaacgagggcttcgatccatctactctctcagacccactttatgtgctggatcaggctgtaggcgcatacctcccgttgactacagctaggtacagcgctctactagcaggtaacctccgtatttag

SEQ ID NO: 135176 - DNA, 2193 bp, Artificial Sequence
  Description of Artificial Sequence: Synthetic coding sequence
atgggcgtgtgtcaaagaaccagagcaccctggaaagaaaagtcccagctcgaacgggccgccctgggttttaggaagggcggatccggtatgttcgcctccggctggaaccagacggtccccatagaggaggccggcagcatggcagctctgctcttattacctctgctcctgctgctccctttgttgttgctgaaacttcacctttggccccagctacgatggctgcccgctgatttggcctttgccgtaagggccttatgttgcaagcgggccctgcgcgcccgagccttggctgctgcagccgccgatccggaaggccccgaagggggatgctccctggcttggagactggcagagcttgctcagcagcgggctgcacatacgttcttgattcacggcagtcggaggttcagctactcagaagccgagcgggaatcaaatcgtgccgctagggccttcctgagggccctgggatgggactggggacctgatggtggcgattcaggcgaaggaagtgctggagaaggcgagcgtgcagctcctggtgccggtgacgccgcagctggcagcggagccgaattcgccgggggggacggtgccgcccgggggggcggggccgccgcgccactcagtcccggggccactgtggccctgctgttgcccgcgggcccagaatttctgtggctgtggtttggattagcaaaggcaggcttaagaaccgcattcgtgcccacagccctccgtaggggtcccttgctgcactgcctgagaagttgtggggccagagctctggttctggctcccgaattcttagaaagcctggaacccgacctgcccgctctccgagctatgggtcttcacctgtgggccgcggggccgggcacgcatcctgcaggcatttcagatctcctggcggaggtctctgctgaagtggatggccccgtgccaggttacttgagcagcccccaaagcatcacagatacctgtctgtatatttttacgtccggcaccactggcctgcccaaagccgcaagaataagtcaccttaaaatactccagtgtcaggggttctatcaattatgcggcgttcaccaggaggacgttatctacctcgcactgccactttatcacatgtcaggaagcttactgggaatcgtgggatgcatgggtatcggggccaccgttgtgctgaaatccaaatttagtgcggggcaattttgggaagactgtcaacagcacagagtgacagtattccagtacattggtgaactctgccgatatctggttaaccagcccccctccaaagctgagagggggcacaaggtgaggcttgcggttggatcagggctgcggccagatacttgggagcggttcgtgagacgatttggtcctttgcaggttctagagacgtatggactgacggaggggaacgtggccacaatcaactacacaggacagaggggcgccgtagggcgggccagctggctgtataaacatatcttccctttttcactgattcggtacgatgtcacgaccggcgaaccgatcagggaccctcaagggcattgtatggcaacctcccccggtgagcctggacttctggtggcccctgtgagccagcagtcgccattcctgggctacgcaggagggccggaacttgcccaggggaaactcctcaaagatgtattccgcccgggagacgtgttttttaataccggggacctactggtgtgtgatgaccagggattccttagatttcatgacagaactggtgatacctttaggtggaagggagagaatgtggcgactaccgaggtggcggaagtgttcgaagccctcgacttcttgcaagaggtaaacgtgtatggcgtgaccgtccccggccacgagggtcgggcgggcatggccgcgctggtgctgaggccacctcacgctctcgacctgatgcagctctatacacacgtgagtgagaatctgcctccctacgccagaccgcgatttttacggctgcaggagagcctagcaacgacagaaactttcaaacagcagaaggttcgaatggcaaacgagggattcgatccttcaacattaagcgatcccctgtacgtccttgatcaggctgttggcgcttatcttccactgacgacggcgcgctacagcgcactgttggctggaaacttacgcatctag

SEQ ID NO: 135177 - DNA, 1932 bp, Artificial Sequence
  Description of Artificial Sequence: Synthetic coding sequence
atgctgttgggggcaagtctagttggcgttttgctgttttcgaagttggtgctgaagctaccgtggacacaggtaggcttttctctgttatttctctacctgggtagcggcgggtggcggttcatcagggtgtttattaagacaatcagaagggatatctttggaggcttggtgctgctgaaagtaaaagcgaaggtccgccagtgcctgcaggagcgccggactgtacccatattatttgcgtccaccgtccgcagacaccctgataagaccgccctgatttttgaaggcacggacactcattggacatttcggcagctagacgagtatagtagcagcgtcgctaactttctgcaggccagaggactggccagcggcgacgtggctgctatcttcatggagaatagaaacgagtttgtaggactatggcttggcatggccaagctgggtgttgaagctgccctcatcaataccaatctaaggcgggatgccttgttacactgcctgactacaagccgggcgagagcactggtttttggttctgagatggcctctgccatctgcgaggtccatgcgtccctcgacccttctctcagcctgttttgttccgggtcctgggagccaggtgccgtgcccccttccaccgagcatttagaccctcttctaaaggacgccccgaaacatctaccttcgtgcccggacaagggctttacagacaagttattctatatatatactagtggaactacagggttgcctaaagcagcaatcgttgtgcatagccgctattatcgaatggccgcgttagtctactacgggtttcggatgcggcccaatgatatcgtttacgactgcctacccttgtatcacagcgcagggaacattgtagggattggacagtgcctgctgcatggtatgaccgtggtgatcaggaagaagttctccgcatcccgcttttgggacgattgtattaagtataattgtacaattgtgcagtacattggcgagttatgccgttatttactcaaccagcctcccagggaagcggaaaatcagcaccaggtaaggatggctttgggcaacggtttacgccaatcaatttggacaaacttctcatcgcgctttcacattccacaggtggctgagttctacggtgcaactgaatgtaactgttcactgggcaacttcgactcccaggtaggggcctgtggcttcaacagccgaattttgtcatttgtctaccctataaggttggtccgggtaaacgaggataccatggagctgatacggggcccagacggggtctgcattccatgtcagccaggtgaaccgggccagctcgtcggtagaattatccaaaaggatccactgcggcgattcgatggctacctaaaccagggggcaaacaacaagaagatcgccaaagacgttttcaaaaagggcgatcaggcctatttaaccggggatgtgcttgtaatggatgagctgggttatttgtattttcgcgataggaccggagacactttcagatggaaaggagaaaacgtctccactactgaagtcgagggaacattgagtaggctgttggacatggccgatgtcgccgtgtatggcgtagaggtaccgggaaccgagggcagagccggaatggcagcggtggcctcccctaccggcaattgtgatctggagcggtttgcccaggttctggagaaggaactgcccttatacgccagacccatctttcttcgactactcccagaactgcacaagaccggtacctataaattccagaagacggagctgaggaaggaaggttttgatccggctatcgtgaaggatccactgttctatctggacgcgcagaagggcagatatgtgccccttgaccaagaggcttacagtcggattcaggcaggtgaagagaaattgtag

SEQ ID NO: 135178 - DNA, 714 bp, Artificial Sequence
  Description of Artificial Sequence: Synthetic coding sequence
atgccactgacactctctaccctgctccagcccggtcggatttggacgggccgccgggccgccgaaccaacgcctggccataatgcggcctggtcactttctgggggaggagccgccgtgttgcaagccggcgctgaaaccgctttggaccccggcggaatcctgcctgttgtgccactgcttgggatctggcggctggccctacaccctgggctgcatcaagaccatcaggcttacctcaccggcgatgtgttggtgatggacgagttaggttatctgtatttccgtgatcggactggcgacacttttcgctggaaaggggaaaatgtctcgaccacagaggtagagggcactctgagcaggctcctggacatggctgatgtggctgtgtatggcgttgaggtccccggcaccgaaggtcgagcgggaatggccgctgtggccagcccaacagggaactgtgaccttgaaaggttcgcgcaggtgctggagaaggaactaccgctatacgctagaccaattttcttgagactgttaccagaattgcacaaaaccggaacatacaagtttcagaagaccgaactgcgcaaggaagggttcgatcccgcaattgtgaaggatcccttgttctacctagatgcacaaaaggggagatatgttccgctggaccaagaagcgtactcaagaatccaggccggagaggagaagctctag

SEQ ID NO: 135179 - DNA, 2073 bp, Artificial Sequence
  Description of Artificial Sequence: Synthetic coding sequence
atgggtgttaggcaacaactggcactcctgctcttactgctgctattgctatggggactcggccaacccgtgtggcctgtcgctgtcgccctcaccctgcgctggttgctgggcgaccccacttgttgtgtgctgttaggtctagccatgctcgctcgcccttggttgggcccttgggtgccccacggactgtcgctcgccgccgcagcactggcattgacattgctccctgcacggctccccccagggcttcgatggctgccggcagacgtaatctttctcgcaaagatccttcatctaggccttaaaatacgaggctgcctgtcccggcagcctcctgatacattcgttgacgcctttgagaggcgggccagggctcagcccggacgagccttactcgtgtggactgggcctggagccggttccgttacttttggtgaattagacgcgagagcctgccaagcagcctgggcgctgaaggcggagttgggcgacccagccagcctgtgcgctggagagcccaccgctctgctggtattggcatcccaggctgttccagcactgtgcatgtggcttggtcttgccaagctggggtgccccaccgcctggattaatccacatggccgcggaatgccactcgctcacagcgtgctgagttcaggcgctcgggtgctggtagttgaccctgacctaagggaatcactggaggagatactccccaagctacaggcagagaacatcagatgcttttatctctcccataccagccctacacctggggttggagccctcggcgccgcccttgatgcagcaccctcccaccctgtccccgctgacctccgagcaggtatcacttggcgttctccggctctgttcatctacacatccgggaccacaggactgcctaaacctgcaatcctgacacacgagcgagtgctacaaatgtccaaaatgctgtcgttaagtggtgccactgctgatgatgtcgtctacacagtgctccctctctatcatgtaatgggcctggttgtcggaatactcggctgcctggacttgggcgccacctgcgtgctggcgcccaaattctctacctcctgtttttgggacgattgccgccagcacggcgtgacggtcatattatatgtcggagagctgctcagatacctgtgcaatatccctcagcagccagaagacagaacacatactgtcagattggctatggggaatggactgagggccgatgtgtgggagacatttcagcagcggtttggccctattagaatttgggaagtgtatggctcaaccgaaggtaacatggggcttgtcaactacgtaggacgctgcggggcccttgggaagatgtcatgcctgttgcgaatgttaagtccctttgaattggttcagttcgacatggaggcagctgaaccagtgagagacaaccaggggttctgcataccagtcgggctgggagaacctggtctgttattgaccaaagtggtatcgcagcagccatttgtggggtaccggggcccgagagagctgagtgaacggaaactggtgaggaacgttagacaatcaggggatgtgtattacaatactggcgacgtcctggccatggatagagagggatttctttacttcagagatcggctgggggacacttttcgatggaagggcgagaacgtgagcactcacgaagtcgaaggcgtgcttagccaggtcgattttctgcagcaggttaacgtgtatggagtgtgcgttcctggctgcgaggggaaggtgggaatggcagccgtacagctcgctcctgggcaaacttttgacggcgagaagctgtaccaacacgtgcgagcttggctacctgcttatgcaacacctcatttcatcaggatccaagatgccatggaggtcaccagtacgttcaagctgatgaagacccgacttgtgagagagggttttaatgtaggcatcgtggttgatccactcttcgtgttggacaacagggctcaatcgtttcgccccttaacagctgagatgtaccaagcggtgtgtgagggaacctggaggctgtag

SEQ ID NO: 135180 - DNA, 1950 bp, Artificial Sequence
  Description of Artificial Sequence: Synthetic coding sequence
atggagaacgatccgtcgaggaggcgcgaatctatctctctgacccccgtggctaaaggactcgagaatatgggcgcggacttcttggagtctctggaggaagggcaactgccaagaagcgacttatcacccgcagagatcagatccagctggagcgaagccgcccccaaacccttctctcggtggaggaacctgcaacccgcactgagagcccggagcttttgccgagagcacatgcagttattcagatggatcggaaccgggcttctatgcacaggtctgtcggcatttctcctggtcgcctgtctgctggattttcagagggccctggcactgtttgtgttgacatgtgtcgttctgacattcctaggtcatcgccttttgaaaagactacttggcccgaaacttagaaggttcttgaaacctcaggggcaccccaggttgctgttgtggtttaagcgaggactggcattagcagcttttctgggcctggtactgtggctgtctctggacacctcccagcggcccgaacagctggtgagctttgcaggcatttgtgtgtttgtggcattgctctttgcgtgttccaagcatcattgtgctgtgagttggagggccgtcagctggggattgggccttcagtttgtgttggggttgctggtgattcggactgaacccggcttcatcgctttcgagtggcttggggagcagatacggatcttcctatcatacacaaaggctggctccagctttgtgttcggtgaggccctggtgaaagatgtgttcgcctttcaagtgctgccgattattgttttcttctcctgcgtgatctccgtcctttaccatgtgggcctcatgcagtgggtcatcctcaagatcgcctggctgatgcaagtgacaatgggaaccacagccacagaaacattgagtgtagcaggaaatatattcgtcagtcagacggaggctcctctgctcattcgtccgtatctcgctgacatgacccttagtgaggtgcacgttgttatgacggggggctacgcaaccatcgctggatccctgctgggggcatatattagctttgggattgatgccacctcacttattgcggcaagcgtgatggccgcaccgtgcgctcttgcccttagcaagctcgtttatcccgaagtggaggaaagtaaatttcggcgagaagaaggcgttaagctcacatatggcgatgcccagaatctgattgaagcagcgtctaccggggctgctatatccgtgaaagtggtggctaatatcgccgctaacttaatcgctttcttggctgtgctggattttattaacgccgccttgtcttggctgggagatatggtcgatattcagggactctcttttcaattgatctgttcctatattctgaggcctgtcgcctttctaatgggcgtggcttgggaagactgtcctgtcgttgctgagctattgggaatcaagctttttttgaacgaattcgttgcgtaccaggacctgtcaaagtacaaacagcgccggctcgcaggcgccgaggaatgggttggtgatagaaagcagtggatcagtgtgagagctgaggttttgacaacgttcgctctgtgtggctttgcaaatttcagtagcataggcataatgctaggcggactcacgtccatggtcccacaaagaaaatcagattttagtcagatcgtactccgggccttgttcaccggcgcttgcgtgtcattggtcaatgcctgtatggcggggattctgtacatgcctagaggagcggaagtcgattgtatgagtctgctgaacaccactctcagtagcagtagctttgaaatttatcagtgttgccgcgaggctttccagtcagttaaccctgagtttagcccggaggctctcgacaattgctgccggttctataaccatacgatttgtgcgcaatag

SEQ ID NO: 135181 - DNA, 528 bp, Artificial Sequence
  Description of Artificial Sequence: Synthetic coding sequence
atggaaaacgatccctcccgcaggagagaaagcatctctcttacgccagtcgccaagggcttggagaacatgggcgctgactttctggaatcactcgaggaggggcagttgccacgatctgatctatccccggccgaaatccgaagttcatggagtgaagcagcacccaaaccgttttctcgctggcggaacctgcaaccagcgttgagagcaaggtccttttgccgcgaacatatgcaactctttaggtggattggcacaggactgctgtgcacaggcctgtccgcattcctgcttgtggcttgtctcttagattttcaaagagcattggccctgtttgtgttgacttgcgtcgtgctgacatttctcggacaccggctcttgaagaggctcttggggccgaagctgagaagatttctaaagccccaaggtcacccacggctacttctttggtttaaacgtgaccctaggccatggagcaaggagggaccaaatcaataccttccacagatcacctggactgtatag

SEQ ID NO: 135182 - DNA, 1950 bp, Artificial Sequence
  Description of Artificial Sequence: Synthetic coding sequence
atggaaaacgacccatcaagaaggcgagagtctattagtctcactcctgtggcaaaggggctcgagaatatgggggccgatttcctggagtcattggaggaggggcagcttcctcggtccgatctaagcccggccgaaattaggagcagttggagcgaggcagccccaaagccattctctcgctggcgcaatctgcagcccgcccttagggccagatcgttctgtcgggaacacatgcagctctttagatggatagggacaggactgctgtgtaccggcctgtcggccttcttacttgtggcatgcctgctggacttccaaagagcgctggctctcttcgtgctgacatgtgtggtgcttacctttctgggacacagactgctgaagcgcctcctaggtcccaagcttaggaggtttctgaaaccccagggccatcctcgactgctgctgtggtttaagcggggtttagctctcgctgctttcctgggcctggtcctgtggctcagcctcgataccagccagcgtccggaacaactggtctccttcgccggcatctgtgtgtttgtggccctgctgtttgcctgctcaaaacaccattgcgccgtgtcatggcgggccgtgagttggggcctcggactccagttcgtcctgggacttttagtaattcggacagaacctgggttcatcgcatttgagtggttaggggagcagattaggatatttctctcttatacaaaagccgggtcatcttttgtgttcggcgaggctctcgtcaaggacgtcttcgcattccaagtgctgcctattattgtgtttttctcatgcgtaatatcagtgttataccacgtgggactcatgcagtgggtaatcctgaaaattgcttggctcatgcaggttacaatgggtacaacagccactgagaccctatctgtcgcaggaaatattttcgtgagccagactgaagcacccctgcttatcaggccctacctggccgacatgactctgtctgaagtgcacgtggtgatgacgggaggatatgccacaatcgccggaagcctgctcggcgcctacataagcttcgggatagacgccacatcactgatcgctgcttcagttatggccgccccctgtgctttagccctgtctaagctagtctaccctgaggtggaagaaagcaaatttaggcgggaggagggagtgaaactgacatacggcgatgcccaaaacctgattgaagccgcatcaaccggcgcagctatctcagtgaaggtggtggctaacatcgctgccaatctcatcgcctttctggcagtgctcgatttcattaacgctgcactttcctggctgggagatatggtggacatccagggtctgtccttccagctcatttgtagctacatcctgcgacctgtggcctttctcatgggcgtggcttgggaggactgtccagtggtggctgaattgttgggaattaagctgtttttgaacgagttcgtcgcctaccaagatctgagcaaatacaagcagcggcgattggccggcgccgaggagtgggtgggcgatagaaaacaatggatatctgttcgtgcagaagtgttgacgacctttgccctgtgcggctttgcaaatttctcctcaattgggatcatgctggggggcctgacaagcatggtgccacagcgaaaatccgacttcagccaaatcgtgctgcgggccttatttaccggcgcttgtgtgtccctggtgaatgcttgtatggccggcatcctatacatgccccgaggtgccgaggttgactgcatgtctctcctgaacactacgctgagctctagctcttttgagatctaccagtgctgccgggaggccttccagtccgtgaatccggaattctctcctgaggcccttgataactgttgcaggttttataatcataccatttgtgcacaatag

SEQ ID NO: 135183 - DNA, 1632 bp, Artificial Sequence
  Description of Artificial Sequence: Synthetic coding sequence
atggagaatgatccatccaggcgtagggaatccattagtctgacacccgtcgctaaggggctggagaacatgggagccgactttctggagtctcttgaggagggtcagctcccaaggagcgatctcagtccagcggagattcggtcaagctggtccgaggcagcccccaagccattctcccgatggcgtaacctccaaccggctctgagggcgcgaagcttctgccgtgagcatatgcagctctttagatggatcggaaccgggctactctgcactggcctgtcagccttcctcctcgtcgcatgtttgcttgattttcagcgtgccctcgcccttttcgtacttacatgtgtggtactcacttttttaggtcacaggcttttaaagagactcctgggccctaagttgcgccgtttcctaaagcctcagggccatcccagattactactttggttcaaaagaggactggctttagctgccttcctcggtcttgtgctttggctgagcctggacaccagtcagcgccctgagcagttggtgtcctttgctggtatctgcgttttcgtcgctttactcttcgcttgctccaagcatcattgcgcagtctcatggcgggctgtttcctgggggcttggactgcagtttgtgcttgggttgttggtgattcgcactgaaccgggcttcatcgcctttgaatggttgggggagcagataaggatatttctgtcgtatactaaggccggctctagcttcgtttttggggaggctctcgttaaagacgtctttgcctttcaggtgctgccaataatcgtcttttttagttgcgtaatcagtgtgctctatcacgtcgggctcatgcagtgggtcattctgaaaatcgcttggctgatgcaggtgacgatggggactaccgctactgaaacattgagcgttgctgggaacatattcgtctctcaaactgaagccccactcctgattcgcccttacctggccgacatgacgctgagcgaggtgcacgtcgtgatgactggcggctacgctacgattgccggaagtctgctgggagcatacattagcttcgggatagacgctaccagcctaatcgcggcatctgtcatggccgccccatgcgccctagcactgtctaaactcgtttatccagaggtggaagagtccaagttcaggcgggaagagggtgtgaagctcacttacggggacgctcagaacttgattgaggcagcaagtacgggcgctgccatctccgtgaaagttgtagccaatatcgcagccaacctaatcgcttttttagctgtgctggactttattaacgcagctctgagctggctgggtgacatggtcgatatccagggtcttagctttcaactcatctgcagctacattttacggcccgtagcgtttctgatgggcgtggcctgggaagactgtcccgtcgttgcagagctccttggcatcaaattgtttctgaatgaatttgtcgcgtaccaagatctgtcaaagtacaaacagcggcgtctggccggcgcagaggaatgggtgggggaccgaaaacagtggattagtaggcgcgggcttgcaatgctgacaaggctggtcctgaactcatggccctag

SEQ ID NO: 135184 - DNA, 1911 bp, Artificial Sequence
  Description of Artificial Sequence: Synthetic coding sequence
atggaaaacgacccatctagacgacgagagagcattagtctcacaccagtggctaaaggcctggaaaacatgggcgccgactttctggaaagtttggaggagggacagctaccgcgatccgatctgtccccagccgagatcaggagcagttggtctgaagccgcacccaaaccatttagtcgatggcgaaatctgcagccagccctcagggcacggtcattctgcagagagcatatgcagctgtttcgttggattggcacagggctgctctgcacgggtcttagcgcctttttgcttgtagcctgcttgctcgacttccaacgagccctcgccctcttcgtgctgacctgtgttgtgttgacctttctcggccacaggttgctgaaacgcctgcttggccctaagcttcgcagattcctgaagcctcagggacatcctaggctattgctctggttcaagcgggggctggctctcgcagccttcctgggccttgttctttggctctcgctggacactagccaaagaccagagcagctcgtgtcttttgctgggatttgcgtgttcgtagcattgctgttcgcctgtagcaagcatcactgtgcagtgtcttggcgagctgtgagctggggactgggtctgcagttcgttcttgggctcctggtgatccgaaccgagccaggttttattgcatttgaatggctgggcgagcaaattcgcatctttctcagctatacaaaagccggctctagtttcgtttttggcgaagccctggtgaaggacgtgtttgcgttccaggtgctccccatcattgtgtttttttcatgcgtgattagtgttctataccatgtcgggctgatgcagtgggtgattctgaagatagcatggttaatgcaagtaactatggggaccacagctaccgagacactcagtgttgcaggcaatattttcgtgtcccaaacagaagcccctctgctgatccggccctatctcgctgacatgacactctccgaagtgcacgtcgtaatgaccgggggatacgccacaattgccggctctctcctcggtgcgtatatcagcttcggaattgatgctacttctctgatcgctgcatcagtcatggcagcgccgtgtgccctggccctgagcaaactagtgtaccctgaggtggaagaatcgaaattccgtcgggaagagggcgttaagctgacctacggggacgcgcagaacctcattgaggccgcgagcacgggggccgctataagcgtcaaggtcgtggctaacatcgctgccaatctgatcgccttccttgctgtccttgacttcataaacgcagcattaagttggctcggtgatatggtggatatacagggtttgtcctttcagcttatctgcagctacatattgagaccggtcgcctttcttatgggcgtggcctgggaggattgccccgttgtggctgagctattggggattaagctgtttcttaatgaattcgttgcctaccaagatctgtctaaatataaacagagacgcttggccggggcagaggagtgggtgggtgaccgcaaacagtggataagtgtgagagccgaagtgcttaccacctttgccctgtgtggcttcgccaatttctcctctatcgggatcatgctggggggtctgacttccatggttccacagagaaagtccgatttttcccagatagtgctgcgagccctgttcactggggcttgcgtcagcctggtgaacgcttgcatggcaggcatcctttatatgccaaggggcgccgaggttgactgcatgagcctactcaatactactctgtcaagctctagcttcgagatatatcaatgttgtagggaagcctttcagcggattttcaagagcacgccggcagagtcccagccctag

SEQ ID NO: 135185 - DNA, 864 bp, Artificial Sequence
  Description of Artificial Sequence: Synthetic coding sequence
atgcagctgtttcgatggataggcacaggtctgctctgcaccggcctgtctgccttcctcctcgtcgcctgcctgctggattttcagcgcgccttagcgctgtttgttcttacttgtgtggtactgacatttctcggtcaccgacttcttaaacgcctgcttggacccaagctgcgaagattcctgaaacctcagggacatcccagattactgctttggtttaaacgaggtcttgctcttgcagcgttcttagggctagtgctgtggctgtcactagacacgagccagcgcccggaacagctggttagcttcgccggcatttgcgtttttgtcgctttgctgttcgcttgttcaaagcaccattgcgccgtttcctggcgggcagtctcctggggcctcggcttacagttcgtgctcggtctcctggtcattaggactgaaccaggcttcattgcctttgaatggctcggggaacagatcagaatctttctgtcatatacaaaagccgggtcttcctttgttttcggagaggccctggttaaagacgtttttgccttccaagtgctacctatcattgtgtttttttcatgcgtgatttcagtgttgtatcatgtcggactgatgcagtgggttattctgaaaattgcctggttaatgcaagttactatgggaacaaccgcgacagagaccctgtcagtcgccggtaatatttttgtttcacagaccgaggccccattgctgattcgaccatacctggcagatatgaccctgtccgaggtccacgtagttatgaccggcggctacgccactattgccggcagtctactgggcgcatacataagtttcggattagagaaactgtag

SEQ ID NO: 135186 - DNA, 1452 bp, Artificial Sequence
  Description of Artificial Sequence: Synthetic coding sequence
atggagaacgatccttctcgaaggcgtgagagcattagtcttacacccgtggccaagggcctggagaacatgggcgccgatttcctggagtctttagaggaagggcagcttccaagatcggatctcagccctgccgagattagatcttcttggtcagaagcggctccgaagccgttctcccgatggcgtaacctccaaccagctctgagggccaggagcttttgccgtgagcatatgcaacttttccggtggatcggcactggtttgttatgtaccggcctgtcggccttcttacttgttgcatgcttgttagattttcagcgggctctggctctgttcgtccttacctgcgtggtcctcaccttcctaggtcatcggctattgaagaggctgctcggacctaaactcaggaggttcctgaagccccaagggcacccaaggctcctgctgtggttcaagagaggccttgccctggctgcctttctgggcctggtgttatggctttccctcgacacatcccagcgacccgagcaactcgttagtttcgctgggatttgcgtgtttgtcgccttgctttttgcatgctcaaaacaccattgtgctgttagctggagggccgtctcttggggtctcggactgcagttcgttctcggcctgctggtcataaggacggaaccgggtttcatcgctttcgagtggctgggggagcagattcgcatcttcctctcctacacaaaagcagggagcagttttgtgttcggggaagccctggtcaaagacgtgttcgcttttcaggtattgcccattatcgtgttcttttcctgtgtcatcagcgtgctgtaccatgtcggcctgatgcagtgggtgatactgaaaatcgcctggctcatgcaggttaccatgggaacgactgcaaccgagacactgagcgtcgccggcaacatattcgtgtctcagaccgaagcaccattgttgattcggccctacctggccgacatgacacttagcgaagtgcacgtcgtgatgactggtgggtatgctactattgcagggtcactgctgggagcttacatctcctttggcgtgagagctgaggtgctcaccacttttgcactctgcggatttgctaatttcagctccatcggcattatgctcggcggcctgacgagtatggtcccccaacggaagtcagacttctctcagatcgtgctgcgcgcactgtttactggcgcttgcgtgagcctcgtaaacgcctgcatggcaggcatcctgtacatgccaaggggagctgaagtggactgtatgtcattgcttaatacaacgctgagcagtagcagctttgagatttaccaatgttgtagagaggcgtttcagtctgttaatcctgaattctcccctgaggcgcttgacaattgttgccgcttttacaaccacaccatctgtgcccagtag

SEQ ID NO: 135187 - DNA, 1977 bp, Artificial Sequence
  Description of Artificial Sequence: Synthetic coding sequence
atggagaaagcctctgggcggcagtccatcgcattgagcaccgtcgagaccggtacagtgaaccccgggctggaattgatggagaaggaggtagagccagaaggatccaagagaactgacgctcaaggccactccctcggcgatggcctaggaccaagcacctaccaacgccggtctcggtggccatttagcaaagcgcgctcattttgtaaaacgcacgcttctttgttcaaaaagattctgctcggtcttctctgtctagcgtatgccgcataccttcttgctgcatgcattctgaattttcagagagccctggcgctgttcgtaataacctgcctggtgatattcgtcctggttcactcttttctgaaaaaactgctgggtaagaaactgactaggtgtttgaagcccttcgagaactcccgcctgagattgtggactaaatgggtcttcgccggtgtcagcctggtcggacttatattatggctggccttggacactgcccagcgacctgaacagctgatccccttcgccggcatctgtatgttcatcctcatactttttgcttgttctaagcaccatagcgctgtgtcctggaggaccgtcttctccggtctcggactgcagttcgtgtttggaatcctcgtcatacggaccgacctggggtacaccgtgttccagtggttgggagaacaggttcagattttcctgaactacacggttgctggctctagttttgtgttcggcgacacgcttgtgaaggacgtgtttgcttttcaggcattgcctatcatcatcttctttggatgcgttgtttcgatcctgtattatcttgggctggttcagtgggttgtccagaaggttgcttggttcctacagataacgatgggcactacagcaaccgagacccttgctgtggcagggaatattttcgtgggcatgaccgaggccccgctcctaataagaccatatctgggagatatgaccctttccgaaatccacgcagtgatgaccggcggcttcgccacaattagcggtaccgtgctcggtgcgtttatagcctttggagtcgatgcctcatcattgataagcgcctccgtcatggcagcgccttgcgccctggcttcttccaagctggcctatccagaggtcgaagaatcaaagttcaaatctgaggagggtgtaaaactccctcgcggcaaggagaggaatgttttggaagccgcctccaacggcgccgtcgatgctatcgggctagcaaccaacgtcgccgctaacttaattgcttttctcgctgttctggcctttattaacgccgcgctatcatggttgggggagcttgttgatatacaggggctgacttttcaggtgatctgctcctatctgctccgccctatggtttttatgatgggagttgaatggacggactgcccaatggttgctgagatggtgggcatcaagttcttcatcaatgagttcgtagcttaccagcagttgagtcagtataaaaataagcgactgtccgggatggaagagtggattgaaggggaaaaacaatggatttctgtccgggcagagattatcacaacgttctccttgtgcggcttcgcaaatctgagttctatcggcatcacgctggggggcctcacttctattgttccccataggaagagcgacctcagtaaggtcgtagtacgcgcccttttcaccggggcttgcgtctcactcatctccgcctgcatggctgggatcctgtacgtcccacggggtgccgaggccgattgcgtgtcctttccaaacaccagcttcaccaacaggacttacgagacttatatgtgttgccgcggcctgttccaaagcacctcactaaatgggacaaaccccccaagcttttcaggtccttgggaggacaaagaatttagcgccatggcactcacgaattgctgcgggttttataacaatacggtgtgcgcatag

SEQ ID NO: 135188 - DNA, 2076 bp, Artificial Sequence
  Description of Artificial Sequence: Synthetic coding sequence
atggagctgagatccacagccgcacctcgcgctgagggttatagcaatgtaggctttcagaatgaggaaaacttcctcgagaatgagaacaccagtggaaacaatagtattcgaagcagagcagtgcagagccgcgaacatactaacacaaagcaggatgaagaacaggtgacagtcgaacaagactcaccgaggaaccgagagcacatggaagacgatgatgaggaaatgcagcaaaagggatgtctggaacgcagatatgacaccgtatgcggattttgtagaaagcacaagaccaccctgaggcacataatctgggggatactgctagctggctatctggtgatggtgatttccgcctgtgtcctgaactttcatcgcgccctgcctctcttcgtgatcaccgtggccgccatcttttttgtcgtgtgggaccacttgatggccaaatacgagcatcgcatcgacgagatgctttcccctggcagaaggctgctgaatagccactggttctggttaaaatgggtcatctggtctagcctggtcctcgccgtgatcttttggttagcctttgataccgccaaactgggccagcaacaactagtgtctttcggcgggctaataatgtatatcgtattgctgtttctgttctctaaataccccacacgagtgtactggcggccggtcctgtggggtattgggctgcagttcttactagggttgctcatcttgcgaactgaccctggttttatagccttcgactggctgggacggcaggtgcagactttcctcgagtatacagacgcaggtgcctccttcgtcttcggagagaaatacaaagaccacttttttgctttcaaggtgcttcctatagtggttttctttagcacggtgatgtccatgctgtactatcttggcttgatgcaatggatcattcgtaaggtcggatggatcatgcttgtgactacaggctcctctccaattgagagcgtcgttgcttctggcaacatcttcgtcggacagacagaatcgcccttactggtgcgtccttacctgccttatattaccaagagcgagctgcatgctattatgaccgccggctttagtacaattgctggcagcgtgctcggagcttatatttcattcggagtaccttcctcacacctgcttaccgcatccgtgatgagtgcccccgctagcttggccgccgcaaaactgttttggcctgagactgaaaaacctaagattactttgaaaaacgcaatgaagatggaatccggcgattccggcaacctgctggaagcagctactcagggggcatcgtcttccatctctctggtcgccaacattgccgttaacttgattgccttcctggccctgctctcgttcatgaactctgcgctgagttggttcggcaacatgttcgactatccccagctgagctttgaacttatctgctcttatatcttcatgcccttttctttcatgatgggtgtagaatggcaggactctttcatggtggcaaggctgattggatataaaactttttttaatgaattcgtggcatacgaacacctcagcaaatggatccacctgaggaaggaaggaggccccaaattcgtcaacggggtgcagcaatacatttctatccgatccgagatcattgccacctatgccctatgtgggttcgccaacattggctcactcggaatagtcatcggtgggctcacatctatggccccatcccgtaaaagagacatagccagtggagcagttcgtgcgctcatcgctgggaccgtggcctgcttcatgaccgcatgtattgcaggcattctgtcctctaccccggtggacatcaattgccaccatgtgttagagaacgcctttaacagcacatttcctggcaacacgacaaaggtcattgcctgctgtcagagtttactcagctctaccgtggcaaaaggacccggggaggtaattccaggaggcaaccattcgctttacagcctgaaagggtgctgtacactgctaaatccctcaacctttaattgtaacggtataagcaacaccttctag

SEQ ID NO: 135189 - DNA, 1869 bp, Artificial Sequence
  Description of Artificial Sequence: Synthetic coding sequence
atggaggacgatgacgaagagatgcagcagaaaggctgtctggagcgcaggtacgatacagtttgcgggttttgccgaaaacataagacgacattacgacacatcatctggggtattcttctggctgggtacttggtgatggtgattagcgcatgcgtgctgaacttccaccgggctctgcctttgttcgtaattaccgttgcagctatttttttcgtggtgtgggatcacctgatggccaaatatgaacacaggatcgatgagatgttaagccccggccgaagactccttaactcacattggttttggctgaagtgggtgatttggtcttccttggttcttgcagtcattttctggctagcttttgatacagctaaattgggccaacagcaactggtgagttttggtggccttatcatgtacattgtgctgcttttcctcttctctaagtatcctacgcgagtttattggaggcccgtgctttggggtatcgggctacagtttctcctgggcctgctcattctgcgcacagaccctggatttattgcgtttgattggcttggccgacaggtgcagacatttctcgaatacactgatgcgggggcgtcctttgtgtttggggaaaagtacaaagatcactttttcgctttcaaggtgttacccatagtcgtgtttttcagtaccgtgatgagcatgctttactatctgggattgatgcagtggattattcggaaggttggctggataatgctggtgacaacgggctcttctccaattgaatctgtggtagccagcgggaatattttcgtcggacagactgaatcaccactgttggtcagaccttacctgccttatatcaccaagagtgaactccacgccataatgacggctgggttttccactattgccgggagcgtgttgggagcttatatctcgttcggagtgccctcgtcccacttgctgacagcaagtgtgatgagcgctcctgcctcacttgccgcagccaagctcttttggcccgaaacagagaagcccaaaattacgctgaagaacgcgatgaagatggagagtggcgacagtggtaacctcctggaagccgccacacagggagcttccagctctatatctctggtggccaatattgccgtgaacctaattgcctttctggctcttctgtctttcatgaattccgccttatcatggttcggaaacatgttcgactatccccagctctccttcgagctgatctgttcgtacatatttatgcctttctcttttatgatgggggttgagtggcaggattccttcatggttgctagattgatcggatacaagacctttttcaacgaattcgtagcgtacgaacacctcagcaagtggatacatctgaggaaagaggggggtccaaagtttgtcaacggcgtgcagcagtatatttctattcgctcagagatcattgcaacttacgccctgtgcggttttgccaacataggatccctcggaatagtgatcggcggactgacatccatggcgccatccagaaaacgggatatcgccagtggagctgttcgcgccctgatagctggtaccgtggcatgtttcatgaccgcttgcatagccggaattctgtcctcgactcctgtcgatatcaattgccaccacgtgctggagaacgcttttaacagtacttttccaggtaacaccactaaggtgatcgcttgctgtcagtccttactgtcgagcacggtcgctaagggccccggggaagttatccccggcggaaaccactccctatactctctgaaagggtgctgtacactgctgaatccatccacattcaactgtaacggaatttccaacaccttttag

SEQ ID NO: 135190 - DNA, 1608 bp, Artificial Sequence
  Description of Artificial Sequence: Synthetic coding sequence
atgcgacgggaaagaacgcgcggcccacaggcctgggagttcccaagccccacaaagagcggctgttcactgcaatccctgagtcgcgatctgcgtgagttaagggaaggtgaaaagccagaggaccaggccgagacggaagagagttggcaaggcctcgctaggaaaacgccaggtaaggcgtgcgccccggagggaggatcatgccagccggggaagacggaaaatactataaccatgactacatcccatcaacctcaagatcgttataaagccgtgtggctgatcttcttcatgttaggtctcggaaccttactgccctggaacttttttatgactgccactcagtacttcactaaccgcctggatatgagccaaaatgttagcttggtaacagcagaattatcaaaggatgcccaagcctccgccgcccccgctgctcctctccccgagaggaacagtttgtcagcaatcttcaataacgtgatgaccttatgtgcaatgttacccctgctgctgtttacatacctaaatagctttctgcaccagagaatcccgcaatctgtacgcatcttgggctcccttgttgcgatactgctagtgttccttataacagctatcctagtcaaagtgcagttggacgccctgcccttcttcgttataactatgatcaagattgtgctcattaacagctttggggctatactgcaggggtcactgttcgggttagccggcctccttcctgcgagctataccgccccaataatgagtggacagggcttagccggattctttgcctctgttgcaatgatatgtgcaattgcctccggcagcgagctctccgaatccgccttcgggtactttataacagcctgtgcggtcattatcttaacaattatatgttacctggggctgccacggctggaattctaccgctactatcagcagttgaagcttgaaggcccaggggagcaagagaccaagctggatctcatttcgaagggagaggagcctcgggcaggaaaggaggaaagtggcgtctccgttagtaatagtcagccaaccaatgaatcgcactccattaaagccatactaaaaaatatcagtgtgcttgcattctcagtgtgtttcatttttaccatcacaattggcatgttccctgctgtgacagttgaggtgaagtcctctatcgccggttcgagcacctgggaaaggtatttcatcccggtgagttgctttctcactttcaacatctttgactggctgggaagatcccttacggccgtctttatgtggcctggaaaagattctcgttggctaccgagtttggtgctggctcgcctggtgtttgttccacttctcttgctgtgcaatattaagccgcggcgctatttgacagtcgtctttgagcatgacgcctggtttatcttttttatggccgctttcgcgttctccaacggctatttggcatccttgtgcatgtgttttggtcctaagaaggtaaaacccgccgaggccgaaacagcaggtgcaataatggctttctttctctgtctcggcttggctctgggcgcagttttctcttttctcttccgggctattgtgtag

SEQ ID NO: 135191 - DNA, 1371 bp, Artificial Sequence
  Description of Artificial Sequence: Synthetic coding sequence
atgaccacatcccatcagcctcaagatcggtacaaagccgtctggttgatttttttcatgcttggattgggcaccttgctcccctggaacttttttatgacagctacccagtatttcaccaatagattagatatgtctcaaaatgtcagcctcgtgaccgcagagctctccaaggatgcccaggcctctgcggccccagcggccccacttcctgagagaaattccctgtcggcaatctttaacaatgtcatgactttatgcgctatgctgccactgctcttgttcacatacctaaattcattcctccatcagaggatcccccagtcagtgcggatactaggctccttagttgccatcctattggtgttcctcatcacagctatcctcgtgaaggtgcaactcgatgctctgcctttctttgtgataacaatgataaagattgttttgataaattccttcggcgctattctgcagggcagcttattcggcctggcgggtctactgcccgcttcgtacactgccccaatcatgtctggacagggactcgcaggatttttcgccagcgtggctatgatatgtgcaatagccagcggaagcgagctcagcgaatcagccttcggctactttattactgcttgcgcagtcatcattctcacaattatttgctacttgggcctcccccggcttgaattttataggtactatcagcagctcaagttagagggacctggagagcaggaaaccaaactggatttgatttctaagggggaggaaccccgcgccggaaaggaggagtccggcgtgagtgtgagcaactcacagcccaccaatgagtcccattcaattaaggcgattctcaaaaatatctccgttcttgcatttagcgtttgttttattttcaccatcaccatcggcatgtttcctgcggtgactgtcgaggtgaagagttcaatcgccggttcaagcacatgggaaagatattttatccctgtctcatgttttctgacattcaatatcttcgattggctgggacggagtttgacagcagtgttcatgtggcctgggaaagactctcggtggctgccttctctagtgctcgcaagactagtcttcgtgccattattgctcctgtgcaacataaaacccagaagatatctgacagtggtgttcgagcacgatgcctggttcatttttttcatggctgctttcgcttttagcaatggctaccttgcgtcactgtgcatgtgcttcggcccaaagaaggtcaaacctgctgaggccgagactgcaggggccattatggccttctttttatgtctcggcttggcgttgggggctgtattcagtttccttttcagagctatcgtgtag

SEQ ID NO: 135192 - DNA, 1371 bp, Artificial Sequence
  Description of Artificial Sequence: Synthetic coding sequence
atgacgacttcacaccagcctcaagatcggtacaaggcagtgtggctgatctttttcatgctgggcctcggaaccttactgccgtggaacttttttatgaccgccacgcagtactttacaaacagactggacatgtcccaaaatgtctctctggttacagcagagctgtctaaagacgcccaagctagtgccgcccctgcagctccactgcccgagcgaaattccttaagcgcaatatttaataacgtgatgactctctgcgcaatgctcccactcctcctatttacgtacttaaactcatttctgcatcagaggatcccacagtcagtgcgcattcttggctcgctcgtggccattttactggtgttcctaatcacagcgatccttgtcaaggtgcagttggatgccctgccattttttgtcattaccatgatcaaaattgtgcttataaattcattcggagccatcctgcagggctccctcttcggtctggccggactcctgcccgccagctatactgccccaatcatgagtggacaggggttggcgggcttttttgcatccgtggcaatgatatgtgcgatagccagtggcagtgagctgagtgaatccgcttttggctatttcataactgcatgcgctgtgataatactgactatcatctgttatctgggactgcctagactggaattctatcggtattatcaacagttgaaactagaggggcccggtgagcaggaaaccaaactggatctgatctccaaaggagaggagccgcgggcaggcaaggaagaatcaggggtcagtgtgtctaattcgcagccaacaaacgaaagccactcgattaaagccatcctcaaaaatatctccgttctcgcattcagcgtttgtttcatcttcacgatcacgatcggcatgttccctgcggtcacagtggaggtgaaaagcagcattgcagggagctctacctgggaacggtacttcatcccggtgtcttgttttctcacgttcaacatcttcgattggctcggacgctcactgaccgcagtcttcatgtggccgggaaaagatagtcggtggctgccaagcctggttctggcaaggctggtcttcgtgcctcttctgctgttgtgcaacatcaagccccgccgttaccttacagtggtgttcgaacatgacgcatggttcatcttctttatggccgcctttgcattcagcaacggttatctggcctctctctgtatgtgcttcggccctaaaaaagtgaaaccagcagaggcggagaccgccggcgccatcatggccttctttctgtgcctgggcctggctctgggagcagtgttttctttcctgtttagggccatcgtctag

SEQ ID NO: 135193 - DNA, 1371 bp, Artificial Sequence
  Description of Artificial Sequence: Synthetic coding sequence
atgaccacctcccatcagccccaagataggtataaagccgtatggctaattttctttatgttaggactggggactcttctgccttggaactttttcatgacggccacccagtattttacaaatcggttagacatgtcccagaatgtgtctctcgtgaccgctgagcttagtaaggatgcccaggcctccgctgctcccgctgctccactgccagagcgaaattcactgagtgccatttttaataacgtcatgaccctatgtgcaatgttacccctgttactgtttacctaccttaactcttttctgcatcaacgaattcctcagtccgtcaggattttggggagtttagtagcgattttgttagtcttcctgataacagcgatactcgtgaaggtgcagctggatgctttgccttttttcgttataacgatgattaaaattgtcttaatcaacagtttcggcgcaattttacaggggtcccttttcggacttgcgggccttctgccagcttcctacacagcacccattatgtccggacaaggccttgccgggtttttcgcctctgtggccatgatctgtgcgatagctagcggtagtgaattgagcgaatctgccttcgggtactttatcactgcctgcgctgtgatcattttgacgattatctgttatctgggacttccccggctagaattttatcgttattaccagcagctgaaattggagggaccaggcgaacaggagactaaactggatctgattagtaagggagaggagccacgcgctgggaaagaggagtctggagtgagtgtgagtaacagccagccaactaatgaaagtcatagtatcaaggccatactcaagaatattagcgtcttagcttttagcgtgtgtttcattttcaccatcacaatcggtatgtttcccgcagtaactgtagaggtcaagtcatctattgccggatcctccacttgggagcggtactttatccctgtaagctgtttcctcacatttaatatcttcgattggttggggagatccttgactgcggtgtttatgtggcctggtaaagactctcgctggctcccatctctagttctggcacgtctggtgttcgtccccttattactcctgtgtaacatcaaacccagacgctacctgacagtggtgtttgagcatgatgcctggttcattttttttatggccgctttcgcctttagcaatggatacctggcaagcttgtgtatgtgctttgggcctaagaaagttaagcccgccgaggccgagactgcaggggccattatggcatttttcttgtgcttgggactggcgcttggtgccgtctttagttttctcttcagagccatcgtgtag

SEQ ID NO: 135194 - DNA, 1371 bp, Artificial Sequence
  Description of Artificial Sequence: Synthetic coding sequence
atgactacgtctcatcagccacaggatagatataaggccgtgtggctaattttttttatgctcggtttggggacactgttaccatggaattttttcatgaccgccacacaatattttaccaatcgtttggatatgagtcagaatgtttccctcgtgaccgccgagctttccaaagatgctcaggccagtgccgctcctgctgcccctttacctgaacgtaactcactgagcgcaatcttcaacaatgtgatgactctatgcgcaatgctgcccctgcttctctttacttatttaaatagctttttacaccaacggatccctcagagcgtacgcatcctaggttcactggtcgccatcctgcttgtattccttatcaccgctatcctggtgaaggtgcagctggatgcattaccatttttcgtgatcactatgatcaaaattgtcctgatcaattcatttggcgccattctgcaagggtcgctattcggcctggccggcctcctccctgcttcctacaccgcccctatcatgagtggacaggggctggccggcttttttgctagtgttgccatgatttgcgctatcgcctcaggatctgagcttagcgaatccgcatttggatacttcattactgcgtgtgctgtaataattctgactatcatttgttatctcggcctacccaggttggaattttaccgatattaccagcaactcaagcttgagggtcctggtgaacaggagactaagttagatctgatcagtaaaggggaagagcctcgcgcggggaaggaggagagtggggtgagcgtcagtaactcacagccaaccaatgaatcacactctattaaggccatactgaagaatatcagcgtgctagcattcagcgtgtgctttatttttacaattacgattgggatgttccccgccgtgacggtggaagtaaaatcatctatcgccggctccagcacctgggaacggtactttatcccggtgtcttgtttcctaacattcaatatcttcgattggctcggacggagcctcaccgcagtgttcatgtggcccggcaaggactctcgatggctgccgagcctcgtgcttgccaggctggtgttcgttcccctgcttctgctgtgcaacattaagccgcgccggtatttgactgttgtctttgagcacgatgcatggttcattttcttcatggcagcctttgcattcagtaatgggtacctcgctagcctttgtatgtgctttggcccaaagaaagtcaagcctgccgaggctgaaaccgcaggtgcaattatggcatttttcctctgtctgggcttagctctgggtgctgttttctccttcttgttccgcgctatcgtctag

SEQ ID NO: 135195 - DNA, 1371 bp, Artificial Sequence
  Description of Artificial Sequence: Synthetic coding sequence
atgactacaagccaccagccccaggacagatataaggccgtatggctgattttttttatgctggggctagggacactgctcccttggaatttcttcatgacagcaacccagtactttaccaaccgcctggacatgtcccagaacgtatcactggtaaccgcagaactttcaaaggatgcccaggcttctgccgcacctgccgcccccctgcccgagcggaattcactgtccgcaatcttcaataacgtgatgacactctgtgctatgctgcctctcctgctctttacctatctcaattcatttctgcatcaacgcattccccagtccgttcgaatcttaggcagcctcgtggctatcctcctggtcttcctcataacggctatcctcgtgaaggtgcagctggacgccctgccgttttttgtcattaccatgatcaaaattgtcctgatcaatagctttggagctatccttcagggctccctctttgggcttgctgggttgcttccagcaagctacaccgcgccaatcatgagcgggcaggggcttgccggattttttgctagcgtggcaatgatttgcgccattgcctcaggaagcgagttaagcgagtccgcttttggctattttattactgcttgcgccgtgattattctcacaatcatttgttatctggggctgccaaggctggagttttacaggtattatcaacagctgaagttggagggacccggcgagcaagaaaccaagctggacctgatctctaaaggggaggagccacgagcaggcaaggaagagagcggggtttctgtgtctaactctcaaccgaccaacgagtcgcattccattaaagccatactcaagaatatctccgtgcttgctttttcagtgtgctttatttttaccataactattgggatgtttccagctgtcaccgtcgaggtaaaaagttccattgctgggagctccacatgggagaggtacttcatacccgtatcttgtttcttaacctttaatattttcgactggctgggacgctcactgacagcagtctttatgtggcccgggaaggattcccgctggctcccttctcttgttctcgctcggttggtcttcgtacctttactattgctgtgcaatataaagcctaggaggtatcttacagtggtgtttgagcacgatgcctggtttatttttttcatggctgctttcgccttctcgaatggttatcttgcttccctgtgcatgtgctttggcccaaaaaaagtcaagccagctgaggcggaaacggctggcgctattatggcttttttcctatgtctgggtctggccttgggtgccgtgttttccttcctatttagggccatagtgtag

SEQ ID NO: 135196 - DNA, 1371 bp, Artificial Sequence
  Description of Artificial Sequence: Synthetic coding sequence
atgaccactagccaccagccccaggatcgctacaaggcggtctggctgatcttttttatgctgggactcggcactctgctgccgtggaatttctttatgacagccacacagtactttacaaacagacttgatatgagtcagaatgtgtcactggtcactgccgagctgtctaaagatgcccaggccagcgccgccccagccgctcccctccccgagcgcaatagcctcagtgccatctttaataacgtcatgacactgtgcgcgatgttgcctctcctgctgttcacctatctcaatagtttcctccaccaaagaatcccccaaagcgtccgtatcctcgggtcactcgtggctatcttgttggtgttcctcatcactgcaatcctagtgaaggtgcagctggatgccctccctttctttgtgattaccatgataaaaatcgtgctaattaactcgttcggagctattctgcagggctccttgttcggcctagctgggctgttgcccgcttcctacacagctcctattatgtctggacagggattggccggtttttttgccagtgttgccatgatttgtgcaattgcctccggttccgagctgtctgagtctgctttcggctactttataacagcatgtgcggtgatcatcctaacgatcatctgttatcttggactgcccagacttgagttttacaggtactaccagcagcttaagctggaagggcccggtgagcaagaaaccaaactggaccttatcagcaagggagaagagccccgagctggcaaggaggaatccggcgtatcggtgtccaatagtcaaccgaccaacgaatcacactccattaaagcgatactgaagaacattagcgtcctagccttctctgtgtgcttcattttcactatcacaataggaatgttccctgcagtgaccgtagaggtgaagagcagtattgccggtagttctacatgggaaagatactttattccagtaagctgctttctgactttcaacatcttcgattggctgggccgctccctcactgcagtattcatgtggcctggcaaggattctcggtggctaccatctctggtattggcgaggctcgtgtttgtccccctgcttttactctgcaatatcaagccacgcagatatctaactgtggtgttcgaacacgacgcctggttcattttttttatggctgccttcgccttctcaaacggatacttagccagcctttgtatgtgttttggaccgaagaaggtgaagccggctgaggccgaaacagctggagccatcatggccttttttctgtgtctggggctggccctaggtgcagttttcagtttccttttcagggcaatcgtctag

SEQ ID NO: 135197 - DNA, 1371 bp, Artificial Sequence
  Description of Artificial Sequence: Synthetic coding sequence
atgaccacgtcacaccaaccccaagatcgctataaggccgtttggctgatcttctttatgctcgggcttgggacactcctgccttggaactttttcatgaccgcgactcagtatttcactaatcgactggatatgtcgcaaaatgtgtctttagtgactgccgaattgtctaaggatgctcaggcttccgcggccccggccgctcccctgccagaaaggaatagccttagcgcaatctttaataacgtcatgaccttgtgcgcaatgctgccactcctcctgttcacctatctgaactctttcttacaccagcgcattcctcagtcagttcgcatactaggaagtctagtggccattctccttgtgtttctcatcaccgcaatcttagtcaaggttcaactggatgccctgcccttctttgtgatcaccatgatcaagatagtcctgataaacagctttggagccattcttcagggtagtctcttcgggctcgcaggcctccttccagcctcttataccgctcctatcatgtccggccaggggcttgccggtttttttgcctcagtggcaatgatctgtgccatcgcctcaggcagcgagctatcagagtccgcattcggctattttataacagcatgtgccgtcatcattttaacgatcatctgctatctgggcctcccacggctggagttctatagatactaccagcagctgaaactggaggggcccggggagcaggagactaagctggaccttatttctaaaggcgaagaaccccgggccggcaaggaagaatctggggtgtcagtatcaaatagccagccgacgaatgaaagtcacagcatcaaagccattctcaaaaatatcagtgtgctggccttcagcgtgtgttttatcttcaccattacgattggaatgtttccagccgtcacagtggaggttaaatccagcattgccggaagctccacttgggagcgctattttataccagtgagctgtttcctgacgttcaatatatttgattggctcggacgctctctcaccgccgtattcatgtggcccggcaaggatagtagatggctacccagcctggtgcttgctcgtctggtgttcgtacctcttctacttctgtgtaatatcaagccaaggcggtaccttacagtcgtatttgaacacgatgcctggttcattttctttatggctgcttttgcctttagcaatgggtacctagccagcctctgtatgtgttttggaccaaagaaagttaaaccagcagaggctgagaccgcaggggctatcatggcctttttcctgtgtctaggactcgcgctgggggccgttttctcctttctctttcgcgccatcgtgtag

SEQ ID NO: 135198 - DNA, 1371 bp, Artificial Sequence
  Description of Artificial Sequence: Synthetic coding sequence
atgacaacctctcaccaaccccaggatcggtataaagccgtgtggctaatcttttttatgctagggctagggactctcctgccttggaactttttcatgaccgcaacccagtactttaccaatcgcctggatatgtcgcaaaacgtttcgctggttacagccgagttgagcaaagacgcgcaggcctctgccgccccagcggcacccctcccagagagaaactccctctccgcgatcttcaacaacgtgatgacactgtgcgctatgttacctctcctgctttttacctatttaaattctttcctgcatcaacgtattccacagtcggtgcggatactaggtagtcttgtggcaatcctcctcgtcttcctgattaccgccatactggtcaaagtgcaactggacgcactgccattttttgtgatcacaatgataaagatcgtgctaattaattcatttggcgccatattgcaggggtcactcttcgggctcgccgggctccttcctgccagttacacagctccgattatgtcaggccaagggctggctgggttctttgccagcgtcgccatgatttgtgccattgctagcgggtcagagctctcagaatcagcctttgggtattttatcaccgcttgcgcggtgatcatcttgactatcatctgttatctgggtctgccccgcctcgaattctaccgctattaccagcaattgaagctggaggggcccggggaacaggagacaaaactcgatctgattagcaagggggaagaacccagagccggaaaggaggagtcaggtgtgtccgttagcaatagtcagccaacaaacgaatcacacagcatcaaggccattctgaagaatatttccgtgctagcatttagtgtctgctttattttcaccatcacaattggtatgtttcccgccgtaaccgtcgaggttaaatctagcatcgctggctcctctacatgggagagatactttatccccgtcagttgcttcctgactttcaacatctttgactggttgggccgcagcttaacagccgtgtttatgtggcccggcaaagattccaggtggctgccttccctggtgttggcacgcttggtgttcgtgcctctgctgctgctgtgcaatatcaaacctcgtcgctatctcacagtagtgtttgagcacgatgcctggttcatcttctttatggccgctttcgcctttagcaacggttacctagcctccctttgtatgtgttttggcccgaaaaaggtgaaacctgctgaggccgagactgctggagcaatcatggccttttttctgtgtctggggttagccctcggggctgttttctcatttcttttccgggccatcgtatag

SEQ ID NO: 135199 - DNA, 1371 bp, Artificial Sequence
  Description of Artificial Sequence: Synthetic coding sequence
atgaccacctcacatcaacctcaggaccggtataaggccgtatggctaatcttttttatgctgggcctcgggaccctgctcccatggaacttcttcatgaccgcaacacagtattttacaaacaggctcgatatgtctcaaaatgttagtctggtgacagctgaacttagcaaagacgctcaggcttcggcagccccagcggcccccctcccggaacgcaattcactatcagctatttttaacaatgtaatgacactctgtgcgatgctgccactgctgttattcacgtatcttaactcctttctgcatcaacgtatcccgcagtcggttcgcatcctgggcagcctcgtggccatcctgcttgtgttcctgattacagcaatcctagttaaagtgcagctcgatgctctgccattttttgttatcaccatgatcaaaatagtgctgattaattccttcggggctattcttcaaggctccctttttggcctcgccggactattgcccgcatcctatactgcccccatcatgagcggccaggggctggccggtttcttcgcttctgtcgcaatgatttgtgccatagcttctgggtctgaactatcggagagcgcttttggatactttattactgcgtgcgccgtgattatactaaccattatttgttatctggggctgccgcggttggaattttaccgatactatcagcagttgaagctcgaaggacctggcgaacaggaaactaagttagacctgatcagcaagggcgaggagccccgggccggaaaggaggagtcaggggtgtcagtaagtaattctcaaccaactaacgagtcacactccattaaggcaattcttaagaatatcagtgtgcttgccttcagcgtatgttttatttttaccatcactatcggcatgttcccagctgtaaccgtggaggttaagagctctatagcgggatccagcacctgggagaggtatttcattcctgtcagctgcttcctgacctttaacatattcgactggctgggccgtagccttactgcagtgtttatgtggcccggaaaggattctaggtggcttccgagcctggtgcttgctaggctagtcttcgtcccgttgctgttgctgtgcaacatcaagcctagacgctatctgactgtagtcttcgaacatgacgcatggtttatcttctttatggcggccttcgccttcagcaacggctatctggcttctctttgcatgtgctttggtcccaaaaaggtgaaacccgctgaagcagagactgcaggagctattatggctttcttcctatgcctgggcctggcccttggcgccgtatttagctttcttttccgcgcaatcgtctag

SEQ ID NO: 135200 - DNA, 510 bp, Artificial Sequence
  Description of Artificial Sequence: Synthetic coding sequence
atgcggcgcgaacgtacacggggtccacaggcatgggagttccccagccctaccaaaagtggatgctcactccagagccttagtcgctacaaggccgtatggcttatttttttcatgctggggttgggtacccttctgccctggaacttctttatgactgctacacagtattttacaaatcggctcgacatgagccaaaacgtcagtcttgtgacagcagagttgtctaaggatgcccaggcttcagctgctccagcggcccctctccccgagcgaaacagcttaagcgccatctttaacaatgtgatgaccctgtgcgcaatgctaccactgttgctctttacttacctaaatagctttttacatcagagaatcccccaatctgttaggatcctgggctccctggtggccatattgcttgtgtttctgataaccgccattttggtgaaggtgcagttagacgccctgccattcttcgtgatcaccatgatcaagatcgtcctgatttag

SEQ ID NO: 135201 - DNA, 1371 bp, Artificial Sequence
  Description of Artificial Sequence: Synthetic coding sequence
atggccaggggagatgcacctcgcgattcttatcatctagtagggatttctttcttcattcttggccttgggaccctactaccttggaatttcttcattacagctataccatacttccaagctcgcctggctggagcaggaaatagcaccgccaggatcctgagtacgaatcacacgggaccggaggacgcctttaactttaataactgggtcacgttgctgagtcagctccccttgctgctgtttaccctcctaaacagttttctttaccaatgcgttcccgaaacagtgcggattctcgggtcactgctcgcaattctgctcctcttcgccctgaccgccgctctagtcaaagtggatatgtcacccggccccttcttctcgattacgatggcttctgtttgtttcatcaattctttctccgcagtcctacagggcagtctgtttgggcagctaggaactatgccatcaacatacagtacactttttctctccggccagggcctggcaggtatctttgccgcactggccatgctcctgagcatggcttccggagtcgatgccgagacctccgctctgggatacttcattacaccctgtgtcggtatactgatgagcatcgtgtgttacctctctctcccgcacctcaaattcgcccggtactatctggccaataagagctcccaggctcaggcacaggagctcgagaccaaggcagagttgctgcagtcagatgaaaatggcattcctagtagcccacaaaaagtagcgctcactctcgatctcgatctggaaaaggagcctgagagcgagcctgatgaaccccagaagcctggcaagccaagcgtttttacagtgtttcagaagatctggttgaccgctctgtgcctcgtgttggtctttaccgtcaccctgagcgtgttcccagcaattaccgctatggtgacttcctcaacaagccccggaaagtggagccagtttttcaatcctatctgttgtttcctgttgttcaatatcatggattggctgggccgtagtcttactagttattttctgtggccagatgaggacagcagacttctaccattgctcgtttgtctcaggttcctcttcgtccctctgttcatgctctgtcacgtcccacagaggtcaagacttcccatcttatttccacaggacgcctatttcattacattcatgctgttatttgcagtctcaaatggatacttagtgagtctcaccatgtgcctggcccctcggcaggtactgccccatgagcgggaggtcgctggggctttaatgacttttttcctagccctcggactttcctgcggagcaagcttaagctttttgttcaaggctctactgtag

SEQ ID NO: 135202 - DNA, 1371 bp, Artificial Sequence
  Description of Artificial Sequence: Synthetic coding sequence
atggccagaggcgacgctcctcgggactcctatcatcttgtggggatatccttctttatactggggctgggaaccctattaccatggaacttttttataacggcaattccttatttccaggcccggctcgctggcgcaggcaacagcacagccaggatcctgtccactaatcacacaggaccagaagatgcgttcaactttaataattgggtaaccctgctctctcagctcccactgttgctgtttacactcctgaactcttttttataccagtgcgtgcctgagacagtgagaatcctgggctccctgcttgccattttgctgctcttcgccttgacagcagctcttgtgaaagtggacatgtctcctggaccgttcttctctataacaatggcttccgtgtgctttattaatagcttcagtgccgtactacagggctcattgtttggtcagctgggcacaatgccatctacctactccaccctctttttgagtggccagggtctggcagggattttcgccgctctggcaatgttgctaagtatggcttcaggcgtcgatgctgaaacatcggcacttggttactttattacaccttgcgtaggcattctgatgagcattgtgtgctacttgagtctcccccacttaaaattcgcccggtactacctggcaaataagtcctcccaagcgcaggcacaggaactggaaacgaaagccgagctactgcagtcggatgagaacgggattccctcatctccgcagaaggtggcactgacccttgacctggacctagagaaggaaccagagtctgagccagacgagccacagaagcccggcaaacctagcgtcttcacagtgttccagaagatatggctgaccgcactttgtctggttctcgtgtttactgtgactctcagcgttttccccgccattactgccatggtgacctcctccacttcccctggcaaatggtcacaattttttaatcctatctgctgtttccttctcttcaatatcatggattggctggggagatcattgacctcatactttctttggcctgacgaagactccagactgcttccactccttgtatgccttcggttcctctttgtgcctctctttatgctttgccatgttcctcaaaggtccagactgccgatcttgttcccccaagacgcttactttatcaccttcatgttactgtttgctgtgagcaatgggtatctcgttagcctgaccatgtgtctggctccaaggcaagtgctgccacacgagcgggaagttgccggggcactcatgacatttttcctggcactggggctgtcatgtggggcgtccttgagtttccttttcaaagctctgttgtag

SEQ ID NO: 135203 - DNA, 1371 bp, Artificial Sequence
  Description of Artificial Sequence: Synthetic coding sequence
atggcgaggggagatgccccccgcgactcttatcacctggtggggatttccttctttatcctgggattgggtactcttctgccgtggaactttttcatcacggccatcccttacttccaggcgcgtttggccggcgctggcaattctaccgctcggattctttcaaccaaccataccggacccgaggacgcgtttaatttcaacaattgggttactttgctctcccaactgcctttgctgctgttcacgctgctgaacagcttcttgtaccaatgcgtgccagagaccgtgcgcatcctcggctcattattggcaatcctcctgctgtttgctcttacagccgcactggtcaaagtcgacatgtctcctggaccatttttttcaatcactatggcgtccgtgtgcttcatcaatagcttctcagcagtcttgcagggcagcttattcggtcaactggggaccatgccgagtacgtactcgacactttttctgtctggccaaggactggccgggatctttgcggccctcgccatgctgctctcaatggcttccggcgtcgatgctgaaacaagcgccttgggatactttatcaccccatgcgtgggaattctgatgagcatcgtgtgctacctcagtctgcctcatttgaagtttgctagatactacttggcaaacaagagctcacaggcacaggctcaagagctagaaactaaagcagagttgctccagagcgatgaaaatggcatcccatcatctcctcagaaggtggctctgacattagaccttgacctcgagaaggagcctgaatcagaaccagacgagcctcagaagccgggcaaaccttcggtctttacagtcttccaaaagatttggttgacagcgctgtgcctcgtattagtgtttaccgtaacactatcagtttttccagcaatcactgctatggtaaccagctccacaagtcctgggaagtggtctcagttcttcaacccaatctgttgttttctgcttttcaatattatggactggctcggccggtcccttacaagttactttttgtggccggacgaagatagcagattgctccccttgttggtgtgtctccggttcctgtttgtgcccctcttcatgctttgccacgtgccacagcgttctagactccctatccttttcccccaggatgcttactttattacatttatgttgctttttgctgtgtccaacggatacctggtgagtctcacaatgtgtctagccccacgccaggtgctgcctcatgaaagagaggtggccggtgcattgatgactttctttctggccctggggctctcatgcggcgcgtcactgtcatttttgttcaaagctctcctgtag

SEQ ID NO: 135204 - DNA, 1428 bp, Artificial Sequence
  Description of Artificial Sequence: Synthetic coding sequence
atggctgtcgtatccgaggacgacttccagcacagcagtaacagtacttatcgaacgacctcctcgtcacttagagctgatcaggaggccctacttgagaagttgctggaccgccccccccctggtctccagcgaccagaagatagattctgcggcacctatataatctttttctcgctgggaatcggctccctcctcccatggaattttttcattacggccaaagagtactggatgttcaagttaaggaactccagctccccagcaactggtgaggatcctgagggtagtgacatcctaaactactttgagtcatatttggcggttgcttccaccgtgccatcgatgctttgcctcgtggctaatttccttctggtcaatcgcgttgctgtccatatccgagtgttagcctcgttgacagttatcctcgccatttttatggtaatcaccgcgctcgtgaaagtggacacctcctcgtggaccagaggcttttttgccgtgacaattgtgtgtatggtcattctctccggcgcgagtaccgtcttttcctccagtatctacgggatgaccggtagcttccccatgcgcaattcccaggcactgatttcaggaggagcgatggggggcacagtgtcagctgttgcttccctcgttgaccttgctgcatcctccgatgtcagaaattcggctttagcattctttctgaccgccacagtgttcctagtattgtgcatggggctttatctgttattgagtagactggaatacgccaggtactatatgcgaccagtgctcgctgcccatgtgttttcaggcgaggaagagctgccacaagatagtttgtccgccccatccgtcgcttcgcggtttatcgactcgcacaccccacctcttcggcctatcctaaaaaaaacagcttcccttggcttctgcgtgacttatgtgttttttatcacttccctcatctatcctgcgatctgcacaaatatcgaatcactgaacaaaggcagcgggagcctgtggacaaccaaattctttattccgttaacaaccttcctgttgtacaacttcgccgatctgtgtgggaggcagttgaccgcttggatccaggtgccaggacctaatagcaaggccttgccaggatttgttctgctgcgcacgtgcctaatcccactgttcgtgctgtgtaattatcagccccgagttcacctgaaaacagttgtttttcagagtgacgtttaccccgcgctattgagtagtcttctaggtttaagtaacggatacctgtctactctcgctttgttgtatggacctaagattgttccacgggagctggccgaggctactggcgtcgtgatgagcttctatgtgtgtttagggctgaccctagggtccgcatgcagcactcttctggtccacctcatttag

SEQ ID NO: 135205 - DNA, 1590 bp, Artificial Sequence
  Description of Artificial Sequence: Synthetic coding sequence
atgtctcaggatacagaggtagacatgaaagaggtggaactcaacgagctcgagccggagaaacagcctatgaacgctgctagcggggctgccatgtcccttgctggcgccgagaaaaacgggctggttaagattaaggtggctgaagatgaggcggaggcggccgctgctgccaaattcacgggcttgagtaaagaggaactcctgaaagtagcagggagcccagggtgggtcagaacacggtgggcattgctgctactgttctggttgggttggctcggcatgctggcaggcgcggtggtgataattgtgagggccccaaggtgcagggagttgccagcacagaaatggtggcataccggtgccctgtatcggataggagatttgcaggcttttcagggtcatggggcaggcaatttggcaggccttaagggccgtctagactacttgagcagcctgaaagtgaaaggccttgtgctgggtcccattcataagaaccagaaagacgacgtggctcagacagacctgcttcagatcgatcctaacttcgggtctaaggaggatttcgacagcctgttgcaatcagccaaaaagaagtcgattcgggtaatcctggacttaaccccaaattaccggggcgaaaatagttggttctccacccaggttgacacagtggcaacaaaagtcaaagacgcactcgaattttggctccaggctggcgtggatggatttcaggttcgcgacattgagaatttgaaggacgcctctagctttcttgctgaatggcaaaacatcaccaagggattttctgaggaccgcctcctaattgccggtaccaatagcagtgatctacaacagatcctgtctctactggaaagcaataaggacctgctgctgactagtagctatctctccgacagcggcagcacaggagagcacaccaagtctctcgtgactcaatatcttaacgccacaggcaatcgatggtgcagctggtcactgagccaggcccggctcctgacctcttttctacctgcacagctcctacgactctatcagctgatgctctttactttgcctggcaccccagtgttctcctacggcgacgaaattggactggacgccgctgctctcccaggacaaccgatggaggccccggtgatgctgtgggatgagtcctcttttcccgacatacctggcgccgtgtcagcaaacatgaccgtgaaaggacagtccgaggaccccggatcactgctgagcctgtttaggaggctttccgaccagcggtccaaggagcgttccctcctgcacggtgacttccacgctttcagcgcgggccctggactgttctcatacatccgacactgggaccagaacgaacggtttctggtggtgcttaatttcggtgacgtgggcttgtccgcagggctgcaagccagcgacttgcctgcctctgccagtcttccggctaaagccgaccttctactgtctacacaacccggccgcgaggaaggctcaccattggaactcgaaaggctcaagctggagccacatgaggggttgttactgagatttccatatgccgcatag

SEQ ID NO: 135206 - DNA, 1707 bp, Artificial Sequence
  Description of Artificial Sequence: Synthetic coding sequence
atggagctccaacctcctgaggccagcatcgccgtggtctcgatccccagacagctcccgggcagtcactctgaagcaggggtgcagggtctgagcgctggggacgattccggcaccatgagccaggacacagaggttgacatgaaggaagtggaattgaacgaactggaaccagaaaagcagcccatgaatgcagccagcggcgccgccatgagcctggctggggccgagaaaaatggccttgtaaagatcaaagtcgccgaggatgaagcggaggcggcagctgccgccaaatttaccggcctgtccaaggaagagctccttaaagtggcaggcagtcctggttgggtgcgaacacggtgggcactgttactcttgttctggctaggttggttagggatgctcgctggggccgtagttatcattgtcagggcgccacggtgtcgggaacttcctgctcagaagtggtggcacacgggtgcattataccggatcggtgacttgcaggctttccaggggcacggtgcaggtaatctggctggactcaagggtcgcttggattacttgagcagcctcaaggtcaaaggcctggtgctgggacctattcataagaatcagaaagatgatgttgctcagacagacctgctgcagatcgaccctaatttcgggagtaaggaggatttcgactctcttttgcagagcgccaaaaagaaaagcatccgcgtaatcttggatctgaccccaaactacaggggcgaaaacagttggttttccacacaggttgacactgtcgccaccaaagtcaaggacgcactcgaattctggctccaggcgggcgtggatggatttcaggtgcgcgatatcgagaaccttaaagatgcctcttcgtttttggcggagtggcagaatatcacaaaggggtttagcgaggacagactactgatcgctgggaccaactcaagcgatctgcagcagatcctgagccttctggaatcaaacaaagacctgttgctgacttcctcataccttagtgactccgggtctacgggggagcacacaaaaagcctcgtcacccagtatttaaatgcgacgggaaatcgctggtgctcgtggtcattatcccaagcccgactgttgacctctttccttccagcccagctgctgcgactgtaccaactgatgctgttcaccctgccggggactccagtcttctcatatggcgatgaaattgggctggacgcagccgctttacccgggcaaccaatggaggcaccagtgatgctttgggacgagtcctcctttcctgacatcccaggcgctgtgagcgccaatatgactgtgaagggccagagcgaggaccccggtagtctcctgagcctgttccggcgtctgagcgatcagagatcaaaagagagatccttgttgcacggcgattttcacgccttttctgccggccctggcctcttcagctatatccggcattgggaccaaaatgagaggttcctagtagtgctgaattttggcgacgtgggcctgtccgctggcctgcaggcatccgaccttcctgcatccgccagcctgccagcaaaagccgacctgctgttgtctacccagcctgggagagaggaagggtcgcctcttgagctggagcgcttaaaactcgaaccacacgaaggcctgctactgcggtttccatacgcggcttag

SEQ ID NO: 135207 - DNA, 1893 bp, Artificial Sequence
  Description of Artificial Sequence: Synthetic coding sequence
atggagctccaaccacccgaggctagcatcgccgtggtgtcgatcccgcgtcagcttcccggctcacacagcgaagcaggcgtgcaggggctttccgccggagatgactccgagttgggaagccattgtgtcgcccagacaggattggagctgttggcctcaggtgatccacttccttccgcatcgcagaatgctgagatgatcgagactggcagcgattgtgttacccaagcaggactccaactgctcgcctcctccgacccaccggccctggcctccaaaaacgccgaggtgactggaactatgagccaggatacagaagttgatatgaaagaggtagagttaaacgagcttgagcctgagaagcagcctatgaacgctgcttctggagccgccatgtctctcgcgggggccgaaaagaatggcctcgtcaagattaaagttgctgaggatgaagctgaagctgctgcagcagccaagttcaccgggctgagcaaggaggaactgctaaaggttgccggaagtcccggctgggtgcgcacacggtgggccttattactgctcttttggttaggctggctgggaatgctggcgggcgcagtggtcatcattgtaagggcacctcgatgcagagagttacccgcccagaagtggtggcatactggcgccctttaccggatcggagatctgcaggcttttcaaggacatggcgcgggtaacctggcagggcttaaggggcgcttggactatcttagcagcctcaaggtcaagggactcgttctgggccccatccataagaaccaaaaagatgatgttgctcagacggatctgttgcagattgacccgaattttggctccaaagaagacttcgatagcctgcttcaaagcgctaaaaagaaatccatcagagtcattctcgatttgacaccgaactatcggggcgaaaattcttggttcagcacccaggtcgacactgtagccacaaaggtaaaggacgcactggaattttggcttcaggctggtgttgacgggttccaagtgcgggatatcgagaacctgaaagacgcctccagctttctggccgagtggcaaaacatcacaaaaggctttagtgaagacagattgctgattgcaggaacaaacagttccgatctacagcagattctgagtctgctggaatctaacaaggacctgctgctgacgtctagttatctttccgactccggatcaaccggggaacacactaagtccttagtgacacaatacttaaatgccacaggcaatcgctggtgtagctggtccctgtcccaagctcgcctgctcacttcatttctcccagctcagctcctgaggctgtatcaactgatgctctttactctccctggcacaccagtattcagctacggcgatgaaatcgggctcgacgcagccgcattgccaggccaacccatggaggctcctgtgatgctgtgggatgaaagctccttccctgacattccgggggccgtaagcgcgaatatgactgtgaagggccaatcagaagatcccgggtctctcttgagtttgttccggaggctgtcggatcagcgaagcaaggaaaggtctttactgcacggcgacttccatgcgttcagtgcagggcccggtctgttctcctatattcgccattgggatcagaatgagagatttctcgttgtactcaacttcggcgatgtcggcctcagcgcaggactccaggcatctgatctacctgcctcggcgtctctgcctgctaaagccgacctgctgctgtctacccagccgggtcgggaggagggctctcctttagaattagagagactcaaacttgaaccccacgagggcctgctcctgcgctttccctatgccgcttag

SEQ ID NO: 135208 - DNA, 1896 bp, Artificial Sequence
  Description of Artificial Sequence: Synthetic coding sequence
atggaactccaaccaccagaagcttctattgccgtcgtgagtatcccaagacaattaccagggagtcacagtgaggccggagtgcagggattgtctgccggggacgacagtgagactggctctgattgtgtgacacaagccggccttcagctgttagcatcctctgatcccccggcactagcctcaaaaaacgctgaagttaccgttgagacaggctttcaccacgtgagtcaagccgacatcgaatttctaacgtccatcgatcccaccgcaagcgcgtctggctcagccgggattacaggcaccatgtcccaggataccgaggtggacatgaaagaagtggagctcaacgagctcgaacctgagaagcagcctatgaatgctgctagcggcgcagctatgtccttagccggggcagaaaaaaatgggttggtgaagattaaggtggcagaagacgaagcagaggccgctgcagcggcaaaatttacagggctgtccaaagaggaactcctaaaagtggccggatcccctggatgggtgcgtacaagatgggccctgctactgctgttctggctagggtggttgggaatgctcgccggggccgttgtcattatcgttagggcgcctcggtgcagagagctgcctgcacagaagtggtggcataccggcgcactttaccgcatcggagatctgcaggcgttccagggccacggcgctggtaacctagccggtctgaaaggccgtctcgattacctgtcctctctcaaagtaaaagggcttgtactgggacctattcacaagaatcagaaggacgatgtcgcgcagactgatttactacagattgatcccaatttcgggtcaaaggaggattttgacagtctgttgcagagcgcaaaaaagaaatctattcgcgtcattctggatctcacccccaattatcgcggagagaactcctggttttcaacgcaggttgacactgtggctactaaggtcaaggatgccttggagttttggctccaggccggcgtcgacggttttcaggtgcgcgacatagaaaatctaaaggacgcaagctctttccttgccgagtggcaaaacatcacaaagggcttctctgaggatagacttttgatcgccgggacgaactcgtcagatctacagcagattctttccttattagaaagtaataaggacctgcttctaactagcagctacctgtctgatagtggctcgactggagagcataccaaaagcttggttacccagtatctgaatgccacagggaatcgttggtgcagctggagcttaagtcaagcccggcttctgacttcattcctgccagcgcagcttctgaggttgtaccagctgatgttgttcaccttacccggcactcccgtcttttcctacggggacgagattgggctcgacgcagctgcgttgcctggccagcctatggaggcccccgtgatgctgtgggacgagtcctcattcccagacatcccaggggctgtctcagccaatatgacagtgaagggtcagtcagaggatcctggaagcctactgagtctatttaggcggctctccgaccagcgctctaaggagcggagtcttcttcatggagacttccatgctttcagcgcgggaccaggcctgttttcatacattagacactgggaccaaaacgagaggtttttggtggtgctcaactttggcgatgtcgggctgtcggcggggcttcaggcgtcagacctgccggctagcgcatccctccctgcaaaagcagatctgctacttagcacacagcccggcagggaggagggcagccctctggagctggaacgcctcaaattggaacctcatgagggtctgttattaaggtttccgtacgccgcatag

SEQ ID NO: 135209 - DNA, 1986 bp, Artificial Sequence
  Description of Artificial Sequence: Synthetic coding sequence
atggaactgcagcccccggaggccagcattgcagttgtgagtatcccaagacagctccccggaagccacagcgaggcaggggttcaaggactctccgcaggcgatgactccgaactaggatcacattgcgtcgcccagaccggactcgagctgctggctagtggagatccattgccatcagctagtcaaaacgctgagatgattgagactggaagcgactgtgtgacacaggcaggcttgcagctgttggcttccagcgaccctccggcactcgcctctaaaaatgcagaagtaactgagaccggcttccaccacgttagtcaggcagacatcgagttcctgacatctattgaccccacggcctccgccagtggttctgcagggatcactggcacgatgtcccaggatacggaagttgacatgaaggaagtcgaactgaacgagttagaaccggagaaacagcctatgaatgctgccagcggcgccgctatgtccttggccggtgctgaaaaaaatggtctcgttaagattaaggtggcagaggatgaagcggaggccgctgccgccgcaaagtttacagggttatctaaagaggagctcctcaaggtggcagggagcccaggctgggtgcgtacaagatgggccctcttgcttctcttctggctgggttggctgggaatgctcgccggcgccgttgttattatcgtgagagcaccgcgctgcagagaacttcccgcccagaagtggtggcatactggggctctttaccggatcggagacctgcaagctttccaagggcatggagctggaaatctggccggcctcaaaggacgccttgactacctcagtagcctgaaggtgaaggggctggtcctgggtcccattcataaaaaccagaaagacgacgttgcacagacggatcttttgcaaattgaccccaactttggctccaaggaggactttgactcattgctgcagtcagccaaaaagaaaagtatacgggttattctggatttaacaccaaactacagaggagaaaactcctggttttctacccaggtagacacggtggccactaaagtgaaggacgctctcgagttttggctgcaggccggcgtcgatggcttccaggttagggacatcgaaaatctgaaagacgctagctcctttctcgccgagtggcagaatattacaaagggttttagtgaagaccgcctcctgatagccggaactaattcgtctgacctccaacagattctctccctgctggagagtaacaaggacctcctccttactagttcttatctgtccgactcaggttcgacgggcgagcatacaaagagcctcgtgactcaatacctcaacgctacaggcaacaggtggtgcagttggtccctaagtcaggcccggttgctaactagcttcttgccagcccagctccttcgattatatcagctcatgctgttcaccctgcctggcacacctgtgttttcgtacggtgacgaaattggactggacgctgctgccctgcccgggcagcctatggaggcacctgttatgttgtgggacgagtccagttttccggatataccaggcgctgtttccgcaaacatgacagtgaaaggacaatcagaagaccccggaagcttattgtcactgtttaggcgactgagtgatcagagatccaaagagcgttccctgctccatggagatttccacgctttttccgccgggccaggactatttagttacattcggcattgggaccaaaacgagaggtttctggtcgtcctgaactttggagacgtcggtctgtctgcaggattgcaagccagcgatttgcctgccagcgcctccctacctgccaaagccgatctgctcctcagtacacagccaggtagagaggaaggctcaccccttgagctcgagcgcttgaagctggaaccccatgagggtcttttgctgagatttccatatgccgcctag

SEQ ID NO: 135210 - DNA, 1536 bp, Artificial Sequence
  Description of Artificial Sequence: Synthetic coding sequence
atgtcccaagatacagaagtggatatgaaggaggtcgagttgaatgagttggaacccgagaaacagcccatgaatgctgcttccggcgctgccatgagcctagccggagccgagaaaaatggcctggtgaaaattaaagtagctgaggatgaagcagaagcagcagcagcggccaagtttaccggactaagtaaagaggaactgctgttttggctgggctggctgggtatgctcgctggcgctgttgtgatcattgtgagggccccacgatgtcgcgagctgcctgctcaaaaatggtggcacacgggcgctctctacagaattggcgatctgcaagccttccaggggcacggagccggtaatctcgccggcctgaaaggacgacttgattacctgagcagcttgaaggtcaagggactggtcctcggtccgattcataagaaccagaaagatgatgtggcccagactgatctgctccagatcgaccctaacttcgggtccaaggaagattttgatagtctgttgcaaagtgctaaaaaaaagtccatcagggttatactggaccttacccctaactaccggggcgaaaactcctggttttctacacaggttgacacagtggcgacaaaggtcaaggacgctctagagttctggctgcaggctggggtcgacggatttcaagtccgggacattgagaacctgaaggatgcatccagtttcctggctgaatggcagaacattaccaagggattctcggaggatcggctcttaatcgcaggcactaactcatccgatttgcagcagatcttaagcctgctcgaaagcaacaaggacctgctcctgacgagcagctacctgtcggactctggatcaacaggcgaacataccaaatcattggttacccagtacctcaatgctacagggaaccggtggtgttcctggtctctatctcaagcacggttactgacaagtttcctgccggctcagttgctacgcctgtatcagctcatgttattcaccctgcctggcacaccggtgttctcttacggagacgagatcggcctggacgcagcagccctcccaggccagcctatggaggctccagttatgctttgggacgaatcaagctttcccgatattcccggcgccgtgagtgctaatatgaccgttaagggccagtccgaagaccccggctctcttttgtctcttttcaggcgcctcagcgaccaacgcagcaaggaacgcagtttgctccatggagatttccacgccttctccgcgggtcctggcctattttcctatatccgccactgggatcagaacgagcgttttttagtggtgctcaattttggtgatgttgggctctcagccggcctccaggcatccgatcttcctgctagtgctagcttacccgctaaagcagatctcttgctctcaacacagccgggccgggaagagggaagcccactcgaattagaacgccttaaactggagccccatgaagggctcttgcttagattcccctatgccgcctag

SEQ ID NO: 135211 - DNA, 408 bp, Artificial Sequence
  Description of Artificial Sequence: Synthetic coding sequence
atgtcacaggacactgaggttgacatgaaagaggtcgaacttaacgaacttgaacccgaaaagcaacccatgaacgctgcctcgggagccgccatgtctctggcgggcgctgagaaaaacggcttagtgaaaatcaaagtggctgaggacgaagctgaggccgctgccgcagctaagttcacagggttaagtaaggaagaactacttaaagtagcagggtcccctggatgggtcagaacgcgctgggcgctgctgcttctattctggctgggatggctcggcatgcttgctggggccgtagtgattattgttagagcccctcggtgtcgagagctgcctgcccagaaatggtggcatactggggccctctaccggattggggacctccaggcttttcagggccactag

SEQ ID NO: 135212 - DNA, 2058 bp, Artificial Sequence
  Description of Artificial Sequence: Synthetic coding sequence
atggccgaagataaatcgaagcgcgacagcatcgagatgtctatgaaagggtgccagaccaacaacggatttgtgcacaacgaggacatcctagagcaaacacccgatccagggtccagtacggataacctcaagcatagcacccgggggattctaggatcccaggagcctgatttcaagggcgttcagccttatgcaggcatgccgaaggaggtgttgtttcagttctccggccaggccagataccgcatcccccgagagatcctcttttggctgacagttgctagcgtgcttgttctcattgccgcgaccatagccatcatcgctctctctccaaagtgtcttgattggtggcaggagggacctatgtaccaaatctacccaagatcctttaaggactctaataaggatggtaacggcgacttaaaggggatccaggacaaactggattatattactgcactgaacattaagacagtgtggatcaccagcttttataaaagcagcctgaaagactttcgatatggagtggaagactttagggaagtggaccctatttttggcacaatggaggactttgagaatcttgttgccgcgatccacgataaggggcttaagctcattatcgacttcatcccaaatcatacctccgacaaacacatctggttccagctttccagaactaggactggcaaatatactgactactatatctggcacgattgtactcatgaaaatggcaagacgattcctccgaataattggctctccgtgtacgggaacagcagctggcactttgatgaagtgagaaaccagtgttatttccatcaattcatgaaggaacagcccgacctaaattttcgaaatccagacgtccaggaggagataaaagagatccttagattctggctgaccaaaggcgtggatgggttctcacttgacgccgtcaagtttttgctggaagctaagcacctgcgagacgagatccaggtgaacaagacccaaatcccggataccgttacccagtattcagagctgtatcatgatttcaccaccacccaggtgggcatgcacgacattgttcgctcctttcgccagactatggaccaatactcaactgaaccggggagatataggtttatgggaaccgaggcctatgccgagtccattgacagaaccgtcatgtactacggcttgcctttcattcaggaagccgattttcctttcaacaactacctgtctatgctagacactgtaagtggcaactccgtgtacgaggtgataacctcatggatggagaacatgcccgagggcaagtggcctaactggatgatcggcgggcctgattcctcccgcctgacaagtcggctaggcaaccagtatgtgaatgtgatgaatatgctcctgttcacccttccaggcactcctatcacatactacggcgaggagatcggcatgggaaacatcgtagcagccaacctaaacgagagttacgatattaacaccttaagatcgaaatcacctatgcagtgggataacagttctaacgcggggttttctgaagcctccaatacctggctgcccacaaatagcgactatcacacagttaacgtggacgtccagaaaacacagccacggtccgccttaaagctgtatcaggatttaagtttgttacatgcaaacgagctgttgctgaacagggggtggttttgccacttgcgcaatgactctcattatgtcgtctatacccgtgagttggatggaatcgaccgcattttcatcgtcgttctgaatttcggagaaagtaccctactgaacctccacaatatgattagtggccttccagctaagatgcggatcaggctgagcactaactcagcagacaaagggagtaaagtggatacgtctggcatcttccttgataagggcgagggcctgatttttgagcacaatactaaaaacctgctacacagacagaccgccttccgggacaggtgtttcgtttcgaatcgagcctgctatagcagcgtacttaacatactttatacctcctgttag

SEQ ID NO: 135213 - DNA, 1866 bp, Artificial Sequence
  Description of Artificial Sequence: Synthetic coding sequence
atgaaaaccttttggagtaggcctcggatccagttttcaggacaggcccgctatagaatacctagggaaatactgttctggctgactgtggcaagcgtgctggtgctcatagccgccaccatagcaatcatcgccctctctcctaaatgtctggattggtggcaggaaggtcctatgtatcagatctacccaaggtctttcaaggactctaataaggacggtaacggtgacctgaaaggcatacaggataagttggactacattacagcattgaatatcaagacagtctggatcacttccttttataaatccagtctgaaggacttccggtacggcgttgaagacttccgcgaagtggaccccatattcggcacgatggaggacttcgaaaatctcgtcgcagccatccacgataagggactgaagcttatcatcgacttcattcccaaccacaccagtgataagcacatctggttccaactgagtcggacacgcaccggtaagtacaccgattattacatctggcatgactgcacccacgaaaacgggaaaaccatcccacccaacaactggctctcagtgtatgggaattcttcttggcactttgacgaggtccggaaccagtgttattttcatcagttcatgaaggagcaacccgacctgaacttccgtaacccagacgtgcaggaagagatcaaggagatcttgcgtttctggttgaccaaaggagtggatggcttttccctggatgccgtcaaattcctgctggaagctaagcacctgagagacgaaatacaggtgaataaaacccagattccagatacagttacacagtacagtgagctctaccatgacttcacaacaacacaagtgggtatgcatgatatagttcgctcgttccggcagactatggaccagtactcaaccgagccagggcgctataggttcatgggcactgaagcttacgccgagtccatcgacagaacagttatgtattacggactgccgttcatccaggaagcagatttccctttcaataactaccttagcatgttagacacagtttcaggtaatagtgtgtacgaagttatcacctcatggatggagaacatgccagaagggaagtggcccaactggatgatcgggggccctgatagtagccgcctgacaagcaggctgggaaatcagtatgtcaatgtcatgaacatgctgctctttactctgccaggcacccccataacgtattacggagaggaaatcgggatgggaaatatagtggcagccaatctcaacgagtcctacgacatcaacaccctgagatcaaaaagtcctatgcagtgggataacagttctaatgcagggttctctgaagccagcaatacatggctccccaccaattcggactaccatacagtgaatgtcgatgtgcagaaaacgcagccccgaagcgcactgaaactgtatcaggacctctcacttttacatgcaaatgaactcttgctaaatagaggttggttctgccacttgcgtaacgatagtcactacgttgtctacacacgcgaactcgatggtattgacagaattttcatagtggtgctgaattttggcgagagcaccttactaaacctacataatatgatctccggactccctgcgaagatgcgcattcggctgagtacaaattccgcagacaaggggtcaaaagtcgatacaagtggcatttttctggataaaggagagggtctgatctttgagcacaatactaagaaccttttacaccgccagactgcttttcgagatcgctgctttgtttccaacagggcctgttacagcagtgttctcaacatcctgtatacatcttgttag

SEQ ID NO: 135214 - DNA, 1656 bp, Artificial Sequence
  Description of Artificial Sequence: Synthetic coding sequence
atggctgaagataagtctaagcgggattctatcgagatgtcgatgaagggttgtcagactaacaacggattcgttcataacgaggacattctcgaacagacaccagatccaggttcaagcactgacaatctgaaacattcaacgaggggaattttggggtctcaggagcccgatttcaagggagtccagccttatgccgggatgccaaaagaggtgctgtttcagttttccggccaggcacggtaccgaatccctagggagattctgttctggctgaccgtagccagcgtcctcgtcttaattgctgccacaattgcgattatcgcactgagtcccaaatgtttagactggtggcaggagggtcccatgtaccaaatctatcccagaagcttcaaggatagcaacaaagatggaaacggagacctgaagggaatccaggataagttagactatattacagcactgaacataaagacagtctggatcacctctttctataagtcctcactgaaagatttcaggtatggcgttgaagatttcagggaggtggatcccatttttgggaccatggaagacttcgaaaatctggtggccgccatccacgacaaaggattgaagttgattattgacttcatcccgaaccataccagcgataaacacatatggttccagcttagcaggactagaactggcaagtacactgattactatatttggcacgactgtacacacgaaaatggaaagactatccctcccaataactggctatcggtgtacggcaattccagttggcacttcgacgaagtcaggaaccagtgctatttccaccagtttatgaaggaacaaccagatcttaatttcagaaatccggacgttcaagaggaaattaaggagatcctgaggttttggctgactaagggcgtggatggcttctctctggacgctgttaagtttttgctagaggccaagcacctgcgagatgaaatccaggtgaacaagacccaaatccccgacactgtgacacagtacagcgagctgtatcacgactttaccactacacaggttggaatgcatgacatcgtaagaagctttcgacagaccatggatcaatatagcaccgagccaggaagataccgcttcatgggaactgaggcttacgcggaatcaattgacaggacagtgatgtactatggcctccctttcatccaagaagccgacttcccattcaataactatttgagcatgctggataccgtgagcggtaacagcgtatatgaggtgataacttcttggatggagaatatgcctgagggcaaatggcccaactggatgataggcggcccagatagctccaggcttacctctaggctcggtaaccaatatgtgaacgttatgaatatgctcctgttcacgcttcccggcaccccaatcacctactacggggaagagatcgggatggggaatatcgttgccgctaaccttaatgaatcctatgacataaatactcttaggtccaagtcacccatgcagtgggacaacagctctaatgctggctttagtgaagcgagcaacacctggctgccaactaattctgattatcacaccgtgaacgttgatgtgcttctgcgtcacccatgtagctctgcggtggcctag

SEQ ID NO: 135215 - DNA, 1524 bp, Artificial Sequence
  Description of Artificial Sequence: Synthetic coding sequence
atgggatgctgggggcgaaatcgtggcaggcttctctgtatgctggccctgacatttatgtttatggtcctggaggtggtagtgagccgggttacttcatctctggcgatgttatccgatagtttccatatgctgagtgatgtcctggccctggtggtcgccttggtggccgaacggttcgcacggcgtactcacgccacacagaagaatacttttgggtggattcgcgcagaggtgatgggggcgcttgtcaatgcaatatttttgaccgggctatgctttgctatactcctggaagccatcgaacgtttcatcgagcctcatgaaatgcagcagcccctcgtggttcttggggtaggcgttgctggactgctcgtgaacgtgttgggtctctgcctgttccaccatcacagtggattctcacaggacagtggacatggtcatagccacggggggcatgggcacgggcatggtctgcccaaagggccaagggtaaaatctaccaggccaggctcatctgatatcaacgtcgcgcccggggaacaggggcctgaccaagaagaaaccaatacccttgtggccaatacttccaacagtaacggacttaagctggacccagcagaccccgagaacccgcgttccggggacactgtcgaggtccaggttaacggaaacctggtgcgtgagcctgaccacatggagctggaggaagacagggcgggccagttgaatatgagaggagtgtttctgcatgtactgggagatgcccttggctccgtgatcgtcgttgtgaatgccctggttttttattttagctggaagggttgttctgaaggcgacttttgcgtgaatccgtgtttcccagatccctgtaaagcctttgttgaaatcatcaacagcacccatgcctccgtctatgaggcagggccctgctgggtgctgtatttagacccaaccctttgcgtagtcatggtctgtatccttctttacaccacttatcccctgttaaaagaatccgcgcttatcttactgcagacagtcccgaaacagatcgatatacggaatcttatcaaggaactcaggaacgtcgagggagtggaagaggttcatgagttgcacgtgtggcagctcgccggctcaaggataatcgctaccgcacacattaagtgtgaggatccaacctcttacatggaagtcgcaaagacaatcaaagacgtgtttcacaatcacggcatccacgccactaccattcaacctgagttcgctagtgtagggagtaaatcatccgttgtgccctgtgaactggcttgccgtacccagtgtgccttaaaacaatgctgcggtacgttaccacaagcgccttccggaaaggacgctgaaaaaacgccggccgttagtatctcttgcttagagctgtccaacaatctcgagaagaaaccaagacggaccaaggccgaaaacatccctgcagtcgtgatcgaaattaaaaacatgccaaacaagcagcctgagagttccttatag

SEQ ID NO: 135216 - DNA, 1119 bp, Artificial Sequence
  Description of Artificial Sequence: Synthetic coding sequence
atggaggccaaagaaaagcagcatttactcgacgctagaccagccatccgaagctacaccggcagtctatggcaagaaggggccggatggattcctttgccacggccggggttggacctccaggctatcgaactggctgcacagtccaaccaccattgtcatgcacaaaagggccctgatagtcattgcgaccctaagaagggcaaagcacagagacagttatacgtagcctcagccatttgtttgttgtttatgattggtgaggtcgttggcggctatctggctcatagtttggctgtgatgactgatgctgcccatctgttaactgactttgcgagcatgctcatttccctattctctctgtggatgagctccagacccgcgacaaagaccatgaacttcggttggcagagggccgagattttgggagccttagtttccgtcctgagcatctgggtggtaacgggagttctggtataccttgccgtggagagactcatttcaggtgactacgaaatcgatggcggcactatgcttatcacaagcgggtgtgctgtggccgtgaatatcataatgggattgactttacaccaaagtggccacggccactctcacggcaccactaaccagcaggaggagaacccgtctgtgagggcagctttcatccatgtaattggcgatttcatgcaaagcatgggagtgcttgtcgctgcgtacattttgtactttaaacctgagtacaaatacgtagaccctatctgcacgtttgtgttctcaatacttgtgctcggtactaccctgaccatactccgcgatgttatactggtgctgatggaaggaacacccaaaggggtggatttcaccgccgtgcgagacctgctgctgtccgtggagggcgtcgaggcactgcactccctgcatatctgggcactaactgtcgcccagcctgtgctgtcggtgcacattgccatcgcacagaacactgacgcccaggctgtgcttaaaaccgcatcttccagattgcagggcaagttccactttcataccgttaccatccaaatcgaagattattctgaggacatgaaagactgtcaagcctgtcaaggaccctctgattag

SEQ ID NO: 135217 - DNA, 972 bp, Artificial Sequence
  Description of Artificial Sequence: Synthetic coding sequence
atggaggcgaaagaaaaacagcacctactggacgccaggccagccattagatcctatactggcagcctgtggcaggagggagcaggctggatcccgttgccgaggcctggcttggacctgcaggccatcgaacttgcagctcaatctaaccaccattgccacgcgcagaaaggccctgacagtcactgtgaccctaaaaaaggcaaagcgcagcgccagttgtatgtggcctcggcaatttgtctgctatttatgattggggaagttgtcgagatcttgggagctcttgttagcgtgttatccatttgggtagtgaccggtgttctggtctatctggcagtggagaggctaatatccggggattatgaaattgatggcgggactatgttgattaccagtggctgtgcggtggcggtaaacatcatcatgggtctcacactacaccaatcgggtcatggacacagtcacggcactacgaatcaacaggaagaaaacccttcagtgcgggcagcctttattcacgttatcggggatttcatgcagtctatgggcgtgctggtcgccgcctacattctgtactttaagcctgaatataagtacgtggaccctatatgcacctttgtgttcagcatccttgtcctgggtacaactctgacaattctgagagacgtgattctagtcctcatggaaggcactcccaaaggcgtggacttcacggctgtgagggaccttctgctctcggtagagggcgtggaggctcttcacagtctccacatctgggccctcacagtggctcagccagtcctgtctgtccatattgctattgctcagaataccgatgcacaggccgtgctgaaaaccgcctcatccaggcttcaaggaaagttccacttccatactgtaactatacaaatcgaggattactcagaggacatgaaagactgtcaggcctgtcagggaccctccgactag

SEQ ID NO: 135218 - DNA, 345 bp, Artificial Sequence
  Description of Artificial Sequence: Synthetic coding sequence
atgggacccagacgaaggagccgaaagccggaagcaccccgtagaaggagtccctcacccacacccacccctgggccttctaggcgggggccatcgctgggggccagctctcatcagcactcaaggaggagacaggggtggctcaaggaaattcgcaagttgcagaaatctacccaccttttaattcggaaactaccattctcacgtctcgcagcggaagctttcctggtccatctttttgaggacgcataccttctaaccctgcacgctggtcgcgtcaccttattcccgaaagacgtccagttggccaggagaatacggggactggaggaaggactggggtag

SEQ ID NO: 135219 - DNA, 300 bp, Artificial Sequence
  Description of Artificial Sequence: Synthetic coding sequence
atgccatttcatcactgccacagagatcctttacccccgccagggttaacacctgagcgcctgcacgccaggagacagctatacgctgcatgcgcagtctgtttcgtctttatggccggcgaagtggtcggcggatatctggcccattcattagcgatcatgacagatgccgcccatcttctcgctgacgtgggcagcatgatggggtccctgttctctttgtggctctccactcgccccgccacgcgaaccatgacctttggctggcacagatctgaaacgctcggtgctctggcttag

SEQ ID NO: 135220 - DNA, 723 bp, Artificial Sequence
  Description of Artificial Sequence: Synthetic coding sequence
atgccttttcaccattgtcatcgcgatcccctgcctcctcccgggctgacccctgagaggcttcacgcccgacgccaattgtacgccgcctgcgcagtatgcttcgtattcatggccggggaggtggtcggtgggtacctggcacactcgctggctattatgaccgatgctgcccaccttctggcagatgtaggttcaatgatggggtcactgttctccctttggctgagcacccgccctgcaaccaggaccatgacatttggctggcaccgctccgaaaccctcggagccttagcctctgtggtgagtctatggatggtgacaggcattcttctctacttagctttcgtgagactgctccattctgattatcacatcgagggcggagcaatgctgctgactgcgtcaatagccgtctgcgccaacctcttgatggccttcgtgctccatcaagccgggccaccccattctcatggcagtcgaggtgctgaatacgctccacttgaggaaggtccggaagagcccctccctcttggaaatacgagcgtgagggcggccttcgttcacgtgctcggggaccttctccagagtttcggagtcctcgccgcctcaattcttatttacttcaagccacaatataaagctgcggacccgatttcaacattcctgttttcaatctgtgctctcggttcaacagcgcccacccttagagatgtgctgtag

SEQ ID NO: 135221 - DNA, 1152 bp, Artificial Sequence
  Description of Artificial Sequence: Synthetic coding sequence
atgcgcgttgccgccggagccagaggcgagaacatcgagcatttaaagcttcgcctcgaggcccggccgccaactctactgctcttcaccgagccaagcgagcccctacccgaagaatccaagccagtggagatgccatttcaccactgtcaccgtgaccccctgccgcctccgggactcactcctgagcgactgcacgctcgaaggcaactatacgctgcctgtgccgtgtgtttcgtgtttatggccggcgaggtggtcggaggatacctggcccactccctggcgataatgacagacgctgctcacctactcgccgatgtgggatctatgatgggcagcttatttagcttatggctctccactcgtccagctacgaggacgatgaccttcggatggcaccgaagcgagacactcggcgctttagcctccgtggtgtcattgtggatggtgacaggcattctcctctatctggctttcgtgcggctcttacactccgactatcatatagagggtggtgcgatgttgttgaccgccagtatcgccgtttgtgccaatctgctgatggcatttgtgctgcatcaggctggacctcctcacagccacggatcacgtggagccgaatacgcacccctagaggaagggccggaggaaccacttccacttgggaatacaagtgttagagccgcgtttgtacatgtgctgggtgatctgctccagagtttcggggttctcgccgcttctattctgatctatttcaagccacaatataaagccgctgatcctatctctacctttttattcagtatctgtgcactggggtctacagccccaaccctgcgggacgttttacgaattcttatggaggggactcccaggaatgtgggatttgagcctgttagagacaccctgctttccgtgccaggagtccgcgctacgcacgagctgcacctgtgggccttgacactaacctaccatgtagccagtgctcacctagccattgatagcactgcagatccggaagcagtcctcgcggaggcctcaagcagactttactcacggtttggtttctcgtcgtgtacactgcaggtggagcagtaccagccagaaatggcccaatgtctgaggtgccaggagcctcctcaagcgtag

SEQ ID NO: 135222 - DNA, 336 bp, Artificial Sequence
  Description of Artificial Sequence: Synthetic coding sequence
atgcctttccaccattgtcacagggatcccctgccccctcccggcctcacgcccgaacggctgcacgcaaggagacagctttatgcagcatgtgcggtttgcttcgtcttcatggccggggaggttgtcggtgggtatttggcccattcactagccattatgacagacgcagcacacttactcgcagatgtaggctccatgatgggaagccttttttccctgtggctttctacacgcccggctacccggaccatgacctttggctggcatcggtccgagactctgggagcactcgcctccgtcgttagtctgtggatggttaccggcattttatag

SEQ ID NO: 135223 - DNA, 1290 bp, Artificial Sequence
  Description of Artificial Sequence: Synthetic coding sequence
atggcgggcagcggcgcctggaaaagactgaagagcatgttaaggaaggacgacgcgcctttgtttttaaatgacacctctgcattcgatttctccgacgaggctggcgatgaaggactgtccaggtttaataagctccgagtcgtggtcgcagatgatgggagcgaagcgcccgagcgccccgtgaacggcgctcatcctaccctgcaggctgatgacgattccctgttggatcaggatcttcctctgaccaattcacagttgagtcttaaggtggatagttgtgacaactgcagtaaacaacgagaaatcctgaaacagcgcaaggtgaaggccaggctcacaatcgcagcagtgctttacctcctcttcatgattggcgaactggtgggcggttacatcgctaattccttagcgataatgaccgacgccttgcacatgctgaccgatctgtcggccattatcctgacacttttagcactctggctttcgtccaagtcacctacaaagcggttcacattcggatttcacaggcttgaagttctttccgccatgatatctgtgctgctcgtatatatcctgatgggcttcctgttatatgaggcagtgcagaggaccatccatatgaattacgagattaacggtgacatcatgttaatcaccgctgcggtcggagtcgcagtgaacgtgatcatggggtttctactgaaccagtccggtcaccggcacagccacagtcactcacttccctctaatagcccaacacgcggctctggatgtgaacgcaatcacggacaggactctcttgcagtgcgagccgcattcgtgcatgcactgggtgacctggtgcagtccgtgggtgtcctgatagccgcctacattatcaggtttaaacccgagtataagatcgcagatcccatttgcacttacgtgttcagcttgttggtggctttcactacgtttagaatcatttgggataccgttgtaatcatcctggaaggagtgccgagtcatttgaatgtcgactacataaaagaggctctgatgaaaatcgaagacgtgtacagtgtcgaggatttgaatatctggagcctaaccagcggtaagtccactgccatcgtgcatattcagctgatccccgggtcatcatccaaatgggaagaggtccaatcaaaggctaatcacctgctcctgaacacttttggcatgtatcggtgtactattcagctgcagtcttaccgccaggaggtggacaggacatgtgccaactgtcagtcaagtagtccttag

SEQ ID NO: 135224 - DNA, 357 bp, Artificial Sequence
  Description of Artificial Sequence: Synthetic coding sequence
atggaagaaaagtacggaggagacgtgctggctggtcctggtggaggcggaggcctgggtcctgttgacgtcccctcggcacgactaacgaagtatatagtgctcctgtgcttcacgaagtttctgaaggccgtcggcctctttgagagctatgacctgctgaaggctgtacacatcgttcagttcatcttcattctgaagctgggaacggcattttttatggtgctctttcagaaacccttctcatctggcaaaacaatcactaagcaccagattattggatctctcaaaattcctgggcgaaaggagttcaaagacaagaagctgaatgatcctcgcaagctggtgggaaactag

SEQ ID NO: 135225 - DNA, 2298 bp, Artificial Sequence
  Description of Artificial Sequence: Synthetic coding sequence
atggaagagaaatacggcggggacgtgctggcaggacctggaggtggcgggggcttgggtcctgtggatgtgcctagtgccagactcactaagtacatagtgctgctgtgctttaccaaattcctcaaggcagtggggctcttcgaaagctacgatctcctaaaggcagtgcatatagtccagtttatatttattctgaagttaggtacagcttttttcatggtgctgtttcagaagcccttcagctctgggaaaactatcaccaagcatcagtggatcaaaattttcaagcatgccgtggccggctgcatcatatcgttactgtggttcttcggcttaactctgtgtggtccattgagaacactgttattattcgaacacagtgacattgtcgttatctcactgctgtccgtgctcttcactagctcgggagggggaccagccaagactcggggcgctgcatttttcatcatcgcggtaatatgcttactactcttcgataatgacgacttgatggccaaaatggccgaacaccctgaagggcaccacgacagcgctttgactcacatgctctataccgctattgcatttcttggagtggcagaccataagggcggcgtcttgctgctggtgctggccttatgctgcaaagttggatttcataccgcctccagaaagctgtctgtcgatgtggggggggcaaagagactgcaagctctttcccatttggtgagtgtcctcctcctctgtccctgggtgattgttttgtcagtgacaacggagagcaaggtcgagagctggttctccctcataatgcccttcgcaactgtaatattctttgtgatgatactcgacttctacgtagattccatatgctctgtaaagatggaggttagtaagtgcgcacggtacggatcctttcctatattcataagcgcgctcctgtttggcaacttttggacacaccccattactgaccagctccgggccatgaataaggccgcccatcaggaaagcactgagcatgtcttgagcggaggggttgtggtaagcgctatattctttattctcagtgccaacatcctcagttcaccttccaagcgcggacaaaaggggacactaattggctattccccggagggtacacccctgtacaactttatgggcgacgcttttcagcatagctctcagagcatcccaaggtttattaaagagagcctcaagcagatcttagaggagtcagacagtaggcagatcttctacttcctatgcctcaatctgctgttcacatttgtggaactattttacggcgtcctcacgaacagtttaggactcatctcagacggattccacatgcttttcgattgttctgcacttgtcatgggtctgtttgcggcacttatgtccagatggaaagccacccgtatcttttcttacggatacgggcgtatcgagatactcagtggcttcattaacggcctgttcttaatagtaatcgctttcttcgtgtttatggaatccgtcgctagattgatagatcccccagagctggacacccatatgctcacgcctgtctctgtaggaggcctgattgtcaatctgatcggcatttgcgctttttcccatgctcactcacacgcacacggagcctcgcagggctcgtgtcattcaagtgaccattcccacagccatcatatgcacggccattcggaccacggacacgggcattcccacgggtctgcgggcggaggtatgaatgctaacatgcgcggtgtattcctgcatgtgctagcagacaccctggggtcaattggagtaattgtttccactgtgctcattgagcaattcggatggttcatcgcggaccccctgtgctcactcttcatagccatcctcatattccttagtgtagtaccattaatcaaggatgcttgccaggtgcttctgcttaggctcccccctgaatatgagaaggaattgcacatcgcactggaaaaaatccagaagatagagggactaattagctatagggatccacatttttggcgccatagtgcttcaatagtagccggcactatccacattcaggtgactagcgatgtactcgagcagcggattgtgcagcaggtgactggaatccttaaggacgcgggggtcaataaccttacgattcaggtggaaaaggaggcttacttccaacatatgagtgggctgtctaccggattccacgacgtgctggctatgaccaagcagatggaaagcatgaagtattgcaaggacgggacctatattatgtag

SEQ ID NO: 135226 - DNA, 1083 bp, Artificial Sequence
  Description of Artificial Sequence: Synthetic coding sequence
atgggggacgcatttcagcactcgagccaaagtatccctcgatttatcaaggagagcctgaagcagatcctggaagagagcgactcaaggcagattttctatttcctttgcttaaatctgctctttacctttgtcgaactcttctacggagtgctcaccaactcactgggcttgatcagtgatggcttccacatgctgtttgactgtagcgccctggttatggggttgttcgcggcccttatgtccaggtggaaagcgacgcgcatcttcagctacggatatggcagaattgagatcctgtcagggttcattaacggtttgttcctcattgtgatcgccttcttcgtgttcatggagtccgtggccaggttaatcgatccacccgaattggacacccatatgttgactccctgccactcacatgcccatggagctagccagggcagctgccacagcagcgatcattcccattcacaccatatgcatggacattccgatcacggccatgggcacagccacgggagcgcaggcggaggtatgaatgccaacatgagaggtgtcttcctacacgtcctggctgatacattagggtctatcggcgtcattgtcagcacggtcctaatcgagcagtttggatggtttattgctgatccactgtgtagtctctttatagccatcctaatattcctctccgttgtccccctgatcaaggacgcgtgtcaggtgctactgctgaggctcccccctgagtacgaaaaggagctgcacatcgccctagagaaaatacaaaagattgagggcctcatctcatatagggacccacacttttggagacattcagcgagtattgtcgctgggaccattcacatccaggtgacaagcgatgtgttggaacagcggattgtccaacaggttactggaatcttaaaggacgccggcgttaacaatctcaccatccaggttgagaaggaggcctactttcagcacatgtcaggcctgagcacaggtttccatgatgtcctcgcgatgaccaaacaaatggagagtatgaagtattgcaaggatggcacatacatcatgtag

SEQ ID NO: 135227 - DNA, 1386 bp, Artificial Sequence
  Description of Artificial Sequence: Synthetic coding sequence
atgggaacgattcacctctttaggaaaccacaaaggagcttttttggtaagttgttgcgcgaattccgcctggtagccgccgacaggcgctcatggaaaatcctgctgtttggagtgattaatctgatatgtacagggtttctgctcatgtggtgctccagcaccaattctatcgccttgacagcctacacttacttgactatttttgacctcttcagcttaatgacatgtctgattagctactgggtgaccctgcggaagcctagtccagtgtattcttttgggtttgagcgattggaggtcctggccgtgttcgcatcaacagtattggcgcagctcggcgctttatttatcttaaaggagagcgcagaacgctttctcgaacagcctgaaatccacacaggtagattactggtcggaacctttgtggctctgtgtttcaacctgtttaccatgctgagtatccggaataagccatttgcttatgtctcggaggccgcctccacctcttggctccaggaacatgtggcagatctgtcgcgcagcctatgtggtataataccaggcctgagcagcatcttcctgcctcgcatgaatccgttcgtattaattgacctcgcaggagctttcgccctttgtatcacttatatgctgattgagattaacaactattttgccgtggatacagccagtgctattgcgatcgccctaatgacatttggaacgatgtatccaatgagcgtctatagcggaaaagtccttttgcagaccacacctcctcacgtgatcggccaactggacaaattaattagggaagtgtccaccctggatggcgttttagaagtgcgtaacgaacacttttggacgctcggcttcggcagtttagctggctcggttcacgtgaggatccggagggacgccaatgagcagatggtcttggcgcatgtgactaatagactatacacgcttgtgtctacactcacagtgcagatattcaaggatgactggatccgcccagccctgctgtcagggcctgtggccgccaatgtccttaatttttccgaccaccatgtgatacccatgccactcttaaagggcaccgacgacctcaatccagtgacttccaccccagctaagccttctagtccccccccagagttctctttcaacactcccggaaaaaatgtcaatccagtcatcttactgaatactcagacaaggccctacggatttggcctcaaccatgggcacactccatatagctcaatgctcaatcaaggactaggcgttcccggcatcggagccacacagggcctgcgcaccggcttcaccaacattcctagtcgttacgggacgaataaccgaatcgggcagccccggccatag

SEQ ID NO: 135228 - DNA, 795 bp, Artificial Sequence
  Description of Artificial Sequence: Synthetic coding sequence
atgaacccctttgtgttgatcgacttggcaggggctttcgcactatgcatcacgtacatgttaatcgaaatcaataactatttcgctgtggacactgcctctgccattgctatcgctctaatgacatttggcacgatgtaccccatgagcgtatattcgggtaaagtcttgctgcagactacccctcctcacgtcattgggcagttggacaaactgatccgcgaagtttcaactctggatggtgtcctagaagtgaggaatgagcacttttggaccttgggcttcgggagcctcgccggctcggttcacgtacgcattcgccgcgacgcaaatgagcagatggtgcttgcccacgtgactaatcgactgtataccttggtgagtaccttgaccgtccagatctttaaagatgactggatcagacctgccctcctgagtggaccggtggccgccaacgtcctcaacttctccgatcaccacgtgatccctatgcccttgctaaaaggaacagatgatctcaaccccgtgaccagcacacccgccaaaccatcttcaccgccgcctgaattctcttttaacacacccggtaagaatgtgaacccagtgattctcttaaacactcagactcgcccatacggcttcggcttgaatcacggccacactccttatagcagtatgctgaatcaaggactaggagttcccggaatcggcgcaacccaaggtctgcggacggggttcaccaatatccctagccgatatggaaccaacaacaggatcggacagcctcgcccatag

SEQ ID NO: 135229 - DNA, 1506 bp, Artificial Sequence
  Description of Artificial Sequence: Synthetic coding sequence
atgggtactatccatctattccggaagccccaaagatccttctttggcaagctactccgcgagttccgtctggtggccgccgacagacgctcctggaagatactgttgttcggagtgattaacctcatctgcaccggcttccttctgatgtggtgcagctccacaaactccatagctctaaccgcctacacctaccttactatattcgatctctttagggacggcgtatctcctttttggctgggatggtcccagaccccagatctgaagtggtctactcacctcggactgccgaagtgctgggacaataggcgggaactgccctgcctaagcaatagcttgatgacctgccttatcagttactgggtaactctgcggaagccttcccccgtgtacagctttggatttgagcgtctggaggtcctcgcagtgttcgctagcacagtgctggcacagctaggagcgctgttcatcctgaaagagtcagctgagaggtttctggagcagcctgaaatacacaccggccgcctgctggttgggacttttgtggccctgtgcttcaacctgttcacaatgttgtcgatcaggaacaaaccttttgcctacgtttctgaagcggcctctacatcttggttgcaggaacatgtggcagatttatccagatcactttgcggaatcattccgggactatcctcaatctttctgcctagaatgaatccatttgtgctaattgacttggctggcgccttcgccctgtgcatcacatatatgctgattgaaatcaacaactattttgcggtcgatactgcttccgcaatcgcgatagcccttatgactttcggcactatgtatccgatgtctgtttatagtggcaaggttctccttcagactacccctcctcacgttatcgggcagctagacaagctgatccgcgaggtgagtacactggacggcgttctcgaggtgaggaatgagcatttctggacgttggggtttggttctctcgccgggagcgttcatgttagaatccgccgggatgccaatgagcaaatggtcctagcccacgtcacaaatcggctgtacactctggtgagcacactgacagtgcagattttcaaggacgactggattagaccagccctattaagcggtccagtcgcagccaacgtcctgaacttcagtgaccaccatgtgatcccgatgcccctgctgaagggaacagacgaccttaacccagtaacatcaacgccggccaagcccagttcaccccctccagagttcagcttcaatactccaggcaaaaatgtgaatcctgttattcttctgaatacccaaacgcgcccctatggatttggtcttaaccatggacacacaccatacagctctatgctgaaccagggactcggtgttccaggtattggcgccacgcagggactgagaaccggcttcacaaatataccttcacggtacggcacgaataatcgtataggccagcccagaccctag

SEQ ID NO: 135230 - DNA, 1164 bp, Artificial Sequence
  Description of Artificial Sequence: Synthetic coding sequence
atgacttgcttgatctcatactgggtcactctccgaaaaccttcacccgtgtacagttttggttttgagagacttgaagtgctggctgtgtttgcaagcaccgtgttggctcaactgggggccctttttatccttaaagagtcggccgaaagattcctagagcagcccgaaattcataccggacgactcctcgtaggtacttttgtagccctgtgcttcaacctgttcacgatgctctctattcgaaataagccttttgcttacgtctccgaagccgcaagtacctcatggctgcaggaacacgtggcggatctttctcgctctctatgcgggataatccctggactgagtagtatttttctcccgcgaatgaatcctttcgttctgattgatctggccggagcttttgccctatgcatcacatatatgctgattgagatcaataattacttcgccgtggacactgcttctgccattgctattgctctaatgaccttcgggaccatgtaccccatgagtgtttactccgggaaagtgttattgcagaccacgcctcctcacgtcatcggccagctggataaattaattagggaggtgagcacgctcgatggcgtgcttgaggtgcgaaacgagcacttctggaccttgggattcgggagcctggcagggagtgtgcacgtacgaatccgcagagacgctaatgagcagatggtgttggcccatgttacaaacaggctttacacactggtgtccacactgaccgtccagatatttaaggacgattggatccggccggcgctgttgtctgggcccgtggccgccaatgtccttaattttagcgaccatcatgtcatcccgatgcctttgctcaaaggcactgatgatttaaatcctgtaacaagcacgcccgccaaaccgagcagtccacccccagagttctcatttaatactcccggaaaaaacgtgaacccagtcattttactgaatacccagactaggccctacgggttcggactgaaccacggtcacaccccctacagttccatgttgaatcagggacttggcgtaccaggcatcggggctactcagggactcaggactggattcaccaacatcccatctcgttatggcaccaacaataggattggacaaccccggccctag

SEQ ID NO: 135231 - DNA, 1317 bp, Artificial Sequence
  Description of Artificial Sequence: Synthetic coding sequence
atgggtacaatccacttgtttcgcaagccacagaggtctttctttggaaagcttctgcgcgaattccgcctcgtggcggctgaccgccgcagctggaagattctgttgttcggtgtcatcaatcttatatgcaccggctttctgcttatgtggtgttctagtaccaatagcattgcactcactgcgtacacatacctgacaatttttgatctcttcagccttatgacctgcctgattagctactgggtcactttgaggaaaccatcacccgtatatagcttcggatttgagagacttgaggtgttggccgtgttcgcctccactgttctagctcaactgggtgccctcttcatcctcaaagagagtgccgaaagattcctggaacaaccagagatccacacgggtaggcttctggtgggcaccttcgtcgccctgtgcttcaacttgttcacaatgctctccatccggaataagccatttgcttatgtgagcgaagctgcgagtacctcatggttgcaggagcacgtggctgacctgtcgcggagtctctgcggaattattcctgggctctcctcaattttcttacctcgcatgaatccatttgtcctcatcgacttagcgggtgcctttgccttatgtatcacctatatgcttattgaaatcaacaattatttcgcagtcgatactgccagcgcaatcgctatcgcccttatgacctttggtaccatgtatcctatgagtgtgtatagtgggaaagttctgctccagacaactcccccccacgttattgggcagctggataaacttatacgggaagccggtagcgtccacgtgagaattcggcgagacgctaatgagcagatggtgctcgcccacgtgacgaatcgcctgtacactctcgtgtccacattgacggtccagatctttaaagatgattggatccggcccgcacttctcagtggaccagtggccgctaatgtgttaaattttagcgaccatcacgtgattccgatgccccttctgaaaggtaccgacgacctgaatcccgtgacaagcactcccgccaaaccctcctctcctcctcctgaattcagctttaacacgcccggtaaaaacgtcaatccagtcatcctgcttaatacgcagacaaggccctacggctttggattgaaccacggtcatacaccatattcttcaatgttaaatcagggcttgggcgtgccaggtatcggcgccacgcaagggctccgcacaggcttcaccaatatcccctcaaggtacggcaccaacaatcgaatcggacaaccccgaccatag

SEQ ID NO: 135232 - DNA, 1299 bp, Artificial Sequence
  Description of Artificial Sequence: Synthetic coding sequence
atgtcgtggaaaatcctgctcttcggagttattaacctcatctgtaccggattccttctgatgtggtgttcttcgactaactcaatcgcactgacagcctacacctacctcacaatctttgatctgttctctttgatgacatgtctgattagctactgggttaccttaaggaagccgagtcccgtctactcctttgggttcgagcgccttgaggtgctggcagtcttcgcatccacagtactcgcacaactcggcgccctgtttattcttaaagagtcagccgagagatttctggaacagccggagatccacacagggcggttgttagtgggtacatttgtggctctctgttttaatctgttcacgatgctgtctattagaaataaacccttcgcgtacgtatctgaagccgcatcaaccagttggctacaggagcatgtggccgatctgtccaggagcttatgtggtatcatccctggcctttccagtattttcctacctcgaatgaatcccttcgtcctgattgatctcgctggggcctttgcattatgtatcacctatatgctgatcgaaataaacaactattttgctgtcgacaccgcttccgccatcgcaattgccctgatgacctttggcacaatgtatcccatgtccgtgtattccggcaaggtgttgctccagactacccctccccacgtcatcggccagctcgataaactgattcgggaggtgagtacgcttgacggcgtgttggaggtgcggaacgagcatttttggacactgggattcggctccctcgccggctccgttcacgtgagaataaggcgcgacgccaatgaacaaatggtgctggcgcatgtaaccaacaggctctacaccctcgtctctactttaactgtgcagatatttaaggacgactggatacgccccgccctgctctccggccccgtggccgccaatgtcttgaacttcagcgaccatcacgtaattccaatgccacttttaaaggggactgatgacctcaatcctgtcaccagcacccccgccaagccatcatcccctccaccagaattcagttttaacactcctgggaaaaatgtaaaccctgtaattctgctcaacacacaaactcgcccgtatggtttcggcctgaatcacgggcacactccatactccagcatgctgaatcaggggcttggggtcccggggatcggtgccacccagggcttaagaacaggatttacaaacattccttctagatatggcaccaacaacaggattggacagccccgcccgtag

SEQ ID NO: 135233 - DNA, 1131 bp, Artificial Sequence
  Description of Artificial Sequence: Synthetic coding sequence
atgctccccctcagcattaaggacgacgagtacaagccccctaaattcaatctgttcggaaagatcagcggttggttcaggtcgatcctgtcagacaaaacttccaggaacctattctttttcctgtgcctgaatctctctttcgcgttcgtcgaactgttgtacggcatctggagcaactgcctgggactcatttctgatagtttccatatgttttttgactcaaccgcaatccttgccggattggctgcttcggtgatcagcaagtggcgggataatgatgcttttagctatgggtatgtacgcgcagaagtgctcgctggttttgtcaacgggctcttcttaatcttcactgctttcttcatattctccgaaggagtcgagcgtgccttagcgccccctgatgtgcatcacgagagactgctgctggtgtcgatactcggcttcgtagtgaatctgattggcatatttgtgttcaagcatggcgggcatggccatagccatgggtctggccacggccactctcactcgctattcaatggggcactggatcaggctcacgggcacgtggaccactgccattcccatgaggtgaagcacggcgcagctcactcgcacgaccatgcacacggacatgggcacttccattcacacgacggaccatccctgaaggaaaccacaggcccatctcgtcagatcctgcagggggtgttcctgcacatcttagcagataccttgggaagtatcggcgtgatcgctagcgctataatgatgcagaatttcggattaatgatcgccgatcctatatgtagtatcctgattgctatcttgattgtggtgtccgtcattcccctgttgcgtgagtcagtaggaatactgatgcaacggacgccaccacttttagagaattcactgccacagtgctatcagcgggtccagcagctccagggcgtctactcattgcaagagcagcatttctggaccctttgttcagacgtttacgttgggactctgaaactgatcgtggcaccagacgccgatgctaggtggatcctcagtcagacgcataatatctttacccaggcgggggttcgacagctctacgtccagatagacttcgcagccatgtag

SEQ ID NO: 135234 - DNA, 273 bp, Artificial Sequence
  Description of Artificial Sequence: Synthetic coding sequence
taggtgattccactgctgcgcgagtccgtggggattttgatgcagcgcacgccgcccctgctggaaaattcacttccgcagtgttatcagcgtgtccaacaactgcaaggagtttacagtctccaggaacaacacttctggaccctctgtagcgacgtctacgtaggaaccttaaaactgatagtggctcctgacgccgatgctaggtggatcctgtctcaaacgcacaacattttcactcagaagttggaggaggagaatgaaaatctgtag

SEQ ID NO: 135235 - DNA, 1131 bp, Artificial Sequence
  Description of Artificial Sequence: Synthetic coding sequence
atgttgcccctatccatcaaggatgatgaatacaagccaccaaaattcaatctgttcggcaaaattagtggctggttccggtctatcctctctgacaaaactagccgtaacctcttcttttttctgtgtttgaacctctcctttgcttttgttgagttactgtatgggatttggtctaactgcctcggcctaatctcagactcgtttcatatgttcttcgactcgaccgcaatcttggctggattggccgccagtgtcatttctaaatggcgggacaacgacgcctttagctatggttatgtgcgagccgaagtgctggctggttttgtgaatggattgtttcttatcttcacggcatttttcatcttctctgagggagtcgagagagccttagctcctcctgacgtccatcatgagcgcttactgctggtgagcatcttagggtttgtagtcaatctgatagggattttcgtgttcaagcacggaggccacggtcatagccacggtagcggtcatggacattcccactccctgttcaatggcgccctggaccaggcccacggccacgtagaccattgtcattcgcatgaggtgaagcacggcgcagcgcacagtcatgatcacgcacatggtcacgggcattttcatagccacgacggaccatctctcaaagagaccacaggacctagcaggcaaatcctccaaggtgtgtttttgcacattctagcagacacgttgggctccataggcgtcatcgcctccgctattatgatgcagaacttcgggttaatgattgccgatcctatctgctcaatccttattgctattctcattgtcgtatccgtcattcctctgctgcgcgagagtgtgggcatcctgatgcagaggacaccaccattactcgaaaacagtctgccccaatgctaccagcgggtccagcagctgcagggggtgtactccctccaggagcaacacttctggaccctgtgctccgacgtgtatgtcggcactctgaagttaatcgttgcccccgacgctgacgctagatggatcttgagtcagacacacaatattttcactcaagcaggggtccgtcaactgtatgtgcaaatcgactttgctgcaatgtag

SEQ ID NO: 135236 - DNA, 963 bp, Artificial Sequence
  Description of Artificial Sequence: Synthetic coding sequence
atgtaccattgccatagcggcagtaagcctactgagaagggtgcaaacgagtacgcctacgccaaatggaagctgtgcagcgcctcagccatctgtttcatttttatgatcgcagaagtggtaggagggcacattgcaggcagcttagcggtggtgactgacgctgctcacttgctgatagatctgaccagcttcctcctatccttgttctcactgtggcttagcagcaagccgccatccaaaagactgacattcggttggcatcgagcagaaatcctgggcgctcttctttctattctgtgcatatgggtggtaacaggtgttctggtgtacttggcatgcgagagactgctatatcctgattatcagattcaagccactgtgatgattatcgtgagcagctgcgccgtggctgcgaatatcgttctgactgtggtactccaccagagatgtcttggccacaatcataaggaagtccaggccaatgccagcgttcgggccgcctttgtccacgctctcggtgatctcttccaatctatctcagtactaatcagcgcgctcataatctactttaagccggaatataagattgctgatcccatctgcactttcatcttctctattctggtgctcgcctctaccatcaccatacttaaagatttttccattttgctcatggagggcgtccctaagtcactgaactatagtggtgtgaaagagctgattttagcggttgatggcgttctgtcagtgcacagccttcacatttggtccctgacaatgaaccaggtgatcctctccgcccacgtcgctacagcagctagccgcgactctcaggtcgtgcgcagagagattgccaaggccctgagcaaaagcttcacgatgcactcgttgacgattcagatggagagcccggtagaccaggacccagattgcctgttctgcgaggacccgtgcgactag

SEQ ID NO: 135237 - DNA, 1110 bp, Artificial Sequence
  Description of Artificial Sequence: Synthetic coding sequence
atggaattcttagagaggacatatctggtgaatgataaagccgcgaaaatgtatgcctttaccctggagtctgtcgagttacagcaaaaacccgttaataaggaccagtgcccacgagagcgacctgaggagctagaatccggcgggatgtatcattgtcactcgggctcaaagcccaccgaaaaaggagctaatgagtatgcctatgcaaaatggaagctgtgctcagcgtcagcgatatgcttcatcttcatgatcgctgaggtggtgggcggtcacatagcaggatcccttgcagtggttacggacgcggctcatttgttgatcgacctgacaagctttctgttgtctctctttagcctctggctgtcctctaagccgccttctaaacgtctgacgtttggttggcaccgcgcggaaatacttggggctttgctctctatcttgtgcatatgggtggtgacaggtgtgttggtgtatctcgcctgcgaaagactcctgtatccggactaccagatccaggccaccgtgatgattatagtatcaagctgcgccgtggcagcaaacattgtgttaacagttgtgttgcatcaacgttgcttagggcataatcataaggaggtgcaggctaacgcctccgtgcgggcggccttcgtccatgcactgggcgatcttttccagagtatttcagtgttaatctcggcgctgatcatttattttaagccagagtacaagatcgcagaccccatttgtacgtttattttttcaatccttgtgctggcctccactattaccattctaaaggactttagcattcttttaatggaaggcgtaccgaagtctctgaattacagcggggtcaaggagttgatattagcggtggatggcgttctgtccgtacactcactgcatatctggtcactaaccatgaaccaagtgatcctgagtgcccacgtcgcgaccgctgcctcccgcgacagccaagtggtacgacgcgaaatcgcgaaggcactgagcaagtcatttaccatgcactcgctgacaatccagatggagagcccagtggaccaggacccagactgcttgttttgtgaagatccctgtgactag

SEQ ID NO: 135238 - DNA, 1458 bp, Artificial Sequence
  Description of Artificial Sequence: Synthetic coding sequence
atgggccgctattcaggcaaaacctgccgtctactgttcatgctcgtgctcaccgtggcattctttgtggcggaacttgtgtccgggtacctgggaaactccatcgcacttttgagcgattccttcaacatgctctctgacctgatcagcctctgtgtgggactcagtgctgggtatatagctcgacggcctacacggggctttagcgcaacttacgggtatgcccgggctgaggtagtgggggccttgagcaacgcggtgttcctcaccgcactgtgtttcacaatttttgtggaagctgtgctgaggctggcccgccctgagcgcatagacgatcccgaactcgtactgatcgtaggggtactggggctgcttgtgaacgtcgtgggcctcctaatctttcaagattgtgcagcctggtttgcgtgctgcctccggggcagatcccgcaggctgcagcagcggcaacagttggcagagggatgcgttcctggcgcttttggcggtcctcagggggcggaggatccgcggcgcgcagcagatcctacggcccctggatcagactccgctgttacactgaggggtacctcagtggagcgcaagagggaaaagggcgccacagtgtttgccaatgtggccggagactcctttaatacccagaatgagcccgaggacatgatgaaaaaggaaaagaaatcagaggccctgaacatcaggggtgttctgctgcatgtgatgggggacgctcttggcagtgttgtcgtcgtcatcacagctatcatcttctatgtgctaccccttaaatccgaagatccgtgcaattggcagtgttacatcgatccttccttaacggttctcatggtgatcattatactgtcttctgcattccccctgattaaggagacggccgcgattctgctgcagatggtgccgaagggggtgaacatggaagagctgatgtctaaattgagtgccgtgccaggcatatcttccgtgcacgaggtgcacatttgggaactcgtcagcggaaagatcattgccacactccacatcaagtatcctaaggaccgggggtaccaggacgcttctaccaaaataagggaaatctttcatcacgcaggcattcacaacgttacgattcagttcgaaaatgtggatctcaaggagcctcttgagcagaaagacctgctgctgttatgcaattctccctgcatctctaagggatgcgcaaagcagctttgttgcccccctggtgctctgccgctggctcatgtgaatgggtgtgctgaacataatggaggccccagcttggacacctacgggtcggatgggctatctcggagagatgctagggaagttgcgattgaagttagcctggattcctgcttgtcagaccatggccagtccttaaataagacccaagaggatcagtgttacgttaatcgcacacacttttag

SEQ ID NO: 135239 - DNA, 723 bp, Artificial Sequence
  Description of Artificial Sequence: Synthetic coding sequence
atgggggacgccctgggcagcgtggtggtcgttattactgccattattttttatgtactgcctctgaaatctgaggacccatgtaattggcagtgttatattgatcccagcttgaccgttttgatggtgatcattatactttcatccgcttttcctttgattaaagagactgccgctattctgctgcaaatggtgcccaagggagtgaatatggaggaactgatgtcgaaactctcggctgtccccggcatcagcagcgtccatgaagtccacatttgggagctggtttcgggcaaaatcatcgcaaccctgcacataaagtatcccaaagatcggggctaccaggacgccagtaccaagatccgggagatatttcaccacgccgggattcataatgtcaccatccagtttgagaacgtggacctcaaagagcctctggagcaaaaggacttactgttgctctgcaatagcccgtgtatttccaaaggttgtgcgaagcaactctgttgtccaccgggagcccttcccctggctcacgtaaacgggtgcgcggaacataacggcgggccttcattagacacctacgggtcagacggactgagccgacgcgatgccagagaggttgccatcgaggtttctctggactcctgtttgtcagaccacgggcagtccctgaacaagactcaggaagatcagtgttacgtaaaccgcacacatttctag

SEQ ID NO: 135240 - DNA, 672 bp, Artificial Sequence
  Description of Artificial Sequence: Synthetic coding sequence
atgggcaggtacagcggcaagacctgccgcctcttgttcatgcttgttctcaccgtagctttctttgtcgctgagttagttagcgggtacttgggcaactcgatcgcgctgctgtccgattcttttaacatgctgtccgacctgatttccctgtgtgtcggcctgagtgctgggtacatcgcacggcggccgacccgggggttctcggccacttatggatatgcacgggcagaagtggtaggtgccctgtcaaatgcagtcttccttacggccctgtgtttcacaattttcgttgaggcagttctgcgattagcccggccagaaagaatagacgaccctgagctggtcctgattgtgggtgtgctcggtctcctcgtaaacgttgttggactgctgatcttccaggactgcgccgcctggtttgcctgctgcctcagaggtcgtagcaggaggttacagcagaggcagcaactagccgaggggtgcgtacccggcgcttttggtgggcctcagggagctgaagatccaaggagggccgcagacccaaccgcaccagggtcggactctgccgtcacactaagggggacatccgtcgaacgaaaaagagagaagggtgccaccgtgttcgctaacgtagccgagctcattcataatactaggtttctgctgtag

SEQ ID NO: 135241 - DNA, 567 bp, Artificial Sequence
  Description of Artificial Sequence: Synthetic coding sequence
atggaccactcacaccacatgggcatgtcttacatggattccaattccactatgcagcccagccaccaccacccaaccactagcgcatctcactcccatggtgggggagactcttccatgatgatgatgccaatgaccttctacttcggcttcaagaatgtcgaactcctcttttccggcctcgttatcaacaccgcaggggaaatggccggagcatttgtcgcagtgttcttgctcgcgatgttctatgaaggcctgaaaattgctcgggagagcttgctcaggaaatcccaggtgagcattaggtacaatagcatgcccgtgcccggcccaaacggaaccatcttgatggagactcacaagacagtgggccaacagatgctgagctttcctcatctcctccagacttgctgggactacagacatgaaccccctcacttaagtttaagtccttcatactactcggatcttaattaccctaaaaaagctaaggtgctgctccgcgtatccgtggaattaatgatccaggaggcattaatgatcaccgccggcgattccctctgttag

SEQ ID NO: 135242 - DNA, 573 bp, Artificial Sequence
  Description of Artificial Sequence: Synthetic coding sequence
atggaccacagtcaccatatgggaatgtcctatatggatagcaacagtactatgcagccctcccaccatcatccgacgacctcagctagccactctcatggcggcggggactcatcaatgatgatgatgcctatgactttctatttcggattcaaaaacgtagagctcttattcagcggactggtcatcaataccgctggggagatggctggggccttcgtcgcagtctttcttctagcgatgttttacgaagggttgaaaatcgcccgcgagtctctcctgcggaagagtcaggtgagcatcaggtacaatagtatgcccgttccaggccctaatggaaccatacttatggagacccacaagacggtcggccagcagatgctgtcttttcctcacctgctccagacagttctgcatatcatccaagtagtgatctcatatttccttatgctgattttcatgacatacaacggctacttgtgtatcgctgtcgcagctggggctggcacaggttacttcctattcagttggaagaaagccgtggtcgttgacatcactgagcattgtcactag

SEQ ID NO: 135243 - DNA, 432 bp, Artificial Sequence
  Description of Artificial Sequence: Synthetic coding sequence
atggctatgcacttcattttttccgataccgcggtgttactgttcgacttttggtccgtccattcacctgccggcatggccctgagcgtgctggtcctgttacttctggcagtgttatatgaaggtataaaagtggggaaggccaagctgctcaatcaggtgctagtcaatctgccaacgagcatctcgcagcagactattgctgagaccgacggcgatagtgccggatccgatagcttcccggtgggtcggacccatcaccgatggtacctgtgccactttggacagagtctaattcatgtcattcaggtagttattggttacttcatcatgctggccgtgatgtcgtataacacttggatttttctgggcgtagtgctgggcagtgccgttggctattatctggcctaccctctgttgagcacggcttag

SEQ ID NO: 135244 - DNA, 1650 bp, Artificial Sequence
  Description of Artificial Sequence: Synthetic coding sequence
atgtcgcctacaatcagccataaggatagttccagacagaggcgccccggaaatttttcccactcactggacatgaagagtggacctctgccgcccggcgggtgggacgattcccacttggatagtgctggtagagaaggcgatagagaagccctgctcggggacacaggaaccggcgactttctgaaggccccacagtcattccgtgccgagctgagctcgatcctgctgcttttatttctgtacgtgttgcagggtattccgctcggtctggccgggtcaatccccctcattctgcagagtaaaaacgtgagctacactgaccaagcattcttctcctttgtattttggccgtttagccttaaacttctgtgggctccactggtggacgctgtttacgtgaagaactttggccgaaggaaatcatggcttgtccccactcaatacatcttgggtctatttatgatttacctgtccacacaagtggaccgactgctgggaaacacagacgacagaacgcccgatgtcatcgctctaaccgttgcattctttttattcgaatttttggccgccacccaggacatcgctgtcgacggctgggctctcaccatgctctctcgagagaacgtgggctacgcaagcacttgcaactcagtgggacagacagcgggttatttcctgggaaacgtgttattccttgccttagagtcagctgatttctgtaacaaatatttgcgattccagccccagcccagaggtattgtgaccctgtccgacttcctctttttttgggggaccgtattcttgattacaaccacgctggtcgctcttctcaagaaggagaatgaggtgtcagtggtgaaagaagagactcagggtattactgatacctacaagctgctgttcgcaatcattaagatgccagctgtgctgacgttctgtttgctgatcctcactgctaagattggtttttctgctgctgacgcagttactggtctgaagctcgtcgaggaaggagtcccaaaggagcatctggcgctgctggccgtcccgatggtgcccctgcaaatcattcttcctttgattatatccaagtacactgctggccctcagccactgaatacattttataaagccatgccttatagactgctgctgggcctcgagtacgctctgcttgtgtggtggacaccgaaggtggagcatcagggagggtttccaatctactattacatcgtggttcttctgagttatgccttacaccaggttaccgtgtacagcatgtacgtatccatcatggcatttaacgctaaagttagcgatcctctgatcgggggaacctacatgactttgttaaacaccgtgtcgaacctaggaggaaattggcccagtaccgtagctttgtggctcgtcgacccacttactgtaaaagagtgcgtaggagcaagcaatcagaactgccgtacacccgacgctgtggagctgtgcaagaagttagggggttcttgtgtgaccgcacttgatggctattatgtggagagcatcatttgcgtcttcatcggttttggttggtggtttttcttgggccccaaatttaagaagcttcaggacgaggggtcatcctcttggaagtgcaagcgtaataattag

SEQ ID NO: 135245 - DNA, 1650 bp, Artificial Sequence
  Description of Artificial Sequence: Synthetic coding sequence
atgtcccccacaattagccacaaggattcttctcggcaacgaagacccggcaactttagccacagtctggatatgaagagtgggccgttgccgccaggaggatgggacgatagccacctggatagcgccggcagggagggagaccgggaggcgttgcttggcgacaccggtaccggcgacttcctgaaggcaccacaaagtttcagagcggagctttcttcaatattgttactcctttttctatatgtcttgcaggggatccctctgggcctcgctgggagcattcccctcatcctgcagtcaaagaacgtcagctacaccgatcaggcgtttttttccttcgtgttctggcccttctcgctcaagctgctctgggccccattggtggacgcggtatacgtcaagaactttggacgtaggaagagctggctggtgcctactcagtacatcttgggcctattcatgatctacctttcaacacaggtggacagactgctcggaaacacagatgatcgaacacctgacgtcattgcacttaccgtggcctttttcctcttcgaatttttggcagcaacccaggacattgctgtggatggttgggccctgaccatgctgagcagggaaaacgtcggatatgcaagtacttgtaattcagtcggacagaccgccggatacttcttgggtaatgtgttgttccttgccttagaatccgccgacttctgtaataagtacctcaggttccagccgcagcccagaggcatcgtcacactcagtgactttctatttttttggggcaccgttttcctcataaccactactctagtcgcattactgaaaaaagagaatgaggtgtcggtggtgaaagaggaaacacaggggatcaccgatacatacaagctacttttcgccatcatcaagatgcccgccgtgctcacgttttgtctgctgattctaacggctaaaattggcttctcagcagcagacgccgtaacaggccttaagctggttgaagagggcgtgccaaaggagcacctagcattgctggccgttcccatggtcccactgcaaattatcctgccactcattatttctaagtacacagctggaccacagcccctgaacaccttctacaaagcaatgccttaccgcctcctcttagggctggagtacgcactcttggtgtggtggactcccaaggtagaacaccagggcggattccctatttattactacatcgttgttctcctgtcttatgccctccatcaggttacggtctattccatgtacgttagcattatggccttcaatgcaaaggtatctgaccctctgattggagggacctacatgacactattgaatactgtctccaatctcggcgggaattggccatctactgtggcgttatggctggtggatccattaacagttaaggagtgtgtgggcgccagcaatcagaattgcagaacccccgacgccgtggaactgtgtaaaaagctcggaggatcttgtgttacggcactcgatggctattacgtggagtccataatatgtgtatttattgggtttggttggtggttcttcctcggaccaaagtttaaaaagctgcaagatgaaggctccagtagctggaaatgcaagcggaataattag

SEQ ID NO: 135246 - DNA, 1920 bp, Artificial Sequence
  Description of Artificial Sequence: Synthetic coding sequence
atgctttcttacggtgagcggctaggctctcctgccgtgtctcctttgccagtgcgagggggacacgtgatgcgtggaaccgcctttgcctatgtgcctagcccgcaagtgctgcaccgtattcctggtactagcgcctacgccttcccctccttaggaccagtagcactggcagagcacacttgcccctgtggcgaggtgctggaaaggcatgagccgctcccggctaagctggcattggaggaggaacagaagccagaatcgcggctcgtgccaaaacttaggcaggccggagcgatgctgctgaaggtccccctgatgttaacgttcctgtacctatttgtgtgctcactggatatgctcagttccgcctttcaactggccgggggcaaggttgcaggcgatatctttaaggacaacgcgatcctgtccaaccctgtggcaggcctggtcgtcggtatcctggtgactgtgctggtgcagtcatcgtcaacaagtaccagtatcatagtgagtatggtgagctcaggtctcctggaagtatcctcagctatccctattattatggggtccaatatcggcacctcggtgacaaacacgatcgtagccctcatgcaggccggagatcggaccgactttcgtcgcgcgtttgctggagctacagtgcatgactgttttaattggctttcagtcctcgtattactccctttagaggccgcaacaggctacctgcaccacattacacggctcgtcgtggcttcatttaatatccacggaggcagagatgccccagacttgctgaagattattactgagcctttcaccaagttgatcatccaattagacgaaagtgtcatcacatccattgccactggcgacgagagtttgagaaaccattcactgatacagatatggtgccacccagactccctgcaggcccccacatctatgtctagggccgaagcgaactcctcccagacattgggcaacgcaactatggagaagtgtaatcatatttttgtggataccgggcttccggacctggctgtgggactcatcttacttgccgggtcacttgtgctgctgtgtacatgcctgattttgctggtgaagatgctcaactccttgctaaaggggcaagtggcgaaagtaatacagaaagtcatcaataccgatttcccggcacctttcacttgggtgaccggttatttcgcgatggtggtgggggctagcatgactttcgttgtccagtcttcctctgtgttcacatctgccataacccccctcatcggtctaggggtaatcagcatagagagagcctaccctctgacactcggaagcaatattggcacgaccaccacggctatcctggccgcactggcttctcccagagagaagctttcttccgctttccaaatcgccctctgtcacttctttttcaacatcagtggtatcctgctttggtaccccgtgccatgtacgcgcctgcctatcagaatggcaaaggcgttgggaaagcgaaccgcaaagtaccggtggtttgctgttctgtacctgctagtgtgcttcctgctgttacccagcctagtttttggcatttctatggccggatggcaggttatggttggtgttggaaccccttttggagctcttcttgcctttgttgtgctgataaacgtactgcagagtcgctcacctggtcatctgccgaaatggctacagacatgggacttcctgcccagatggatgcatagccttaagcctttggaccacctgattactagggccacactgtgctgtgctaggccggaacctcgttctcctcccctgccacccagggtctttcttgaagagcttccgcctgccaccccaagcccgagactggctctgccagcccatcacaacgctacccggctgtag

SEQ ID NO: 135247 - DNA, 330 bp, Artificial Sequence
  Description of Artificial Sequence: Synthetic coding sequence
atgctgtcctacggcgagcgccttgggtcccctgcagtaagtccacttccggtcagaggaggacatgtgatgcggggtaccgccttcgcctatgtgccttcgcctcaggtgctgcacagaattccaggcacaagcgcatatgcatttcctagccttggaccagtggcattagctgaacatacctgcccatgcggcgaagtgcttgagcgccatgagcctctgccagcaaagttggccttggaggaggagcagaaaccagagtcccggctggttccaaaactgaggcaagctggtgcgatgttactgaaggtgccccttatgctcacgtag

SEQ ID NO: 135248 - DNA, 1023 bp, Artificial Sequence
  Description of Artificial Sequence: Synthetic coding sequence
atgctatcatacggcgaaaggctggggtctccagccgtcagcccactcccggttcgaggaggccacgtcatgcgcgggacggcttttgcctatgtgccttctccccaggtgctccacaggatccccggtaccagcgcatacgctttcccctctcttggacctgtggccctcgctgagcatacgtgcccctgtggggaggtcctggaaagacatgagccgttgccggctaagctagctctcgaggaagaacagaagccagagagcagactggttccaaaactgaggcaggcgggagcaatgctcctgaaggtgccattgatgctcacatttctttacctttttgtatgtagcctagatatgctctcctccgccttccagctggcaggcgggaaagtggccggagacatctttaaggataatgccattctgtcgaacccagtcgcaggactcgtggtcggaattctcgtcacggtgctggtacagtcatctagcactagcaccagcattattgttagcatggtaagtagcggcttactggaggtgtcttccgctatccccattattatgggctctaacattggaacctccgtgaccaatactatcgttgctctaatgcaagccggggataggaccgatttcagacgagccttcgcaggtgcgacagttcacgattgtttcaactggctctcggtactggtgttacttcctctggaagccgccaccggatatcttcaccacatcactcgattagtggtggcctcctttaacatccacggtggacgagatgcccccgacttgctcaagattattacagagcctttcactaagcttatcatacagttggacgagtccgttatcacttcaattgccactggtgacgagtccctgcgcaaccacagtcttatacaaatctggtgtcatccagattctctgcagcagaacctggaaggccgggaaattacgcattttgacttacgcaagaagcaggctatggaagattcaagcgtaccacactgtccctag

SEQ ID NO: 135249 - DNA, 2073 bp, Artificial Sequence
  Description of Artificial Sequence: Synthetic coding sequence
atggctccctggcctgagcttggtgatgcacagccaaatcccgataagtatctggagggtgccgccggccagcagccaacagctcccgacaaaagcaaggagactaacaaaacagataacacggaggcgcccgttactaagatcgagttacttcctagctattcaactgccacgcttatcgatgaacctactgaggtcgacgacccttggaacctgccaaccctgcaggactctggtatcaagtggagcgagcgagacacaaaggggaagatcctgtgtttctttcagggaataggaaggctgatcctcctgctgggcttcctatactttttcgtctgttcactggacattctttccagcgcattccagctggtagggggcaaaatggctggtcaatttttcagtaacagtagcatcatgagcaatccccttctgggtctcgttatcggggtgctggtgactgtactagtccagtcgtcctccaccagcactagcatagtcgtttccatggtgtcgtcttcactgctgacggtccgagcagccatcccaattatcatgggagctaacattggaacttcaattacgaataccatcgttgcgctgatgcaggttggcgaccgcagcgagtttagacgggcatttgcaggggccaccgtgcacgactttttcaattggctgtccgtcctcgtcctcttgccagtggaggtggctacgcattacctggaaattattactcaactgattgtggaatcctttcacttcaaaaatggcgaggatgctccagaccttctcaaggtcataacaaagccattcacaaaactgattgtgcagctggacaagaaggttatttctcagatcgccatgaacgatgaaaaagctaagaataaaagcctggtaaagatctggtgtaagacattcacaaacaaaacacagatcaatgtgacagtgccctctactgccaattgcacaagccccagcctatgctggacagatgggattcagaattggaccatgaagaatgttacgtataaggagaacattgccaagtgccagcacattttcgttaatttccatttgcccgacctggccgttggcacaatcttactgattctatccctcttagtattatgtggctgccttatcatgattgtgaagattctggggtcagttctgaaaggccaagtcgcaaccgtgattaaaaagaccatcaataccgacttcccattccccttcgcttggttaacaggatatcttgctattctcgtgggcgccggcatgacattcattgtgcaaagcagctcggtgtttactagtgccttgacgccactcattgggatcggcgttatcacaatcgaacgggcctatccacttaccctcgggtcaaacatcggtaccacgacaacagctatcttagccgctctggcttcacccggcaatgcgcttagatcatcattgcagatagctttgtgccattttttcttcaacataagcgggatccttctgtggtacccgatcccttttactaggctacccatcagaatggccaagggtctgggcaatattagcgccaagtatcgctggttcgcagttttttatctgattattttctttttcctgattccactgacggtgtttggtctttccttggccggatggcgggtcctggtgggagttggagtacctgttgtgtttatcatcatcttggtgctgtgtctgcggctccttcagtcgcgctgcccccgcgtcttacctaagaagctccaaaattggaattttctcccgctctggatgaggtcactgaagccttgggatgcagtggtaagcaaattcactggttgctttcaaatgcgttgttgttgctgttgcagggtgtgctgtcgggcctgttgcctcctgtgtgattgccctaaatgctgcaggtgtagcaagtgctgtgaggatctggaagaggcacaggaaggccaagatgttccagtgaaggcgcccgagaccttcgacaacattacgatttctcgcgaagcccaaggggaggtacctgcttctgacagtaagactgagtgtactgccctttag

SEQ ID NO: 135250 - DNA, 2070 bp, Artificial Sequence
  Description of Artificial Sequence: Synthetic coding sequence
atggccccttggccagagctgggagatgctcagcccaacccagataagtatttggagggggccgctggccaacaacccactgcaccagataaatctaaggagaccaataagaacaatacagaggctcccgtgactaaaatcgagctgttgcctagctattcgaccgctacactgattgacgaacccaccgaggtggatgatccttggaacctgcctactctgcaagacagcgggatcaagtggtctgaaagagatacgaagggaaagattctatgcttctttcaaggtattgggaggctgattctgctcctgggtttcctctacttctttgtgtgcagtttggacattctttcaagtgccttccagctcgtgggcggtaagatggctgggcagtttttcagcaattcctcaatcatgtccaatccactactaggactcgtgattggagtgctcgtcaccgtattggtgcagagttcatccacaagtacaagcatagtggtgtccatggtgtcttcttcactcttaacagtgagggccgccatacccatcatcatgggcgctaatatcggaacaagtatcactaacacaattgtcgcactcatgcaggtgggagaccgctccgagtttagacgagcttttgctggggctacagtgcatgatttctttaattggctgtcagtgctcgtgttactacctgtagaagtcgccacacattatctcgaaattattacacaattgattgtggaatcattccattttaagaacggggaggacgcccctgacctacttaaagttattaccaaacccttcactaagctgattgtgcaactggacaagaaggtgatctctcagatcgccatgaacgatgagaaggctaagaataagtctctcgttaaaatatggtgtaagacgtttactaacaagactcagattaatgttaccgtgccctctaccgctaactgtacgtccccgtccttatgctggacagatggaattcaaaactggacaatgaaaaacgttacctataaggagaatattgccaaatgtcagcatatcttcgtgaatttccaccttcccgacttggccgtgggcacgatcctcctgattctgagccttctggtgttatgcgggtgcttaatcatgattgtcaagatccttggtagcgtcctcaagggacaggtggccacagtgataaaaaagactatcaacactgatttcccattccccttcgcttggttgactgggtatctggccattctggtgggagcaggcatgacttttattgttcagtcatcctccgtgttcacctctgcgctgactccactgattggtataggagtgatcaccatcgagagggcctatcccctgactctcgggtcaaatattgggacaactaccaccgcgatcttagcggcacttgctagtccgggaaacgcactccgatctagtctgcagatcgcactgtgccacttctttttcaacattagcgggatcctgctttggtatcccatcccctttacacggttacccatccggatggccaagggcctgggaaatatatctgccaaatacaggtggttcgcagtgttctatcttatcatctttttcttccttatcccactcacagttttcgggctctcattggcaggatggcgcgtactcgtcggcgtgggcgtaccagtagtcttcatcattatcttggtgttgtgccttcgactcttacagtctagatgtccgcgggttttgccaaagaagctgcagaattggaactttctgcctctgtggatgcgaagcctgaaaccttgggatgctgtggtcagcaagtttaccgggtgcttccagatgcgctgttgctgctgctgccgtgtttgctgtcgggcttgctgtctgctttgtgactgcccaaagtgctgtaggtgcagcaaatgctgtgaggatctggaagaggcccaggaggggcaggacgtgccggtgaaagctccagagaccttcgacaatatcacaatttctagagaggctcagggggaggtgccggcttcagatagtaagacagagtgcaccgccctgtag

SEQ ID NO: 135251 - DNA, 2070 bp, Artificial Sequence
  Description of Artificial Sequence: Synthetic coding sequence
atggccccctggcctgaactgggagatgcccagcccaaccctgacaaatatctcgaaggggctgcaggacagcagcctacagctccagacaaatcgaaagaaaccaataaaaacaatactgaagccccggtaacaaaaatagaactgctaccatcctattccacagctacgctcatcgatgaacccaccgaggtcgatgacccctggaatctccctaccttgcaggacagcgggatcaaatggagcgagagagataccaagggtaaaattctctgtttcttccaggggattggccgcctcatcctccttttgggattcttgtatttctttgtctgttccctcgacatcttgagctccgcattccaactggtagggggcaagatggcaggtcaatttttctctaactcctcgattatgtcgaatcctctcctcggcctggtcatcggcgtcctggtcacagtgcttgtgcagtctagcagcacctctactagcattgttgtgtcaatggtgtcttccagcctcttgacagttcgggctgctatccctatcatcatgggggcaaacatcggaacctccataacaaatacgatcgtggctctcatgcaggtgggtgaccgcagtgaatttagacgagcattcgctggtgctaccgtccacgacttcttcaactggctgagcgtcctggttttactgcccgttgaagtggccactcattacctggaaataattactcagttgatcgtggagtcctttcacttcaagaacggcgaagacgcccccgacttactgaaagttatcaccaaacccttcaccaagcttatcgtgcaactggacaagaaagtgatttctcaaatcgcaatgaatgacgaaaaagctaagaacaagagtctggttaagatttggtgtaagacctttaccaataaaacccaaataaatgttacggtcccgtctactgctaactgtaccagcccttctctatgctggaccgatggcatccagaattggacgatgaagaatgtaacctacaaggaaaacattgctaagtgccaacatatttttgtgaacttccatctgcctgaccttgcggttgggacgatccttctgattctgtctcttctggtgctttgtggatgccttattatgatcgtgaagatccttggcagtgtgttgaaaggacaggtggccaccgtaataaagaaaactatcaatactgatttcccatttccttttgcttggctgaccgggtacctggcgatccttgtgggcgcagggatgacattcatcgttcagtcatcctccgtgttcacatccgcactgacgccattgatcggaatcggggtcattactatcgagcgcgcctatcccctcacacttgggagtaacatcgggaccacaacaactgcaatcctggctgccctggcgtcccctggcaatgctctgaggtcttccctgcagatcgccctttgccatttctttttcaatatttccggcattctgctttggtaccccattcccttcacgaggcttcctatcagaatggcgaaaggtctcggcaatatttcagctaagtacagatggttcgccgtcttttacctgatcattttcttctttctcatccctctgaccgtgtttgggctttcgctagctggatggcgggttctggttggagttggtgtgcctgtagtattcataattatattggtgctgtgtctgcggctgcttcagagccggtgtccccgcgtgctaccgaagaagctgcaaaactggaattttttgcctttatggatgcggagcttaaagccctgggacgccgtggtgtctaagttcaccggctgtttccagatgagatgttgctgttgctgcagggtttgctgtcgcgcttgctgcctcctttgtgattgtcccaaatgctgccggtgtagcaagtgctgtgaagacctggaagaggcccaggaaggtcaggacgtgccagtcaaagcaccagaaaccttcgacaacattacaatctcccgtgaagcgcagggagaggttcctgcatcagactcaaagacggaatgtaccgcattgtag

SEQ ID NO: 135252 - DNA, 486 bp, Artificial Sequence
  Description of Artificial Sequence: Synthetic coding sequence
atggccccatggcctgaactgggcgacgctcaaccaaaccctgataaatatttggaaggtgcagccggccaacagccaaccgccccggacaaatccaaagagactaataaaacggataatacagaggcccccgtcacaaaaatcgaactactcccctcctatagtacagcaactttgattgacgagcccactgaggttgacgatccgtggaaccttccaacacttcaggacagcgggataaagtggagcgagagggatactaaaggaaagattctgtgttttttccaaggcattggacgtctcatcctgctcctgggttttctatatttttttgtctgtagcctcgatatcctctcctctgctttccagcttgtcgggggcaagatggccggacagttctttagtaactcctcaattatgtccaacccactgctaggcttagtcattggagtgctcgtgacagtgttggtgcagtccagcagctag

SEQ ID NO: 135253 - DNA, 492 bp, Artificial Sequence
  Description of Artificial Sequence: Synthetic coding sequence
atggccccatggcctgaactgggagatgcccagcccaaccctgacaagtatctggagggagccgcgggacagcaacccacagcccccgacaaaagcaaggaaactaacaaaaacaatacagaggcgcccgtgactaagatagagctgcttccttcctattcaaccgctaccctgatcgatgaacctacggaggtggacgacccttggaatctgccgacattgcaggattccggcattaaatggtctgaacgcgatacaaagggaaagatcctgtgtttcttccagggaatcgggaggttaatcctgctgctggggtttctctacttttttgtctgctctctggacattctgagttccgcattccagctggtgggcggtaaaatggcaggccagttcttctcaaactcttccataatgtccaacccactccttggactggtgataggagttttggttaccgtactggtgcagagctccagtactagcacatag

SEQ ID NO: 135254 - DNA, 1800 bp, Artificial Sequence
  Description of Artificial Sequence: Synthetic coding sequence
atgccatctagcctgccgggatcccaggtgcctcacccaaccctcgacgccgttgacttagtggaaaaaactttgcgcaacgagggaacctcttctagtgctcccgtgttggaagaaggagatacagatccttggacgctccctcaactaaaagatacttctcagccatggaaggaattacgcgtggccggtcgcctcaggagggtggcaggttcggtcttgaaggcatgcgggctgctgggatcactctacttctttatctgcagcctggatgtactctcttctgcgtttcagctcctcggaagcaaagtggctggagacatattcaaagataacgtggtcctgtcgaaccccgttgcggggttagtgatcggtgttctcgtgaccgcattggtccagagttcttcaacaagctcaagtatagttgtgtctatggtcgcggccaagctcctgactgtccgcgtttcggtccctatcattatgggcgtgaacgttgggaccagcataacttcaacgctcgtatcaatggcacagagtggagaccgagacgagttccagagggccttctccgggtcagccgttcatgggatttttaactggctgacggttttagtcctgctgccactcgagagcgccactgccctgttagaaaggctttcagagctggcattgggtgctgctagcctaacgccaagagcccaggctccggacatactcaaagtgcttaccaagccactcacacatctgatcgttcagttggactcggatatgatcatgtcctccgcaacggggaatgccacaaacagcagcctgattaagcactggtgtgggactaccggccagccgacccaagagaactcttcttgtggagcatttggcccgtgtaccgagaaaaattctaccgcaccggccgacagactaccctgccgtcatctgttcgctgggacagaactcacagacctggccgtgggctgcattctgcttgctgggtcactcctggtgctgtgtggatgcctggtgcttatcgtgaagctgctcaacagcgtcctccgaggtagggtggcccaagtagttagaaccgtaattaatgcagactttccattccctctgggttggctgggaggatatctggctgtgctggccggagccggcctcacatttgctttgcagagctcttccgtatttaccgctgccgtcgtccccctgatgggggtgggtgtaatatcgctggaccgcgcctacccacttctgctgggatccaacataggcacaaccactacagcgctgctggctgctctagcatcccctgcagataggatgctctcagccttgcaagtagcgctgattcattttttctttaatctagctggaattctcctctggtatctggtccctgctttgcggctgcccatccctctggcgcgacattttggcgtggtgacggcccggtaccgatgggtcgcaggggtgtatctcctcctcgggtttctgctcctccccctggcagccttcggcctcagcctcgctggaggaatggaattagctgctgtcggcggacccctagtaggccttgtgctgctcgtcatccttgtcacggtactacaacgcagaagacccgcctggcttccagttaggctgcggtcttgggcgtggctccccgtgtggctgcattctcttgagccctgggataggcttgtcacccggtgctgcccatgcaacgtgtgcagccctcccaaagcgaccacaaaggaggcgtactgctacgaaaatcctgagatcctggcttcccagcagctgtag

SEQ ID NO: 135255 - DNA, 1800 bp, Artificial Sequence
  Description of Artificial Sequence: Synthetic coding sequence
atgccgagcagtttgcccggttcccaagtaccccatcccactctggatgccgtagacctggtggaaaaaacactgcggaacgaagggactagcagctcggcacccgtgctggaggagggcgatacagacccgtggacactgccgcagctcaaagatacctcgcagccatggaaagagctgagggtagccggcaggctgcgaagggttgcaggctccgttttgaaagcttgcggacttctcggatccctttacttcttcatctgctcactagatgtactgagcagcgccttccagctccttggcagcaaagtagctggcgacattttcaaggacaacgtggttctcagtaacccggtggccgggctggtcatcggtgtgctggtgactgcactagttcagagttctagtacctcttccagcattgttgtctccatggtggccgccaaactgttgaccgtgagagtctcggtccccatcattatgggagtgaacgtgggtacctccattacgtccacgctcgtctccatggcccagagtggggaccgcgatgagtttcagcgagcattctcaggctctgccgtgcacggcatatttaactggttgactgtgctcgtgctgcttccgcttgaatcagcaaccgcactcctggagagactgagtgaactggcgctcggagcagcctccctaactccgcgagctcaggcccccgatatccttaaagtgctgactaagcccctgacccatttgatcgtacaattggacagtgatatgatcatgtccagcgccactgggaacgcaaccaattcatctctcatcaaacactggtgcggaacgacaggacagcctactcaagagaacagtagctgtggcgcatttgggccttgcaccgagaaaaacagcactgcccctgcagaccgtcttccctgcaggcacctctttgctggcactgaacttacagacttggcagtgggttgcattctcttggccggtagcctcctggtgttgtgtggctgcctggtgctcattgtcaaactgctgaatagtgtgctgcggggcagagtggctcaggtggtccgaactgtgataaacgctgacttccccttccctctagggtggcttggggggtacctggctgtgctggccggcgctggcttgacctttgctttacagtcttcttccgttttcaccgctgccgtcgtgcctctcatgggggtcggggtcatttctctcgacagagcctaccccctgttactggggtcaaacattggaactacaacgaccgcgctactcgcagctctcgcctctcctgcagatcgtatgttaagtgcactccaggtcgccctgattcatttcttcttcaatttggcgggcattctcttatggtacctggtgccggcactccggttgcctattcccttggctagacactttggcgtagttactgctcgatatcgctgggtggctggcgtttatctgctcctagggttcctgctgctgcccctggccgccttcgggttgtccctcgcagggggtatggagctggccgcggtcggaggcccactggtgggcctggtgctactggtcattttagtgacggtcctccagagaagacgccctgcctggctcccggtgagattgaggtcttgggcttggttgcctgtttggttgcacagcctggagccctgggacaggctcgtcacacgctgttgcccctgtaacgtgtgttctccgcccaaggctaccactaaagaggcgtattgctacgaaaaccccgaaatcctggcgagtcagcagctttag

SEQ ID NO: 135256 - DNA, 570 bp, Artificial Sequence
  Description of Artificial Sequence: Synthetic coding sequence
atgaccctcatggctgcggtgtacactatcgccctgagatacacgcgcacaagtgacaaggagctgtatttctcgactacagctgtgtgcataacagaggtgatcaagcttctcctgtccgtcggaattctggccaaggagactggctccctgggccgcttcaaggctagtcttcgcgaaaatgtgctgggatcacctaaagaactgctgaaactgagcgtgccatcactcgtgtatgccgttcagaacaatatggccttcctggctctctccaatctcgatgccgcagtctaccaggtcacctatcagctcaaaattccatgtacagccctgtgtaccgtgctgatgcttaacagaactctttctaaactacagtgggtgtcagtattcatgctctgtgccggagtgactttggtgcagtggaaacctgctcaggccactaaggttgttgaatatatcctcaagaagtttaaagagttccggtatttttccctcggcgaaaagcattctaacgtctcaatcagggactattgtgacatcagctggaggcttcttgtgagatggtcctag

SEQ ID NO: 135257 - DNA, 1014 bp, Artificial Sequence
  Description of Artificial Sequence: Synthetic coding sequence
atggccgctcccagggacaacgtgactctcctgtttaaactgtattgcctggcggtgatgactctgatggcagccgtgtacactatcgctctgagatacacccggacttcagacaaagagctgtacttcagcactacggccgtgtgcattactgaagtgatcaaactcctgctgtcagtgggcattctggcaaaggagactgggtcccttgggcggtttaaagctagcctccgcgagaacgtgctcggctcccccaaagaactgttgaaactgtccgttccaagcctggtttatgccgtccagaataatatggcatttttggccctcagtaacctcgacgctgccgtgtaccaggtgacttaccaactaaagataccctgtactgccctgtgcaccgtgctcatgctgaatagaacactttctaagctgcagtgggtgagcgtgttcatgctctgcgctggcgttaccctggtccagtggaagcccgcccaggccacaaaagtagtggtggagcagaaccctctgctgggctttggtgctatagcaatcgccgtcctctgctccggcttcgccggggtgtattttgaaaaagtcctaaaatcttcagacaccagtctgtgggtccgcaacattcagatgtatttgtcaggcataatcgtcacgctggccggtgtctacctgtctgacggagccgagattaaggaaaagggttttttttacgggtacacttattacgtatggtttgttattttcctcgcttctgtgggtgggctgtataccagcgttgtcgtgaagtataccgacaatataatgaagggtttctcggccgcagctgctattgtgctgtccactatcgcgagcgtgatgctcttcggactgcagatcacgctgacctttgcattgggaacgcttctggtgtgtgtttctatttacctctacggcctcccccgccaggacacgacgtcaattcagcagggcgagacagcctccaaggagcgtgtgatcggcgtatag

SEQ ID NO: 135258 - DNA, 837 bp, Artificial Sequence
  Description of Artificial Sequence: Synthetic coding sequence
atggccgccccacgggacaacgtgacgttgctctttaaactctattgccttgctgtgatgactctcatggcagccgtgtatactattgccttgaggtacactcgcacatcagataaagagctgtatttctccaccacagcggtgtgcatcactgaggtcataaagctcctgttgtcggtaggaatcctcgctaaagagacaggctcacttgggagattcaaggcttccctgagggaaaacgtgttggggtcgcctaaagaacttcttaagctgtctgtccccagcctggtctacgccgtgcagaacaatatggcattcttggctctctctaaccttgacgccgcggtctaccaggtgacttaccagctgaagattccgtgtactgccctgtgcaccgtgctgatgctgaacagaacactgagcaagcttcagtgggtgagtgttttcatgctgtgtgccggagtgacactggtgcagtggaaacccgctcaagccacaaaggtggtggtggaacagaaccccctgctgggttttggcgcaatagccatcgcagtgctgtgtagcggattcgcagtgctagccagtgtcggtggcctttacacgagtgttgtggtcaaatacacggacaatataatgaaaggtttttcagcggctgctgcaattgtgctgtctactattgcaagcgtgatgctgtttggtctccagataacacttacttttgcgcttggcaccttgctggtgtgtgtgtccatatatctatatgggttacccagacaagacacaacctccatccagcagggagaaaccgcaagcaaggagagggttatcggcgtttag

SEQ ID NO: 135259 - DNA, 570 bp, Artificial Sequence
  Description of Artificial Sequence: Synthetic coding sequence
atggccgcgcctagagataatgtcacactgctgttcaagctgtattgcctggccgtgatgaccctaatggcggctgtctacaccatcgcccttagatatactaggacatctgataaagagctgtacttctccactactgctgtttgtataacagaggtcataaaactcttgctttctgtagggattctcgcgaaagagaccggttctctcgggcgatttaaggctagtctacgagaaaatgtgttggggtcccctaaagagttgcttaaacttagcgttccatcactggtgtacgccgtacaaaacaacatggccttcctggcattgagcaaccttgacgccgccgtctaccaagttacctaccaacttaaaattccctgtaccgcactgtgtaccgtgctcatgctgaaccgcactctgtctaagttacagtgggtctcagttttcatgttatgtgccggcgtaacacttgttcaatggaagcctgcacaagccacaaaggtcgtctttctgcaggttttagtggccagcaccctgcttctttggctgtctacccagactacttcttag

SEQ ID NO: 135260 - DNA, 537 bp, Artificial Sequence
  Description of Artificial Sequence: Synthetic coding sequence
atggctgcccctagagacaacgtcacactgctgttcaagctgtactgtttggcggtgatgacccttatggccgccgtgtatacaatcgcgcttcgctacaccaggacctctgacaaagagctgtacttctcgaccaccgccgtgtgtattaccgaggtgattaagctgctgctgtctgtgggcatcctggcaaaggagacagggagcctcggtcgattcaaggcctccctgagggagaacgtgttggggtctccaaaagaattgctgaagctttccgtcccttctctagtgtatgcagtgcagaacaacatggcctttttggccctctccaatcttgacgccgcagtctaccaggtgacctatcagcttaagattccctgcactgccttgtgtaccgttctgatgctgaaccggactctgagcaaactccagaagaaagatttctcaatggttactcacataatgtctggactctctagcgttagcattcaggagctcaaggtcctgtctagatcctttattttcttcctgtcatag

SEQ ID NO: 135261 - DNA, 612 bp, Artificial Sequence
  Description of Artificial Sequence: Synthetic coding sequence
atgttgaatcggacactgtccaagctgcagtgggtttcagttttcatgttgtgtgctggagtgaccttagtgcagtggaaacctgcccaggccacaaaggtggttgtcgagcagaacccactgcttggcttcggagccatagcaatcgctgtcctgtgctccgggtttgccggcgtgtacttcgagaaggtgcttaaaagtagtgacacaagtttatgggtacgcaacatacagatgtatctgagcgggataatcgtcacattggccggtgtgtacctgtccgacggcgctgagattaaggagaaaggatttttctacgggtatacttactacgtgtggtttgtgatattcctggcgagtgtcggaggcctttacacttctgtcgtagttaaatacaccgataatattatgaaaggattcagcgcagcagcagcaattgtcttgtccacgatcgctagtgtcatgctgtttggcttgcagattacccttacattcgcgctgggtactctcctcgtgtgcgttagtatctatctgtatggcttgccccggcaggacaccacctccatccaacagggtgagacggccagcaaagagagagttataggtgtttag

SEQ ID NO: 135262 - DNA, 1191 bp, Artificial Sequence
  Description of Artificial Sequence: Synthetic coding sequence
atggctgcggtgggggccgggggatcaacagcggccccaggtcccggggcggtttctgcgggcgcacttgaacccgggaccgcatccgctgcccaccggcggttgaaatatatctcactggctgtcctggtagttcagaatgcctctctcatcctgtcaatccgttatgcccgtactttacctggggaccggttctttgcaactacggcagtggtgatggcagaggtactgaaggggctgacttgtctcctgctgctgtttgctcagaagagaggtaacgtcaagcatctggtgctattcttgcatgaggccgtgctggtgcagtacgtcgacacactgaagctcgccgtgcctagtctgatttacacccttcagaacaacctgcagtacgtggctatctcaaaccttcccgctgccacgtttcaggtcacttaccaactcaagatactgacaacggcattattctccgtgcttatgctgaacagatccttgagtcgtttacagtgggcctccctccttttgcttttcacgggcgtggctatagtgcaggctcaacaggccggtggggggggtcctagacccctcgaccagaatccgggggcaggacttgctgccgttgtggccagttgtctctcatcaggattcgccggagtttacttcgaaaagatcctaaaaggctcctcggggagtgtatggttgcgaaatttgcagttgggactcttcgggaccgcactcggcctggtcgggctatggtgggcagagggtaccgcagtggccacacgaggattttttttcgggtatacacccgctgtgtggggagttgttctgaatcaagcctttggcggcctgttggtagccgtcgtagtaaagtatgccgataatattctaaagggcttcgctactagcctgagcattgttttaagcaccgtggcttccatccggctgtttgggttccatgtagacccgctctttgccctcggggccggcttagtaattggggctgtttatctatactccttgcctagaggagcagcaaaggctattgctagcgcgagcgcaagcgctagtggaccttgtgtacaccagcagcctccggggcagcccccccccccccaactcagcagtcatcgcggcgacttgatcaccgaaccatttctgccaaagcttctcaccaaagtcaagggctcgtag

SEQ ID NO: 135263 - DNA, 492 bp, Artificial Sequence
  Description of Artificial Sequence: Synthetic coding sequence
atggcagctgtaggggccgggggaagtactgccgccccaggcccgggcgccgtctctgcaggtgccttagaaccaggcactgcctccgccgcccacagacggttgaaatacatttcactcgccgtgttggtggtccagaatgcctccctaatcctgagtataagatatgcccgcacccttccgggggaccggttttttgctacaacagcagtagtgatggcagaggtcctcaaggggttgacatgcctcctgctgctcttcgcccagaagaggggcaacgtaaagcatcttgtgctgttcctgcatgaggccgtgctcgtgcagtacgtggacacccttaagctggccgtaccttccctgatttacacgctccagaataacctacagtacgttgccatcagtaacctcccagcagcaacattccaggtgagccctaagccttccatggccccagaggaactgaccggactaggaaccggtgtttgggagtag

SEQ ID NO: 135264 - DNA, 657 bp, Artificial Sequence
  Description of Artificial Sequence: Synthetic coding sequence
atgaagctgtgccgcgacgcccatagacgactgaagtacatttccctggccgtgttggtcgtgcagaatgcttcccttatcctttcaattagatacgccagaactctgcccggcgatcggtttttcgcaacaacagctgtggtgatggccgaggtgctgaaaggcttgacatgcctgttgttactttttgcacaaaagcgggggaacgtgaaacatttggtcctgttcctgcacgaggcagttttggttcaatatgttgataccctgaagctggcggtgccttcactgatatacaccctgcagaataacctgcagtatgtggccatttctaacctccccgccgcaacttttcagccttctcctagatgcagccagagtcattctctctgcctctgtttacgactcagggccctgaggagccccgccgcatctcgggccgcaactacaaccgctgctgtcttccctccatggaggccacaccatggtgcgctaagtgcaaaagtcagcgcaggcgaggtccgcgcagggtccaatgggggaacacagggccgcggcacaggggtcgagggggtggggcacttgcaggacccgagtcgtcacccaccaggacctggaagttccgggttcggacggtggagcttcctgccaggccactag

SEQ ID NO: 135265 - DNA, 1182 bp, Artificial Sequence
  Description of Artificial Sequence: Synthetic coding sequence
atggcagccgtgggcgccggtggctccaccgcagcacccggtccaggcgcagtaagcgcaggagccctggaacctggaaccgcgtcagcggctcaccgtagattgaagtatatctccctcgccgtgctggtcgtccagaacgcctcgttaatattatccatccgatacgcacgcaccctgcccggagacaggttcttcgccacaacagccgtggtgatggctgaagtacttaaggggctcacgtgcttgcttttgctcttcgcccagaagaggggcaacgtcaaacatttagttctctttcttcacgaggcagtccttgttcagtatgtggatacattgaagctggccgttccttctcttatctacaccttgcaaaataatcttcaatatgtggcaatttccaacctgcccgctgcaacgtttcaggtgacctatcaattgaagattctgacaacggcactgttttcagtcctcatgctgaatcgctccttgagtcgtcttcaatgggcttccctacttttgctttttacaggagtcgcgatcgtccaagcccaacaggctgggggcggcgggccacggcccctggaccaaaaccctggagccggactcgctgccgtcgtcgccagctgccttagcagcggctttgccggcgtgtacttcgaaaaaattctgaaaggctcttccggatcagtctggctgcggaacctgcaactcggactgtttggaaccgcgctaggattggtgggattgtggtgggccgaaggaacagccgttgccacgcggggattcttcttcggctatacaccagcagtctggggcgtggtcctgaaccaggccttcggtggacttctggtggcagtcgtagtcaagtacgccgacaacattcttaaaggcttcgccacttccctatctatagtactgagcacagtcgcctccattcggttgttcgggtttcatgttgaccccctgtttgcattaggcgccggcctcgtgataggcgcagtatacctttactccctgcctcggggtgctgccaaggctatcgcgtcagcttcagctagcgctagcggcccctgtgttcatcaacaacccccaggtcagccaccgcccccgcagctgtcctcccacaggggggacctgatcactgaaccattcctccctaagagtgtgctggtaaagtag

SEQ ID NO: 135266 - DNA, 675 bp, Artificial Sequence
  Description of Artificial Sequence: Synthetic coding sequence
atggccgcggtcggcgctggggggagcaccgctgccccggggccaggagcagtgagtgctggagccctggagcctgggacagcgtcggccgcccatcgacggcttaagtatatcagcctggctgtgttagtagttcagaacgcttccctcattctgtctatccgctatgcaaggaccttgcccggcgaccggttcttcgccacaacagcagtcgtcatggcggaagtgctgaagggcttgacatgcctgttgctgctattcgcccagaagcgcggcaatgtgaaacacctggtcctgttcctccatgaagcagtgctggtgcagtacgtagatacactcaagctcgcagttccctcgctcatttatactctccagaataatctccagtacgtggcgatctccaatctgcccgccgctaccttccagccctctccaaggtgcagccagtcccactcgttgtgcctttgtcttcggctccgggcactgcggtctccagcagcctcccgggcggccactacgacagccgccgtgtttccaccttggcgcccccatcacggagccttatccgctaaagtcgctcatcagggtgagggatttctggctgccggaatcgaggacattggactcgccagtttctccctcctggcacttggtccagccggcacgaagttgtag

SEQ ID NO: 135267 - DNA, 999 bp, Artificial Sequence
  Description of Artificial Sequence: Synthetic coding sequence
atggctgccgtaggtgctggcggcagcacagcagcgccagggccaggtgccgtctcagctggcgccttggaacctggcaccgctagcgctggaaacgtgaagcacctggtgctgtttctccacgaggcagtcctggtgcagtacgtcgacacactgaaattggctgtaccaagtctcatttatacgctgcagaataatctgcagtacgtggctatttctaatctgcccgccgccactttccaggtgacctaccaactgaaaatcctgactactgcactgttctccgtattgatgttgaacaggtcactgtcacggctgcagtgggcttcgctcctgcttttgttcacaggcgtggcaattgtacaggcgcagcaggccgggggaggcggcccgcgccccctagaccagaaccccggtgccgggctggccgcggtagtggccagttgtctgtccagcggctttgcaggtgtatacttcgaaaaaatcctaaaaggatccagcggcagtgtgtggctgcggaacctacagttagggctgtttggcaccgcacttggccttgtgggcttgtggtgggcagaaggcacagccgtcgctactcgcggattcttcttcggatatacacctgctgtgtggggggtggtcctgaaccaagctttcgggggacttctcgtggcagtcgtagttaagtatgctgacaatatactgaaaggcttcgcaacaagtcttagtatcgtgctttcaactgtggcttctataagacttttcggcttccacgtggacccgctgtttgcacttggcgcaggactcgtgattggtgcggtttatctgtatagcctgcctaggggcgcagccaaagccatcgcatctgcctccgcatccgcatcggggccatgcgtacatcagcagcctcctggtcagccaccccccccccagcttagctcacatcggggagacttaatcacagagccttttctgcccaaatctgtgttagtgaaatag

SEQ ID NO: 135268 - DNA, 729 bp, Artificial Sequence
  Description of Artificial Sequence: Synthetic coding sequence
atggctgccgtcggagcaggcggcagtactgccgctcctggtcctggcgcggtgtccgctggagctctggaaccaggcaccgcctcagccgcacatcggcggttgaagtatatctcccttgccgtccttgttgtgcagaatgccagtcttatactctccattaggtatgcccggaccctccccggtgacagattctttgcaacaacagccgttgttatggcagaggttcttaaggggctcacttgtctgttgctgttatttgcccaaaaacgcgggaacgtaaaacacctggttctatttctgcatgaggccgtcctggtgcaatacgtggacactctgaaacttgccgtgccatctctgatatacaccttacagaataatctccagtatgtggccatttccaaccttcccgccgccactttccaaccctctcctagatgctcccagagtcattctctctgcctctgcctcagacttagggcgctcagatcccctgcagcctctcgggctgctacaacaacggccgccgtgtttccgccgtggcgcccccatcatggcgcattgagcgccaaagtcagcgcaggggaggttcgcgccgggagcaacggcggcacccagggtcgtggaactggcgtggaaggggtgggccatctgcaggatccttctcgccacccacccggtccagggtcctctggcttcgggagatggtcttttctacctggacactag

SEQ ID NO: 135269 - DNA, 531 bp, Artificial Sequence
  Description of Artificial Sequence: Synthetic coding sequence
atggcggaggtgctcaaggggctgacctgcctgcttctgctgttcgcccagaaaagagggaacgtgaaacatctcgttctctttctgcatgaagccgtgttggtgcagtatgttgacacacttaagctggcagtcccgtcactgatctacacattacagaacaatttgcagtatgtggcaatttccaatctacccgcagccacctttcaggttacataccagctgaaaattcttacaaccgcactgttctccgttctgatgctcaatcggagcctctccagactgcagtgggctagtcttcttttgctgtttactggggtagctatcgtccaggcccaacaagccggaggtgggggccctcggcccctggatcaaaaccctggggccggtctggcagcagtggttgcctcctgcttgtcgagcggcttcgccggcgtttacttcgagaagatactgaaagggtcttccggttcagtgtggctgcggaatctgcagctaggcctatttgggaccgcacttggcctcgtgtag

SEQ ID NO: 135270 - DNA, 1266 bp, Artificial Sequence
  Description of Artificial Sequence: Synthetic coding sequence
atggctgctgtgggcgcggggggcagcaccgccgcgccagggcctggcgcagtgagcgctggggcgcttgagcctggcaccgcttctgccgagttgttactgacgtgggaagaagcggaggcaaggggccagggccttccgcaacctctgccagatacttccgtccggatccctgcgcaccggcgcttgaaatatatctcccttgcggttttagtggtacagaacgcatcgctcatcctgagcattcggtacgctcgaacactgcctggggaccgcttctttgcaactaccgccgttgttatggccgaagtgctgaaagggctgacttgtctgcttctcctgtttgcgcagaagcgtgggaacgtcaagcatctggtgctgtttttgcacgaagctgtccttgtccagtacgtggacaccctgaaactagctgtaccttccctcatttacaccctgcaaaataacctccaatacgtggccatttcaaatttacctgcggccacatttcaggtgacatatcaactgaagattctaacgacagcgttattcagcgtgctcatgctgaaccggtcactgtcccgactgcaatgggcatccctcctgctcttgttcacaggggttgctattgtacaggcccagcaagcgggcggaggggggccaaggcctctagaccagaacccgggagcagggctcgccgccgtcgtggcgtcttgcctttcttcaggctttgcgggagtgtattttgagaagatcctgaaaggcagctccggatctgtctggcttaggaatctccagctggggttgttcggcacagctttgggacttgtggggctgtggtgggcggaaggcaccgccgtagctactcggggcttcttctttggctatacgcccgctgtgtggggtgtggtactcaatcaggcgtttggtggcctgctggttgctgtggttgtcaaatacgcagacaatattctgaaaggcttcgcaactagcctcagcatcgtgctttccactgtagcgtccatcagattattcggcttccacgtggatcccctgtttgctcttggtgcagggttagtgatcggggcagtctacttgtattccctgcccaggggcgctgcgaaagccatagcctctgccagcgcctcggcgtccggcccatgcgttcaccagcagccccctggccagccacccccacctcagttgtccagtcacagaggtgatttgattactgaaccgttccttcctaagtccgtgttggtaaagtag

SEQ ID NO: 135271 - DNA, 1068 bp, Artificial Sequence
  Description of Artificial Sequence: Synthetic coding sequence
atggccgaagtccaccggcgtcagcatgcccgcgtaaaaggagaagcgcctgccaagtcttctacattgcgtgacgaagaggagctcgggatggcttcagccgaaactttgaccgttttcctcaagctgctcgcagccggcttttacggcgtctcttcctttctaatcgttgttgtgaataagtccgtgctgacgaactaccgctttcccagttcattgtgcgttgggctcggacagatggtggcaacagtggccgtgctgtgggtggggaaggcgttacgagtagtgaaattccccgacctcgaccggaacgtgcctagaaagacgttcccgctcccgctgttatacttcggcaatcagatcactgggctttttagtacaaagaaattgaatctgccaatgtttactgtcctcaggcggttcagcattctgttcactatgttcgcagaaggcgtcctgctcaagaaaacattcagctggggaattaagatgaccgtctttgcaatgattataggcgcttttgtggccgcctcttctgatctggccttcgacttagaggggtacgcgtttattctgattaatgacgttctgacagcagctaacggcgcctatgtcaagcagaaactggattcgaaggaactgggtaaatatggacttttgtattacaatgcactgtttatgatactccctaccctggccatcgcctactttaccggggatgcccaaaaggccgtcgagttcgagggatgggccgacaccttgtttctgctgcagttcacacttagttgcgtgatgggattcatccttatgtatgccactgtgctctgtacacagtataattctgcacttacaactactattgtcggatgcatcaagaacattctcataacttatattggaatggttttcgggggagactatatctttacatggactaatttcattggcctcaacatcagcattgcgggctccctcgtgtattcttatattacatttacagaagagcaactctctaagcagtccgaggctaataacaaactggacataaagggcaagggagctgtctag

SEQ ID NO: 135272 - DNA, 783 bp, Artificial Sequence
  Description of Artificial Sequence: Synthetic coding sequence
atggttgcgactgtggcagtcctatgggtggggaaggcgctgagggtggtgaaattcccagacctcgatcgaaacgtcccccggaaaacgtttccattgccattgctgtatttcggcaaccagatcaccggactgttcagtactaagaagctaaatctgcccatgttcacagtactgcgacgattttcgattctgttcactatgttcgctgagggggtcctcttgaagaagacattctcttggggtattaaaatgacagtgttcgcaatgattataggtgccttcgtcgcagctagctccgatttggctttcgatctcgagggttacgcattcatcctcattaatgatgtactcaccgctgctaatggagcttatgttaaacaaaaactagacagcaaggaactgggcaaatacgggctgctctactataacgctctgttcatgatcctgccaactctcgccattgcttattttacaggggatgcacagaaagccgttgagtttgaagggtgggcggatactttgttcctgctacagttcaccctgagctgtgtgatgggtttcatactgatgtatgctacagtactgtgcacgcagtacaacagcgcccttaccacaaccattgtgggttgcattaagaacatcctgatcacctacattggtatggtctttggaggcgactatatatttacttggactaactttattggactgaatatcagctgtatttgccacagaggtctctgtgaactcagggttggtagcgcaacactggggggttag

SEQ ID NO: 135273 - DNA, 1104 bp, Artificial Sequence
  Description of Artificial Sequence: Synthetic coding sequence
atgtcttccaggtccgtcttgtcaccagtggttgggaccgatgcacccgaccaacatctggaactgaagaagcctcaagaacttaaggaaatggaaagactgcctctagccaatgaagacaagaccatgttcgctaatctgaagtatgtgtcactcgggatcctcgtgttccagacgacctcgctcgtcctcactatgagatacagcagaacgctcaaagaagagggcccacgatacctgtcttctacagcagtggttgtggccgaactcctgaagatcatggcatgcatcctgctggtctacaaagatagcaaatgctcccttagggccctgaatcgggtcctgcatgacgagattctgaacaaaccaatggaaacccttaaactggccatcccctctggtatctacacgctccagaacaatttactgtatgtggccctcagcaacctcgacgctgctacctaccaagtgacataccagctcaaaatactgacaaccgcactcttttcagtgtctatgctgtctaaaaaactgggcgtgtatcagtggctgtctcttgttatccttatgaccggcgtagcgtttgttcaatggcccagcgactcccaattggattcaaaagagctctcagcaggctctcaatttgtgggcctgatggcagtcctaacagcatgcttctcctcaggttttgcaggcgtgtatttcgaaaagatactgaaagagacgaagcaatcagtttggatcaggaacatacagctcgggttttttggatcaatctttggtctgatgggcgtgtacatatacgacggagaattggtttcaaaaaatggctttttccagggttacaacagattgacctggatcgtagtggtgctgcaagcactgggtgggctggtgattgctgccgtgatcaaatacgctgacaacatactaaaaggttttgctacctctctgtcgattatcctctcaaccttgattagttacttctggctacaggacttcgtgcccactagcgttttttttttgggcgccatcctggtcatcactgccactttcctgtacggctatgaccccaagcccgctggtaaccccacgaaagcctag

SEQ ID NO: 135274 - DNA, 978 bp, Artificial Sequence
  Description of Artificial Sequence: Synthetic coding sequence
atgttcgcgaacctcaaatatgtctcattagggatcctggtgttccagactacgtctctggttctcacgatgcgatactctcggactttaaaggaagaagggccccgttacttgtcgtccaccgccgtcgtggtggccgagcttcttaagatcatggcttgcattctgcttgtgtataaggatagtaaatgctctttacgcgcgctcaatcgggtgctgcatgacgaaattctgaataaacccatggaaacactgaaactggcaatccccagcgggatctacaccctgcagaataaccttctgtatgtggcactgtccaacctcgacgctgccacctaccaggttacctatcaactcaaaatactgaccaccgctttgtttagcgtttccatgcttagcaagaaactgggcgtgtaccagtggctgagcctggttatactgatgacgggagtggcgtttgtccaatggccaagcgattcccagctcgatagcaaagagctgtcagctgggtctcagtttgtgggacttatggcagttcttacagcatgcttttcttcaggtttcgccggagtttacttcgagaagatcctgaaagaaaccaagcaatctgtatggattaggaacatccaattggggtttttcggttcaatcttcggactgatgggtgtatacatttacgatggagagttagtgtcaaaaaacggtttcttccagggatacaataggctaacttggattgttgtggtgcttcaagcccttggtggcctggttattgccgctgttataaaatacgccgacaatatactgaagggctttgcgaccagtctgtctatcattctgtccactctcattagttacttctggctccaggactttgtccctacctcagtgttctttttgggcgctatactcgtgatcacagcaacattcctgtacgggtacgacccgaaaccagcaggtaacccgacgaaggcctag

SEQ ID NO: 135275 - DNA, 675 bp, Artificial Sequence
  Description of Artificial Sequence: Synthetic coding sequence
atgtttgccaatctgaaatacgttagcctgggtatactggttttccagacaacgtcgctggtcttaaccatgagatactccagaactctgaaggaggaggggccaagatacctgagtagcaccgctgtcgttgtggctgagctgctcaagattatggcctgtatattgttagtctataaggattcaaagtgtagcttgcgagcactgaacagagtgctccatgacgaaattctgaataagccaatggagaccctgaagctggcgatcccctcaggaatctacaccctgcaaaataatctcctctatgtggccttgtccaatctggatgccgcaacttatcaggttacctatcagttaaaaattctgacaacagctctgttttccgtcagcatgctctctaagaagcttggggtttaccagtggttatccctcgtcatacttatgactggtgttgcttttgtccagtggcccagtgacagccagctggacagcaaagaattgtctgcaggctcacaattcgtcgggctgatggccgtgctcacggcatgcttctcatctgggttcgcgggtgtgtatttcgaaaagatcctgaaagaaaccaaacagagcgtctggattagaaatatccagctcggattctttggatcaatattcggcctgatgggcgtgtactag

SEQ ID NO: 135276 - DNA, 978 bp, Artificial Sequence
  Description of Artificial Sequence: Synthetic coding sequence
atgtttgctaatctgaaatacgtgtcgctggggattcttgtcttccagactacatcactagtgcttacgatgagatactccaggactctgaaagaagaaggcccaagatatcttagcagcaccgccgtggttgtggctgagctcttgaaaattatggcctgcattctactcgtttacaaggattccaagtgctctctcagggccctgaaccgcgtgctccacgatgaaattttaaacaaacccatggagaccctgaagctcgctatccccagcggcatctatactctgcaaaacaacctactctatgtggctctgtcaaaccttgacgccgccacttaccaggttacctaccagttgaaaatcctgaccactgcgctcttctctgtgtccatgctgtctaaaaaacttggcgtgtaccagtggctgagccttgtcatcctgatgacaggagtggcgtttgttcagtggcctagtgacagccagcttgattctaaagaacttagcgccggctctcagtttgtcggcttgatggcagtccttaccgcttgtttcagctctggctttgccggggtgtattttgagaaaattctcaaggagaccaaacaatccgtatggatcaggaatatccaattaggttttttcggcagtatattcggcctgatgggcgtgtacatatacgatggggaattggtctcaaagaacgggttctttcagggttataatcggttaacctggatcgtggtggtgctccaggcgctaggtggcctggtgatagccgcagtgatcaaatacgccgacaacatcctgaagggctttgcaacctcactgagtatcatcctgagtacattgatatcttatttctggctccaggattttgtgccaacctctgtgttcttcctgggggccatactggtgatcacggccactttcctgtacggctatgacccaaagccagccggcaatcccactaaggcatag

SEQ ID NO: 135277 - DNA, 663 bp, Artificial Sequence
  Description of Artificial Sequence: Synthetic coding sequence
atgttcgccaacctcaagtacgtctctctcggcatcttggtgttccagactacctctctcgttctgaccatgagatattcccgtacccttaaggaagaggggccaagatatctgtcaagtactgctgttgtggtggccgaactgctgaaaattatggcctgcatcctcctagtctacaaagactcgaagtgctccctgagagctctgaacagggtgctgcatgacgaaatactgaacaagccaatggaaacgttaaagctcgccatcccgagcggaatttatacactccagaataacctcctttatgtggccctctcgaatctggacgctgcaacctaccaagtcacctaccaattaaagatcctcacaacagccctgttcagcgtatctatgttgtccaaaaagctgggagtgtaccaatggcttagtcttgttattctcatgacgggcgtggctttcgtccagtggccctccgattctcagctagattcgaaggaactctccgccggcagtcagtttgtgggcctgatggcagttttaaccgcttgcttttccagcgggtttgctggggtttacttcgagaaaatactgaaggaaacgaaacaatccgtatggattcgcaacatccagcttgtgtcctttagtttggagccgagcctgtag

SEQ ID NO: 135278 - DNA, 258 bp, Artificial Sequence
  Description of Artificial Sequence: Synthetic coding sequence
atgttcgctaatctcaagtatgtctccctaggcatcctcgtattccaaactaccagccttgtgttgaccatgcgttacagccggaccttaaaggaagaggggccaaggtatctctcatccactgctgttgtggttgctgagcttcttaaaatcatggcctgcatattactggtttacaaagactccaaatgtagcctgcgtgcgttgaatagggtgctccacgacgaaatcctcaataagcctatggagacactgtag

SEQ ID NO: 135279 - DNA, 1104 bp, Artificial Sequence
  Description of Artificial Sequence: Synthetic coding sequence
atgagctctaggtcggtactctctcctgttgttgggactgatgcccccgaccagcacctggaactgaagaaaccgcaggaactgaaagagatggagagactccctttggcaaacgaagataaaacaatgtttgccaatcttaagtatgtctccctcgggatactggtattccagaccacttcattagtgcttaccatgcgctacagtaggactctgaaggaggaaggccctcgctacttgagctcgacagcggttgtggtggcagagctgctcaagattatggcctgcatcttgctcgtgtacaaggatagtaagtgttccttacgggcactgaatagagtactccacgatgaaatcttaaacaaaccaatggagactctgaagctggctattcccagtggaatctatacactgcaaaataacctgttgtacgtcgcgctaagcaacctcgatgcagcgacctatcaggtgacctaccagctgaagattctcaccaccgccttgttttcagtgagtatgctttcaaagaaacttggcgtttaccagtggctgtctttagttatcctgatgacaggtgtggcatttgttcagtggccaagtgactcccagctggattccaaggagctgtccgctggatcccagttcgtggggttgatggcagtattaacagcatgtttcagttccggctttgccggcgtatacttcgaaaaaattctcaaagagacgaagcagtcggtctggattcggaatatacagcttggcttttttggtagtatcttcggccttatgggggtgtatatctatgacggtgaactagttagcaaaaacggattttttcagggatacaatcgcctgacgtggatcgtcgtcgttctgcaggccttaggcggtctcgtcattgccgctgttattaagtacgctgacaatattctgaagggatttgccacctcactgagcattattctctctactctaatttcttacttttggctccaggattttgtgcccacctctgtgttcttcctgggggccattctggtgatcaccgcgacattcctgtatggctatgaccccaagcctgcggggaatccgacaaaagcctag

SEQ ID NO: 135280 - DNA, 969 bp, Artificial Sequence
  Description of Artificial Sequence: Synthetic coding sequence
atggcttccagcagctcacttgtgccagataggctccggctgcctctctgtttcctgggggtgttcgtttgctacttctactacggtattctgcaggagaaaattacaaggggcaaatatggcgagggggctaagcaggaaactttcacatttgccctgacactggtttttatccagtgcgtgatcaatgccgtcttcgctaaaatcttaatccagtttttcgacacggctcgggtggataggacccggtcatggttgtatgctgcttgttctataagctacctcggagccatggttagctccaatagtgcactgcaatttgtgaactatcctacacaggtgctggggaaatcctgcaaaccaattccagtgatgctgctgggtgtcacactcctaaagaagaagtaccccctcgccaagtacctgtgcgttttgctcattgttgcaggcgtcgcgttattcatgtacaaacctaagaaggtggtcgggatagaggaacacactgtaggttatggagagctgctcctgcttttgtctctgacattggatggactcaccggcgtgagccaggaccacatgcgtgcccactaccagactggtagtaatcatatgatgttaaacatcaacctctggagtactctcctcctaggaatgggtatcctgttcactggggaactatgggagtttctgtcctttgccgagagatatccagccattatctacaatatcttactgttcgggttgaccagcgccttgggccagtctttcatttttatgaccgttgtgtatttcggtccactcacctgtagcataataacaacaacaaggaagttttttacgattctggcatctgtgatcctttttgcgaaccccattagcccaatgcagtgggtggggacagtgctggtcttcctggggctgggactcgacgccaaattcggtaagggcgcaaagaagactagtcactag

SEQ ID NO: 135281 - DNA, 450 bp, Artificial Sequence
  Description of Artificial Sequence: Synthetic coding sequence
ccacagtcctgcctcattggaaagatctctcgcgcaagggaccagagtcgaggctgtcggtttccatggccaagtggcatggaaccaaggacacgggttggccctctgcttgtcttgccagacgcgtgcaaacagcctatcagaccgcgcccatggtgccattcccgtaatacagtgagctcatgtttgggcactaggggcaaatacggtgagggggcaaagcaggagaccttcactttcgccctcacacttgtctttattcagtgcgtgattaatgccgtgttcgctaaaatctggtggatcgtccctggggctgggtcaatgctgcccgtgctttcgcctatatgggtcccttggagtccagctattcagcattattcactctcgacaacgcaactgcgctctcttgtgaatccagccagccaatcacagtcctgctcactcgggtag

SEQ ID NO: 135282 - DNA, 1080 bp, Artificial Sequence
  Description of Artificial Sequence: Synthetic coding sequence
atgaggcccttgccgcccgtgggcgacgttcgcctggagttgagtcccccgcctcccctgctcccggttcccgtggtcagcggctcacccgtgggctcatcagggcgcttaatggcgtctagcagttctcttgttcctgatcggcttaggcttccactgtgcttcctgggcgtgtttgtctgttacttctattatggcattctacaggagaagatcacccgcgggaagtacggggagggcgctaaacaagagacgtttacttttgcactcacattggttttcattcagtgcgtgataaacgctgtgtttgccaaaattctcatccaattcttcgacaccgcgcgcgtggataggacccgctcatggctatacgcggcgtgctccatctcttacctcggagccatggtgagcagtaactccgccctccagttcgtaaactaccccacacaggttctaggaaaaagttgcaagccgatacccgtcatgttgcttggggttaccttgctgaagaagaaataccctctcgcgaaatacctgtgcgtactgttaatcgtggcaggagtcgccctattcatgtacaaacccaagaaggtagtcggcattgaagagcacacagttggatatggcgaattgctgcttctcctttcgttaaccctggacggactgacgggtgttagccaggatcacatgcgcgctcactatcagaccgggtcgaaccatatgatgcttaacattaatctttggtctaccctgttgctcggcatgggaatcctgtttactggcgaactgtgggagtttctgtcttttgcggaacggtatcctgcgatcatctacaatatcctgctgttcggactcaccagtgccctcggacagagctttattttcatgactgtcgtatatttcggcccccttacatgctccataatcaccacaacaagaaagtttttcacaattcttgcgtcagtcatactcttcgctaatcctatttctcccatgcagtgggtagggaccgtcctggtgtttttggggctggggctggacgctaaatttgggaaaggagccaaaaagactagccattag

SEQ ID NO: 135283 - DNA, 720 bp, Artificial Sequence
  Description of Artificial Sequence: Synthetic coding sequence
atggccagttcttctagtctggtgcctgacaggctgcggctgccattgtgcttcctcggcgttttcgtgtgctatttctattatgggattctgcaggagaagataacccgtggaaaatacggagagggcgctaagcaggagacttttactttcgccttgacactcgtcttcattcagtgcgtgattaatgcggttttcgccaaaatccttatccagttctttgataccgcaagagttgatcggacacgctcttggctgtatgctgcctgtagtatatcttatctaggagccatggtgagctccaactccgccttgcagtttgtgaattacccgacacaggttttgggcaaatcatgcaagccaattccagtgatgctacttggagttaccctgttgaaaaagaaataccccttggcaaaatacctgtgtgtgctcctgattgttgctggagtcgctctgttcatgtacaagccaaagaaggtagttgggattgaagagcatactgttggctatggggaactgctgcttctgcttagcctgaccctggacgggctaaccggggtcagccaggatcacatgcgagcccactatcagacaggtagcaaccatatgatgctgaacattaacctctggagtaccctcctgctgggaatgggagagtctcagttctgttgcagtagccacgtgagccccgaagggagattgccaagttccttctag

SEQ ID NO: 135284 - DNA, 597 bp, Artificial Sequence
  Description of Artificial Sequence: Synthetic coding sequence
atgctgctgggcgtcaccctgctgaagaaaaagtatccgttggccaagtacctgtgcgtgctattaattgtcgctggggttgcactgttcatgtacaagcctaagaaagtcgttggaatcgaggaacataccgttggatacggagagctgttgctcctgttatccttgacgttagatggtctcacaggagtttctcaggatcatatgagggcacattaccagacagggtccaatcacatgatgctgaacatcaatctgtggagtaccttacttctggggatgggtatactgttcaccggcgaactgtgggaatttctttccttcgccgagagataccctgctattatttataacatcctgctgtttggtctgacttccgccctggggcaaagtttcatattcatgacagttgtgtacttcggcccactaacgtgctccatcattactacgacgagaaagttctttaccattctcgcctccgtcatcctgtttgcaaacccaatatcccccatgcaatgggtgggcacagttttggttttcctgggactggggctggatgccaaatttggcaagggcgccaagaaaaccagccactag

SEQ ID NO: 135285 - DNA, 570 bp, Artificial Sequence
  Description of Artificial Sequence: Synthetic coding sequence
atgctgctcggtgtgactctgctcaagaagaagtatccactggctaaatacttatgtgtcctgctgatcgtggcgggagtggctctgttcatgtacaagcctaagaaggtggtagggattgaggagcacaccgtcgggtacggtgaactgttgctgttgctgtctcttacgctagatggactgaccggagtatcgcaagaccacatgagagcccactatcagaccggctccaatcatatgatgctgaacattaacctgtggagtacactcttgctgggtatggggatattgttcactggagaactgtgggagttcctcagcttcgctgaacggtatccagccatcatctacaacattcttctcttcggcctcacttccgcactgggccagagttttattttcatgaccgtggtgtatttcggcccactgacatgctccattattactaccaccaggaagtttttcaccatactggccagtgttattctttttgccaatcccatttcccctatgcagtgggtgggaacagtgctagtgttccttgccatgggatcttgctgtgtagcctag

SEQ ID NO: 135286 - DNA, 1179 bp, Artificial Sequence
  Description of Artificial Sequence: Synthetic coding sequence
atggatgccagatggtgggccgtggtggtgttggcggcattcccctcacttggcgcaggaggcgaaactccggaggctcctcctgaatcctggactcaactgtggttctttagattcgtcgtaaatgccgcaggatacgcatcgtttatggtgccgggttacctgttagtccagtattttaggcgtaagaactacctggaaactggacgcggcttgtgttttccattagtcaaggcctgcgtgttcggcaacgagcctaaggcctctgacgaggtgccattggcaccaaggacggaggctgccgagacaactcccatgtggcaagccctcaagctcctcttttgtgccaccgggttacaagtctcatatcttacctggggggtcctgcaggagagggtgatgaccaggtcatatggtgccaccgctacatctccaggcgagagatttacggactctcagtttctggtgctgatgaacagagtgctggccctgattgtcgccggattgtcatgtgtgctgtgtaaacagcctagacacggtgctcctatgtaccggtatagtttcgcatcactttccaatgtgttgagtagctggtgtcaatatgaggcccttaaattcgtgtctttccctacacaagtcttagcgaaagcttccaaagtaattcctgtgatgcttatgggaaaactagtgtccaggcgctcctacgagcactgggagtatctgacagccactctgatctcaatcggtgtgtctatgttcctgttatcgagtggtcccgagccccggtccagcccggccactaccctatccggactgttcactgtggggtcgttgctagaacagggggctctgctagaaggaacacgcttcatggggagacactctgagtttgcagcacatgctttattgttatctatttgttcggcatgcgggcaactgttcattttctataccataggacagtttggcgcggccgttttcactataatcatgacattgagacaagccttcgcgattctgttgagttgtctgttatatggacacacagtgacggtggtggggggcctgggagtcgccgttgtgtttgccgcactcctacttagagtgtatgccagaggacgactcaaacagaggggaaagaaggcggtgccggtcgagtctccagtgcaaaaggtgtag

SEQ ID NO: 135287 - DNA, 1299 bp, Artificial Sequence
  Description of Artificial Sequence: Synthetic coding sequence
atggacgcccgatggtgggccgtggttgtcctggccgccttcccaagcttgggtgccggcggggagacccctgaggcaccaccggagtcatggacacagttatggttctttcgtttcgtggtgaatgcagccggatatgcttctttcatggtgcccggttacctgctggtgcagtactttaggaggaagaattacctcgagactggacgggggctgtgctttcccttggtcaaggcctgtgtctttggcaacgagcctaaggcctccgacgaagtacccctagctcctcggaccgaggccgctgaaactacaccaatgtggcaggcactgaagttgctcttctgtgcaaccgggcttcaggtgagttacctgacttggggggttttgcaagaaagggtcatgacccgtagctacggtgctacagcaacttcaccaggcgagcgatttacggatagtcagttcctggtgctgatgaacagagtactagcattgatagttgccggcctgtcctgcgtgttgtgcaagcagcctagacacggcgcccctatgtataggtactcattcgcctccctgtctaacgtcctgtcttcttggtgccagtatgaagcattaaaatttgttagttttcccacacaggtgttagctaaggcttctaaggtgattcccgtgatgttaatgggtaaactggtgtcaaggcggtcgtacgaacactgggaatacctaaccgctaccttgatctcaattggggtgtccatgttcctcctttctagcggcccagagcctagatcgtctcccgctactaccttgtcaggcctgatcttgttggccgggtacattgcctttgacagcttcacatccaactggcaagatgccttgttcgcgtacaagatgagctcggtgcagatgatgttcggcgtgaactttttttcatgcctcttcaccgttgggtctctccttgaacaaggcgccctgctcgaaggcaccaggttcatggggaggcatagcgagtttgctgctcatgcactacttttgagcatatgtagtgcttgcggccagttgttcatcttttataccattggccagtttggagccgctgtctttactattattatgactctcaggcaagccttcgctattctgctcagctgcctcctctacggacacactgttacggtggtgggcggtctgggggtggcggtggtgtttgcagcactcctattgcgggtgtacgccagaggcaggttaaaacagagagggaagaaggctgtgccagtagagtctccagtccagaaggtgtag

SEQ ID NO: 135288 - DNA, 900 bp, Artificial Sequence
  Description of Artificial Sequence: Synthetic coding sequence
atgactagaagctacggagccacagccactagccccggagagcggtttacggattcccagttcctcgtactcatgaacagggttctggcactaatcgtggccggtctgtcatgcgtcttgtgcaagcagcctcgccacggggcaccaatgtacaggtactcctttgctagtctgtccaatgtgctctcttcgtggtgtcagtatgaggccctgaagttcgtgtctttccccacacaggtactggctaaagcctccaaagtcattccagttatgctgatgggcaagcttgtgtctcggcgatcttatgaacattgggagtatctgaccgccaccctgatttctatcggcgtcagtatgtttcttttgagctcgggccctgaaccccgttccagcccagctacgacactgtccggcctgattttgctggcaggatacatcgccttcgattcatttaccagtaactggcaggatgccttgtttgcgtacaagatgagctcagttcaaatgatgtttggagtcaattttttttcttgtctgttcactgtcggtagcctcttggaacagggggccctgttggaaggcacccggttcatgggcagacatagtgagtttgccgcgcacgcattactgttaagcatctgttcagcctgtggccagctcttcatcttttataccattggtcaattcggcgccgccgtcttcactatcatcatgacactccggcaggcatttgctatcctgttgagttgtctgctgtacggccataccgtgaccgtggttggtggattgggcgtggcggtggttttcgccgcccttctgctcagagtctatgcgagaggaaggctcaagcagcgcggcaaaaaagcggtgcctgtggagagcccagtgcagaaagtgtag

SEQ ID NO: 135289 - DNA, 1020 bp, Artificial Sequence
  Description of Artificial Sequence: Synthetic coding sequence
atgctgctggccatgcccgcattgtggtacctggctacttcctggtgcagcacatccggcgggaggaccacatggcgccccgtctcctatctgacttggggagtgttacaggaaagggtcatgacaagatcttatggggccacagcaaccagcccaggcgagcggtttaccgattcccagtttctcgtgctgatgaaccgcgtcctggcactgatcgtggctggcttgagctgtgtgctgtgtaagcagccccgtcacggggccccgatgtatcggtacagttttgcctcactgtctaatgtgctgtcttcttggtgtcagtatgaagcacttaagttcgtctcttttcctactcaggttctggcaaaagcctccaaggtaatcccagtaatgctcatggggaagctggtaagccgaaggtcctatgagcactgggaatacttgaccgctactctcattagtattggggtgtctatgttcttgttaagtagcggtcccgaacctcgaagctcaccagcgacaactctcagtggccttatactgttggccgggtatatagctttcgactccttcacttccaattggcaggatgcattattcgcatataagatgagtagcgtgcagatgatgtttggagtgaatttttttagctgtctcttcactgtcggctcactgctcgaacaaggcgccttgctggagggcaccaggtttatggggagacattccgagttcgctgcccacgctctgctccttagcatctgtagtgcttgcggccaattgtttattttctacacaatcggacaatttggagccgccgtcttcactattatcatgaccttgcgccaagcctttgccatcctgctttcctgtcttttatacgggcacaccgtgacggttgtgggggggctgggcgtcgcagtggtgttcgccgctctgctgctgcgggtatacgcgcgaggacgactcaaacaacgcggcaagaaggccgttcccgtggagtcgcccgtgcaaaaggtgtag

SEQ ID NO: 135290 - DNA, 852 bp, Artificial Sequence
  Description of Artificial Sequence: Synthetic coding sequence
atggatctgacccaacaggcaaaagatatccagaacattaccgtccaggagacgaacaaaaacaatagcgagtctatcgagtgcagcaagataactatggacctgaaattcaataactctaggaagtacatatctatcacggttccatctaaaacccaaactatgtctccacatatcaaatccgtggacgatgttgtggtgctcggtatgaatctgagtaagttcaataagcttacacagttctttatctgtgtcgccggggtctttgttttttacctaatttacggttacctccaggagctgatcttttctgtcgagggctttaagagctgtggctggtatcttactctggtgcagttcgccttctactcaatcttcggcctcatcgaacttcagctgattcaggataagcgccggaggatcccagggaaaacatacatgattatcgccttcttgaccgtcggcactatgggcctgagcaatacctcattaggatacctcaactaccccactcaagtaatctttaagtgttgcaaactgattcctgtcatgctgggaggggtttttatccagggtaagagatacaacgtggccgacgtatccgcagccatctgcatgtccctgggattaatctggtttactttggctgactccaccaccgctcccaacttcaatctgacaggtgtagtgctcattagcctggctctctgcgctgacgctgtgattggaaatgtacaagagaaggctatgaagctgcacaatgcttcaaacagcgagatgaatattacaacgagtagctactccggggtctttatattccctaataaacttaagattcccttagttttatag

SEQ ID NO: 135291 - DNA, 1206 bp, Artificial Sequence
  Description of Artificial Sequence: Synthetic coding sequence
atggaccttacccagcaagccaaagatatccagaacattaccgtgcaggaaacaaacaagaataactctgaaagcatcgagtgcagtaagattaccatggatctgaagttcaacaattctaggaagtacataagcatcacagtgccctcgaagacacagaccatgagtccgcacattaagagcgtcgacgacgtagtggtgctgggcatgaacctgtccaagtttaacaagctgactcagttttttatttgcgtcgccggcgtttttgttttttatctcatatacggctacctgcaggagcttattttcagtgtcgagggatttaagtcttgcggttggtatctaacactcgtgcaattcgccttttattcaatattcggcctgattgaattgcagctaatccaggacaaacgccgacgcattccgggcaagacctacatgatcattgccttcctgacagtgggtactatggggctcagtaacacaagccttggttatctgaattaccccacacaggtgattttcaagtgttgtaagctcatacctgtaatgctaggaggcgtattcatccaagggaagcggtacaatgtcgccgacgtgagcgctgctatttgcatgagtttgggactcatctggttcactctggcagacagtacgacggcccccaactttaatttgactggagttgtcctgatcagcctggccctttgtgccgacgccgtgatcgggaatgtgcaggagaaggccatgaaattgcacaacgcatctaactcagagatggtgctgtactcttatagtatagggttcgtgtatattctgttgggtttgacctgcacatctggccttgggcctgctgtgaccttttgcgcgaagaaccctgttagaacatacggatacgccttcctgttcagtctgacaggctactttgggatctcattcgttctggctctgatcaagatttttggtgcattgattgctgtgacagtgactaccggcaggaaggcaatgacaattgtcctatccttcatattcttcgccaagccatttacatttcaatacgtgtggtctggcctactggtggtgctggggatattcctcaatgtatatagcaaaaatatggataagatccgactgccctcactgtacgatctgattaataagagcgtggaagccagaaagtcgagaacattggcccagacagtctag

SEQ ID NO: 135292 - DNA, 657 bp, Artificial Sequence
  Description of Artificial Sequence: Synthetic coding sequence
atgctgcgcctggcgcagacccctaggcggctaccttcccctttcagagtgacatatcgaccctggggcacaagggcattcggagcgttccccgttttcggaacacagataagctctccccctgagaaccttgataccgcccatctgcctcatcccgagggagctttcgaggaatggatgagaagtgggtggaagaaaagagatctaacccagcaggctaaggatatccagaacatcacagttcaagagacaaacaagaataattcagaatcaatcgagtgctcgaagattacgatggatctcaagttcaataacagcaggaaatacattagcattaccgtcccctccaaaacccaaaccatgtctccacacatcaagagtgtcgatgatgtggtggtcctgggcatgaacttgagcaagtttaacaagcttactcagtttttcatctgcgtcgcaggcgtgttcgttttctacctgatttacggatacctgcaggagctgattttcagtgtggaggggttcaagtcatgcggttggtatttgaccctagttcagttcgcattctactctatattcggcctcatcgagcttcagctgatacaggacaaacggcgccgctacgtggtgtgtttttatttcctgatcttcctgtactag

SEQ ID NO: 135293 - DNA, 996 bp, Artificial Sequence
  Description of Artificial Sequence: Synthetic coding sequence
atgcgccccgcgctggcagtgggcctagtttttgctggctgctgttcaaatgtgatattcctggaactcttagctagaaaacatccaggatgcggaaacatagtcacctttgctcagttcttgtttatcgccgtggaggggttcctattcgaagctgacttgggtcggaagcctcccgcgatccctatcaggtactacgccattatggtcaccatgttcttcaccgtttcagttgtgaataactacgctctcaatctgaatatcgccatgcctctgcacatgatttttagaagcggaagtctcatcgccaatatgattctgggcattataattttaaaaaaaaggtattccatatttaagtacacaagcatcgctctggttagcgtgggcattttcatatgcacgtttatgtctgccaagcaggtcactagccaaagctccctgagcgagaatgatggcttccaggcattcgtgtggtggctgcttggtatcggcgcactgacttttgccctactgatgagcgcaagaatgggaattttccaagagacattgtataaacggttcgggaagcactctaaggaggccctgttctacaaccatgccctgcctctgccgggcttcgtgtttttggcctccgacatctatgaccacgccgtcttgtttaacaaaagtgagctctacgagattcctgtgattggagtcacactacctattatgtggttttaccttctcatgaatattatcactcaatacgtatgcatccgaggagtgttcatcctgacaactgagtgtgcctcacttacagtgaccttggttgtgactttgcgcaagttcgtgagcctgattttctcaattctttatttccaaaatccctttaccttatggcattggctgggcacactgttcgtgtttatcgggacgctgatgtacaccgaagtgtggaacaacctaggcaccactaaatcagagccacagaaagactcaaagaagaactag

SEQ ID NO: 135294 - DNA, 1095 bp, Artificial Sequence
  Description of Artificial Sequence: Synthetic coding sequence
atgaatagagcacccctcaaacgatcccgcatccttcacatggctttaaccggcgcgtccgatccgtccgccgaagccgaagctaacggcgagaaaccttttctgctgagggccttgcagatcgccctggttgtgagcctgtactgggtcacaagtatctcaatggtattcctgaataagtacttgttagactctccttctctgcgactcgatacacctatatttgttaccttctatcagtgtttggtcactacactcctttgtaagggcttgtcagctctcgccgcatgctgccccggagccgttgacttccctagcctccgcctggatctgagagtggccaggagcgtacttcccctttcggttgtgttcatcggaatgatcactttcaataacctgtgtttaaagtatgtcggcgtagccttctacaatgtggggagaagccttacaaccgtgttcaatgtactcttatcctatttactgctgaaacagactacctcattttatgctttgctaacatgtggaatcataattgggggcttctggctgggggtcgatcaggaaggtgccgagggaactctcagttggctgggaactgtgttcggagtcttggctagcctctgcgtgagcttaaacgccatttacacgaccaaggtcctgccggccgtggatggctctatttggagactgacattttacaacaacgtgaatgcctgtatacttttcctaccactgctgttgttgctcggggaactacaagcgctccgtgacttcgctcaactcggaagcgctcacttttggggcatgatgaccctggggggcctgtttgggttcgccatcggttatgtaactgggctacagatcaagttcacaagccctctcacacataacgtgtccggtacagccaaggcctgcgctcagactgtgcttgccgttctgtattacgaggaaacaaagagcttcctgtggtggacctctaacatgatggtgctgggagggagcagtgcctatacttgggtcagagggtgggagatgaagaaaaccccagaagagccttcccccaaagatagtgaaaaatccgccatgggtgtgtag

SEQ ID NO: 135295 - DNA, 1056 bp, Artificial Sequence
  Description of Artificial Sequence: Synthetic coding sequence
atggcactgacaggtgcctcagaccccagtgctgaggcagaggccaacggtgagaaaccttttctgctccgcgccctccagattgccctggtagtgtccctgtactgggttacatccatcagtatggtgttcttgaataagtatctgctggactctccttcactgcggctggacacgccgatcttcgtgaccttttaccagtgtctggtgaccaccctgctatgcaaagggctgagcgccctggctgcatgctgtccaggggccgtggattttccatccctcagacttgacctccgtgttgctagatcagtgctgccactgtcagttgtcttcatcggaatgatcacattcaataatctctgccttaagtacgtgggagtcgctttctacaatgtgggacgcagcctgacaaccgtgttcaacgttctgcttagttatctgttgctcaagcagactactagcttttatgccctgctgacttgcggaatcatcatcggtggcttctggctcggcgtggaccaggaaggcgccgaaggaaccctctcttggctgggcaccgtgttcggcgttctcgcttcactctgtgtgagcctgaacgctatctatacaaccaaagttctgcccgccgttgacgggtcaatttggcgcctgacattttataacaacgtgaatgcctgtatcttgttcctgcccttattgctcttgctcggtgaactgcaggcattaagagatttcgcccagctcggctcagctcatttctgggggatgatgacactggggggtttattcggctttgcgattggctacgttacaggacttcagattaagtttacatcaccccttactcataacgtgtctggcaccgcaaaggcatgtgcacagacggtgcttgcagtgctgtactacgaggagaccaaatcttttttatggtggactagtaatatgatggttcttggtgggagcagcgcgtacacttgggtgaggggctgggagatgaaaaagactccggaggagccatcacccaaggactccgagaagagtgccatgggtgtctag

SEQ ID NO: 135296 - DNA, 1056 bp, Artificial Sequence
  Description of Artificial Sequence: Synthetic coding sequence
atggctctaacgggcgcttccgacccgtctgccgaggcagaagccaacggagagaaaccctttctccttcgggcactgcagattgcccttgtggtcagcctgtattgggtgacttcaatatcgatggtgttcctgaacaagtacctgctggattccccgtcattgagactggatactcccattttcgtgactttttaccagtgcctggtgaccacactgctgtgcaaggggttaagcgctctggcagcctgctgtccaggcgcagtggatttcccatctttgagactggatctcagggtggccagaagcgtcttgcctctttccgtggtgtttattggaatgattaccttcaacaacttgtgcctcaagtacgtgggggtcgcgttctataacgtgggacgctccctgactaccgtctttaacgtattgctttcctacttactcctcaaacagacgaccagtttttatgcactcctgacttgcgggatcatcattggcggattttggctgggcgtcgatcaggaaggagctgagggtactctgagctggctagggaccgtgtttggggtgcttgcctcactgtgcgtaagtctcaatgctatctatacaacaaaggtactccccgccgttgacggttctatttggagactcacgttctacaacaatgtgaatgcttgtattctctttctgcctctcctgttactgcttggggaactgcaggccctgagagatttcgcgcagctgggttccgcccacttctggggaatgatgactttgggaggcctgtttggttttgccatcggatatgtgacagggctccaaattaaattcaccagtcctctgacacataacgtgagtggcacagccaaggcttgtgcacaaactgtgctggcagtgctttattacgaggagactaaaagctttttgtggtggactagtaacatgatggttctgggagggtccagtgcctacacgtgggtgcgggggtgggagatgaagaagaccccagaggaaccttcccccaaagattctgagaagtcagccatgggtgtttag

SEQ ID NO: 135297 - DNA, 219 bp, Artificial Sequence
  Description of Artificial Sequence: Synthetic coding sequence
atggccctgacaggagcctccgatccgtctgccgaggcggaagccaatggcgagaagcctttcttattgagggcactacaaatcgccctcgttgtaagtctgtactgggttacaagtatctctatggtgtttctgaacaaatatttactcgatagcccgagcttacgcttggacaccccaatctttgttaccttctatcaatgcttagtaacaacctag

SEQ ID NO: 135298 - DNA, 498 bp, Artificial Sequence
  Description of Artificial Sequence: Synthetic coding sequence
atggccctaaccggcgcgtccgatccttctgcagaagcagaggctaacggcgagaaaccgtttctcctccgcgcactccagattgcactagtggtctctctgtattgggtgacctcaatttccatggtctttcttaacaaatacctcttggattccccctccctgcgtctggacaccccgatcttcgtgaccttctaccagtgtttggtgacaaccctactgtgcaagggtttgagcgccttggcggcctgttgcccaggagccgtcgacttcccctctctgaggctggaccttcgggtcgctcgctcagtcctacccttgagcgtagtgttcattggcatgattacgttcaacaatctatgtttaaaatacgtaggcgtagcattttacaacgtgggtagatcccttacaacggtgtttaatgttttgctgtcataccttctactgaagcaaactaccagtttttacgcactgctgacttgcggaattatcatatag

SEQ ID NO: 135299 - DNA, 741 bp, Artificial Sequence
  Description of Artificial Sequence: Synthetic coding sequence
atgaaccgcgcccctcttaagcggagtaggatactgcatatggcattaacgggtgcgtcagatccctctgctgaggccgaggctaacggagagaagcccttcctgctgcgggccttgcaaatcgccctggtggtttcgctatattgggtcactagcattagtatggtatttttgaataaatacctgcttgattcgcccagtctgcggctcgacaccccaatctttgtcactttctaccagtgcctggtcactacactactttgcaagggcttatcggctctggcagcatgctgtccgggggccgttgactttccctccttacgcctggatttgagggtggcacgatcagtattgcctttgtccgtcgtttttattggaatgatcacctttaacaacctttgcctgaagtatgtgggagttgctttctacaatgtcggccgaagtctgaccactgtgttcaacgttctcctctcgtatctgctcctgaaacagaccaccagtttctatgcccttctcacttgtggaattattatcggggggttctggctcggagtggatcaggaaggtgcagaaggaactctgtcttggctgggtaccgtgtttggggtgctggcctccctgtgcgtaagtctgaacgctatatacactaccaaggtgttgcctgcggtggacggcagcatttggagactgacattttataacaacgtgaacgcttgcatcttgtttctccctcttctgtag

SEQ ID NO: 135300 - DNA, 1014 bp, Artificial Sequence
  Description of Artificial Sequence: Synthetic coding sequence
atgaccgcaggcggacaggccgaggcagagggggcgggcggggagccaggtgctgcccggttgccctcccgggtggctcgcctgctgagcgccctgttctacggaacatgttcatttcttatcgtgttggtgaacaaggccttgttgactacctacggcttccccagtccgatcttccttgggattggccagatggctgctacaattatgatactgtatgtctctaaactgaataaaattattcatttccctgattttgacaaaaagatccccgtgaaattgttcccactgccattgctctacgtgggaaatcacatcagcggtctaagcagcacttcaaaactgtctctgcctatgttcacagtgctgcgcaagttcaccattcccctgaccctactcttggagaccatcattttggggaaacagtatagcctgaacattattcttagtgtgttcgccatcatccttggagcttttatagcagccggctcagacctcgcattcaatttagaaggctatattttcgtatttttgaatgatatcttcacagccgcaaacggggtgtacacaaagcaaaaaatggatcctaaagagctcgggaagtatggcgttctcttctataatgcctgctttatgatcattcccactttgattatttccgtttccaccggagacctacagcaggcaacagagtttaatcagtggaaaaatgtagtatttatactgcaatttttactctcatgtttcctgggtttcctactgatgtactctactgtgttatgttcctactataatagcgccctcacaacagccgtagtgggagctatcaagaatgtgtccgtggcatacataggaatccttatcgggggagactacatattttccctactcaatttcgtcggcttgaacatctgcatggccgggggtctacgatactccttccttaccctgagctcccagcttaaaccaaagcccgttggcgaggagaacatatgtttggacctcaagtcttag

SEQ ID NO: 135301 - DNA, 492 bp, Artificial Sequence
  Description of Artificial Sequence: Synthetic coding sequence
atgacggcaggaggccaggcggaagctgaaggcgcaggcggcgagcccggggccgccagactgccttccagggtcgcaaggttactgagtgccctcttttacgggacatgtagctttctgattgtattggtgaataaagccctgctgacaacatatgggttcccgtcccccattttccttgggatcggccaaatggccgctacgattatgatcctgtatgtgtccaaactgaacaagatcatccacttcccggacttcgacaaaaaaattcccgtgaaacttttcccactccccttactgtacgtcggaaatcacatatccggcctctcctctacgtcaaagctcagtctcccaatgttcacagtgctacggaaatttacgattccactgacactcctgctggaaacaatcatactgggtaagcagtacagccttaacatcattctgagcgtttttgccatcattcttggagcgtttatcgccgccggctag

SEQ ID NO: 135302 - DNA, 750 bp, Artificial Sequence
  Description of Artificial Sequence: Synthetic coding sequence
atgacagctggaggccaggcagaagctgaaggtgccggaggcgaacctggcgccgctagactacccagccgcgtggcaagactcttatcggctctgttttacgggacttgtagcttcctcattgtgttagtcaataaggctttgctaaccacctacggttttcctagcccaatttttctcgggattggtcagatggccgccactattatgattttgtatgtttccaagctcaacaagattatccacttcccggacttcgacaaaaagattcctgtgaaattattccccctcccactgttgtacgtgggtaaccacatttcgggtctaagctcaacctcaaagctgtctctgccgatgttcacggtcctccggaagtttaccattcccctcactttattgttagagaccatcattcttgggaaacaatattcactgaacatcattctttccgtattcgctattattctcggggcctttatcgccgctggttttctgctaatgtatagtacagtgctgtgtagctactacaatagtgcattaactaccgctgtcgtgggtgccatcaagaatgtttctgttgcttacataggtatcctcatcggtggcgattacatttttagtctgttaaacttcgttgggttaaacatttgcatggcaggagggctcagatatagtttcctgaccctcagctcccagctcaaacccaagcccgtcggggaggagaatatctgcctggaccttaagtcatag

SEQ ID NO: 135303 - DNA, 1251 bp, Artificial Sequence
  Description of Artificial Sequence: Synthetic coding sequence
atgcgccagttgtgtagaggaagggttttagggatcagcgtggctattgcgcatggcgtgttcagcggcagtctgaacatcctgcttaagttccttattagccgttatcaattctcttttttgacactcgtgcagtgcctgacgtcctcaacagctgccctatctctcgagctgctgagacggttaggcttgatcgccgttccaccctttgggctaagcctggcccggtcattcgcgggggtcgcagtactgagcaccctgcagtccagcctgactttatggagtctgcgtggcctgtcactccccatgtacgttgtctttaagcgatgcctcccactcgttacaatgttgataggcgtccttgtacttaagaacggagctcctagtcccggcgtgctggccgcagtgctcataactacttgcggcgcagcactggccggtgcgggtgaccttacgggcgacccaatcgggtacgttaccggcgttttagcagtcctcgtccacgccgcataccttgttctgatccagaaagcatcggccgataccgagcatggaccattgaccgcgcagtacgtgatagcagtgtcagccactcccctcctggttatctgtagcttcgcaagcacggactcgatccatgcatggaccttcccggggtggaaggatccagccatggtctgcatatttgtggcctgcatactgattggctgtgcaatgaactttaccactctgcattgtacctacatcaattcagctgtgacaacatcattcgttggcgtggtcaagagcatcgccactatcacagtgggaatggtggccttttcagatgtcgagccaacaagcctcttcatcgccggcgtggtcgtaaacacactgggtagtataatctattgtgttgccaagtttatggagacacgaaagcagtctaattatgaagatctggaggctcaacctagaggcgaggaggcgcagctttctggcgatcaactccccttcgtgatggaggagttgccaggagagggtgggaacggccgctccgagggcggagaggctgccggagggccggcccaggaaagcagacaggaggtgagaggttccccgagaggcgtcccgctagtagcagggagcagcgaggagggatcaagaagatctctcaaagacgcgtatctggaagtgtggagactcgtgcggggcactaggtatatgaagaaagactacctgatcgagaacgaggaacttccttctccgtag

SEQ ID NO: 135304 - DNA, 1431 bp, Artificial Sequence
  Description of Artificial Sequence: Synthetic coding sequence
atgagtactcagcggctgaggaatgaggactaccacgattactcttccaccgacgtctcccccgaggagagtccaagtgaaggtctcaataatctttcttcacccggttcgtatcagagattcggacaaagcaattcaacaacctggtttcagacgctgatccatcttcttaaaggcaatattggtactggcctgctgggcttgccactggccgtgaagaacgctggcatcgtaatgggacccatatccttgttgattatcggtattgtggccgtacattgcatgggtattctggttaaatgcgcccaccatttctgccgccgattgaacaagtcttttgtagattacggggacactgtgatgtacggtctggaaagcagcccgtgctcatggctccgcaaccatgctcactggggtagaagagtagtggatttctttctcatcgtcacacagttgggattctgttgcgtttatttcgtcttcctcgccgacaacttcaagcaggtaattgaagcagcgaacggaacaaccaataattgtcacaataatgagaccgtgattcttactccaacaatggacagtaggttgtacatgctttcattccttccattcctcgtgcttcttgtatttatcagaaacctgagggctctatcaatcttcagtcttcttgctaatattactatgcttgtgagtctggttatgatatatcagttcattgtgcaaaggatccccgacccatctcacctgcctctcgttgctccgtggaagacctaccctttgttcttcggcactgctatttttagctttgagggaattggtatggttcttcccctcgagaacaagatgaaggaccccagaaaattccccctcatcctgtacctaggcatggtaattgtgaccattctctacatctcattgggctgcctggggtatttgcaatttggtgccaacatacagggatccatcacattaaaccttcctaactgttggctgtaccaaagcgtcaaactgctatacagcatcggaattttcttcacttatgctctgcagttttacgtgccagctgagatcatcatcccattctttgtcagtcgcgctcccgagcactgcgagcttgtcgtggacttgtttgtgaggactgtgcttgtctgcttgacctgtattctggccattctgatacccagactggacttggttatctccttagtggggtccgtgtccagttccgctttggccctaatcattccacccttgctggaagttacaaccttctattctgaaggtatgtcacctcttacaattttcaaggatgccttaattagtattttggggtttgttggtttcgtggtcgggacctacgaggccttgtatgaactgattcagcccagtaacgccccaattttcatcaacagcacttgcgctttcatatag

SEQ ID NO: 135305 - DNA, 1161 bp, Artificial Sequence
  Description of Artificial Sequence: Synthetic coding sequence
atgtccacccagcgacttaggaatgaagactaccatgactactcttccacagacgtgtcccctgaggaaagtcccagcgagggacttaataatctgagttcacctggctcttaccaacggtttgggcagtctaattcaactacctggttccagactcttatacacctgttaaagggtaatattggaaccgggctacttgggttaccactagccgttaagaatgccggaattgttatgggccccatctccctcctgataatcggcattgtggccgtgcattgcatggggatccttgtgaaatgcgcacaccatttctgtcggcgtctcaataagagctttgttgattacggagacactgtgatgtacggcctggagagttcaccctgttcgtggcttagaaaccacgcacactggggaaggcgagtagtggacttcttcctgatcgtgacacagcttggcttctgctgcgtgtattttgtttttctggctgacaacttcaagcaagtgattgaagcagctaatggcacgaccaacaattgtcacaataacgagaccgtcatcttaactccgacaatggattcgcgcttgtatatgcttagcttccttccctttctggtgttgctggtgtttatacgcaatctgagagccctaagcatattctccctcctcgcaaacattactatgctcgtgtcactcgtgatgatctatcagtttattgtacagcgtataccagatccaagccatctgcctttggtagcaccatggaagacataccccttgttcttcgggacagcaatcttctcatttgagggtatcggaatggtcctccccctggaaaataagatgaaggaccccagaaagttccctctgatcctttatctgggtatggttattgtgacgattctgtacatctcactgggctgcttaggttatctgcagtttggcgcaaacatccaaggctctatcactttgaatttaccaaactgctggctctaccagtctgttaagcttctgtatagcatcgggatattctttacttacgccctgcagttctatgtgcctgctgagatcatcattcccttctttgtcagccgcgcacctgagcactgcgaactggtcgtggatctgtttgtcaggactgtgctggtatgcctgacctag

SEQ ID NO: 135306 - DNA, 213 bp, Artificial Sequence
  Description of Artificial Sequence: Synthetic coding sequence
atgagtacacagagacttcggaatgaggattaccatgattactcctccacagacgtgtctccggaagaatccccttccgagggattgaacaatctctcctccccaggctcctaccaacgcttcggtcagtcgaacagtaccacatggtttcagactctaattcatttgcttaagggaaatatcggaaccggattgttgggtctaccgctgtag

SEQ ID NO: 135307 - DNA, 219 bp, Artificial Sequence
  Description of Artificial Sequence: Synthetic coding sequence
atgtcaactcaacgtttaagaaatgaagactatcacgactattcatctacggatgtgagtccagaagaatcaccgagcgaaggcctgaataacctaagctctcctggttcataccagcgcttcggacagtctaacagtacgacctggttccagaccctgatccatctgctgaaaggcaatataggcaccggcctcttaggtttgccgctggcggtatag

SEQ ID NO: 135308 - DNA, 1431 bp, Artificial Sequence
  Description of Artificial Sequence: Synthetic coding sequence
atgtccacacagagattgcggaacgaagattaccacgactattcatccaccgacgtgtctcccgaggaatcaccgagcgagggtctgaataacctctcatctccaggctcttaccagcgatttgggcagtctaatagtactacgtggtttcagacactcattcacctgttaaaaggcaacattgggacaggactactgggactccccctggccgtaaagaacgcaggcatagtgatggggcctatcagtctgctgatcataggcatagtagctgtgcattgcatgggaattttagtgaaatgcgcacatcatttctgcagaagacttaataaaagctttgtggactacggggatacagtgatgtacggtctcgaatcgagcccatgttcctggctccggaaccacgctcattggggccgaagggtggtcgactttttcttgatcgtaacacaactgggtttttgctgcgtatattttgtatttcttgccgacaacttcaagcaagtcatagaggcagctaacggaactactaacaattgtcacaataacgagactgtgatcctcacaccaaccatggacagcagactgtatatgcttagctttctgcccttcttggttctcctcgtatttattcgcaacttgcgcgccttgagcatcttctccctcctggctaacattacaatgttggtcagcctcgtcatgatctatcagtttatagtgcagagaattcccgacccaagccatctcccactggtggcaccctggaaaacataccctctgttttttggaaccgcgatcttcagcttcgagggcattggcatggtgctgccactcgagaacaagatgaaggatccgagaaaattcccattaatcctgtatctgggcatggtcattgttacaattctgtatatttcactggggtgcctgggataccttcaatttggagctaatattcagggatcaatcacgcttaatttacctaactgctggctgtaccagtcagttaagctcctttatagcattggcatattttttacttatgccctgcaattttacgtacccgctgaaatcatcatccctttcttcgtgtcccgcgcccctgaacactgtgagttggtggtagacctgttcgtgagaacagtactggtctgccttacgtgcattctcgcaatcctaatccctcggctcgacctagtgataagcctagtgggcagcgtgagtagctcagccctggccttaattattccccctctgctggaagtcacgaccttctattccgaggggatgtctcccctgacaatttttaaggatgccctcatttctattctcgggtttgtcgggttcgtcgtagggacgtatgaggcactctacgagctgattcagccttctaatgcacctatctttatcaactcaacctgcgcattcatttag

SEQ ID NO: 135309 - DNA, 1167 bp, Artificial Sequence
  Description of Artificial Sequence: Synthetic coding sequence
atgtcaacccagcgattgcgaaatgaagactatcatgattatagcagtacagacgtctcaccagaagagagccccagcgaaggccttaacaatctgtcctcaccaggatcatatcaacgctttggtcagtcaaactctaccacatggttccagacactaattcaccttcttaagggtaatattgggacggggctgctagggctcccgttggcagtgaaaaacgcagggatcgtgatggggcccatatcgctccttatcattgggattgtcgccgtccattgcatggggattttggtcaaatgtgctcaccatttttgtcgccggctcaataagagttttgtcgactatggggacaccgtgatgtacggtctggagtccagcccatgctcctggttgcggaaccatgctcactggggcaggcgagttgtagactttttcctgatcgtgacccagctcggcttttgctgcgtgtactttgtctttctggctgataacttcaaacaggtaattgaggcggctaacggcacgactaacaattgccacaataatgaaaccgttattctgaccccaacaatggactcccgcctgtacatgctgtcattcctgcccttcctggtgcttctggtgttcatccgaaacctcagagcactttctatattcagccttctggcgaacatcactatgctggtatcactggtaatgatttaccagtttatagtccagcgcattccagatccttctcatctgccccttgtggccccatggaagacctatcccctcttctttggcaccgcaattttcagctttgaagggataggcatggtgctgccgctggagaataagatgaaggacccacggaagttcccactgattctgtacttgggcatggtaatagtcaccattctgtacatttctctcggctgtcttggatatctccagtttggggccaacattcaaggcagcattacactgaacctaccaaattgctggctgtaccagagcgtcaagctgctatatagtatcggtattttctttacgtatgcgttgcaattttatgtgcccgctgaaattatcatacccttcttcgtctcccgcgcgccagaacactgcgagttggtcgtggacttgtttgtcaggacagttttagtctgtctgacgtgcgagtag

SEQ ID NO: 135310 - DNA, 1452 bp, Artificial Sequence
  Description of Artificial Sequence: Synthetic coding sequence
atgtccgtcactaagtccacagagggccctcagggagctgtggctattaagctggacctgatgtctccccccgagtcagcaaaaaagttagagaataaggacagcaccttcttagatgagagcccttcagaatctgccggcctgaagaaaactaaaggcattacagtattccaagccctgatccatctggtgaaagggaacatggggacgggcattctcggactcccacttgccgtgaaaaacgcaggaatcctgatgggtccgctgtctttattggtgatggggtttattgcctgccattgtatgcacatcttggtgaagtgtgcacaaagattttgcaagcgcctgaataaaccattcatggattacggggatactgtgatgcacggtcttgaggctaacccaaacgcctggttacagaatcacgcacattgggggcggcatattgtgtcatttttcctgattattacccagcttgggttctgctgtgtatacatcgtgtttctggccgataacctgaaacaggtcgtggaggccgtgaattccaccacaaacaactgctattcaaatgagactgtgatattgacacctacaatggactcccggttgtatatgctctccttcctgccatttcttgtgttgctggtcctcatcagaaatcttagaatcctcacgatcttctcaatgctagcaaatatctccatgctcgtgtcactggtgattattatacagtatataacccaggagataccagatccttccaggttgccgctggttgcgtcatggaagacctatcccctctttttcgggaccgcaatcttttcatttgagtccatcggggtggtcctacccctcgagaataaaatgaagaatgcccggcattttcctgccattcttagtctcgggatgtcaattgtcacctctctgtacatcggaatggccgctttgggttaccttagatttggcgacgacatcaaagctagtatcagtctgaacctgcccaactgctggctctaccagtcagtaaagctgctgtacatagccggcatcctttgcacttatgctctacagttctacgtgcctgctgaaatcataattccttttgctattagcagagtgtcaacaaggtgggccctcccacttgacctgtctattagactggtcatggtgtgtctgacatgcttgctcgctatcctaataccacgactggatctggtaatctccctggtaggatctgtctccggcactgcgctagcgctgatcattcctcccctgcttgaagtcaccaccttctatagcgagggcatgtccccactcaccatctttaaagatgccctgatctcaattctgggatttgtagggttcgttgtgggcacttaccaggccttagacgagctgttgaaaagcgaggattcccacccattctcaaattccacaacttttgttagatag

SEQ ID NO: 135311 - DNA, 624 bp, Artificial Sequence
  Description of Artificial Sequence: Synthetic coding sequence
atgaacgatacggcagtattgccactcgaaaataaaatgaaaaatgctaggcacttccccgcgatcctgagcctgggcatgtctatcgtgacgtctctctatatcggcatggccgcccttgggtacctcaggtttggagatgacataaaggcctccatctcactcaacctacccaattgctggctgtatcagagcgtgaagctgctgtatattgccgggatcctctgtacatatgcactgcagttttatgtgcccgctgaaataatcattccgttcgctatctcacgggtcagcactaggtgggcccttccattggatttaagcattaggctagtgatggtttgcctcacatgtctgctcgctatcctgatcccaagactcgacctggtaatctcactggtcggatccgtctccggcactgcccttgcactgattatcccaccactactggaagtcacaactttctattccgaagggatgtcacccctgacaattttcaaagatgctctgatctcaatactaggcttcgtgggatttgtggtgggtacgtaccaggctctcgatgagttactgaaaagcgaagactcacaccctttctccaacagtactaccttcgtgcgttag

SEQ ID NO: 135312 - DNA, 1413 bp, Artificial Sequence
  Description of Artificial Sequence: Synthetic coding sequence
atgtctttgctgggcagggattacaactcagagttgaacagtctcgacaacggacctcaatcaccgagcgaatctagctcaagcattactagcgagaatgtgcatccagcaggtgaagctggcctgtcaatgatgcagactctgattcacctgctcaagtgcaatattgggacaggtcttctcggactacccttggctatcaagaatgccggtctgctcgttgggccagtgtctctactcgcaatcggcgtgctaactgttcattgtatggtaatcctgctcaactgtgcacagcatttatcacagcgcctccagaagacatttgttaactacggagaagccactatgtacgggctggaaacttgtcccaacacatggttgagagcccacgccgtctggggacgctataccgtgagtttcctgcttgtcatcacccaactggggttctgttccgtctactttatgtttatggctgacaacttgcagcagatggttgaaaaagcccatgttacctcgaacatctgccagcctagagaaatcctgacactaacccctatactggatattcgcttctatatgctgattatactcccatttttaatattattggtgtttattcaaaatctcaaggtgctctctgtgttctcaactctggcaaatatcacaacccttggctctatggctctcatctttgagtatataatggagggcattccatatccgagcaacctacctctcatggccaactggaagacatttctgttgttctttggaacagctatcttcaccttcgagggagtcgggatggtgctcccgctcaaaaaccagatgaaacatccccaacagttctcctttgtgttgtacctgggtatgtctatcgttattattttatacatcctgctggggaccctgggctacatgaagtttgggtccgacactcaggcatccattacactgaatttgccaaactgttggctctaccagtcggtgaagttaatgtattcgattgggatcttcttcacctacgccctacagtttcatgtgccagccgagatcattatcccgttcgcgatctcacaggtcagcgaaagctgggcgctctttgtggacctgtcagtgcggtctgcactcgtctgtctgacttgcgtctccgcaattctgattcccaggcttgatctggtaatctcgttagttgggtcagtctcttcaagcgctctggcgctgattatccctgctctgctggaaatcgtgatcttttactcagaagacatgagttgcgtaacgatagcaaaggatattatgatctccatcgtcggccttctgggatgcatcttcggaacataccaggccctctatgagttacctcagcccataagccattccatggctaattccacaggtgtgcatgcatag

SEQ ID NO: 135313 - DNA, 1536 bp, Artificial Sequence
  Description of Artificial Sequence: Synthetic coding sequence
atgagcctgctgggacgcgactacaactctgagctaaattctcttgataacggaccgcagagcccatctgaatcctccagcagcatcactagtgaaaatgtacaccctgctggcgaagccggactttctatgatgcagaccctgatccacctactcaagtgcaacattgggaccgggttgttgggcctccccctggccataaagaacgccgggttattagtgggccccgtatcactgctcgctataggcgtgctcaccgtccactgcatggtgattttgctcaactgcgcacagcacctctctcagcgactgcagaaaacctttgtcaactacggtgaagccaccatgtatggtttagaaacctgtcctaacacctggctccgggcacacgccgtgtggggccgctggaacctcgctctttctccacgactagagtgcagcggtaaaataagtgctcattgtaatccccatctccaggggtcttctaactccccggcccaggcttccagagtggccggcatttatcggtacacagtctccttcctccttgttatcactcaactgggcttttgctccgtctactttatgttcatggccgacaacctgcagcagatggttgagaaggcccacgtcacctcaaatatttgtcagccacgagaaatactcacactgactcccatcctggacattagattttatatgcttatcattctcccgtttttaatactcctggtgttcatccagaatcttaaggtgttgtcagtctttagcacccttgctaatataactacactgggcagcatggccttgatcttcgaatacatcatggagggcatcccctatcccagcaacctgcccctgatggcgaattggaagactttccttctcttttttggaacagcaatattcacattcgagggcgttggtatggtgttgcccttaaaaaatcaaatgaaacatccccagcagttcagctttgtgctgtacctgggaatgagtatcgtgattatcctgtacattctcctgggaaccttgggctacatgaaatttggttctgatacacaggcctcaattacactcaatctgcctaactgttggttgtatcagagcgtcaaattgatgtactctattggaatcttctttacatatgccctccaattccacgtgccagccgagattattatacccttcgctatatctcaggtgtcagagtcctgggccttattcgtcgacctgtccgtgcggagcgctctggtgtgcctcacttgtgtgagcgctatcctaatccctaggctggatctagtcatctctctggtgggctcagtgtccagttctgccctggcactaattattccagctctgctcgaaattgtgatcttctatagcgaggacatgtcatgtgtgaccatcgctaaggacataatgatatccatcgtggggctcttaggatgcatcttcgggacttaccaggccttgtacgaactgccacagccaattagccactccatggccaatagtactggtgtgcatgcctag

SEQ ID NO: 135314 - DNA, 1515 bp, Artificial Sequence
  Description of Artificial Sequence: Synthetic coding sequence
atggaagctgccgcaaccccggcggccgccggagcggcccgccgcgaggagcttgacatggacgtcatgcgccctctgattaacgagcagaattttgatggcacctcagatgaagaacacgaacaagagttactgcctgtccaaaagcattatcagctggacgaccaagaggggatctcatttgtgcagaccctgatgcacctgttaaaagggaatataggcactggacttttagggctgcccctggccatcaagaatgccgggatcgtgttaggacccatctctctggtctttatcggcatcatctcagtgcactgcatgcacatccttgtgaggtgttcacacttcctctgtctgagatttaaaaagtctaccttgggctacagcgacaccgtttccttcgccatggaggtgtccccctggtcatgccttcagaaacaggcagcctgggggcgaagtgtggtggatttctttttggttattacgcagctcgggttttgcagtgtttacatcgtctttcttgccgagaacgtgaaacaagtgcacgaaggcttcttagagtccaaggtattcatctccaactcaactaacagcagcaatccctgcgagcgccgctccgtcgacttacggatctacatgctttgctttctcccatttattatactgctcgtgttcatcagagagctgaagaatctgtttgtgctatcgtttcttgctaatgtgagcatggccgtaagcctggtgatcatctatcagtatgtagtgcgcaatatgccagacccgcataatttacccattgttgctggttggaagaagtacccgctatttttcggaaccgcagtcttcgcgttcgagggtatcggtgtggtactcccactggagaatcagatgaaggaatcaaagcgtttcccgcaggctctgaatattggcatgggcattgtgaccacgctgtatgtaacacttgcgacactgggttacatgtgcttccatgacgaaattaaagggtctattacacttaacttgccgcaggatgtgtggctttaccagtctgtgaagattctctattcattcggcatcttcgtaacatattccatccaattctacgttcccgctgagattatcatccctgggattacgtccaagttccatacaaagtggaagcagatatgcgaatttgggataaggagcttcctcgtttccattacatgcgctggggctatattaataccccgactggatattgttatctcttttgtcggtgccgtctcctcgagcactctcgccctgatcctccctcccctggtcgaaattctgacatttagcaaggaacactacaacatctggatggtcttgaagaacattagcatagcttttacaggtgttgtcggtttccttcttgggacctacatcaccgtggaagagatcatctaccctacgcctaaggtcgttgctgggacccctcagagcccatttctcaatctcaatagcacatgtctcacaagtggcctgaagtag

SEQ ID NO: 135315 - DNA, 1602 bp, Artificial Sequence
  Description of Artificial Sequence: Synthetic coding sequence
atggcccgcctgcctgctggaatccggttcattatatcattttccagggaccagtggtatcgcgctttcatctttatattaacatttctgctgtatgcttcctttcatctgagtagaaagcccatttctatcgtgaagggggagctgcataagtactgtaccgcatgggacgaagcagatgttcgcttctcctcacaaaaccgaaaatccggcagcgcagctccgcatcaattgcctgataacgagaccgactgcggatgggcaccattcgacaaaaataactatcagcaattattgggcgcgttggattatagtttcctgtgcgcttacgctgttggaatgtacctgagtggaattattggggagaggctcccaattaggtattacctcacctttggcatgctggcttccggcgcctttacagccttgtttggactcggttatttttacaacattcattccttcggcttttatgttgtgacgcaggtgatcaatggcctagtacagaccacgggctggccaagcgtggtcacctgtctcggtaactggttcggtaaaggcagaagaggcctcatcatgggcgtgtggaacagtcatacctccgtgggcaacatactgggttccctcatagctgggtactgggtgtccacgtgttggggcctgtcctttgtcgtccccggcgccatcgtggcggcaatgggaattgtctgcttcctgttcctcattgagcatcccaacgatgtgagatgctccagcactttggtgacgcacagcaagggatacgaaaatggaactaaccggctgcgcctgcagaaacagattctaaagagtgaaaaaaataagccactggatccagagatgcagtgcctcctgctgtccgacggtaagggctctatacatccaaaccatgtggtgatcctgccgggggatggtggctcggggaccgcggccatcagctttacaggcgccctaaaaattcccggggtcatcgaattctctctgtgtctgctgttcgcgaagctggtgtcctatacttttctgttttggttaccactgtatatcacaaacgtcgaccacctcgatgcaaaaaaggcgggagagctgagcacactgtttgacgtgggaggcatcttcgggggcatactggccggggtgatttccgaccggctggagaaacgtgcgtccacatgtgggttaatgttactgcttgctgctccgacgctctacatcttctccacggtgagtaaaatgggattggaggctactattgcgatgctattgctgtcgggcgcactggtttcggggccatacaccctaatcaccacggcggtgtctgcggacctaggaacacataaaagtttgaagggaaacgctcatgcactatcaaccgtcacagcaattatcgacggaaccgggagtgtgggtgcggccttgggcccgctgctagcagggctgctctcaccaagcggttggagcaacgtattctatatgcttatgtttgcagatgcctgtgcactgctgttccttattcgccttatccataaggaactttcctgtccagggtccgcaactggcgatcaggtcccattcaaggagcagtag

SEQ ID NO: 135316 - DNA, 1602 bp, Artificial Sequence
  Description of Artificial Sequence: Synthetic coding sequence
atggccagactgccggctggaatccgcttcatcatctctttttcgcgcgatcaatggtacagggccttcatctttattctgaccttcttactctatgctagtttccatttgtctaggaagcccatctctattgttaaaggcgagctgcacaaatattgtaccgcttgggatgaagccgacgtcaggttctctagccagaatagaaaaagcggatctgccgcaccacaccaactgcctgacaacgagacagactgtgggtgggcaccctttgacaagaataactatcagcaactgctgggcgccctggactacagctttctgtgtgcatatgctgttgggatgtacctgagcggaatcataggtgaacgcttgccaattcggtactaccttaccttcggaatgctggcatcgggcgccttcacagcgttgtttggattgggttacttctacaatatccactctttcgggttttacgtggttacacaggttatcaacgggctcgtgcagaccaccggatggccaagcgtcgtcacttgccttggcaactggttcggtaaaggcagacgggggctgatcatgggagtctggaactcacataccagtgtggggaatatactgggatctcttatcgccgggtactgggtgagcacctgctggggcctgagttttgtcgtcccaggggccatagtagctgcaatgggaatcgtgtgctttctgttcctgattgagcaccccaacgacgtgcggtgctccagtacattagtgacccacagtaaaggctacgaaaacgggactaacagattgagactccagaagcaaatactgaaaagcgagaaaaataagcctctggatccggaaatgcaatgcctcctcttgtcagacggcaagggatccatccatcccaatcatgttgtgatcctcccaggcgatggggggtccggcaccgctgcgattagttttacgggcgcacttaagatcccaggcgtaatagagttcagtctgtgtctcctgttcgcaaaactggtgtcttacaccttccttttctggcttcccctctatataacgaacgtggaccacctggatgccaaaaaagctggtgagctgtctactctcttcgacgtcggcggcatctttggcggaatcctcgcaggggtgatcagtgacaggctcgagaagcgcgctagtacttgcggcctgatgttgctcctggccgcacccaccctgtacattttttccactgtgtcaaaaatgggcttggaagccacgatcgctatgctgttactcagcggcgctctggtttcggggccttataccctaattacaaccgctgtcagcgcagacctgggcacgcacaaatccctcaagggcaatgctcatgccctgtcaacagtgacagctatcatcgacgggacaggcagcgttggcgcagccctgggcccactactggccggcctcctgtccccatcgggctggagtaatgtgttttatatgctcatgtttgccgatgcatgcgctctgctctttctcatccgcctcattcacaaggagttgagctgtcccggaagcgctactggcgaccaggtgcccttcaaggagcagtag

SEQ ID NO: 135317 - DNA, 57 bp, Artificial Sequence
  Description of Artificial Sequence: Synthetic coding sequence
atggctaggctccccgccggcatcaggttcatcatctcctttagcagggaccaatag

SEQ ID NO: 135318 - DNA, 57 bp, Artificial Sequence
  Description of Artificial Sequence: Synthetic coding sequence
atggcaagactgcccgctggcattaggtttattatctcattctcccgggatcaatag

SEQ ID NO: 135319 - DNA, 1464 bp, Artificial Sequence
  Description of Artificial Sequence: Synthetic coding sequence
atgatgcactttaaaagcggtttagagctgaccgagctccagaacatgacggtgcccgaggacgacaacattagcaatgactctaacgacttcactgaggtagagaatggccagatcaacagcaagtttattagcgatagggaatcacggcggtccctcactaatagccacctggagaagaagaagtgcgacgaatacatccccgggaccacttcgctcggaatgtccgtcttcaacttgtccaacgccatcatgggctctgggatcctcgggctggcatttgcgctggccaacaccggcattctactgtttttggtgcttttgactagcgtgacattgctgagtatatattctattaacctgctcctgatttgctctaaagaaactgggtgtatggtctatgagaagctcggggagcaggtcttcggtacgaccggtaagtttgtgatctttggagctacctcactgcagaataccggcgccatgctgagttacctgtttatcgtgaagaacgagttaccaagtgccattaagtttttgatgggtaaagaagagaccttttcagcttggtacgtggatggaagggtgctggttgtcattgtgacattcggcatcattctgccattgtgcctactcaagaacctgggttatctggggtatacgagcgggttctcattgagctgcatggtgttttttctgatcgttgtgatttataagaagtttcagatcccctgcatcgtgcccgagttaaactccaccatttccgctaattccacgaatgccgacacttgtactcctaaatacgtgacatttaactccaagacagtatatgctcttccaacaatcgcctttgcatttgtgtgtcacccgtcagtgctgcccatttatagtgagctaaaagataggagtcagaagaaaatgcaaatggtgtcaaatattagcttttttgctatgttcgtgatgtatttcctgacggcaatttttgggtacttgaccttttatgacaacgttcagtccgatcttctccacaagtaccagtctaaggatgatattctgatcttgactgtcagattggccgtgattgtggccgtaattctcactgttcccgtgctattttttaccgtgcgctcgtcacttttcgagctggcgaaaaagactaagttcaatctttgtcggcatactgtcgttacatgcattctgctagtagtgattaacctgctggtcattttcattcccagcatgaaggacattttcggcgtcgtcggggtcacaagtgctaatatgctgatctttattctgccaagctccttatacttgaaaatcaccgaccaggacggggataagggcacacagcggatctgggctgcccttttcctaggcctcggcgtactgttttccctagtgtcaatcccacttgtgatctatgattgggcatgctcatctagctccgatgagggacattag

SEQ ID NO: 135320 - DNA, 1464 bp, Artificial Sequence
  Description of Artificial Sequence: Synthetic coding sequence
atgatgcattttaagagcggcttagagttgacagagctgcaaaacatgactgtgcctgaagacgataatatcagcaatgacagcaacgatttcacagaagtcgagaatggccaaatcaattctaaatttatcagtgacagagagagtcgacgttccctgacaaactctcacctggagaaaaagaagtgcgatgagtacattccagggacaacttccttgggaatgtcagtctttaacctcagcaacgccattatgggttcagggattctgggcctggcttttgccctggccaataccggcatcctgctattcctagtcctcttgaccagcgtaaccttgctcagtatctactcaattaacctccttcttatatgctctaaagaaacaggttgcatggtctatgagaagctcggggagcaggtgttcggcacaactgggaagttcgttatttttggggcgacatccctccaaaacacaggcgcaatgttatcttacctgttcatcgtgaaaaacgagctgcctagtgccattaaatttctgatggggaaggaggagaccttctcagcctggtacgtcgatggaagggtgctggttgtgatagtcactttcggcatcatccttcccctgtgcctattgaaaaacctcggatacctcggatacacctctggcttcagcttgtcctgcatggtgttctttctcatcgtggtaatttacaagaagtttcagataccttgcattgtccctgaactcaacagcaccatttctgcaaactctacaaatgctgacacctgtacccccaagtatgtgacattcaatagcaaaacggtttacgccctgcccacaatcgcgtttgctttcgtctgtcatccgtctgttttgccaatctactcagagcttaaggataggtctcagaagaaaatgcagatggtctccaatattagctttttcgccatgtttgtgatgtattttctcactgctatctttggctacctgactttctatgacaatgttcagtctgacctcctgcataagtaccagagcaaagacgacatcttgatcctgactgtcagactcgctgttattgtggctgtcattttaacggtccctgtgctgttcttcacagtgcgctcctcactgttcgagttagctaagaagactaaattcaatctgtgtaggcacacagtggtgacttgcatcctgctcgtagtgatcaatctacttgtcatctttatcccgtccatgaaagacatttttggggtcgttggggtaacaagcgcgaatatgttgattttcatattaccttcatctttgtacctgaagatcacggatcaggacggcgataagggtacacagcggatctgggctgctctgttcttgggtttgggagtgctcttttcccttgtgagtatcccactggtgatatacgactgggcttgtagctcttcatcagatgaaggacactag

SEQ ID NO: 135321 - DNA, 1464 bp, Artificial Sequence
  Description of Artificial Sequence: Synthetic coding sequence
atgatgcatttcaagagtgggcttgaacttactgagctccagaacatgactgttcctgaagacgataatatcagtaacgattctaacgattttaccgaagtggagaatggccagatcaacagcaagtttatctccgatcgagagtcccgcaggtcactgacgaactcacatttagagaaaaagaaatgcgatgagtatattccgggaacaacatctttggggatgtctgttttcaacctgagcaacgcaataatggggagcggaatcctcggcttggcctttgctctggccaacacaggtattttgctgttcctggtgttactgacctcggtgaccctcctgtccatctattctataaatctccttctcatctgctccaaagagaccggctgtatggtctacgaaaaactgggcgaacaggtgttcggtactaccggaaaatttgtgatctttggtgctacatccctccaaaacaccggggctatgctttcataccttttcatcgtgaaaaatgaactacccagtgcaatcaagtttctgatggggaaagaggaaacgttttccgcctggtatgtggacgggagagtactggtggttatcgtaacatttggtataatccttccgctttgtctactcaagaacctgggttacttggggtatacatccggatttagtctttcgtgcatggtgtttttcctgatcgtcgtgatctacaagaaatttcagatcccttgtatcgtacctgagctcaacagcactatctccgccaatagcactaacgctgatacttgcacacctaagtatgtaacgttcaatagtaaaacggtttatgccttgccaaccatcgctttcgcctttgtatgtcaccccagtgtgctgccgatctattctgaactgaaagataggagccagaagaagatgcaaatggtgtccaatatatcctttttcgctatgtttgtgatgtacttcttgacagccattttcggctacctgacattctatgacaacgtccaaagcgatctgcttcacaaatatcagtctaaggacgacatcctaatattaacggtgcgcttagcggttatcgtcgccgtcattctgaccgtgccagtacttttcttcaccgttaggtcatcgttgtttgaactcgctaagaagaccaagtttaatctctgcaggcatacggtggtcacttgtatcctcctagtggttattaatctgctggtcatttttatcccctcaatgaaagacatcttcggtgtcgtgggcgttactagcgccaatatgctgatcttcatacttccgtctagcctgtacctcaagattactgatcaggatggtgacaaaggcacccagcgcatctgggcagcattgtttctcggccttggcgtgctttttagtcttgtgtctattccactggtaatttacgactgggcatgttcttcctcctccgatgaagggcactag

SEQ ID NO: 135322 - DNA, 1464 bp, Artificial Sequence
  Description of Artificial Sequence: Synthetic coding sequence
atgatgcatttcaagagtggcttggaactaaccgaattacagaacatgaccgttcctgaagatgacaatatatctaacgatagcaatgacttcacggaggtcgagaatggccaaattaactccaagtttattagcgaccgcgaaagtagaagaagtctgacaaacagtcacctcgagaaaaagaagtgcgacgaatacatccccggtaccacttccttgggaatgagcgttttcaatctgagtaacgcaatcatgggttccggtattctcggacttgcatttgccctagctaatacagggatcctgctgtttttggtattgctgacctctgtgacgctgctgtcaatttattctatcaacttactcctaatctgcagcaaagaaacaggatgcatggtgtatgagaagcttggtgagcaggtctttggaacgacaggcaaattcgtgattttcggagccacatctctccagaacaccggggcaatgctcagctatcttttcatcgtgaagaatgaacttccaagcgcgatcaaattcctgatggggaaggaggaaactttctccgcatggtacgttgatggtcgcgtgttagtggttatcgtcacgtttggtatcattctgcctttatgcttactgaagaatctcggatatctgggttatacaagcggattctcccttagctgcatggttttcttcctaatcgtggtgatctacaaaaaatttcagataccctgtattgttccagagttgaattcaacaataagtgccaatagtacaaacgctgatacgtgtacccctaagtatgtgaccttcaacagtaaaaccgtatacgccctaccaacaattgcttttgccttcgtttgccatcccagcgtccttcctatttactcggagttgaaggaccggtctcagaagaagatgcaaatggtaagcaacatctcttttttcgccatgttcgtgatgtattttcttaccgccatcttcggatatctgacgttttacgataacgtacaatcagatctgctgcacaaatatcagtccaaggatgatatcctgatcttgacagtcaggcttgctgtcatagtcgccgtcatcctcaccgtccccgtgctcttcttcactgtgcggagcagcttgttcgaactagcaaaaaaaaccaagttcaatctgtgccggcacacagtggtgacttgtatacttttagtggttatcaatctgttagtcatcttcataccgtctatgaaagacatctttggcgtagttggcgtaacctctgctaacatgctgattttcattctgccgtcttctctatatctgaaaattaccgatcaggacggagacaagggcacacaacggatatgggcagccctatttctaggcctgggagtgctattctcccttgtcagtattccgctagtcatatacgattgggcctgttcatcatcatcagacgaggggcattag

SEQ ID NO: 135323 - DNA, 1521 bp, Artificial Sequence
  Description of Artificial Sequence: Synthetic coding sequence
atgaaaaaagctgagatgggaagattcagcatatcacctgacgaggattcctcgtcatattcaagcaattcagattttaattatagctatcctaccaagcaagctgcacttaagagccactatgcagacgtggatcctgagaatcagaacttcctgttggaaagtaacctgggcaaaaaaaagtacgagacagaatttcacccaggcaccacttcctttggtatgagtgtcttcaatctcagcaacgccatcgtcgggagcggcatactcgggttgtcttatgccatggccaatacaggcatcgctttatttattattttactgacctttgtttctattttttcattgtatagtgtgcatttgctcctaaaaacggccaatgaaggagggtctcttctgtatgaacagttgggatacaaagcctttgggctggtcggtaagctcgccgcctcgggctctattactatgcaaaacatcggcgccatgtcgagctatttgtttatcgtgaaatacgagttaccccttgttatccaggcgctcaccaacatcgaggataaaacagggctgtggtatctgaacgggaactatcttgttctcctggtgtctctggtcgttatactgcctctctctctgtttcgcaacttgggatacttgggttatacctccgggctgtccctcctgtgtatggtgttcttcctgatcgtggtgatctgtaagaagttccaggtgccctgtcctgtggaagcagcactgatcattaacgagaccatcaataccacccttacccagccgaccgccctggtccccgcactgagccacaacgtgactgagaatgacagttgccgaccgcactatttcatctttaactcacagaccgtgtatgctgtgccaatcctcatattttcctttgtatgtcatcctgcagtcctgcctatttacgaggaactcaaggaccgcagtaggaggaggatgatgaatgtctctaagatctccttcttcgcgatgttcctaatgtatttattggctgctctgtttggctacctgaccttctacgagcatgtggagagcgagttgctccatacgtacagctccatcctgggcactgacatactgctgcttatcgtcaggctagccgtgctgatggccgtgactctgactgtcccagtcgtgatctttcctatccggagttccgtcactcatttactgtgcgccagtaaggactttagttggtggaggcactcactgattactgtatccatccttgcgtttacaaatcttctggtcatcttcgtgcccaccatccgggacatttttggattcattggggcctctgctgcaagcatgttaatttttatcctgccctccgctttttatatcaagctggtcaagaaggagccaatgaaatccgtccagaaaatcggtgccctcttctttctcctctctggggttctggtgatgaccggctctatggccttgatcgtcctggattgggtccataacgcaccaggcgggggccattag

SEQ ID NO: 135324 - DNA, 1644 bp, Artificial Sequence
  Description of Artificial Sequence: Synthetic coding sequence
atggatcccatggaactcagaaatgttaacatcgagcctgacgatgagagttctagcggggaaagcgccccagattcttacatcggcatagggaactctgagaaggccgcgatgtccagccagtttgcaaatgaggataccgagagtcagaagttcctgaccaatgggttccttggtaaaaagaagctggctgattacgcagacgagcatcaccccggcacaacctcatttggtatgagttcattcaatctaagcaacgccatcatggggtcgggaattctgggactgagctatgctatggctaacaccggtatcatcctcttcataatcatgctcctggccgttgccatactgtccctgtactccgtacatctgctgctgaaaaccgctaaggagggtgggagtctgatctacgaaaagctcggtgagaaggctttcggctggcctgggaagattggggcgtttgtgtctattacaatgcaaaacataggcgctatgtcaagctacttgttcataattaagtacgaactgcctgaggtgatacgggcgtttatggggctggaggaaaacacgggggagtggtatcttaacggaaactacctgatcattttcgtctctgtgggaattatcctgccactgtccctgctcaagaacctgggttacctgggctatactagcgggttttctctgacctgtatggtgtttttcgtgtctgtcgtcatttataaaaagttccaaattccctgtcctctgcctgtccttgatcactctgtgggaaatctttcctttaataacaccctcccaatgcacgtggtcatgttgccaaacaattccgaatcatccgatgtgaacttcatgatggactatacacatagaaacccggctggccttgatgagaaccaggctaaaggtagcctgcacgattcaggtgtggagtatgaggcacactctgatgataagtgcgagcctaagtacttcgtgttcaattctaggacagcatatgccataccaatactcgtgtttgccttcgtctgtcaccccgaagtcctgcctatctattctgaactcaaagacaggtcaaggcggaagatgcaaactgtgtcaaatattagcattaccggcatgctcgtcatgtatctgctggccgcattgtttggttatctcacgttctatggcgaagtggaagatgagctgcttcatgcctattccaaggtgtataccctggatatcccactcctgatggtgaggctggcagtgctggtggcagtaaccttgaccgtgcccattgtactcttcccaattagaacgtctgtgatcactctgcttttccctaagagaccattctcttggatccggcacttcctgattgccgctgtgctcatcgccctgaacaatgtcctggtgatactggttccaactatcaaatatatcttcggattcattggcgcctcatctgctaccatgctgatttttattctgcccgcagtgttttatctgaagttggtcaaaaaggagacctttagatctccccagaaagtgggagctcttatatttcttgtcgtgggtattttctttatgattggcagcatggccttgattatcatagattggatatacgacccgcctaatagtaagcatcactag

SEQ ID NO: 135325 - DNA, 780 bp, Artificial Sequence
  Description of Artificial Sequence: Synthetic coding sequence
atggatcctatggagctgaggaacgtgaatattgagcctgacgacgagtctagctccggggaaagcgcacctgactcttatatcggaattggaaactccgaaaaagctgcaatgagctcccagttcgctaatgaggataccgaatcccagaaatttcttacaaacggattcttaggaaaaaagaagttggcagactacgctgacgagcaccaccctggtacaacctctttcgggatgagcagtttcaacctcagcaacgccattatggggtcgggtatcctcggcctctcttatgccatggcgaacacaggtatcatcctgttcatcattatgttgctcgccgtcgcaatcctgagtctctactcggtgcacctgctccttaaaacagcaaaagagggagggtctctgatttacgagaagcttggtgagaaagcctttggctggccagggaagatcggtgcttttgtgtccattacaatgcagaatatcggggctatgtccagctacctgtttattataaaatacgagctccccgaggtcattagagccttcatgggcctggaggagaacaccggggaatggtacctgaatggaaactacctcatcattttcgttagtgtagggattatcttaccactcagcctcttgaaaaacctgggttatcttggatatacatccggattcagtttaacgtgtatggtgttttttgtcagtgtaatgatatataagaagatcagtttctttcttcaaatctttatcattctcaagctgtttttctag

SEQ ID NO: 135326 - DNA, 1644 bp, Artificial Sequence
  Description of Artificial Sequence: Synthetic coding sequence
atggatcctatggagctgagaaacgtcaacatcgagcccgatgacgagagcagctcaggagagtctgcccccgacagctatataggtataggtaactcagagaaggccgccatgagtagccaattcgccaacgaagacacagagtcccaaaaatttttaacaaatggcttcttgggaaaaaaaaagctggccgactacgcggatgaacaccaccctggcacgaccagttttggtatgagcagctttaatctcagtaacgccattatgggaagcggaattttgggcctgagttacgcaatggccaacaccggcatcattttgttcattatcatgttgctggccgtggccattctgtccctgtactccgtacacttgttgttaaagactgctaaagagggcggatccctcatctatgagaagttgggagagaaggctttcggttggccgggaaagatcggcgcattcgtttcaattactatgcagaacatcggggctatgtcctcttacctgttcatcattaagtatgaacttcccgaggtcatccgggcttttatggggctggaagagaatacgggagagtggtatctgaacggcaattaccttattatttttgtgtctgtcgggatcattctgcctcttagcctccttaagaacttagggtacttaggatacactagcggcttctcgctcacctgcatggtgttttttgtcagcgtcgtgatttataaaaagttccagattccttgccctcttcctgtgctggaccactctgtcggaaatttgtcttttaataacaccttgccaatgcatgtggtgatgctgcccaacaactcggagtcaagcgacgtgaattttatgatggattacactcaccgcaaccccgctggcctggacgaaaaccaggcaaaagggtctcttcacgattccggagtcgaatacgaggcacactccgacgacaaatgtgaacctaagtatttcgtattcaacagtcgcactgcttacgcaatccctattctggtgtttgcttttgtgtgccaccccgaggtactcccgatctattcagagttgaaggatagaagccgacggaaaatgcagacagtcagtaacatctcgataactggaatgctggtaatgtatctactggcagccctgttcggctacctcacattctatggcgaggtagaagacgaattgctgcacgcctactctaaagtgtacacgttggatattcccctgctcatggtaagattggctgtccttgtggcagttacgctcactgtccccatcgttctcttccccattagaacctctgtgataaccctcctgttccccaagaggccttttagctggattagacacttcttgattgccgccgtgctgatagcgcttaacaacgtcttagtaatactcgtgcctactattaagtacatctttggtttcatcggagcatctagcgcaactatgctgatctttattctgcctgctgtgttctatcttaaactcgttaaaaaggagaccttccgatctccacagaaggtgggtgccctaattttcttggttgtagggatcttcttcatgataggcagtatggccctgataatcatagactggatatatgacccacccaatagcaaacaccactag

SEQ ID NO: 135327 - DNA, 579 bp, Artificial Sequence
  Description of Artificial Sequence: Synthetic coding sequence
atggacccaatggagctccggaacgtaaacatcgagcccgatgatgaaagcagcagcggagagtcagcgccagacagctacataggtatcggcaattcagagaaggctgccatgtcttcacagttcgctaacgaggatacagaaagtcagaaattcctgaccaacggattcctcggcaaaaagaagttagctgactatgcagatgagcaccaccctggaactacttcgtttggcatgagctcctttaatttatctaatgctatcatgggatccggaatactgggtctaagttacgccatggccaatactgggattatcctgttcatcattatgctgctcgccgtcgctattctgtccttgtactcagttcatttactgctgaaaacggctaaggagggaggttcgctaatttacgaaaaattgggcgaaaaggcctttggctggcctggaaaaatcggcgcatttgtctcgattacgatgcaaaacattggagctatgagctcctatctgtttattattaaatacgagttgcctgaggtgattagagcttttatgggattggaagaaaatacaggttag

SEQ ID NO: 135328 - DNA, 660 bp, Artificial Sequence
  Description of Artificial Sequence: Synthetic coding sequence
atggatccgatggagctgcggaatgtgaacatcgagcctgacgacgagtcctccagtggcgaatcggcacccgactcatacatcgggatcgggaattctgagaaagccgcgatgtcttcccaattcgctaatgaagacactgaatctcagaaattcctcaccaatgggtttctgggcaagaagaagctcgccgattacgcggacgagcaccatccaggtaccactagcttcggcatgtcttcttttaatctgtcgaatgccattatggggagtggaattttgggcctcagttatgcaatggctaataccggcattatcctcttcatcatcatgctgctggccgtggcaatcctcagcctatacagtgtgcacctgctactcaaaaccgctaaggagggtggctccttgatttatgaaaaactgggcgagaaggcgttcggttggcctggaaaaatcggagctttcgtgagcatcacaatgcagaatattggcgccatgtcttcctatttgttcatcattaaatacgaattacccgaagtaattagggcattcatgggccttgaagaaaacaccggtgagtggtacctgaacggaaattacctcattatctttgtgagcgttggcattattctcccactttctctgttaaaaaacctctag

SEQ ID NO: 135329 - DNA, 1419 bp, Artificial Sequence
  Description of Artificial Sequence: Synthetic coding sequence
atggagttgcaggaccctaagatgaatggagctcttcctagcgatgccgtgggttaccgccaggagagggagggattcctgcctagccgcggtccagcccccgggagcaaacccgttcaattcatggactttgaaggtaaaacttcttttggtatgtcagtgtttaaccttagtaatgctatcatggggagcggtattctcggactggcatatgctatggcccacactggggtgatttttttcctggctcttctcctgtgcatagctctcctaagcagctactcaatccatttgctgttgacgtgcgcggggatcgccggcattcgggcttacgagcagttaggccagagagccttcggacctgcggggaaggttgtagtggccacagtcatctgcctgcataacgtcggggccatgtcttcctacctgtttatcataaagtccgagctacctctggtaattggcaccttcctctacatggacccggaaggagactggtttctgaagggaaacctgctgattattatcgtcagcgttctaatcattctgcctctggcgttaatgaagcacctgggatacctcggttacacatcagggctttccctcacctgcatgttattcttcctcgtgagcgttatatacaagaaatttcagctcggttgcgccataggccataacgagacggccatggagtcggaggctctggtgggactcccatctcagggccttaacagctcttgtgaggcacagatgttcactgttgactctcagatgtcatacaccgtgcctatcatggccttcgcttttgtgtgccaccctgaggtcctccccatatacacagaactgtgccgcccttccaagcggcggatgcaggctgtggctaatgtttccattggagctatgttttgtatgtatggactcacagcgaccttcgggtatctgacattttactcttccgtcaaagcggaaatgttacatatgtattcacagaaggatcccctgatactctgcgtgaggctcgcagttcttttggcggtgaccctgactgttcccgttgtgctttttcccatccgccgggcgctgcagcagttgctgtttcctggaaaagcgttcagctggccgcgccacgtcgcgatcgccctcatactgctcgttctggtcaacgtgctggtaatttgtgtaccaactattcgtgatatctttggggtcatcgggtcaacttccgctccatccttgattttcattttgccatccattttctacctgcgcatagtgccgtctgaggtggagcctttcctgtcttggccaaaaattcaggccctgtgctttggggtcctgggagttctattcatggctgttagtcttggatttatgttcgcaaactgggctaccggccagagccgcatgagcggccactag

SEQ ID NO: 135330 - DNA, 1266 bp, Artificial Sequence
  Description of Artificial Sequence: Synthetic coding sequence
atgtccgtgtttaatctgtcgaacgcaataatgggtagcggaatattaggcctggcctatgccatggcccacactggggtcatattttttctcgcccttcttctctgcatcgccttactgtcctcttactctatccacctgcttctgacctgcgcgggtattgccggcatccgcgcttatgagcagctaggccaaagagcctttggccctgccgggaaggtagtggtcgccactgtcatctgtctacacaatgtaggagccatgtcttcttacctattcattatcaaatccgagcttcccctcgtgatcggaactttcctgtacatggaccctgagggggattggtttctgaagggaaacctcctgattatcatcgtgagtgtccttatcattctgcctctcgccttgatgaagcatctgggatatctcggctacacttcaggcctgtccctaacgtgcatgctcttttttctggtgtctgtcatctataagaaattccagctgggctgcgccatcggtcataatgagaccgctatggagtccgaggccttagtgggtctcccgagccagggactcaacagctcctgtgaagcacagatgttcacagtggactcccagatgtcgtatacagtcccgatcatggcgttcgcattcgtgtgccatccggaagttctgcctatatatactgagttgtgccgtccttcgaaacgacgaatgcaggctgtcgccaatgtgagcatcggggcaatgttttgtatgtacggtcttacagctactttcggctacttaactttctactcctccgtgaaagcagagatgctgcacatgtattcccagaaagatccactgatactctgcgtacgtctggccgtcttgctcgccgtgactttgaccgtgccagtggtgctgttccctataaggcgagctctgcaacagctccttttcccgggcaaggcattttcttggcctaggcacgtggccatagcgctgatccttctggtgttggttaatgtactggtgatttgcgtgcctacaattagagacatcttcggcgtcataggatccaccagtgccccatctctcatcttcattctgcctagtatcttctacttacgaatagtgccttcagaggtggagccatttttaagttggcccaagatccaagctctctgctttggcgtgcttggggtgctgttcatggccgtttcattaggctttatgttcgcgaactgggccaccggacagtctcggatgagtggacattag

SEQ ID NO: 135331 - DNA, 1419 bp, Artificial Sequence
  Description of Artificial Sequence: Synthetic coding sequence
atggagctgcaggatccaaagatgaacggggcactgccctcggacgccgtggggtatcgccaggaaagagaaggctttctcccctctcgaggacccgcgccaggatcgaagcctgtccagtttatggattttgaaggaaagactagttttgggatgtcggtcttcaatttatctaatgcaattatgggctcgggtattttgggtctcgcctatgctatggcacacactggagtgatctttttcctcgctctactcctctgtatcgcgttgctgtcatcctatagcatccatctcttactgacatgtgctggaatcgcaggaattagggcctacgaacagctgggacagagggcctttggacctgcgggaaaggtggtcgtagctactgtgatctgcctccataacgttggggccatgagttcctacctgttcattatcaagtccgagctccctcttgtgatcggtacattcttgtacatggatccggaaggagattggttccttaaagggaatcttctcattatcattgtgtctgtgctgatcattctccctcttgccttaatgaagcacctgggttacctggggtatacaagcggcctctcattgacctgcatgctgttttttttggtcagcgtgatctataaaaagtttcaactggggtgtgctatagggcataatgagactgccatggagagtgaagcccttgtgggtcttccatctcaaggactgaatagttcttgcgaggctcaaatgtttaccgtggatagtcagatgtcctatactgttcccataatggcattcgcatttgtatgtcatccagaggttttaccaatctacaccgagctatgtagaccatcgaaacggcggatgcaggccgtggccaacgtcagcatcggtgccatgttttgcatgtacggcttgacagccacctttggttatctgacattttattcaagtgtgaaagccgagatgctccatatgtactctcagaaagatcctttaatactctgtgtccgcctggccgtcctactagcagtcacactcacggtgcccgtcgttctttttccaatcagacgggctctccaacagcttctgtttcccggcaaggcgttctcgtggccccgtcacgtggctattgccttgatactgttggtccttgtgaacgtgctggtcatttgtgttcctaccatcagagatatttttggtgtcatcggaagcacatccgcaccgtccctgatcttcattctgccctcgatattttatctcaggattgtaccatcggaggtcgagcctttcctgtcttggcccaaaattcaggctttgtgcttcggcgtgctaggcgtcctgttcatggccgtgtccttaggctttatgttcgcaaactgggccactggtcagtcaagaatgagtggacattag

SEQ ID NO: 135332 - DNA, 660 bp, Artificial Sequence
  Description of Artificial Sequence: Synthetic coding sequence
atggagctccaggatcccaagatgaatggcgccctgccttcagatgcagtgggctatagacaagaacgtgagggcttcctcccttctaggggtccagcaccgggctcaaagcccgtgcaatttatggatttcgagggcaaaacatccttcggcatgagcgtattcaacctgagcaacgccatcatgggtagcgggatcttgggactggcttacgctatggctcataccggtgttatcttctttctggcgctcctgctctgcatcgccctgctctcttcttactcgatccatctgctgctgacatgtgccggcatagccggtattagggcttacgagcagctggggcagagggcttttggaccagccgggaaagtcgtggttgccactgtcatctgtctccacaacgttggcgcaatgagcagttacctgttcattatcaagtctgagctgcccctggtcatcggaacctttctttacatggacccagaaggggactggttcctgaagggcaacttgctcattataatcgttagcgtgctgatcatcttaccattggctcttatgaaacatttaggttatctgggatatacctctggtcttagtctgacctgtatgctcttcttcttagttagcgtcatttacaaaaagttccagctgtag

SEQ ID NO: 135333 - DNA, 576 bp, Artificial Sequence
  Description of Artificial Sequence: Synthetic coding sequence
atggaacttcaagacccaaaaatgaacggggctttaccgtccgacgccgtggggtaccgccaagaaagggaaggctttctcccgtcaagggggcctgctccaggatctaaaccagtgcaattcatggatttcgagggtaaaacctctttcggcatgtcagtttttaacctgagcaatgcgatcatgggatctggcatcctcgggttggcctatgccatggcccataccggcgtgatctttttccttgccctgctcctctgtattgcgcttctgagttcctattctatccacttgctgttgacatgtgcaggaatcgccggcatcagggcttacgaacaactgggtcagagagccttcgggccagccggtaaagtggttgttgcaactgtcatctgtctgcacaatgtgggggcgatgtccagctatttattcattataaagtcagaactgccgctcgtcatcgggactttcctgtacatggatccagagggggactggttcctcaaaggcaaccttctcataataatcgtatccgtcctgattatcctacctctagcccttatgaagcatctctag

SEQ ID NO: 135334 - DNA, 495 bp, Artificial Sequence
  Description of Artificial Sequence: Synthetic coding sequence
atggagctgcaagatccaaagatgaatggcgccctgccttcggatgccgtcggctatagacaggagcgagagggattcctaccctctcgagggcccgctccaggttctaagcctgtgcagtttatggattttgaaggcaaaacaagcttcggcatgtctgtgttcaacctaagcaacgctatcatgggcagcggcattcttgggctcgcttacgccatggcccacaccggggtaatattctttctcgccctgctcctctgcatagccctcctgtccagttattcaatccacctcttactgacatgtgccggaattgccggtatcagggcctacgaacagctggggcaaagggcgttcggccctgccggcaaagtggtagtggctaccgtgatttgccttcacaatgtcggagccatgagctcgtatctatttattatcaagagtgagttgcctctagtgattggaactttcctgtatatggaccccgaagggtag

SEQ ID NO: 135335 - DNA, 840 bp, Artificial Sequence
  Description of Artificial Sequence: Synthetic coding sequence
atggagttgcaagacccaaaaatgaatggcgcactgccatccgatgccgttggatataggcaagagagggagggattcctgccaagtcggggacccgctcccggcagcaaacctgttcagtttatggatttcgaaggcaagacctccttcggcatgtcagtgtttaatctgtccaatgcgatcatgggctccggaatactgggcttagcatatgcgatggcccacacaggcgtaattttcttcctggcccttttgctatgtattgcactccttagctcatactccatccatctgctcctgacatgtgctggaatcgccgggatcagagcgtatgagcagctcgggcaaagggcttttggacccgcaggcaaggtggtggtggccacagtgatctgcttgcacaacgtgggggctatgtcttcttatcttttcatcattaagtctgagctacctctggtcataggaacttttttgtacatggaccccgagggcgactggtttctcaagggcaaccttctgataatcattgtgtccgttctgattatcctcccattggcactcatgaaacacctggggtatctgggctacacaagtgggctaagcctcacttgtatgcttttctttctggtgagtgtaatctacaagaaatttcagttgggctgtgcaattggacacaatgagacggctatggagtcggaggctctggttggcctgccttcacaaggtctcaattcaagctgcgaagcacagatgttcactgtagatagtcaaatgtcttacactgtcccaatcatggcattcgcattcgtctgccatccagaagtccttccaatttattag

SEQ ID NO: 135336 - DNA, 819 bp, Artificial Sequence
  Description of Artificial Sequence: Synthetic coding sequence
atggaactgcaagatcctaagatgaatggcgcactgccctctgatgcggtaggctacaggcaagagcgggaggggtttcttcccagtcgcggccccgctcctggctccaaacccgtgcagtttatggatttcgagggcaaaacctcttttggtatgtcagtttttaatctgtcaaacgccattatgggctccggaatacttgggctggcatatgcaatggcacatacaggcgtgatattcttcctcgccctcctattatgtattgcgctcctcagctcctactcaatccatctgttgctcacttgtgcaggtattgctggaatacgagcctatgagcaactggggcaaagagcatttggccctgccgggaaggttgtggtggcaactgtaatctgtttacataatgtaggtgctatgtcttcttatctgttcatcataaaatcggagctgcctctggtcattgggaccttcctctacatggaccccgaaggagattggtttttgaagggcaacctgctaattattatcgtgtctgttctgattatcctaccactagctctcatgaaacacttggggtaccttggatatacgagtggactgtcactaacatgtatgttattcttcctcgtgtccgtgatctacaagaaattccaactggggtgtgctataggacataacgaaacagccatggagagtgaagctctggtgggcctcccaagccaggggcttaacagcagctgtgaggcccagatgttcaccgtcgacagccagatgtcttatacagtaccgataatggccttcgcatttgtttgccactag

SEQ ID NO: 135337 - DNA, 1422 bp, Artificial Sequence
  Description of Artificial Sequence: Synthetic coding sequence
atggcaacccaagccaaacgacctcgcgtggctggaccagttgacggcggagacctcgatcccgtcgcctgttttctctcctggtgccggagagtcggcctcgaactgtccccaaaagtaagcgagcgcgcgggggggagacgcacaaggggcggcgcccgagccgccctgacctctccaccagcccaggtcgctgtcagtcgtcagggaacagttgccggatatggcatggtcgcacgtgagtctgtgcaagccggggagcttctctttgtagttcctcgggctgcactactttctcagcatacttgcagcatcggcggtttgctggagcgtgaacgagtggcgttgcaaagccagagcggatgggtgccattgcttctcgctctccttcacgagctgcaagctcccgcgtcccggtggaggccgtactttgcgttgtggcccgaactcgggcgtttggagcatcccatgttctggccagaggaggaaaggagatgtttgctccaggggaccggagtgcccgaggctgtagaaaaggacctggccaatattcggagtgagtaccaaagcatcgtgctccccttcatggaagcacatcctgacctgttctcgttaagagtgcgctccctggaactctaccatcagctcgttgccttggtcatggcttattccttccaggaacccttagaggaagaggaagatgaaaaggagccaaattcccccgtgatggtgccagctgccgacatcctgaaccatctcgcaaaccacaacgcaaatctagaatatagcgcaaattgtcttcgcatggtcgcgacacagcctattccaaaaggccatgaaatctttaacacctacggccagatggcaaattggcagctcattcatatgtacggttttgtcgagccctacccagataacaccgatgacactgccgatatccaaatggtcacagtgagggaagcggccttgcagggaacaaaaacagaagccgagcggcatctggtgtacgagcgctgggatttcctgtgcaagcttgaaatggtcggagaggagggagcattcgtcataggacgcgaagaagtattgaccgaggaagaactgactacaaccttgaaggttctctgtatgcccgcagaggaatttcgcgagctgaaagatcaggacggtgggggtgatgacaaacgtgaagagggatcattgaccatcactaatattcccaagctgaaagccagctggagacagttactgcaaaactcagtgctgcttacccttcagacatacgccacggacctgaagacggatcagggtttgctgtctaataaagaagtgtacgcaaagctaagctggcgagaacagcaggctctgcaagtacgctacggacaaaagatgatcctgcatcaactgctggagcttactagctag

SEQ ID NO: 135338 - DNA, 975 bp, Artificial Sequence
  Description of Artificial Sequence: Synthetic coding sequence
atgggcccctggggcgagcctgaacttctggtgtggagacctgaggcggtagcatctgagcctccagtccccgtggggctggaagtcaagcttggcgctctggtgctactgctcgtgctgaccctgctgtgcagtctggtgcccatttgcgtcctccgacggccaggagctaaccacgaagggagcgcatccaggcagaaagctctctctctcgtctcttgttttgctgggggggtctttctggctacctgcttgctggatctcctccctgactatctggccgccattgacgaggctttggccgccctgcatgtgaccttgcaatttccacttcaggagtttatcctggcgatgggtttttttttggtgcttgttatggagcaaattactttggcttataaggagcagagtggaccatccccgcttgaggagacaagggccttactgggcactgttaatggtggcccgcagcattggcatgacgggccaggtgttccccaagcgtccggtgcccctgccacccctagcgccttgcgggcctgcgtgctggtgtttagcctcgcactgcattctgttttcgaaggcctcgccgtcgggttacagcgggatcgggcacgtgctatggaactttgcctagcccttctgctacacaaggggatcctcgcggtgtccttgtcgctacggttgctccaatcccacctgagggcacaggtcgtcgccggatgcggaatattgttttcgtgtatgacaccactgggtatcggtctaggtgccgcactcgcggagtcagctggccccctccaccaacttgcgcagtcagtgctggagggtatggccgctgggacatttctatacattacctttctggagatcctgcctcaagaattggccagttcggagcaacgaatcctgaaggtgatccttctgctcgcaggtttcgcgcttctgactggccttctgttcatccagatttag

SEQ ID NO: 135339 - DNA, 975 bp, Artificial Sequence
  Description of Artificial Sequence: Synthetic coding sequence
atggggccatggggcgagccagaactactggtgtggcgaccagaagccgtggcctctgaacctcccgtgcctgtcgggctcgaggtgaagctgggagccttagtcctgctcctagtcttgactctactgtgttcactagttcccatctgcgtgcttagaaggcctggagcaaaccatgagggatccgcctccagacaaaaagccctcagcctggtctcttgctttgccggtggcgtgtttctggccacatgtctgcttgatctgcttcccgactacctcgctgccattgacgaggcattagcagccctgcacgtgacccttcagtttcctctccaggagtttattctggcaatggggttcttcctagtgctggtgatggagcagatcacactggcctataaggagcagagtggcccatccccactggaggaaacacgtgccttgctgggcactgtgaacggagggccccagcactggcacgatggccctggggttccacaagcgtcaggcgcgccagcaacccccagcgcactgcgcgcctgcgtgctcgtcttctccctggccctccactcagtgtttgagggcctggccgtgggtctgcagcgggacagagcccgggcaatggagttatgtctcgcattgctcttgcataaaggtattttggcagttagtctctccttgcggctcctgcagtcccatctcagggcgcaggtggtagcaggctgcggtattctgttctcttgcatgacccctctgggaattggtctgggcgccgcccttgcagaatccgccggcccactccaccaactggctcagagcgtcctggaggggatggcagccggaaccttcctctacatcaccttcctggagattctgcctcaggagctcgccagctccgaacagcggatacttaaggtcatcctcctgcttgccgggtttgccctgctcaccgggctcttattcattcaaatctag

SEQ ID NO: 135340 - DNA, 975 bp, Artificial Sequence
  Description of Artificial Sequence: Synthetic coding sequence
atgggaccctggggcgaaccagagctgctcgtctggcggcccgaggcggtggcgagcgagcctcccgttccagtcggcctggaggtcaaattgggcgctctggtcctattgctggtgcttaccttactgtgctcactggtcccaatctgcgtgctgcgaaggcctggcgccaatcacgagggaagtgctagcaggcaaaaagcactcagcctggtgtcctgttttgctggaggagtgttcctggctacatgccttcttgacctgctgcccgactacctcgcagcaatcgacgaggctttagcggccttgcacgtgactttacagttccccctccaggagttcattctcgccatgggcttctttttagtgcttgtgatggaacagatcaccctagcctataaagaacagagtggcccttcaccgctggaggaaacgcgcgctttgctgggtactgtcaacggcggcccacagcattggcatgatggcccaggagtcccccaggcatcaggcgcccctgctaccccaagtgcattgcgggcttgcgtgctggttttcagccttgcactgcactcggtgtttgagggattggccgtgggcctccagcgcgatagggcccgcgcgatggagctttgcctggctctgctcctacataagggcatcctcgcagtcagtttatccctgaggctgctgcagtctcatttgcgggctcaggtagtggccggatgtggcatcctgttctcttgcatgacccccctaggaataggcctgggcgcagctctggcagagtccgcaggtcctttgcatcagctggcacaatccgtactggagggcatggccgccgggacctttttatacatcaccttcctggagattctaccacaggagttggcatcctctgagcagcgcattctcaaggtcattctcctgcttgccggatttgctcttctgaccggactgttgtttatccagatttag

SEQ ID NO: 135341 - DNA, 975 bp, Artificial Sequence
  Description of Artificial Sequence: Synthetic coding sequence
atgggaccctggggagaaccagagctgctagtttggcgcccggaagcggtagctagtgagccccccgtgccagtcgggctcgaggtaaagctgggagccctagtactgcttcttgtgttgacgttattatgttctctggtaccgatatgcgtcctacggcggccaggggctaaccatgagggctcagctagtcgccagaaggccctgtcactcgtgtcctgctttgcagggggcgtctttctggccacctgtttactggatttgctgcctgattacctcgcagcaatcgatgaagctctggcagcgcttcacgtgacacttcagttccctcttcaggagtttatcttggccatggggtttttcctggttctggtcatggaacagatcacactcgcgtataaggagcaatccggacccagtcctcttgaggagacgcgcgccctgctagggacagtaaacggtggcccccagcattggcatgacggccccggcgtgcctcaggcaagtggagcgcccgcaactccctcagccctcagggcatgcgtgttggtttttagccttgcattgcactcagtttttgagggactggcagtcgggctgcaacgggaccgcgccagggcaatggaactgtgcctcgctctcctgctacataaaggcattctggctgtgtccctgtccttaaggttactgcagtcacacctaagagcccaggtagtggccggctgcggcatactgttttcttgcatgactcccttaggaatcgggctgggagccgctttggcagagtctgccggacccctgcatcagctcgcacagagcgtgctggaaggaatggccgcaggaactttcctctacatcactttcttggaaattttgccacaggaactggcctcttcagaacagcggattctcaaggtaatcctcctgctcgccggattcgcactgctgacaggcctgctcttcatccagatttag

SEQ ID NO: 135342 - DNA, 723 bp, Artificial Sequence
  Description of Artificial Sequence: Synthetic coding sequence
atggggccctggggggagccagagctcctcgtctggcgtccagaggcagttgccagcgaacctcccgttcctgtagggcttgaggtgaagttaggagcgctggtgttgcttctagtgctcacattgctctgctctttagtacctatttgtgtactccgcaggccaggtgcaaaccacgaaggtagcgccagccgccagaaggcactttccttagtgagttgcttcgctggaggcgtctttctggccacctgcctgcttgacctgctaccagattacctggccgcaattgacgaagccttggcagcgctgcacgtgacccttcagtttcctctgcaggagttcattcttgccatgggattcttcctggtgctggttatggagcagatcacccttgcctacaaggaacagtccgggccttcgcctcttgaggagaccagggcgctcttaggcaccgtgaatggaggcccgcagcactggcatgatgggccaggcgtgccccaggcctctggggctccagccactccgagcgccctgcgtgcctgcgtgctggtcttttctcttgccctacactccgtcttcgaaggtctcgcagtggggctgcagcgcgatagagcacgcgctatggagctgtgtctcgcgcttctgttgcacaaaggcattctcgctgtctctctctcccttagactgctgcagagccacctacgcgcccaggttgtcgcatag

SEQ ID NO: 135343 - DNA, 621 bp, Artificial Sequence
  Description of Artificial Sequence: Synthetic coding sequence
atggggccatggggggaacccgagttgctggtctggcggccagaagcagttgctagcgaacctcccgtcccagtgggactggaggtaaaactcggagcactcgtgctcctcctcgttcttactctcctgtgctctttggtgcctatttgtgtgcttaggcggcccggcgcaaatcatgaggggagcgcttcgcggcagaaggcgctgtcacttgtgtcctgctttgccggaggggtttttttggccacatgtctattggacctgctgccagactacttagcagccatcgatgaagcactcgccgccctgcacgtcactttacagtttcctctgcaggagtttattcttgccatggggttctttctggtgctggtaatggagcagattacactcgcgtacaaggaacaaagtggcccaagtcccttggaggaaacgcgagctctcctggggacagtcaatggtgggccacagcactggcatgacggaccaggggtcccccaggcatccggagcaccagctactccctcagccctgcgcgcctgtgtgctcgtcttctcccttgctctgcacagcgtgttcgaaggactggctgtgggcctgcagcgtgaccgggcccggtag

SEQ ID NO: 135344 - DNA, 966 bp, Artificial Sequence
  Description of Artificial Sequence: Synthetic coding sequence
atggggccctggggcgagccagagcttttagtgtggaggccagaggcggttgctagcgaacctcctgttcctgtgggacttgaggtgaaattgggagccctcgtgctgctgctcgtcttgacactgctctgttctctggtgcccatttgcgtcctacgccgccccggcgctaaccatgagggctccgcgtcccggcagaaggccttgtcacttgtcagttgtttcgctggtggggtattcctggcaacgtgcctgctggatctcctgcccgattacttggctgcaatcgacgaggctctcgcagccctgcatgtcacactgcagtttccacttcaagagtttatcctcgcaatggggttcttcctcgtccttgttatggaacagatcacattggcgtataaagagcagagtggaccatctccattagaggagacacgggccctgctcggaacagtgaacggggggccccagcactggcacgacgggcccggggtcccccaagccagcggcgctcccgccacgccctctgccctgcgggcctgcgtgttggtcttcagcctagctctgcattccgtattcgaggggctcgcagttggcttgcagagggatagggcccgagctatggaactgtgcctcgccctcctgcttcacaaaggtatcctggccgtgtctttgagtttgcgcctgcttcaatcccaccttcgggctcaggtggtcgcggggtgcggtattctgttcagctgcatgactcccttagggattgggcttggcgccgcactcgcagagtctgctgggccattgcatcagctggcgcagagcgtactagagggtatggccgccggcaccttcctgtatatcacgttcctggagattcttccgcaggaactagcctcatctgagcaacgtattctcaaagtgatcctgctgctcgcaggtttcgctctgttgaccggcctgttgttttag

SEQ ID NO: 135345 - DNA, 669 bp, Artificial Sequence
  Description of Artificial Sequence: Synthetic coding sequence
atgaaagcgcagctgcagtttcctctgcaggaattcattcttgccatgggtttctttcttgtgctcgttatggaacagatcaccctcgcatacaaggagcagagcggtccatcaccattggaggagacaagagctcttctgggcaccgttaatggtggcccacaacattggcacgatgggccaggggttccgcaagcctcgggggcaccggctactccgagtgcactgcgcgcttgcgttctggtgttctcgctggcactgcactccgtattcgagggactagctgtgggtctgcaacgggatcgcgctcgcgcaatggaactgtgtctggcactcctgctgcataaaggaattcttgccgtaagcctctccctccggttgctgcagtcacatctgagggcacaggtggtggctgggtgtgggatattgttttcctgcatgacccccctggggattggacttggtgccgccctggcggagagcgccgggcccctgcatcagctagcccagagcgtgttggaaggaatggcagcgggaacttttctgtatatcactttcctcgaaatcctccctcaggagctggcgagctcagaacaacgcattttaaaggtaatcttgctgttggccggctttgcactgctgacagggctccttttcattcagatttag

SEQ ID NO: 135346 - DNA, 942 bp, Artificial Sequence
  Description of Artificial Sequence: Synthetic coding sequence
atgggcccctggggggagccagaattgctagtgtggaggccagaggcagtggccagcgagccaccagtgccagtgggactggtgctgaccttactgtgttctttggtgcctatttgtgttcttaggaggccaggagcaaatcacgaaggcagcgccagtcgccaaaaggcattgtctctggtcagttgcttcgccgggggagtcttcctagcaacatgtctgctggatctgctgccggattacttggcagccatcgacgaggccctggccgcgctccatgtcacgctacagttcccactccaagagttcattctggctatgggcttctttctggtactggttatggaacagattacccttgcctataaggaacagtccgggccttctcccttggaggaaactcgggcgcttctgggcaccgtgaatggcgggccccaacactggcatgacggaccaggggttcctcaagcatccggagctcctgcaaccccgtctgccctcagagcatgtgtgttagtgttcagcctggcactccactccgtgtttgaagggttggctgtgggtctccagagggatcgcgcacgggcaatggaattgtgtctggctctcctgctacataagggcatcctggcggtcagccttagcctccgtctgctccaatctcacctacgggcgcaggtcgttgcgggctgtggcatcctcttctcctgcatgacccctctcgggatcggtctaggtgcggcactcgctgaatctgcaggccctctccaccagctggcccagagcgtgctggaggggatggcggcagggacgtttctgtacattactttcctggaaatactgccacaggaacttgcctcatccgagcaaaggatactcaaggtaatccttctgctagctggattcgccctcctcacagggctcctttttatacaaatatag

SEQ ID NO: 135347 - DNA, 1095 bp, Artificial Sequence
  Description of Artificial Sequence: Synthetic coding sequence
atgccggggtgtccatgtccaggatgcggtatggccggcccaagattactcttccttactgcgctggccctagagctcctggaaagggccggcggcagccagccagccttacgcagcaggggcaccgcaaccgcgtgcagattggataataaggagtccgagagttggggggcccttctatcaggggaaaggcttgacacctggatctgcagcctgttgggctctctgatggttggactctcaggcgtcttccccctcttggtgattcccctggaaatgggaaccatgctgaggtctgaggcgggcgcttggcggctgaaacagctcctctctttcgctctgggcggtctgctgggaaacgtgttcctccatctgcttccagaagcatgggcctatacctgttctgccagtccaggcggcgaggggcagtctctccaacagcagcagcaattgggcttgtgggtcatcgctggtattttgacctttctggcccttgaaaaaatgtttctcgattccaaggaagaaggaacatcccaggctcctaataaagatccaacggcagctgctgcagccctcaacgggggtcactgcctcgcccagccagcagcggagcctggcctgggagctgtcgtacgcagcattaaagtctccggctatttaaatttattggccaatacaatagataactttacacacggcctggccgtggcagcttcctttctggtctcaaagaaaatcgggctgttgacgaccatggccattcttctccacgaaatacctcatgaagttggggactttgctattctgctaagggcagggttcgacagatggtccgctgcaaagctgcagctgtctacagccctgggcggcctgttaggggctgggttcgctatatgtacccagagtcccaagggcgtggaagagactgctgcttgggtgttgccgttcacttccggaggctttctctatatagcattagttaatgtgctcccagacctgctcgaagaagaggacccgtggagatcgctccagcagctgctccttttgtgcgcaggaattgttgtgatggtcctgttcagcctgtttgtggactag

SEQ ID NO: 135348 - DNA, 1116 bp, Artificial Sequence
  Description of Artificial Sequence: Synthetic coding sequence
atgcccgggtgtccctgtccgggatgcgggatggcagggcctagactcctgtttttgaccgcgctggctctcgaacttctagagcgcgccggtggttcacagcccgcgcttaggtcacgggggacagccacagcctgccgactggacaacaaggagagtgagtcttggggcgcacttctgagtggtgagcggttagacacctggatttgctctctcttgggatctcttatggttggcctgagcggggtctttcctctgttggtcattcctcttgaaatgggaactatgctacggtcagaggctggagcctggcggttgaaacagcttctcagctttgccctaggcgggctcctgggaaacgtgtttttgcacttgctgcccgaagcttgggcttacacttgtagcgcatctccaggaggcgaggggcaatccctccagcagcagcagcagttgggcctctgggtcatagccgggatcttaacttttttagcacttgaaaagatgttcctggactctaaggaggaaggaacctctcaggctccaaacaaggaccctactgccgcagcggcggcattgaacggaggccactgccttgctcagccggccgccgaacctggacttggggctgtcgtgaggagcatcaaggttagcggctaccttaatttgctggccaacacaattgacaatttcacacatgggctggcagttgctgcaagcttcttagtatctaagaagattgggttattgactactatggccatcttgctgcatgagatcccccatgaagtgggtgactttgcgattctcttgagggcaggctttgaccgctggtcagccgctaaacttcagctgtctactgcgctcgggggactgctcggagccgggttcgcaatctgtacacagagcccaaaaggcgttgtcggctgctcgccagccgcggaagagacagctgcttgggtgctgcccttcacaagcggaggcttcctgtatattgctctagtaaatgtcctccctgatctcctcgaagaggaagacccttggaggtcccttcagcagctgcttctcctttgcgccggaatcgttgtcatggtgctgttttccctgttcgtggactag

SEQ ID NO: 135349 - DNA, 930 bp, Artificial Sequence
  Description of Artificial Sequence: Synthetic coding sequence
atggagcagcttttgggaatcaagctgggatgcctgttcgcattactggcattgacactggggtgcggcctcacgccaatttgctttaagtggtttcagattgatgctgcccgaggacaccaccgcttggtgctgcgcctgcttggctgcatttccgctggcgtcttcctcggcgcaggatttatgcatatgaccgccgaggccttagaagagattgagagtcagattcagaaatttatggttcagaatagatccgcttccgagcgcaacagttccggggatgcagatagtgcccatatggaatatccctacggcgagttaattatttctctaggattctttttcgtgttcttcctggagtctctggccctgcagtgctgccccggcgccgctggtggctccactgtacaggacgaagaatggggcggcgcgcacatcttcgagctgcattcacacggacacctccccagcccatctaagggccctctgagagccctcgttctcctgctcagtttgagttttcattcagtgttcgagggcctagccgtaggtctacagcccaccgtggccgcgacggtacaactatgtctcgccgtactggcccacaagggcctcgttgtgtttggggttgggatgaggctggtccatctgggtacctcctctaggtgggccgtcttctccatccttctgctggctctgatgagcccactgggtcttgctgttggactcgcggtgaccggaggtgactctgaaggaggaagagggcttgcgcaggccgtgctcgagggagtggccgccgggacctttctgtacgtaactttccttgagattctcccccgcgagctggccagtccagaagcccctctggctaagtggtcttgtgtagctgcgggttttgcgtttatggcatttattgcgttgtgggcctag

SEQ ID NO: 135350 - DNA, 945 bp, Artificial Sequence
  Description of Artificial Sequence: Synthetic coding sequence
atggtgaagctcttggtcgctaagatcttgtgtatggtgggggtcttctttttcatgctgctaggttcattactccccgttaaaataattgaaaccgactttgaaaaagcgcataggagtaaaaagatccttagcctgtgcaacactttcggaggtggggtgtttctggcaacttgtttcaacgctctgcttccagcagtgagagagaaactgcaaaaggtgctgtctctgggccacatctcaacagattaccctttggccgagacgattcttctccttggcttttttatgacagtcttcctcgagcaactgatattaacattccgcaaggagaaaccctccttcattgatctcgagaccttcaacgcgggaagcgatgtcgggagcgattccgagtatgagtccccattcatgggcggggcccgggggcacgcgctgtatgtggaaccccatggccacggacccagtctgtccgttcaaggattaagtcgcgctagccccgtacgcctgctgtccctagccttcgccctctctgcccatagcgtgttcgaaggtcttgctctggggctccaggaggaaggcgagaaggtcgtctccctattcgtaggagttgcagttcacgagactctggtggctgtggcgcttggaatatctatggcccgatctgccatgccacttcgggatgctgccaagctggctgtgaccgtgagtgctatgatccctctggggattggtctgggtttggggattgagtccgcccaaggggttcctggcagtgtggcgtcagtgttactgcagggactggccggagggacatttctgttcattactttcctggagattctggcaaaggagctagaggaaaagtccgaccgcctgttaaaagtcctctttctcgtgctcggctacaccgtgctggccggcatggtcttccttaaatggtag

SEQ ID NO: 135351 - DNA, 318 bp, Artificial Sequence
  Description of Artificial Sequence: Synthetic coding sequence
atggtcaagctcttagtggcaaagattttgtgcatggtgggagtatttttcttcatgctcctagggtccctgttgccggtgaagattatcgagaccgacttcgaaaaggcccacagatcgaagaaaatcctaagtctgtgcaatacgtttggtggcggcgtcttcctagccacctgttttaacgcactgctgcctgccgttcgagagaaagtgagagctccctgggcgctcgccgctgcattgggaactctttggccgagggactcggacgcttttagcaccttaatgccatccagcgtaaaggccctaatgctgtag

SEQ ID NO: 135352 - DNA, 972 bp, Artificial Sequence
  Description of Artificial Sequence: Synthetic coding sequence
atggtgaagctgttggtggcgaaaatcttatgtatggtgggggtgtttttttttatgcttctcggatctctcttgccggttaagataatagaaacagactttgagaaagcccacagatctaaaaagatactgagcctgtgcaacacattcgggggcggcgtgtttctagccacctgcttcaatgccctactgccagccgtccgggagaaattacagaaagtgctatccctggggcacatatccacagactaccccctggcagagaccatcctgttactaggtttctttatgacagtcttcttggagcagctgatccttacgttcagaaaggaaaagccttcttttattgatttagagacattcaatgccgggagtgatgtaggtagcgatagtgaatacgagagccccttcatggggggtgccagaggccatgctctgtacgtcgagcctcacggtcatggacccagcttatcggtgcagggactgagcagagcgagcccagtgcggctgctgtctttagcattcgctctgagcgcacacagcgtgtttgagggactggcgctgggactgcaggaggaaggggagaaggtggtgtctctctttgtgggagtagctgtacacgagaccctggttgccgtggccctaggcatcagcatggctcggtccgcaatgccccttagagatgcagccaaactggccgtgacggtcagtgctatgattcccctcggaatcgggttaggcttgggcatcgagtccgcgcagggcgtccctgggtccgtagcctctgtgcttctgcagggcctggcagggggtacctttctctttattacgttcctggagatattggccaaagagctggaagagaagtccgaccgactactgaaagttctcttcttggtccttggttatacggtcttagccgggatggtatttctgaaatggatctccccgccggaaccacgggtgtcatag

SEQ ID NO: 135353 - DNA, 1869 bp, Artificial Sequence
  Description of Artificial Sequence: Synthetic coding sequence
atggtcgacgtagttggcctggagagagagaccgggcccagaggtagtccctggcctggactgcctctgcccagtctggtaggtccggcccctctcctcacctgtctctgtccccagtgcctatctgttgaagacgctttggggctgggagagccggagggaagcggtttaccaccaggacctgtgctcgaggctagatatgtcgctcgactgtccgcagccgccgtgttatatctctctaacccggaaggtacctgcgaagacgctagggccggattgtgggcgtctcacgccgatcatttgctggcactacttgagtcccctaaagctctaactcccggactctcctggttgctgcagcgaatgcaggcaagggcggcggggcagactccaaagaccgcatgcgtggacattccccaactgttggaagaagctgtgggtgcgggcgccccaggatccgcagggggcgttctggctgctctgctggaccatgttagatctgggtcctgttttcacgccctgcctagtccccagtatttcgtggactttgtattccaacaacattctagtgaagtcccaatgacattggccgagttgtcagcacttatgcaacgcctaggagtcggacgagaggcacactccgatcacagtcaccggcaccggggcgcttcttcctgggatccagttccccttatctccagttccaatagttccagtgtttgggacacggtgtgcttgagcgcaagggacgttatggccgcctacggccttagcgagcaagcgggtgtcacccccgaagcctgggcccaactctctccagctctgctgcaacagcagttgtctggtgcttgcaccagccagtctcgccctccagtgcaagaccagctctcccagtcggagcgatacctgtacggttctctggccaccctgctcatttgcctgtgcgcggtgttcgggctgcttctgctgacctgtacgggctgtcggggcgtcacacactacatactccagacattcctgtctctcgccgttggagcactgactggagatgctgtgctgcacctcactcctaaggtcctgggtctgcacacacatagcgaggaaggtttgagccctcagcccacctggcgattgctggccatgctggcaggcttatacgcattctttctgtttgagaacctgttcaacctgctcctgcccagggatccagaagacttagaggacggcccctgcgggcacagtagtcacagccacgggggccattcacacggagtgagcctgcaactcgcacctagtgaactgagacagcctaaaccccctcacgagggctcccgtgcagatctcgttgccgaagagagtcccgaactcctgaaccctgagcctaggagactctcacccgagctgaggctcttaccatacatgattacactgggagacgctgttcacaattttgcggacgggctggcagtcggggcagcctttgcctcctcatggaaaaccgggctagccacgagtttggctgtgttctgccacgagctgccacatgaactcggcgattttgccgccctcctgcatgcggggctctctgtgcggcaagcactcctcctgaacctcgcatcagccctgactgcttttgccggtctatatgtggcgctggccgtgggggtgtccgaggagtcagaggcctggattcttgccgtggccaccgggttgttcctgtatgtcgcactatgcgacatgctccccgctatgctgaaagtgagggaccctcggccatggctgctgttcctcctacataacgttggccttttagggggctggactgttcttctactgctgagcctctatgaagatgatatcacattttag

SEQ ID NO: 135354 - DNA, 1944 bp, Artificial Sequence
  Description of Artificial Sequence: Synthetic coding sequence
atggcctcactcgtatctctggagctcggattgctgttggccgttctcgtcgttaccgcaacagctagtccccctgctgggcttctcagcttactaacctcaggacagggtgctctggatcaggaggctcttggaggactgctgaataccctcgcagatagagttcattgcgccaatggaccctgtgggaaatgtctgagtgtcgaggacgcccttggtctaggtgagccagagggcagcggactgccccccggcccagtgctggaagcccgttacgtcgcccgactgtccgccgcggctgtcctgtacctgtctaatcctgaagggacttgcgaggatgcacgtgcagggctctgggcttcccatgctgaccatttattagctttgctagagagccctaaagccctcacgcctggtctgtcctggctgctccagcggatgcaagcgcgcgccgccggccagacccccaaaaccgcctgtgtggacatcccccagctcctggaggaggccgttggagcaggagcccctgggtctgctggtggagttttggctgccttactggaccacgtcagaagtggtagttgcttccacgctctgccttcgccccaatattttgtggattttgtattccagcaacactcatccgaggtccccatgacactggccgaactgagcgccctcatgcagcggcttggggtggggagagaggctcactccgaccactcacataggcaccgtggagcaagctcttgggaccccgtgccactcatctcaagttccaactcgtctagtgtttgggacacagtctgcttatcagccagggatgttatggccgcatacggtttgtccgagcaggcaggcgtaacccctgaggcctgggcccagctcagcccagctctcttgcagcaacaacttagcggagcatgcacatcccagagccgtccacccgtgcaggatcagctaagccagtcagaacggtacctttatggatctctcgccaccttgctcatatgcctctgtgctgtatttgggctgctcttgctcacatgcacaggttgccgaggggtgactcactatatactccagacctttctaagtctggcggttggtgctctgacgggggatgcggtgctgcacttgacgccaaaagtactgggattgcacacacatagtgaggagggattgtcccctcagcccacttggaggctgctggctatgctggccggcctttatgcattctttctgtttgaaaacctgttcaacctgttgctgccacgagacccagaagatctggaggatggaccatgtgggcacagttcacactcccatggaggccatagccatggagtatccctccagctggctccttctgagctccgtcagcccaaaccccctcacgaggggtctagggcagatctggtggcggaggaatctcctgagctgttgaacccggagccccgtcggctctcacctgaactgcggctgttgccatatatgattacccttggcgatgctgtacacaatttcgcagacgggttggcagttggtgcagccttcgcctcaagttggaaaaccggactcgcaacgtccctggcagtcttttgccacgagttacctcatgagctgggtgatttcgccgccctcctgcacgctgggctgtccgtaaggcaggccctgctgctgaacctggctagtgccctgacagcttttgccgggctatacgtcgccttggcagtaggcgtctcggaagagtctgaagcctggatcctagccgtagccacgggactgtttctgtacgtcgctctctgcgacatgttgcccgctatgctgaaagtacgcgaccccaggccctggcttctgttccttctgcacaacgtgggcctccttggaggatggaccgtgctgctacttctcagcctctatgaagatgacattaccttctag

SEQ ID NO: 135355 - DNA, 1410 bp, Artificial Sequence
  Description of Artificial Sequence: Synthetic coding sequence
atggccaggggactcggcgcacctcattgggtcgctgttgggctgctgacttgggcgactctgggactgctggtcgccggccttggaggacatgatgacctgcacgacgacttacaggaagatttccacgggcactctcacagacactctcatgaggatttccaccatggccactcccatgcccacgggcacgggcatactcatgagtcaatatggcacggtcatacccatgatcacgatcacggccactctcacgaagatctgcatcatggacattctcacggctactctcacgagtcattgtaccacagggggcatggtcatgatcacgagcactcccacggtggctacggcgagtcgggggccccgggaataaaacaagatctggatgccgtgaccctgtgggcctatgccttgggggccactgtgctgatttccgctgcccctttctttgtactcttcctcattccagtggaatccaattccccacggcaccgctcactgttgcagattctgctgtccttcgcatccggagggctgctcggagacgctttcctccacctcatcccccatgcgcttgaaccacattcacatcacacattggaacagcctggtcacggacactcccactctggccaaggccctatactgagcgtggggctgtgggtgctgtccggcatcgtagccttcctggtggtcgaaaagttcgttcgccatgtgaaaggtggacacggccattctcacggacatggccatgctcattcccacactcgtggttcgcacgggcatggtcgccaagaaaggagtaccaaggaaaagcagtcctccgaggaggaagaaaaggagacgcgcggcgtccagaagagacgtgggggtagtaccgtgccgaaagacggccccgtccgccctcaaaacgcagaggaggaaaagcggggccttgatctccgggtgtcggggtacttgaaccttgcagccgacctagcgcacaattttacggacggccttgcgattggcgcttccttccgggggggcagaggcctcggcatactgacaaccatgactgtcctgctgcatgaagtgccccatgaagtcggggactttgccattttggtccagtctggatgctctaaaaaacaggcaatgcggctgcagctgctcactgccgtgggggctctggccggcacagcatgtgcgctcctgactgaaggaggtgccgtggggtcagagattgctgggggggcaggccctggatgggttttgccttttaccgcaggtggtttcatttacgttgctaccgtgtccgtccttccagaactgctacgagaagcatcgcccctgcaatccctgctagaggtgctgggcctgctgggcggagtgattatgatggtgctcattgcccatctggagtag

SEQ ID NO: 135356 - DNA, 1410 bp, Artificial Sequence
  Description of Artificial Sequence: Synthetic coding sequence
atggccagagggctgggcgccccccactgggtggctgtcggacttctcacctgggcgactctcggtctgctggtggcgggcctgggaggccacgacgatcttcacgatgatctccaggaggactttcatggccattcacatagacatagccacgaagacttccatcacggccatagccatgcgcatgggcatgggcacacccatgagtctatctggcacgggcatacccatgaccacgaccacggtcattcacacgaggacctgcatcatgggcactctcacggttatagccacgagtccctctaccatagggggcacggccacgatcacgagcacagccatggaggatacggtgagtcaggagccccaggtatcaagcaggatcttgacgctgtcacattgtgggcctatgccctaggagccactgtgctgatttctgccgcgccattttttgtgcttttcctcattccagtggaatccaatagccctagacatcgatccttgcttcagattcttttaagctttgcatcgggagggcttctgggggatgccttcctccatcttataccccacgcgttggagccacactcccaccataccctggaacagccagggcatggccatagtcattccggccaggggccgatcctaagcgtgggattgtgggtcctatccggtattgtcgcctttctggtggtggaaaagttcgtgcgccacgttaaagggggccacgggcactctcatggacatggccacgctcacagccacacacgagggagccatggacacggccgacaggaaagatccaccaaggaaaagcagtccagcgaagaggaagagaaagagacccgaggtgtccagaagagacgggggggtagtacggtacccaaagacggtcctgtccgcccccaaaatgccgaggaggagaagcggggactggacctgcgtgtgagcggctacctcaatctggcggcagaccttgctcacaatttcaccgatgggctggctataggggccagctttcgggggggtcggggactgggaattctcactactatgacagttctgttgcatgaagtgccacatgaggtgggggactttgccatcctggtgcagtctggctgctcaaagaaacaagcaatgagacttcagctcctgactgcagtgggggcgctggcaggaacggcctgtgcactgctcaccgagggcggggccgtcggatctgaaatcgccgggggagccggccctgggtgggttctgccctttacagccggcggatttatatacgtggccaccgtctccgtactacctgaactactacgggaggcatccccccttcaaagtcttctcgaggtgttgggactcctgggaggggtgatcatgatggtcctcatcgcacatttggagtag

SEQ ID NO: 135357 - DNA, 1410 bp, Artificial Sequence
  Description of Artificial Sequence: Synthetic coding sequence
atggcacgagggctgggtgcgccccactgggttgctgtcgggctcttgacctgggctacgttgggcttgctggtggcaggcctgggcgggcatgatgatttgcacgatgacctacaggaggattttcacgggcattcccacagacactctcatgaggattttcaccacggccattctcatgcccacggccacggccacacacacgaaagcatttggcacggccatactcacgatcacgatcatggccatagccacgaagacctgcaccacggccactctcatggctatagtcacgagtccctctaccaccgaggccatggccacgaccacgagcactcacacgggggatacggagaatctggcgcccccgggattaagcaggatcttgacgccgtaacgttatgggcttacgcgctgggcgctaccgttctcatcagtgccgcaccttttttcgtgctgtttctcataccagttgaatccaatagccccaggcacagaagcctgttacagatcttactgtcctttgcgtctggggggctgctgggcgatgctttcttacatcttattccacatgccctagagccacacagccatcacacactggaacagcccgggcacggccactcgcacagcggacaggggcctattctcagtgtggggctgtgggtgttgtcaggcattgtggcatttctggtggttgaaaagttcgtgagacacgtcaagggaggacatggacactcgcatgggcatggacatgctcacagtcacacacgaggcagccacggtcatgggcggcaggagcggagtaccaaagaaaagcagagcagtgaggaagaagagaaagaaacgcgcggggtccagaaaaggagaggcggcagtacagtgcctaaagacggacccgtgcggccccagaatgccgaagaggagaagcggggcctcgacctgagggtttctggttatctcaacctggcggctgacctcgcccataacttcacagacgggctcgcaataggcgcctcattcagaggcggacggggtctgggcatactaacaaccatgaccgtattgctacacgaagttccgcacgaagtaggcgattttgccattctagtacagagtggatgctcgaagaaacaggctatgaggctgcagctgctgactgccgtgggtgccctggctggcacagcctgtgcactgttaacagaaggcggagccgtcgggtccgagatcgccggcggggccggccccgggtgggtgctgccattcaccgccggggggtttatctacgttgccaccgtgagcgttctgcccgagttactgcgcgaagcctctcctctgcagtctcttttggaagtgctcggattgctcggcggcgtgatcatgatggtgcttatcgcgcacttggaatag

SEQ ID NO: 135358 - DNA, 1410 bp, Artificial Sequence
  Description of Artificial Sequence: Synthetic coding sequence
atggctcggggtctcggagctccccactgggtggccgtggggttgcttacatgggctaccctcgggctcctcgtagccggcctgggcgggcacgatgatctgcatgacgatttgcaggaagattttcatggacatagtcatagacactcccacgaggatttccaccatggccactcccatgcccatggacacgggcatactcacgagagtatctggcatggtcacacccacgaccacgatcatggccatagccatgaggaccttcatcacggccactcccatggatactcacatgagtcgctgtaccaccgcgggcatggtcatgaccacgaacacagtcacggcggatacggtgagtctggcgccccgggcattaagcaggacctggacgccgtgactctgtgggcatacgcactaggagccactgtcttgatttctgccgcacctttctttgtcctcttcctgattccagtggaatccaacagccctagacaccgctcgctcctccaaatccttctgagctttgcctcaggaggactgcttggtgacgcgttcttgcatttgatccctcacgccctggagccccattctcaccacactctggagcagcctggtcacggacactcacattccggacagggcccgattctttcagttggactgtgggttctgtcaggcatcgtggcctttctggttgtcgaaaagttcgttcgccatgtcaagggtggccacggccacagtcacggccatggccatgcccactctcatacccgcggctcacacggacatggaaggcaggagagatcgactaaggaaaaacagtcttctgaggaagaggagaaagagactcggggagtacagaaaaggcgcggaggttccacagtgccaaaagacggccctgtgagacctcaaaacgcggaggaagagaagaggggcctcgacctcagggtgtccgggtatctgaacctagccgccgacttagctcataactttactgacggtcttgctatcggggccagctttcgcgggggcagaggacttggtatactcacaaccatgaccgtcctcttgcatgaagtcccgcacgaggtgggagacttcgccatcctcgtgcagagtggctgctccaagaagcaggctatgcgtttgcaattgctgacagccgtgggagcgctcgccggtacagcctgcgcactgcttacagagggtggcgcagtcgggagcgagatcgccggaggtgccggtcccggctgggttttaccgttcacagccggtggattcatctacgtggctacagtcagcgtgctcccagagctgctgagagaggcatccccgctgcagtcactcctggaagtgctcggactgctgggtggggtaatcatgatggtgctgattgctcacctggaatag

SEQ ID NO: 135359 - DNA, 663 bp, Artificial Sequence
  Description of Artificial Sequence: Synthetic coding sequence
atggacagctctttgcccgaatgtagacacattggcaagggcatcagggctaaagtggagcggaatttcttgttttcacgagacttaaaagctggccttcctcgaccgtcaaagcccggtaaggaaaggatccccgagcctgctctgggagccacagtcctcatctctgccgctcctttcttcgtactgttcttaatacctgttgaatcgaactctccacggcatagaagtctgctgcaaatcctgttgagctttgctagcggtgggctcctaggcgacgcctttctgcatctcatcccccatgcactggagcctcattctcatcataccctcgaacagccaggccacggccacagccattctggccagggccccatcctttctgtggggctatgggttttgagcggtatagtggcttttcttgtggttgagaagttcgttagacacgttaagggcggccatggacactctcacggacatgggcacgctcactctcatacgcgcggatcacacggacatggtagacaggagcgctctacaaaggagaagcagtcctccgaagaggaagagaaagagacgagaggcgtgcagaagcgccgcggggggtcaaccgtgccaaaagacggacctgtcaggccacagaacgccgaagaagaaaagtag

SEQ ID NO: 135360 - DNA, 663 bp, Artificial Sequence
  Description of Artificial Sequence: Synthetic coding sequence
atggactcctctctgccagagtgtaggcacatcggcaaggggatacgcgccaaagtggagagaaacttcctattttcccgcgacctgaaagccgggctgcctaggccctctaaaccaggcaaagagcggattccggagcctgcccttggtgccaccgttctaatatcagcagcgccttttttcgttctattcctgattccagtggagtccaattctcctcgccacagatccctgctgcagatcttgctcagcttcgccagcgggggcttactgggggatgccttccttcacctcatcccacacgctctagaacctcacagccaccatacactcgagcagcccggacacggacacagtcattcaggccagggtccaatactgagtgtcggcctttgggtgctgtccggcattgtcgcatttttggtggtggagaagtttgtcaggcacgtgaaaggggggcacggtcacagtcacggccatggccatgcacactcgcataccaggggttctcacggtcacggtcgtcaggagagatcgacaaaagaaaagcagtcctcggaggaagaggaaaaggagacacggggggtccaaaagagacggggggggagcacagtgcccaaagatggacctgttagaccacagaacgcggaagaagaaaagtag

SEQ ID NO: 135361 - DNA, 1410 bp, Artificial Sequence
  Description of Artificial Sequence: Synthetic coding sequence
atggcaagagggttaggcgccccacactgggttgcggtagggctgctcacatgggccactctgggactgctcgtggcggggctgggcggccatgacgatctccacgatgatctgcaggaggacttccacggacactctcatcgccactcccatgaagactttcaccacggccattctcacgcccatggccatggacacacacatgaatcaatctggcacggtcacacgcacgaccatgatcacggtcactcacatgaagatctccatcatgggcactcacatggttacagccacgagagcctgtatcatcgggggcacggacatgatcatgagcacagtcatggtggctacggagaatccggtgcacccgggatcaagcaggatctcgacgccgtaactttatgggcctatgcactgggggccactgttctgatatccgctgctccattcttcgtgctctttctgatccccgtagaatctaactcaccccgacaccgatctctgctccaaattttgctgtcttttgcctcaggtggcttactgggggatgcgtttctccacttgattccccacgctctcgagccacattcacaccatacacttgaacaaccaggtcacggtcattcccactctggacaggggcctatcctttctgtgggattgtgggtcttgagcggtatcgtcgcttttctggtcgttgagaaattcgtccgccacgtgaagggcggacacggtcatagccacgggcacggacatgctcattcgcatacgcgaggctctcacggacacgggagacaagagaggagcacaaaggaaaaacagtcctcagaggaagaggagaaagagaccagaggcgtgcagaagcgccggggaggctcgacagtacctaaagatggcccagtgcggccccagaatgcagaagaagagaagcggggtttggacctgcgcgtgagcggatatctcaacctggccgccgatctggctcacaattttaccgacgggctggcaattggagcaagctttcgggggggccgaggcctcggaatccttactaccatgacggtcttactgcacgaggtgccacacgaagtgggggattttgctattttagtgcaatctggctgttccaagaagcaggcgatgagactacagctcctgacggctgtgggcgcccttgcaggtactgcctgcgctttattgaccgaggggggggccgtggggtccgagatcgcaggaggtgccgggccagggtgggtgctgccattcaccgccggaggtttcatctacgtcgccacagtctcagtcctgcctgaactactgagggaagcatcccctctgcagtccctccttgaggtcctgggtcttctgggcggggtgataatgatggtgctgatcgcacatcttgaatag

SEQ ID NO: 135362 - DNA, 1410 bp, Artificial Sequence
  Description of Artificial Sequence: Synthetic coding sequence
atggcccgggggctgggcgccccacactgggtggcggtgggtcttctgacctgggccaccctgggcctgctggtcgccgggcttggcgggcacgatgatctgcacgacgacctgcaagaagattttcatggccactcacaccggcactcacatgaagacttccaccacggtcacagtcacgcgcatggacacggtcacacacacgagtctatctggcatgggcatacccacgatcacgaccatgggcacagtcacgaagacctccaccacggtcacagccatggatactctcacgagtccctctatcatcggggccatggtcatgaccatgaacactcccatgggggctacggcgaatccggagcaccgggtatcaagcaggatctcgacgccgtgaccctgtgggcgtatgccctgggggcaacagtcttaatctccgccgcccccttcttcgtgctgtttctaatacccgttgaaagtaactcaccacgacaccgatctctgctgcagatcttgttaagctttgccagcggaggcctgctaggggacgccttcctccacttgatcccccacgctcttgagccacactcccaccacacattggagcaacctggccatgggcattcacattcagggcaaggaccgatcctctccgtgggtctgtgggtgctgtccggtatcgttgcctttctggtggtcgagaagtttgtccgacatgttaagggaggacacggccactctcacggccacggccacgcccattcacatacaaggggctctcatgggcacggacggcaggaacggtctaccaaggagaagcagagcagcgaggaggaggaaaaagagaccaggggagttcagaagaggagggggggctccacagtccctaaagacggtcccgtaagaccacaaaacgccgaggaagagaaacggggtctggatctgcgcgtaagtgggtaccttaacctggctgctgacttagctcataactttaccgacgggctggccattggcgcctccttccgcggtggccggggcctcgggattctgacaaccatgacagtacttctgcacgaggtgccccatgaggtgggtgacttcgccattctagttcagtctggatgttccaaaaagcaggcaatgcgactccaactgcttacggcagtgggtgccctagcagggacagcctgcgcgctcttaacggaaggaggcgctgttggctctgagatagcaggaggcgccgggcctgggtgggtactgcccttcacagccggcgggtttatatacgtggctaccgtgtccgtcttgccagagctgctgcgcgaggcctccccgctccaatccctgctggaggtgttgggcctcctggggggagtcatcatgatggtcctgatagctcatctggaatag

SEQ ID NO: 135363 - DNA, 1410 bp, Artificial Sequence
  Description of Artificial Sequence: Synthetic coding sequence
atggcccgcgggctcggtgctccccattgggtcgccgtcggcctccttacctgggccactctcggcctcctcgtagccgggttgggagggcacgacgatttacatgacgatctgcaggaggacttccacggccacagccatcgccattcgcacgaggacttccaccacgggcacagccacgcacatggtcacggccatacccacgagtctatatggcatggccatacacacgatcatgaccacgggcactctcacgaggatcttcaccatggacacagccacggctattcacacgagtccttataccatagagggcatggccacgatcatgagcattcacacggagggtatggagaatctggagctcccggaatcaaacaggatctggatgccgtgactttgtgggcatacgcgttaggcgccacggtacttatctccgcggcaccgttttttgtgctgtttctcatcccagtcgaaagcaactcgccgcggcatcgttctctactgcagatcctactcagtttcgcgagtggagggctcttaggcgatgcattccttcacctgatcccccacgcactggagccacactctcaccataccttggaacagcccggtcatggacactctcactcagggcagggtcccatcctgtccgtgggcctatgggttttatcgggaatagtagctttcctggtggtggaaaagtttgttaggcatgtgaagggcgggcatggacactcacatggccacggccacgcccacagtcacacccgggggagccacggccatgggagacaggagagaagtaccaaagaaaaacagagtagcgaggaggaggagaaagaaacccggggggttcagaaacgcagggggggcagcaccgtgcctaaggatgggcccgttagacctcagaatgccgaagaagaaaagcgggggctggatttgagagtttcgggctaccttaatctggccgcagacctggcccataacttcactgacggccttgctattggcgcgagcttcagaggggggcgcggccttggcatcctgacgacaatgacagtcctacttcatgaggtcccgcatgaagtgggagacttcgcaattctggtgcagtccggctgttccaagaagcaggcaatgagactgcagttactgacggctgtaggggcgttagccggtacggcctgtgcactgctaacagaagggggggccgtgggatctgaaattgccggcggagctggacccggctgggtcctgcctttcactgcaggcggattcatatacgtagcaactgtatcagtattgccagagctgctgcgtgaagccagccctctgcagtccctgctagaggtcctgggattactcggcggagtgattatgatggtgctgatcgcccatctggaatag

SEQ ID NO: 135364 - DNA, 663 bp, Artificial Sequence
  Description of Artificial Sequence: Synthetic coding sequence
atggactcctcccttcccgaatgtcgccacataggcaaaggtatccgggccaaagttgagcgaaacttcctcttttctcgagatctgaaggcgggcttgccaaggcccagcaagcctggcaaggaacgaatacccgagccggcactgggggctaccgtacttatcagcgctgcacctttcttcgtcctgttcctgattcccgtggaatcaaatagcccccgacaccgtagcttactgcagattctgctctcattcgcatcaggcggtctgctgggcgacgccttcctgcacttgattccacatgctctcgagccacactcccaccatacactcgagcagcccggacacggccacagtcattctgggcaagggccaatcctttccgtgggactctgggtcctgagtgggattgtagccttcttggtggtcgagaaatttgtgcgccatgtaaaaggcggtcacggacattcccacggacacggccatgctcactcccacactagggggtctcacggccacggaagacaggagagaagcaccaaagagaagcagtcttctgaggaagaagagaaggaaacaagaggcgtgcagaagcggcggggcggctctactgtgcccaaggatggacctgtgcgcccccagaacgctgaggaggaaaaatag

SEQ ID NO: 135365 - DNA, 663 bp, Artificial Sequence
  Description of Artificial Sequence: Synthetic coding sequence
atggacagcagtctgccggagtgccggcatattggcaaaggcatacgagccaaggtcgagcgcaactttctgttctcccgggacctgaaggctggtcttcccaggccatctaagccgggtaaggaaagaataccggagcccgccctaggcgccactgtgcttatctctgcagcacccttcttcgttctgtttctcatccccgtggagtcaaattcgcccaggcataggtcgctgttgcagattcttctaagcttcgcttctggcggactgttgggcgacgcctttctgcacctaattccacacgcactagagccgcattctcatcacacactcgagcaaccaggacatgggcattcgcactcaggtcaaggccctatcctgagtgtaggcctctgggtgttgtcgggaatagtcgctttcctagtggtggaaaagttcgtcagacacgtgaaaggcggccacggccactcccacggtcacgggcacgctcattctcacacccgaggctcacatggccacggacggcaggaaaggtctaccaaagaaaagcagtctagcgaagaagaagagaaagaaaccagaggcgtgcagaagcgacgcgggggaagtaccgtgcctaaggatgggccagtcaggccgcagaatgctgaggaagaaaaatag

SEQ ID NO: 135366 - DNA, 1410 bp, Artificial Sequence
  Description of Artificial Sequence: Synthetic coding sequence
atggcgcgtggactgggcgccccccattgggtcgccgtcggcctgctgacgtgggcgaccctcggactactggtagcagggctaggcgggcatgacgaccttcacgacgatctgcaggaggactttcacggccacagccatcgacactcccatgaagatttccaccacgggcatagccatgcacatgggcacgggcacactcacgagtccatttggcacggccacacccacgatcacgatcacgggcatagtcatgaggatctccatcacgggcactcacatggctactcccatgaatcactgtaccatcgtggccacggtcacgaccatgagcatagtcacggaggatatggagaatcaggagcccccggtatcaaacaggatttggatgcggtgactctgtgggcatacgcacttggcgcaacagtgcttatttctgccgccccattctttgttctgttcttgattccagtagagtcaaactcccctagacatcggagcttattgcagatactgctctccttcgctagcggcggactcctgggagatgcattcctacatctgattcctcacgccctggaaccacattcccatcacacgctagagcaaccagggcacggacactcacattcgggccaaggaccaatattgtctgtgggtctgtgggtgctctctggtattgtcgcgttcctggtggttgagaagtttgtgaggcacgtgaaaggaggtcatggccatagtcatgggcacggccatgcccactcccataccaggggctcacatggacacgggcggcaagagagaagcactaaagagaagcaaagcagcgaagaagaggagaaagaaacccgaggcgtgcaaaagcggaggggcggctcgactgtgcccaaggatgggccagttaggccgcaaaacgcagaggaggagaagagaggccttgacctccgagtgtcaggttatctcaatttggcagccgatcttgcgcataactttacagacgggctggcaattggcgcctcattccggggggggcgtgggttgggaatcctgacaactatgacggtgctcctgcatgaagtgcctcatgaagtgggcgatttcgcaatcctggtacaatccgggtgctctaagaaacaagcgatgcggctacagttactgacagccgtgggggctcttgcgggcaccgcctgcgctctgctgaccgagggtggggccgttgggtcggagatcgccggcggagctgggccagggtgggtgcttccttttaccgccgggggctttatctatgttgctacagtgagcgttctgccagagctgttaagggaagcctcacccctgcagtctcttttagaagtgttaggactgttgggtggggttataatgatggtgcttatagctcatctggaatag

SEQ ID NO: 135367 - DNA, 1410 bp, Artificial Sequence
  Description of Artificial Sequence: Synthetic coding sequence
atggctcgcggcctgggagctccccattgggtcgccgtgggactgctcacctgggccactctgggtctactggttgcgggtctcggcggccacgatgacctccacgacgatctccaggaggacttccacgggcacagtcataggcactctcacgaggactttcatcacgggcattcacacgcccacggtcacgggcacactcatgaatccatctggcacggacacacgcacgatcatgatcacggccacagtcacgaagacttacaccacggacattcacatgggtacagtcacgaaagtctgtaccaccgcgggcacgggcacgaccatgaacatagtcatggagggtacggcgagtccggcgccccaggaattaagcaggacctagatgccgttaccctgtgggcctacgctcttggggcaacagtgctcatatccgccgccccattttttgtcctcttcctcatccctgtggagagcaattcaccccgacacagaagcttactacaaatcctactgtctttcgccagcggaggactgctgggagacgctttcttgcatctcatcccccacgcgttggaaccacacagtcaccacacccttgagcagcctggacacggccacagccactccgggcaaggccccatcctttcagtggggctgtgggttctgtcaggaatcgtcgctttccttgtggtcgagaagtttgtcagacatgtgaaaggagggcatggacacagccatggacatgggcacgcccactctcatacgaggggaagccacggccatggccgtcaggagcggtcgaccaaagaaaagcaatcaagcgaggaggaagagaaggaaactcgcggggtccagaagaggaggggaggtagtacggtgcccaaggatggaccagtgagacctcagaacgctgaggaagagaaaaggggcctggacctcagggtcagcggctacctgaatctggccgcggatttagcccataattttactgacggtctagccatcggggccagcttccgtggaggaaggggcttgggcatattaacaaccatgaccgtcctcttacacgaggtcccccacgaggtgggggacttcgctattctcgttcaatctggctgctctaagaagcaagccatgcgtttacagctcctcactgccgtaggcgcactggccggaactgcgtgtgccctccttactgagggaggcgccgtcggcagtgaaatcgcgggaggagccggccctggttgggtgcttcccttcaccgctggagggttcatctacgtggccactgtctccgtgttacctgagctactgcgcgaagcttcaccattacagtcattactcgaagttctgggtctgctgggaggggtcatcatgatggtgttaatcgctcatttggaatag

SEQ ID NO: 135368 - DNA, 1410 bp, Artificial Sequence
  Description of Artificial Sequence: Synthetic coding sequence
atggcccgtgggctcggtgctccccactgggtggcagttgggctcctcacatgggccacactgggtcttctggtcgccggactgggtggccacgacgatctccatgacgacctgcaggaagatttccatgggcattctcatcggcacagccacgaggatttccatcacggacatagccacgctcacgggcacggccatacccacgagtccatttggcacggccacacacacgaccacgaccacggacattctcacgaggaccttcatcacggtcactctcatggatattcacacgagtccctgtatcaccgaggacacgggcatgatcacgaacatagtcatgggggctatggagagtctggagcaccaggcataaaacaggatttggatgcggttacgctgtgggcttacgcgttaggagccaccgtcttgataagtgccgctcccttctttgtgctgtttctcataccagtggaatctaactctccccggcaccgctccctgctgcagattctcttgtccttcgcctcaggaggcctgctgggtgacgcgttcctccacttaatcccacatgctctggagcctcacagccaccacacactggaacagcctgggcatggccactctcattccggacagggacctatcctgagtgtcgggctctgggtactatccggcattgtggcctttctggtggtcgagaaatttgtgcgccatgtgaagggcggccacgggcactcgcacgggcacggacacgcgcatagtcatactcgcggctcccacggacacggccgacaggagcgcagcactaaggagaaacaatcatctgaggaagaggagaaggaaactcggggagtgcagaagcggcgcgggggcagtaccgttccgaaagacggcccagtgcgcccccaaaacgcagaggaggagaaaagagggcttgatctaagggtgagcggctatctgaacctggccgccgatctcgctcataacttcactgacggattggccattggagctagcttccgcgggggccgcggcctaggcatactaacgactatgacagtgctgctccacgaagttccccatgaggtgggcgactttgctatattagtgcagagtggctgctcaaagaaacaggctatgaggctgcaattgctaacagctgttggggctttggcaggaaccgcatgcgccctgctgacggagggaggcgcagtggggagcgaaatcgccggaggggccggccccggttgggtcctgcccttcaccgccgggggattcatatatgtcgccacggtatctgtactgcccgagctgctgcgagaggcctcaccgctgcagtcgctgttggaggtattagggctgctgggcggcgtgatcatgatggtgctgattgcacacttggagtag

SEQ ID NO: 135369 - DNA, 1410 bp, Artificial Sequence
  Description of Artificial Sequence: Synthetic coding sequence
atggcaagagggttgggtgcgccccactgggtcgccgtgggactgctgacctgggctactctaggtctgctggtcgctggattggggggacatgatgacttgcatgatgatctccaggaagatttccatgggcattcccataggcattcccatgaggattttcatcatggccattcccatgcgcatggtcacggccacacccatgaatccatatggcatggccatacgcacgaccacgatcacggtcacagccacgaagatttgcaccatggtcatagccatggttattctcacgaatccctctaccaccgaggccacggccatgaccacgagcattcccacgggggttacggagagtccggcgcccctggcatcaaacaggacctcgacgcagtgacattgtgggcctacgcacttggtgctacggttcttatctcagcagcgccttttttcgtgctattcctgattccggtcgaatcgaatagcccccgtcaccggtctctgctccaaattttgctgagcttcgcgtccggaggcctgttaggcgacgcttttctacatcttataccacatgcacttgagcctcactctcaccataccctcgagcagcctgggcacggccacagccattcaggccaaggacccattttgagcgttggcctgtgggtgctatcaggtatagtcgccttcttagtcgtggaaaaatttgtacggcacgttaagggagggcatggccattcgcatggacacggtcatgcccacagtcacacaaggggatctcatggtcacggaaggcaagagaggagcacgaaagaaaaacagtcatccgaagaagaggagaaagagacaagaggcgtgcagaaaaggcgaggaggcagcactgtcccgaaggatggacccgtgaggcctcagaacgccgaagaggagaagagggggctagatctccgagtcagcggttatttaaacctggcggcagaccttgcgcacaacttcacagacgggctggccattggcgcctccttccggggcggccgaggactggggatccttacaacgatgacagtgctgctccacgaggtcccgcatgaagtgggggactttgcgatcttggtgcaaagcggctgttcaaagaaacaggctatgaggctccagctactgacagctgttggtgctctggctggcaccgcatgcgccttgttgaccgagggcggcgcggtgggctctgagattgctggtggagccggtccgggctgggtgttgccgttcactgctgggggtttcatttatgttgctactgtatccgtactgcccgagctgcttagagaggccagcccactgcagtctctcctcgaggtcttgggccttctgggcggggtaatcatgatggtgctgattgctcacctggagtag

SEQ ID NO: 135370 - DNA, 663 bp, Artificial Sequence
  Description of Artificial Sequence: Synthetic coding sequence
atggacagtagccttcccgagtgccgacacattgggaaaggcatccgtgctaaagttgaacgtaatttcctctttagccgcgacttaaaggcggggctcccacgccctagtaagcctggcaaggaacggatcccagagcctgctctgggggccactgtgctgattagcgcagccccatttttcgtgctgttccttattcctgtagaatccaattcacccaggcatagatcgttattacagatcctcttgtccttcgcctctggagggttgctgggggacgcattcctacacctgattccacacgctctggaaccccatagccaccacacgttggaacagcctggtcatggacatagccatagcggacagggaccaatcttgagcgtcgggctgtgggttcttagcggcatcgtggcgttcttagtcgtggagaaattcgtccggcacgtgaagggcggccacggccactcgcacggccacggccatgcccactcgcataccagaggcagccatggccacgggaggcaggagcgatctaccaaagaaaagcagagctcggaagaagaagaaaaggagacgagaggggtgcaaaaacggcgagggggctcgactgtgcccaaagacggacccgttagaccccaaaatgccgaagaggaaaaatag

SEQ ID NO: 135371 - DNA, 1125 bp, Artificial Sequence
  Description of Artificial Sequence: Synthetic coding sequence
atggccaggggactcggtgcgccgcactgggtcgccgtcggcctgctgacttgggcaacgctcgggctgctcgttgccggattgggcgggcacgatgacctccatgacgatctgcaggaagattttcatggtcactcacacagtgccgacctgtcttcttctatattttgtcctctcccttacccacgaggagttgaactgagccctgcaagcctatccaccagcgatcttgcccagttctgcttcagatgggccccaggtcgctgttttctccatcttattccccatgccctggagcctcattcacaccataccctcgaacagcccggtcatgggcacagccactctggacagggccccattctgtccgtcgggctgtgggtgttgtccggcatcgtcgcatttctggtcgttgaaaagttcgtgcggcacgtcaaaggcggccacggtcacagtcacggacacggacatgcacattctcacacacgcggatcccacggacatggcagacaggaacgatcaacaaaagagaagcagagctcagaggaggaggagaaggaaacaagaggagtgcaaaagcgacgggggggctctaccgtgcccaaggacggacccgtgcgtccccagaacgctgaagaagaaaaaagagggctcgacttgcgcgtatccggatatctgaatctggcagccgacctggctcacaattttactgatggcctggcaattggggcatcttttcgtggagggcgtggtttggggatactgaccaccatgacggtcctgctccacgaggtgccacatgaggtaggagattttgcaatactcgtgcagtcaggctgcagtaagaaacaagcaatgagactacagttactaacagccgtcggtgcactagccggcaccgcttgcgctctgctgacagaaggtggagcagtgggttccgagattgccggtggtgcaggcccaggttgggtcctgcctttcacggctgggggtttcatctacgttgccactgtgagcgtcctccccgaacttcttcgggaggcctctccactgcaaagtctgctggaggtgttgggcctgctaggaggggtgatcatgatggtgctcattgctcacctagagtag

SEQ ID NO: 135372 - DNA, 1353 bp, Artificial Sequence
  Description of Artificial Sequence: Synthetic coding sequence
atggctcggggcctgggggccccccactgggtggccgtcggccttctgacatgggccactttgggacttctggttgcgggattgggagggcacgatgatctgcacgacgatctccaagaggattttcatggccatggccacactcatgagagtatctggcatggccacactcacgatcacgatcacgggcacagtcacgaggacctgcatcacggccacagtcacgggtatagccatgagtccctctatcaccgaggccatggacatgaccatgagcactcccatggcggatatggggagagcggcgcaccgggcattaagcaggacctagatgccgttactctctgggcttacgcactgggtgctaccgtgctgatatctgctgctcctttctttgttctctttctgatcccagtggaatcaaattcaccccgacatcggagtttattacagatccttctctcattcgcaagtgggggcctcttgggcgacgctttcctccacctgatcccccatgctttagaaccgcattcgcaccatacccttgagcagccggggcatggccatagtcacagtggacagggcccaatacttagtgttggcctctgggtgctgtcaggtatagtggccttcctcgtagtggaaaagtttgtacgccatgtcaagggagggcacggacattctcatggccacggacatgctcattctcatactcggggctcacatgggcatggccgtcaggagcgctccaccaaggagaagcagtcgtctgaagaagaagaaaaggaaaccaggggtgttcagaagaggagggggggctctaccgtccctaaggatgggcctgtgcgtccccaaaacgcagaggaggaaaagcggggacttgatctgagggtgagtgggtatctcaacctggccgccgatttggcccataattttacagacggcctcgcgattggcgcctcttttcggggcggtcgaggccttgggattctcactactatgaccgtcctgctccatgaagtccctcacgaggtcggcgactttgctatcctcgtgcagtctgggtgttctaagaaacaggccatgaggctgcagctgctgacagccgtaggagcactggcaggcacagcgtgtgcactcctgaccgaaggaggcgcagttggatcagagatcgccggcggagcgggtccggggtgggtcctgccatttactgcaggtggctttatctatgttgccacagtgtcggttctgccagagctgctgcgcgaggcctccccactgcagtccctgttagaagtattgggattgctgggaggggtgattatgatggttttaatcgcccatcttgaatag

SEQ ID NO: 135373 - DNA, 663 bp, Artificial Sequence
  Description of Artificial Sequence: Synthetic coding sequence
atggacagcagcctcccagaatgtcggcacatcgggaaaggcattagagccaaagtcgagaggaatttcctgttcagccgggacctgaaagccggcctgcctcgaccgtccaagcccgggaaagagagaataccagagccggccttgggagccacggtgctcatttccgcggccccgttctttgtgctctttctcataccagtggagagcaacagtccgcggcaccgcagcctgctgcagatcctgctttctttcgcatcaggaggcctgctcggggatgctttcctgcaccttatcccccacgccctcgagccacactctcatcatacccttgaacagcccggacacggccattcgcactcagggcagggtcctattctgagtgtgggtctgtgggtgctgagtggcatcgtagcctttctggtggtagagaaattcgtgcgacacgtcaagggggggcatggccattcccatggccatggccacgcccacagtcacacgcgaggaagtcacggccacggccgtcaagaacggtcaacaaaagagaaacagtcgtctgaagaggaagagaaagagacccgtggcgttcagaaacgtaggggcgggtctaccgtacctaaagacggccccgtaagaccgcaaaatgccgaggaggaaaaatag

SEQ ID NO: 135374 - DNA, 1410 bp, Artificial Sequence
  Description of Artificial Sequence: Synthetic coding sequence
atggcccgaggcctgggcgcgcctcattgggtagcagttggattgctgacttgggcaacactcgggctgcttgtggcggggctgggtggccacgatgacctgcatgacgatctgcaggaggactttcacggccactctcaccggcacagccacgaggatttccaccacggacactctcacgcacatggtcacggccacacccacgagtccatttggcatggccacacacacgatcacgatcacggacactcgcacgaagatttgcaccatggacattcccacggttatagccacgagagtctgtatcataggggacatgggcacgaccatgagcacagccacggcgggtacggtgagtccggagccccaggtatcaagcaagatctggacgccgtcaccctgtgggcttatgccctcggggccacagtgctcatatcggctgccccattctttgtgctctttctcattcctgttgagtcgaactcccctcgacacaggagccttttgcagatacttctgtcattcgcgtcgggcgggctcttgggagacgctttcctgcatcttataccccatgctctagagccacacagccaccacaccctggaacagcccggccatggccacagtcattctggccagggccccatactcagtgtgggtctgtgggttttgtccgggatcgtggccttcctggtggtcgagaagttcgtgcgacacgttaaagggggccacggccattctcatggccacggccacgcgcatagtcacacacgaggcagccacggccacggtcgtcaggagaggtcaacaaaggaaaaacagtcctcagaagaggaggaaaaagaaacaaggggcgttcagaaacggagaggaggttctacagtcccgaaagatggacccgtgagaccacaaaatgccgaagaggagaagcgcggattagatctgagggtgagcggatacctgaatcttgcagcagatctggcccacaactttacggatggactggcaataggcgcatcttttcgtggtgggagaggcttggggattttaacaaccatgaccgttcttttacatgaggtgccgcatgaggtaggagattttgctattctggtccagagtggctgctctaagaaacaggcaatgcgcttgcaactgctcaccgcagttggtgcccttgcgggcacggcttgcgctctccttactgagggcggtgctgtcggtagcgaaattgcaggtggcgctggccctggctgggtgctgccattcaccgcaggtggtttcatatacgttgcaacagtttccgttctccccgagctactgagagaagccagccctctgcagtccctacttgaagttctgggtcttctcggtggcgtgattatgatggtgctgattgcccaccttgagtag

SEQ ID NO: 135375 - DNA, 1125 bp, Artificial Sequence
  Description of Artificial Sequence: Synthetic coding sequence
atggcccggggtctaggcgcacctcattgggtggccgtggggctcctaacatgggccactctagggttactcgtcgcaggacttggtggccatgatgatcttcatgatgatcttcaggaggacttccatgggcactcacatagtgcagatctaagcagctctatcttttgcccactgccatatcctaggggcgtggaactctctcctgccagcctgtccacaagcgacttggcgcagttttgctttaggtgggctcccggtaggtgtttcctccacctgataccacacgccctggagccccattcccatcacacattggaacagccaggacacggccactcacactcgggtcaagggcccatcttgagcgtaggcctgtgggttctgtctggcatagtcgcatttctcgttgtggaaaaattcgtgaggcacgtgaagggaggccacgggcatagtcacggacatgggcatgctcactcacatacccggggttctcatggccatgggcgtcaggagaggtcaactaaagaaaaacagagcagcgaagaggaggaaaaggagacccgcggtgtgcagaagcgtcggggaggctccaccgtgccaaaggacggacctgttcggcctcagaacgccgaggaagaaaaaaggggactggacctacgagtgagtggctatcttaatctcgctgcggacttggctcataattttactgatggtttggctatcggcgcctcattcagagggggaagaggccttggaattttgacaactatgacagtgctcctgcacgaggtgccccatgaagtcggagacttcgcaattcttgtccagtccggatgctccaagaaacaagctatgcggctccagttgctgaccgctgttggagcactggctggcactgcttgcgccctgctgaccgaggggggtgccgttggctctgagatcgccggtggtgccggccctggttgggtcctgccgttcactgctggaggcttcatctacgtggctacagtgtccgtgttgcctgagcttctgcgagaggctagtcccctgcagtcccttcttgaggttctgggccttctcgggggagtgatcatgatggtactcattgcccaccttgaatag

SEQ ID NO: 135376 - DNA, 1353 bp, Artificial Sequence
  Description of Artificial Sequence: Synthetic coding sequence
atggcccgcggactgggggctccacattgggtcgccgttggattgctgacttgggcaactctgggtttgcttgtggcgggactggggggccacgatgacttgcacgacgacctccaggaagattttcacggccacggccacacccacgagtccatctggcacggacacacccatgaccacgaccatggacattcccatgaagatcttcaccatggacattcacacgggtatagccacgaatccctttatcaccgtggccacggccacgaccacgaacacagccacgggggatacggggagtctggagctccaggaatcaagcaggatcttgatgccgtcactctctgggcatacgcgctgggggctactgttctgattagcgccgcaccgttctttgtgcttttcttaatccctgtggaaagcaactccccgaggcatcgctctctcttgcaaatccttctcagcttcgcctccggaggacttttaggcgatgcttttctccatctgatcccacatgcacttgaacctcatagccatcacaccctcgagcagccaggacacgggcattctcactctggtcaggggcctattctgtctgtggggctctgggttttatcgggcatagtggccttcttagtggtggagaaattcgtgcggcacgtgaaaggcggccacggacatagccatgggcacgggcatgcccattcccacactcgaggtagccacggacatgggcgccaggagcggtccaccaaagagaaacagtcatccgaagaggaagagaaagaaacccgtggagtgcaaaaacgcaggggagggtccactgttcccaaggatggccccgtgagaccacagaacgctgaggaggagaagaggggactcgaccttcgcgtgtcaggttatctgaacctcgccgccgatcttgcacacaactttacggacggcctggctattggcgcatccttcagaggcggacgaggcctgggtatattgaccaccatgacagtcctactgcatgaagtacctcacgaggtgggagatttcgctatattagtgcaatctggatgctcaaaaaagcaggccatgcgcctccagctgttgacggctgtgggagcattggccgggaccgcctgtgccctgctaaccgaaggtggcgctgtgggatccgaaattgcaggaggggcaggtcctgggtgggtcctcccattcacggctggcggatttatctacgtggcgacagtatctgtgctccctgagctgctgcgcgaggcctcacccctgcaatcccttctagaggtactgggactgcttggtggagtgattatgatggtgttaatcgctcacctggaatag

SEQ ID NO: 135377 - DNA, 1125 bp, Artificial Sequence
  Description of Artificial Sequence: Synthetic coding sequence
atggcgaggggactgggtgccccccactgggtggccgtcggtctgctgacatgggctactctgggcctgctggtcgccggcctgggcggccatgatgacctacatgacgacctgcaagaagatttccacggccattcccacagtgcggacctgagctcatcaatcttttgccctcttccatatccgaggggagttgagctctctcctgcgagtctcagcacatccgatttggcgcaattttgctttagatgggcacccggccgatgttttctgcacctgatcccgcatgcgctcgagccacactcccaccacaccctggagcagcctggacacggacactcacattctggtcagggcccgatcttaagcgtgggactctgggtgctgagcggcattgtggcattcttggttgtcgagaagtttgtaaggcatgtaaaagggggccacggccactctcatgggcacgggcatgcccactcccacaccaggggaagccacggccacgggcgccaggaacggtctactaaagagaaacagagttccgaggaggaagaaaaagagacaagaggggtccaaaagcgccggggcggaagcaccgtgccaaaagacggtcctgtgcggccacagaatgcagaggaggagaagcgcggcctcgacttgcgtgtgtctggctatttgaacctggctgcagacctggcccataatttcactgatggcctcgcaatcggcgcaagcttccgcggtggacgagggctgggtatcttgacgactatgaccgtccttctgcacgaggttccccacgaggtgggtgatttcgccattctggtacaaagtggatgttccaaaaagcaggcaatgcgacttcagctgttgaccgctgtaggagctctcgccggcacagcctgtgctctgctcaccgaaggaggagcagtgggatctgaaattgctggcggagcaggtcctgggtgggtgctgccatttaccgcagggggctttatctacgtggccactgtgtccgtcctgcctgagctgctgcgcgaggcaagcccattgcagagtcttctggaagttctcgggctgctgggcggcgttattatgatggtgctaatcgcacatttggagtag

SEQ ID NO: 135378 - DNA, 1125 bp, Artificial Sequence
  Description of Artificial Sequence: Synthetic coding sequence
atggcccgcggtcttggtgctccacattgggttgccgtggggctgcttacctgggcgactctcggtcttttggtggcaggccttggaggccacgacgatctgcatgatgacctccaggaagattttcatggccacagccattccgccgacctgtcgtcaagcattttctgccccctcccatatccgaggggggtagaactgtcacccgccagcctctccactagcgacttggcccagttctgctttcgctgggctccgggtcgatgtttccttcatctgattcctcatgcactggagccacattctcaccataccttagaacagcctggtcatggacactcccattctggacaaggaccaattctgtccgtcggactgtgggttttatccggaattgttgcctttctggtggttgagaagttcgtacggcacgtgaagggcgggcatgggcacagccacggccatgggcatgcacactcccatactcggggctctcacggtcatgggcgacaggagagatccacgaaggagaaacagagtagtgaggaggaagaaaaggagacacgcggcgtccagaagcgtagaggggggagcaccgtcccaaaagatggacctgttcggccacagaatgctgaagaggagaaacgcggtctggatctcagagtttcggggtacttaaatctggcagccgaccttgcgcataacttcaccgatggtctggccatcggagcctcctttcgcggaggccgagggttgggaatcctaactactatgacagtccttcttcatgaggttcctcacgaggtcggtgacttcgctatactcgtgcaaagcggctgctcaaagaaacaggccatgagactgcaactgttgacagcggttggtgctctagctggtaccgcctgcgcccttctcacagagggcggagcagtgggatcggaaatagccggaggcgcaggccccggatgggtgttgccttttacggccggaggttttatctacgttgcgactgtatccgttctgcccgaactcttgagagaagcatcgcctctccaaagcctcctggaggtgttgggactactgggcggcgtgattatgatggtgttaattgcacaccttgagtag

SEQ ID NO: 135379 - DNA, 1353 bp, Artificial Sequence
  Description of Artificial Sequence: Synthetic coding sequence
atggccaggggactcggggcgccacactgggttgccgtcggactgctgacgtgggcgacactgggactcctggtggctggtctgggaggtcacgacgatcttcacgatgatttgcaggaggatttccatgggcatgggcatactcatgaatcaatatggcatggacacactcatgatcatgaccacgggcactcccacgaagacttgcaccatggccacagtcacgggtattcacacgaaagcttatatcatcggggccacgggcacgatcatgagcactcccatggaggatacggagaaagcggcgctcctggcataaaacaggatctcgacgcagtcaccctctgggcctacgctctgggagcaacggtgctgattagcgccgccccgttcttcgtgctgtttctgatccctgtcgaaagtaattctcccagacaccgctcattactgcagattctactgtccttcgccagcggcgggctgctgggagacgcatttctgcacctgatccctcatgccctcgagccacactcccaccacaccctggaacagccggggcacggccacagtcacagcggccaaggccccattttgtccgttggcctgtgggtactttcaggtatcgtcgcctttctggtggtggagaaatttgtcaggcatgttaagggcggccatggacattcgcatggccatgggcatgcccactcacatacaagggggtcccacggccacggtcgccaagaacgctctaccaaggagaaacaatctagcgaagaagaagaaaaggagacaagaggcgtccagaaacggcggggaggtagcaccgtaccaaaggatggtccggttagaccccaaaatgccgaggaggaaaagcgaggtctggacctgagagtgagcggctatctgaacctcgctgccgacctagcacataacttcaccgacgggctcgctataggtgcatcttttcgaggcggacgtgggctgggcatcctgaccaccatgacagtgcttctccacgaggtgccacacgaggttggcgatttcgccattctcgttcagtccggatgttccaaaaagcaggccatgcggctacagctgctgaccgctgtgggcgcactggccgggacagcctgcgccctcctgacagaaggaggcgctgtgggttctgagatcgcaggcggcgcaggacccgggtgggtgcttccctttaccgcaggaggcttcatttacgtggccactgtgagcgtcctccctgagctcctgagagaagcctcacccttgcagtctttgctcgaagtcctcggcctgctggggggggtcataatgatggttctgatcgctcatctggagtag

SEQ ID NO: 135380 - DNA, 1353 bp, Artificial Sequence
  Description of Artificial Sequence: Synthetic coding sequence
atggctaggggcctcggggccccccattgggtggctgttggcctgctgacatgggccaccttagggctactcgtcgccggtttagggggacacgatgaccttcatgacgacttacaggaagattttcacggccacggccatacccacgagtcaatctggcatggtcacacacatgaccacgatcacggccattctcacgaggatctgcatcatggccattcacacggttattcacatgagtccctgtatcatagaggccatggccacgatcacgagcacagtcatggaggctacggcgaaagcggcgcccctggcatcaagcaggacctcgacgcagtgaccctatgggcttacgctctgggcgctactgtgctcatcagcgcagcccctttcttcgtgttgttcctgatcccggtcgagagtaactcccctcggcatcggtcgctgttacagatcctgttgagctttgcatccggtggactgcttggcgatgctttcctgcacctgataccgcacgccctggaacctcactcgcaccatactttggagcaaccgggacacggccattcccactccgggcagggcccaattctctctgtcggactatgggtgctgtccgggattgtggccttcctcgttgtggaaaagttcgtgaggcatgttaaaggtggccatggccattcgcacggccatggccacgcccattcacacacaagaggaagccacggtcatggccgccaggagagatccacaaaagaaaagcaaagcagcgaagaagaggagaaagagactcgaggggtgcaaaaaaggcgcgggggctctactgtcccaaaggacggccccgtgcgcccccagaatgcggaggaagaaaagcggggcctggacttgcgagttagcgggtatctcaacttagctgctgatcttgctcataacttcaccgatgggctcgccataggtgctagctttcgggggggccgcggtctgggcattttgaccacaatgacagtcttgctgcatgaagtgccgcatgaggtgggagactttgcgattttggtacaaagcgggtgcagtaagaaacaggcaatgcgcctgcaactcctcactgctgttggcgctctagccggaaccgcttgcgctctccttactgagggtggagccgtgggctctgagatcgcaggtggtgccggtccgggatgggtcctccccttcaccgcaggcggcttcatatacgtcgccaccgtttctgttttgcccgaactactgcgtgaggccagccccttacaaagtctactggaagtactgggcctcctgggcggtgttatcatgatggtgctgatcgctcacctcgagtag

SEQ ID NO: 135381 - DNA, 1125 bp, Artificial Sequence
  Description of Artificial Sequence: Synthetic coding sequence
atggcccggggcctcggtgcgccgcattgggtggctgtgggtttacttacctgggcgacgttgggcctgctggtggccggccttggagggcacgatgacctgcacgacgatctgcaggaggatttccacggacatagccactctgctgacctgagctctagcattttctgccctctgccttaccccagaggagtggaactctcaccagcatcactatcaactagtgacctggcccagttctgcttccggtgggctcccggacgctgctttctgcatctaatcccccacgcccttgagccacacagccaccacacccttgaacagcccggacatgggcactcccattccggccagggcccaattctaagtgttggactgtgggtgttatcaggcatcgtggcgtttctcgtggtcgaaaaattcgtgcggcatgtgaagggcggtcatggccactctcacgggcatgggcatgcccattctcacactcgcggctcgcatgggcacggacggcaagagagatcaaccaaagagaagcagtctagcgaggaagaggaaaaagaaacaagaggcgtccaaaagcgccgcggcgggtcgacggtgccgaaggacggccccgttcggccacagaacgccgaagaagaaaagaggggactggacttgagggtgagcggataccttaatctggccgcagaccttgctcacaacttcactgatggtcttgctattggcgccagcttccgtggcggccgcgggttgggaatcctcactactatgacagtactccttcacgaggtgccccacgaagttggcgactttgctatcctcgtgcagagcgggtgcagtaagaaacaggccatgcggctgcagctgctgactgcggtaggggcactcgccggcaccgcctgcgctcttctgactgaaggtggcgccgtggggtccgaaatcgcaggcggggccggcccagggtgggttctgccttttacagctggaggttttatctacgttgccactgtgtctgtgctccccgagctgctccgtgaggcttctccactacagagcctgctcgaggtgctgggcctcctaggaggtgtgatcatgatggtactgatcgcccatctggagtag

SEQ ID NO: 135382 - DNA, 1353 bp, Artificial Sequence
  Description of Artificial Sequence: Synthetic coding sequence
atggcccgcgggctgggtgccccccattgggtggcggtcggacttctcacctgggcaacactgggcctgctcgtggccggactgggaggacatgatgatctgcatgatgatttgcaagaggactttcatggacacggccatacccatgaatccatttggcacgggcacacacatgaccacgatcacggacactcgcacgaggacttgcatcacgggcacagccacgggtactcacacgaatccctatatcatcgtggccatggccacgaccacgagcattctcatggcgggtacggagaaagcggcgcacctggtattaaacaagacctcgatgccgtcactctctgggcctatgctctgggggctacggtgttgatttctgctgcccccttctttgtgctgtttctgatcccagtggagtccaatagcccacgccaccggtcactgctgcagatccttctcagttttgcttccgggggcctgcttggagacgctttcctgcacctgatcccacacgcgcttgagcctcacagccaccacacccttgagcagcccggtcacgggcactcacattcaggccaaggcccaatactgtcagtcggtctgtgggtactatctggcatagtcgctttccttgtagtcgagaagtttgtacgtcacgtgaaaggtggacatgggcattcacatggccatggtcacgcccattcacacacccgcggctcccacggacacggacgtcaggagaggagtactaaagagaaacaatcatctgaagaagaagagaaggagacccgcggagtgcaaaagaggagagggggttcaaccgtcccaaaggacgggcccgtgcggccacaaaatgcagaagaagagaaaagaggactagatctcagggtctctggctatttaaatctggccgctgacctggctcacaatttcactgacgggcttgccattggtgctagcttccgcggtggcagggggctcgggatactcacgaccatgaccgtgcttctgcacgaagttccgcatgaggttggggattttgcaatcctcgtgcagtcaggttgcagtaagaaacaggccatgagactgcagctgctgacagccgtgggagctctggctggcacagcctgcgccctgttgaccgagggtggcgccgtcggttcggaaatcgccggtggagccggccctggctgggtcctgcctttcacggccgggggctttatttacgtggcaaccgtgtctgtcctgcctgagctgctccgcgaggccagtcctcttcaaagcttgctggaggtcctcggattgctaggtggtgtaatcatgatggtgctgattgctcatctggagtag

SEQ ID NO: 135383 - DNA, 1353 bp, Artificial Sequence
  Description of Artificial Sequence: Synthetic coding sequence
atggcacgaggcctgggcgctccacactgggtggccgtaggcctgctcacttgggccactctgggccttttggtcgctggtctagggggccacgatgatcttcacgatgatcttcaggaagattttcacgggcacggacacacgcacgagtccatttggcatggccacacacacgaccatgaccatggtcactcccacgaagacctccaccatggccactcacacggctacagtcatgagtccctgtaccatagaggtcatgggcacgatcatgaacacagtcacggcgggtacggagagtctggggcacctggaataaaacaggacctagacgccgtgaccctctgggcctacgctctgggcgccacagttctcatctctgccgccccattctttgttttattcctgattccagtcgaatccaattcaccacgccataggtcactgcttcagatattactcagctttgccagtggtggcttgctgggcgatgcctttctgcacctgatccctcacgctttagagccacatagtcatcacacgctcgaacaacccgggcatggccattctcattccggccaggggcctatcttgtctgtcggattgtgggtgctcagcggcattgttgccttcctcgttgtagaaaaatttgtaagacacgttaaaggtgggcacgggcacagccacggtcatgggcatgcccactcccatacaaggggtagtcatggccacggacgacaggagcgtagcacgaaagaaaaacagtctagcgaagaagaggaaaaggagactagaggcgtgcagaagcgacgtggagggagtactgtcccgaaggacggaccagtgcgcccacagaacgccgaggaggagaagcgaggactcgaccttcgcgtctctggttacctcaacttagccgctgatttagcccataatttcactgacggcttggccatcggggcaagtttccgagggggtcgaggactaggtatcttgactacaatgactgtgctcctgcatgaggtaccccatgaggtcggcgatttcgccatactcgtccagagcggctgctctaagaagcaggccatgcggctgcagctgctgactgcagtgggggcattagctgggacggcttgtgccctcttgacagagggaggggcagtgggtagcgagatagcgggtggtgctggccctgggtgggtgctcccctttaccgcaggtggcttcatctatgtggctaccgtctcggtgctgcctgagctcctccgcgaagcatctcccttacagtctcttctcgaagtgcttggactgctgggaggggtcatcatgatggtgttaatcgctcacctggagtag

SEQ ID NO: 135384 - DNA, 1125 bp, Artificial Sequence
  Description of Artificial Sequence: Synthetic coding sequence
atggcccgtggactcggtgccccacattgggtggccgtcgggctgctgacctgggcgaccctgggcctgcttgtggcagggctgggaggacacgacgacctgcacgacgatttgcaggaagactttcatggccacagtcattccgctgacctcagctcttccatcttttgtcccctgccataccccagaggagtcgagttatccccagcctctctctccacctccgatctggcccagttttgcttccgctgggcaccaggtcgctgctttctccatctgataccacacgctctggaacctcacagccaccacactttggagcagccaggacacggacattcgcactctgggcaaggccctatcctgtcagttggcttgtgggtactttccggaatcgttgcctttttagtagtggagaagtttgttcggcacgtgaaaggcggacatgggcactctcatggccacggacacgcccattcccatactagagggtctcatggacatggtcggcaggagaggagcaccaaggagaagcagtccagcgaagaagaagagaaagaaacaagaggagtccagaagcggagggggggctctacggtgcctaaggacgggcccgtcagaccacagaacgcagaagaggaaaaaagaggcctggatctgagagtgtctggctatctaaatctcgcagccgacctggcacataatttcaccgatggattagccatcggggcatcctttcgtggcggcagaggcctgggcatactaactaccatgacagtgttgctgcatgaggtgcctcacgaagtaggagactttgccatcctagtacagagtggatgctcgaagaagcaggccatgcggcttcagctgcttacagccgtaggggcactcgcgggtactgcttgcgccctgctgactgagggcggcgcagtgggaagcgagatcgctggcggcgcaggccctggatgggttctgcctttcacagcaggcggcttcatatacgtggctaccgtgtccgtgctgccagagcttctcagagaagcaagccccttgcagtccctgttagaggtcctggggctactgggaggagtcattatgatggttctgattgcgcatctggagtag

SEQ ID NO: 135385 - DNA, 2391 bp, Artificial Sequence
  Description of Artificial Sequence: Synthetic coding sequence
atgctcgccccactgagaaatgccccaggcagggagggcgctactagcccgagccctcccaccgatgccaccggcagcctgggggagtgggacgtggatagaaatgttaagacagagggttgggtgtctaaggagcggatcagtaagttgcatagactgagaatggcagacatactctctcagtctgaaactctggcttcacaggacctctcaggagattttaagaagcctgctctacctgtgagccctgccgctagatccaaggctcccgcttcaagcagttcaaacccagaagaagtgcaaaaagaagggccaaccgccctgcaagactccaacagcggggagcccgacatacccccccctcaaccagactgcggggattttcgcagcttacaggaagagcagtcgcgtccacccaccgccgttagcagccccggcggcccagcacgcgcccctccataccaagaaccaccatggggtgggccagcaacagctccatactccctcgagacattgaaaggaggcaccatcctcggcacacggtctctcaagggaaccagctattgtctgtttgggcgactgtctggttgcgacgtgtgcctggaacatccctctgtgtcaaggtatcacgctgtgctgcagcatcgcgcttctggtcccgatggagagtgcgacagcaacgggccaggattctacttgtacgatttaggctctactcatggaaccttcctgaacaaaaccagaataccgcccaggacttattgtcgcgtccacgtgggccatgtggtcagattcggtggctccacccgtctgttcatccttcagggacccgaagaagaccgggaggccgagtcagaactgaccgtcactcagttgaaggagctgcggaaacagcagcagatactgctagaaaagaaaatgctaggggaagactcagacgaagaggaagagatggatacttctgaacggaagataaacgcaggcagccaggatgatgaaatgggctgtacctggggaatgggcgaagacgccgtcgaggacgatgctgaggaaaaccccatcgtgcttgaattccagcaggagcgcgaggccttctacataaaagatcccaaaaaggctttacagggtttttttgacagggaaggagaggaactcgagtatgagtttgacgagcagggccactcgacctggctctgtcgggtccgactgcctgtcgacgatagcaccgggaagcagttggttgccgaagcaatacacagcggaaaaaagaaagaggccatgattcagtgctcactggaagcatgtcgtatcctggatacactcgggctgctgagacaggaagcagttagccgtaagcggaaagctaagaactgggaagatgaggacttctacgattccgacgatgacacgtttcttgaccgcaccggccttatcgagaaaaaacggttgaatcgcatgaaaaaagccggaaagatcgacgaaaaacctgagacctttgaaagtctagtggcaaagctgaacgatgcggagcgcgagttgtctgagatctccgagagactgaaggcctcctcacaggtgctgtctgagagcccatcccaggactctctggacgcttttatgtctgagatgaagtcgggttctacattggacggggtgagccgcaagaagctgcaccttcgcaccttcgaactgagaaaagaacaacaaaggctgaaagggcttataaaaattgtgaaacccgctgagataccagagttaaagaagactgagacacaaactacaggcgccgaaaacaaagctaagaaactcaccttgcctttgtttggggcaatgaagggaggcagcaaattcaagctgaagaccgggactgtgggcaaactgccacccaagcggcccgaactgccgcccactctgatgcgcatgaaagatgagcccgaggtggaggaagaggaagaagaggaggaggaagaagagaaggagaaggaagagcacgaaaaaaagaaactggaggatgggtcactatcaaggccccagccagaaattgaaccagaggctgccgtccaagaaatgcgccccccaacggatctaacccacttcaaggagacccagacgcacgagaatatgtcacagctcagcgaggaggagcagaacaaggattaccaggattgtagcaagaccacctcactctgcgcaggtccctctgcatccaagaacgaatacgaaaagtccaggggggagttaaagaaaaaaaagacccccgggcctggcaaactgccccccactctgtcatccaagtaccccgaggatgacccggattattgcgtttgggtccccccggaaggccaatcaggggatggtaggacccacctaaacgataaatatggctattag

SEQ ID NO: 135386 - DNA, 3699 bp, Artificial Sequence
  Description of Artificial Sequence: Synthetic coding sequence
atggactttctattgagaccacaacctgagcctgagtccctcgggccaggcacccctggattccctgagcaggaagaggacgaattacatcggaccttgggcgttgagagattcgaagagatactgcaggaagccggatccagaggaggcgaggagcccgggcgctcctacggcgaggaggacttcgaatatcacagacagagcagtcatcatatccatcatcccctgtccactcatctgcccccagatgcccggaggaggaaaacaccccagggacctggaagaaagcctcggcgcagaccgggggccagtcccaccggggagacccctaccatcgaggagggcgaggaggacgaggatgaagcctcagaggccgagggtgccagggcactgacccagccctctcctgtatcaactccaagctccgtgcagttttttcttcaggaagatgacagcgctgaccgaaaggccgagcgtacatctccctcgtcccctgcccctcttccacaccaagaggctacaccgcgggcatccaaaggggctcaagccggcactcaggtggaggaagctgaagccgaggccgtggccgtcgcctcaggcacagcaggtggcgatgacggaggcgctagtggaaggcctctgcccaaagcgcaacccggccaccgctcatataaccttcaggagcggcgacggatcggatctatgacaggcgcggaacaagccttgcttccgagggtgcccactgacgaaatcgaggcccagacactggccacggcagacttggacctcatgaaaagtcaccgtttcgaggacgtgccgggagtgcgcaggcaccttgttcgcaaaaacgccaaggggagcacccaaagtggaagagagggtcgcgaaccagggcctaccccacgcgcccgtcctcgagcaccccacaaaccgcacgaggtgtttgtagaactcaacgagctgctgctggacaaaaaccaggagccacaatggcgtgagaccgctcgatggatcaaattcgaagaggatgtggaagaggagaccgagcggtggggaaagcctcatgttgctagcttgagcttcaggtccctgttggaactgcggagaacacttgcacatggtgctgtgctgttggacctggatcagcaaacactcccgggggttgcccatcaagtggttgagcagatggtcatctccgaccaaatcaaagctgaggacagagccaacgtcttgagggccctccttctgaaacattctcacccttctgacgagaaagatttctcatttccgaggaatatcagtgcagggtccctgggctccctgctagggcatcaccatggacaaggggcagaatccgatcctcacgtgactgaacccctcatgggtggggtccccgaaaccaggctggaggttgagcgggaacgcgagctccccccccccgcaccaccagctgggattactcgaagcaagtctaagcacgagttgaagttgttggaaaagatacccgaaaatgctgaggcaacagtggtgcttgtggggtgtgttgagtttctgtccagaccaactatggcttttgtaagactgagagaggctgtcgaattggacgctgtgcttgaggtaccagtgcccgtccgcttcctgttcctgcttttaggtccatcctccgccaacatggactatcacgagataggccgcagcatttcaacattaatgtctgataaacagttccatgaggcagcttacctggccgacgagagagaagacctgctgaccgcaataaacgccttcctggactgctcagtagtgctcccgccttctgaagttcagggcgaagaactcctacggtcagtcgctcatttccagagacagatgctcaagaaacgggaggaacagggcaggctcctaccaactggcgccggattggagcccaaaagcgcccaggacaaggccctcctccagatggtagaggccgctggcgccgccgaggacgacccactccggcgcactgggaggccatttgggggtttaatcagagacgtacgtcgtaggtacccccactacctcagtgactttcgcgacgccctcgatccccagtgtctagcagcggtgattttcatttattttgctgcactgagtcccgcaatcacctttggcgggctccttggtgagaaaacacaagacctcattggtgtttctgagctgatcatgagcactgccctgcagggagtggtgttctgtctactaggcgcacagcccttactggtgatcggattcagtggccccctgttggtgttcgaggaagcctttttctccttctgctccagcaatcacctggagtatctagtcggcagggtgtggattggattttggctggtgttcctggccttgctgatggttgctctggagggtagcttcctggtacgcttcgttagcaggttcacgcaggagatctttgcttttctaataagtctgatctttatttatgaaactttttataaacttgtgaagattttccaggaacatcccttacacgggtgctccgccagcaactcatccgaagtagatggtggtgagaatatgacatgggctggcgccagacccacattaggtcctggaaaccggtcactagcaggacagtcaggccaggggaagccccgcggacagccaaataccgctttgctgtccctggtactgatggcagggactttttttatcgccttcttcctgagaaaattcaaaaacagtcgcttctttccaggcaggatccggcgcgtaatcggcgatttcggagtccctatcgcaatcttgataatggttctggtggactatagtatcgaggacacttacacccagaaactctcggttccttctggtttcagtgtgaccgccccagaaaaacgtggttgggtgataaaccccctcggggagaagagtccgtttcccgtgtggatgatggtggccagtctgctacctgccattctggttttcatactgatctttatggagacccaaattacaactttgatcatctctaaaaaggagaggatgctacaaaagggatccggatttcatttggatctgctgctcattgtcgctatgggagggatctgcgctctattcggactgccctggcttgcagccgccactgtaagaagcgttacacatgccaatgcactgactgtgatgtccaaggcggtggctccaggcgataaacccaaaatccaagaggttaaggagcagagggtgaccggtctcctggtggccttgctcgtggggctttccatagtgataggtgacctcctgcggcaaatcccgctggccgtattattcggcatcttcttgtacatgggggtgacgagccttaatggcattcagttctacgaacgcctacacctgttgctgatgcccccaaagcatcatcctgacgttacttacgtgaagaaagtcaggacattgaggatgcaccttttcaccgccctgcagctgctgtgcctggccctgctgtgggctgttatgtcaacagcggcttccctcgcattccctttcattttaatcctgacagtgcctctgagaatggtagtgctgacccgcattttcactgacagggagatgaagtgcctcgacgccaacgaggccgaacctgtctttgacgagcgggagggtgtggatgagtacaacgaaatgcccatgccagtgtag

SEQ ID NO: 135387 - DNA, 3684 bp, Artificial Sequence
  Description of Artificial Sequence: Synthetic coding sequence
atgacacagccggagcccgagagcttgggccctggaactcctggctttccagagcaagaagaggacgagctgcatcgaactctaggagtggagcgctttgaggagattctgcaggaagccgggtcgcgcggaggagaggagcctggccgttcctatggcgaggaagattttgagtatcatcgtcaatcttcccaccatattcaccatccactgtccacacacctcccccccgatgcccgcaggcgaaagaccccacaaggccctggcaggaaaccccgacggcgcccaggcgcctctccgacaggagagactcctacaatcgaggaaggcgaagaggatgaggatgaagcgtcagaggccgaaggggcaagagctttaacccagcctagccccgtgagtacgccttcaagtgtccagttcttcctacaggaggacgacagcgccgatagaaaggcggagcgcacttctccctccagccctgcccccctcccccatcaagaggccacacctcgtgcatccaagggagctcaggcagggactcaggtcgaagaagccgaggccgaggccgtggcagttgccagtggaactgccggaggcgacgatggcggggcgtccggtaggcctctgcccaaagcgcagcccgggcacaggtcctacaacctgcaggagagaaggcgcataggctctatgaccggagctgaacaggcactgctgccccgggtgcccaccgacgaaatcgaggcccagacgctggcaactgccgacctagatctaatgaagagccaccgcttcgaagatgttccaggcgtcaggcgccacttagttcgaaagaatgcaaaagggtctacccaaagcggcagggagggaagggagcctgggcctactccaagagccagacctcgggcccctcataagcctcacgaagtgtttgtggaacttaatgaactgctcctggataagaaccaggagcctcagtggcgggaaacagcacgttggatcaaattcgaggaggatgtggaagaggagaccgaacgctggggaaaacctcatgtggcgtccctgagttttaggagccttctggaactgcggagaactttagctcacggcgcagtccttcttgatctggatcagcaaaccctcccaggagtcgctcatcaggtggtcgaacaaatggtgatctcagaccagattaaggctgaagacagagccaacgtcctaagagcgctgctgcttaagcatagtcaccccagtgacgaaaaggactttagcttcccgagaaatatctcagccggatccctgggctccctgctggggcaccaccacggacaaggcgcagagagtgaccctcatgtcaccgagcccctgatgggcggagttccagaaaccaggttggaggtggagagggaacgcgaactgcctcccccagcgccccctgctggtattacaagaagcaagagtaagcacgaactgaaattgctggagaagatacccgagaacgctgaggccactgtagttctggtggggtgtgtggaatttctttctagacccactatggcgtttgttcggctaagagaggccgttgagctcgatgcggtgctagaagtgcctgtgcccgtcagattcctgttcttgctcctggggccatccagtgcaaacatggattatcacgaaattggtcgaagcattagcacccttatgtccgataagcaatttcacgaggccgcttacctcgccgatgagcgtgaggacctccttaccgcaattaatgccttcctggactgtagcgtggtgttacccccaagtgaagtgcaaggagaggagctgcttcgctcagtggctcactttcagcggcagatgcttaagaaacgggaagagcagggccgtctgttacctacgggagcaggactggaaccaaaaagtgcacaagacaaggctctcttacaaatggtggaggcagcaggagccgccgaagacgacccactcagacgcacagggagaccattcggcggtctgattcgagacgtgaggcggagataccctcactatctgtcggatttccgcgacgcgttggatccacagtgtctcgcagcggtgatctttatctactttgctgctttgtcacccgccataacattcggtgggcttctaggcgaaaagacccaggatctgatcggggtatccgaactcattatgagcaccgcacttcaaggcgtggtattctgtttactgggagctcagccgctccttgttataggattcagtggaccgctgctggttttcgaagaagccttctttagtttttgctcctccaaccatttggaatacctggtgggacgcgtatggatcggtttttggctggtctttcttgcccttctgatggtcgccctggagggctcattcctcgtgagattcgtctctcgcttcacccaggagatcttcgcttttcttatcagcttgatttttatttacgaaaccttctacaagttagtgaaaatcttccaggagcacccactgcatggatgttccgccagcaattcgtcggaggtggatggtggcgagaatatgacttgggctggcgcccgccccacgctgggacccggaaatcggagtctggcaggccagtccggacaggggaagcccagggggcaacccaatactgctcttctttccctcgtgctgatggcaggtacgttttttatcgctttctttctcaggaaatttaagaatagtcgattcttccccggcaggatccggagagtcattggagattttggggtgcccatcgcaatcttgatcatggttttagtggattattccattgaagacacctatactcagaaattgagtgtgccctccggcttttcagttaccgctcctgaaaaacgcggatgggttatcaatccattgggagagaaatccccatttcctgtctggatgatggtagcttctcttctaccagcaattctcgtgtttatcttgatcttcatggaaactcagattacaacactcattatatccaaaaaggagagaatgctgcagaaaggaagcgggttccacctagatctgctgctcatagtagcgatgggagggatctgcgcccttttcggcctcccctggcttgctgctgccacggtccgaagcgtgacccatgccaatgccttaacagtgatgagcaaggctgtggcaccaggcgataagccaaagattcaggaggtgaaggaacagcgcgtcacggggctgctagtagccctcctagtgggactgtcaatcgtgataggagacctcctgcggcagatcccgttggcagtgcttttcggaatcttcctgtacatgggtgtgacctccttaaatggcatacagttctacgaaagactgcacttgcttctgatgccacctaagcatcaccctgatgtgacatacgtgaagaaggtgagaactctccgcatgcatctattcaccgccctgcagctcctgtgtcttgctctgctgtgggccgtgatgtcaaccgctgcctcactggcctttccttttatcctgattctcaccgtgcctctacgaatggtcgtcttaacccgtatcttcactgacagagaaatgaaatgcctggacgctaacgaggccgagccggtgtttgacgagagagagggcgtcgacgagtacaatgagatgcctatgccagtctag

SEQ ID NO: 135388 - DNA, 2406 bp, Artificial Sequence
  Description of Artificial Sequence: Synthetic coding sequence
gtcatggaggtggtcgaggccgaaaagatagtattactaacttcagcgagatttctgttcctgttgcttggacccgcgggcaaagctccacagtatcacgaaatcggaagatcgattgccactctgatgactgacgagatcttccacgatgtggcttataaggccaaagacagaaatgatcttctgagcggaattgacgagtttctggatcaagtgaccgtgttgccccccggagagtgggaccccagcatccgcatagaacctcctaaatcagttccctcccaagagaaaagaaaaattcctgttttccataatggctccacccccaccctgggagagacacctaaggaggccgcacaccatgcaggccctgagctgcagcggacgggacgtctcttcggaggcctgatcctggatatcaagcgaaaggcccccttcttcctgtcagactttaaggatgcactgtccttacaatgtctagcctcgatcctgttcctgtactgcgcctgtatgtccccggtgatcacatttggagggctcttaggggaggccacagagggaagaatatccgccatagagtctcttttcggggcttctctcaccggcattgcatattccctctttgctggccagccactcacgatcctcggcagtacgggacccgtgttagtcttcgaaaagatcttatacaaattctgcagggactaccagctctcctacctcagtctcaggaccagcataggtctatggacatcgttcctgtgtatcgtgctggtcgcgacagatgcaagcagtctggtgtgctacatcacgcgttttacagaggaggctttcgctgccttgatctgcattatttttatctacgaggctctggaaaagctcttcgatttaggggaaacttacgccttcaatatgcataataacctcgacaaactcacctcttacagctgcgtgtgtacagaaccgccgaacccgtctaatgaaacactggctcagtggaaaaaggataatatcactgctcacaatattagctggaggaatctgactgtgtccgaatgtaagaagctgaggggtgttttcctcgggtctgcatgtggtcatcacgggccatacatccctgatgtgctcttctggtgcgtgatccttttcttcacaactttcttcttaagcagcttcctcaagcagtttaaaaccaagagatacttcccgacaaaggtgcgaagtactatttctgatttcgccgttttcttgacaatagttattatggttactatcgactacctcgttggcgtaccgtcacccaaactacatgtcccagaaaagtttgaacctacgcatccggaaagagggtggattatcagcccattgggggacaatccctggtggaccttgttaatcgcagcaatccccgccctgctttgcactatcctgatatttatggaccaacagatcacggccgtgatcattaaccggaaggagcataagctgaagaagggggccgggtatcatctggatctccttatggttggggtcatgcttggcgtctgttccgtcatgggcctgccttggttcgtcgccgcaacagtgctctctatttcacacgtaaactccctgaaagtagaaagcgagtgctccgcccctggtgaacagcctaaatttttgggtattcgtgagcagagggtgaccgggctcatgatcttcattctgatggggttgtctgtctttatgactagtgtcctgaagttcatccccatgcccgtgctgtacggagtttttctgtacatgggcgtgtcttcattgaaggggatccagctatttgatagaattaagttgtttggaatgccagcaaagcaccagcccgatttgatttaccttcgctatgtccctctgtggaaagtgcacattttcactgtgatccagcttacatgtctcgtccttctatgggtgattaaggtgtcagctgccgccgtcgtctttccaatgatggtgctggcgctggtgttcgtgcgtaaattaatggacttgtgttttacgaagagggagctaagctggctggacgatcttatgcctgaatctaagaagaaaaaagaggatgataaaaaaaaaaaggagaaggaggaggccgaacggatgttgcaggatgacgatgatactgttcacctgcctttcgagggcggaagtctgctccaaattcccgttaaggctctgaaatattccgtcgatccatccatagtcaacatcagcgacgaaatggcgaaaaccgcccaatggaaagcgctgtccatgaacacagaaaacgctaaggtcacccgtagcaatatgtcccctgataaacctgtgagcgtcaagatcagctttgaggatgagcctcggaagaaatatgtcgacgccgaaacttctctgtag

SEQ ID NO: 135389 - DNA, 2244 bp, Artificial Sequence
  Description of Artificial Sequence: Synthetic coding sequence
atgcccctgggtaggcagtcgcaccggcatcatagaacccatggtcaaaaacataggcgaaggggcagaggtaagggagcttcacagggcgaggaaggacttgaagcactggcccatgacaccccctctcaacgggtgcagttcatcctgggcaccgaagaggatgaggagcacgttcctcacgaactgttcactgagctggacgaaatctgcatgaaggagggagaagatgccgagtggaaggaaactgctcggtggctgaagttcgaagaagatgtcgaggatggaggagaaaggtggtcaaaaccatacgtggctaccctcagtctgcacagcctgtttgaacttagaagctgcttgatcaatggaacagttctcctggatatgcacgcaaactctatcgaggagatctccgacctaatcctcgaccaacaagaactgtcatccgacctgaacgactccatgcgagtcaaggtaagagaggcgcttttaaaaaagcaccaccatcaaaatgaaaaaaagaggaacaaccttattccaatcgtgagatcattcgctgaagttggaaaaaagcagagcgatcctcacctgatggataagcacggccagaccgtgagtccccagtccgtgccaactactaacctcgaggttaagaacggggtcaactgtgaacatagtccagtggacctgagtaaggtcgacctacattttatgaaaaaaataccaaccggagcagaggcatccaacgtgttggttggagaagttgacattcttgaccggccaatcgtggcattcgtgcggttaagtccagctgtgttgctgtctggactgacggaggtgccaatccccaccaggtttcttttcattctgcttggtccggtgggcaagggccagcagtaccatgaaattggacgttcaatggcaaccatcatgaccgacgaaattttccacgatgtcgcctataaggccaaagagagagatgatttgctcgctggtatcgacgagtttttggatcaagtcactgtgctccctcctggagaatgggatcctagtattagaattgagccccctaagaatgtacccagccaggaaaaacggaagatgcccggtgtcccgaacggcaatgtatgccatatcgagcaagagccacacggtggtcattcaggccctgagttacagagaactggaagactctttgggggattggttctcgatattaagcgtaaagcaccctggtactggtccgactatagagatgctttatccctgcagtgtctcgccagcttcttgttcctttactgcgcctgcatgtcccctgtcatcacgtttggcggactcttaggtgaagccacagagggaagaatcagcgcaatcgagtccctctttggagcatctatgaccgggattgcatacagtctgttcgccggtcaggccctaacaatcctgggttccacggggcccgtcctagtctttgaaaaaatcctgttcaagttttgcaaggattacgccttgtcatacctgagcttgcgcgcatgcatcggcctatggacagccttcctgtgtatagttctggtcgctacagatgcatctagtctggtgtgctatatcacacggtttactgaagaagcttttgctagccttatttgtattatcttcatatacgaagctatagagaaactgattcacctggctgagacttaccccatccacatgcatagccagctggatcatctgtcattgtattattgccgctgcacacttcccgaaaacccaaataatcatactctacaatattggaaggatcataacattgtgacagcagaagtacactgggctaacctgacggtctctgaatgtcaggaaatgcacggtgagttcatgggatcagcctgtgggcatcatggaccctacacccccgacgtcctcttttggtcctgcattctcttctttactaccttcatcctgagttccaccttgaagacctttaagacaagcaggtacttcccaacccgcatggagtcttgtagtgtggcctggctggaatgcggcggcgtgattctcgcacactgcaacttgcgattgctacctagtagttgggattataggcacgcccctcctcagcctgccaacttttgcatctttagtcgtgatggcgtgtcaccgtgttggcccggatggtctcaatctctggatttggtgatatgccttcctagaccacccaaaatgctggggctgcaggcgtag

SEQ ID NO: 135390 - DNA, 3135 bp, Artificial Sequence
  Description of Artificial Sequence: Synthetic coding sequence
atgccagccgcgggtagcaacgagcccgacggggtgctttcataccagcgccccgacgaagaagctgtcgtggaccaggggggcacttctacgatccttaatattcactatgagaaggaagagctcgaggggcatcgcacactgtacgtgggtgtgagaatgcccctggggcgacaatcccacagacatcatagaacccatgggcaaaagcatcgacgccgggggagggggaaaggcgcaagccagggagaggaaggattggaggcgcttgcacatgacacccctagccagcgtgtgcagtttatcctggggactgaagaggacgaggagcatgtccctcacgaactgttcacggagcttgatgagatttgcatgaaggagggcgaggatgccgaatggaaagaaacagcccgctggcttaagttcgaagaagatgtagaagacggaggcgagcgatggtcaaaaccttacgtcgccactctgtcactgcactccctgttcgaattgcgtagttgtctgattaacggtacggtgctcctagacatgcacgcgaatagcattgaggaaattagtgacctgatccttgaccagcaggagctaagctctgatcttaacgactctatgagagttaaggtcagggaagctttgcttaagaagcaccaccaccagaatgaaaagaaaaggaacaacctcattccaatcgttcgatccttcgctgaggtgggtaagaagcagagcgacccgcatctgatggacaaacatggccagaccgtgagtcctcagtctgtgcccaccaccaacctggaggttaaaaatggagtgaattgtgagcactccccagttgacctgagtaaggttgatctgcattttatgaagaagatccccactggtgctgaggcttccaacgtcctcgtgggcgaagtggatatcctggacaggcctatcgtggcttttgtgcgtctgagcccagcggtgctactcagcggattgaccgaggtgcccattccaaccagatttctgttcatcctgctagggcccgtgggaaaaggccaacaataccacgagataggccggtcgatggctactataatgactgacgaaatctttcacgatgtcgcctataaagctaaggaacgggatgacctgctggccgggatagacgagtttttagatcaggttaccgtgctgcccccgggcgaatgggatcccagtatccggatcgagccacccaagaacgtgcccagccaggagaagagaaagatgccaggagtccctaacggtaatgtttgccatatcgaacaggagccccacgggggtcactccgggccagagttgcagaggaccggtcgtctgtttggggggctggtgctggacatcaaacgcaaagctccttggtactggtccgactaccgcgacgccctgtctctccagtgtcttgctagcttcttgttcctttactgtgcctgcatgtcacccgtaatcacattcggcggcctgctgggggaggccaccgaaggccgtatctctgcaatcgaatcccttttcggtgcgtccatgacggggattgcctatagtctgttcgcgggtcaggcattaacaattcttggatcaacaggccctgttctggtgtttgagaaaattctcttcaagttctgtaaagactacgccctgagttacctgagcttgagggcttgtattggactgtggacagcattcctgtgcatcgtattggttgctacggacgcttccagcctggtatgctatatcacgagattcacagaagaggccttcgcttccctcatctgtattatttttatctacgaagctatcgagaagctgattcacctggctgagacctacccaatacacatgcactcccagctggaccacctatcactgtactattgtagatgtacacttcctgaaaatcctaacaaccatacgctccaatattggaaggatcataacatagtgacagccgaggtgcattgggccaacttgacagtgagcgagtgccaggagatgcacggagaattcatgggatctgcttgcggacaccatggcccatatactcccgacgtcctgttctggtcatgtattttatttttcaccacattcatcttgtcatccacactcaaaacattcaagaccagtaggtatttccctacacgtgtccgatctatggtatcagactttgctgtgtttttgacgatctttaccatggttattatcgatttcctgattggcgtcccctcacccaaattacaagtgccttcggtatttaagccaactcgggatgacagggggtggattattaatcctattggtccaaacccttggtggaccgtgatcgccgcaatcatcccagccctcctgtgcaccatcctcatctttatggatcaacagatcactgccgttattatcaatagaaaggaacacaagctgaaaaaaggttgtggctatcacctcgacctgttaatggttgcaattatgctgggtgtgtgttcaatcatgggccttccctggtttgtggctgccaccgtcctcagtattacgcatgtgaactctctcaagctcgagagcgaatgctccgccccaggtgagcagccaaagtttctgggcattcgcgaacagagggttacaggcctgatgatcttcgttctgatgggttgttctgtctttatgaccgctatcctgaaattcattcctatgcccgtgctatacggagtcttcctttacatgggagtgagctctcttcagggcatccagttctttgatcggttaaagctgttcggcatgcctgctaaacatcagcccgacttcatttaccttcggcacgtgccattacgtaaagtgcatctgttcacccttatccaacttacatgtctcgtgctcctgtgggttatcaaagcctcccccgcagccatcgtgtttccaatgatggtgctggcgttagtgttcgtgaggaaggttatggatctgtgtttctcaaagcgagagctcagctggctcgacgatctcatgcccgagtctaaaaagaaaaagttagatgatgccaagaaaaaggccaaagaagaggaggtgatcgtactggctcctaccgtatacctcggcgcaagcaattatcggacctag

SEQ ID NO: 135391 - DNA, 2736 bp, Artificial Sequence
  Description of Artificial Sequence: Synthetic coding sequence
atggaagaactccaggatgactacgaagatatgatggaggagaatctggaacaagaggagtatgaagaccctgacattccagaatcacagatggaggagccagctgctcacgatacagaggccacagccaccgattatcacacaacctcccatccagggactcataaggtgtacgtggaactccaggaactcgtgatggacgagaagaatcaggagctccggtggatggaagccgcgagatgggtccagttggaggaaaatctgggggagaatggggcatggggacgaccccatctctcccacttaactttttggtcactcctggaacttcggcgggtctttacaaagggaaccgtactcttggacctgcaagagactagtctggctggggtggcaaatcaacttctcgaccgttttatcttcgaggaccagatccgaccacaagacagggaagagctgctgcgagcgttgcttctgaagcactcgcacgctggagagctggaggcactgggtggcgttaagcctgcagttttaacgcggtccggagacccctcgcagccactgctgccccagcatagttcgcttgaaacgcaactgttctgtgaacaaggcgacgggggaacggaaggccactccccatcaggtattctcgagaagattccacctgactccgaagcaacactggtcctcgtcggccgtgcagattttcttgagcagcctgtgctaggcttcgtgaggctacaggaagctgccgagttagaagctgtcgagctgcctgttcccatcagatttctcttcgttctactagggcccgaggctcctcatatcgactacactcagcttggaagagccgccgcaaccttaatgtccgagagagtattccgaattgatgcctacatggcccagtctaggggggaactgcttcatagcctggagggttttctggactgctccctcgtattacccccaacagacgccccatcagagcaagctttactgagtctcgtccctgtgcagcgggagctactccggaggcgttatcagagttctccagcgaaacccgactcttcattttataagggcctggatctcaatggagggcccgacgaccccctgcagcagacgggacaattgttcgggggtcttgtgagggacataagacgccgatatccttactatctcagtgacataactgacgctttttcaccccaagtgctcgccgccgtcatcttcatttatttcgctgccctgtctcccgccatcacttttggaggcctgcttggcgaaaaaactcggaaccaaatgggcgtctcggagctgcttatatctacagccgtgcaggggattctatttgccctattgggggcgcaaccactgctggtagttggattctccgggcccctactcgtgttcgaagaggcctttttttcattctgcgaaaccaatggcctcgagtatatcgtgggccgagtgtggattggcttctggctcattttactggtcgtcctcgtcgtggccttcgaaggctcttttctggtgcgcttcataagtcgctatacacaggagattttcagcttcctaatcagcctgattttcatctacgagacgttcagcaagcttatcaagatctttcaggatcacccattgcagaagacttacaactataacgttctcatggtgccgaagccccagggtcccctcccgaacaccgcacttctatccctggtactgatggcaggcaccttctttttcgcaatgatgctaaggaagttcaagaactctagctatttccccggcaagctgagaagggtcattggcgacttcggtgtccccatctctatcctcattatggtcctggtggacttcttcatccaggatacttatacccaaaagctctcggtccctgacggttttaaagtttctaactcttccgctcgagggtgggtgattcatcccctcggactgcgcagtgaattccctatctggatgatgttcgcctcagcattgcctgctctcctggtattcatactgatctttctcgaaagtcagattactactctgatcgtctctaagcccgaacgaaagatggtaaaagggtcggggttccacctcgacttgcttctggttgttgggatggggggtgtcgccgctctgttcgggatgccatggctcagcgcaactaccgttcggtcagtgacacatgcaaacgcgctcactgtgatggggaaggcatcgacacccggcgctgctgcacagattcaggaggttaaagagcagcgtatttccggcttgcttgtggccgtccttgtagggcttagtattttgatggagccaattctgagcagaatccccctggcagttctgttcgggattttcctgtacatgggcgtcacatctctgtccgggatacaactgtttgaccggattctgcttctgtttaagccccccaagtaccaccccgacgtgccctacgtcaagcgggtgaaaacctggagaatgcatttgttcacaggaatccagattatatgcctagctgtgctgtgggttgtgaaatctacgcccgccagcctggcactgccctttgtcttaattttaaccgtcccactgagaagagttctgctgccgctcatcttccgaaacgtggaactgcagtgtctggatgcagacgatgcaaaagctactttcgatgaagaggaaggacgcgacgagtacgacgaggtggcaatgccggtttag

SEQ ID NO: 135392 - DNA, 3480 bp, Artificial Sequence
  Description of Artificial Sequence: Synthetic coding sequence
atgtcttcggccccacggaggccggcaaaaggtgcagactcattctgcacccccggccccgggcgtaaacccagaaggaggccaggtgcttcacccactggggagacccctacgatcgaggaaggagaagaagacgaagacgaggcttcagaggctgagggtgcccgggcccttacacagccaagtccggtcagtacaccgtcttctgtgcagtttttcctccaggaggatgatagtgctgatcgtaaggccgagcggaccagcccaagcagcccagccccgctcccacaccaggaggctactcccagagcaagcaagggagctcaagctggtactcaagtggaagaggccgaagccgaagccgtagcggtagctagcgggacagctgggggcgatgatggtggtgcatccggcagaccattgcctaaggcgcagccgggtcaccgatcctacaatttacaagagagacgccgaatcggcagtatgaccggcgccgaacaggccctgctccccagggtaccaaccgacgagattgaagctcagaccctggcaactgcagatctagacctgatgaaatcccatagatttgaggatgtgccaggcgtgagacgccatctggtccgcaaaaatgccaagggctctacgcagagcgggagagagggacgtgaaccaggcccaaccccaagagcccgaccgagagctcctcacaagcctcacgaggtgtttgtcgagcttaacgagctgctactagacaagaatcaagaaccacagtggagggagactgcccgatggatcaagtttgaagaggacgtggaagaagagactgagagatggggaaagccacatgtggcctccttgtctttccgtagcctccttgagctgcggaggactctcgcacatggagccgtgctgctggacctggaccaacagaccctacctggggtggctcaccaggtggtggagcagatggtcatctcagaccagataaaggctgaagaccgagccaacgtcttaagggccctgctcctgaaacactcccatccttcggatgagaaggacttttccttccctcgcaacatctctgcagggtcccttgggagtctgctgggtcatcaccacggccagggtgctgagtctgatccacacgtgaccgaacctttgatggggggtgtacctgagacgcgattggaggtagaacgggaaagagagctgccacctccagctccccctgccgggataacaaggagcaagtctaagcatgaattaaaacttctggaaaaaattccagagaatgccgaagcgaccgtcgtgctagtgggctgtgtagaattcctgagtagaccaactatggccttcgtaaggctgcgcgaggcagtggagctcgatgccgtcctggaagtgcccgttcctgtgaggtttcttttcttgctcctaggccccagcagtgccaatatggactaccatgagatcggaagatcaatatccacccttatgtcagacaagcaattccacgaagccgcgtatttagccgacgagagagaggacctccttacggccattaacgcattcctggattgttccgtggtgctgccgcctagtgaggtccagggagaggaacttctgcgttcagttgcccattttcaaaggcagatgctgaagaagcgggaagaacagggccgtctcctgccaaccggcgcaggcttggagcccaaatccgctcaggacaaggctctgctgcagatggtggaggccgctggtgctgcggaggacgatcctctgagaaggaccggccgaccttttggtgggcttataagagatgtgagaagacgttacccccattatctctccgacttccgggacgcccttgacccacagtgtctggcagccgttatttttatatactttgctgccctttcacccgctatcaccttcggggggctgttgggagagaagacccaggacctgattggcgtgagcgagctgatcatgtccactgcactgcaaggagtcgttttttgccttttgggcgctcagccattgttggtgatcggcttctctgggcccctcctggtgtttgaggaggctttcttttctttctgttccagcaaccacttagagtaccttgtgggcagggtgtggataggtttctggctggtcttccttgccctgctaatggtggcccttgaggggagctttctggtgcgattcgtatctcgattcacgcaggaaatattcgcgttcctcatcagcttgatcttcatttacgagactttttataaactagtgaagatcttccaagaacatccactgcacggatgttcggcctcgaactcttcagaggtagatgggggggagaacatgacatgggccggagcccggccaactctcggtccagggaatcgctccttggctgggcagtccggccaggggaagcctaggggccaacccaacacagctctcctgtcactcgtgctcatggctggtacgtttttcatcgccttttttctgagaaaattcaaaaatagtcgctttttccccgggagaatcaggcgagtcatcggcgattttggcgtgcccattgctatcctgatcatggtgcttgtagactactctattgaagatacatacactcagaaactgtccgtgccctcggggttttcagtgacagctccagaaaaaaggggttgggtaatcaaccctcttggagagaagtcaccctttcccgtgtggatgatggtcgccagtctactgcctgcaatcctggtgttcatcctcatttttatggagactcagatcactacactgattatttctaaaaaagagcgtatgcttcaaaaaggctcaggttttcacctagatctgcttctcatagtcgccatgggagggatctgtgctctgttcggactcccgtggctggccgcagcaacagtccgaagcgtcacacatgctaatgccctgaccgtcatgagtaaagcggtggcccccggggataagcctaaaattcaggaggtgaaggaacaaagggtcacaggccttttggtcgccctgcttgtggggctcagcattgtaatcggtgatctactgcgccagatcccattggcagtgctctttggcattttcctgtatatgggggtcacaagcctgaatggaatacaattctacgagcgcctgcacctcctgctaatgccacccaaacatcacccggacgtcacctatgtgaaaaaggtccgtacccttagaatgcacttgttcactgcgttacagctgctgtgcctcgctctgctgtgggccgtcatgtccacagccgccagtctcgccttccccttcatcctcattttgactgttcccttaaggatggttgtcctgacaagaatctttactgatcgcgaaatgaagtgcctcgatgctaacgaggccgaacctgtttttgacgagagggaaggagttgacgaatataatgagatgcctatgccagtctag

SEQ ID NO: 135393 - DNA, 3726 bp, Artificial Sequence
  Description of Artificial Sequence: Synthetic coding sequence
atgagctccgccccacggaggcccgccaagggggcagactcgttttgtactcccgagccggaaagcttggggcccggcacccctgggttccctgagcaggaggaagacgagctgcatcggacactaggagttgagagatttgaggagatcctgcaggaggccggctctagggggggggaggaacccgggcggagctatggagaggaggattttgagtatcacaggcagtcctcacaccacatccaccatcccctgagcacccatctgccacctgatgccaggaggagaaagacaccccaaggccctggccggaaacccagacggcggcctggagcttctccaacaggagaaactcctacgatcgaggaaggggaggaagatgaagatgaggcctccgaagcagagggcgctcgagcactgacccaaccctcccccgtgtcaacaccctcatccgtccagtttttcttacaggaagacgactcggccgatagaaaagccgaaagaacgagccctagctccccggctcccctgccacatcaggaggccacacccagagcttcaaagggggcccaggccggcactcaggttgaagaggcagaagctgaagccgttgccgtggccagcggaactgccggtggcgacgacggaggcgcaagcggccgccccctgcctaaggcgcagcctgggcatcgttcctacaatctgcaggaacgcaggcgtattggttcgatgacaggcgccgagcaggccctgctgccgagggtaccaaccgatgagattgaggcccagaccctggccacagctgacctggacctgatgaagtcacaccgcttcgaagatgtgcccggtgtgcggcggcatctggtgagaaagaacgcaaagggatcaacccagtcaggccgggagggacgggagcccggacccacccctagggcccgtcccagagcccctcataaaccacacgaggtatttgtcgagctcaatgagctcctcctggataagaaccaggagccacaatggagagagacagcgcgctggatcaagtttgaagaagacgtggaagaggagacagaaagatggggcaaaccacacgttgcctccctgtcttttcgctcccttttggagctccgacgcacactcgctcacggagccgttcttctcgacctcgatcagcagacgctgccaggggtggcacaccaggtagttgagcagatggttatcagtgaccaaataaaagcggaggacagagccaatgtgctgcgggcactgctgctgaagcacagccacccatccgatgagaaggacttttcctttcccaggaatatatctgccgggagcctgggctctctcctaggacatcatcatggacagggggccgaatctgatccgcatgtgaccgaaccattgatgggcggtgtccccgaaactaggctcgaagtggaacgcgaacgggagctccctcctccagctcctcctgctgggattacccgcagcaagtcaaagcacgaactgaagctccttgaaaagataccagaaaatgcagaagctactgtagtgctcgtgggatgcgttgagtttctcagtcgccctacgatggccttcgtgcgattgagagaagcagttgagcttgacgccgtcctagaggtgccagtgcctgtgaggtttctattcctgcttttgggcccttctagcgcaaatatggactaccatgagattgggagatctatttctacgcttatgagcgataagcagttccatgaagccgcctatctcgccgacgaaagagaggatcttttgacggccatcaacgcctttctcgattgttctgtcgtcctccctccatctgaggtgcaaggcgaggagctcctccggagcgtagcacacttccaaagacaaatgctaaagaagcgggaggagcagggccggctcctacctacgggcgctgggctcgagccaaaatccgcacaggacaaggctttgctccagatggttgaggccgctggcgccgccgaggacgatccactcaggagaaccgggcggcctttcggcggcctaataagagatgtacgacggagatacccccactatctgagcgattttagggacgcacttgacccgcagtgtctggcggccgtcatttttatatacttcgctgctctatctccagctatcactttcggcggcctgctgggggagaagactcaggacctgatcggagtgagtgaactgattatgtcaacagcccttcaaggcgtagtcttttgtctcctcggtgctcagcccttgctcgtcataggcttctctggtcctcttctcgttttcgaggaggcctttttctccttctgcagttctaaccacttagagtacctggtcgggcgggtatggataggattctggcttgtgttccttgcactcttgatggtcgcactggagggcagttttctcgtaagatttgtgagcagattcacccaggaaatttttgcctttctgatctcactgatcttcatttacgagaccttctacaaacttgttaagatattccaggagcaccccctgcatggctgcagtgcatcaaactctagtgaagtagatggcggggagaatatgacctgggccggcgcacgccccacgttggggcccggtaaccgcagtctggccggccagtctggtcaggggaagcctcggggccagcccaatactgcccttcttagcctcgtgctgatggctggtacgttcttcatcgccttttttctccgcaagttcaaaaactctcgctttttcccaggacgtatacgacgggtgatcggcgacttcggggttcctatagcgatcctcatcatggtattggtggactactcaatagaggacacatatacacagaagctgagcgtgccctcgggattctctgtgacagctcccgaaaagagaggctgggtgatcaacccgctgggtgaaaagtctcctttccctgtctggatgatggtggctagcctactcccggctattctggtgtttatcctcatcttcatggaaacacagataaccactctgatcatttcaaaaaaggaacgaatgctacaaaagggctccggatttcaccttgacctgctgctgattgtggccatgggcgggatttgtgcattatttggcttgccatggctggccgcggcaaccgttcgatccgttacgcacgctaatgccctgacagttatgtctaaggccgtcgctcccggtgacaaacctaaaatccaggaggtaaaagagcaacgtgttacaggacttcttgtggccctgctggttgggttgagtattgtgatcggtgatctcctgaggcaaatacccctggctgtactgtttggcattttcctttacatgggcgtgacctcacttaatggcattcagttttatgaaaggcttcaccttttgctcatgcccccaaagcatcacccggatgtgacgtacgttaaaaaggtccggacactccggatgcatcttttcactgctctgcagctcctctgtctcgccctcctctgggctgttatgtcgactgctgcctccctggcctttccttttatactgattctcacagtgcctttacggatggtggttctcacccgaatattcactgatcgcgagatgaagtgtttggatgccaatgaagctgagcccgtattcgacgaaagggagggcgtggacgagtacaatgaaatgcctatgcctgtctag

SEQ ID NO: 135394 - DNA, 456 bp, Artificial Sequence
  Description of Artificial Sequence: Synthetic coding sequence
atgtcctcagcaccgcgccgccccgccaagggcgcggactccttttgtactcctgagcccgagagcctgggcccgggtacccctggattcccagagcaggaggaggacgaacttcaccgtacccttggcgttgagagatttgaagagattctgcaggaggccggctcccggggcggagaagagccaggacgaagctacggtgaagaagactttgagtaccacagacagtcttctcaccatatacatcaccctctcagcacccacctcccccccgatgctagaagacggaagactccacagggccccggaagaaagcccagacggcggcctggagcgtcaccaacaggggaaactcccactatcgaggaaggtgaggaagatgaagatgaagcatcagaggccgaaggcgcacgtgccctcacacagcccagtccggtgtcgacccctagcagctag

SEQ ID NO: 135395 - DNA, 384 bp, Artificial Sequence
  Description of Artificial Sequence: Synthetic coding sequence
atgagctcagcacctcgacgtcctgccaaaggcgccgattctttttgtaccccagagcctgaatcattaggtcctggaacccccggcttcccggagcaagaagaggatgagctgcaccgcacgctgggagtagagcggtttgaggagatcctgcaggaggccggatcacgaggaggtgaggagcctggtaggtcttatggtgaggaggattttgaatatcatagacagtcttcgcaccacatccaccatccactgtcaacgcacctgccacccgacgctcggaggcgcaaaactccgcagggacccgggcgtaagcctaggagaaggcccggagcttcgcctacaggagagacaccaactatagaggagggggaggaggattag

SEQ ID NO: 135396 - DNA, 438 bp, Artificial Sequence
  Description of Artificial Sequence: Synthetic coding sequence
atgtcctcggctcctcggcgtcctgctaaaggagcagatagcttttgcactcccgagccagagagtctcggcccaggcacgcctggattccccgaacaagaggaggatgaattacacaggacactaggcgttgaacggttcgaggaaattctacaggaagctggctctcgaggaggagaggagccggggcggtcttacggggaggaggactttgagtatcaccggcaatcttcacaccacatacatcaccccctctcgacccaccttccacccgacgcccgcagaaggaaaactcctcagggacccggccgtaaacccagacggaggcctggcgctagccccaccggcgagacccccacaattgaagaaggagaagaggatgaggatgaagccagcgaagccgagggagctagagccttgactcagcccagcccgtag

SEQ ID NO: 135397 - DNA, 3726 bp, Artificial Sequence
  Description of Artificial Sequence: Synthetic coding sequence
atgtcctctgcccctaggcgcccagccaaaggtgctgacagcttttgtacccccgagcccgaatccctcggaccgggtaccccgggctttcccgagcaagaggaagatgaactgcacagaaccctcggcgtggagcgtttcgaggagatcttacaagaagctgggagcagggggggcgaggaacccggccggtcctacggagaagaggattttgagtaccaccggcaatctagtcatcacattcatcacccactctcaacacacttaccccccgacgcccgcaggcgcaagacaccacaggggccaggccggaaacctagaaggcgacctggtgcctcgcctacaggggagactcccaccatcgaggagggggaggaagatgaggacgaagcatccgaagccgagggagcacgcgcactgacacagccttctccggtttctacaccatctagcgtgcagtttttcctgcaggaagacgactcagcagaccggaaagccgagaggacatcaccatcttctcctgctcccctccctcatcaggaggcgactcctcgggcgtcaaagggtgcacaggctggaacgcaagtggaggaagccgaggcggaggcagtcgccgtggcatcaggtactgctggaggggacgatggtggagcctctggtcggcccctgccgaaggcccagccagggcatcgcagttataacctccaagaaagacgtcgaattggttcaatgacgggtgcagagcaggctctgctgcctagggttcccacagacgaaattgaggcccagacactcgctaccgctgatctcgacctgatgaagagccacagattcgaagacgttccaggcgtccggcgtcaccttgttagaaagaacgcaaaaggttctacccagagcggacgtgagggacgcgagccgggaccaacacctcgcgcacgccctagagcaccgcataaaccacatgaggtttttgtggagctgaacgagctgctgctcgataagaatcaagagccacagtggcgggagacagcccgctggatcaagttcgaagaagacgttgaagaggagacggaaagatggggcaagccccacgtggcctcactttcattccgaagtcttctggaactaagacggacactggctcacggtgctgtcctgcttgacctggaccagcaaaccctgcccggtgtcgcccaccaagttgtggagcagatggtcatttcagatcagataaaagccgaggatagagcaaatgtgcttcgggcgctattgttgaaacactctcatcctagtgacgaaaaagatttttccttcccacggaatatctccgcagggagccttggttctctgctcggccatcaccacgggcagggggctgaatctgatccccatgtaacagagcccctgatgggcggagtcccggaaaccagactggaggtcgagcgagagagagagcttccgccaccagccccaccggctggtatcacgcgctctaagtcaaaacacgaacttaaattgcttgaaaagatccctgaaaacgctgaggccacagtggtgcttgtcgggtgtgttgaattcctcagccggccaaccatggcattcgtgcgattacgggaagcggtggaactggatgctgtgttggaggtgccagtacccgttagatttctcttcctcctgctgggaccctcatctgctaatatggattatcatgaaataggtaggtccatctctacactgatgtcagataagcagttccacgaggccgcctatttggccgacgaacgagaagacttgctcaccgcaataaatgctttcttggattgctcggttgtgctccctccctcagaggtacaaggtgaagagctgctgcgcagcgtggcgcattttcaaagacagatgttaaagaagcgcgaagagcagggccggctcttaccaacgggtgctggcctggaacccaaatccgcccaggacaaggctctcctgcagatggttgaagctgcaggcgccgctgaagatgaccccctccggagaaccggtcggccgttcggaggcttgatccgcgatgtccggcgtcgttatccacactatctcagtgattttcgcgacgcactggatccacaatgtttagccgcggtgatcttcatatactttgcggcgctgagcccagcaataactttcggcggcttacttggagagaagacacaagatctaattggagtgtctgagctgatcatgtccaccgccctgcagggcgtggtgttctgcttgctgggtgcccagcccctgctcgtgatcggatttagcggtccactgctggtctttgaagaagcgtttttctctttttgcagttctaatcacctggagtatttggttggtagagtttggattggattctggctcgtgtttctagctctgctgatggtcgcactagaaggctcatttctagttcggttcgtgagcaggtttactcaggaaatcttcgccttccttattagtctgattttcatttatgagaccttttataaattggtgaaaattttccaggagcatcccctgcatgggtgttcggcctccaattctagtgaagtggatggcggtgagaatatgacttgggctggggcccgcccaactctgggacccggcaataggtctctggcaggtcagagcggacagggaaaacccaggggacagcctaataccgccctcctcagtcttgtgctgatggctggcacatttttcattgccttctttttacgaaaatttaaaaattccagatttttccccggacggataaggcgggtgatcggtgacttcggagtccctatcgccatactaattatggtcctcgttgactattccattgaggacacatacacccagaagctgagcgtgccatcgggtttctcagtcacagcgcctgagaaacgcggctgggtgataaaccccctcggagagaagagtcccttccccgtgtggatgatggttgccagccttcttcctgcgattctggtctttatcctgatattcatggagacccaaatcaccacactgatcatctcaaagaaggaacgcatgctccagaaaggtagcggattccacctagacctgctgctgatcgtcgcaatgggcggcatttgcgccttattcggactaccgtggctcgccgccgccacagttaggtctgtgacccacgcaaacgctttgactgtcatgtctaaagccgtggcccccggggataagcccaaaattcaagaagttaaagagcagagagtaacaggattgctggtagctctcctcgtgggactgtctatcgtaatcggtgaccttctgagacaaatcccgttagccgtgctcttcggaatctttttgtatatgggagttacctccctgaacggaattcaattttacgaacgccttcacctgcttttgatgccccccaagcaccaccccgatgtcacgtatgttaagaaggtacgaacattaaggatgcatctgtttacagccttacagctgctgtgtctcgccctcttatgggcagtgatgtctacagctgcgagcctggcattcccattcatcctgatattgactgtccccctgaggatggtagttctcacaagaattttcaccgatagagagatgaaatgtctagatgccaacgaggccgagcccgtgtttgacgagcgtgaaggcgtggatgaatacaacgagatgcccatgcccgtctag

SEQ ID NO: 135398 - DNA, 213 bp, Artificial Sequence
  Description of Artificial Sequence: Synthetic coding sequence
atgtccagcgcccccagacggcccgccaaaggcgcagactcattctgcactccagaacctgagtctttaggccctggaactcccgggtttcccgagcaggaagaagacgagctccacagaactctcggggtcgaaagattcgaggaaatcctgcaggaggcagggtccagggggggtgaggagcctgggcggagttatggcgaggaggactag

SEQ ID NO: 135399 - DNA, 510 bp, Artificial Sequence
  Description of Artificial Sequence: Synthetic coding sequence
atgagctctgcaccgcgtaggcccgccaagggagcggattctttttgcacgcctgaacccgagtcgctagggcccgggactcctggcttccctgagcaggaggaggacgagttgcaccgcaccttaggagtggaacgcttcgaggagattttgcaggaagccggttctaggggtggcgaagagcccggacgctcctacggggaagaggacttcgagtaccaccgccagtccagccaccacatccatcaccccttgagtacacatttaccacctgatgccaggcggagaaagactccacagggtccagggcgaaagccacgacgcagacctggagcctcccccaccggtgaaacacccacgattgaggagggtgaggaggacgaggatgaggcttctgaggccgagggagcccgagctctcacccaaccctcgcccgtcagcaccccatcttctgtgcagttcttcctgcaagaggatgatagcgcggaccggaaggccgagcggacttag

SEQ ID NO: 135400 - DNA, 3240 bp, Artificial Sequence
  Description of Artificial Sequence: Synthetic coding sequence
atggaggatgaggcggttctcgaccggggcgcctcattcctcaaacacgtttgtgacgaggaagaagtggagggccatcacacgatatacataggtgttcatgtgcccaagagctataggaggcgccgtagacacaagcggaagaccgggcacaaagagaaaaaggaaaaagagcgaattagtgagaactattccgataaaagcgacatcgagaatgccgatgagagcagctcctccattctgaagcctctaattagcccggctgcagaacggattaggttcatcctcggagaagaggacgactcccctgcaccaccccagctgtttactgagcttgatgagttacttgccgtggacggccaggagatggagtggaaagagactgctagatggattaaatttgaagagaaggttgagcaggggggtgaacgatggtctaagccacacgtggccacactgagcttgcattctctgtttgaactccgtacttgtatggaaaaggggtccataatgctggacagagaggcatcgtcgctgcctcagctcgtggagatgattgtcgatcatcagatcgaaacaggcctcctgaagcctgaactgaaagataaggtcacatacacactgctgaggaaacaccgacaccagacgaagaagtcgaatctgaggagcttagctgatatcggcaaaactgttagttctgcttccagaatgttcactaatccggacaacggctctccggcaatgactcaccggaacctgacctccagctctcttaacgacatttcagacaagccggaaaaggatcagctcaaaaataagttcatgaagaagcttccacgcgacgccgaggcttctaacgtcctggtcggcgaggtggacttcctggatacacccttcatcgcttttgtccgtctgcaacaggccgtgatgctgggcgccctcacagaagtgcctgtgccgacccggtttctgtttatcttgctcgggccgaagggcaaagccaagagctaccacgagatcggaagggccatcgcaacgctgatgtctgatgaggtctttcacgatatagcatacaaagccaaggatcggcatgatcttatcgccgggatcgacgagttcctggatgaggtcatcgtcctgccacccggggagtgggaccccgccatacggatcgaacctcctaaaagcttaccatccagcgataaacgaaaaaatatgtacagcgggggtgaaaatgtacagatgaacggggatacccctcacgatggaggtcacggcggcggcggacacggggattgcgaggagcttcagagaactggcagattctgtggcggactcatcaaggatatcaaacgcaaggcccccttcttcgcatccgacttctatgatgccttaaatatccaagctctcagtgccatcctgttcatctaccttgccacggtgacaaatgccataacatttggcggtctgctgggcgacgcgactgataacatgcagggcgtccttgaaagcttccttggaaccgccgtgtccggagcgatcttttgtctgttcgcgggacaacctctgactatcctgagcagcaccggtcctgtactggtgttcgaacgactcttgttcaacttctccaaggacaacaactttgattatcttgagtttcggttatggataggcttgtggtccgcttttctctgtctgatcctggtcgcaaccgatgccagctttctggtgcaatacttcacaagatttacggaggagggttttagctccctgatctctttcatctttatttacgacgccttcaaaaagatgattaagctggcagattactacccaataaattctaatttcaaggtaggctataacacactgttctcctgcacatgcgtgcccccagaccctgcaaacataagtatcagcaatgacacaacactggcccctgaatacctcccgaccatgagcagtaccgacatgtatcacaataccactttcgactgggcttttttgtccaagaaagaatgttctaaatatggcggtaacctggtgggcaataactgcaatttcgtgcccgacattaccctgatgtcttttattctgtttctgggcacgtacacatcttccatggccttaaagaaatttaagacatcaccctacttccctacaacagcccggaaattgatctctgactttgctataattctttccattttgattttctgtgttatcgacgccctggtgggtgttgatactccaaaactcatagttcctagcgaatttaagcctacatcccccaatagaggatggtttgttcctcctttcggggaaaacccctggtgggtatgcctggctgccgccatcccagctctcctggtgacaatcttgatattcatggaccagcagatcacagcagtgatcgtcaatcgaaaggagcacaaactgaaaaaaggggcagggtaccacctcgatctgttctgggtggccatcctgatggttatctgtagtctgatggccctaccctggtacgtggccgcaaccgtgatttcaatcgctcacattgattctctgaagatggagaccgagacaagcgctcccggagagcagcccaaatttctgggcgttcgagaacagagggtgactggaaccttagtgttcatcttgaccggattgtctgtctttatggcccccatactgaagttcatcccgatgcccgtcctgtacggagtcttcctgtatatgggtgtcgcctccctaaatggtgtccagtttatggatcgcttgaagcttctgctgatgcccctgaagcaccagccagacttcatctatctcaggcacgtgcctttgcggcgggtgcacttgtttacctttctccaagtgctgtgcctggccctattgtggatactaaagtccactgttgcggcgattatatttccggtcatgattctagcccttgtggccgtgcgcaaggggatggactacttgttcagccaacatgatctcagctttctagacgatgtgattcccgaaaaggataagaagaagaaggaggatgagaaaaagaagaaaaagaaaaaagggagcttagacagcgataatgatgatagcgactgcccttactccgaaaaggttccaagcatcaaaatccccatggacatcatggagcagcaaccattcttaagtgattccaagccctccgacagggagcgctctccaacctttctagaacgacacacaagttgctag

SEQ ID NO: 135401 - DNA, 3108 bp, Artificial Sequence
  Description of Artificial Sequence: Synthetic coding sequence
atgagcacggagaatgttgagggcaagcccagcaaccttggtgaaagaggacgcgctcgcagctccacgttcctcagagttgtgcagccaatgttcaatcacagtattttcacctcggcggtatctccagctgcagaaagaataagatttattctcggggaagaggatgactcgcctgcaccacctcagctatttacggagctggatgagttgctggcggtggatggccaggagatggagtggaaagagactgccagatggatcaagtttgaggaaaaagtggaacaagggggggaaagatggagcaaaccccacgtggccaccctctcgctccacagcctttttgagcttcgtacctgcatggagaaaggtagcatcatgttggacagggaagcgagtagtctccctcagctggtggagatgatcgtcgatcatcagatcgagaccggtctgctgaaaccggaactcaaggacaaggtaacatatacccttttgcggaagcataggcatcagactaaaaagtccaatctccgcagcctcgcggacattgggaaaaccgtgtcctccgccagcaggatgtttacaaaccctgacaatggatccccagcgatgacccaccgcaatctgactagcagtagtctaaacgacataagtgacaagccagaaaaggatcagctaaaaaataagttcatgaagaagctgcctcgggatgctgaggcaagcaacgtcctggtaggtgaggtggatttcctcgatacaccatttatcgcattcgttaggttgcaacaggccgtgatgctcggagcattgactgaagtgccggttccaactagattcctattcatcctgttgggccctaagggcaaagcaaaaagctaccatgaaattggcagggcaatcgcgactctgatgtccgacgaggtatttcacgacattgcatacaaggccaaagatcgacatgatcttattgccggaatcgacgaattcctcgacgaagttatcgtcttaccccccggtgaatgggatcccgcaattcgcatcgagcccccgaagagtctgcctagctccgacaaaaggaaaaacatgtactcagggggggaaaatgttcagatgaacggagatacccctcacgacggtggccatggcggaggtgggcacggggactgcgaggagctacagcgaactggcaggttctgcggaggattgatcaaagatatcaagcggaaagctccattttttgcttcagatttctacgacgcccttaatattcaggcactgtcggccatactctttatctatctggccacagtcactaacgctatcactttcgggggattattgggagatgccaccgacaacatgcagggagtactggagagctttctggggaccgccgtttctggggctatcttttgcctgttcgccggccagccactcactatattgagtagcactggtccggtgcttgtgttcgaaagacttttatttaacttcagcaaagataacaactttgactatctggaatttcgtctttggataggtttgtggtctgcttttttgtgcttaatactggtggccacggatgccagctttctagttcagtacttcacccgctttacagaggaagggttttcctcattaatttcatttatattcatttacgacgcctttaaaaagatgattaagctggcggattactacccaatcaattcaaatttcaaggtaggctataacaccctcttttcatgtacatgcgtgccacctgaccctgcgaatatcagtatcagcaatgacacaacccttgcacccgagtacctgcctactatgtcctcgaccgatatgtaccataatacaacattcgattgggctttcttatcaaaaaaagaatgttccaaatatggcggaaacctagtcggtaataattgcaatttcgtccccgatattacactgatgtcattcatcctgttcctggggacatatacttcctcgatggctctgaagaagtttaaaacatcgccctattttcccactactgctagaaaacttatcagcgacttcgccattattctatctattcttatattctgcgtgattgatgccctggtaggtgtcgacacacctaagctgattgtcccatccgaatttaagcctacgtctcccaatcgcgggtggtttgtaccaccattcggtgaaaatccatggtgggtgtgcctagccgccgccatccccgcactcctggttaccattctgatcttcatggatcagcaaataactgctgtcatcgtgaatagaaaagagcacaagctgaagaaaggggcaggctaccacctcgacctgttctgggtggctattttgatggtaatttgcagcctgatggccctgccttggtacgtggccgctactgtgatcagcatagctcacatcgatagcctgaagatggagaccgaaacttctgcccccggtgaacagccgaaattccttggtgtccgggagcaacgggtcaccggtacgctggtgttcatcctcactggtctctcagtgttcatggcgcctattctgaaatttatccctatgccagttctgtacggagtatttctttatatgggggttgccagtctaaacggcgttcagtttatggataggcttaaactcctactgatgcctctgaaacaccagccggacttcatctacctgagacatgtcccgctacgtcgggtgcatctcttcacctttctccaggtgctttgcctggcgctgctctggatcctgaaatcaacagtcgccgccattatttttcctgtgatgatactggctcttgtggcagtgagaaaaggtatggactaccttttttcccagcatgatctgtcctttttagacgatgtgattcctgaaaaagataagaaaaagaaagaggatgaaaaaaaaaagaagaagaagaagggtagcttagattctgataacgacgactccgattgcccatatagcgagaaagtgcctagcattaaaattcctatggacatcatggagcagcagcccttcctgtccgattccaagccatcagaccgggaacgttcacctacttttctcgagaggcacactagctgttag

SEQ ID NO: 135402 - DNA, 2988 bp, Artificial Sequence
  Description of Artificial Sequence: Synthetic coding sequence
atggaggacgaggctgtcttggatcgcggggcctcatttctcaagcatgtttgcgacgaagaggaagttgaggggcatcacactatctacatcggagtgcacgtgcccaaatcctacaggaggcggaggagacacaaaagaaagaccgggcacaaggagaagaaagaaaaggagcggatcagtgaaaattacagcgataaatccgatatcgagaatgccgacgagagctcttcatcaatccttaaaccactgattagtcccgccgccgagcgtatacggtttatactgggcgaagaagatgactcacccgcaccaccgcagctgtttactgagttagacgaacttctcgcagtggatggtcaggagatggagtggaaagagactgcgcggtggatcaaatttgaggaaaaggtcgaacagggtggcgaacgttggtctaagccccacgttgcgacactgagcctgcattctctgttcgagttgcggacctgcatggaaaaaggctccatcatgctggacagagaagcatcctcattgccccagctagttgagatgatcgtagatcatcagatcgagaccggcctgttaaagcctgagctcaaggacaaagtgacatatacactgcttcgcaaacaccggcatcagacaaagaaatcgaacttgcgtagcttagccgatattggtaaaacggtgtcgagcgccagtagaatgttcaccaaccctgataacggctctcccgccatgactcaccggaacctgacgagcagctctctgaatgacatctccgataagccagagaaagaccagttgaagaacaaattcatgaagaaactgcccagggacgcagaggcctccaatgtgcttgtgggggaagttgactttctggatacccccttcattgccttcgtcagattgcaacaggccgtgatgctcggggccttaaccgaagtgcccgttccaacgcggtttctgtttatccttctcgggcccaaagggaaagctaagtcctatcatgaaataggccgggcaattgccactcttatgagcgatgaggtgttccatgacatcgcgtacaaggccaaagacagacacgatttaatcgccggaatagacgagttcctagacgaggtgatcgtcctgcctcctggcgagtgggacccagccatccgcatcgaacctcctaagtccttgccaagcagcgataaaagaaagaatatgtactccgggggcgagaatgtgcagatgaatggtgataccccccatgatggtggtcacggcgggggcggtcacggggactgtgaggagctgcagcgcaccgggcggttctgtggaggcctcataaaggacattaagaggaaggccccattcttcgctagcgacttctacgacgcccttaacatccaagccctgtctgcaatccttttcatttacctggctacagttaccaacgccattaccttcggaggacttttgggtgatgccactgataatatgcaaggagtccttgaatcatttctgggcacagctgtttcgggggcgatattttgcctcttcgccggtcagccgctcacaatattgagctctacagggccggtcttggtgtttgagagattacttttcaacttttctaaagataataattttgattacctcgaattccggctgtggatcggcctgtggtcagctttcttgtgcctgatcctcgtggccacagatgccagctttctagtccagtacttcactcgtttcacagaagagggattttcttcactgatcagtttcatcttcatatatgatgcatttaaaaaaatgattaagttggcagactactatccaattaatagtaactttaaggtcggctataataccctgttctcctgcacatgtgtgccccccgatccagccaacatctctattagcaacgatactacattggctcccgagtacctccctaccatgagttcaaccgatatgtatcacaacaccaccttcgactgggcatttctgtctaagaaggagtgcagcaagtacggaggaaatctcgtcggtaataactgcaatttcgtgccagatattacgttaatgtcgtttattctgtttttgggcacctatacgagctctatggctttgaaaaagttcaagacgagcccttattttccaaccacagctcgaaagctgatctccgactttgccatcattctgtcaattctgattttctgtgtaattgacgccctggtcggggtggatacccccaagttgatagtcccaagtgagttcaaacctacatctcctaacagaggctggtttgtgccaccctttggagaaaacccgtggtgggtatgtctggctgctgccatacccgccctcttggtcaccatactaattttcatggaccaacaaattaccgccgtcatagttaatcgtaaggagcacaaactgaagtttatccctatgcctgtcctgtatggggtgtttttatatatgggcgtggcctcgcttaacggagttcagttcatggaccgcctgaaactgctgctcatgcctctgaagcatcagcctgacttcatttatctacgacatgtgcccctgcgcagggtccatctgttcactttcctccaagttctctgcctggctcttctgtggattctgaaaagtaccgtcgcagccatcatcttccccgtgatgatcttagctttggttgctgttcgcaagggtatggattatctgttctctcaacatgatctgtcatttttggatgacgtcatcccagaaaaagacaaaaaaaaaaaggaagatgagaaaaaaaagaagaagaagaagggttctcttgacagtgataacgatgacagcgattgtccatattccgagaaggtaccctctataaagataccaatggatattatggagcagcagccatttctctctgactccaaacctagtgaccgggagcggagccccacctttctggagcgccacacttcctgctag

SEQ ID NO: 135403 - DNA, 3285 bp, Artificial Sequence
  Description of Artificial Sequence: Synthetic coding sequence
atggaggacgaagcagttctggatcggggcgccagtttcttaaaacacgtgtgtgatgaggaggaagtcgagggtcatcatacgatttacattggcgtacatgtgcctaagagctaccggagacggcgtcggcataaacgaaaaacgggccataaggagaaaaaggagaaggagcgaatttcagaaaactactcagacaaatccgatatagaaaatgcggatgagagcagttccagtattctgaaaccattaatttcaccagctgccgagaggataaggttcatccttggagaggaagatgacagccctgcacccccacagctgtttaccgaacttgacgagttattagcggtcgatgggcaagagatggagtggaaagagacggcacgctggattaaattcgaggaaaaggtggaacagggtggggagcgctggtcaaaaccacatgttgcgactctttctttgcacagtctgttcgagctgaggacctgtatggagaagggtagtattatgctcgatagggaagctagctctctcccgcagctggtcgaaatgatcgttgatcaccaaatcgagactggacttctgaaaccagaattgaaagacaaggtgacttatactttgctgcgaaagcatcgccaccagactaaaaagagcaatctgcggtccctggcagacattggcaagacagttagctccgcctcaaggatgttcacaaatcctgataatgggagtcctgcaatgacccacagaaatctcacgtctagctccctcaacgacatctccgacaagcccgaaaaggatcagctcaagaacaagtttatgaaaaagctccccagagatgctgaagcgtctaacgtgttggtgggtgaggtggactttttagacacccccttcatagcgttcgtgcgcttgcagcaggcggttatgctcggcgctttaaccgaggtaccagtgcctacacgatttctttttatccttctggggccaaaggggaaggcaaagtcttaccatgagatcggaagggctattgcaactctgatgagcgacgaggtgtttcacgacatcgcctacaaggctaaagacagacatgatctgattgctggaattgatgagtttctggatgaggtgatcgtgctgccgcctggcgagtgggatccagccatccggatcgaacccccgaagagcctgccttcatctgacaaaaggaagaatatgtattctggaggcgagaatgtgcaaatgaacggagatactccccacgacggtggtcacggcggaggcgggcacggagattgtgaggagcttcagagaactggtagattctgcggcgggctgatcaaggatataaagcgtaaggcccccttcttcgcgtccgacttctatgatgctctgaatattcaggcgctgtcggctatcctgtttatttatctggccacggtaactaatgctataacattcggagggctgttgggagacgcaacagataatatgcaaggagtgctcgagtccttcctggggaccgccgtgtctggggctatcttctgcctttttgcaggccaaccgctgaccattctgagctctaccggacctgtgctggtcttcgaaaggctgctctttaatttctcaaaggataataactttgattacctcgagtttcgattgtggatcgggttgtggtctgcttttctttgtttaattctcgtagccacagacgcatcctttctcgtacaatactttaccagattcacggaagagggatttagcagcctgatatcgttcatttttatttatgacgctttcaaaaaaatgattaagttggccgactactatccgatcaattcgaattttaaagtcgggtataacaccttattcagttgcacatgtgtgccacccgaccctgccaatattagtatcagtaatgatactactctggcacccgagtatctgccaacaatgagttccaccgacatgtaccataataccacatttgactgggccttcttgtctaagaaagaatgttccaagtatggagggaatctggtggggaataattgcaatttcgtccctgatatcaccctgatgtcattcatcctttttcttggtacatacacctcttccatggccttgaagaagtttaagacctcaccttattttcctactacagctcggaagctgatctccgacttcgctatcatcctgagcatactgattttttgcgtgatcgacgccttggtgggagttgatacacccaagctgattgtccccagtgagtttaaaccgacctccccaaatcggggctggttcgtgcccccatttggagagaatccctggtgggtttgcctggctgcggccattccagctttattagtgacaatcttaatctttatggaccagcagataactgcagtgattgtgaatagaaaagagcacaaactaaagaagggcgcgggatatcacctggaccttttttgggtcgcaatcttaatggtgatatgttccttgatggctctcccttggtatgttgcggccaccgtaatcagcatagcacatatcgacagcctaaaaatggagaccgaaacgtctgcccctggcgagcagcctaagttcctgggtgtcagggaacagcgtgtgaccggcaccctggtgtttattttaacgggtctatccgtattcatggctccaattctgaaattcatacccatgcccgttctgtacggggtttttctgtatatgggcgtggcttctttgaatggcgttcaatttatggatcggttaaagctcctgctgatgccgcttaagcaccagccggatttcatttatctccgacatgtgccactccgacgcgttcatctgtttaccttcctgcaagttctctgcctggcactgctctggatactgaaatcaaccgttgcggctataatcttccctgtaatgatacttgccctggtggctgtgcgaaaaggaatggattatcttttcagccagcatgatttgtcctttctggacgatgtcattcctgaaaaggataagaagaaaaaagaggacgagaaaaaaaagaaaaagaaaaagggctctttagactcggacaacgacgatgagaaagatcaccaacatagtctgaatgcgacacatcacgccgacaaaatccctttcctgcagagcctgggaatgccgtcacctccccgaactcccgttaaagtggttccacaaatccgcatcgaactggagcccgaagacaacgactatttctggcgctctaaaggaaccgaaaccacgctgtag

SEQ ID NO: 135404 - DNA, 3123 bp, Artificial Sequence
  Description of Artificial Sequence: Synthetic coding sequence
atgaaggtgaaggaggagaaggccggcgtggggaaacttgaccacacaaaccaccggcggcgcttccccgatcaaaaagaatgccctcccattcacattggactgccggtgcccacctacccgcagagaaagacagaccagaagggacatctgagtgggctgcagaaggtgcattggggactgaggccagatcagcctcagcaggagttaacaggtccaggaagtggggcctctagccaggacagctctatggacttgatcagccggactaggagccccgccgcagaacagctgcaggatatcttaggggaggaagacgaggctccgaatccaaccctcttcacagagatggatacccttcagcacgatggggaccagatggagtggaaggagtctgccagatggattaagttcgaagaaaaagtggaagagggcggtgagagatggagtaagccgcatgttagcacactttccctgcacagcctctttgaattgcggacgtgtctccagacgggaaccgtgctgctggatctggactctgggagcttgcctcagattattgacgatgtcatcgaaaaacagatagaagatgggcttcttagacccgagctgcgcgaaagagtgagctacgtactgctacgccgccatcgtcatcagactaaaaagccaattcaccgatccctggcggacatcgggaagtcagtgagtaccacaaacagaagccctgctcgctctccaggagcaggtccttctttgcatcatagtacagaggatcttagaatgcggcagtcagccaattatggaagactctgccacgctcagtcacggagcatgaacgatatctctctcacccccaatacagatcagaggaagaacaagttcatgaaaaaaatccctaaggacagcgaagcatcaaatgtcctcgtgggcgaggtagactttctggatcagccctttatcgctttcgttcgcttaattcaatccgctatgttagggggtgtgaccgaggtgccagtgccaaccaggtttctcttcattctgttagggccctcaggacgggcaaagtcctacaacgagattggaagagctattgcgacgctgatggtcgatgatttgttcagcgacgtagcatacaaggctcgcaacagggaggatttaattgctgggatcgatgagttcttagatgaggttattgtcctcccacctggggagtgggacccgaatatcaggatcgaaccaccaaagaaagtgccctccgcggacaaaagaaaatccgttttcagccttgctgaactcggacaaatgaatggatccgtggggggcggcggcggcgcgcctggcgggggtaacggcggggggggtggaggggggtcgggggggggcgctggctccggcggagccggtggtacaagttccggcgatgatggcgaaatgcctgccatgcacgagattggggaggagctcatctggaccggcaggttcttcggcggcctgtgtctcgatatcaaaagaaagctgccttggttcccttccgacttctacgatgggttccatattcagtccatctccgccatcctgttcatctatctgggctgtatcacgaacgcaatcacatttgggggcttgctcggtgatgcaactgacaattatcagggcgtcatggaatctttcctgggtactgcaatggcgggcagcctgttttgtctgttcagtggacagcccctgataattttgtcttctaccggacccattctaatcttcgaaaagctgttatttgatttttctaaaggcaacggcctagactacatggaattccgcctgtggattgggctgcatagcgcagttcagtgtcttatactggtggcaacggacgccagcttcatcattaaatacatcaccaggttcaccgaagagggcttctccacactgatttcgttcatctttatctacgatgcgattaaaaagatgatcggtgcttttaaatattatcctatcaatatggatttcaagcccaacttcattacaacctataaatgcgagtgtgtcgcccctgacacagtgaatacaaccgtgtttaacgctagtgcccctctggctccggatacaaatgcgtcactgtataacttgctcaacctgaccgctctggactggtcgctcctgagtaagaaggagtgtctgtcatacgggggcaggttgttaggtaacagctgtaaatttatccctgaccttgctctgatgagctttatcctcttttttggaacttactccatgacactcactttgaaaaagtttaaattctccagatatttcccaactaaagtgcgcgccctggtcgccgatttttccatcgtcttctccatcttgatgttttgcgggattgatgcctgtttcggccttgaaaccccaaaactgcacgtgccaagcgttataaagcccaccagacctgatagagggtggtttgtggcaccgttcggaaagaacccatggtgggtataccccgcgagcatcttgcccgcactattggtcactatcttgattttcatggaccagcaaattactgctgttatcgtcaatagaaaagagaataagctcaaaaaagcagccggataccacctggatttgttttgggttggcatcctgatggctctatgttccttcatggggctcccatggtacgtcgcagccacagtcatcagtatcgcccatattgacagcctgaaaatggagaccgagaccagcgcccctggggagcagccccagtttttgggagtccgagaacagcgagttaccggaattatcgtttttattctgacggggatctctgtgttccttgctccgatcctaaaaatactcggcctaatcatagtcagaagattgcttgactttattttcagtcagcacgacttggcgtggatcgataatatactacccgaaaaggaaaagaaggaaactgacaagaagcgcaaacggaaaaagggggcgcacgaagactgcgacgaagaaccccagttcccacccccaagtgtcataaagattccaatggagtctgtccaaagcgatcctcagaatggaatacactgtattgccagaaaaagatcgtcctcctggtcatactctctctag

SEQ ID NO: 135405 - DNA, 3414 bp, Artificial Sequence
  Description of Artificial Sequence: Synthetic coding sequence
atgaaggtcaaagaggagaaggcaggcgtcgggaagctcgatcataccaaccaccggagacgctttcccgaccagaaagaatgtccccccatccacattggccttccagttccgacgtacccacaacggaagaccgaccaaaaggggcacctctcgggcctgcagaaagtgcattggggattgagacctgatcagcctcaacaggagctgactggccccggatctggggccagcagccaagatagctccatggacctcatcagccgcactcgcagtcctgctgccgagcagctgcaggacattctgggcgaagaggatgaggcaccaaacccgacactcttcacagagatggataccctgcagcatgatggcgaccagatggagtggaaagagagcgccaggtggattaagttcgaagaaaaagttgaagaagggggtgagcgctggagcaagccccatgtaagcactttatccctgcatagcctgttcgagctaagaacctgcctgcaaaccgggacagtactgctggatctggattcgggctcactcccccagatcattgacgatgttatcgagaagcagatagaagacgggttgctcaggcccgagctgagagaaagggtctcctacgtgctgcttaggcgccatcggcaccagacaaagaagccgatccacagatcgcttgctgatattggaaaaagtgtgtctacaacaaacagatccccggcaagatcaccaggagccggaccgtcgcttcatcattcaacagaggacctgcgtatgcggcagagtgcaaactatggccgcctctgccatgcgcaaagtaggagtatgaacgacatctccctaacccccaacactgaccagaggaagaataaattcatgaagaagatccccaaggacagcgaagcttctaatgtgctggtcggtgaagtagatttcctagaccagcctttcatcgcattcgttagactgatccaaagcgcaatgctggggggcgtgacagaggttcctgtcccaacccgatttctatttattctgctgggccccagcgggagagctaagtcctataacgaaatcgggagagcgatcgcaaccttgatggtagacgatctgttttctgatgtggcgtacaaggcccggaatagagaggatctgatcgccggcatcgacgaattcctcgatgaagtcatagtactgcccccaggagaatgggatcctaatatcaggatcgagcctcccaagaaagtcccctcggctgataagcggaaatctgtattctctctggccgaattgggccagatgaatggatcagtggggggtggcgggggcgcccctggcgggggcaacggcggcggtggaggtggggggagcggtggcggggcaggatctgggggtgcgggagggacctcttctggagatgatggggagatgccagcaatgcatgaaatcggcgaggaactcatctggaccgggcgcttcttcggcggtctctgcctggacatcaaacgaaagctgccttggtttccgtcggatttctacgatgggttccacatacaatcgattagtgccatcctctttatctatttagggtgtatcactaacgcaatcacattcggcggtctcttgggggacgctaccgacaattaccagggcgtaatggagagttttctgggaacagccatggccggttcattgttttgtctcttttctggacagccgctgataatactctcttctacaggaccgatcctcatttttgaaaaactcctctttgacttctctaaaggtaacggattggactatatggagtttaggttgtggatcgggttgcacagtgcagtgcagtgtttgatcttggtggccaccgacgctagtttcatcatcaagtatatcaccagatttaccgaggaaggatttagtacactcatctctttcatctttatctatgatgcaattaagaaaatgatcggcgctttcaagtactaccccataaacatggacttcaagcccaattttataacaacatataaatgtgaatgtgtagcacccgatactgtgaacacgaccgtgtttaatgccagcgcccccctcgcccccgacaccaacgccagtctttataacctcctgaacctgactgcactggactggtcactcctgtctaaaaaagagtgccttagctacggaggaaggctgctcggcaactcctgcaagtttatccccgacttggccttaatgtcattcatcctgtttttcgggacatactctatgactctgacactgaagaaattcaagttcagcagatacttcccgactaaggtgcgtgctctcgtggctgactttagtattgtcttttcaatactgatgttctgcggcattgatgcctgtttcggcctagagaccccaaagctgcatgtcccctctgtgatcaagccaacaagacctgatagaggttggttcgtagctccgtttgggaagaacccctggtgggtgtatcccgctagcatcctgccagcactgctggtgacaatcttgatcttcatggatcaacagatcaccgccgtgattgttaatagaaaggagaataagttgaagaaggccgctggctatcacctggacctcttctgggtggggatcctgatggccttatgctccttcatggggctaccctggtacgtcgcggcgaccgttatcagtattgcgcatattgactctcttaaaatggagactgagaccagcgcgccaggggagcagccacagtttctcggcgtgcgcgaacagcgtgtcaccggaattatcgtgttcatcctcaccggtatctctgttttcctggcgccaatcctgaagtgcatcccattaccggtactgtatggtgtgtttctatacatgggcgtcgcctccctgaacggcatccagatgggtactgggggtagcgagtttaagatccaaaaaaagcttacacccttctgggaacggtgcaaactctttcttatgccagctaagcaccagcccgaccatgctttcctcagacacgttcctctaagacggatccatctttttacactagtgcagattctgtgcctggcagtgctctggatcctgaagagcaccgtggcagcaattatcttccccgttatgatcctgggcctgataattgttcgaagactgctcgacttcattttctcccaacatgatctagcatggatcgataatatcctgccggaaaaagagaaaaaagaaaccgataaaaaacgcaaacgtaagaaaggcgcccacgaggactgcgacgaggaaccacagtttcctcctcccagcgtcataaagattcccatggaatccgtgcagtccgatccccagaacggaattcattgtatagcccgtaaacgaagctcgagctggagttattcattatag

SEQ ID NO: 135406 - DNA, 3060 bp, Artificial Sequence
  Description of Artificial Sequence: Synthetic coding sequence
atgaaggtcaaggaagaaaaagctggggtcggcaagctggatcatactaaccacaggaggagattccctgaccaaaaggggtctcctgcggccgaacagcttcaagatatcctgggcgaagaagatgaagctcctaaccccacactctttacagaaatggacaccctacagcacgatggagatcagatggagtggaaggagagtgctcgctggattaagtttgaggagaaagtggaggaaggtggggaacggtggtccaaaccacacgtctctactttgtccctgcattctctgtttgagttgaggacctgccttcagaccggcacggtactcttggaccttgacagcgggagtcttccccagatcatcgacgatgtgatagaaaaacagatcgaggatgggctgctgcgacccgagctccgggagagggtcagctacgttttgctccgccgacaccggcatcaaactaagaaacccatccatcgctccctggctgacattgggaaatctgttagcactaccaataggagtccggcacgtagtcccggggcaggtccatccttacaccattctactgaagatttaagaatgcggcagagcgccaattatggtcgactctgtcatgctcaatcccgatcaatgaacgacattagtctaacccctaacactgatcagaggaaaaacaagttcatgaagaagatcccaaaggattctgaggcctccaatgtgttggtcggcgaagtcgattttctagaccagccttttatagcgtttgttaggctgattcagtcagccatgttgggtggcgttacggaggtaccagtgccaacacggttcctgttcatcctcctgggcccctccggccgcgccaaatcatacaacgagatagggagagctatcgcaactctgatggtggacgacctttttagcgacgttgcctataaggctcgtaacagagaggatttaatcgctggcattgacgagttcctggatgaggtcattgttctgccaccaggcgagtgggacccaaatatccgtatcgagcctcccaaaaaggtgccctccgcagataaaaggaaatccgtctttagcctcgccgagttaggccagatgaacggtagcgtgggcggaggcggcggcgcacccggggggggtaacggagggggcggaggcggaggcagtggaggaggcgccgggagcggcggagcggggggaacctctagtggcgacgacggcgagatgcccgcaatgcacgagattggggaggaacttatttggacaggcagatttttcggcggactgtgcctcgacatcaaaagaaagttgccgtggtttcctagtgacttctatgacggctttcacattcagagcattagcgctatactttttatttaccttgggtgcataaccaatgctatcacgttcggcggcctgctaggcgatgctacagataactaccagggggtaatggaaagctttcttggaactgcaatggctggaagccttttctgcttgtttagtggacagccattaatcatactcagtagtacgggacctattcttatcttcgaaaagctgttattcgacttctctaagggcaacgggttggattatatggagtttcggctgtggattgggctgcacagtgccgttcagtgtctgatcctggttgctacagacgctagtttcattattaaatatattactagatttactgaagaggggttcagtaccttgatttcgttcatttttatctatgatgccatcaaaaaaatgattggtgccttcaagtactacccaattaacatggatttcaaaccaaacttcatcacaacatacaagtgtgagtgcgtcgctcccgacacagtcaataccaccgtttttaatgcatcagctccactggcacctgacacgaacgcctccctgtacaatctgttaaatctgaccgcacttgattggtccctgctgtccaagaaagagtgcctatcctatggtggaaggcttttaggcaattcctgcaaattcattcccgaccttgctctgatgagctttattctgttctttggcacctactcaatgaccctgactctcaagaaatttaagttctcacggtacttccctaccaaaccaactagacccgaccgcggttggtttgtggccccttttggcaaaaacccctggtgggtttaccccgcttcaatcctaccagcacttttggtgacaatccttatctttatggaccagcagattaccgccgtgatagttaaccgcaaagagaacaaactgaagaaagccgccggctatcacctggatttattctgggtaggaatactgatggctctgtgctcattcatgggcctgccttggtatgtcgctgccactgttatctcaatagcccacattgactccttaaagatggagaccgagacgtctgctccgggcgagcaacctcagttcctcggcgttcgagaacaacgcgtgaccgggataatcgtgttcattcttaccggcattagtgtctttctcgcgccgatccttaagtgcattcccctgcctgtgttatatggggtattcctgtacatgggggtcgcatctctcaatgggattcagttctgggaaagatgtaagttgtttctcatgcctgcgaagcaccagcccgatcatgcgttcctccgccatgtccccttgaggcgcatccaccttttcactctagtgcagattctttgtttggcagtgctctggatcttaaagagtacagttgcagcaattatctttccagtaatgattctagggctgatcattgtgagacgcctactggatttcatattctctcagcatgacctggcctggatcgacaatatcttgccggaaaaagagaagaaggagacggacaagaaaaggaagcggaagaagggagcccatgaagactgcgacgaggagccccagtttccgcctccttcagtgattaaaatccctatggagtcggtccagagtgacccacagaatggaatacattgcatcgcccggaaacgctcatccagctggagctacagcttgtag

SEQ ID NO: 135407 - DNA, 3060 bp, Artificial Sequence
  Description of Artificial Sequence: Synthetic coding sequence
atgaaggtcaaggaagaaaaggccggagttggcaagcttgaccatacaaatcatcggagaagattccccgaccagaagggtagccccgctgcagagcagttgcaggacattctgggggaagaggacgaggcccctaatcccactctgttcaccgaaatggatacactgcaacacgacggcgatcaaatggagtggaaagaaagcgcgcggtggatcaaattcgaggagaaggtcgaagagggtggcgagcgatggtcaaaaccacacgtcagtacgctctcgctccattctctgtttgagctgcgtacctgcttacagaccggcaccgtccttctggatctggattccgggagtctcccacagatcatcgacgatgtaattgaaaagcagatcgaggacgggctgctgagaccagaactgcgggaaagggtgtcctacgttctgctgcgcagacataggcatcaaacaaaaaagcctatccacagatcattagcagacataggaaaaagtgtcagtacaaccaataggtcacctgcccgttccccaggagctgggccttccctgcatcacagcaccgaagacctccgcatgagacagagcgctaattatggccgcttatgccacgctcagtcccgctcaatgaatgacatctcactcactccaaacaccgatcaacgtaaaaataagtttatgaagaaaatccccaaggactccgaagctagtaatgtgctggtcggagaagtggacttccttgaccaaccctttatcgcttttgtgcggcttattcaatcagccatgctgggtggagtgaccgaagtgccagtgcctacccgtttcctattcatactgctcggccctagcggccgtgctaagtcctacaacgagattggccgggcaatcgcaaccttgatggtcgatgatttattctccgatgtcgcgtataaggctaggaatagggaggatctgatcgctggtatcgacgagtttcttgacgaggtgattgtccttccacccggcgagtgggatcctaatattaggatcgagcctccgaaaaaggttccatccgcagacaaacgcaaaagtgtgtttagcctagcagagttaggccagatgaatggctccgtgggcggcggcggcggtgcccccggcggcggcaacggcggcggcggcggcggggggagcggtggcggggcgggttccggcggcgctgggggtactagctcaggcgacgacggagaaatgccagctatgcacgagatcggggaggagctgatctggaccggccgcttcttcggtggactttgcctggacatcaaacgcaagctgccctggttcccatcagacttttacgatggctttcatattcagtccattagcgctattttgtttatttatctgggatgtattaccaacgccatcaccttcggcggactcctcggggacgccactgacaattaccaaggagttatggaaagttttctagggaccgcaatggcaggatccctcttttgtctcttcagcgggcagccacttattatcctttcctccaccggccccatcttaattttcgagaagctgctgttcgatttttcaaagggcaatggactggactacatggagtttcgactctggatagggctgcattccgcggtgcagtgcctcatcctggtcgctactgatgcatcctttattattaagtacatcacacgatttaccgaggaaggattctctaccctcatttccttcatctttatctacgacgctattaagaagatgattggcgcgttcaaatattatccaattaacatggacttcaaaccgaattttatcaccacctataagtgtgaatgcgtggccccagatactgtcaacacaactgtgtttaatgcttctgcgccactggcgccagacacgaacgcctccctttataacctcctgaacctgacggcccttgattggagtttgctctccaagaaggagtgcttgtcctatgggggccggcttctcgggaatagttgcaagttcatcccagatctggctttgatgagctttattctgtttttcggcacatacagtatgacactgaccctgaaaaaatttaagtttagcaggtactttcctactaagcctaccaggcctgacagagggtggtttgtcgccccctttggaaaaaatccgtggtgggtttatcctgcatcaatcttgccagcactgttggtaacaattctcattttcatggatcaacaaatcaccgccgtaattgtgaatcgcaaagaaaacaagctgaaaaaggccgccggctaccatctggatctgttctgggtcggcatactcatggctttgtgctcttttatggggctcccatggtacgtggcggctaccgttataagtatcgcacacatcgatagcttaaaaatggagaccgagacttcagcacccggcgaacagccccagttcctgggcgtgagagaacagcgggtgacaggcattatcgtctttatcctcactggcatctctgtgttcctggccccaatcctgaaatgcattcctctgcctgttctttacggagtttttctgtacatgggggtggcgtccctgaatggaattcagttctgggaaaggtgtaagctttttctgatgccagctaaacaccaacctgaccatgcctttctacgccacgtccccctgagaaggatacacctcttcacactcgtgcagatcctctgtctcgccgtgctctggatcctcaagtcgactgtggcagctattatcttccccgtcatgatcctgggactgataatcgttagacgcctgcttgattttatattcagccagcatgatttggcctggatcgataacattttgcccgagaaggagaagaaggagactgacaaaaagcggaagaggaaaaaaggagctcatgaggactgcgacgaagaaccacaattccccccgccatcagttatcaagatcccaatggagagtgtgcaatctgacccgcaaaatggcatacactgtattgctcgaaaaaggagctcttcctggtcctattctttatag

SEQ ID NO: 135408 - DNA, 3123 bp, Artificial Sequence
  Description of Artificial Sequence: Synthetic coding sequence
atgaaggtgaaagaggagaaggccggggtgggaaaactagaccacaccaaccaccggcgcaggttccctgaccagaaggagtgccctcctatccacattggactgcccgtgccgacatatccacagcgcaagaccgaccagaagggtcacctttcgggcctccagaaggtccactggggtctcagacccgaccagccccagcaggaacttaccggacctggttctggcgcctcctcacaggactcaagcatggacctgatatccaggacccgttctccagctgccgaacagctacaagacatcttgggagaagaggacgaagcacctaacccaacgctattcacagaaatggataccctacagcacgacggcgaccagatggaatggaaagagtcagcacggtggataaagtttgaagagaaagtcgaagagggtggtgaaagatggtctaaaccacatgtgagcactctgagtctacacagcctattcgagcttcgcacatgcctgcagacaggtactgttctgctcgatctggattccggttctcttcctcagattatagatgacgtaatcgagaaacagatcgaggatggcctcctgaggcctgagctccgcgagcgagtgtcctacgttttgttaagacggcatcggcaccaaactaagaagccaatccatagaagtctggccgatattggaaagtctgtgagcactactaaccggtctcctgccaggtcccccggggccgggccaagtctccaccatagtacggaagacctgagaatgaggcaatcagccaactacggcaggctctgtcatgcacaaagccgttcaatgaacgatatatcgctcacacccaatacagaccagcggaaaaataaattcatgaagaaaattcctaaggactccgaggcttctaacgtgttggtcggtgaggttgacttcctggatcaacctttcatcgcgtttgtgaggctgattcagtctgctatgcttggaggtgtaactgaggtccctgtgccaacaaggttcttattcatcctcctaggccctagtggccgagcaaagtcttataatgaaatcggccgcgctatagccacactgatggttgacgacctctttagcgacgtcgcctataaggcccggaatcgagaggatttaattgcaggtatagatgagttcctggacgaggtaattgtgctgccccctggcgagtgggaccccaatataaggattgagccgcccaagaaggtgccttcagccgacaaacgcaaaagcgtgttcagcctggcagaattgggtcaaatgaacgggtccgtgggaggaggcgggggcgccccagggggaggcaatgggggtggtggcggcggcggaagcggaggcggtgcaggttcaggaggagcaggaggaacctcctcgggcgacgacggcgaaatgccagccatgcatgaaattggtgaggagctaatctggacgggcaggtttttcggtggactttgtctggatatcaagcggaaactgccgtggtttccatccgacttctatgatggcttccacatacaaagcatctctgctattttgttcatttatctgggctgcatcacaaatgctatcacatttggggggctgctcggagacgcgacagataattaccagggcgttatggaatccttcttgggtaccgccatggctggctctctgttctgcctcttctcagggcagccgttaatcatcctgagcagcaccggccccattctgatttttgagaagctgctcttcgattttagcaagggcaacggcctggattatatggaattccgactctggatcggactgcatagtgcagtccagtgtctcattctggtggctacagatgcttcgtttattattaaatacattacccgattcactgaagaaggatttagcacgctcatctcattcatctttatttatgacgccataaagaagatgataggtgcctttaagtactaccctatcaacatggacttcaaacctaattttattacaacgtacaaatgtgagtgcgtagcacctgacactgttaacaccactgtcttcaatgcttccgcgccgctcgcacccgataccaacgcgtcactgtataacctccttaacctcactgccctggactggtcgctgctgagcaaaaaagaatgtctgtcttacggggggcggctgctggggaactcctgtaaatttattccagatctcgcactcatgtccttcatacttttttttggtacttactctatgacactgactcttaaaaagtttaaattcagccgatactttcctaccaaggtgcgggctctggtggccgacttctctattgtgttttctattttaatgttctgtggaatcgacgcctgttttggtttagagactccgaagctgcacgttccttcagtgatcaagcctacgagacccgacagaggatggttcgtcgctccatttggtaaaaacccttggtgggtgtatcctgcatccattctcccagcactgctcgtgactattctgattttcatggaccagcagatcactgctgttattgtgaaccgcaaggaaaacaagttgaagaaagcagccggctaccatttggacctcttttgggtggggattctaatggctctgtgctccttcatggggctgccttggtacgttgctgccaccgtaattagcattgcccacatcgattccctaaaaatggagacagagacttccgccccaggggagcagccacagtttctgggagtgcgagaacagcgagtgaccggaattattgtgtttatcctgaccggtatatccgtatttctggcaccaattttaaagatcctggggctgatcattgtaagacgtctgctagatttcatattcagtcaacatgatttagcctggattgataatatcctgcccgagaaggaaaagaaagaaactgataagaagcgcaagcgcaagaagggagcccacgaagactgcgacgaggagccgcagttcccccctccatctgtcatcaaaatccccatggagtccgttcaaagcgacccacagaacggcatccactgcatcgctagaaaaagaagtagctcttggtcatactcactctag

SEQ ID NO: 135409 - DNA, 3414 bp, Artificial Sequence
  Description of Artificial Sequence: Synthetic coding sequence
atgaaagtgaaggaggaaaaggcgggcgtcggcaagcttgaccatactaaccatagaaggaggttccccgatcaaaaggaatgcccaccgatacacataggcctccctgttccgacctacccgcagagaaagacggaccaaaaggggcatctgagcggactgcaaaaggtccattggggtttgaggccagaccaaccccagcaggagttgaccggaccgggatcgggcgctagttcccaggattcgtccatggatcttatcagtcgcacaaggtcacccgctgccgagcagctgcaggacattctcggagaggaggacgaagcccctaacccaaccctgtttacagaaatggacactctgcagcacgacggggaccagatggaatggaaggagtcggctagatggattaagtttgaggagaaggttgaggagggcggtgagaggtggagcaaaccacacgtcagtaccctgagtctgcactcactctttgaacttaggacctgcttgcagaccgggaccgtcctgctagacctggatagcggttcccttccccagataattgacgatgtcatagagaagcagatcgaggacggcctgttacgacctgaacttcgagagcgggtcagttatgtgctgctgagacgtcacagacaccagacaaaaaaacccatccaccgtagcctggctgacatcggcaagtcggtgtccaccaccaatcgctcccccgcgcgcagcccaggagccggcccaagcttgcaccactccacggaagacttgaggatgcgtcagtcagcaaactacggtcgactgtgtcacgctcagtctagaagcatgaatgatataagcctgactcccaacacagatcagaggaaaaataagtttatgaagaagattccaaaggacagtgaggccagcaatgttttggtcggagaagtggacttcctggaccagcccttcatcgcattcgtccgccttattcagtccgcaatgctcggtggcgtaactgaggtcccagtgccaacccggttcctgtttatactcctgggcccaagcggacgggcaaagtcgtacaatgagataggacgcgccatcgccacactgatggtggacgatctctttagcgatgttgcatacaaggcaaggaacagagaggacctcatcgcaggcatcgacgagttccttgatgaggtaatagtccttccccctggcgagtgggacccaaatattagaatcgagcctccaaagaaggtaccctccgcagataagaggaagagcgtgttctcattagccgagcttgggcaaatgaatggcagcgtgggaggcggtgggggggccccaggcggcgggaacggtgggggagggggaggaggtagcggcggaggtgctggctctgggggggccgggggaacgagcagtggggacgacggagagatgcctgctatgcacgaaatcggggaagaactaatctggaccggcaggttctttggcgggttgtgcctggacattaaacggaaactgccatggttcccttccgacttctacgatggtttccacatccagagtatcagtgcgatcctgttcatctacttgggctgtataaccaatgctatcaccttcggcggcttgcttggcgacgcgacagacaactatcagggagtaatggagagctttctcggtacagctatggcaggcagtctgttctgtctttttagtggacagcctctcataatcctgtcgagcacaggcccaatactgatcttcgaaaagctgctcttcgatttctccaagggcaacggtctggattatatggagtttaggctgtggattgggctccacagcgctgttcagtgtctgatcttagtggcgactgacgcttcatttattatcaagtacattacacgatttaccgaggaaggattcagcacccttattagctttatatttatatatgatgcgattaaaaaaatgataggtgccttcaagtattaccctatcaatatggatttcaaacccaatttcatcactacctacaagtgtgaatgcgtcgccccagatacagtgaatactacggttttcaatgcaagcgcgccacttgcccctgataccaatgcctccctctacaatttgcttaatctgacagccttggattggtcactcctatcaaagaaagaatgtttatcgtacggtgggcgactcctggggaactcctgtaagtttatcccagatctggccctgatgagtttcatactgtttttcgggacctatagcatgacacttacccttaagaagtttaaattctcaaggtattttccgactaaggtccgtgccttagtggccgactttagtatcgtgttttccatcctcatgttctgcggtatcgatgcttgttttggattggaaacacctaagctccacgtgcccagcgtgataaaacctacccgcccagacagaggctggttcgtcgcgccattcgggaagaacccttggtgggtatatccagccagcatactcccagccctgctagtaacaatacttatattcatggaccagcagatcaccgcagttatcgttaaccggaaggaaaataagttgaaaaaagctgcaggctatcatctggatctcttttgggttggtatactgatggccttgtgcagttttatggggctgccttggtatgtcgccgccaccgtaatcagtattgctcatatcgattctctgaaaatggagacggagacgagtgcacccggtgagcagccacagtttttaggcgtccgggaacaacgtgtgacagggatcatagtttttatactgacgggcataagcgtgttcctggcacccattttgaagtgcatccccttgccggttctttacggtgtctttctgtacatgggagtggcttcgttgaacgggattcagatgggcacaggaggctccgaattcaagatccagaagaaactaacaccattttgggagcgatgcaaactctttctaatgcccgctaagcaccagccggaccacgcgtttctgaggcatgtgccattgcgccgtattcacctgtttaccctggtgcagattctgtgtctggccgtgctgtggattctcaagagcaccgtcgccgccataatctttccagtcatgattctggggcttatcattgtccgccggctcttggacttcatcttcagccagcacgacttggcttggatcgataacatcctgccagagaaagagaagaaggagacagataaaaaacggaaaagaaagaagggtgctcacgaagactgcgacgaggagcctcagtttccccccccatctgtgatcaagatccctatggaaagcgtgcagtccgatccacagaatggaatccactgtattgcgaggaagcgtagcagcagttggtcttatagcctgtag

SEQ ID NO: 135410 - DNA, 3366 bp, Artificial Sequence
  Description of Artificial Sequence: Synthetic coding sequence
atgaaggtgaaagaggagaaagctggagtggggaaactggaccacaccaatcatagacggaggttcccagaccaaaaagaatgcccgcctattcatatcggtctccccgtgcccacctatccacagaggaaaactgatcagaagggacatctgtccggcctgcagaaagtgcattggggcctccggcctgatcagcctcaacaggaactgacggggcccggtagtggggctagtagtcaagacagctccatggacctcatcagtaggaccagatctcctgcggccgagcagttgcaggatatcctgggcgaagaagacgaagcccctaatccaactctgttcactgaaatggacaccctacagcatgacggcgaccagatggaatggaaggagagcgcccggtggattaagttcgaggaaaaggtggaagaggggggcgaaagatggtccaagccccacgtgagcacactgagtctgcattcactgttcgagttgagaacttgtctccagacaggaaccgtcctgctggatctcgatagtggcagcctgccacagattatcgatgacgttatcgagaagcagatcgaggatggtttattacgcccagaactgagggaacgtgtatcttacgtgctgcttaggagacataggcatcagaccaagaaacctatccaccggagcctggccgacattgggaaatctgtttcaaccacgaaccgcagcccagccagaagcccaggtgcgggccccagcctccaccacagtaccgaggatcttagaatgcgccagtcagcaaactatggtcgtctttgtcacgcccagtcacgaagcatgaatgacatctctctgactcccaacacagatcaacggaagaacaagttcatgaagaaaatccctaaggactctgaggcatccaatgttctggtcggggaggtggactttctggatcaaccgtttatcgcatttgttcgactaattcagtccgccatgttggggggcgtcaccgaagtgcctgtgccaacccgattcttgttcatcctcctgggaccgagtggtcgggcaaagagctacaacgagataggaagggccattgctacacttatggtcgatgacctcttctctgacgtggcatataaggctaggaatcgggaggatctcattgcaggaatcgatgagtttctggatgaggtgatcgtgctgccaccaggagaatgggatccaaacatcaggattgagccacccaaaaaggtcccctctgcagacaagcggaagtcagtgttcagcctggctgaactcggacaaatgaacggatccgttggcggtgggggtggcgctccgggcggaggcaatggtggaggtgggggtgggggctccggtgggggggctggatcgggaggggccggcggaactagtagtggggatgacggagagatgcctgccatgcacgagatcggagaggaactcatctggactggacgcttttttggtggtctgtgtttggacataaagcggaagctcccttggttcccaagtgacttttatgacggattccacatccagtcgatttctgccatccttttcatttacctgggatgcataaccaacgcaatcacctttggaggtcttctgggggatgccactgataactatcaaggagtaatggagtcctttctggggacagcaatggccggaagcctcttttgtctgttcagtggtcagcctcttatcattctatcctcgactggtccgatcctcatatttgaaaagctgttgtttgattttagtaaggggaatggccttgattacatggagttcagactctggattggactgcattctgcagtgcagtgcctgattctggtggctactgacgcatcctttattatcaagtacatcaccagattcacggaagagggtttcagtactctgataagcttcatcttcatttacgatgctataaagaagatgattggagcctttaagtactacccaattaacatggattttaaacccaacttcataacaacttataagtgcgaatgcgtggccccggatactgtaaacaccacagtgttcaacgcaagcgcaccactggcaccagacactaatgctagcctctacaacctcctgaacttgacggcattggactggtcactgctcagtaagaaggaatgtctctcgtatggtggtagactgctgggcaactcttgtaaatttattcctgatctagccttgatgagttttatcctcttcttcggcacgtacagcatgaccctcaccctcaaaaagttcaaatttagccgctacttcccgaccaaggtgcgcgctctcgtcgccgatttctccattgtcttttccattcttatgttttgcggtatagatgcttgcttcggattggagacaccgaaactgcacgtcccgagcgtaattaagcctactagacctgaccgagggtggttcgtagctccctttggcaagaatccttggtgggtctacccagccagcatcctgcctgcgttgctggtaaccatcctcatttttatggatcagcagatcacggccgtaatcgtaaatcgaaaggaaaacaagctgaagaaagccgcagggtaccatttggacttattctgggtggggattttgatggccctgtgttctttcatgggcctgccttggtacgtggctgccacagtcatatctatcgctcacatagattccctgaagatggagaccgaaacatcagcccctggcgaacagccccaatttctgggtgtgagggagcagcgagtcaccggcatcatcgtcttcattctgaccggcatttctgtgtttctggcccccattctcaagtgtatacccctaccagttctatatggagtcttcctgtacatgggtgtcgcatctcttaacggtattcagttttgggagcgctgtaagttgtttctaatgcccgctaaacaccaacccgatcatgcttttctgcgtcacgtgccactgagacggatccatctgtttacactcgttcagattctgtgcctcgccgtgctgtggatccttaaatctaccgtcgccgctattatcttcccagtgatgatcttaggtttaatcatcgttaggaggctattggattttattttctcgcagcatgatctggcctggattgacaatatcctcccggagaaggagaagaaggagaccgataaaaaacgtaaacggaagaaaggggcacacgaagactgtgacgaggagccccagttccctccaccctcagtgattaagatccctatggagtccgtacagagcgatcctcaaaacggaattcattgcatagccaggaagaggtcatcgtcttggagctattctctgtag

SEQ ID NO: 135411 - DNA, 2982 bp, Artificial Sequence
  Description of Artificial Sequence: Synthetic coding sequence
atgaaagtcaaggaggaaaaggccggcgtcggcaagctcgatcacacaaaccatcgcagacggttcccagaccagaaagagtgtcctcccatccacattggactgcctgtgcccacatacccccaaagaaaaacagatcagaagggtcacctgtctggtctgcaaaaagtgcactggggactgcggcctgatcagcctcagcaggagctgactgggccaggtagcggcgcctcaagccaggacagctctatggacctgatctctagaactcggagcccagctgctgaacagctccaagatattttaggagaggaagatgaagcccccaaccccacactgttcaccgaaatggatacattacaacacgacggagaccaaatggagtggaaggaatccgccagatggatcaagttcgaggagaaagtcgaagagggaggagaacgatggtcaaaaccacacgttagcactctctccctccacagcctttttgagctacggacctgtttacagaccggcactgtgctccttgatctggactccggtagcttgccacagattatcgacgacgtcatcgaaaaacagattgaggacggtctgcttaggcctgagttaagggagcgcgttagctacgttttgctgcggcggcatagacaccaaacaaagaaaccgatacacagaagcctcgctgacattggcaagtcggtctccacaacgaatcgatctcccgcccgaagtccgggggctgggccatctcttcaccattccacagaagacctgagaatgagacagtccgcaaactatgggcgactctgccacgcgcagagcagaagtatgaatgatattagcctgaccccaaataccgaccagaggaaaaacaagttcatgaagaaaatccccaaggactccgaggccagcaacgttctcgtgggagaagttgatttcctggaccagcctttcatcgccttcgtgcgactcattcagagcgccatgctgggcggcgtaactgaggtaccagtacctactcgattcctcttcatcctgctgggcccctctggcagagcaaagtcctataacgagatcggtagagcaattgcaacactcatggtcgatgatctgttcagtgacgttgcatacaaagccaggaatcgcgaggatttgatcgccgggatcgacgagtttctggatgaggttattgttctgcccccaggcgaatgggatccgaatattagaattgaacctcccaaaaaagtaccaagcgccgataagcgaaagagcgtgttctccctggcggaacttggccagatgaacggaagcgttggcggcggcgggggcgcccccggtgggggcaatggcggaggcggcggcggaggtagtggcggaggcgcgggcagtggaggggccggaggcacgtcgtccggagacgacggagaaatgccagctatgcacgaaattggcgaggaacttatatggacggggcggttttttggcggtctgtgtctggatataaagcgtaaactgccttggtttccttcagatttctatgatggatttcacatacagagcatatccgcaatactgttcatttaccttggttgtatcaccaacgcaataacctttggggggctcctgggcgatgccaccgataattaccagggcgtgatggaatccttcctgggaactgccatggccggctccttgttttgtctgttctctgggcagcctctgattatcctgtcatccactggccctatactgatcttcgaaaagctgctctttgacttctcaaaaggaaacggcctggactacatggagtttaggctgtggattggtctgcactcagccgttcagtgcctgattttagttgccacggacgcaagcttcatcatcaagtacattacaaggttcacagaggaaggattttccactctcatatcctttatttttatttacgatgcaatcaaaaagatgataggagcatttaagtattaccccattaacatggacttcaagcccaatttcattaccacctacaaatgtgaatgcgtggccccagatacagtgaacactactgtgtttaatgcctccgccccgttggccccagacactaacgccagtctttataatctcctgaacctgacggcactggactggtccttgctgtccaagaaagaatgtctgagttacggaggccgcctcctcggcaattcatgtaaattcattcccgaccttgccctcatgtccttcatcttgttcttcggcacttattcaatgactctcaccctgaaaaaatttaagttctctaggtacttcccaacaaaagttcgggccctggttgccgacttttccatagttttcagtatccttatgttttgtggaatcgatgcatgctttggcctcgagacacctaagctgcacgtaccttccgtcataaagccaacccgccccgaccgagggtggtttgttgccccttttggaaagaacccttggtgggtgtaccccgcgtctattctgccagcgctgctggttaccattttaatctttatggatcaacaaatcacagccgttatcgtaaatcgtaaagagaataaactgaagggcactgaatctaatagacaccaccggctgcatcccgacggaaacttgtgcctgcctggaagccacccgaaagtgtatccaccagcaggcgcggttcgtagtttacctctccacggacgagggctgccagagtggcatccagtcttggggaccctgcaggcactgcctgatgcctcccaggcccccgccggaccgtgcctgcctgccgcccgggctgccgccccagatcctccccttcacccaggtgccgaccccctcccaggcggcgcgcttgatccccagatccacgggggctgccaccacctgcctgggcatgaccctgggcctcatcacaggtcaaaagccagtggctttcatctttttcctgcacgcccagggctggattag

SEQ ID NO: 135412 - DNA, 2895 bp, Artificial Sequence
  Description of Artificial Sequence: Synthetic coding sequence
atgaaggtcaaggaagaaaaagccggggttgggaagctggaccacaccaatcaccggaggcgcttccccgaccagaaggaatgccctcccatccacattggactcccagtgcctacatatccccagcgtaaaacggatcagaaggggcacttgtccgggttgcaaaaagtgcattgggggcttcgtccagatcaaccccaacaggaattaaccggccctgggtccggagcaagcagccaagacagttcaatggatctaattagccgcacacgcagtccggccgctgaacagctgcaggatatcctgggagaggaagatgaggctcccaaccctactctgttcacagagatggacacactccagcatgacggcgaccagatggaatggaaggagtcagctaggtggatcaaatttgaggagaaagtggaagagggaggagaacgttggagcaaaccacacgtgtccaccctgagcctccactccctttttgagctgagaacctgtctgcagacaggcaccgtgcttctggacttggacagcggttcacttccacaaatcatcgatgacgttattgaaaagcaaattgaggatggccttctccggccagagttgcgagagcgcgtttcatacgtgctcctgcgaaggcatcggcaccagacgaagaagcccatccatagatcacttgccgatatcgggaaatcagtgagtactactaacaggtcacccgcgagaagccccggtgccggacctagcctgcatcattccactgaggacttgcgtatgagacagtctgccaattacggccgcctctgtcacgctcagagcagaagcatgaatgatataagccttacaccgaacacagatcaacgcaagaacaaattcatgaaaaaaatccctaaggattcagaggcctcgaatgtgttggtaggagaggtggacttcctcgaccagccttttatcgccttcgtgaggctgatccaatcagcaatgttgggcggcgtcacagaggtgccagtacccactcggttcctgttcattctgctcgggccttccggaagagctaagtcgtacaatgaaataggacgggccatcgccacgctgatggtcgatgatctcttctctgacgtggcttacaaggccagaaatcgagaggacctcatcgccgggatagacgagtttcttgacgaagtcattgttctgcctcccggtgagtgggatccaaacatccgaatcgagccgccaaagaaagtaccctctgccgataagcgaaagtccgttttctcacttgctgaactcgggcagatgaacggatccgtgggggggggcgggggcgccccagggggaggcaatggaggcggcggtgggggagggtccggggggggggctggcagcggcggcgccgggggtacatcatcaggcgatgacggtgaaatgcctgctatgcacgagataggtgaagaattgatatggaccggcaggtttttcggtggactctgtctggacattaagcgtaagctgccctggtttccgtctgacttctacgacgggtttcacattcagtctatatccgccattctcttcatttacttaggttgcatcactaacgcaatcacattcggcggcctgctgggcgatgccacggataactatcagggagtgatggagagcttcctgggcactgccatggccggttcattgttctgtctcttctcggggcagccactgattatacttagcagcacgggccctatcctgattttcgagaagctgttgtttgacttcagcaaggggaatgggctcgattacatggagtttaggctttggattgggttgcacagcgccgtgcagtgtcttatcctggtggccacagacgctagttttatcattaaatacataactcgatttacagaggaagggttcagtacgttaatctcatttatcttcatctatgatgccattaaaaaaatgatcggcgcgtttaagtactaccccataaacatggactttaagccgaacttcattactacctacaagtgcgagtgtgtagctcccgacacggtgaacactactgtgtttaacgcatctgccccgctcgcacctgatactaacgcaagcctgtacaatctgttaaacttgaccgcactagactggagtttgctgtccaaaaaagagtgtttgtcttacggcgggcgcttattgggaaattcatgcaagtttataccagacctggccctgatgagtttcatactgttcttcggcacctactccatgactttaactttgaaaaaattcaagttcagccgttactttcccactaaaccaacacgccccgaccgaggctggtttgttgcccctttcgggaaaaacccatggtgggtatacccggcctctatattacccgccctgctggtgactatcttgatcttcatggaccaacagattacagccgtcatagttaataggaaagagaacaaacttaaagggaccgagagcaaccggcatcataggttacatcctgacggaaacctatgtctgcctggaagtcatcctaaggtctacccacccgcaggggcagtacggtctctgcctcttcacggtcgaggcctccctgagtggcatcccgttttgggaactctgcaggctctgccggatgcttcccaggccccggctggaccctgcctgcctgctgctagggctgctgccccagacccacctctccaccccggggccgatcccctgcccggaggggctctggaccctcaaatccatgggggctgccaccacctgccaggccatgtgtcactacaccaccgctcttgggcatcttcatcgttcgagggattttggatcagcagcttcccatccacgacctggccgggtttaactactagttag

SEQ ID NO: 135413 - DNA, 390 bp, Artificial Sequence
  Description of Artificial Sequence: Synthetic coding sequence
atgaaggtcaaagaggaaaaagcaggtgttggtaagctggatcataccaaccaccgaagaagattcccagatcagaaagaatgtccccctatccacattgggctgcccgtgcccacatatccacagcggaagaccgaccagaaggggcacttatccggccttcagaaagtgcattggggcctccggcccgaccaaccccagcaggaactaaccggcccaggaagcggtgcttcatctcaggactcaagtatggatctgatcagcagaacacggagtccagccgccgaacagcttcaagatatcttgggcgaagaggacgaggctcccaacccaaccttgttcaccgaaatggacactcttcagcacgacggcgatcagatggaatggtag

SEQ ID NO: 135414 - DNA, 438 bp, Artificial Sequence
  Description of Artificial Sequence: Synthetic coding sequence
atgaaggtcaaagaggaaaaggctggagtcggaaaactggatcatactaatcaccggcgcaggtttccagaccaaaaagagtgccccccgatacacatcggcttacctgttcccacgtacccccaacggaaaaccgatcaaaaaggacacctgtctgggctgcaaaaggtacactgggggctgcgcccagatcagccacagcaggaactgactgggcccggctcaggagcctcctcacaggactcttccatggacctaattagcaggacaaggtctcccgctgcagagcagctgcaagacatcttgggcgaagaagatgaggctccaaaccctactctatttactgagatggacactctgcagcatgatggcgatcagatggaatggaaagaaagtgctcgctggattaagttcgaagagaaggtagaggagggctag

SEQ ID NO: 135415 - DNA, 3429 bp, Artificial Sequence
  Description of Artificial Sequence: Synthetic coding sequence
atgaaggttaaagaggagaaggcgggagtcggcaagctggatcataccaatcatcggcggagatttccagatcagaaggaatgtcccccaatccatatcgggcttcccgttcctacgtaccctcagcgaaaaaccgaccaaaagggccatttgtccggtcttcagaaagtccactgggggttgagaccggaccaaccacagcaggagctgaccggacccggctccggggcatcctctcaggacagcagcatggatctcattagccgtacccggtccccagccgcggagcagctgcaggatatcttgggagaggaggacgaggccccaaatcccactctgtttactgagatggatacgctccagcacgatggcgaccaaatggaatggaaggagtccgctcgctggattaaatttgaggaaaaagtggaagaggggggagagaggtggtctaaaccccacgtgagtacattgtctttgcattctttgttcgagcttaggacttgcttgcagaccggcacggttttgctggatttggactccgggtcactcccacaaatcatcgacgatgtgatcgaaaaacagatcgaagacggtttactccggcctgaactgcgagagcgggtttcttacgtcttgctcaggcggcaccggcatcagaccaagaaacctattcacaggagcttagcggatatagggaaatccgtgagcacgacaaacaggtccccggctcgttctcctggagctggtccgtctctacatcactccacagaggatctgcgcatgcggcagagcgccaactacggaaggctgtgtcatgcgcagagcagaagtatgaatgacatttccctgaccccgaatacagaccagaggaagaacaagttcatgaagaagatcccaaaggactcagaagcaagtaacgtcctcgttggcgaggttgatttcctggatcagcccttcatcgccttcgtccgcctcattcagtcagccatgctaggtggcgtcacggaggtgcccgttcccacaagattcctgtttattctcctgggcccgtcaggccgggctaagagctataatgagatcgggcgcgctatcgccactctgatggtggacgatctgttcagcgatgtggcatacaaggcaaggaatagagaggacttgatagccggcattgacgagtttctcgacgaggtgatcgtgctgccgcctggcgagtgggatcctaacatcagaatcgagcctccaaagaaggtgccttccgccgacaagcggaaatctgtgttttccttggcagagcttggccagatgaacggtagcgttggcggaggcggaggagcacccggcggcggcaacggtggtggaggcgggggaggcagtgggggaggagcaggaagcgggggcgccggcggcacgagcagcggagatgatggtgaaatgcccgcaatgcatgagatcggggaggagctcatttggactggcaggttcttcggcggcctttgtctggacattaagcggaaactcccctggtttccttccgatttttacgacgggtttcacattcagtctatttctgcaattctatttatataccttggatgcatcacaaatgccatcacattcggcggattactgggagacgctacggacaactaccagggtgttatggaaagcttcctgggcacagcaatggccggatctctgttttgcttatttagtggacaacctctcattattctgagctccaccggaccaatactgatcttcgaaaaattactatttgattttagcaaagggaatggattggactatatggaatttaggctatggatcggcctccacagcgccgttcagtgcttgatcctggtggccacggacgcaagtttcatcattaagtacataacgcgctttacagaggagggtttcagcacactcatctcatttatctttatctacgatgccattaagaagatgatcggagcctttaagtactaccccataaatatggacttcaaaccgaactttataaccacttacaagtgcgaatgcgtggccccagacactgtcaacaccactgtgtttaatgcctccgcccccttggcccccgatacaaacgcgtccctgtataacctgctgaacttgacagcccttgactggagtttgctctctaagaaggaatgcctctcctatggaggccgtctcctgggcaacagctgtaaatttatccccgatctcgctctgatgagttttatcctgtttttcgggacttactcaatgactctaacattgaagaagttcaagttttctcggtacttccccacgaaagtgcgagccctagttgctgacttttctatagttttcagcatcttgatgttctgcgggatcgatgcttgttttggattagagacccccaaactgcatgtgccatcagtgatcaagccaacacgccccgatcggggctggtttgtggcaccttttggcaaaaacccgtggtgggtctatcctgcttcaatcttgccagctctcctcgtgaccatactgatcttcatggaccagcaaataaccgcagtgatcgtcaaccgtaaggagaataagttgaagaaagcagctgggtatcatcttgacctgttctgggtgggcatcctcatggcattgtgctccttcatgggactgccatggtatgtagcagcaacagtgatcagcatcgcccatatcgacagcctgaaaatggagacagaaacctcagcccctggagaacagccacaatttctcggagtgagagagcagcgagtcactgggataatcgttttcatcttaactggcatttctgtttttctggcaccaatcctcaagtgcattcctcttccagtgctgtatggcgtcttcctctatatgggggtcgctagcttaaatgggatccagatgggcacaggaggaagtgagtttaagatccagaaaaagcttaccccattctgggagcgatgcaagctgttcctaatgcccgccaagcaccagcccgatcatgcctttctgcggcatgtaccactgagaagaatccacctcttcacgttagttcagattttgtgtttggctgtgctctggatcttgaagagcactgttgcagcaataatattcccggttatgagcctgagcacaaccgatctcgggcttatcatcgtccgacgactgctggattttatcttctcacagcacgatttagcctggattgataacatccttccggaaaaagagaaaaaagaaactgacaaaaagcgcaagagaaaaaagggcgctcacgaggactgtgacgaggaaccccaattcccccccccctcggtcattaagattccaatggagtccgtgcagtctgaccctcaaaatggcatacattgcatcgcgcggaagcgctcctcttcctggagctactcattatag

SEQ ID NO: 135416 - DNA, 3645 bp, Artificial Sequence
  Description of Artificial Sequence: Synthetic coding sequence
atggaaagattccggctagaaaaaaaactgcctgggcccgacgaggaggccgtcgtagacctcggcaagacttctagtactgtcaatactaagttcgagaaggaagagctggaatcccaccgggcagtgtacatcggcgtgcatgtgccgtttagtaaagaatcaagaaggcggcacagacaccgcgggcataagcaccatcaccggcgaaggaaggataaagaatcagataaggaagacggccgcgagtcaccctcctatgacacgccctcccagagagtccaattcatcctggggaccgaagacgatgacgaagaacatattccgcacgacctgtttacagagatggacgagctgtgctatagagatggtgaggaatatgaatggaaggagaccgcacggtggctgaagttcgaggaggacgtggaagacggcggggacagatggtcaaagccctacgtggccacgcttagtcttcactccctgtttgaacttcgatcctgcatcttgaacggcactgtaatgctcgacatgcgggcttcaaccttagacgagatcgccgatatggttcttgacaatatgatagcatcagggcagctggatgagtccattagggagaacgtgcgagaagcccttcttaagagacaccaccaccaaaatgaaaagcgcttcacaagtaggatcccactggtcagatctttcgctgacatcgggaagaagcactcagacccccatctcctggagcggaatggcgagggccttagcgcttcacgtcactctcttcggacaggcctgtccgcctcgaacctcagtctacggggagagagccctttatccctgctgcttggccacctcttgccctcatcacgggcgggtacacccgctggttcaagatgcactacacccgtcccaacccctcagaactcccccccatcaagcccatcgatcagcaggctgacgtctagaagctctcaagagagccagagacaggcgccagaactcctcgtgtctccggcctctgacgacatcccaacagtggtcatccacccgccagaagaggatcttgaggccgcactgaagggcgaggaacagaagaacgaggagaacgttgatctgactccaggcattctcgcatccccccagagcgctccaggcaatttggacaactccaagtctggggagataaagggcaatgggagcggaggcagcagggagaacagtaccgtcgatttctctaaggttgatatgaatttcatgcgaaaaattcctaccggtgcagaggcctctaatgtcctggttggtgaagtggactttctggaacgacccattatcgctttcgtgcggctcgcccctgccgtgctgctgaccggactgaccgaggtcccggtgcctacaagattcctgttcctgctgctgggacccgctggtaaggccccacagtaccacgaaatcgggcgcagtattgctacacttatgaccgatgagattttccacgacgtcgcttacaaagccaaagatcggaacgatctgctttctggaattgatgaattcctggatcaggtgacagtgttaccacctggagagtgggaccccagtatcaggattgaaccccctaagagcgtgccttctcaagagaagagaaaaattccggtatttcacaacggctccactcccactctgggagagacacccaaagaagcagcccaccacgcaggtcctgaactgcagcgaaccggacgtctctttggaggcttaatcctcgatatcaaacgaaaagctcccttttttctgtccgattttaaggacgctttgagccttcagtgtttggcctcgatcctgtttctgtactgcgcctgtatgtcaccggttattacttttggcggactgttgggcgaagccacagaggggcgaatatctgccatagagtctctttttggagcatctctgacaggaattgcctactccctgttcgctggccagcctctgaccatcctgggaagcaccggcccagtgctggtgtttgagaaaatcttgtataaattttgcagggattatcaactttcatacctgtctctcagaacaagcatcggcctctggacatcatttctatgtatcgtccttgtggcaaccgacgccagttcactagtatgctacataaccaggtttacagaggaagcatttgccgcattgatatgtataatatttatttatgaggccctggagaaactgttcgacctgggggaaacgtatgcctttaatatgcacaataatctggataagttgacatcatatagctgcgtttgtaccgaaccccctaatccgtctaacgagacactggcacagtggaagaaagataatatcacggcccacaatatcagctggcgaaacctcaccgtaagcgagtgtaaaaagctaaggggtgtgtttcttggatctgcttgtggccatcacggtccctatatacctgatgtcctattttggtgcgtgattctgttcttcactacctttttcctgtcttctttcctgaaacagtttaaaactaagaggtattttccaaccaaagtgcggtctactattagcgatttcgcagtatttctcaccatcgtgataatggtaaccatcgattatctggtcggggttccatcccccaaactccatgtccccgagaagtttgagcctacacatcccgagcggggttggatcatcagcccgctgggagataacccttggtggacccttctcattgctgccatacccgccctgctctgcactatactgatctttatggatcaacaaattactgcagtgatcattaatcgaaaggaacataagctcaagaagggtgcggggtaccacctggacttactgatggtcggagtaatgctcggcgtgtgctctgtgatgggcctgccttggttcgtagcggccaccgtcctgtctattagtcacgtaaatagccttaaggtcgaatcggagtgctctgccccaggcgagcagccaaagttcctgggaatccgcgagcagagggtgaccggactgatgatcttcattctgatggggctgtccgtgttcatgactagcgtgcttaagttcattcctatgcctgtgctctacggcgtatttctgtatatgggggtgagctccctcaagggcatccagttgttcgacagaatcaagctctttggtatgcctgcaaaacaccaacctgacctcatctacttgcgttacgtgcccttgtggaaagtgcatatttttacagtgatccagctcacatgcctagttctcttatgggtgattaaagtgtcagcagcggcggtagtattccccatgatggtcctggccctggtgttcgtccgcaaactgatggatctctgtttcactaagagagaactgtcctggctggatgatctcatgcccgagagtaagaaaaaaaaagaagacgataagaagaagaaagagaaagaagaagctgaacgcatgctgcaggacgatgacgataccgtgcacctgccgtttgagggaggctctctattgcagatacctgtgaaagcattgaagtatagccccgacaaaccagtcagcgtgaaaatttcttttgaggatgagccacgcaaaaagtatgtagacgccgagacatccctgtag

SEQ ID NO: 135417 - DNA, 2403 bp, Artificial Sequence
  Description of Artificial Sequence: Synthetic coding sequence
atggaggtcgtggaagcagagaaaattgtgctcctaacttcggccagattcctgtttcttctgctgggtcctgctggaaaggctccccaataccacgagataggcaggtcaatagctaccctgatgactgacgagatctttcatgacgtggcatacaaggccaaggatcggaatgacctcctcagcgggatcgatgagttcctagaccaggttacagtgcttcccccaggcgagtgggacccgtctatccggattgaacctcctaagtccgtgccttcccaagagaagaggaagataccagttttccataatggctctacaccgactctgggggagaccccaaaagaagctgcccatcatgccgggccagagctgcagagaacggggcgcttatttgggggtttgatcctggacattaagagaaaagcaccattcttcctgtccgattttaaggatgcactttccctgcagtgtctcgccagtattctgtttttgtactgcgcttgcatgagtcctgtgatcacatttgggggccttttaggtgaagctacagaaggtagaatcagcgctatcgaaagccttttcggtgcctctctgaccggaatcgcctattctctcttcgcgggtcagcccctgaccatcttaggtagcactgggccagttctggtgtttgagaaaatactgtacaagttctgtcgcgattaccagttatcatacctctcgctgaggacttccattggactgtggacctccttcctgtgtatcgtgctggtggcaactgacgccagctcactcgtgtgttatataacacgctttaccgaggaggcctttgccgcattgatatgtatcatttttatttacgaagctttagagaagctattcgatttgggagagacatacgccttcaatatgcacaataacctggacaagctaacgagttactcctgcgtctgtacagaaccacccaaccctagcaacgagaccctggctcaatggaagaaggacaatattacagcgcacaatatttcttggcgaaatctgaccgtttcagagtgtaaaaagctgcgcggggtgtttttgggtagtgcttgcgggcaccacgggccctatatccccgatgtgctgttttggtgtgttatcttgttcttcacaaccttttttctgagctccttcctgaaacagtttaaaactaagagatattttcccactaaggtgcgcagcactatcagtgatttcgccgtgtttttgaccattgtgatcatggttaccattgactacctggtgggcgtaccctcccccaaactgcacgttcctgagaagttcgagcctacccatcccgagcgtggatggatcatttcccctctaggcgacaatccgtggtggacacttcttatcgccgccattccagcccttctttgtaccattctgatctttatggatcagcaaattacagccgtgatcataaaccggaaggagcacaagttgaagaaaggcgctggttaccacttagacctcttgatggtgggtgtcatgttaggcgtatgcagcgtgatgggtcttccttggtttgtggcagcaacagtgctgtctatctctcacgtcaatagcttgaaggtggagtctgagtgcagtgctcccggtgagcaacccaagttcttaggaatacgggaacagcgcgtgaccgggctgatgatcttcattctgatggggctgtcggtgtttatgacatctgtgttgaaattcattcctatgcctgttctgtatggagtattcctgtatatgggcgtttcctccttaaagggaatacaactgtttgaccgcatcaagctgtttggcatgcccgcaaaacaccagccagatctgatatatctgagatacgttcccctgtggaaggtgcacattttcactgtgatacaattgacgtgcttggtcctgctgtgggtgattaaagtgtccgctgcagctgtcgtcttccccatgatggtgctagctctagtctttgttcgcaagctgatggatttgtgttttaccaagcgggaattatcctggctggacgaccttatgccagaatccaagaagaaaaaagaagatgataagaaaaagaaggagaaagaagaggccgagaggatgttacaggacgacgatgatacagtgcacctgccgtttgaaggtggcagccttctgcagatccccgtgaaagccctaaagtactctgttgatccatctattgtgaatatctctgacgaaatggctaaaaccgcccagtggaaggctctgtccatgaataccgaaaacgccaaggtgacgcggtccaacatgtcccctgacaaaccagtgtctgtgaaaatctctttcgaagatgagcctaggaaaaaatacgtggatgctgagacttctctctag

SEQ ID NO: 135418 - DNA, 1725 bp, Artificial Sequence
  Description of Artificial Sequence: Synthetic coding sequence
atggaagcagatggagcaggcgaacagatgcggcctctgctaaccagaggaccagatgaagaagctgttgtggatttgggcaagacctctagcacagtgaatacaaaattcgaaaaggaagagcttgagtctcaccgtgccgtctacatcggcgtccatgtccccttctcaaaggagagccgcaggcggcacaggcacaggggacacaaacaccaccaccggcgcagaaaagacaaagagtcagacaaagaagatggacgggagtccccttcctatgacaccccttcacaacgagtgcagtttatccttggaaccgaagatgacgacgaagagcacatcccacatgacttattcactgagatggacgagctttgctacagggatggcgaggagtacgagtggaaggagactgccagatggctaaagttcgaggaagacgtggaggacgggggcgaccggtggagcaaaccatacgtcgccacactaagtctccactcactgttcgagcttaggtcttgtatccttaatggaaccgttatgttggacatgcgggcgtctacactcgacgaaatagccgacatggtactggataatatgatagcatctggccagcttgacgaatccatacgcgaaaacgtcagggaggcactccttaagcgacaccatcaccagaacgagaaacgtttcacatcccgaatccccttggtcagatcttttgctgacattggagagggccttagtgctagcagacactccctccggaccggcctctccgccagtaatctttctctgcgaggtgagtcacctctgagtctgcttctggggcatttgctgccttcctccagggcaggtactccagcaggatctagatgcactacgcctgtgccgacgcctcagaacagccccccctcctccccctctatctctcgactgactagcagaagtagccaggagagtcagcgtcaggcccctgaactgctggtgagcccggcctctgatgatataccaactgttgtgattcacccaccagaagaagatctcgaagccgctttaaaaggtgaggagcaaaagaacgaggagaatgtagacctcacacctggcatcctcgcttccccccagagcgctccaggcaatctcgacaactctaagagtggagaaatcaaggggaatggctcggggggatcacgagaaaattccaccgtcgactttagcaaagtcgacatgaactttatgcggaagatccctaccggcgccgaggcgtcaaatgtgctcgtcggcgaagtggactttcttgaacggccaattatcgcatttgtgaggctagcccctgcagtgctgcttaccggattgacggaggtgcccgttcccactcgctttctgtttctcctgctcggaccagctggcaaggctccgcagtatcacgagatagggcgcagcatcgccacccttatgacagacgaaatcttccacgatgtagcctataaggccaaggatcgtaatgacctgttgtccggcattgatgaattccttgaccaggtgaccgtgctgccccctggtgaatgggatcccagcataaggatagaaccgcctaagtctgttccaagccaggagaaaaggaaaataccagtttttcacaacggttctacccctactctgggagagacaccgaaggaagccgcacatcatgccgggcccgagttgcaacgtaccggccgggtccagtag

SEQ ID NO: 135419 - DNA, 3273 bp, Artificial Sequence
  Description of Artificial Sequence: Synthetic coding sequence
atggagaggttccgcctggaaaagaagctgcccggccccgacgaagaggccgttgtggacctgggcaagacctcctcaactgtgaatactaagttcgaaaaagaggaactggagtcccacagggctgtttacatcggagtgcacgtaccattctctaaagaatctcgacggagacatagacatagggggcataaacaccatcatagaagaaggaaagacaaggaatccgacaaggaggacgggcgggaaagcccatcctacgatacaccctctcagcgcgtccagtttatcttgggaacagaggacgacgatgaggagcatatcccacacgatttgttcacagagatggatgaactctgctatagggacggtgaggaatacgaatggaaagagaccgcccgatggctgaaatttgaagaggatgtcgaagacggtggcgaccggtggtccaagccatacgtggctacactctcattacactcacttttcgaattaagatcttgcatccttaatggtactgttatgcttgatatgcgggcttccacactcgacgagatcgcagatatggttcttgacaatatgattgcctccgggcaattggacgagagcatccgcgagaatgtgagagaagccctgcttaagcggcatcatcaccagaatgagaaacggtttacaagtagaatacccctggtgcgctcatttgctgatattgggaagaagcacagcgacccccacttactcgaacgtaatggaattctggcctctccacagtctgccccgggcaacttggataactcaaagtccggcgagatcaagggaaacggcagcggcgggagtcgcgaaaattcaaccgtagatttttcgaaagtagatatgaactttatgcgaaagattcccacaggtgccgaagcctcgaacgtgcttgtcggagaggtcgacttcttagagagaccgataattgctttcgttcgcctcgccccggctgtgctcttgaccggcctcacggaggtgccagttcccaccagattcttgttccttttgctcggtcccgcaggtaaggccccccagtaccatgagatcgggcgatccatcgccaccctgatgactgacgagatttttcatgacgtggcctataaagcgaaagaccggaacgaccttctgagtggcatcgatgagtttctcgaccaggtcacagtgcttccccccggcgagtgggaccccagcattaggatcgagccccctaaatccgttccctcacaggaaaaacggaaaatcccggtgttccacaatgggagtacccccactcttggtgagacacctaaggaggcagctcaccacgccggccccgaactgcagagaacagggagactgttcggaggattgattctggatattaagagaaaagccccattcttcctttcggacttcaaggatgccttatccctgcaatgtttagcaagcattcttttcttatactgcgcctgcatgtcgccggtgatcaccttcggaggcctcctgggcgaggccacggaaggacgcatcagtgctattgaaagcctgttcggggcctcactgacagggatagcatacagtctttttgccggccagcctctcacgattctcggaagcaccggacccgttttggtctttgagaagatcctctacaaattttgtcgggattatcagttgagctacctctctctacggactagcattggactctggacctcttttctgtgcatcgtgctcgtagcaacagacgcctcctctttggtgtgctacattacgcgcttcacagaagaggcttttgcggccttgatttgtatcatttttatctacgaagctctcgagaagctgtttgacctaggtgaaacttatgccttcaatatgcataacaacttggataaactaacatcttactcctgtgtgtgtacagagcctcccaatcctagcaacgagactctagcacaatggaaaaaggacaatataacagctcataacatttcgtggcgaaacttgaccgtttccgaatgcaagaagttgcgcggggtcttcctgggtagcgcatgtggccatcacgggccctatatccccgatgtcctgttctggtgtgttatcctgtttttcactactttctttctgtctagttttctgaagcagttcaagactaagaggtactttcccactaaagtgcggtctacaattagcgactttgcggtgttcttgacaatagtgatcatggtcacaatagattatctggtcggcgtgccatctcctaaactgcatgtgcctgaaaagtttgagcccacccaccccgaacgtgggtggataatctctcccctcggagacaatccatggtggaccttgctgatcgccgcaattccagccctgctctgtacgattctgatcttcatggaccagcagataaccgcggtcatcatcaacagaaaggaacacaaactgaagaagggagccggatatcacttagatttactcatggttggcgtgatgttaggcgtttgcagcgtgatgggtctcccgtggtttgtcgcagctaccgtcctaagcatcagccacgtgaattccttgaaagttgaatctgaatgctcagcacccggggaacaacctaagtttctgggtatccgcgaacagagggtgaccgggttgatgatttttatactgatggggctaagtgtcttcatgaccagcgtgctgaaattcattcccatgccggtcctctacggggttttcctctacatgggcgtgagttccctaaagggaatccagctttttgaccgcataaaactgttcgggatgcccgccaagcatcagcccgatctcatctacctgaggtatgtgccactgtggaaggtgcatattttcacagtcatccagcttacctgtctggtgctgctatgggtgattaaggtttctgccgcagcagtggtgtttcccatgatggttctggccctggtgtttgtaagaaagctaatggatttatgcttcactaagcgggaactatcctggttggatgatctcatgccagaatcaaagaagaaaaaagaggatgacaagaagaagaaggagaaagaggaggccgaacgcatgctgcaggacgatgatgatacagtccacctgccgttcgaaggaggctccctgttgcagatacccgttaaggcgctcaaatattcacctgacaaacctgtgtcggtcaagatctcattcgaagatgagccacgcaagaaatacgtagatgctgagacctccctctag

SEQ ID NO: 135420 - DNA, 3408 bp, Artificial Sequence
  Description of Artificial Sequence: Synthetic coding sequence
atggaagctgacggcgctggagaacagatgcgcccattattgactagagttacaagtcggggacccgacgaagaggcagtggtggaccttggcaagacttcttctactgtgaataccaagtttgagaaggaggaattagaaagtcatcgcgccgtgtacattggagtgcatgttccattctctaaggagtctaggcggcggcatagacatcgcggtcacaaacaccatcataggcgacgcaaggataaagagtccgacaaggaagatggcagagagtccccctcgtatgacacccctagtcaacgcgtgcagtttatccttggaacagaagatgatgatgaagagcacattccccatgatctgtttactgagatggatgaactctgctaccgggacggcgaggagtacgagtggaaggagaccgcccgctggctgaagttcgaggaggatgtcgaagacggtggcgatcgctggagcaagccttatgtagctactctttccctgcacagtctgtttgagttgcggagttgtatactcaacggtacagttatgttagacatgagagctagcaccttagacgagattgccgatatggttctggacaacatgattgcttccgggcaattggacgagtctatccgggagaacgtccgggaggccctcctgaagagacatcaccatcagaacgaaaaacgtttcacctctcgcataccactcgttagaagctttgcagatattggcaaaaagcacagcgacccgcacctcctggaaagaaacggaatactggcctcaccccagtccgcccccggcaatctcgataattccaagagtggggaaatcaagggcaatgggtctggcgggtcaagggaaaactcaacagtagacttctctaaagtggacatgaactttatgagaaaaattcccacaggagccgaggcaagcaacgtgctcgtgggagaagtcgattttctggaacgcccaattattgccttcgttcgtctggcccctgctgtcctccttaccggtctgacagaagtccccgttcccactcggttcctcttcttactcctggggcccgccggtaaggctccacagtaccatgagatcggtcgcagcatcgcgactctaatgacagatgaaattttccacgatgtggcatacaaggccaaggatcggaatgacttgctgtccgggatcgatgagtttctggaccaggtgactgttctgcctcccggagaatgggatccatccatcagaatcgagccaccgaagtctgtccccagtcaggagaaacgaaaaatccccgtattccacaatgggtctacaccgactctgggagagactccgaaagaggccgctcaccacgctggacccgagctccagcggacgggtaggttattcggcggattgattttggacataaaacgtaaagcccccttcttcttaagtgatttcaaagacgctttgagccttcagtgcctcgcctccatcctgtttctgtactgcgcgtgcatgtcaccagtgattaccttcggaggattgctgggtgaggcaaccgagggccgtatctcagccatcgagtctctattcggcgcctcactaactggtattgcttactccttgttcgcagggcaacctctgactattctcggatccactggaccagtgctggtgttcgagaagattctgtacaaattttgtcgtgactatcagctgtcttatctgtcattgcgtacgtcaatcggcctgtggacgtccttcctgtgcattgttctggtcgctacagacgcttcttcattggtgtgctatattacacgattcactgaagaggcattcgcagcacttatctgcattattttcatttacgaagcactggaaaaattatttgacttgggtgaaacatatgcgttcaatatgcacaacaatctggataaacttaccagctatagctgtgtgtgtacagagcccccgaacccatccaacgaaaccctggctcagtggaagaaggacaatattaccgctcacaatatctcttggagaaacctgactgtgtccgagtgtaagaaactgaggggagtgttcctgggctctgcatgtggtcaccacgggccatatatacccgacgtcctgttctggtgcgttatcttatttttcacaacctttttcttgtcaagctttcttaaacagtttaagaccaagagatatttcccaactaaggtgagatctacaatttccgacttcgccgtgttcctgactatagttatcatggtgaccatagactatctggtgggagttccaagtcctaagctacacgttccagaaaaatttgagcccacccacccagagaggggctggatcatctcaccacttggagataacccctggtggaccttactcatcgccgcaatccccgcccttctgtgcactattctgatcttcatggaccagcagattaccgcggttatcatcaatcgcaaagagcacaagttgaaaaaaggggccggctatcatttagacctcctaatggtgggtgtcatgttgggcgtatgtagtgtgatgggcctgccatggttcgtagccgccaccgtgctgtccataagccacgttaatagccttaaggtggagtccgaatgcagcgccccgggggagcagcctaaattcctcggcatacgcgaacagcgagttactggacttatgatattcatattaatggggctgagtgtctttatgacttcagtgctgaagttcatacccatgccagtgttatacggagtattcctatacatgggcgtctcttctctgaagggtatccagttatttgacagaattaagctgtttgggatgcccgccaagcaccagccggaccttatctatttgcggtacgtgcctctttggaaggtccatatcttcaccgtgatccagttaacctgcctggtactcttatgggtgattaaggtgagcgctgcagccgtggtgtttcccatgatggtcctggcactggtgtttgttcgcaagttaatggacttatgtttcacgaagagagagctttcctggcttgatgatcttatgcccgaatccaagaagaaaaaggaagacgacaaaaagaagaaggaaaaggaggaggctgagcggatgttgcaggacgatgacgatactgtccacctaccctttgaagggggctcactgctccagattcctgtgaaggcactgaaatattcagttgatccctcaatagtgaatatctctgacgaaatggctaagaccgcgcaatggaaagctcttagcatgaacaccgagaacgctaaagtgacacgctccaatatgtcaccggacaaaccagtctccgtcaagatttcattcgaagacgagccccgcaaaaagtacgtcgatgccgagacgtccttgtag

SEQ ID NO: 135421 - DNA, 3288 bp, Artificial Sequence
  Description of Artificial Sequence: Synthetic coding sequence
atggaggccgacggagccggtgagcagatgagacctctcctgactagaggcccagacgaagaagcggtcgtggatttaggaaaaacgtcaagcactgtgaatacaaaatttgaaaaagaagaactcgagtcgcaccgcgccgtgtacattggggtgcacgtcccattcagcaaggaaagtagacgtcgccaccgtcatcgcgggcacaagcatcatcatcgacgccgcaaagataaagagagcgataaggaggatggcagagaatccccatcgtacgatacaccgtcgcagcgcgttcagttcatcctgggcacagaggatgacgatgaggaacacattccacacgatctgtttactgaaatggatgaactgtgttacagagacggggaagaatatgagtggaaagagacagcacgctggctcaagtttgaggaagatgtcgaggacggcggtgacagatggtccaaaccctacgttgccactttgagcctgcactctttgttcgagcttaggagttgcatactaaacggcaccgtgatgctggatatgagggccagcacacttgatgaaatcgctgacatggtcctcgataacatgattgcgagcggacagctggatgagtctatcagagaaaacgttcgtgaagccctactcaagcgacaccaccaccagaacgagaagaggttcacaagcaggatccctctcgttagaagtttcgcggacatcggcaaaaaacacagcgaccctcatttactagaaaggaacgggatcctcgcatctccacagtcagccccaggaaatctggacaactccaagtccggcgagataaaagggaatggaagcggcggttcccgcgagaactctactgttgatttttcgaaggtggatatgaacttcatgaggaaaattcccactggcgcagaggcctctaacgtgcttgtaggcgaggtcgactttctggagcgaccaatcattgcatttgtgcgcctcgctcccgcagtactgctcaccggccttactgaggtcccagttccgacaagatttctgttcttacttttaggccccgccggtaaagcgccccagtaccacgaaatcggcagatctatagctacactgatgaccgatgagatcttccacgacgttgcctacaaggctaaagatcggaatgatttactgtccgggatcgacgagttcttagaccaggttactgtgctgccgcctggggagtgggatccatctattagaatcgaacctcccaagagcgttccatcgcaggagaagcgcaaaattccagtatttcacaatggctctacgccaacactgggagagacccctaaggaggccgcccaccacgccggacccgagttgcagaggactgggaggctgttcgggggcctgatcctcgacataaaaagaaaggcccctttttttctttcagatttcaaagacgctttatcactgcagtgccttgcatctatactgtttctgtactgcgcttgcatgagccccgtgatcactttcggcgggctgctcggcgaggccactgagggaagaatcagtgcgatcgaaagcctcttcggcgcaagtctgacagggatagcttacagtctgttcgctggacaacctctgaccatactgggatctacagggccagtgctggtgttcgaaaaaattctctacaagttttgtcgggactaccaactgtcatatcttagtttaaggacaagcattgggttgtggaccagctttctgtgtatcgtgttggtcgcaactgatgcttcatcgctagtatgctacatcactagattcacagaagaggcgttcgctgccttgatatgcataatatttatttacgaggcactggaaaagctgtttgatctgggagaaacttatgcctttaatatgcataataacctggacaagctgactagttacagctgcgtctgtactgagccaccaaacccgagtaatgaaactctggcacagtggaagaaagataatatcactgcccataatattagctggcggaacctgacagtgagtgagtgcaaaaaattgcggggcgtgttcctgggctccgcttgtggacatcatggcccttatatcccggatgtgctcttctggtgcgtcattctgttttttaccacattctttttgagttccttcctgaagcagttcaaaacaaagcggtattttcccaccaaagtgaggagcactatttcagatttcgccgtatttctgactatcgttattatggtcactatagactacttagtgggcgtcccgagccccaaattacacgtgcccgaaaagtttgagcctactcatcccgaaaggggctggattatctccccactgggcgacaacccctggtggactctcctgatcgcagccatcccagcgctcctgtgtactatcctgattttcatggatcagcagatcacagcagtaattattaatcgtaaagagcataagctcaagaaaggtgccggctaccacctagatctgctgatggtaggggtcatgttgggagtgtgttctgtgatggggctcccttggtttgtagctgcaaccgtcttaagtattagtcatgtgaactccttaaaagtggaaagtgagtgctctgccccaggcgagcaacctaagttcctgggtattcgcgaacaacgggttacaggcctgatgatatttatcctgatgggactaagcgtctttatgacctccgtgctgaagttcatccccatgcccgtgctgtatggtgtttttctctacatgggagttagcagtcttaagggtatccagctgtttgatcgcataaaacttttcggcatgcctgccaagcaccaaccagacctgatctacctacggtacgttcctctatggaaagtgcacatttttacggtgatacaattaacatgcctggtattgctgtgggttattaaggtatccgcagcggcagtggtcttccccatgatggtgctagcccttgtgttcgtaagaaagcttatggacctgtgcttcactaagagagagctctcctggctagacgatctcatgccagaaagcaaaaaaaagaaggaagacgacaagaaaaaaaaggaaaaggaggaggcggagcggatgctgcaggatgacgatgacacagtgcacttgcccttcgaaggcggctccttgctgcagatcccagtcaaggcacttaaatacagtcccgataagccagtcagtgttaagattagctttgaggacgagcctagaaaaaagtatgtggatgctgagacaagcttatag

SEQ ID NO: 135422 - DNA, 1392 bp, Artificial Sequence
  Description of Artificial Sequence: Synthetic coding sequence
atggaagcagacggcgcgggcgaacagatgcgaccattacttactagggggccggacgaggaggccgtggtcgatcttggcaagacttcatctactgtgaatacaaaatttgagaaggaggaacttgaatcccaccgggctgtgtatataggagtgcacgtaccttttagcaaggagagccggcgccggcaccgacacaggggccacaagcatcaccataggcgacggaaggataaagaatccgacaaggaggacggtcgcgagtctccctcttatgataccccgagccaacgcgtgcaatttattcttgggactgaggatgatgacgaagaacatatacctcatgatctttttaccgaaatggacgagttatgctatagagacggggaggagtacgagtggaaggaaaccgcccgatggctcaaattcgaagaggatgtggaagacgggggggaccgatggtcgaagccctacgtggccacgctgagtttacattcattgtttgaactacgctcctgtatcttaaacggtacggtcatgttggatatgcgagcctctaccctcgacgaaatcgcggacatggtactcgacaacatgatcgcatcgggccagctggacgagtctattcgagaaaatgtgagagaagccttactgaaacggcaccaccatcagaacgagaagcggtttaccagtagaattccactcgtaagaagctttgctgacattggtaagaaacactcagatccgcatttgctggagaggaacggcatattggccagtcctcagagtgctcctggcaacctggacaatagcaagtcgggcgaaatcaaaggaaacggcagcggagggagccgagagaacagcacagtggacttctccaaagtcgacatgaactttatgcggaaaatccccaccggcgctgaggcctcaaatgtactggtcggggaagttgatttcctagagcggcctatcattgcattcgttaggcttgcccccgccgtcctcctgaccggcctgactgaagttcccgttccaacccgctttctgtttctgcttttaggacccgctggaaaggcccctcagtatcatgagatcggaagatccatcgctacattgatgactgacgagatttttcacgacgttgcctacaaagcaaaagaccgcaacgatctgctgtcgggtatcgacgagtttttagatcaggtcacggtgctgccaccgggtgaatgggatccttccatcagaattgaacctcccaaatccgtccccagtcaggaaaaacgcaagattccagtgttccacaatgggtcaaccccaacacttggggagactccaaaggaggctgcgcaccacgctggtcctgaattgcagcggactgggagggtgcagtag

SEQ ID NO: 135423 - DNA, 1725 bp, Artificial Sequence
  Description of Artificial Sequence: Synthetic coding sequence
atggaagcggacggcgccggggagcagatgagaccactcttgactaggggccccgatgaagaggcagtggtggatcttgggaagacgtcatccaccgtgaataccaaatttgagaaggaagagctggaatcacatcgggctgtgtatattggtgtccacgtaccgttctcaaaagagtcccgcagaaggcataggcacagaggacacaagcatcatcaccggcgtagaaaagataaggagagcgataaagaggatggaagagaatctcctagttatgatacccctagccagagagttcagtttattctgggtacagaggatgacgacgaagaacacattccccatgacttattcaccgaaatggatgaattatgctacagggacggagaggagtacgaatggaaagagactgcaagatggctcaaattcgaagaggatgtagaggatggcggcgaccgttggtccaaaccctacgtcgccaccctcagtctgcattccctgtttgaactgagatcgtgcattctgaatgggaccgtcatgttagacatgagagcgtccacactggacgaaatcgccgacatggttcttgacaatatgatcgcctccggacagctggacgagtctatcagagagaatgtgcgggaggccctcctgaagcgccaccatcaccaaaacgagaaacggtttacatctagaattcctctcgttagatcattcgccgacataggggaaggcttaagcgccagccgccacagcctgcgaacaggactgtccgcctcaaacctctcccttcggggggaatccccgctcagtctcttacttggccacctgctgccatcatctcgcgctggcacgccagccggttcccgatgcacgacacccgtcccgaccccccagaatagtccacctagctcgccaagcatttctagactgacgtccagatcgtcccaagaatcacagcggcaggctcctgaattgttggtctctcccgcatctgatgatataccgactgtcgtgattcatccccccgaagaagacttggaagcagccctaaagggggaggaacagaaaaatgaagagaatgtggacctcacgccgggaattctggcgagtccgcagagtgcacccggcaatctcgataacagcaaatctggcgagatcaagggcaatggctccgggggttcacgggagaactctacagtggatttctcaaaagtcgacatgaacttcatgagaaaaattcccaccggggccgaagcatccaacgtactggtcggcgaagtcgatttcctggaacggcccattattgcattcgtgaggctcgcgcccgcagtgcttctcactgggcttacagaggttcctgtccccacacgcttcctgttcttgctgcttggcccagccggtaaggcaccccaataccatgagataggtcggtccattgctacactgatgactgatgagatttttcatgatgtggcatacaaagccaaagatcggaacgatttactgtccggcattgatgagttcttggaccaggtgaccgtcctgccaccaggcgagtgggacccaagcattcggatcgaaccccctaaaagtgtgccgtcgcaggagaagcggaaaatcccggtgttccacaacgggtctacaccaacattgggtgaaacccctaaggaagccgcccaccacgccgggccagagctgcagcgcactggacgggtccagtag

SEQ ID NO: 135424 - DNA, 3741 bp, Artificial Sequence
  Description of Artificial Sequence: Synthetic coding sequence
atggaagctgatggggcaggcgaacagatgcgcccgctgctaacccgggttacatcaagagggcccgatgaagaagccgtcgtagacttaggtaaaacgagctcgaccgtgaacaccaagtttgagaaagaagaactcgaatcccatagagctgtctacatcggagttcacgtgccgttttccaaagagtcccgaagaaggcataggcacagaggtcataaacatcatcacaggaggcgaaaggacaaggaatcagataaagaagatggtcgtgaaagtccttcgtatgatactccttctcagcgggtgcagttcatacttggaactgaagatgacgacgaagaacatatcccgcacgatctgtttaccgagatggacgagctttgttatcgggacggcgaggagtacgagtggaaggagaccgccagatggctgaagttcgaggaggatgttgaggatgggggcgacaggtggagtaagccctatgtggctactctaagtctgcatagccttttcgaattgaggagttgcattttgaacggcactgtgatgctggatatgcgcgctagcaccctggacgagatagctgatatggtgctcgacaatatgatcgctagcggtcagctcgatgaatctatcagagaaaacgtgcgtgaggccctgttgaagcgccaccaccaccagaatgagaaacgcttcactagccgcatccccctcgtccgcagcttcgcagacatcggagagggtctgtccgctagtcggcacagtctgcgaaccggcttgtccgctagtaacctaagcttgagaggggagagccccttgtccctgttgctgggacatctccttccaagttctcgggcgggaacaccggctggatctaggtgtacgacgccagtgccaacacctcagaactccccgccctcctccccatcgatatcaaggctaacgtccagaagcagtcaagagagccagcgacaggccccagagctcttggtgagccccgcctctgatgacatccctactgtggtgatccacccacctgaggaggacttggaagctgcgctcaaaggcgaggaacagaaaaatgaggaaaacgtcgacctgacaccaggaattctggccagtcctcagagcgcacctggcaatttggacaatagtaagagtggagagataaaaggcaacggatccggcggcagcagggagaactccacagtggacttctctaaggtggacatgaattttatgaggaagattcccactggcgccgaggctagcaacgtgcttgtgggagaagtagattttcttgaaagacctattatcgctttcgtccggttggcaccagctgttcttctaactggtttgaccgaggtgccagttccaacgagatttctgtttctgcttcttgggcctgcagggaaggctccgcagtaccatgaaatcgggaggtcaatcgcaacgctgatgacggatgagatttttcatgacgttgcctataaggctaaggataggaatgacttactgtccgggattgatgaattcttggatcaagtaacggtcctgccaccaggcgagtgggacccgtctatcaggatagagccacccaaaagcgtgcctagccaggagaagcggaaaataccagtcttccacaacggctccacccctaccctgggcgagacaccgaaggaggccgcacaccatgcggggcccgagctgcaacgcaccggccgtctgttcggcgggctcattttggatataaaacggaaggcccctttttttctgtcagatttcaaagacgccctgtccctgcaatgtctggcttccatcttgttcctctactgcgcttgcatgtccccagtgattacattcgggggtcttctgggcgaggctacggagggtcgtatctcagccatcgagagtctgttcggtgccagcctgaccggcatagcctactctcttttcgccggacagcccctgacaattcttggaagcactgggcccgtgctcgtgttcgaaaagatcctttacaagttctgccgggattaccaactgagttatctgtccctgcgaacttctataggactgtggacctcgtttttgtgtattgtgctggtcgccaccgatgcatccagtctggtgtgttacataacccggttcacagaggaggcttttgcagccctcatctgcatcattttcatctacgaagccttagagaagctgtttgatttgggcgagacgtacgcgttcaacatgcataacaatcttgacaaactgacttcatattcgtgcgtttgcactgaaccaccaaacccatcgaacgagactctggctcagtggaagaaggacaatataacagctcataacatctcatggcggaatttaacagttagtgagtgtaagaagctccggggcgtatttcttggaagcgcctgcggtcatcacggcccctacatccctgacgtgctgttttggtgcgtcatcctgttctttactacattctttttgtcaagctttctcaagcagttcaagaccaagcgttattttccgactaaagtgaggtccacaatctccgactttgctgtgttcctgacgattgtcatcatggtcaccatcgattacttggtgggcgtgccaagccctaagctccacgtgccggaaaaatttgaacccacccaccctgagagaggatggattatatcgcccctgggcgacaatccatggtggactctcttgatagccgccattccagccctgctgtgtacgatcctgatctttatggatcagcaaatcactgccgttatcattaaccgtaaggaacataagttaaagaaaggggctggctatcacttggacctcctaatggtcggtgtgatgctgggggtctgttccgttatgggtctcccttggtttgtagcagctactgtgctgtctatcagccatgtgaatagtctcaaggtggagagcgaatgcagtgcccccggggaacaacccaaatttttggggatcagggaacagagggtgaccgggctaatgatattcatcctgatggggctgtccgttttcatgacatcggttttaaaatttattcctatgccagtgctgtatggggtcttcctctatatgggcgtcagctccttgaaagggattcagctcttcgaccggattaagctgtttggaatgcccgcaaagcatcagccagacctcatatatctcaggtatgttccactgtggaaagtacacatatttaccgtgattcaactgacatgcctcgtgctactttgggtgatcaaggtctcggctgctgctgtggtgttccccatgatggtcctagccctcgtgttcgttagaaaattgatggacctatgctttacaaagagagaactgagctggctggacgacctgatgcccgagtccaaaaagaaaaaagaagacgataaaaagaagaaagagaaagaggaggctgagagaatgttgcaagacgacgacgataccgtgcatctcccatttgagggcggatctctgctgcagatccctgtgaaggcactgaagtactctgttgatccgagtatcgtaaatatctctgacgagatggcgaagaccgcccagtggaaagcccttagcatgaacactgaaaacgctaaagtaacccgatcgaacatgagcccagataagcccgtctccgtcaaaattagcttcgaggatgaaccaaggaagaagtatgtcgacgccgagacatcgttgtag

SEQ ID NO: 135425 - DNA, 3780 bp, Artificial Sequence
  Description of Artificial Sequence: Synthetic coding sequence
atggaagctgatggggccggggaacagatgcgtcctctcctgacgcgggtcaccagccgcggccctgatgaagaggcggtggttgacttggggaagacttcctctactgtcaacacaaagttcgaaaaagaagaattggaatcccacagggccgtctacattggggtgcacgttccattcagcaaggaatctagaagacggcaccgccaccggggacataaacatcaccacaggagacgaaaagacaaggaaagtgacaaagaagatggtcgggagtcaccctcttatgacactccctcccagagagtccaattcattctgggtacagaggatgatgatgaagagcacattccccatgacctgttcacagaaatggatgagctctgttacagagacggcgaggagtacgaatggaaggagaccgccagatggctgaagtttgaagaggacgtggaggatgggggagatcgatggtccaagccctatgttgccaccctgtcactccacagcttgttcgaactgcggagctgtatcctgaacggcactgtcatgctggacatgcgggcctctactctggacgagattgctgacatggtgctggataatatgatcgcttccggccaattggacgagtccattcgcgaaaatgtccgcgaggccctgctcaagcgccaccaccaccagaatgaaaagaggtttacctcccggatcccccttgtcagaagtttcgcagacatcggcaagaaacattccgaccctcaccttctcgagaggaatggggagggcctgtcggcatccaggcactcacttaggaccggtctgtccgcttccaatctctcattgaggggggaatcgcccctaagcctgctcctgggtcacctcttgccctcctcccgagctggcacccccgccggcagccggtgcaccacccctgtccccaccccccagaattcccctcccagctctccctcaatctcacgcctgacttcgcggagcagccaggagtctcagcgccaagcacctgaactcctggtgtccccggcatccgacgacatccctacagtcgtcattcatccgccagaggaagacctggaggccgcattgaagggcgaggagcagaagaacgaggaaaacgtcgacctgacgcccggtattctggctagcccacagagtgcccccgggaatttagacaattctaaaagtggggagatcaaagggaacggctccggcgggtctcgggagaacagtacagtcgacttctccaaggtggatatgaactttatgagaaaaatccccaccggcgcagaggcgagcaatgttctagtcggcgaagtcgacttcctggaaaggcctattattgcattcgttcggcttgcacccgccgtgctcctaactggtctgacggaagtgcccgtaccaaccaggtttttgtttcttcttctgggtcccgcaggaaaagcaccccagtaccacgagatcgggaggtctatcgctacactgatgacagacgaaatcttccatgatgtggcctacaaagcaaaggatagaaacgacctgctctccggcatcgacgagttcctggaccaggttacggtcttgccgccaggggaatgggacccttctattcgcatcgagcctcctaagtcggtccccagccaggagaagaggaaaattcccgtgttccataatggctcaacacccaccctcggcgagactccgaaggaggctgctcaccacgctggacctgagctgcagagaactggtcgtctgttcggaggcctgatcctagacattaagagaaaagcgccattcttcttatccgacttcaaagacgcactgtctctgcagtgcctggcatcaatactgtttctctactgtgcttgcatgagtcctgtgattacttttgggggccttttgggcgaggctacagagggccgaatctcagccatagaatccctgttcggggcgtccctgacgggcattgcctatagcctctttgccggacagccgctcacgattctggggagtactggtccagtattggtattcgagaaaatactgtataagttttgccgggattaccaactgtcctatctaagtctgagaaccagcattgggttatggacatcattcctttgcatcgtgctagtggctactgatgcgtcctccttggtctgttatatcactagatttacagaggaagcatttgctgcgcttatatgcattatatttatttacgaggcactggaaaaactgtttgacttgggtgagacttatgcatttaatatgcataataatctagacaaacttacttcatatagttgcgtgtgtaccgaaccacctaatccgtcgaatgagaccctggcgcagtggaagaaggacaatataacagcccataacattagttggcgcaaccttacagttagcgagtgtaaaaagttgagaggggtcttccttgggagcgcctgtggccatcacggtccctatattccagacgtgctgttttggtgcgtcattctgttctttacaacattcttcctatccagttttctgaagcagttcaagacaaagcgttatttccccactaaggtgcgatctaccataagcgatttcgcggtctttttgactattgtaataatggtgaccatcgactaccttgtgggcgtgccgagtcctaaactccacgtccccgagaagttcgagcctacacacccagaaagagggtggatcatctcaccactgggggataatccatggtggaccctgctgattgccgctattccagccttgctgtgcaccattctgattttcatggaccagcagattaccgccgtcattattaatcgcaaggaacacaaattgaagaaaggcgctggctaccatctggatctattgatggtcggtgtgatgctgggtgtgtgcagtgtaatgggcctgccttggttcgtggccgctactgttctgagtatctcacatgtcaactctttaaaagtggagtccgaatgtagcgcacccggcgagcagcctaagttcctcggcattcgggaacagagggtgaccggactaatgatttttattcttatgggcctgagtgtgttcatgactagtgttttaaagttcattcctatgcccgtgttgtacggcgtatttctctacatgggggtgtcatcactgaagggcattcagctgttcgatcgcatcaaactgtttggaatgccagcaaaacatcaaccggacctgatttatcttcggtatgttcccctctggaaagtccacatcttcactgtgatccagctgacgtgcttagtgctgttatgggtgattaaagtgtccgccgccgccgtggtttttccgatgatggtgctggccctggtgttcgttaggaagcttatggatttatgtttcacaaaacgggagctcagttggctggacgatctcatgccagagtccaagaagaagaaggaggacgacaaaaaaaagaaggaaaaggaagaggcggaacggatgctccaggatgatgacgatacagtgcatttgcccttcgaaggaggcagcttgctgcagattcccgtcaaagcgcttaaatactccgtagacccctcgattgtaaacatctcagacgaaatggctaaaactgctcagtggaaagctttgagtatgaacacggaaaatgctaaagttacccgtagcaatatgtcacccgacaagcccgtgtctgtcaaaatttcatttgaggatgagccaaggaagaagtacgttgacgcagagacaagcttgtag

SEQ ID NO: 135426 - DNA, 3396 bp, Artificial Sequence
  Description of Artificial Sequence: Synthetic coding sequence
atggaggcagacggtgccggtgagcaaatgcggcccctgctgacaagggggcctgacgaagaagctgtggttgatctgggcaaaactagcagtacggtcaatactaaatttgagaaggaggaattagaatcacaccgggccgtgtacattggggtacatgtgcccttctccaaagaatctagaaggcgtcacagacacagaggacacaagcaccatcaccggagaagaaaagacaaagagtctgataaagaggacggtcgcgaaagcccatcatacgacactccttctcagcgagtgcaatttatactgggtaccgaggatgacgatgaggagcacattcctcacgacttgtttacagaaatggatgagctctgctatcgtgacggggaggaatacgagtggaaagagacagcgcgctggttgaagttcgaagaggacgtggaagatggcggcgataggtggagtaagccttatgtcgccaccctgtctctacactctctgttcgaactccgatcctgtatattgaacggcaccgtcatgttagatatgcgggcttccaccctggacgaaatcgcagatatggtactagataatatgattgccagcggccagttggacgagtctattagagagaacgtgcgcgaggcgctgctcaaacgacaccatcatcagaacgaaaagcggttcacaagcaggatacccttagtaaggtccttcgcagacatcggaaagaagcactctgacccacacctgctcgaaaggaacgggatcctcgcttctccccagtcagcacccggcaacctggacaattccaaatccggcgagattaagggaaatggctccggtgggtcccgggagaattcgaccgtcgatttctcgaaagtggacatgaattttatgcgaaagattccgaccggtgctgaagcttcaaacgtgctcgtcggcgaggtcgacttcctggaacgccctatcattgcctttgtgcgactggcccctgcagttctcctgactggactgactgaagttcctgttccaacccgtttcctgttcctgctgctaggacctgccggaaaggctcctcagtatcatgagatcggaaggtcgatcgctacactgatgacagatgagattttccatgacgttgcctacaaagccaaggataggaatgacctgctgtccgggatcgatgaattcctagaccaggttacagtgctccctccaggtgaatgggatccgtcaatacggatcgagcccccaaagagcgtacctagccaggagaagagaaagattccagtatttcacaacgggtcaaccccaaccctcggtgaaactccaaaggaagccgcgcaccatgccgggcctgagcttcaaagaacagggcgtctgtttgggggtcttattttggacatcaagcggaaagcgccgttttttcttagcgatttcaaagacgccctgtccctgcaatgcctggcaagcatcctgttcctgtattgtgcctgcatgagcccggtcattacattcggcgggctcctgggggaggctaccgagggtcgtatctccgccatcgaatccctcttcggagcaagcctgacaggcatcgcatatagtctcttcgcagggcagccgctgactatactcggaagtactggacccgtgctggtattcgaaaagatcttgtacaagttctgccgggattatcagctgtcctatctgtccctcaggactagtattggattgtggacttctttcctctgcattgtcctggtagccacagacgcctcatccctggtctgttacatcactaggttcaccgaagaggccttcgccgctctcatttgcattatttttatctacgaagccctggaaaagcttttcgatttaggggaaacttacgccttcaatatgcacaataacctagataaacttacaagctactcgtgcgtttgtactgagcccccaaatccgagcaatgaaactctggcccaatggaagaaggataacataactgcccacaacattagctggcggaatctgaccgtgtccgagtgtaagaagcttagaggggtcttcttagggtctgcttgtggccatcatggtccatacatccccgacgtgctgttctggtgtgtgattctcttcttcaccacgttcttccttagctccttcttaaaacaattcaagaccaaaagatactttccaactaaagtgaggtctactatcagcgacttcgcagtatttctcacaattgtgatcatggtgactattgactatttggtaggggttcccagtccaaagctgcatgtgcctgaaaagtttgaacctacacaccccgagaggggttggattatcagtcctctcggagataatccatggtggaccctgcttatcgctgcaattccagcgctgctatgtaccattctgattttcatggatcagcagatcaccgcagtgattatcaatcggaaagaacataaattgaagaagggcgccggatatcatctcgatctgctcatggttggggtgatgctgggagtctgcagtgtgatgggcctgccgtggtttgtggctgctacagtgctttcaatcagccatgtcaattctttaaaggtcgaaagtgagtgctcagcaccgggggagcagcctaagttcctgggaattcgggagcagagagtgactggccttatgattttcatactaatgggactgtcggtcttcatgacatcagtactgaaattcatccccatgcccgtgctgtatggtgtgtttttatacatgggtgtctcctctctgaaaggcatccaactcttcgaccgtatcaaattatttgggatgccagccaaacaccagccggacttaatctacctgcgctacgtccccctgtggaaagtacatatctttaccgtaatccaactgacatgcctcgtgctactgtgggttatcaaagtaagcgctgccgctgtagtctttccaatgatggtcctggcgctggtgttcgtacggaaactgatggacctctgtttcaccaagcgcgaactgtcctggctggacgatctcatgcccgagagtaaaaaaaagaaagaagatgataagaaaaaaaaggaaaaggaagaggctgagcgaatgctgcaggacgatgacgatactgttcacctgccttttgagggcgggagcctgctccagataccagtaaaggccctaaagtactcagtggatccaagcattgtgaatatatcagatgagatggccaaaaccgcccaatggaaagccctgtctatgaacaccgagaacgctaaggttacaaggtcaaatatgtcacctgataaaccagtgtccgtgaagatctccttcgaggacgagccacgaaagaagtatgttgatgccgaaacatctctttag

SEQ ID NO: 135427 - DNA, 1392 bp, Artificial Sequence
  Description of Artificial Sequence: Synthetic coding sequence
atggaagccgacggggccggcgagcaaatgcgcccacttcttacaagaggccctgatgaagaggccgtggtagacctggggaagacgagctccactgtcaatacaaagttcgagaaggaagagctcgaaagtcatcgtgcggtttatatcggtgttcatgtgcctttcagcaaggagagtagacgtcgccatcgtcacagaggtcacaagcatcaccaccggagacggaaagataaggaatcagataaagaggatggcagagagagtccaagctacgatactccgtcccagcgcgtgcagtttatactgggcaccgaggatgacgatgaagagcacatcccacacgacctgttcacagagatggacgagctctgttatagggacggggaggagtacgagtggaaagagacagcccggtggctcaagttcgaggaagatgtcgaagacggaggcgaccgatggtccaagccctacgtggccaccctgtcccttcacagtctgtttgagctgagatcatgcatcttaaacgggaccgtgatgctcgacatgcgtgcctccactctggatgagattgcagacatggtgctggacaacatgattgccagcgggcagttagatgagtcaatcagagagaacgtgcgggaagcactcttaaagcgccatcatcatcagaacgagaagcggttcacctctaggattcctctggtaagaagtttcgctgacattggaaagaagcacagcgatccccatcttctggagagaaacggaattttagccagtccccaatccgccccaggcaatctggacaactccaaaagcggagaaatcaagggaaacggcagcggaggttccagggaaaacagcaccgtcgatttctccaaggtagatatgaatttcatgaggaaaattccgaccggcgcagaagccagcaacgttctggtgggggaagttgactttcttgaacgccctatcattgctttcgtgcggctagctcctgctgtgctccttacaggcctgaccgaagtgcccgtccccactcgattcctattcttattactcggccccgctggcaaagctccacagtaccatgaaataggtcgtagtatagctactcttatgaccgatgaaatcttccacgatgtggcctacaaggccaaggatcggaacgacctattgtccggtatcgacgagttcctggatcaggtcacagtgctcccaccaggcgagtgggacccatcgatccggatcgaaccccccaagtccgtgccttcccaggagaagaggaagatccccgtctttcacaatggtagcactcctacactgggggagactcccaaagaagcggcccaccatgcagggccagagctgcagaggaccggtcgcgtgcaatag

SEQ ID NO: 135428 - DNA, 3135 bp, Artificial Sequence
  Description of Artificial Sequence: Synthetic coding sequence
atgcccgctgctggaagtaatgagcctgatggggtgctcagttaccaacgccctgacgaagaggccgtcgtcgaccagggcggaacatcaaccatcctgaacatccattacgaaaaagaggagctggaggggcataggacgctctacgtcggtgtgcggatgccacttggtagacagtcccatcggcaccatcggacccatggccagaaacaccgacggagaggcagaggcaaaggagccagtcagggcgaggagggacttgaagcccttgcacacgacaccccatcccaacgtgtccagttcatactcggcaccgaagaggacgaggagcacgtacctcacgagctgttcaccgagctggatgagatatgtatgaaagaaggtgaggacgctgagtggaaggagaccgctagatggctgaaattcgaggaagatgtggaggacggcggagaacgttggtcaaagccctacgtcgctaccctgtcgctacactccttattcgagttaagaagctgccttatcaacggaaccgtgctgctcgacatgcacgccaattctatcgaagaaatcagcgatctgattttggatcagcaagagctttcatctgatctgaatgacagcatgcgagtgaaggttcgggaagctctgctgaagaaacaccatcaccaaaatgaaaagaagcggaataaccttatccccatagtcaggtctttcgcagaagtcgggaaaaagcaatctgacccacacctgatggacaagcacggccagacagtcagtccacaatctgtacctaccacaaacctggaggttaagaacggcgtcaactgtgagcatagccctgtggatctgagtaaagtggacttgcacttcatgaagaagatacctacaggtgccgaagcttctaatgtgctggtcggagaggtggacattttggaccgtccgatcgtcgccttcgtcaggctgagtcctgctgtgctgctgtccggtctgacagaggtaccaattccaaccagatttctgttcatcctattagggcctgtgggaaagggtcagcagtaccacgaaataggcagatcaatggccaccatcatgacggacgaaattttccatgacgtcgcctacaaagccaaggagcgtgacgacttgctggcaggtattgatgagtttctcgatcaggtcaccgtgctccctcccggagagtgggaccctagtatccgaatcgagccccccaagaacgtgcccagtcaggagaaaagaaaaatgccaggagtccctaacgggaacgtttgccacattgaacaggaaccccatgggggacattccgggcccgagctccaacgcacaggacgtttgtttggcgggcttgtcctcgacattaaacgcaaggccccctggtactggtcagactaccgcgacgcgctctccctgcagtgcctggcaagtttcctttttttgtactgtgcgtgtatgtcaccagttatcacatttgggggacttctaggcgaggcaactgaagggcgtatctccgcgattgagagtctattcggggcatctatgacaggaatagcctacagtctgtttgccggccaagctctcacaattctgggatccaccggcccggtgcttgtgtttgagaagatactctttaaattctgcaaagactacgcccttagctatctgagtctgagagcatgcattgggctttggaccgcatttctgtgcatagttctcgtggccacagatgcctcatcccttgtttgttacatcactaggtttacagaagaagcattcgctagcctgatatgcattatctttatatacgaagctatcgagaaacttatccaccttgcagagacataccccatacacatgcactcacagctggatcacctgagcctctattattgccggtgcacactgcccgaaaaccccaacaatcacactcttcagtattggaaagaccataacatcgtcacagcagaagttcattgggccaacctcaccgtgagcgagtgccaggagatgcacggcgaatttatgggcagtgcatgcggccatcacggcccctacaccccggatgtgctcttttggtcctgcatcctattttttaccacattcatcttgagctcgaccctcaaaacatttaaaacttcccgatactttccaacccgagttcgcagcatggtttctgatttcgcggtcttcctcaccatcttcacaatggtcattatcgactttctaatcggcgtcccatcacccaaactgcaggtgcccagcgtttttaagcctacccgcgacgatcgcggatggattatcaaccctatcggaccaaacccgtggtggaccgtgatcgccgctatcatccctgcactgctgtgtacaattttaattttcatggaccagcagattactgctgtaatcattaaccgcaaggagcataagttgaaaaaggggtgcggctatcacctagacctcctcatggtggccatcatgctcggggtttgcagcatcatggggctaccttggtttgtggctgcaaccgtgctttcgattacacacgtaaatagcctaaagctcgagagcgaatgctctgcgccaggggaacaacctaaattcctgggcattagagaacagagggtgacggggttgatgattttcgtgctgatgggttgtagtgtcttcatgactgcgatcctcaagttcatcccaatgcctgtactgtacggcgtttttctctatatgggcgtcagctccctgcagggaatacagtttttcgatagattaaagttatttggcatgcccgctaaacaccagcctgattttatttatcttaggcatgtgcccctgcgcaaagtgcacttgtttaccctaatccaattaacatgtcttgtactgctgtgggtgatcaaagcctcccccgctgctatcgtgtttccgatgatggtactcgctctagtgttcgtaagaaaggtcatggatctgtgtttcagcaaaagggagctgagttggttggacgatctgatgccagagtccaaaaagaagaaactagacgacgccaaaaagaaggccaaagaagaggaggtgatcgtactggctccaacagtttatttaggagcctccaactacagaacctag

SEQ ID NO: 135429 - DNA, 3216 bp, Artificial Sequence
  Description of Artificial Sequence: Synthetic coding sequence
atgtttaacaaaaataactctaacaagctgaggagtacacccaggtatcgccgtggggatcccggatacctgaacttcaccgagctgggtcccctgaaacccgaacagaaagatcagtggtctcagcatagaccagacgaggaagccgtggtggaccaggggggaacctctactatcctgaatatccattacgaaaaggaagagctggaagggcatagaaccctgtacgttggagtgaggatgcccctgggccgacagtcacacaggcaccataggacgcacgggcagaaacaccgccgtcgcggccgaggcaagggcgccagccagggcgaagaggggcttgaggcactggcccatgacaccccgtcccagcgagtgcagtttatactcggaacagaggaggatgaggagcatgtaccccacgagctgttcactgagttggacgagatttgcatgaaagagggggaggatgcagagtggaaggaaaccgccagatggctgaagtttgaggaagacgtagaagacggcggggaacgatggagcaaaccctatgttgcgacattgagtctgcacagcctattcgaattacgttcctgcctcatcaacgggacagtgttgcttgatatgcatgcaaactcaatcgaggagattagcgatcttatcctggatcagcaggagctttcttccgatctcaacgacagcatgagggtcaaggtgcgggaggccttactgaagaagcatcaccaccagaatgagaaaaagcggaataatctcatccctattgtgagatcattcgctgaagtgggtaaaaaacagtccgatcctcacctcatggacaagcacggtcagacggtttcaccccagtccgtgccaacaaccaacttggaagttaagaatggcgttaactgtgaacatagcccagtcgacctttctaaagtcgatctccacttcatgaaaaagatccctaccggtgcagaggcctctaacgtcctggtgggggaagtcgacatcctcgaccgacccatcgtagccttcgtaaggctgtcccctgcagtgctcctgagcggtcttacggaagtgccaatccccacaaggttcttgtttatattgcttggcccggtggggaagggccagcagtaccacgagattggacgttccatggctaccatcatgaccgatgaaattttccacgacgttgcttacaaggccaaagagagggatgatctgctggctggcatagatgagttcctagatcaagttacagtactcccgcctggggaatgggacccatcgattaggattgagcctccaaagaatgttccctcacaagagaaaagaaagatgcctggagtgccaaacggaaacgtctgccacattgagcaggaaccccacggagggcactcaggcccagaactccagaggactggtaggctgttcgggggcttagtactggatatcaagcgtaaggctccttggtactggtctgactaccgcgatgctctgtctctacaatgtctggcctcctttctctttctgtactgcgcatgcatgagtccagtgatcacatttgggggcctgctaggagaagctaccgaggggcgcatcagtgcgatcgaatccttatttggggcttcgatgaccggcatagcttattcgctatttgctggtcaagccttgaccatcctcgggagcactgggcccgtgcttgtgtttgagaagattctgttcaaattctgcaaagattacgcactgagctacctgagcctgagagcctgcattggcctgtggactgcctttctgtgcatcgtacttgtagcaaccgacgcttcttctctcgtttgttatatcacacgatttaccgaagaggcgttcgcctccctgatttgcatcatcttcatctacgaggcgatcgaaaagcttatacaccttgcggagacgtatccaattcacatgcattcccagctagaccatctgtcattgtattattgcagatgcactctgcctgagaatcccaataaccacaccttacagtactggaaagaccacaatatagttactgccgaagtccactgggctaacctgaccgtaagcgaatgccaagagatgcatggtgagtttatgggaagcgcgtgtgggcatcacggcccctacacaccggacgtattgttctggtcctgtattctttttttcaccacattcattctctcctctaccttaaagactttcaagacttcaaggtacttcccgacgcgagtccggtccatggtaagtgactttgccgtgtttctcaccatcttcacaatggttataattgatttcctgataggggtcccgtctcccaaactgcaggtgccatcagtctttaaacccaccagggacgatagaggctggatcatcaaccccatcggacctaatccatggtggacagtaatcgcagcaatcatccccgcactcctgtgcactatcttaatttttatggatcaacaaatcacggctgtcatcatcaatcggaaggagcacaagctgaagaaggggtgcggctatcacctggacctgctcatggtggcaatcatgctaggcgtgtgcagcatcatggggttgccctggttcgtggcagctaccgttttaagtattacacacgtgaactccctgaagcttgagagcgagtgttctgcccctggggagcaacctaaattcttggggattcgcgagcaaagggttacagggctaatgatcttcgttctgatgggctgtagcgtttttatgacagccatactgaagtttattcctatgcccgtactgtacggggtgtttctctatatgggggtgtcttctcttcagggcattcagttctttgatcgtctgaaactctttggaatgccggcgaagcatcagcccgacttcatatacctgcgtcatgtaccactccgcaaggttcatctgtttaccctgattcaactgacatgcctggtgctattatgggtgattaaagccagccccgccgctattgtgttccctatgatggtgcttgctctggtctttgttagaaaagtgatggatttgtgctttagcaagcgggaacttagctggctggatgacctaatgccagaatctaagaaaaagaagctggacgacgcaaaaaagaaggccaaggaagaggaagtgatcgtgcttgctcccacagtttacctgggtgcctctaattatcgcacctag

SEQ ID NO: 135430 - DNA, 2244 bp, Artificial Sequence
  Description of Artificial Sequence: Synthetic coding sequence
atgccattaggcagacagagtcacagacaccaccgaactcacggtcagaagcacagaagaagaggcaggggcaagggagcgagtcagggagaggagggactggaagccctggcacacgataccccaagtcagcgagtccagtttattctcggcaccgaggaggatgaggaacacgtgccccatgagcttttcaccgagttggacgagatttgtatgaaagaaggcgaggatgcagagtggaaagagaccgcgcgctggctcaagttcgaagaggacgttgaggatggcggcgagagatggtcgaagccctacgtagccaccttatctctgcacagcttgttcgagttgaggtcttgtctcattaacgggacagttctgctggacatgcacgcaaactcaatcgaggagatatctgatttgatcctcgatcaacaagagctttcttcagacctgaatgattcaatgcgggtgaaggtcagagaggccctgctgaagaagcaccatcatcagaatgagaagaagcgaaacaacctgattccaattgtgcgaagctttgccgaagtcggaaaaaagcagtctgacccccatttgatggacaagcacggccagacagtttcacctcagagtgtgccgaccaccaacttggaggtgaaaaacggcgtcaactgtgagcacagtccagttgacctttctaaggtagacctgcatttcatgaagaaaataccaacgggcgctgaagcctcgaacgtcctggtcggagaagtggacattttggaccgtcccattgtggcattcgtgagactgtctcctgccgtccttctctcaggtctgacagaggtccccatcccaacccggtttttgttcatcctgttgggaccagtggggaaggggcagcagtaccatgaaattgggaggagcatggccacaataatgacggacgaaatcttccacgacgtcgcttataaggccaaagaaagagacgacctgctggctggcatcgatgaatttttagaccaagtcaccgtgcttccaccaggtgagtgggatcctagtatcagaatcgagcctcctaaaaatgttccatcccaggaaaaacggaaaatgccaggagttccgaacggaaatgtctgccacattgagcaagaaccacacggagggcacagcggcccagaactccagcgcaccggccgactgtttgggggcctcgtcctcgatatcaagaggaaggctccctggtactggtcagactatcgcgacgctctttcactgcagtgtcttgcctccttcctgtttctgtattgtgcatgtatgtcccccgtgattacctttgggggactgttaggcgaagccaccgaggggcgcattagcgccatcgaaagcttgttcggggcctctatgaccggcattgcatattccctctttgccgggcaggcactcactattctcggttctactgggccggtactggtttttgaaaagatcctgttcaagttttgcaaggactacgcactgagttatttatctctgagagcttgcatcggactgtggaccgccttcctctgtatcgtcctggttgccaccgacgcctcaagcctggtgtgctacatcaccagatttaccgaagaagcttttgcaagtcttatatgtattatcttcatctacgaagctatagaaaaactgattcaccttgctgagacctaccctattcatatgcactcgcaactggaccatctgagcctgtactattgtcgctgcacgttacctgaaaatcccaacaatcataccctgcagtactggaaagaccacaatatagtgaccgctgaagtgcattgggctaacctaacagttagcgaatgtcaggagatgcatggcgagttcatgggaagtgcctgcgggcaccacggtccctataccccagatgtgctgttctggtcttgcattttgtttttcaccacattcattctctcaagtacgctaaagacatttaagactagcagatattttcccactaggatggagtcttgcagcgtcgcatggctcgaatgcggaggggtgatccttgctcactgtaacttgcggctcctcccaagcagttgggattataggcacgctcctccccaaccagccaatttttgtatcttcagccgggatggtgtcagtccttgctggcctggttggagtcaaagcctggacctagtgatctgtctgcctagaccgcccaaaatgctcggcctgcaagcctag

SEQ ID NO: 135431 - DNA, 3282 bp, Artificial Sequence
  Description of Artificial Sequence: Synthetic coding sequence
atgcccgcagctggctctaatgagcccgatggcgtcctaagttatcagagaccagacgaagaagccgtggttgatcagggcggcacaagcactatactgaacatccactacgaaaaggaagagctcgaaggccacagaacactgtatgtgggcgtcagaatgccgcttggaaggcagagccataggcaccacagaacccatggccagaagcatcgccgccggggccgcggcaagggggcttcccagggcgaagaaggcctggaggccctggcgcatgacacccctagtcaaagagtgcaatttattcttggcacagaagaggatgaggagcacgtcccccatgagctatttacagagctggatgagatatgtatgaaagagggggaggatgcagaatggaaggagacagcccgttggctcaagtttgaagaagatgtggaggacgggggcgagcgctggtctaaaccttacgtggccactctgtcactgcacagcctttttgaattgcgttcatgcttaattaacggaactgtgctccttgacatgcacgccaattccatcgaagaaatctcagatctgatactggaccagcaagagctaagctccgacctgaatgactctatgcgggtaaaggtgcgagaggcgctcttgaaaaaacatcaccaccaaaatgagaaaaaaagaaataatctgatccccattgtcaggagttttgcagaagtgggcaagaaacaatcagatccccacttaatggataagcacgggcagacagtgagccctcagtcagtccctacaactaacctggaagtcaaaaacggggtgaattgcgagcatagcccggtggacctgagcaaagtagatctgcattttatgaaaaagatacctaccggtgctgaagcgtcaaatgtgctagtcggtgaagtggacatcttagacagaccaatagtggcctttgtcagactctcccctgctgtgctactgagtgggctgaccgaggtccctattccaactaggtttctgtttatcctcctagggccagttggaaagggacaacaataccatgagattggaagatcgatggctaccatcatgactgacgaaatcttccacgatgtggcatataaagcaaaggaacgggacgatttgcttgcaggtattgatgagtttttggatcaggtgacagttcttcctccaggtgagtgggatcccagtattcgtatcgaacctcctaaaaatgttccttcccaggagaaaagaaagatgcctggtgtcccaaatggtaacgtttgccacattgagcaggagccacacggaggccatagcggtcccgagctccagcggactgggaggctgtttggcggtctcgtgttagacataaagcgcaaagccccttggtactggtccgactacagagatgctcttagccttcaatgcttagcctccttcctctttctctactgtgcttgcatgagccctgttatcacatttggcggccttctgggagaggctacagagggaaggatttcagcgattgagtccctgttcggagcctctatgaccggaatcgcatattctctctttgccggtcaggcacttacaatacttgggagtacagggccagttctcgtgttcgaaaagattctgttcaagttctgcaaggattacgcactgagttacctgagtctgcgggcctgtatcggactctggactgcgtttttatgcatcgtactggtggcaactgacgctagcagtctggtctgttacatcacccggtttacagaagaagcgttcgctagcctcatttgcattatctttatttatgaggccatcgagaaactgattcaccttgcagagacttatccaatccacatgcattcgcaactggatcatttgtcactgtattattgccgctgtaccctacctgaaaatcctaataatcataccctccagtactggaaggatcacaatatcgtaacagcagaagtgcactgggccaacctgaccgtatcagagtgccaggaaatgcatggggagtttatggggtctgcatgcggacaccacgggccatatactcctgatgttcttttttggtcctgcatcctgttttttaccacattcattctgtcctctaccctcaagacttttaaaacatccaggtactttccgacacgcgtgcgtagcatggtcagcgactttgccgtgttcctcacaatctttaccatggttatcattgactttctgatcggcgtgcctagcccaaaactgcaagtgccatccgtcttcaagcctacccgagatgacaggggctggatcattaacccaattgggcccaacccatggtggaccgtcatcgctgccattatccctgccctgttgtgtacaatactgattttcatggatcaacagatcacagccgttataatcaacagaaaagagcacaaacttaaaaaagggtgtggctatcacttggacttgctgatggtcgccatcatgctgggggtgtgtagcatcatgggtctgccctggtttgttgcagccacagtacttagcatcacacacgtgaacagtctcaagctggaatccgagtgttctgcgcctggggagcagcctaagttcctcggaataagggaacagcgtgtcacgggcctgatgatttttgttctgatggggtgcagcgtctttatgactgctattctaaaatttatccctatgccagtgttatacggcgtgtttctctatatgggcgtcagttcgctccagggcattcagttctttgaccggctgaagctctttggaatgcctgctaagcaccaacccgactttatttatctgcgacacgttccattgaggaaagtgcatcttttcactctcatacagcttacctgcttagtgctgttgtgggttataaaggcatcaccagccgctatagtcttccccatgatggtactcgctctggtttttgttcggaaagtcatggacttgtgcttcagtaagagagaactgtcctggctggacgacctgatgccagagtctaagaagaaaaagttggacgatgccaaaaaaaaagctaaagaagaggaagaggctgagaagatgctcgagattgggggagataagttcccgttggaaagccggaagctgctttccagccccggaaagaatatttcatgtcgctgtgatccttctgagattaacatttccgatgagatgcccaagacaacagtctggaaggcactttctatgaattctggcaacgccaaggaaaagtcgctgttcaactag

SEQ ID NO: 135432 - DNA, 1917 bp, Artificial Sequence
  Description of Artificial Sequence: Synthetic coding sequence
atgcctctggggaggcaaagccatcgccaccatcgcactcacggacagaagcatcggagaagggggcggggtaaaggcgccagccagggagaggaaggcctcgaagccctagcccatgacaccccctcccagagagtgcaatttatcctcggcactgaagaggatgaagagcacgtgccacacgaattgttcaccgaattggacgagatttgcatgaaagagggtgaggatgctgaatggaaagaaactgcccgttggcttaagtttgaggaagacgtcgaagatgggggagagagatggtccaagccatacgtagccactctctccctacattcactgttcgaactccgcagttgcctaattaacgggaccgtgctgctggacatgcacgcgaacagcatagaggaaatatccgacctcatcctggatcagcaggaactttcctccgacttgaatgactccatgcgcgtgaaggtgcgggaggccttgctgaagaagcatcatcaccagaatgaaaagaagcgcaataacctcatccctatcgtcaggtcatttgcagaggtgggcaagaaacagtccgatccccacttaatggataaacatggccagacggtatcccctcagtccgtgcctacaacgaacttggaggtcaagaacggagtcaactgcgagcactccccggtcgatctgagcaaagtggatctccactttatgaaaaaaatacctacgggagcggaagcctccaacgttcttgtcggagaggtggacattctggatcgcccaatcgtggctttcgtgcggctgtcccccgcagtactgctatctgggctgaccgaagtgccaattccgacacgttttctctttatcctgttgggcccagttggcaagggccagcagtatcatgagataggccgtagcatggccacaatcatgaccgatgagatattccatgatgtggcctacaaggcaaaggaacgcgacgatttgttagcaggcatcgatgagttcctcgaccaggttacagtgctcccgccaggagaatgggatccttcgatacgcattgaaccgccaaaaaatgtgccctctcaggagaaacggaaaatgcccggggtcccaaatggaaacgtttgtcacatcgagcaggaacctcacggcggccactccgggccagagctccagcggacaggacgccttttcggtggcctggtgttggatattaaaaggaaagcgccatggtactggtctgattaccgcgatgccctgtccctccagtgtctggcatctttcttgttcctgtattgcgcttgcatgagtccggtgattacattcggagggctgctcggcgaggccacggaagggagaatatccgctattgagagccttttcggcgcaagcatgacaggaatagcttattcactgttcgccggacaggctctcacgatcttgggatccaccggtcctgtccttgtcttcgaaaagatcctttttaaattctgcaaggattacgccctgtcgtacctgagtcttcgagcttgtatcggactgtggacggcctttctgtgtatcgtgctcgttgccaccgatgcaagttctctggtatgttacatcacgcggtttacagaagaggcgtttgcgagcctgatatgcattatcttcatctatgaagcaatcgagaagctcatccacttggcagagacttacccaattcacatgcattcccagctggaccatctgagcctttattactgtcgctgcacccttcctgagaaccccaacaatcatactttacagtactggaaggatcacaacatcgtgactgctgaagtgcattgggctaacctcactgtatcagtaagcctcggcgctgcaagatgcccctctattgttacgaccgggcttggtggcacctcgaagtag

SEQ ID NO: 135433 - DNA, 2976 bp, Artificial Sequence
  Description of Artificial Sequence: Synthetic coding sequence
atgccgttaggtcgacagagccacaggcaccacaggacacatgggcagaagcacagacggcgtgggcggggtaaaggagctagccaaggtgaggaagggctggaagctctcgcccacgacaccccaagtcagagagtgcaatttattctgggcactgaggaagatgaagagcacgtgcctcacgaactcttcaccgaattagacgaaatatgcatgaaggaaggcgaggatgcagagtggaaggagaccgctcgttggctgaaatttgaagaagatgtcgaggacgggggcgagaggtggtctaagccctatgtggccactttgagcctgcactcactatttgagcttcgcagctgtttgatcaacggcacagtgttgttggatatgcacgcaaattctatcgaggaaatctctgacttaattctggaccagcaagaattatcaagcgacctcaatgacagcatgcgggtgaaggttagggaggccctactcaaaaagcaccaccatcagaatgagaaaaaacggaacaatcttattcctatagtgagatccttcgctgaggtcgggaagaaacagtccgatccgcacctgatggacaagcatggccagacagtgagcccgcagtccgtaccaaccactaacctggaggttaagaatggcgtgaactgtgaacattctccagtggacctgtctaaggtcgacctgcacttcatgaagaagattcctactggagccgaagcctcaaatgtgctggtgggagaggtggacattctggacagaccgattgtggcattcgtccgtcttagccctgccgtccttctctcaggcctgactgaagtgcctattcccacacgcttcctatttatcttgcttgggcccgtcggcaaagggcagcagtatcacgagattggtaggtctatggcgaccataatgacagacgaaatatttcacgatgtggcttataaggcaaaagaacgagatgacctgctggctggtattgacgagtttcttgaccaggttaccgtgttgccccccggggagtgggatcctagcattcgcatagagccacctaaaaatgtgccttctcaagagaagcggaaaatgccaggcgtcccaaacgggaacgtgtgccacatcgagcaggagccacatggcggacattccgggcctgaactgcagagaaccgggagactttttggtggtctggtcttggatattaagagaaaagccccctggtattggagcgattaccgcgatgctctcagcttgcagtgcctcgcttccttcctttttctgtattgtgcctgtatgagccccgtgatcaccttcggtggtctgttaggagaggcaactgagggccggatttctgccatagagtccctgttcggggccagcatgaccggcatagcatattcactgttcgcaggccaggctctgaccatcctgggcagtacaggtcccgttctggtgttcgagaagattctgttcaagttttgcaaggattacgcactgtcctatctgagcctgagagcgtgcatcggcctgtggactgccttcctgtgcatcgtcctcgtggccactgatgctagttcattggtgtgctatatcacccgatttactgaggaagcttttgcctctctcatttgcatcatatttatttacgaagccatagaaaaactcatccatctggcagaaacatatccgattcacatgcattcacagttggaccacctgagcctttactactgcaggtgtacgctgcccgaaaaccccaataaccatactctccagtactggaaagatcataatatcgtgactgccgaagtgcactgggccaacctgacagtgagcgaatgccaagaaatgcatggggagttcatggggagcgcgtgtggacaccacggcccctatacgcccgatgtcttgttctggagttgtatcctgttctttaccacatttatcctctcctcaaccctaaagacctttaagacatcgagatattttccaactcgtgtgcggtcaatggtttctgattttgcagtttttctgaccattttcacaatggtgattattgacttcctgatcggcgtgcctagcccaaaactccaggtaccgtcagtttttaaaccgacgagggacgacaggggttggatcatcaacccaatcgggcctaatccatggtggactgtcattgctgccatcattcctgccctgctctgtacaatcttaatattcatggatcaacagatcaccgcagtcatcattaaccggaaagagcacaagttgaaaaaaggatgcgggtaccacctggatttgttgatggtggccatcatgctgggcgtgtgctcaatcatgggcctgccatggtttgttgccgcaacagtcttgtctatcactcacgttaactccctgaagcttgaaagcgagtgttccgctccaggcgagcagccaaagtttctgggcattagagagcagagggtgacagggctgatgatcttcgtccttatggggtgctccgtgtttatgacagccattctcaaatttatcccgatgcctgtcctctacggcgtttttctttatatgggcgtgagtagcctacagggcatccagttctttgaccggcttaaactgtttggtatgcccgcaaaacatcagcccgacttcatctacctgcgacatgtcccgttgaggaaggtccatctatttactcttattcagttgacctgcttggtgctcctctgggtcatcaaagcgtctccagccgccatcgtcttcccgatgatggtactagccctggtttttgtacgtaaagtgatggatctgtgtttcagtaagagagaattgtcctggctagacgatttgatgcccgaatctaaaaaaaagaagcttgacgatgctaagaaaaaggccaaggaagaggaagtcattgtactggcgccaacagtttacctgggcgcgagtaactacaggacttag

SEQ ID NO: 135434 - DNA, 3321 bp, Artificial Sequence
  Description of Artificial Sequence: Synthetic coding sequence
atggagataaaggaccagggtgctcagatggagcctctgctcccgacaaggaacgatgaagaggctgtggtggaccgtggtggaaccagatcgattcttaaaacccattttgaaaaagaggacctggagggccataggaccctttttatcggagtccacgttcctctgggcggcaggaagagccacaggagacaccggcaccgaggccataaacaccggaagcgagatcgcgagcgagattctggcctggaagacgggcgggaatcaccgtcttttgacacgccgagtcagcgagtacagttcatccttgggaccgaagatgacgatgaggagcacattccccacgatctcttcacagaactagatgagatttgctggcgcgagggtgaagatgccgaatggcgtgagaccgctcgctggctcaagtttgaagaggacgtcgaagatggtggtgaacggtggtccaagccatatgtcgccacgctcagtctgcactctctatttgagttgcgctcttgcatccttaatgggactgtcctcctggacatgcatgctaatacactggaggagattgccgatatggttttggatcagcaggtgtccagcggccaattgaatgaggatgtccgccacagagttcatgaagccctcatgaaacagcaccaccaccagaaccagaagaaactgaccaatagaatccccatagtcaggagctttgcagacataggcaaaaagcaatctgaaccgaattcgatggataagaatgccggacaagtggtctcccctcagtctgcacctgcatgcgtggaaaacaagaatgatgtgtcccgggagaacagcaccgtcgacttttctaaagtcgacctccacttcatgaagaaaatcccacccggagccgaagctagcaatatcctcgttggtgaactggagtttctcgatcgcacagtcgtggcattcgtccgactgtcccccgctgtcctgctgcagggactcgcggaagtgcctatccctacccgcttcctcttcatcctattgggtcctcttggcaaagggcaacagtatcatgaaattggcaggtccattgctaccttaatgaccgacgaggtcttccacgacgtggcatataaggccaaggataggaacgatctcgtgtctggaatcgatgagtttctggaccaggtgaccgttctgccccctggtgaatgggatccctctatacggattgagccacctaagaatgtacccagtcaggagaagcgtaagatccccgcggtgccgaatggaacagcggcacatggcgaggcagagccccatggtggacactcaggccctgagcttcagcgcacgggcaggatctttggcggcctgatcctagatatcaagcgtaaggctccttacttctggagcgattttcgagacgcgttttctctgcagtgtcttgccagttttctatttctgtattgtgcatgcatgagtccagttattacctttggaggtctgctgggcgaggctacggaagggaggattagtgctatcgagtcgcttttcggtgcatctatgactgggatcgcttactcattatttggcggccagcctctcaccatcctggggtccaccggccccgtcctggtgttcgaaaagattttgttcaaattctgtaaagaatacggtctgagttacctctctctgcgagcgtcaattgggttatggactgcaacgttatgcatcatactggtcgctacggacgcatcaagcttggtgtgttacataacgcgattcaccgaagaagcgtttgcatctttgatttgtatcattttcatctacgaagccctagagaagctattcgagctgtcggaggcgtatcccatcaacatgcataatgacttagaactcctgacacagtacagttgtaattgtgtagagcctcacaatccctcgaacggcacactgaaggagtggagagagtccaacatcagcgcctctgacatcatttgggagaacctgacggtgtcggagtgcaagagtctccatggggagtacgtgggccgagcttgcgggcacgatcatccctatgtgcccgatgttttgttttggtctgtgattttattcttctctaccgttaccctgtctgcgacactgaagcaattcaaaacttcccggtatttcccaactaaagtacgtagtatcgtgtctgacttcgctgtgtttctgactatcctgtgcatggtgctgattgactacgccatcggcattcccagtccaaagcttcaggtaccttcagtcttcaaacccacaagagatgacagggggtggtttgtgactcctctgggacctaacccatggtggactgtgatcgccgctatcatacctgcactcctctgtacaattttgatttttatggatcaacaaatcactgcggtaataataaaccggaaggagcacaaattgaaaaagggctgcgggtaccacctggacctgttaatggtggcggttatgctgggagtgtgctcgattatgggcctcccctggtttgtggcagcgactgtcctgtccattacccacgtgaacagtttgaagctcgagagcgagtgtagcgcacccggtgaacagcccaaatttctaggtattcgtgagcagcgagtcacaggactgatgatcttcatcctgatgggttccagcgtattcatgacttctatcctaaagttcatccctatgcctgtactgtacggggtgtttctgtacatgggcgcatcaagcctgaaaggcatccaatttttcgatcggatcaaattattttggatgccagcaaaacaccagccggacttcatctacctgaggcatgtgccccttcggaaagtccatctgtttaccattatacaaatgtcctgcttaggtctgctttggatcatcaaggtgtccagagcagctatcgtgtttcctatgatggtccttgccttagtctttgttcggaagctgatggacctcctcttcactaaacgcgaactctcctggctagatgatttgatgccagaatccaagaagaagaagctcgaggacgccgagaaagaggaggagcaaagtatgctcgccatggaagacgagggaaccgtgcagctaccactggaggggcactatagagatgatccatccgtcattaatatcagtgacgagatgagtaagaccgccctttggagaaacctgcttattaccgccgacaactcaaaagacaaggagtcctccttcccctctaaatccatcgaatcacgtaaggaaaagaaggctgattccggaaagggagtagacagagaaacatgcctctag

SEQ ID NO: 135435 - DNA, 3300 bp, Artificial Sequence
  Description of Artificial Sequence: Synthetic coding sequence
atgcagagcctgggcgtcagcggaaataggaaagtgatgcagtcgggcacctgtgagccgtttcaatcactttcacaccagcggaatgatgaagaagccgttgttgatagagggggcactcgctctattcttaagacacacttcgaaaaggaggatctcgagggccaccgcacactgttcataggggtgcacgtgccacttggggggagaaagtcccacagaagacacagacacagaggccacaagcacagaaagcgcgaccgggagagagatagcgggctggaagacggccgcgagtcaccgtcatttgacaccccctcgcagcgggtccagttcatccttggcaccgaagacgatgacgaggagcacatacctcacgatctgttcactgaacttgatgagatttgctggagggaaggcgaggacgcggagtggcgcgagactgctcggtggctgaagttcgaggaagatgtagaagatggtggagagagatggtccaaaccttatgtggctaccctcagcttacactctctgttcgagttgagatcttgcattttgaatggaaccgttctcctggatatgcatgcaaatactctggaagagattgctgacatggtgcttgatcagcaagtcagcagtggtcaacttaacgaggacgtccgccacagagttcatgaggccctgatgaaacaacaccaccaccaaaatcaaaaaaagctgaccaacagaattcctatcgtcaggtcctttgctgatatcggtaaaaaacagtcagagcctaacagtatggataagaacgccgggcaagttgtatccccccagagcgctccagcctgtgtggaaaacaaaaacgacgtttctagagagaactccactgtcgacttcagtaaagtcgacctccatttcatgaagaagattccccctggagctgaagcatctaacattctcgttggtgagctggagttcctagaccgtaccgtcgtggccttcgtccggctgtcaccggcagttctgctacaaggcctagccgaggtcccaatacctaccaggttcctttttattctgctgggccccctggggaagggccagcagtaccatgagatcggtcgttccatcgccactctcatgactgacgaagtgtttcatgacgttgcttataaggccaaagataggaacgatctcgtatcggggatcgatgagttcctggatcaggtgacagtgcttccaccaggggaatgggatccatcaatcagaatagaacccccgaaaaatgttcccagccaggagaaacggaagatcccagcggtccccaatggaactgccgcccacggagaggccgaaccccacggcggacatagcggcccagagctgcaaagaaccggccggatctttggaggattgatcctagatattaaacggaaggctccatatttctggtcagattttcgggatgcattctcactccaatgtctagcgagcttcctgttcctgtattgcgcatgtatgagtccagtgattacctttggcggccttcttggtgaggccacagaaggacgcattagtgcaatcgaatccctgttcggtgcatccatgaccgggattgcatactctctgttcggcggccagcctctgaccattctggggagcacagggcccgtgcttgtgtttgaaaagattctctttaagttctgcaaagagtacgggctctcatacttatcacttcgcgcttccatcggactgtggacagctactctgtgcatcatcctggtagcaaccgacgccagttcactggtgtgctacataacaagatttaccgaagaggctttcgcttctcttatttgtatcatttttatctacgaagccctggagaaactgtttgaactgagcgaggcctacccaataaatatgcataatgacttggaactgcttacccagtacagttgtaactgtgtggagccacataacccctcaaacggaaccctcaaggagtggcgcgagtctaatataagcgccagcgatattatctgggaaaacctaacagtctccgagtgcaagtcactgcacggagagtatgtcggccgggcttgtggacatgatcacccttacgtccctgatgtgttgttctggtccgtcatcctcttcttttctactgttacactcagtgctaccctcaagcagtttaagacctctcgttacttccccacgaaggtccgatcaatcgtgtcagacttcgccgtatttctgaccattctttgtatggttctgatcgactatgcaattggcatcccaagccccaaacttcaggttcctagcgtatttaaacccactcgagatgaccggggatggttcgtgacaccactgggacctaacccttggtggaccgtgattgcggcaatcattcccgccttattgtgcacgattttaattttcatggaccagcagattaccgccgtgatcattaaccggaaggagcacaagctgaagaaaggttgcgggtaccatctggaccttttaatggtggcggtgatgctcggcgtttgcagcatcatgggtctaccctggtttgtcgccgccaccgtgcttagcattacgcatgtcaattccctgaaattggagagtgaatgctccgcacccggtgaacagccaaaatttttgggcatccgcgagcagcgcgtcactggactcatgatatttatcctgatggggtctagtgtattcatgacttccatactgaagtttattcctatgccagtgctctacggcgtatttctgtacatgggagcctcttcgctgaagggcatccagttttttgaccgaatcaagttgttttggatgcctgctaaacaccagcccgatttcatctatctgcgccacgtgccccttaggaaggtgcatctttttaccattatccagatgtcttgtctcgggctgctctggattattaaggtttcccgtgctgccattgtctttccaatgatggtgctggctctcgtatttgtgcgtaaactgatggaccttttgttcactaagcgagagttatcttggctcgatgacctcatgccagagtcaaaaaagaaaaagctggaggacgcagaaaaagaggaggagcagagcatgctagctatggaggacgagggcactgtgcaattgccactcgaaggacactatagagatgatccaagcgtgatcaatatttcagacgaaatgagcaagaccgccctctggcgaaacctcctgataacagccgataactcaaaagataaggaaagctccttcccttctaaatcaagccccagctag

SEQ ID NO: 135436 - DNA, 3354 bp, Artificial Sequence
  Description of Artificial Sequence: Synthetic coding sequence
atggaaatcaaagatcagggagcacagatggaacctctcttacctacccgtaacgacgaggaagcagttgtggacagaggagggaccaggtcaatcttaaagacacactttgagaaagaggaccttgagggtcataggactcttttcatcggggtgcacgtcccacttgggggtaggaaaagtcacagaaggcatcgacacaggggccataagcatcggaagcgggatagggagcgcgattccgggctcgaagacggaagggagtcaccaagctttgataccccgtcacagagagtgcagtttattctgggaacagaggatgacgacgaagagcatatccctcacgatctgttcactgaactggatgagatctgctggagagagggcgaggacgctgaatggagggagaccgctcgctggctgaagtttgaagaagacgtcgaggacgggggagagagatggagcaaaccttacgtggcgacactctcactccactccctgtttgaattgcgttcctgtatcctgaatggtactgttcttctcgacatgcacgccaacacacttgaagaaatagcggatatggttctggatcagcaagtcagctctggacagcttaatgaagatgtgaggcaccgggtgcacgaagcattaatgaagcagcaccaccatcagaaccagaaaaagctgacaaatcggatccctatcgtgcggtcttttgcagatataggaaagaaacagagtgagcctaactctatggataaaaacgggcaggtcgttagcccccagagcgcccccgcatgcgtggaaaacaagaatgatgtctcacgggagaattccactgtcgacttctctaaggggctcggcggacaacagaagggacacacctcaccttgcgggatgaaacagcggcacgagaaaggacccccacaccagcaagagcgcgaagtggaccttcactttatgaaaaagatcccccctggtgcagaagcttctaacattctggtgggggagctggaattcttggaccgcaccgtcgtggcatttgtccgcctctcccccgccgtcctgcttcagggcttggctgaagttccgatccccacccgctttctctttattttactgggacccttagggaagggtcagcagtaccatgaaattggacgatccattgccacactcatgactgatgaggtcttccacgatgtggcatacaaagccaaagaccggaacgacctggtgagcggcattgacgagttccttgatcaggtgaccgtgctcccgccaggggaatgggatccaagtattcgcatcgaaccaccaaaaaacgtacccagccaagaaaagaggaaaataccggccgtacctaacggtacagccgcccacggcgaagccgaacctcatggtggacactcagggcctgagttgcagaggaccggcagaattttcggtggtttgattctggatatcaaacgcaaagccccctacttttggtcagatttcagggatgcattcagtctgcagtgtctcgcgtcctttttgttcctgtattgtgcctgcatgagccccgtaattactttcggcgggttgctcggagaggccacagaaggaagaattagcgctattgagagcctcttcggggcctccatgacaggaattgcctacagcctttttggtggccaaccgcttactatcctgggttccaccggtccagtgctcgtcttcgaaaagattctgttcaagttctgtaaagagtatggactgtcttaccttagtctgagagcttcaattgggctttggaccgctacactctgtatcattctggttgccactgacgcaagctctctggtatgctacattactcgctttaccgaggaggccttcgcaagcctgatctgcatcatcttcatatatgaggccctggaaaaactcttcgaactcagtgaagcctacccgatcaatatgcacaatgacctggagctactcacacaatactcttgtaactgcgtggaacctcacaacccctctaatggtaccttaaaggagtggcgcgaatccaacatttctgcatctgacattatttgggagaacctcacggtgtctgaatgtaaatctcttcacggagaatatgtaggccgtgcatgtggccacgaccacccctacgtcccagacgtactcttttggtccgtcatcctgtttttctctactgtgactttgagcgccactctgaagcagttcaaaacatctcggtactttcccaccaaagtcaggtccatcgttagtgatttcgccgtgtttttgactatcttgtgtatggtcttaattgattacgccatcggcatcccttcacccaaactgcaggtgccaagtgtctttaaacccacaagggatgaccgcgggtggtttgttactccactcggtccgaacccttggtggacggtgattgccgcgatcattcccgccctactctgcacaatcctgatcttcatggatcaacagatcacagctgtcattatcaaccgtaaggagcacaaattgaagaaaggctgtggataccacttagatctcctcatggtggccgtcatgctgggggtgtgctctataatggggctgccatggtttgtcgccgcgacagtgctaagtatcacacacgtgaacagtctaaagctggagtctgagtgtagtgctccgggggagcagcccaagttcctcggaatccgggagcagcgcgtcaccggtcttatgatctttatcctcatgggatcttcagtttttatgacgtcgatcttgaaattcatccccatgccagttttgtacggggtttttctgtatatgggcgccagcagtcttaaaggcatacaattttttgaccgcataaagctgttctggatgccggccaaacaccaacctgattttatctacctcagacatgttcctcttcggaaggtgcacctgtttaccatcattcagatgtcttgcctgggccttctctggatcatcaaggtgtcccgagccgctatcgtgtttcctatgatggtgttggccctcgtgtttgtgagaaaactgatggacctgttgtttaccaaaagggaacttagttggctggatgacctgatgcccgagagtaagaaaaagaaacttgaggatgctgaaaaagaggaggaacagtcgatgctcgcaatggaggatgaaggtacggtacaattaccactggaggggcactatagagacgacccctccgtgatcaacatcagcgacgagatgagcaagacagcgctgtggaggaaccttctgataacggcggacaattccaaggataaggagagcagcttcccttctaaatcgtcaccttcttag

SEQ ID NO: 135437 - DNA, 3267 bp, Artificial Sequence
  Description of Artificial Sequence: Synthetic coding sequence
atggagattaaagatcaaggggctcagatggagccccttctgcctactcgtaatgatgaagaagcagttgtggatcgcgggggtaccaggtctatcttgaagacacactttgagaaggaggacctggaaggccatcgcacattattcattggcgtacacgtcccactgggcggacgaaagagtcatcggcggcatcgccaccgcgggcacaagcaccgaaagagggatcgcgagcgcgatagcgggcttgaagatggcagagaaagtccatcattcgacacacccagccagcgcgtccagtttattctggggacagaagatgacgacgaggagcacatacctcacgatctgtttacagagctggatgaaatctgctggcgagagggcgaagatgccgagtggagggaaacagcccgttggctgaaatttgaggaggacgttgaggatggaggggaacgctggtccaaaccgtacgttgccaccctatctctgcattctctcttcgaactcagatcctgcatcctcaacggcacggtgctgctggacatgcatgccaacacactggaagaaatcgccgatatggttctggaccagcaagtgagctccgggcagttaaatgaagatgttcggcaccgggttcatgaagccctgatgaagcagcaccaccatcagaatcagaaaaagctgactaaccgcattccaattgtacggtctttcgctgatatcggtaaaaagcagtcggagccaaactccatggataaaaacgccggacaggtcgtgagtcctcagtcggcccctgcttgtgtagagaataaaaacgacgtgtctagagagaatagtactgtggatttttctaaggtagatttgcatttcatgaaaaaaatccccccgggggcggaagcgtctaatatcttggtgggtgagctcgaatttcttgatagaacggtcgtcgcttttgttcgcctttcccctgcagtgttgttgcagggactggccgaggtgcccatccccacccggtttctgtttatcctcctaggccctctgggcaagggccagcaatatcatgaaataggcagatcaatcgccaccctcatgaccgacgaggtgttccacgacgtggcttacaaggcaaaagacagaaacgacctggtgtcaggtatagacgagttcttagatcaggttactgtattaccccctggagagtgggacccaagtatcaggatcgaaccacccaagaacgtcccctcccaagagaaaagaaaaattccagcggtgccaaatggcaccgctgcacacggcgaagccgagcctcatgggggccactcaggtcccgagttgcaaaggacaggccgtatttttggggggctgatcctggatattaaaaggaaggcgccttacttttggagtgacttccgggacgcattctctctgcagtgtctggcctctttcctgttcctgtattgcgcctgtatgtcccctgttataaccttcggtggcttactgggagaagctacggagggaaggatctcagccatcgagtcactgttcggggcatctatgacgggcattgcgtactccctctttggaggccagcctctgacgatactgggcagcacaggtccagtcctggtctttgagaagattctgtttaaattctgtaaggaatacggcctgtcgtaccttagcctgagggcatctattggcctttggacagctacactctgcattattctggtcgctacagacgcctcctccctcgtctgctacataaccagatttacagaggaagcctttgcctcacttatatgtattatttttatctacgaggccctggagaaactttttgagctgagcgaggcgtatccaattaatatgcacaatgacttggaactcctgacccagtactcctgtaattgcgtcgaaccccataatcctagtaatggtactcttaaagagtggcgggagagcaatatcagcgcctctgacatcatctgggagaatctgacggtgagcgagtgcaaatctctacacggcgaatatgtgggacgggcatgtgggcatgatcacccctatgttcctgatgttttattctggtctgtgatactgttcttttccacggtgaccttatcggccaccctgaagcagtttaaaacgtctaggtattttcccaccaaagtcaggtccatagtttccgactttgctgtcttccttaccattttatgcatggtcctgatagattatgccattggaattccttcaccaaagctccaggtgccttctgtgttcaagcctactcgggatgatcgcggctggttcgtcacacccctgggcccaaacccctggtggacagtaatcgccgctataattcccgccttattatgcacaatattaattttcatggatcagcagatcactgctgtgatcattaatcgcaaggagcacaagctcaagaagggttgcgggtatcacctggatttactgatggtggccgtgatgctgggagtgtgctcgattatggggcttccgtggttcgttgctgccacggtgcttagcatcacacatgtcaattcacttaagttggaatccgaatgtagtgccccaggcgagcagcccaagttcctggggatccgcgagcagagggtgacaggcttgatgattttcatcctgatggggtcctccgtgtttatgaccagtattttgaaattcatcccaatgcctgttctctatggggtgtttctttacatgggagccagttcactcaaaggcattcagttttttgataggattaagctcttttggatgccggctaagcatcagccagattttatctacctgaggcacgtgccccttcgcaaagtgcatttgtttactattatccagatgagctgcctcggtttactgtggattataaaggtgagcagagcagccattgtgttccctatgatggtcctcgcgcttgtgtttgtgcggaaattaatggacctgctgttcacaaagagggagctcagctggttggacgatttgatgcccgaatctaagaaaaagaagctggaagatgccgagaaggaagaggaacagagtatgctggcgatggaggacgagggaaccgtccagctgcccctggaaggccattatcgggatgacccctccgtgatcaacataagtgacgagatgtccaaaacagctctgtggcggaacctattgattaccgctgataatagcaaagataaggaatcttccttcccatctaagtccagtccatcttag

SEQ ID NO: 135438 - DNA, 3165 bp, Artificial Sequence
  Description of Artificial Sequence: Synthetic coding sequence
atggagattaaagatcagggagcgcagatggaacctctcctacccacaagaaatgatgaagaagccgtcgtcgaccgtggggggacccgcagtatcctaaaaactcacttcgagaaggaagacctcgagggacatcgaacactgttcattggggtgcacgtccctttaggcggacgaaaatcgcatcgcaggcaccggcatagggggcataagcatcgcaagcgggacagagagagggactcaggacttgaggatggtcgtgaatctcccagctttgatacaccgtctcagagagtgcagtttatactgggcactgaagatgatgatgaggaacatatcccccatgacctttttactgagctggacgagatttgttggcgcgaaggcgaagacgccgaatggcgggagacagctcgctggctcaaatttgaggaggatgtggaagacgggggcgagcggtggtccaagccatacgtggccaccctgagccttcactcactgttcgagcttagatcctgtattctgaatggaacggtgctgctcgacatgcatgcgaacactctcgaggagatcgctgacatggtactggatcaacaggtgtcttcaggtcaactaaatgaggatgtcagacacagggtccacgaggccctcatgaagcagcatcaccaccagaaccaaaagaagcttactaaccgtatccctatcgttcgatctttcgccgatattggcaaaaagcagtctgagcccaattctatggacaagaatgccggccaggttgtttccccgcagtccgcacctgcctgcgtggaaaacaaaaacgacgtaagtagagagaacagcacagtggatttttctaagggccttggaggccagcaaaaaggccacaccagcccctgcggtatgaaacagaggcacgaaaaaggccctcctcaccagcaggagagagaagtggacctgcactttatgaagaagatccccccaggagctgaggccagcaacattctcgtgggggaactggagttcctggatcgcacagtagtggcattcgttagactgtcaccagcagtcctgttgcaaggcctggcagaagttccaataccaactagattcctgttcatcctgctgggaccactcggcaagggtcagcagtatcatgagatcgggagatctatcgcaacactgatgactgatgaagtgttccacgatgtagcttacaaggctaaggaccgaaacgacctagtgagcggaatcgacgaattcctcgatcaagtgaccgttctgccccctggtgaatgggatccctccataaggatcgagccccccaaaaatgtgccaagtcaggaaaagcggaaaatccccgctgtccccaacggaacagcagcacatggcgaggctgagccccacggcggacatagtggacctgagctgcaacgaacaggcaggattttcggaggcttgattctggatattaagcgaaaggccccatatttttggtccgatttccgtgacgccttttcccttcagtgtctcgcctcctttctcttcctttattgcgcttgcatgtccccggttatcactttcggggggctcctcggcgaggccacggagggacgcatctcagctatcgagtcactgtttggggcctcaatgacaggcatcgcatactcgctctttggcggccagcccctgaccattctaggatcaacagggcccgttttagtgttcgaaaaaatcttgttcaagttctgcaaggagtacggtctgagttacttatcgctgagggccagtattggtctttggacagccaccctttgtatcatcctcgtggcaaccgacgcgtccagccttgtttgttatataactagatttaccgaagaggcctttgcctcactcatctgtataatcttcatatatgaggcattggaaaagctgtttgagctgtcagaggcatatcctatcaatatgcacaacgacttagaactgctgacccagtactcttgcaactgtgtcgagccgcacaatccctccaatggaacactcaaggaatggagagagagtaatatttccgcctctgacattatctgggaaaatctcacagtgtccgagtgtaagtctttgcatggcgagtacgtcggcagagcttgcggacatgatcacccatacgtgcctgatgttttgttttggtccgtcattctgtttttttctaccgtgacattatcagcaaccctaaagcagtttaaaaccagcaggtattttcccacgaaggtgagatctatagtctccgatttcgcagtgttcctgaccatcttatgtatggtgcttatagactacgcaatagggatacccagtccaaaactgcaggtgccaagcgtattcaaaccgacgcgtgatgatcgcggatggttcgtaactcccttagggccaaatccctggtggaccgtgattgcggccatcattccagccctcttgtgcaccatactcatcttcatggaccagcagattactgccgtaatcattaaccgtaaagagcataagctcaaaaagggttgtggataccacttagatctcctcatggttgccgttatgctgggcgtgtgcagcatcatggggctgccttggttcgtggcggcaaccgtactctcaatcactcacgtcaatagccttaaactggaatccgaatgttccgcccctggggagcagcccaagttcctgggcatcagggaacagcgcgtcaccggcctgatgatttttatcttaatgggctctagtgttttcatgactagtatcctcaaatttattccaatgcccgtactgtatggggtcttcctgtacatgggagcatcgtcattgaaagggatccagttctttgatagaatcaaactattttggatgcctgcaaagcaccagccagacttcatctacctcaggcacgtgccattgcgcaaggtgcacttgtttacaataatacagatgtcttgcttggggctgctctggattattaaggtgagccgggcagcaatcgtgtttccgatgatggtgctggccttggtctttgttcggaagctgatggacctcttattcacaaaaagggagctctcttggctggatgatcttatgccagagagtaagaaaaagaagttagaggacgcggagaaagagcattag

SEQ ID NO: 135439 - DNA, 3357 bp, Artificial Sequence
  Description of Artificial Sequence: Synthetic coding sequence
atggagatcaaggaccagggcgcacagatggaacccctgttacccacacgcaatgacgaggaggcggttgtcgataggggaggcacacggagcatccttaagacccacttcgagaaggaggatctggaggggcaccgaacgttgttcataggcgtccacgtcccactgggcggcaggaagtcacatcgccgccaccgccaccgcggacacaaacatcgcaaaagggacagggagagggatagtggccttgaagacggacgtgaatccccatcctttgacaccccatcccagagggtgcagttcatcctgggtacagaggatgatgacgaggagcacatcccacatgacctttttactgagctagacgagatctgctggcgcgaaggggaggatgcggagtggagagagaccgctcgctggttaaagttcgaagaggacgtggaagacggcggtgagcggtggtcaaagccatacgtcgctacgctttccctgcacagccttttcgaattgaggtcgtgcatcctcaacgggacagtcctgctggatatgcacgccaatactttagaggagattgccgacatggtcctggaccagcaggtgtcttctggccaactcaatgaggacgtgcgtcacagagtacacgaggcactcatgaagcaacaccaccaccagaaccaaaagaagctaaccaaccgaatccctatagtgagaagctttgctgacattggcaaaaagcaaagcgagcctaattccatggacaagaacgcaggccaagtggtgagcccgcagagcgcccccgcttgcgttgaaaacaaaaatgacgtcagtagggagaattccaccgtggatttcagtaagggcctgggcggccagcagaaaggacatacgtctccctgcgggatgaaacaacgccatgagaagggccctccccatcagcaggagcgcgaagtagacctccactttatgaaaaaaattcctccaggcgctgaggctagcaatattctggtgggggagcttgaatttctggaccgcaccgtcgttgcctttgtgcgcctgagtccggccgttcttctgcagggccttgccgaggtccccatccccactaggttcctttttatactactgggaccccttggaaaagggcaacagtaccatgaaattggtaggtcaatcgccaccctaatgaccgacgaggtcttccacgacgtcgcatataaagccaaagaccgtaacgacctcgtttcaggcattgatgagttcttggaccaagtcacggttctgccaccgggtgaatgggacccgtcgatacgaatcgagccccctaaaaacgtgccctcccaggagaaaagaaagatccctgctgtgcccaacggaactgctgctcatggcgaagctgagcctcacggaggacacagtggaccagagttacagaggaccgggaggatattcggcgggctgatcctggatatcaagcggaaggcaccttacttctggtcagactttcgggatgccttttcgctgcagtgcctggcgtccttcctgttcctctattgcgcttgtatgtctcccgtcattacttttggaggcctcctcggcgaagccactgaaggccgcattagtgccatagaaagtctatttggtgcgtctatgaccggaattgcctactctctcttcggcggccaacccttgacaattttgggaagcaccggacctgtactggtcttcgaaaagattctgtttaaattttgtaaagagtacggcctgtcttaccttagtttacgcgcatccattggcctttggactgccacactttgcatcattctcgtggctactgatgcaagttcactcgtgtgctatatcacacggtttactgaagaagcgtttgccagcctgatttgcatcatctttatctatgaggcactggagaagctatttgagctttccgaagcttatccaataaacatgcacaatgatctggagctgctcacccagtacagttgcaactgcgtcgaaccacataacccctccaacggtacactcaaggagtggcgggaatcgaatatcagtgcatctgatataatctgggagaatttgactgtgtctgaatgtaagtcgctgcacggtgaatacgtcgggcgagcatgtgggcacgatcacccatacgtgcccgacgttttgttttggtcagtcatcctgtttttttcgacggtgaccttaagcgcaactctgaagcaattcaagaccagccgatattttccaaccaaagtgaggagtatcgtgtccgactttgccgtgtttctcacaattctttgcatggttttaattgattacgcaatcggtatacctagcccaaaactgcaggtaccctcagtcttcaaacccacgcgggatgacagaggctggttcgtgacacctcttggtcccaacccttggtggaccgtcattgcggccataatacctgcgttgctttgtaccatccttatttttatggaccagcagatcacggcagtgatcattaataggaaagagcacaagctaaaaaaaggatgcggttaccatttagacttactcatggttgccgtgatgctaggcgtgtgcagcataatgggtcttccgtggttcgttgcagcaacagtactgagtatcacgcacgttaactctttgaaacttgagagcgagtgcagcgctcctggggaacagccaaagttcttgggaattcgagaacagagagtgaccggtctgatgatttttatattgatgggctctagcgtcttcatgacttctatccttaagttcattccgatgcccgttctgtacggtgtatttctgtatatgggggcctcatccctgaagggcatacagttctttgaccgcatcaaactcttttggatgccagccaagcaccagcctgactttatctacctacgccatgttcctcttcgaaaggtgcacctgttcacaattattcaaatgagttgtctcggcttgctgtggatcatcaaagtgagcagggccgccatcgtgtttccgatgatggtgttggccctcgtatttgttcgcaaactgatggacctgctctttaccaagcgggaacttagctggcttgacgacctaatgccggaatctaaaaaaaagaagttggaggatgccgaaaaagaggaagagcagtctatgctggccatggaggatgagggcaccgtgcagctgcccctggaggggcactacagagatgatcccagcgtcattaacatctcggacgaaatgagcaagaccgcactgtggcgcaacctccttataaccgcagataattcaaaggacaaagagtcgagctttccctcaaagtcttcacccagctag

SEQ ID NO: 135440 - DNA, 3318 bp, Artificial Sequence
  Description of Artificial Sequence: Synthetic coding sequence
atggagattaaggatcaaggtgcgcagatggagccgctacttccaactagaaatgatgaagaggcggttgttgacagaggcggtactaggagcattttgaaaacccactttgagaaggaggatctcgaggggcacaggactttatttattggcgttcacgttcctttgggcggcaggaagagccaccggaggcatcggcaccgcgggcataaacaccgcaaaagagaccgcgagagggacagcggattggaggatggcagagagagcccctccttcgatacgccatctcagagggtgcagtttattctgggtactgaagatgacgacgaggaacacatcccgcatgatctgttcacagaactcgacgaaatctgctggcgcgaaggggaggacgctgaatggcgcgagacagcgcggtggctcaagtttgaggaagatgttgaggacgggggagagcggtggtcaaagccatacgtggcaactctgagtctgcacagtctcttcgagcttcgatcttgcatcttgaacgggacagtcctgctagacatgcatgccaacaccttggaagaaattgcggatatggtgctggaccagcaggtctctagtgggcaactgaacgaggacgtgaggcatcgagtgcatgaagctctcatgaaacagcatcaccatcaaaaccagaagaagttgaccaaccgtattccaatcgtaagatcatttgctgacattgggaagaaacaaagcgagcctaactccatggacaaaaatggtcaagtcgtaagtccccagagcgctcccgcatgcgtggagaacaagaacgatgtgagcagggagaactcaacagttgacttttccaaggtcgacctgcacttcatgaagaagattccacccggcgccgaggcatccaatatactggttggcgagttggaatttttggatcgcaccgtggttgctttcgtgagactttcacccgccgtgttactccagggcttagcagaggtgccgattccaactaggttcttgtttatcctcctggggccactgggtaaaggacaacagtaccatgagatcgggagaagtatcgccacactgatgacggacgaagtcttccacgacgttgcatacaaggcgaaggatcgcaacgatctggtctccggaatcgacgaatttctcgatcaagtaactgtcctgccgcccggcgagtgggacccctccataagaattgaaccccctaaaaatgtgccgagtcaggagaagcggaagatccccgccgtccccaacgggactgccgcccatggggaagccgaaccacacggcggccacagcggtccagagctacagagaactggacggatcttcggcggtctgattctcgatatcaaacgcaaagctccctatttttggagcgatttccgtgacgcgtttagtctccagtgtctcgctagtttcctgtttctttactgcgcctgcatgtcccccgtgattaccttcggggggttgcttggggaggcaaccgagggacgaatctcagcaattgaaagcctgttcggcgcctccatgacaggaatagcatacagtctgtttggagggcagccactgacaatactcggctcaacaggacccgtgctagtgtttgagaaaattctgtttaagttctgtaaggaatatggtctatcatacctaagcctgcgagcaagcatcgggctgtggaccgctacactgtgtattatcttggtggcaactgacgcttcatctctagtctgttacatcacccgctttaccgaagaggccttcgcgtctctgatttgcattatcttcatctacgaagcattggaaaagctgtttgagctgtctgaggcataccccattaacatgcataacgacctggagcttctcactcagtatagctgtaattgcgtggaacctcataatccatccaatggtactctcaaggaatggagagaatccaacatctccgcaagcgatatcatatgggaaaatttgacagtctcagagtgtaagagccttcatggggaatacgttgggagggcctgtgggcatgaccacccttacgtcccagacgtcctgttctggagtgtgatcttgttcttctctactgtgactttgagtgctaccctaaagcagttcaaaacttcccggtattttcccaccaaggtcaggtctatcgtgtccgattttgctgttttccttaccatcctctgtatggtgctcatagattatgccatcgggattccgagcccaaagctgcaggtgccctccgtctttaaacccacgcgcgatgatcggggttggtttgtgaccccattggggcctaacccctggtggaccgtcatcgccgcaattatccccgcccttctttgcactatattaatctttatggatcaacagatcacggccgtgataatcaaccgaaaggaacacaagctaaaaaagggctgtggctaccacctcgacctgctgatggtggcggtgatgttaggcgtgtgcagtatcatgggcctgccttggttcgtagccgccaccgtgctctctattactcacgtgaatagcttaaaactcgaatctgagtgcagcgcccccggagaacaaccgaagttcctgggcattagagaacagagggttaccggcttgatgattttcattttaatgggcagtagtgtcttcatgacttctattctcaagttcattcctatgcctgtcttgtacggcgtcttcttgtatatgggggcatccagtctcaaaggtatacagttctttgataggattaagttgttttggatgccagccaaacatcagcccgactttatctacctacggcatgtgcccctgcgaaaagtgcacctattcactattatccagatgtcgtgtcttggactgctgtggattattaaggtgtctcgggccgctattgtctttcctatgatggttctggctcttgtctttgtacgcaagctgatggatttgctgttcacgaaaagggagttaagttggcttgacgatctaatgccggagtccaagaagaaaaagctcgaggacgcggagaaagaagaggagcagtctatgctcgctatggaggacgaaggcaccgttcagctgcccctggaagggcactatcgtgacgatccgagcgttattaacatcagcgatgaaatgagtaaaacagcactgtggcgcaatctactcatcacagctgacaattcaaaggataaggaatctagcttccctagtaaaagtatcgagtcacgaaaggagaaaaaggctgattcaggcaagggcgtcgacagagagacttgcctctag

SEQ ID NO: 135441 - DNA, 1227 bp, Artificial Sequence
  Description of Artificial Sequence: Synthetic coding sequence
atggagatcaaggatcagggggcccagatggaacccctactacctactagaaacgacgaagaggcagtcgtggacagaggcggcactaggtcaatcttgaagacgcacttcgagaaggaggacttggagggccacaggaccctgttcattggagttcacgttccgctggggggccgcaaatctcacagacgacaccgccaccggggccataagcaccggaaacgggatagggagagggattctggcctcgaggacgggagggagagtccaagcttcgacactccgtcccagcgtgtgcaattcatcctcgggacagaagacgatgacgaggaacacatcccacacgatctctttacagaattagacgagatttgctggcgggagggggaggacgctgaatggagagagaccgcccgctggttaaaattcgaggaagacgttgaggatggtggcgaacgttggtcaaagccgtatgtcgctaccctaagtttacacagtctattcgagttgcgttcatgcattctcaatggtaccgttctgctggatatgcacgccaacactctggaagagattgctgatatggtcctcgaccagcaggtgagctccggccagctgaatgaagacgtccgtcaccgtgtgcacgaagcccttatgaaacagcatcaccaccagaaccagaagaaactgactaataggattccaatagtgaggtcattcgccgatattgggaagaagcagtccgaaccaaatagcatggataaaaatgccgggcaggttgtgtctccgcagagtgctcccgcctgcgtcgaaaataaaaatgacgtcagccgtgagaattcaactgtagattttagcaaggggcttggcgggcagcagaagggccacaccagcccatgcggcatgaaacagaggcacgagaagggtccaccccaccagcaggaacgggaagtggacctgcattttatgaagaagattcccccaggggccgaggcatcaaacatcctggtgggagagctggaatttctagaccgaacagttgttgccttcgtccgcttaagcccagctgtactgctccagggcctcgcagaggtccctatccccacaagatattttatgatgctgccaatcaaattgaaaattgtgatgacatggtaccaggagttgatgagtttttggatccgtctgctgttctctctccttgagaacgggatccaggctttcgaatag

SEQ ID NO: 135442 - DNA, 2676 bp, Artificial Sequence
  Description of Artificial Sequence: Synthetic coding sequence
atgtcacaagttggtgggagaggggatagatgcacccaggaggttcagggcctggtacacggcgccggagatctttccgcttcccttgccgagaattccccaactatgtcccaaaacggctactttgaggactcaagctactataaatgcgatacagacgacacctttgaagcgcgggaagaaatcttgggggatgaggcctttgacacagctaactcatccatcgtgagcggagaatcgattcgctttttcgtcaatgtgaacttggagatgcaggccactaacactgaaaatgaggccacatccggggggtgcgtcctgctccacactagtagaaaatatctgaagctcaaaaacttcaaagaggagattcgtgcccatagagacctggatgggttcctggctcaggcctcaattgtgttaaatgagaccgctacatccttagataatgtcctccgaactatgctcagaaggtttgccagagatcccgacaataacgaacccaattgcaatctggatcttctgatggccatgcttttcactgatgcaggagctcctatgagaggaaaggtgcacctgcttagtgacacgatacagggtgttactgcaactgtaaccggggtcagataccagcaatcctggctttgtattatctgcactatgaaggccctgcagaaaagacatgtttgtatttcccggctggtccggccacagaactggggtgagaacagctgcgaagtgagattcgtcattctggtgctggccccccctaagatgaagtctactaaaaccgctatggaggttgcacgcaccttcgccactatgtttagcgacatcgcttttagacagaaactactggaaaccagaacagaggaggaattcaaagaggccctggttcatcagcgacagctgctaaccatggtcagtcatgggcccgtggcaccacgaacaaaggaaaggtctaccgtgagtctgccagcccatcgccatcccgagccgcctaagtgtaaagattttgtgccattcggtaagggtattcgggaagatattgcacggcgctttccgctgtatcccctcgatttcactgacggtataatcggcaaaaataaggccgttggtaagtatatcacaactaccctgttcctctacttcgcatgtttgcttcccacgattgcattcggaagcctcaatgacgaaaatacagacggagctattgacgttcaaaagactatcgctgggcagagtatcggggggctcctgtatgccctcttttcaggtcagcctttggtcattttgttgacaacagctcctctggcactttatatacaggttatccgagtcatctgtgacgattacgacctggacttcaactcattctatgcttggacaggcctttggaactcttttttcttagctttgtacgccttctttaatcttagcctggtcatgtctctgttcaagcgaagtactgaggagatcatagcactctttattagtatcaccttcgtacttgatgctgtaaaagggaccgtgaaaattttttggaagtactattatggccactacctggacgactaccacactaagaggacctcatcccttgtgagcctgagcggtctaggagcatcccttaacgcgagcctgcacaccgcgctcaatgcctcatttctggcttcacccaccgaacttccttccgcaacacactccgggcaggcgacggcagtcctctcactgctgattatgctcggcacgctttggctgggatacacactctatcagtttaaaaagtcaccttacttgcacccttgcgtcagggaaattctctctgactgcgccttacctatagccgtgctagcatttagtctgattagctcccacggattcagggagattgagatgagtaagttcaggtataacccaagcgagtccccctttgccatggcccaaattcaaagcctgagtctcagggcggtgagtggggcaatggggctggggtttctgctgagcatgttgttcttcatcgaacaaaaccttgtagcagcattggtcaatgctcccgagaaccgcctggtcaagggaaccgcataccattgggaccttctgctgctcgccattataaatactggcctcagtttatttggtttgccatggatccatgcagcatacccacacagccctcttcacgtgcgggctctggctctggtggaagaacgcgttgagaacggacacatctacgatacaatcgtcaatgtgaaagagaccagactgacttcccttggggcctccgtcttggtggggttaagtctcctcctgcttccagttcccctgcagtggattcccaagcctgtgctctatggactcttcctgtatatagccctgacctccctcgatggtaaccagctggtgcagcgcgtagcgctccttctgaaagaacagacagcataccctcctacacactatatccggagggttccacaaaggaagatacactacttcacggggttgcaggtgctacagctattgctcctctgcgcctttggcatgtcctcgctaccctatatgaagatgatcttccccctgatcatgattgccatgatccctatccgttacatcctgttgccacggattattgaagccaaatacctggatgttatggacgccgaacacaggccatag

SEQ ID NO: 135443 - DNA, 2757 bp, Artificial Sequence
  Description of Artificial Sequence: Synthetic coding sequence
atgggcgtttacgggcctcaagatagatcagagtccgaaaagagagacgtgcagagggatccacctccgtggcatccccgccgggaaggggaacgcccagcaagggctaggtccctcccgctcgctgcagcagggcaggggtttttaaggaagacctggataagtgaacatgaaaactcccccactatgtctcaaaatgggtatttcgaagacagtagctactacaagtgtgacacggatgatacctttgaagcccgggaggagatccttggggacgaagcctttgatacagccaatagttctatcgtcagcggagaaagtatacggttcttcgtgaatgtgaacctggaaatgcaggccaccaacaccgaaaatgaggccacgtcgggtggctgcgttctgctgcacactagcagaaagtacctaaaacttaagaacttcaaggaggaaataagggcgcacagggaccttgacggtttcctcgctcaggcctctatcgtgctgaacgagactgcaactagcttggataatgtgctaaggaccatgctgcgccgttttgctcgtgacccggataataatgagcccaactgcaacttagatctgctgatggccatgctgttcactgacgcgggggcaccaatgcgaggcaaggttcatttgctctccgacacgatccagggggtcaccgccacagtgacaggagtacggtatcaacaaagctggctctgcattatttgcactatgaaggcgttacagaagagacacgtttgtatctctagactggtgcgaccccaaaattggggagaaaattcctgcgaggtgaggttcgttattctggtcctggctcctcccaaaatgaaatccacgaagacagccatggaggtggctagaaccttcgcaaccatgtttagcgacatcgccttcaggcaaaaactgttagagacgagaacagaggaggaattcaaagaggcccttgtccaccagcggcaactcctaactatggtgagccatggccctgtggctccccgaaccaaggaacggtctacagtgtccctcccagcccatagacatcctgagccgccgaaatgcaaggacttcgtgcccttcggcaagggcattcgagaggacatagccaggagatttcctctctacccattagatttcacagatggcatcataggcaaaaacaaggctgtgggtaagtacataaccaccaccttgttcctttactttgcgtgcctgctccccacaatcgcgttcggatccctgaacgatgaaaataccgacggggctatagatgttcagaagaccattgccggacagagcattgggggcctcctctacgcactcttttcaggacagccactggtgatactactgaccaccgcgccactggcgttatatatccaggtgatccgcgtaatctgtgacgactacgacctggactttaattccttctatgcctggacgggactctggaacagtttctttctggcactgtacgctttctttaatttgagtctggttatgtctctcttcaagaggagcacagaggaaatcattgctctatttatttctattacctttgtactggacgcggtgaaaggcacagttaagattttctggaaatactactatggccactacttagatgattaccacacaaaaaggacctcgtccctcgtgagtctttctggccttggagcctcattgaacgccagcctgcacacagccctgaacgcttctttcctggcctcacctacagagttaccttcagccacacacagcggacaggcaacagcagtgctgtcgctgctcattatgctgggcactttgtggctgggctatacactttatcagtttaaaaagagtccttacctccacccgtgtgtccgggagattctgagcgactgcgccctgccgattgctgtgctggctttttccttgatctcctctcatggatttcgcgaaatcgaaatgtcaaagtttaggtacaatccctccgaaagcccattcgcaatggcccagatccagagcctatcgcttcgcgccgtgtccggcgctatgggacttggctttttgctttccatgcttttttttatcgaacagaacctggtcgctgcactggtaaacgcccctgaaaatcgactcgtcaaaggcaccgcctatcactgggacttacttttactcgcgattataaataccggactgagcctcttcggcctgccttggattcacgccgcatatcctcattcccccttacatgtgcgtgccctcgccttagttgaggaacgggtggaaaacggacacatctacgataccatcgtaaatgtcaaggaaacacgcctgacatccttgggcgccagcgttctggtgggccttagtttgttgctgcttcccgtccctctgcagtggatccccaaacccgtcttgtacggcctatttctgtacatcgctctgacatccttggatggtaatcagttagtccaacgagtggccttacttctgaaggaacagaccgcctaccctccaactcattatatccggagggtccctcagcgcaagatccattatttcactgggcttcaggtgctacagctactgctattgtgcgcctttgggatgtccagtctaccctacatgaagatgattttccctttgataatgattgccatgatcccaatccgatatattctgctcccaagaatcatcgaagccaagtacctcgatgtaatggatgctgaacataggccatag

SEQ ID NO: 135444 - DNA, 951 bp, Artificial Sequence
  Description of Artificial Sequence: Synthetic coding sequence
atggccgctgcgacacgacgggtgttccatctgcaaccttgcgaaaattcccctacaatgagtcagaacggctacttcgaggatagcagttactacaagtgcgatactgacgacactttcgaggccagagaagagatcctcggcgatgaagcatttgacaccgccaacagttctatcgtttctggcgagtccattagattctttgtaaatgtgaatctcgagatgcaagctacaaatacagagaacgaggcaacctctgggggctgcgtattattacatacttcccgcaagtatctcaagcttaagaatttcaaggaagaaataagagcacaccgggatctggacggcttcctggcacaagctagcattgtcctaaacgagactgcgacaagtctcgacaatgtcctgagaactatgctccggcgtttcgcgcgagatccagacaacaacgagccaaactgcaaccttgatttgcttatggcaatgctgtttaccgacgccggtgccccgatgagaggcaaggtgcatctgctctctgataccatccagggtgtgaccgcaacagtaacaggagtgagatatcaacagtcatggctctgcatcatatgcactatgaaggccttgcaaaaaaggcacgtgtgtatatcccgactcgtacgccctcagaactggggagaaaactcttgcgaggtgcgctttgtgatactggttctcgccccccccaagatgaaaagcacaaagactgctatggaagttgcccgtactttcgctaccatgttttcagacatagccttccgccagaaattgttggaaacacgtactgaagaagaattcaaagaggcactcgtgcatcagaggcagctgctcactatggtgtcccatgggcccgtggctccccggaccaaagaaagatctacagttagtttaccagctcatcggcacccagagtag

SEQ ID NO: 135445 - DNA, 2628 bp, Artificial Sequence
  Description of Artificial Sequence: Synthetic coding sequence
atggccgcagccactagacgcgtcttccatctgcagccgtgtgagaattctcctacaatgagccagaatggctattttgaggacagcagttattacaagtgtgataccgatgatacattcgaggcgcgagaggaaattctgggtgatgaggcattcgacactgccaacagtagcatcgtttcaggcgagtcgatcagatttttcgtgaatgttaaccttgagatgcaggccaccaatacagaaaacgaggccacctccggtggatgcgtgcttctacatacgtctcgcaagtacctgaagctgaaaaatttcaaggaggaaattcgggcgcatcgagatcttgacggctttttggctcaagcgagtattgtgcttaatgaaacggctacctccttagataatgtcctgaggaccatgttacgcaggtttgctagagatccagataacaacgaacctaattgcaacctggacttacttatggcaatgctgttcacagacgctggcgctcccatgagggggaaagtgcatttgctgagtgacaccatccaaggtgtgactgccaccgtgactggagtcaggtatcagcaaagttggctgtgcatcatctgcacaatgaaagctttacagaagagacacgtctgcatctcaaggctcgtgcgccctcagaactggggggagaatagttgcgaggtccgcttcgtgatactcgtacttgctccaccaaaaatgaaatctacgaaaacagccatggaggtcgcccgcacttttgctactatgttttccgatattgcctttcgacagaaactgttagagacacggaccgaggaagagttcaaagaggccctggtgcaccagagacaacttctgactatggtctcccacggccccgtagcaccccgaacgaaggagcggagcactgtgtccctccccgctcacaggcatccggaaccccctaaatgtaaggacttcgtcccctttggaaaaggtatcagggaggatattgcccggcgctttcccttgtacccgctcgacttcacagacggcataattggtaagaacaaagcagtcggcaaatacatcactacgactctgttcctttactttgcttgcctgctgccaaccatcgcctttggctcgttaaacgatgaaaataccgatggcgccattgacgtccagaagaccatagcaggccagagtatcgggggtttactgtatgcactgttttctggacaacctctggttattctgctaacaacagctcccttggccctgtacattcaggtcatccgtgttatttgtgatgattacgacctggactttaattcgttctacgcgtggactggtctgtggaattccttttttctggcgctatacgctttcttcaacctttcactggtgatgagtttgttcaagcgtagcaccgaagaaatcatcgccttgtttatcagcataacgtttgtgctcgacgctgtgaaaggcactgtgaagatcttttggaaatactattatgggcactacctcgatgattatcatacaaagaggacttcatccctggtttcactctctggccttggtgccagtctaaatgccagccttcatactgcactgaatgcttcttttctggcttcacctaccgagcttccaagtgcaacacactccggccaagcaacagcggtgttgagtcttctcattatgcttgggacgttgtggctgggctacacactttaccagttcaagaagtcaccttatttgcatccatgtgttcgggagattctttcagactgtgcgctacctatcgcagtgctcgccttctccttgatcagttctcatggttttagggaaatcgaaatgtccaaatttaggtacaacccgagcgaaagtcctttcgcaatggcacagatccagagtctgagcttacgagccgtgtcaggtgccatgggactcgggtttcttctgtccatgctattttttatcgagcaaaatctggtggccgcactggtcaacgcccctgagaatagactggtgaagggcaccgcctatcactgggatttgctgcttctcgcaatcattaatacggggctatctttattcgggttgccttggatccatgctgcgtacccgcacagtccactccacgtgagggcactggccctcgtagaggaacgcgtagagaatggccatatatacgacaccattgtgaatgttaaagagacacggctgacctctctcggcgcaagtgtccttgtaggactctcactcttacttctgcctgtcccacttcaatggataccaaagcccgtgctttacggactgtttctgtatattgccctcacttctctcgatgggaatcagctggtacagagggtggcactgctgctcaaggaacagacagcttacccacctacgcattacatccgaagagtgccacagcggaaaatacactacttcaccggtctccaggtacttcagctgctgttgctgtgcgcctttggcatgtccagcctgccatatatgaagatgatctttccgctgatcatgatcgccatgatcccgatcagatatattctgttgcccagaatcattgaagcaaagtacttggacgtcatggacgctgaacaccgcccctag

SEQ ID NO: 135446 - DNA, 1113 bp, Artificial Sequence
  Description of Artificial Sequence: Synthetic coding sequence
atgaccctggcttccaggctgtcaacggctgctaacactggacaaattgatgatccccaagaacaacaccgcgtcataagtagcaacctggcgttaattcaggtgcaagcaacagtcgtgggattgctagctgcagtcgctgctctgctgctcggggttgtgagtcgcgaggaagtcgacgtggctaaggtggagctcttatgtgcctcaagcgtgctgactgcctttctggcggcatttgccctgggtgtgctgatggtgtgtattgtgatcggcgcccggaagttaggcgtcaaccctgacaatatagcgaccccaattgcagccagcctgggcgatctgattacactgagcattctcgccctggtgagcagctttttctatcgccacaaggattccagatacctgacgcctttagtgtgtctcagctttgcggccctgaccccagtctgggttctcatagccaagcagtcccctcccatagtcaagattctcaaattcggctggtttcctattattcttgccatggtgatcagtagcttcggtggcctgatactgagcaaaacagtctctaagcaacaatacaaaggtatggcaatcttcactcctgtcatttgcggcgtgggtggaaatcttgtcgccattcaaacctcccgcatttcgacttatttacacatgtggtccgcacctggggtgcttcctctgcagatgaagaaattttggccaaacccctgctcgaccttctgcaccagcgagatcaattcaatgagcgcacgggtactgttattgctcgtggttccaggtcatctcatattcttctacattatctatctcgtcgaaggccagtctgtgatcaactctcagacatttgtggtgctttatctgcttgccggtcttattcaggtcaccatcctgctgtatctagccgaagtgatggtgagacttacttggcatcaggcccttgaccctgacaaccattgtatcccatacctgactggcctgggcgatttgctggggaccggtctgctggcactgtgttttttcacagactggctcctgaagagcaaagcagagcttggaggaatcagcgagctcgccagcggtccaccatag

SEQ ID NO: 135447 - DNA, 1542 bp, Artificial Sequence
  Description of Artificial Sequence: Synthetic coding sequence
atgtcaagcaaacccgaacccaaggatgtccaccagcttaatggcacgggtccgagtgctagtccctgtagtagcgacggacctggcagggagccactcgctggcaccagcgaatttttaggccccgatggggctggcgtggaggtcgtcattgaatcgcgggctaatgccaaaggggttcgagaagaggatgccctgctcgaaaacggtagccaatcaaacgagagtgacgacgtttctaccgataggggccccgcccccccttctcctcttaaggaaacctccttcagcataggactacaggttcttttcccattcctgctcgctgggtttggcacggtggcagccggaatggttctcgatattgtgcagcactgggaggtcttccaaaaggtgacagaagtatttatcctggtgcccgccctgctggggttaaagggcaacttggagatgactctcgcctctagactgagtaccgcagccaatattggtcacatggacacacctaaagagttgtggcgtatgatcacaggaaatatggccctgatccaggtacaggctacagttgtgggctttctggcttccatcgctgccgtcgtcttcggatggattcccgatgggcacttcagcattccgcacgcattcctgctctgcgcgtctagtgtcgcaacagcattcattgcatccctggtactgggcatgattatgattggtgtcattattggaagcaggaaaattggaatcaatcccgataacgtggcgacacccatagccgcaagtttgggcgacttgattactctggcattgctgtctggcattagctggggactgtacctggagcttaaccattggcgttacatctaccccctggtgtgtgcctttttcgttgccctacttccggtctgggtcgtgctggcccgccggtctccagctacccgtgaagtgctgtatagcggctgggaacctgtgatcatagctatggctatttctagcgtcggcggcttgattttagataagactgtgagcgaccctaatttcgcaggaatggcagtgtttacacctgtgatcaatggagtggggggtaacctggtggctgtacaggctagtagaatttcaacattcctccacatgaacggcatgcccggagagaattcagaacaggctccgcggcgttgcccttctccctgtaccacattcttttctcccgatgttaatagcaggagcgcacgggttctttttctgctggttgtccccggtcacctggtcttcctgtatacaatttcttgtatgcaagggggtcacacaacgctgacacttatctttattatcttctatatgactgccgccctgctccaagtgctgattctgctgtacatagctgattggatggtccactggatgtggggcaggggtctggaccctgataacttctccatcccttacctgactgctctgggagatttgttgggaaccgggctcctggccctctcatttcacgtgctgtggttgataggcgaccgggacactgacgtgggcgattag

SEQ ID NO: 135448 - DNA, 1722 bp, Artificial Sequence
  Description of Artificial Sequence: Synthetic coding sequence
atgaccaatagtaagggcaggtccattaccgataagacctccgggggcccctcaagcggaggaggctttgttgactggaccttgaggttaaacaccatacagagcgacaaattcttgaacctgctgctaagcatggtgcctgttatttatcagaagaaccaagaagaccgccataagaaagctaacggaatttggcaggatggcttaagcactgcggtgcaaactttctccaatcgcagcgagcagcacatggagtatcatagcttctcggagcaatcctttcatgccaataacggccacgccagtagttcatgctcacagaagtatgacgattatgctaactacaattattgtgacggtcgggaaacatcggaaacaaccgccatgctgcaggatgaggatatttccagcgatggagacgaagacgccattgtggaagtgactcctaaacttcctaaggagagctccggtatcatggcactgcagattctggtgccatttctcctagcgggcttcggtactgtctcggccggtatggtgctcgatatcgttcagcattgggaagtttttagaaaggtgactgaagttttcattctggtgcctgccctgctaggtcttaaaggaaatttagagatgacgcttgcctctagactgagtaccgcggtcaatataggtaagatggactcacctatcgagaagtggaatttaatcattgggaacctggcattaaagcaggtgcaggccaccgttgtcggctttctggccgcagtagctgctatcattcttggatggattccagaaggcaagtactatttagatcactccattctactgtgttcaagttccgttgcgacagcttttattgcctcacttctacagggtatcatcatggttggcgtcatcgtggggtctaaaaagactggtatcaatccagacaatgtggccactccgatcgccgccagctttggcgatctgataacactcgctatactagcatggatttcccaggggctgtacagctgcctcgagacttattactacatctcgcccctcgtgggtgtgttcttcttggctctaacccccatttggattatcattgcagctaagcaccctgccacccgtacagtgctccattccggctgggagcctgttattactgctatggtgatatcatccatagggggtttgattcttgacaccacagtatccgatccgaatctcgttggtatcgtggtttacactcctgttatcaatgggattggtggaaacctggtggccattcaagcttccagaatttctacctatctgcacctgcactcaatccctggcgagctccctgacgagccgaagggatgctactacccgtttagaactttcttcggccccggggtgaataacaagagcgctcaagtgctcctcttgttggttatacctgggcacctgattttcctatacactatccaccttatgaagtcagggcacaccagcctcaccattatcttcatcgtggtatacctgttcggtgcggtgcttcaagtattcacattgctttggatagctgattggatggtccaccatttctggaggaaaggaaaagaccccgactctttcagcatcccgtacctgactgctcttggggacctgcttggtacagccctgctagcgctatccttccatttcctgtggttaattggagatcgggatggtgacgtgggggattag

SEQ ID NO: 135449 - DNA, 369 bp, Artificial Sequence
  Description of Artificial Sequence: Synthetic coding sequence
atgacaaactctaaagggcgatcgattaccgacaaaacaagtgggggaccttccagtgggggcgggttcgtcgactggacactcagactcaacactatccagagtgacaagtttctcaatctgctgctcagtatggtgccagtcatttatcagaagaaccaggaggatcggcacaaaaaggccaacggcatctggcaggacggtctttccacagctgtgcagacatttagcaacagatccgaacagcacatggagtaccacagctttagcgagcaatcttttcacgcgaacaatggacatgcttctagctcctgcagccaaaagtatgatgactacgcaaactataactactgcgatggtagagagtag

SEQ ID NO: 135450 - DNA, 432 bp, Artificial Sequence
  Description of Artificial Sequence: Synthetic coding sequence
atgacgaattctaagggccggagtattactgacaaaacctctggaggcccttcgagtggaggcgggtttgtcgattggacactgaggctcaacaccattcagagcgacaaattccttaacctgctgttaagtatggtccccgtgatttaccagaaaaatcaggaggaccgccacaaaaaggcaaatggaatctggcaggatggcctgtccacagccgtgcaaaccttcagcaacaggagtgagcaacatatggaatatcacagctttagcgagcagtccttccacgcgaataatgggcatgcaagtagtagttgtagccagaagtacgacgactatgccaactacaactactgcgacggccgagagacatctgagactaccgctatgctgcaggatgaggacatctcgtctgatggtgacgaggacgcctag

SEQ ID NO: 135451 - DNA, 141 bp, Artificial Sequence
  Description of Artificial Sequence: Synthetic coding sequence
atgaccaactctaagggtagatctataaccgacaaaacaagtggtgggccctcttcaggcggtgggtttgtcgattggaccctgcgcttgaatactatccagagcgacaaatttttaaatcttctacttagcatggtatag

SEQ ID NO: 135452 - DNA, 219 bp, Artificial Sequence
  Description of Artificial Sequence: Synthetic coding sequence
atgaccaactccaaaggccgctcgataacagataaaacatccggaggcccgtcttcaggcggaggatttgtcgactggaccctgagactgaacacaatccagtctgataagtttctgaacttactcttgtccatggtcccagttatttatcaaaaaaaccaggaagacagacataaaaaagcaaatgggatttggcaggacgggctatccacagcatag

SEQ ID NO: 135453 - DNA, 39 bp, Artificial Sequence
  Description of Artificial Sequence: Synthetic coding sequence
atgactaactccaaagggaggtcgattaccgataagtag

SEQ ID NO: 135454 - DNA, 231 bp, Artificial Sequence
  Description of Artificial Sequence: Synthetic coding sequence
atgacgaatagcaagggcagatctatcacagataagacctcgggcggtccttcctcaggcggtggcttcgtggattggactctccgactgaataccatacagagcgacaaattcctgaatctgttgctcagtatggtgcccgttatttaccagaagaaccaggaggaccgacacaaaaaagccaacggaatatggcaagatgggttatcaacagctgtgcagacattctag

SEQ ID NO: 135455 - DNA, 285 bp, Artificial Sequence
  Description of Artificial Sequence: Synthetic coding sequence
atgacaaactccaaaggcaggtccatcaccgataaaacgagtggcggcccgtcttctggcggcggatttgtcgattggacacttcgcctgaacacaattcagtcagataagttcttgaacttactgctgtctatggtccctgtcatataccagaagaatcaggaagatagacataagaaggctaatgggatttggcaagacgggctgagcacggccgtgcagacctttagcaacaggtctgaacagcacatggaataccacagtttttccgaacagtccttttag

SEQ ID NO: 135456 - DNA, 1524 bp, Artificial Sequence
  Description of Artificial Sequence: Synthetic coding sequence
atggacgggacagagacacgccagaggagattagactcctgtggtaaacctggggagctgggactgccccaccccctttcaactggaggtctccccgtggcaagcgaggacggcgcattacgagctcccgagtcccagagtgtgaccccaaaaccactggaaaccgagcccagccgcgaaaccacctggtctataggattgcaggtgactgtgccgttcatgtttgccggcctgggcctgtcttgggctggaatgctgctcgattacttccagcattggcccgtcttcgttgaagtgaaagatctgttgacactcgtcccccctctggtcggcctaaaaggaaatctagagatgacattggcgtctcgcctgagcactgcggcgaacaccggccaaatcgacgatccgcaagaacaacaccgcgtaatatcctctaacctggccttaattcaagtccaggccactgtggtggggctcctcgcagccgtggctgcactccttttaggtgtcgtgtctcgcgaagaggtcgacgtcgcaaaggtagagctcctttgcgcaagtagcgtgctgactgctttcctggcagccttcgccttaggggtcctaatggtgtgcatcgtgattggcgcgcgcaaactcggtgtcaaccccgataacatcgcgacccctattgccgctagtctcggggatcttataacactttctatactggccttagtctctagtttcttctaccgccataaagactcccggtaccttacccccctagtgtgcctctctttcgccgctctgactccagtatgggtgctgattgctaaacagtccccacccatagtgaaaatcttgaaattcgggtggtttcctattatcctggctatggtgatcagttcttttggcggtttaattctttccaaaaccgtcagtaagcaacaatacaagggcatggctattttcacacccgtcatatgcggggtggggggaaacttggtggcaattcagacatctcgcatcagcacttacctgcacatgtggtcggcgccaggagtgctaccccttcaaatgaagaagttctggcctaacccctgtagtactttctgtacctcggagataaacagcatgagtgctagggttctcttgctgcttgttgtgcccggccatctgattttcttctatattatctatctcgtggagggtcagagcgtaataaattcacaaacatttgtagtgttatatttgcttgccggactaatccaggtcacaattctgctctatctggccgaggtgatggttagactcacgtggcatcaggcactggatccagacaaccattgtatcccttaccttacagggctaggcgacttactcggcagcagttccgttggccacactgcagctgtccctaggagatgtaccgccagtcctggatgggggctgattcagccatttatctgcacacagcacctcatagtatcccttttgagtttttactttccattctgcttactggccaagactagcatctag

SEQ ID NO: 135457 - DNA, 1416 bp, Artificial Sequence
  Description of Artificial Sequence: Synthetic coding sequence
atggatggaacagaaacaagacagcgtaggctggatagctgtggcaaacccggggagctgggactgccgcatcctctgagtaccgggggacttcctgtggctagcgaggacggggccctaagagcccccgaatcacagtctgtcacccctaagcccctagagacagagcctagtcgtgaaaccacatggagcattggactgcaggtaacggtgccctttatgttcgcaggtctgggtctttcatgggcagggatgctgctggactactttcaggctaataccggacagatagacgacccccaggaacagcatagagtcatttcttccaacctggccctgatccaagtacaagctaccgtggtcggactattggcggctgtggcagccctattattgggcgtggtttcacgagaggaggtggacgtagctaaagtggagttgctttgcgcttcttctgtgttaactgcctttctggctgcattcgccctgggtgttctgatggtctgcatcgtgattggagcccggaagttgggagtgaaccccgataatattgctacacccatcgccgcgagcctcggggacttaattactcttagcattctcgctctggtgagttcatttttttacaggcacaaggactccagatatcttacacccctggtctgcctttcattcgctgctttgactccggtttgggtcctgattgccaagcagtctcctccaattgtcaaaattttgaaattcggctggttccctatcatcctggcgatggtgatcagctcttttggtggtcttattctctctaagacagtctccaaacagcagtacaaagggatggcaatcttcacacctgtaatctgtggcgtaggcgggaatctggtggcaatacagaccagccgaatcagtacttacctacacatgtggtcggccccaggggtgctgccactccagatgaagaagttctggcccaacccatgttccactttctgtaccagcgaaatcaattccatgagcgcccgagtcctgctgcttctggtggtacctggacacctcatctttttctacatcatctacctggtcgagggccagtcagtgatcaacagtcagacattcgttgtgctgtacctgctggcaggactcatccaggttacaatccttctttacctcgcagaggttatggtgcggctcacctggcatcaagcgctggatcccgacaatcactgcatcccttatcttacaggtttaggcgacttgctcggctcctcttccgttgggcacacagccgccgtaccacgccggtgtacagcttcgccgggctggggactgatccagcccttcatttgcacacagcacctcattgtcagcctgttgtctttttattttccattctgccttctggccaagacttctatctag

SEQ ID NO: 135458 - DNA, 1464 bp, Artificial Sequence
  Description of Artificial Sequence: Synthetic coding sequence
atggacggcacagaaactagacagcgccgcttagacagttgtggcaaacctggggaattaggacttccccatcctttaagcactggtgggctgccagttgccagcgaagacggtgccctaagggcgcccgagtcacagagcgtcaccccaaagcccctcgaaacagaacctagcagagagactacctggtccatcggcctgcaggtcaccgttcccttcatgttcgctgggctgggactgagctgggccggcatgctgcttgattatttccagcactggcccgtatttgttgaagtaaaggatctgctgacactggtcccccctctggtcggactgaaagggaatttagagatgacacttgccagtaggctctctacggctgcgaataccgggcagatcgatgacccacaggagcagcacagggtcataagctcaaaccttgctctcatacaggtgcaagccactgtggttggattgttggctgcagtggccgctctgctgttaggagtggtctccagagaggaggtcgacgtggccaaagtcgaactactgtgcgcctcttccgtgctcacagcgtttctggccgcgtttgcactcggcgtcctgatggtttgtatagttattggggccagaaaattgggtgtcaacccagataacatcgcaacaccaatcgctgcgagcctgggagatttaatcaccctgtctatcctcgctctcgtgtcttcctttttttaccgccacaaggactcccggtacctaacacccctggtttgcctctccttcgcagccctgacccccgtgtgggtgttaatagctaaacagtctccacctatcgtgaagattctgaaatttgggtggtttccaatcatactggcaatggtcatttcatctttcgggggtctgatactgtcgaagacggtaagcaagcaacaatataagggaatggccatcttcacaccagttatctgcggcgtaggcgggaatcttgttgccatacaaacaagccggatttccacctacctgcatatgtggagcgctccgggggtcctacctttgcagatgaaaaaattctggcccaatccatgcagtactttctgtacttcagagataaattctatgtccgcccgggttctgctcctcctcgtggttccaggtcaccttatcttcttctacatcatttacttagtcgagggtcagagtgttataaactcccaaacatttgtcgtgctttatcttttggctggacttattcaggtcacaattcttctgtacctcgctgaagtgatggttcgcttgacatggcaccaggctttggaccctgacaaccattgtatcccctatctgactggactgggggatctcctaggaacaggactgctcgccctgtgttttttcaccgactggctcctcaaaagcaaggccgaactgggaggaatctccgaactcgcttcagggcctccctag

SEQ ID NO: 135459 - DNA, 1386 bp, Artificial Sequence
  Description of Artificial Sequence: Synthetic coding sequence
atggtggtcacacaactcaatctcgaattctgcttccagggcaagaagctacgtggattctcatgcgaactgactcgttccccacacggtgtgctccccgagtctttctttaccataatgtgccaggtggtggttcccattctactgagcggcctgtgtatgatgacagctggtctggttatgaacaccatccagcactggccggtcttcgtggaggtgaaggatttgctgactctggttcctccactggttggcttaaagggaaatctcgaaatgactctggcctcccgtctttccacggcagctaataccggtcagatcgatgatccacaggagcagcaccgagttataagttcaaacctagccttaatacaggttcaggccactgtggttggacttctggcagccgtggcagccctacttctcggcgttgtgtcacgagaggaagtcgacgtagcaaaggttgaattattgtgcgcaagctcagtactcacggcatttctggcagctttcgccttaggcgttctgatggtctgtatagtcataggggcccgtaagctgggagtgaatcctgataatattgccacaccaattgccgcaagcttgggggacttaatcaccctgtctatcctggcacttgtgtcatcattcttctacaggcacaaagattcacgctatctcacacctctggtgtgcttgagcttcgccgctttgacacctgtctgggtgctgatcgccaagcagtcaccgcccattgttaagatactgaaattcgggtggtttccaatcatcctggccatggttatcagtagctttggaggcttgatcttatcgaagacagtgagtaagcagcaatacaaaggcatggctattttcacacccgttatttgtggcgtgggggggaacctggtggctattcagacctcgagaatttctacttacctgcacatgtggtctgctcccggggttcttccactgcagatgaaaaagttttggcccaacccttgctccaccttttgcacgagtgaaattaacagcatgtctgcccgcgttctccttctacttgtggtgcctgggcaccttatttttttctacatcatatacctggtcgaaggccagagtgtgataaacagtcagacatttgtcgtgctgtatctcttagccggcttaattcaggtgactatcctgctgtatctggctgaggttatggtaagactcacttggcatcaggcgttggacccggacaaccattgcattccatacttgacaggccttggcgacctcctgggtactgggcttctggccttatgcttctttacagattggttgctgaaatctaaggctgaattaggcggaataagtgagctggcatctggtccaccctag

SEQ ID NO: 135460 - DNA, 1437 bp, Artificial Sequence
  Description of Artificial Sequence: Synthetic coding sequence
atggatggtaccgagacgcgacagcgccggctggattcgtgcggtaaacccggcgagctgggattgccacatcccttgagtacagggggcctccctgtggcatccgaagatggtgccctccgggcccctgaaagtcagtccgtcactccaaagccactggaaacagaaccgtctcgggtgacagttcccttcatgttcgccggactggggctttcctgggccggtatgctgctggactacttccagcattggccggtgttcgtagaggttaaagacttgctgaccttagtgcccccgttggtagggctcaagggcaatcttgaaatgaccctggcttcgaggctgtctactgcggcaaacacagggcagatcgacgatccccaggagcagcatcgggtcatttcgtccaatctcgctctgatccaagttcaggccaccgttgtgggcctcctcgccgcggtagcagccctgttgcttggcgtcgtatcaagggaagaggtggacgtcgctaaggttgagctcctgtgtgcttcttctgtgcttactgcctttttggcggctttcgctctgggtgtactgatggtatgtatcgtcatcggggcacggaagttaggcgtgaaccctgacaacatcgcgacacctatagcagcatcactgggggatttgattacactgtccatcctcgccctggtgtccagcttcttctaccggcacaaggatagtcgatacctcacccctttggtctgtctctcctttgctgccctcactcctgtgtgggtcctgattgccaagcagagtcccccgattgtcaaaatcttgaagtttggatggttccccattatcctggccatggtaatctcttcgtttgggggcttgattctcagcaagaccgtctccaagcagcagtataagggcatggccattttcacccctgtgatttgcggcgtcgggggaaatcttgtggcgattcagacaagccggattagtacttacctgcatatgtggtctgcacccggagtgttgcccctgcaaatgaagaagttctggccaaatccatgtagtacattttgtacctctgaaattaactctatgagtgctcgggttttgttactgttggtggtgccgggtcacctaatatttttctatatcatatatctcgtggaaggccagtcagtgatcaatagccagacattcgtggttctctaccttctcgcagggcttatccaggttaccattctcctctatttggctgaggtgatggttcgactaacttggcaccaggctcttgaccctgataatcattgtatcccttatctgaccggattgggggacctgctggggacaggtctcctggctctgtgtttctttaccgattggttgctcaaatcgaaagctgaattgggtggtattagcgagctcgccagcgggcctccatag

SEQ ID NO: 135461 - DNA, 459 bp, Artificial Sequence
  Description of Artificial Sequence: Synthetic coding sequence
atggatggcacagagacacggcagcggcgtttggacagctgtggtaagccaggagagctaggcttgccccaccctctgtcaactgggggtcttcctgtcgcctcagaagacggggctctgcgggctcccgagtcacaatctgtgacccccaagcccttggagacagagcccagccgagagacgacatggtcaattggcctgcaggtcacagtcccattcatgttcgctggcctgggactgagctgggctggcatgctcctggattattttcagcactggccagtgttcgtggaggtaaaagatctgttaaccctggtcccccccttagtggggctcaagggcaatttggagatgaccctggcatcgagactgtccaccgccgccaatacagggcagatcgatgatccgcaggagcagcatcgagtgatcagctcaaaccttgcactcatacaagtctag

SEQ ID NO: 135462 - DNA, 459 bp, Artificial Sequence
  Description of Artificial Sequence: Synthetic coding sequence
atggacggcacagagacacgccaaaggaggttggactcgtgtggtaaacccggggaattgggactaccgcatcccctttccactggcggcctgcccgtggcgagcgaagacggagccctaagagcaccggagagtcagtcggttactccgaagccacttgaaaccgagcctagtcgtgagaccacgtggtctattggcctccaggtcaccgtgccattcatgttcgcgggcctgggcttatcctgggccggcatgctactcgactatttccagcactggccggtttttgttgaggttaaggaccttctcaccttagtgccaccgctcgtgggtctgaaggggaacttggagatgacgcttgcgtcacgcctcagcaccgctgcgaacacaggacagatcgacgaccctcaggagcagcatcgagtgatttcctcaaacctcgcactgattcaggtttag

SEQ ID NO: 135463 - DNA, 261 bp, Artificial Sequence
  Description of Artificial Sequence: Synthetic coding sequence
atggacggaacagaaaccagacaacgcagactcgactcctgtggaaagcctggggaactggggctgccacacccattgagcactggagggctgcccgtcgctagcgaggatggggctctaagggccccagaaagccaaagcgtaaccccaaagcctctcgagacagaaccatccagagaaactacatggtcgataggattacaagtgacggtcccttttatgtttgccggactgggactatcatgggccggcatgctatag

SEQ ID NO: 135464 - DNA, 606 bp, Artificial Sequence
  Description of Artificial Sequence: Synthetic coding sequence
atggatgggacagaaacacggcagaggcggcttgactcatgtggcaagcccggtgaactgggtctgccccacccattaagtaccgggggcctcccagtcgcttccgaggacggagctctgagggcccctgaatcccagtccgtcactccgaaaccgctcgaaactgagcctagtcgggaaacaacctggtctatcggcctgcaggtcaccgtgccgttcatgtttgctggactgggcctgtcttgggccggcatgctgcttgattactttcagcactggcctgtgtttgttgaggtgaaggatctgctgactctggtgccacccctggttggcctgaaaggcaatctggaaatgacgctggcctctcgtttgagcacagctgccaataccggacaaattgatgatccacaggaacaacatcgggttatctcttccaatctggctctcatccaagtgcaggccaccgtggtgggcctactggctgctgtcgccgcgctcctgttaggagtggtgagtcgagaagaggtcgatgtggccaaagtcgagttgctctgcgccagcagtgtgcttaccgcattcttggccgcttttgcactcggagaatag

SEQ ID NO: 135465 - DNA, 414 bp, Artificial Sequence
  Description of Artificial Sequence: Synthetic coding sequence
atggatggcaccgaaactagacagaggagactcgatagctgcggcaaaccaggggagctgggcctcccacatcccctgagcactggtggcctccccgtagcgagcgaggatggggctctgcgggcccccgaaagccagagcgtgactcctaagccactcgagactgaaccatcacgcgagactacttggagcattggcctgcaggtgactgtcccttttatgttcgctggattaggcctgtcctgggcaggcatgctcctcgattactttcaagcgaacaccgggcaaatcgatgacccccaggagcagcacagggttatctcctcaaacctcgcattgatccaagtacaggccactgtggtaggtctgttggcagccgtggccgccctactgttaggggtggtgagcagatag

SEQ ID NO: 135466 - DNA, 459 bp, Artificial Sequence
  Description of Artificial Sequence: Synthetic coding sequence
atggacggcaccgagacgaggcagcggcggctggactcctgtggcaaacctggggagctcggactgcctcaccctttgtcaacaggcgggcttcctgtcgccagcgaagacggcgccctcagggcgcctgaaagccagagcgttacacccaagcccttagagaccgaaccgtccagagagactacctggagcattgggttgcaggtcacagtacctttcatgttcgcgggcctgggattatcctgggcaggcatgctgctagattacttccagcactggcctgtgtttgtagaggttaaggacctactgacactagtgcctcccctggtgggtctcaaaggaaatttagaaatgactctcgcttcacgactttccacagctgccaacacagggcagatcgacgatccacaagagcagcacagagtgatctcctcaaacttagcgctgatccaggtgtag

SEQ ID NO: 135467 - DNA, 1680 bp, Artificial Sequence
  Description of Artificial Sequence: Synthetic coding sequence
atggcccctaccctgcagcaagcatatcgtcgccggtggtggatggcctgtacagcagtgcttgagaacctgttcttcagcgcggtgcttctgggctggggcagtctgctgatcatccttaaaaatgaaggcttttattcttctacctgtcccgcagaatccagcacgaacaccacccaggacgagcaacgcaggtggccggggtgcgaccagcaagacgagatgctgaatctaggatttactattgggagctttgttctgtcagccacgactttgccattaggaattctgatggacaggttcggtccacgacccgtgaggcttgtaggatctgcctgtttcacggccagctgcaccctgatggctctggcctccagggacgtggaggccctttctccactcattttcctggcactatccctgaacggtttcggcggtatatgcttgacttttacaagtctgaccttgcctaatatgtttgggaacctgaggtccaccctgatggcacttatgattggctcctacgcaagttccgccattacctttcctggtatcaaactcatatacgatgccggtgttgctttcgtcgtgatcatgtttacatggagcggcttggcctgcctaatttttctcaactgcacccttaattggcccatcgaagcatttcctgctccagaagaggttaattacacaaagaaaattaaactgtcggggctggcgctggatcacaaagtgaccggcgatctcttttacacccatgtgaccacgatggggcagcggctctctcagaaggcaccgtccctcgaggacggcagcgatgcctttatgagcccacaggacgtgaggggtacatccgaaaaccttcccgagcgcagcgtccctctgagaaagtccctgtgcagtcctaccttcctgtggtcactgttaaccatgggtatgacgcagctgcggatcatcttctacatggccgccgtaaacaagatgctggaatacctggtcacaggcggtcaggaacacgagacaaatgagcagcagcagaaggttgcagaaaccgtgggattctacagcagcgtcttcggggcaatgcagctgttatgtctccttacttgccctctcattggatacataatggattggagaatcaaagactgcgtggatgcccctacacagggtaccgtactgggcgacgcgcgcgacggagtcgccacgaaatccataaggccgcgctattgcaagattcagaaactgacgaacgcaatttctgcctttacacttaccaatcttcttttagtgggtttcggaattacgtgccttatcaacaacttacatctccaatttgtgacctttgtactgcacaccatagtaagaggttttttccatagcgcctgtggtagcctgtatgcagctgtttttcccagcaaccatttcggaaccttgacgggactgcagagccttatatcggccgtcttcgccctattgcaacagccactttttatggccatggtgggacctttgaagggcgaaccattctgggtgaatctggggctgctgctcttttcacttctgggttttttgctaccctcctacctgttctactatcgggcacgactgcagcaggagtatgccgctaacggcatggggccccttaaggtgttgagcgggtctgaggtcaccgcgtag

SEQ ID NO: 135468 - DNA, 1680 bp, Artificial Sequence
  Description of Artificial Sequence: Synthetic coding sequence
atggcccctacacttcagcaggcatatagaaggcgctggtggatggcctgcaccgctgtgctggaaaacctgtttttcagtgcagtcctgctgggttggggttcgttattgatcatccttaaaaacgaagggttctactcctccacctgtcccgcagaatcatcgacaaataccacacaagacgagcaacggaggtggccaggctgtgaccagcaggatgagatgctgaatttaggcttcacaattgggagtttcgtccttagtgccacgacgctgcccctggggatcctgatggaccgcttcgggcctagacctgtgagattagtagggtctgcctgttttaccgcgtcttgtacgctgatggctctcgcctcccgggacgtggaagctctcagccctctcatttttctggcgctcagcctgaacggttttggcgggatctgcctgacgttcacctcactgaccttgccgaacatgtttggtaacctgcgcagcacattaatggcgcttatgatcgggagctacgcttcatcggctatcaccttcccaggcattaaactcatttacgacgctggggtggcgttcgtggtcattatgttcacttggtctggactcgcatgtttgatctttttgaactgcacccttaactggccaattgaggcatttcctgctccggaagaggtgaattacaccaagaaaatcaaattatcagggttagctctagaccataaggtcactggtgaccttttctatacacatgttacgacaatgggtcagcgtctctctcagaaggcaccatctctggaggatggtagcgatgccttcatgtccccccaggacgtgcgggggacctctgaaaatttacccgaacgttctgtccccttgcggaaatcactttgctcgcctacttttctttggtccttgctaacaatggggatgacgcagttgcggatcatattttatatggccgctgtcaacaaaatgctggagtacctggtcactgggggccaagagcacgaaactaacgaacaacaacagaaagttgcggagaccgtggggttctattctagtgtcttcggagctatgcagctgttgtgtcttttgacatgcccgctgatcggctacatcatggattggcgtattaaagactgcgtggatgcccccacccagggaaccgtcttgggcgacgcaagggatggggtagccacaaagtcaatacggcccaggtattgcaagatccagaagctgacaaacgccatatccgccttcaccctcaccaatttgcttttagtcggcttcgggatcacatgcttgattaacaaccttcatctgcagttcgtgacatttgttttacatacaatagtaagagggttcttccattctgcttgtgggagtctctatgccgccgtcttcccttctaatcacttcggcacacttaccggccttcagtcactcataagtgccgtgtttgccctgttgcagcaacctctgtttatggcgatggtgggcccccttaagggtgaaccgttttgggtaaacctgggtcttctccttttctctctgctgggattccttctgcctagctatctgttttattaccgggcaagactccagcaagaatacgccgccaacggcatgggacctttaaaagtcttgtctggaagcgaagtcacagcttag

SEQ ID NO: 135469 - DNA, 333 bp, Artificial Sequence
  Description of Artificial Sequence: Synthetic coding sequence
atggccccaacattacaacaggcctaccggcgccgatggtggatggcgtgtaccgctgtgttagagaacctctttttctctgcggtgttgctgggctggggtagcctattgataatactgaaaaatgaggggttctattcctccacctgtccagcagagtccagcactaacacaacacaggatgagcagaggcgttggcctggttgtgaccagcaggacgaaatgttgaacttgggcttcacaataggtagctttgtgctatctgcgactaccctacccttaggaatccttatggaccgctttgggccccgccctgtgaggctggttggttag

SEQ ID NO: 135470 - DNA, 1710 bp, Artificial Sequence
  Description of Artificial Sequence: Synthetic coding sequence
atggcccccaccctagccaccgctcaccggcgccgatggtggatggcttgcaccgcagtactggaaaatctgttgttcagtgcggtgctgctcggttggggttcacttctcattatgctcaagtcggagggtttctacagctacctgtgtacagagcccgagaatgtcacaaatgggacagtgggcgggaccgctgagcctggccacgaagaggtgtcatggatgaatggatggctctcatgccaagctcaggatgaaatgttgaacttggcctttactgtcggatccttcctgctcagcgccatcacccttccacttggaatcgttatggataaatacggccctagaaagctgaggctcctgggctcagcatgttttgccgtgtcttgtctcctcattgcttacggagccagcaaacccaacgctctctctgttctgattttcattgcactggcactgaatggctttgggggtatgtgcatgacgttcacgagcctgacgctgcccaacatgttcggcgatctacggagcaccttcattgccctgatgatcgggtcttatgcgtccagtgccgtcaccttcccaggtatcaaactcatttacgacgctggcgtctccttcatcgttgttctggtggtgtgggccggctgttccggtctggtctttctgaactgtttcttcaactggcctcttgaaccatttccaggcccggaagatatggactacagtgtcaaaattaagtttagctggttgggctttgaccacaagattacaggtaaacagttctacaaacaagtaaccaccgttggccgaaggctgtccgtgggtagttccatgagatctgctaaggagcaagtagccttacaagagggccacaagctgtgccttagcactgtggacctggaagtgaaatgccaacccgacgccgcggtagctccttccttcatgcattcggtattcagccccatcctcctgcttagccttgtgaccatgtgcgtgacccagctgagattaatcttctacatgggcgcgatgaataatattctgaagttcctggtgtccggtgatcaaaaaacagttggactgtatacttccattttcggggtcctgcaactcctttgcttattgactgcccccgtgattggatatataatggattggaggttgaaggaatgcgaggacgcaagcgaagaaccagaggagaaagatgccaatcagggagagaaaaaaaaaaagaaacgcgacaggcagatccaaaagatcacaaacgccatgcgagcattcgcattcactaacctgctgctcgtcggattcggcgtaacctgtctgattccaaacctgccccttcagatcctctctttcatcctgcacacaattgtccgaggattcattcattcagctgtggggggcctgtacgccgcagtgtacccatcaacccagtttggttctctgactgggcttcagtccttgatcagcgctcttttcgcactgctgcaacagccgttgtttctggccatgatgggtccactgcagggcgatccgctgtgggtgaacgtgggccttttgttactgtcgctcctcggcttctgcctgcctctctatttaatctgttaccgcaggcagttggaacgccagctgcaacaaaggcaggaggacgataagctgttcctgaaaattaacggatcctcaaaccaggaggctttcgtgtag

SEQ ID NO: 135471 - DNA, 1722 bp, Artificial Sequence
  Description of Artificial Sequence: Synthetic coding sequence
atggcacccaccctggccactgcgcaccgaagacgatggtggatggcctgtacagctgtactggagaacctgttattctccgctgtcctcctgggatggggtagcctcttaatcatgttgaagtccgagggattctacagctatttgtgcacagagcctgagaatgtgaccaacggaaccgttggcgggactgccgaacctggacatgaagaggtgtcttggatgaatggatggttgtcatgccaggcacaagacgagatgctgaacctggccttcaccgttggcagtttcctactcagtgcaatcacactgcctctagggatcgtgatggataagtacggtcctcggaaactgcgtctcttaggctctgcttgcttcgccgtgtcctgcctgctgatcgcatacggcgctagcaaacctaacgccctctccgtgctgatttttattgctttggccctgaacggctttggcggcatgtgcatgacattcaccagcttgactctgcccaatatgttcggtgatttacgcagtacttttatcgcgctcatgatagggagctacgcctccagtgctgtgacttttcctggcattaagttgatctacgacgccggagtgtccttcatagtagtcttagttgtctgggctgggtgcagcggccttgttttcttgaattgtttttttaattggcctcttgaaccctttcccgggccagaggatatggattactctgtgaaaatcaaatttagttggctggggtttgatcacaaaattaccgggaagcagttctacaagcaggttaccacagtggggagaaggttaagcgtgggtagctctatgagaagtgccaaagagcaggtcgctctccaggaagggcacaagctatgcctgagtacagtcgacctggaagtcaagtgccagccggacgctgctgtagctcccagttttatgcactcagtgtttagccccattcttctcctgtcactcgttactatgtgcgtcacacagttgcgactgattttctatatgggcgcgatgaataatattctgaagttcctggtgtcaggtgaccagaaaacagcatcctctactgtggggctgtatacaagtattttcggcgtactgcagttgctttgcttgttgaccgcccccgtaattggttacatcatggattggcgcctgaaagaatgtgaggacgcgtctgaggagccagaagaaaaggatgctaaccagggggaaaagaaaaagaagaaacgcgaccgccagatccagaagatcaccaacgcgatgcgagcttttgcatttacaaatctgcttctcgtggggtttggggtgacctgccttatccctaaccttccactgcagattctctcatttatattgcacactattgtccgcggattcatccacagcgcagtgggcggtctgtatgccgccgtttacccctcaactcagttcggtagccttaccgggctgcagagtcttatttcagcccttttcgccctgctccaacaacccttgtttctggccatgatggggcctcttcagggggatcctctttgggttaatgttggcctcctgttattgtcccttttgggtttctgcctgccactataccttatatgctataggcggcagctcgaaaggcaactgcagcaaaggcaggaggatgacaaactgtttctgaaaataaacggctcaagcaatcaggaagcatttgtctag

SEQ ID NO: 135472 - DNA, 1299 bp, Artificial Sequence
  Description of Artificial Sequence: Synthetic coding sequence
atgacctatggctctccacaggccaatgcttctccctcggacgctgtagccttggatcacggggaggtatctcgcaggcagcagcaagaactgccgaatatgttcggtgacttgaggtctacctttattgccctaatgattggctcctacgccagttctgcagttacctttcccggtatcaagctgatatatgatgccggcgtgagcttcatcgtagtcctcgttgtgtgggccggatgctcaggccttgtgtttctgaactgttttttcaattggccgctagaacctttccctggcccagaagatatggactactcggtcaaaataaaatttagttggctcggctttgaccataagatcaccgggaagcagttctacaagcaggttacgaccgtgggccggcggctgtcggttggatcttccatgcgaagtgctaaagagcaggttgcccttcaagaagggcataaactttgtctctccactgttgacctggaagttaaatgccaacctgacgccgcagtggcccctagtttcatgcatagcgtgttctctcctatcctcctgttgagcctcgtgaccatgtgtgtgacgcagcttaggcttatcttttacatgggagccatgaataatattttaaaatttctcgtgagcggggatcagaagactgtggggctctacacctcaattttcggagttctgcagctgctgtgcctcctcactgctccagtcattggatatattatggattggcgactgaaagagtgcgaagacgcctcagaggaacctgaggagaaagacgcgaatcagggtgagaagaagaagaagaagagagatcgacaaatacagaaaattaccaacgctatgcgggcctttgccttcaccaacctgttactggtcggatttggtgtgacctgcctgattcctaatctccccctgcagatcctgtcattcattttgcataccattgtgcgcggctttatccattccgccgttggtggactctacgctgcagtctacccctcaactcagttcgggtcactgaccggcttgcagagtttaatcagcgcattatttgccctgcttcaacagccacttttcctcgctatgatgggccctttgcagggagatccactttgggtaaacgtggggttactgctgctatccctgctgggattctgcctccctctctaccttatctgctatcgtcgccagctagaaagacagctgcagcagcgtcaagaagatgacaagctgtttttaaagatcaacggcagctctaaccaagaagcctttgtatag

SEQ ID NO: 135473 - DNA, 1341 bp, Artificial Sequence
  Description of Artificial Sequence: Synthetic coding sequence
atgactagcaaggagattatcctgggcctgtgcctccttagcctggtgctttcaatgatattaatggtgattattcgctacatttctcgcgtgctcgtgtggattctgacaatccttgtgatcctcggttccttggggggtactggagtactctggtggctgtatgcgaaacaacggaggtcccccaaggaaactgttactccggagcagttacagattgcagaagacaatctgagggcgctactcatctacgccattagtgccaccgtctttacagtgatcctgtttcttattatgctcgtcatgcgcaagagagtggccttgactattgcactgttccatgtggcaggcaaggtgtttatccacctcccgctgctggtgtttcagccattctggacctttttcgctcttgtattgttctgggtgtactggattatgaccttgcttttcctgggcacaaccggttcccccgtacagaatgaacaaggctttgtggaattcaaaatctccgggcctcttcagtacatgtggtggtatcacgtagtgggcctgatctggataagcgagttcattcttgcctgtcaacagatgactgttgctggggccgtcgtgacctattattttactagagacaaacggaacctgcctttcacccctattcttgccagcgtaaatcggctgataagatatcacctcggaaccgtcgctaagggctccttcattattaccttagtgaaaatcccgagaatgatcttgatgtacatccactctcagctgaaaggaaaagagaacgcctgcgctaggtgcgttctgaaatcctgcatctgctgcctatggtgcttagaaaaatgtctaaattacctgaatcaaaacgcttatactgccaccgcaatcaattccacaaatttctgcacaagtgcaaaggacgctttcgttattttggtggagaacgctctgcgtgtggcaacgatcaatacagtcggagattttatgctgtttcttggcaaggtcttgattgtatgcagtacaggtcttgccggtatcatgttgctgaattaccagcaggactataccgtgtgggtgctgcccctgataattgtctgtctgtttgctttcttggttgcacattgttttctgtccatttacgagatggtggtggatgttctgttcctgtgtttcgctatcgacacaaaatataatgacggaagtcctggaagggaattctacatggacaaagtcctgatggaatttgtggagaactcaaggaaggccatgaaggaggccggcaagggcggcgtggcggattccagggagctcaaacccatgcttaagaaacgctag

SEQ ID NO: 135474 - DNA, 1974 bp, Artificial Sequence
  Description of Artificial Sequence: Synthetic coding sequence
atgggctgctgtagttctgcctctagcgcagcccagagctccaagcgagagtggaagcctttggaagacagaagctgtaccgatattccctggctgctgctgttcatcctgttttgtatcggaatgggattcatttgcggttttagcatagccactggtgcggctgccagactggttagcggctacgacagctatggcaacatttgcgggcaaaagaacaccaagctggaagcaatccctaacagcgggatggatcacacacagcgcaagtacgtctttttccttgatccttgtaacctggacctgattaaccggaagattaagagtgtggccctctgcgtcgccgcatgcccacggcaggagctaaaaaccctctctgacgtccagaaatttgctgaaataaatggctctgccctatgttcttataatcttaagccaagcgagtacaccacttctcccaaaagctccgttctgtgccctaagttgccggtgccagctagcgcacctattcccttctttcaccgttgtgcacccgtgaacattagttgctacgctaagttcgccgaagcgctgatcacgttcgtctctgacaatagtgtcctgcaccggctgatttcaggcgtgatgacatcaaaggagatcatcttggggctttgcctgcttagtctggtcctgtcaatgatcctgatggtgatcatccgatatataagcagagtgctagtgtggattctcaccattctcgtcattctcggaagtttaggcggtacaggcgtgctgtggtggctgtacgcgaaacaacgcagatcccccaaagagactgtcacacccgagcagctccagattgccgaggataatctgagagctctgctgatttatgccatttctgccacagtcttcacggttatcttgttccttataatgctggtgatgcgtaaaagagttgctctgacaatcgccctattccacgtggccgggaaggttttcatccatctacctctcctggtctttcagcccttttggactttttttgccttggtactcttctgggtgtattggatcatgacgctgttgttccttggcaccaccggttctcctgtccagaacgagcaggggttcgtagaatttaagatttccgggcccctgcagtacatgtggtggtaccacgtggttggcttgatttggattagcgagttcatcctcgcttgtcagcaaatgacggtggccggggcggtggtcacgtactacttcaccagagataagaggaacctcccctttactcccatcctcgccagtgtcaatcggctgatcaggtaccatctcggcacggtggcaaagggcagctttatcatcactctcgttaaaatccccagaatgatcctgatgtacattcattcccagctgaagggcaaggagaacgcttgcgcaaggtgtgtcttaaaaagttgcatctgttgcttgtggtgtctggagaagtgtctgaattacttgaatcagaacgcatatacagctactgccataaattctaccaacttctgcaccagcgccaaggacgcatttgttatcctggtggaaaacgccttgcgtgttgccaccatcaatactgtgggtgatttcatgctgttcctcgggaaagtcctgatcgtctgtagcacaggtctagccggcatcatgctgctgaactaccagcaggactacaccgtttgggttttacccctcataatcgtttgcctcttcgctttcctggtagcacactgcttcctcagcatctatgagatggtggtggacgttcttttcttatgcttcgctatagataccaagtataatgatgggtcgccgggacgggagttctatatggacaaggtgctgatggaattcgtagagaattcccggaaggctatgaaggaggccggaaaggggggagtagccgattcccgggaactgaaacctatggccagcggtgcctcaagcgcctag

SEQ ID NO: 135475 - DNA, 1959 bp, Artificial Sequence
  Description of Artificial Sequence: Synthetic coding sequence
atgggttgctgctccagcgcaagctccgccgcacagagcagtaaaagggagtggaaacccctggaagacaggtcctgtacagatatcccctggttgttgttgttcatcttattctgcatcggcatgggctttatctgcggctttagtattgctaccggcgctgccgctcgcctggtgtccggatacgacagttacggcaacatctgcggacaaaagaatacgaaactagaggcgatcccgaactcaggcatggaccacacccagcggaagtatgtctttttcctggatccatgcaatctagatttgataaatagaaagataaagagcgttgcactgtgcgttgctgcatgtcctcggcaggagttaaaaactctgtcagacgtgcaaaagtttgcagagataaatggctctgcactgtgcagttacaatctgaagccctccgaatatacaacaagccctaagtcgagtgtgctgtgcccaaaacttcccgtgccagcgtctgcccccataccatttttccaccgatgcgcgccagttaatatttcctgctacgcaaagttcgccgaggctctcatcaccttcgtgtcggacaacagcgtcctgcatcgtctcatatctggcgttatgacaagcaaagagatcattctgggtttgtgtctactctccctcgtgctctcaatgatcctaatggtgataattcgctacatctccagggtccttgtgtggatcctcacaatcctggtcatcctgggatcattgggcgggacgggggtactatggtggctctatgccaagcagagaaggagccccaaggaaacagtgaccccagagcagttacagattgctgaggacaacctcagggcactgcttatatacgccataagcgccaccgtctttaccgtgatactgttcctcatcatgctggttatgaggaaacgggtggctcttactatagcattgttccacgtggccggaaaagtgtttatccatttgcccttgttagtgtttcagcctttttggacattcttcgcgctggtcttattctgggtgtactggataatgaccctcctcttcctggggacaacaggctcgcctgtccagaacgagcaggggttcgtggaatttaaaataagtgggccactgcaatatatgtggtggtatcatgtggtgggtttaatctggatttcggaatttatactcgcctgccagcagatgaccgtagccggagccgtggttacctattattttactagggacaaacggaatcttccatttacacctatcctggccagcgtgaatagactgattaggtaccatctgggtaccgtcgctaaaggcagctttattataacgcttgtaaaaatcccgcgtatgatcctgatgtatatccatagccagctgaagggcaaagagaatgcttgtgctaggtgcgtgctgaaaagttgcatctgttgtctttggtgtttggaaaaatgtttgaactaccttaaccaaaatgcatatactgcgacggcaataaactccactaatttttgtacctccgctaaagacgccttcgtaatcttggtggaaaacgccttaagggtggcgacaattaacacagtcggtgattttatgctcttcctcggcaaagtcctgatcgtctgctccactggattggccggtatcatgcttttgaattatcagcaggattatacagtgtgggtcctcccattgatcattgtctgcctcttcgcgtttctagttgcccattgcttcttatcgatatatgaaatggtggttgacgtactctttctgtgcttcgccatcgacaccaagtacaatgacggcagcccaggaagggagttttatatggacaaagttttgatggaattcgtggagaattcgagaaaagccatgaaagaggctggaaaaggcggtgttgctgactcacgtgaattgaaacctatgatcaaatag

SEQ ID NO: 135476 - DNA, 1965 bp, Artificial Sequence
  Description of Artificial Sequence: Synthetic coding sequence
atgggctgttgtagctctgcttcgtccgctgcacagagctcgaaaagagagtggaaaccattggaagatcggtcttgcactgacatcccatggctgctgctgtttattttgttctgcatcggaatgggttttatctgcggattctctatcgccaccggagctgcggcaagactcgtaagcggctatgattcctacggtaacatctgcggtcagaaaaatacaaagctcgaggctattcccaattcaggaatggatcatacccagagaaaatatgtgttttttttagatccctgcaacctggacctgattaatagaaagatcaaaagcgtggccctgtgtgttgccgcttgtcccagacaagaattgaaaacacttagcgatgtacagaagtttgcggagattaacggctctgctctttgttcatataatctcaaacccagcgagtatacaacttctccaaaaagttccgtactctgccctaaactgcccgtgcctgcgtctgcacccattcccttttttcataggtgcgctcccgtaaatatctcatgttacgccaagtttgccgaggctttgattactttcgtctccgataatagtgtcttgcatcgcctcatcagtggagtcatgacgtccaaagaaatcatccttgggctgtgtctgctcagcctagtcctttcaatgattctgatggtgattattcgctacatcagtcgtgtgctggtttggatcttgactatcctggtgattttggggagccttggcggcactggtgtgctctggtggctgtatgctaagcagcggcgttctccaaaagaaacagtgacacctgagcaactgcagatcgccgaggacaatctgagagccctcctgatctatgcaatatcagccactgttttcaccgtgatcttattccttatcatgctggttatgcgaaagcgggtcgcccttaccatcgccttgttccatgttgccggtaaggtgttcattcacctgcccctcctggtcttccagcccttctggaccttcttcgccctagtgttgttttgggtgtattggattatgaccttgctattcttgggaaccaccggaagtcctgttcagaatgaacaaggattcgttgagttcaaaatttcgggacctttgcaatacatgtggtggtatcacgtggtcggcctgatctggatttctgagttcatcttggcttgtcagcaaatgacagtagctggagcagtcgtaacgtattactttacccgggacaagcggaatttgccatttaccccaatactggccagtgtgaacagactcatcaggtatcatcttgggacagtcgccaaaggcagtttcattattaccctcgtcaaaatacccaggatgatactgatgtacatccattcccagctcaaaggtaaagagaacgcgtgtgctcggtgcgtactgaagtcctgtatctgttgcctgtggtgcctggagaaatgcctcaactatctgaatcagaatgcctacacagcgaccgcgattaactccacaaatttttgcacgagtgcaaaggacgcattcgtgatcctcgtcgagaacgccttgcgcgttgctacaatcaatacggtgggagacttcatgctgttcctgggaaaggtcctcatagtgtgctctaccggcctcgccggcattatgctgctgaactaccagcaggattacactgtttgggtgctcccacttataatagtgtgtttatttgcttttctcgtggctcactgttttctgagcatctacgaaatggtggtagatgtcctgtttctttgctttgctatcgacacaaaatacaatgatggtagtccaggccgggagttttatatggacaaagtgcttatggaattcgtggagaattctcgaaaagctatgaaggaggccggcaaagggggtgtcgcggattctcgggagctcaaacctatgctgaaaaagagatag

SEQ ID NO: 135477 - DNA, 1974 bp, Artificial Sequence
  Description of Artificial Sequence: Synthetic coding sequence
atgggttgctgctcaagcgccagtagcgctgcccagagttcgaaacgtgagtggaagcctctcgaagacagaagctgtacagacataccttggttactgctgttcatcttattttgtattgggatgggctttatttgcgggttttccatcgcaacaggcgcggctgctcgtctggtctcaggttatgacagctacggtaatatctgcggacagaaaaataccaagctggaagcaatcccaaacagcgggatggaccatacccagagaaagtatgtgttctttttagacccctgtaatcttgacctcattaacagaaagatcaagagtgtcgccttatgtgtcgctgcctgcccacggcaggagctgaagaccctgtcggatgtccagaaatttgcggaaatcaatggaagtgccctatgctcctataatctgaagccctccgaatacacaacttcccccaaatcgagtgttctatgtcccaagttaccagttcctgctagtgccccaataccattcttccaccgctgcgcacctgtcaatatttcctgctacgccaagtttgctgaagccttgatcactttcgtgtctgataactcagtgctccataggctcatcagcggcgttatgacgagtaaggagattatcctgggtctgtgtctcttaagccttgtgctcagcatgatcttgatggtaataatacggtacatctctagagtcctggtgtggatcttgaccatattggtcatcttgggtagtctggggggtacgggcgtcctgtggtggttgtacgcaaagcagagaagatcgcctaaagaaactgtgaccccagagcagctgcaaattgccgaggataatctccgggcactcctgatttacgccatctccgctactgtgtttactgttatcctgtttctaatcatgctggtgatgagaaagcgtgtagctttaacaatagctctttttcatgtcgctggcaaagtattcatccacctacccctcctcgtgtttcagcccttctggacgttttttgccctcgttcttttttgggtctattggattatgacgctcctgttccttggcacaaccggcagtcctgtgcagaatgagcagggtttcgtggaattcaagattagtggcccattacagtatatgtggtggtaccatgtggtgggactgatctggatcagcgagttcatcctggcttgccagcaaatgaccgtggcaggtgccgtggtgacgtattacttcaccagggacaagcgcaatctgccctttacgccaatactggcttctgttaatcggctgatccggtatcatctgggcacagtggctaagggttccttcattatcaccctcgtgaagatcccacgcatgattctcatgtacatacactctcagctgaaaggcaaggagaacgcttgtgcgagatgcgttttgaagagctgcatctgctgtctgtggtgcctggagaagtgcctgaactaccttaatcaaaacgcctatactgctaccgccattaattcaactaatttttgtacaagtgctaaggacgcattcgtgatactggtggaaaatgcacttcgcgtggctaccatcaacactgtgggtgatttcatgctctttctgggaaaagtgcttattgtgtgttccacaggactggccggcattatgcttctgaattatcagcaagactacactgtttgggtgctccctttgattattgtctgcctcttcgcgtttctggttgcacattgcttcctgtctatttacgaaatggtcgttgacgtgctgttcttatgttttgccattgacaccaagtataatgacggcagcccaggcagagagttctatatggacaaggttctgatggagtttgtcgagaactcaagaaaagccatgaaagaggccgggaaggggggtgtcgctgacagcagagagcttaaacctatggccagtggggcaagttcagcctag

SEQ ID NO: 135478 - DNA, 2121 bp, Artificial Sequence
  Description of Artificial Sequence: Synthetic coding sequence
atgggcgacgagaggccccattactatggtaagcacgggacaccccagaagtacgacccgaccttcaagggccctatctacaatcggggatgcaccgacataatctgttgcgtgttcttgttgctagccatagtgggctacgtggcagtaggcatcatagcttggacgcatggcgatccgagaaaggtgatttatccaactgactcaagaggcgagttttgcgggcagaagggcacaaaaaatgaaaataagccttatctgttttactttaacatagtgaagtgtgcttcacccctggtgctgctcgagtttcagtgccctaccccccaaatctgcgtagaaaaatgcccagacaggtacctcacctatcttaacgcccgtagttcccgcgattttgagtattacaagcaattctgtgtgccaggttttaagaataataagggcgtagcagaggtcctgcaagacggagattgtcctgccgtgcttatcccctccaagccgcttgcaagaaggtgttttcccgccatccacgcatacaagggtgtgctgatggtgggcaatgagacaacctacgaagatggccacgggtcccgcaagaatatcaccgacctggtcgagggagccaaaaaagcgaatggggtcctcgaggcgcgccagctggcaatgcgaattttcgaagattacacggtgagctggtattggattattatcggccttgtcattgcgatggccatgtcactgctctttataattctgcttcgattcctggcaggcattatggtctgggtgatgattatcatggtgatcttggtgctaggctatgggatctttcactgctatatggagtacagcagacttcggggagaagccggctcagacgtgtccctggtggacctgggctttcagacagacttcagagtgtatcttcatctgcggcagacatggctcgcatttatgatcattctctcaattctggaagtcatcatcatactccttttgatttttctgcgcaagagaatcctaatcgctattgcacttatcaaggaggcctctcgcgctgttggttatgtgatgtgcagcctgctttatccccttgtgacttttttcctcctgtgtctttgtatcgcttactgggcatccactgccgtctttctcagcacatctaacgaagctgtgtataaaatcttcgatgatagcccttgtccattcactgcaaaaacatgtaatcctgagacatttcctagtagtaacgaatcaaggcaatgccctaacgcacgctgtcagtttgccttctatgggggcgaaagcggttaccatagggccctgctcggtctgcagatcttcaacgctttcatgttcttttggctggccaacttcgtgctagccctagggcaagtgaccctggccggagctttcgcgagctattactgggccttgaggaagcctgacgatctgcctgccttcccgcttttctcagcgttcggacgtgcacttcgatatcataccgggtctctggcgtttggcgctctgatactggctatcgtccaaataattcgagtgatccttgaatatctggatcagcgcttgaaagcagcggagaacaaattcgccaagtgcctgatgacttgcctcaaatgttgtttctggtgcctggagaaatttattaaatttctgaaccgaaacgcatacataatgatcgccatttacggcaccaatttctgcacctcggccaggaacgctttttttctgcttatgaggaatataataagagtcgcagttttggacaaagtcactgacttccttttccttctcggtaaactgctcatcgttggctccgtcgggattctggcttttttcttttttacacaccgcatacgcatcgtacaggataccgcccccccactcaattattactgggttcctatcttgactgttatcgtgggcagctacctaatagcccacggatttttctctgtctacggtatgtgcgtcgacactcttttcctctgctttctggaagatttggaaagaaacgatggctcggcagagcgcccttactttatgtctagcactttgaagaagctcctgaacaagacaaacaaaaaggccgctgagagttag

SEQ ID NO: 135479 - DNA, 2121 bp, Artificial Sequence
  Description of Artificial Sequence: Synthetic coding sequence
atgggggatgagaggccacattactacggcaagcacggaacccctcagaaatacgaccccaccttcaagggtcccatctataaccgcggctgcactgacatcatttgctgcgtttttcttctgctggctatcgttgggtatgtggccgtgggtataatagcatggactcatggcgatcctcgcaaggtgatataccccacggattctaggggcgaattctgtggccaaaagggaacaaagaatgaaaacaaaccatatttgttctacttcaacatcgtgaaatgcgcgagccccctcgtgctgttagaattccagtgtcccactccacaaatctgcgttgaaaagtgcccggacaggtaccttacttacctcaacgcaaggagttcccgagactttgaatattataagcagttctgtgtccccgggtttaagaataacaagggcgttgccgaagttctccaagacggggactgcccggccgttctcatccctagcaagcctcttgcccgaagatgttttcccgcgatccatgcttacaagggggtcctgatggttgggaatgaaacaacctacgaggatggacacggaagccggaagaacatcaccgacctggtagagggtgccaaaaaggctaacggagtgcttgaagcccggcaactggcgatgagaatcttcgaagactataccgtcagctggtactggatcattataggcttggtgattgcaatggctatgtctctcctgtttattatcctgctgcgcttcctggctggtatcatggtttgggtcatgataatcatggttatcctcgtactgggatacgggatctttcactgctacatggaatattctaggctgcgtggcgaagccggcagcgacgtatccctggtggacttgggcttccaaacggattttcgggtgtaccttcacttgcgccagacctggctggcttttatgatcattttgtccatcttagaggtgatcatcattctacttcttatctttctgagaaagaggattcttatcgccatcgcactcattaaggaagccagcagggctgttggctatgtgatgtgttccctcttgtaccctctcgtcaccttctttcttctgtgtctctgcatcgcctactgggcctccaccgccgtttttctctctacctctaatgaagccgtctataagatttttgatgatagtccctgcccattcaccgcaaagacatgtaatcccgagacattcccgtcaagcaacgaatctcgccagtgcccaaatgcccggtgccagtttgccttttacgggggtgagtccggctatcacagagctttgctaggcctccagattttcaatgcttttatgttcttttggctggctaactttgttttggctctaggccaggtaacactggctggcgcatttgctagctattattgggcgctgaggaagccagatgatcttcccgcttttcctctcttttcggcctttggccgcgccttgcgataccacacaggatctttggcctttggggccctcatactggccatcgttcagatcataagagtaattctggagtatcttgaccaacgcttgaaggccgcagagaataagtttgctaagtgccttatgacttgtctgaaatgttgtttttggtgcttagagaaattcataaagttcctgaacagaaatgcttacatcatgatcgctatatacggcacaaacttttgcacttccgccagaaacgcgttctttctgctgatgcggaatattatcagagtcgccgtgctggacaaggttactgacttcctctttcttcttgggaagctcctcatcgtgggatccgtgggcatcctagcatttttttttttcacacaccggatcagaatcgtgcaggataccgcgccacccctcaactactattgggtccccatcctcacagtcatcgttggcagctacctaatagcgcatgggtttttctccgtctacggaatgtgcgttgatacactgttcctctgcttctgtgaggacctagagagaaacgacggatctcaggagcgaccatattttatgtcaccagaactgcgtgatatcctcttaaagggctccgcagaagaggggaagcggtag

SEQ ID NO: 135480 - DNA, 2115 bp, Artificial Sequence
  Description of Artificial Sequence: Synthetic coding sequence
atggaagatgaaaggaagaatggtgcctatggcactccacagaagtatgacccaacattcaagggacccatttacaaccgcggctgtacagacatcatttgctgtgtcttcctgcttctggccatcgtaggctacgtggcagtgggaatcatcgcctggactcacggggacccaagaaaggtgatatatcctacagactctcgaggcgagttttgtggacaaaagggaactaaaaacgagaataagccatatctgttttacttcaatatcgtgaaatgtgcatcacctctcgtcctgctggagttccaatgccctactccccagatctgcgttgagaaatgccccgacaggtatcttacctacctgaacgctcgttcctccagggactttgagtactataagcagttttgtgtgccaggcttcaaaaacaacaagggagtggcagaagttcttcaggatggcgattgtccagcggtgttgattccctctaagccacttgctaggcgttgtttcccagccatccatgcatacaagggggtcctaatggttggcaatgagaccacctacgaagatggccatgggagcaggaagaatataaccgatctcgtcgagggcgcgaaaaaggccaacggtgttcttgaggcccggcagttggcaatgcggatctttgaagactataccgtttcctggtactggataattatcggactggtgattgccatggcaatgtcgctcttatttattatccttcttcggttccttgctggaatcatggtgtgggtcatgatcataatggtcatcttggtgcttggctatggtatcttccattgttatatggaatacagcaggctgaggggagaggccggcagtgacgtgtcacttgtggatctggggttccagaccgattttagagtgtacttgcacttgcggcagacttggttagccttcatgataatattgtctatcctcgaggtgatcatcattctgctgctgattttcctccgcaagcggatcttaattgctatcgccctaattaaagaggcaagcagggccgtcggatacgtcatgtgttcactgctgtatcctttggtcactttctttttactctgtctgtgtatcgcgtattgggcgtctactgctgtatttctcagtacctctaacgaagcagtgtacaagatatttgacgatagcccctgcccatttactgccaagacctgtaacccggaaacatttcctagtagtaacgagtctcggcagtgccccaacgcgaggtgccagtttgccttctacgggggcgaaagcggataccacagagctttactggggctgcagatctttaacgccttcatgtttttctggctggccaacttcgttttagcactgggacaggtcactctggccggcgcctttgcttcatactactgggcactgcggaaaccggatgatctcccagcttttccactgttttcagcgttcgggcgagcactcagataccatacgggtagcctcgcctttggtgcactgattcttgccatcgtccagattatccgcgtgattctggagtatctggaccagcggcttaaagccgcagaaaataagttcgctaaatgcctcatgacatgcttgaaatgttgtttttggtgcttggagaagtttatcaagttcctgaatagaaatgcttacataatgattgccatttatggcactaacttttgtacatctgcccggaacgcattcttcctccttatgcgcaacattatcagggtcgctgttctggacaaggtaaccgattttttgtttttacttgggaagctgttgatcgtggggtccgtaggtatactggccttcttcttctttacccacagaatccgcatagtgcaagacaccgcccctccgttgaattactactgggtccccattttgaccgtgatagtagggtcctatctgattgcacacggctttttttctgtctatggcatgtgtgtggacacgctcttcctatgcttcctggaggacttggagcggaatgacggatccgccgaacgcccatacttcatgtctagtactctgaagaagctcctgaacaaaactaataagaaggccgccgagagttag

SEQ ID NO: 135481 - DNA, 1248 bp, Artificial Sequence
  Description of Artificial Sequence: Synthetic coding sequence
atgaccggagaacgaccctctaccgccctacccgatcggcgctggggaccccggatcttggggttttggggaggatgccgcgtctgggtctttgcagctatttttcttttgctgtccctggcagcgagttggagcaaagcagagaacgattttggtctggtccagcctctcgtaactatggaacaactgctctgggtgtcaggaagacagatcggttctgtggatacgttccgcatcccattaattaccgccacgccccgaggaacactcctggcatttgccgaagcgagaaagatgtcctcctccgatgagggagctaagttcatcgccctgagacggagcatggatcagggctcaacttggtcacccaccgctttcattgtgaacgacggtgatgtccccgacgggttgaacctgggcgcagtggtgagcgatgtcgagacaggtgtcgtgtttctcttttactcactctgtgcccataaagcaggctgccaagtagctagcaccatgctggtgtggtcaaaggatgacggcgtcagttggagcacccctcggaacctgagccttgatatcgggacggaggtcttcgcccccggcccagggtccggcattcaaaaacagagggagcctagaaaggggcgcctgatcgtgtgtgggcatgggacccttgaaagagacggagttttctgtctcctcagcgatgatcatggggcgtcctggaggtacggctctggcgtgtctggaatcccatacgggcagcccaaacaggagaacgatttcaaccctgacgaatgccagccgtacgagctccccgacggcagcgtagtgataaatgcacggaaccaaaacaactaccactgccactgccggattgtcttgcggtcatacgatgcctgcgataccctgaggcctcgggacgtgacctttgacccagagctggttgaccccgtagtcgcagctggagccgttgtgacaagctcaggaatcgtcttcttctcaaacccagcacatcctgaatttcgggtcaacctgactcttcgctggagtttttccaatgggaccagctggcgaaaggagaccgtgcaactatggcccggaccgagcggttactcctccctcgctacattggaagggagtatggatggtgaggagcaggccccgcagctgtatgtcctttacgaaaagggacggaaccattacacggaatccatatctgtcgccaagatttcagtgtatgggaccttatag

SEQ ID NO: 135482 - DNA, 2007 bp, Artificial Sequence
  Description of Artificial Sequence: Synthetic coding sequence
atgggcggtaagcagcgggatgaggatgatgaagcttacggcaaaccagtgaagtacgatcctagttttcggggccctatcaagaaccggtcttgcacagatgtgatatgctgtgttcttttcctgttgttcatactaggctatattgtggtgggtatcgtcgcttggctgtatggcgaccctaggcaggtcctgtatccgagaaacagcactggtgcctactgtgggatgggagaaaataaagacaagccgtacctcttatattttaacatattctcgtgcatcctcagctctaatatcatatccgtggctgagaatgggcttcagtgtcccacccctcagacagtgattacttcgctgcagcaggagctctgtcctagtttcttgctcccttctgctccagctttggggcgctgttttccttggactaacgtcactccaccggctctcccgggcataaccaatgacacaactatccagcaaggaatctccggtcttatcgactcacttaatgcaagggatattagcgtcaaaatattcgaggatttcgcgcagagctggtactggatcctggtagctctgggagtagcgctggttctctctctgctattcatcctgctgctcaggctggtggccggaccactggttctggtcctgatcctcggcgtgttaggcgtattagcttatggaatctactattgctgggaagaatatagagttctgcgcgataaaggcgcctcaatctctcagctgggtttcaccaccaacctgtctgcgtatcagtctgtgcaagaaacctggttggcggctctgattgtcctcgcagtgctggaggctatactgctgctcatgctgatctttctccgccagaggatacggattgctatcgctcttctgaaggaggcaagcaaggccgtcggccagatgatgagcaccatgttttaccccctcgttacctttgtgctgctgctcatttgtatagcgtactgggctatgaccgctctatatctggccacatctggccagccccaatacgtcttgtgggccagcaatattagttcccccggctgtgagaaagtgccaattaacactagttgcaatcccacagcccatttagtaaacagctcttgcccaggcctgatgtgcgtttttcagggatacagttccaagggtcttatccagcgcagcgtgtttaatctgcaaatctacggggtgttgggcctgttctggacattgaactgggtccttgcgctcggacagtgtgtgttggctggagcattcgcgagcttctattgggccttccataagccacaagatatacccacattccctcttatcagtgcttttattcggaccttacggtaccacactgggtcgttagcatttggggcactcatattaacgctagtacagattgctcgagttatactcgaatatattgaccataagctgcgtggggtccagaacccagttgcccgttgcatcatgtgctgttttaagtgttgtctgtggtgcctcgaaaaattcattaaattcctgaaccgaaatgcatacattatgatcgccatttacggaaagaacttctgtgtgtcagccaaaaacgcattcatgctgctcatgaggaacatcgtgagggtggtggtccttgacaaggtaactgacttgctgctgttcttcggtaagctcctcgtggtgggtggggtgggagtactctcattcttttttttcagtggccggattcccggattaggcaaggacttcaagtctcctcaccttaactattactggctgcccatcatgacctctatcctcggtgcgtacgtgatagcctcggggttcttctccgtctttggcatgtgcgttgacaccttgtttctgtgttttctcgaagatctcgagcgcaataacggcagcctagacaggccctactacatgagcaaatcacttctcaaaatactcgggaaaaagaacgaagcccctcccgataataagaagagaaagaaatag

SEQ ID NO: 135483 - DNA, 2133 bp, Artificial Sequence
  Description of Artificial Sequence: Synthetic coding sequence
atgggaggcaaacaaagagacgaggacgatgaggcctatggcaaacccgtgaaatatgacccatcctttcgcggcccgatcaagaacaggtcctgtaccgatgttatctgttgcgttttgttcttgctcttcattctgggatacatcgtcgttgggatcgtggcatggctgtatggtgacccacggcaggtcctctatcctaggaactcaacaggggcgtattgcggcatgggtgagaacaaggataaaccatatttgctgtacttcaacatattctcatgcatcctttcgtcaaacattattagcgtggctgaaaatgggttacagtgtcccacaccacaggtgtgcgttagcagctgtccagaggacccttggaccgtaggtaagaacgagttttcccaaacagtgggcgaggtgttctataccaaaaaccgtaatttctgcctccctggcgtgccctggaacatgacagtgattactagcctgcagcaggaattatgtccttctttcttgctgccaagcgcgccggccctcggacgatgctttccctggaccaacgtgacccctccagccctgccaggcatcacaaacgacaccacaattcagcaaggcatcagcggattgatcgatagtctgaatgcgagggatatctctgtcaagattttcgaggactttgcccagagctggtactggatccttgtcgctctaggagttgccctcgttctttccttgctgttcatccttttattacgactggtcgccggtccattagtgctggtgttgatcctgggggtcttgggagtgctcgcatacggaatctattattgctgggaggagtacagagtactgcgggacaaaggcgcctccatctcacaactcggatttacaacgaacctgtcagcctatcagtccgtgcaagaaacctggctggctgccctgatcgtcctggccgtgctggaagctattctactcttgatgttgattttccttcggcaaagaattcggatcgcaatagccctcctgaaggaggcttccaaggcggtcggacagatgatgtcaactatgttttacccactggttacttttgtgctgctactgatttgcatcgcctattgggccatgacagccctctacctggcaacctccggtcagccccagtatgtcctctgggctagtaacatcagctccccggggtgtgaaaaggttcccattaatacgagctgcaatcccacagctcaccttgtcaattccagctgtccgggccttatgtgcgtgtttcagggctattcaagtaagggattgatccagagaagcgtctttaacctgcaaatttatggagtgttggggctcttctggacactgaattgggttctggctctgggacaatgtgtactcgcaggcgccttcgcaagcttctattgggcttttcataagccacaggacatcccaactttcccccttatcagcgccttcattcgaactctccgataccataccggaagtctcgctttcggggccctcattttgacactggtgcagatcgctagagtgattctcgagtatattgatcataagctgcgtggtgttcagaaccctgtggctcgatgcataatgtgttgcttcaagtgttgcctttggtgcttagagaaatttatcaagttcctgaaccggaacgcttatattatgatcgcgatctacggaaaaaatttctgtgtgtcagccaaaaatgcgttcatgttactgatgagaaacatagtccgagttgtagttttagataaggtcactgatctcctcctctttttcggtaaactgctggtcgtggggggcgttggggtcctgagcttcttctttttttctggtagaatacctgggctgggcaaggatttcaagtcaccacacttaaattactattggttgccaatcatgacatctattctcggcgcctatgtgatcgcgtcaggatttttttctgtgttcggaatgtgcgtggatactttgttcctgtgttttctcgaggacctggagcgcaataatgggtcactagatagaccatattacatgagcaagtccctgctgaagattttgggaaagaagaacgaggctccacccgacaacaagaaaagaaaaaaatag

SEQ ID NO: 135484 - DNA, 1236 bp, Artificial Sequence
  Description of Artificial Sequence: Synthetic coding sequence
tagagagacgaagatgacgaggcttacgggaaaccagttaagtatgacccatcctttaggggccccattaagaaccggagctgtacggatgtgatctgctgtgtcttatttctgctcttcatactcggctatatcgtggtgggaatagtggcgtggctctacggagacccccggcaggttctctaccccaggaattctaccggtgcatattgtgggatgggtgaaaacaaggacaagccctatctgttgtattttaatatcttctcctgtatcctctcttctaacataattagcgtagctgagaatggcttgcagtgccctactccacaggtgtgcgtgtcatcatgcccggaggacccttggacggtgggcaagaacgagtttagccagacagttggagaggtcttttacacgaagaacagaaacttttgtctccctggggtcccatggaatatgacagttatcacatcactgcagcaggagctctgtccttcgttcttgctgccaagcgcgccagctctaggccgatgtttcccatggacaaacgttactcctcctgccctccctggcattacgaatgataccaccattcaacaaggtatctcagggttgatcgattccctcaacgcccgcgacatatccgtgaagatctttgaagacttcgcgcagtcctggtattggatcctcgtcgctgttggccagatgatgagcacaatgttttacccccttgtgacattcgtgttgctgcttatatgcatcgcctattgggcaatgacagctctgtacctcgccactagcgggcagccccagtatgtattatgggctagtaatatttctagccctggatgtgaaaaggtgcccatcaacacatcctgcaacccgactgcccacctggtgaatagctcctgtcctggtctcatgtgcgtttttcaaggatactcatccaaaggcctaatccagaggtcagtgtttaatctccagatctacggcgtgctgggactgttttggactcttaattgggtcctggcacttggccagtgcgtgttggcaggcgcattcgccagcttttactgggcttttcacaagcctcaggacattccgactttcccactcatcagtgccttcataaggacactccggtaccatacaggtagcttggccttcggcgctctgattcttacgctagtccaaattgctcgtgtgattcttgagtatattgatcataaactgaggtag

SEQ ID NO: 135485 - DNA, 1236 bp, Artificial Sequence
  Description of Artificial Sequence: Synthetic coding sequence
tagagagacgaggacgacgaagcctacgggaagcccgtaaagtatgatccaagctttaggggcccaattaaaaaccggtcttgcaccgacgtgatttgctgcgtgctatttttgctctttatcttggggtatatcgtggtgggcatcgtcgcctggctgtacggagatccgcgtcaagttctgtatcctcgtaattctactggcgcctactgcggaatgggcgagaacaaggacaagccttatttactttatttcaacatcttttcatgcatcctgtcctctaatatcatttcagtggcggaaaatggtttgcaatgtccaactccccaggtctgtgtgtcctcatgccccgaggacccttggaccgtcggcaagaatgagttcagccagactgtgggagaggtgttttacactaagaaccgaaacttctgcttgccgggagtcccttggaacatgaccgtgatcacgagcctgcagcaggaattgtgcccctctttcttgttgccgagcgcccctgctctggggcggtgctttccctggaccaatatcactccacccgccctcccaggaatcaccaatgatactacgatccagcaaggcatttctggcctcatcgacagtctcaacgcgagggatatttctgtgaaaatctttgaggattttgcgcagtcttggtattggattcttgtcgctgtcggtcagatgatgtccaccatgttctatccccttgtgaccttcgtcctgctcctaatatgcatcgcttattgggcaatgaccgcactctatttagctacaagcggccagcctcagtacgtcctttgggctagcaacatttccagccctggttgcgaaaaggtccctatcaacaccagctgcaatcccacagcccacttggtgaatagcagttgtccgggcctgatgtgtgtcttccagggctactcatccaagggtctcatacaacggagcgtttttaacctgcagatttacggcgtcctgggtctgttttggaccctcaattgggtgttggctctgggtcaatgcgtgcttgccggtgccttcgccagtttttactgggcatttcacaaacctcaggatattcccaccttcccgttgatatctgcgttcattaggactctgcggtatcatactggtagcttagcatttggagcccttattctgactcttgtccagattgcacgagttattcttgagtatattgaccacaagctgcgctag

SEQ ID NO: 135486 - DNA, 2133 bp, Artificial Sequence
  Description of Artificial Sequence: Synthetic coding sequence
atgggaggaaagcaacgagacgaagacgacgaagcatatggtaaacccgtgaagtatgacccctccttcagggggcctattaaaaatagatcttgcaccgacgtcatctgctgtgttttgttcctcctgtttatccttggctacatcgtcgtggggatcgttgcctggctttatggagatcccagacaagtgctgtacccccgcaactccaccggagcttactgtggcatgggtgaaaacaaggataagccttaccttctgtattttaacatcttttcttgtatcctgtcttctaatattatttcagtcgccgagaatggtctgcaatgccctactccgcaggtctgcgtgagcagctgtcccgaagacccctggactgtgggcaagaacgaatttagccagactgtcggtgaggtgttttacactaaaaatcgcaacttctgtctgcccggtgttccatggaacatgaccgtcataaccagtctgcagcaggagctgtgcccttctttcctgctgccatcagctcccgcgctgggccggtgctttccatggactaatattacccctcccgcacttcccgggataaccaacgacaccacaatacagcagggaattagtgggttaattgacagcctgaatgcgcgcgatataagcgtcaagatattcgaggactttgcgcagtcctggtactggattttggtggcactgggagtagcccttgtgctgtcgctgttgttcatcttactgctgcggctggtggctggacccctggttctggtgttaattctcggtgtcctgggagttctggcctacggcatctactattgctgggaggagtatagggttcttcgcgataagggcgcgtcaatcagtcaactcggattcacaactaacctgtccgcttatcagagcgtgcaggaaacatggctggctgctctgatcgtgctggccgtcttagaagcaatcctgctgttagtgctgatcttcctccgccaaaggattaggatcgcaattgcactcctcaaggaggcatctaaagcagtgggccagatgatgtccaccatgttctaccctttagtgactttcgttctcctgctaatctgtatcgcatattgggccatgactgcactgtatctcgctacttctgggcagccccagtatgttctctgggcatcaaacatttccagccccgggtgcgagaaagtacccattaacactagttgcaacccgacggcccatcttgtgaatagcagttgcccgggcctgatgtgcgtttttcagggatattctagcaaaggcctgattcagcggtcagtattcaaccttcaaatctatggcgtccttggtctgttctggacactgaattgggtgctcgccctggggcagtgcgtccttgctggagcatttgcctccttctactgggcgtttcataagccacaggatatccctacattcccacttatctccgcgtttatcaggacactccggtaccataccggcagcttagcttttggggctttgattcttactctcgtccagattgcacgcgtaatcctcgaatatatcgatcacaaacttcgaggcgttcagaatcccgtggcccgttgtatcatgtgttgcttcaagtgctgtctatggtgcctggaaaagtttataaagttcctcaatcgaaacgcatacattatgatcgctatctacggaaagaatttctgcgtgagcgccaaaaacgcattcatgttgctcatgcggaatatcgtcagagtcgtggtcctcgataaggttacagaccttctcctcttctttggcaagctgctggttgtggggggcgtcggggttttaagcttttttttcttttccggtcggattcccgggctaggaaaggactttaagtccccccacctcaattattactggttgccaatcatgaccagcattctgggtgcctacgtcatcgcaagtggcttcttctcagtgttcggaatgtgcgtggacaccctgtttctctgttttttggaggacttagaacgcaataacgggagccttgatcggccatactatatgtctaagagtctgcttaagatcttgggaaagaagaacgaagcacctcccgataacaaaaagaggaagaagtag

SEQ ID NO: 135487 - DNA, 2133 bp, Artificial Sequence
  Description of Artificial Sequence: Synthetic coding sequence
atgggcgggaaacaaagggacgaagatgacgaggcctacgggaaacccgtgaagtacgaccctagctttcggggccctatcaagaaccggagttgcaccgatgtcatatgctgcgtcttattcctgttatttatcctcggttacatagtggttggtatcgtcgcatggctgtatggtgatcccaggcaggttctctatcctcgtaatagcaccggcgcgtattgcggaatgggcgagaacaaggacaagccttatttactgtacttcaatatcttctcctgcatattaagctcaaacattatttctgtagcagagaatggactccagtgtccgacaccccaagtttgtgtctcctcttgcccagaagacccttggacagttggaaaaaatgagtttagtcagacggtgggggaagttttttacacaaagaaccggaacttctgtctgccgggcgtgccatggaatatgaccgtgattaccagcctgcaacaggagctgtgtccaagttttctcttgcccagcgctcctgcccttggacgttgctttccctggaccaatattacccccccagctctgccagggattaccaatgacacaacgatccagcaggggataagcgggttaatagatagcctaaacgcacgcgatatctccgtaaagatctttgaggattttgcacagagctggtactggattctggtggcactgggcgtagctcttgtgttatcacttctattcattctgctcctaagattagtggccggtccgctggtgctagttctcattcttggggtgctgggggtgctcgcttacggaatctattactgttgggaggaataccgggttctacgagataagggcgccagtatcagtcagctgggctttactaccaacctgtccgcatatcaaagtgttcaagagacctggttagcagccctcatcgtcttagcagtgctagaagccattcttctgttagttttgatcttccttagacagagaatcagaatcgccatcgccctcctcaaggaggcgtccaaagccgtgggccagatgatgagcactatgttttatcctctggtcacattcgtattattactgatatgcatcgcttactgggctatgaccgccttgtatctggctacctcggggcagccccagtacgtgctctgggcctccaacatcagctctcctggatgcgaaaaagtccctatcaataccagctgcaacccgaccgcccatctggtgaactcttcctgtcctggcctaatgtgtgtgtttcaggggtatagctcaaaagggctaatccagcgctctgtcttcaaccttcagatatacggcgttttaggtctcttctggaccctaaattgggtgcttgcgcttggacagtgtgtgttggcaggagcctttgctagtttctattgggccttccacaaaccacaggacatacccaccttcccactgatttccgcatttattaggaccctgaggtaccacactgggtctttggccttcggagcccttattctaactctggtgcaaatcgcgcgcgtaattctagaatacatcgatcacaaattacgcggcgtacagaaccctgtcgccagatgtatcatgtgctgtttcaaatgttgcttatggtgcctggagaagtttattaagttcctgaatcgaaatgcgtacatcatgatcgccatctacggaaaaaatttctgtgtctcagccaagaacgcctttatgctcctgatgaggaatattgtgcgggttgtcgtgcttgacaaggttacagatctcctgctgtttttcggaaaactgctcgtggtggggggcgtcggagtgctgtccttctttttcttttctggcaggatacccggcctcgggaaagactttaaaagcccacacctcaactactactggttgccaataatgacatctatcctcggagcatatgtgattgcctccggctttttttctgtgtttggtatgtgtgtggacaccttattcctgtgctttctggaagatcttgaacggaacaatggctccttagaccggccatactacatgtctaaaagtctgctcaagatcctcgggaaaaagaacgaggcaccaccggacaataaaaaaagaaaaaagtag

SEQ ID NO: 135488 - DNA, 2133 bp, Artificial Sequence
  Description of Artificial Sequence: Synthetic coding sequence
atgggcggtaagcagagggacgaagatgatgaagcttacggaaagcccgtcaagtacgacccatccttcaggggtcctataaagaaccgaagttgcacagacgttatttgttgtgtactctttctcctatttatcttgggttacattgtggtaggtattgtcgcatggctgtatggcgatcctcggcaggtgctctatccgaggaactccaccggggcctactgtggcatgggcgaaaataaagataagccatacctgctatatttcaacatcttctcgtgcatcttgagctccaacatcatctccgtggccgaaaacggtcttcaatgtccaactccccaggtttgtgtttcctcttgccctgaggatccctggacagtgggcaaaaatgagttttcccaaaccgtaggtgaggtgttttataccaaaaaccgcaatttttgtttgcctggcgtgccatggaacatgacggtgattaccagtctccagcaggagctgtgcccttcatttttgctcccatccgcccccgctctgggacggtgcttcccttggaccaacgttactccccccgccttgcctggaattaccaatgacactaccattcaacaaggcatctctggactgatcgatagcctgaatgcccgcgatatctcagtgaagatatttgaagattttgctcagagctggtactggatcctggtcgctctgggggtggcattggtgttatctctgctgttcattcttttgcttagactagtggccggaccccttgtgctggtgcttattctgggagtgctcggagttctggcatacgggatctactactgttgggaagagtaccgagtgcttagggataagggcgctagtatctctcagttggggtttacgacgaatctaagcgcataccagtcagttcaagaaacctggctggctgccctgatcgtgttagccgtactggaagccatactgctgctgatgctcatctttttgcgccagagaatccgcattgctattgctctgttgaaagaggcctctaaagctgtgggacagatgatgagcaccatgttttacccgctcgttacatttgtcttgcttcttatttgcattgcttattgggcgatgactgcattgtatctagcaacctccggccagcctcagtatgtactgtgggctagcaatatatccagtcctggttgtgagaaagtgcccattaacaccagttgcaatcccacagcacatttggtgaactcatcctgtcccggccttatgtgtgtcttccagggatactcgagtaaaggcctgattcagagatcagtttttaacttgcagatttatggtgtactcggtctcttctggacccttaactgggtgttggctctggggcagtgcgtgcttgctggagccttcgcgagtttctattgggcctttcataaaccacaggatatacctacattccctctgatttctgcttttatccgcactctgcggtatcacaccgggtcactggctttcggcgctctgattctcaccttggtgcagatcgcacgggtgatcctcgagtatattgaccacaagctgaggggtgtgcaaaaccctgtggccagatgcatcatgtgctgttttaagtgttgtctatggtgtctcgagaagttcattaaattcttgaacagaaacgcgtatatcatgattgcgatttacggcaagaatttttgcgtttcagccaaaaatgcctttatgctgctaatgcgaaacatcgttagagtggtcgtactggacaaagtgaccgacctgctcctcttctttggaaagctcttggtcgtgggaggcgtaggtgtgttatcttttttctttttctctggaagaatcccgggcctcggaaaagatttcaaatcaccccacctgaactactattggctaccgatcatgacctccattctgggagcttacgttattgcctctggcttcttcagtgtgttcgggatgtgcgtagatactctctttctgtgctttttagaggatctggaacgaaataacggatccctcgacagaccatactacatgtccaagtcattgctgaaaatcttaggcaaaaagaacgaggcaccaccggacaacaaaaagaggaagaagtag

SEQ ID NO: 135489 - DNA, 1236 bp, Artificial Sequence
  Description of Artificial Sequence: Synthetic coding sequence
tgacgcgacgaagacgacgaagcctatggaaaaccggtgaaatacgaccctagcttccggggccctatcaaaaataggagctgcacagatgtgatttgttgcgtgctgttcctgctgttcatactcggatacatagtcgtgggcattgtcgcctggctgtatggagatcccagacaggtcctgtaccccaggaactccactggtgcatactgtggtatgggagagaataaagataaaccctacctgctttactttaatatattcagctgcatcctgagcagcaatattatctcagttgccgagaatggactgcagtgtcccacccctcaggtgtgtgtatctagttgtccagaggacccctggaccgtgggtaagaacgagtttagccaaacagtcggagaagtgttctacactaagaatcgtaacttctgcctgccaggagtgccatggaacatgacagtgattacaagcctgcagcaggagctgtgtcccagcttcctcctgccctcagcacccgcactcggacggtgtttcccgtggacaaacgtaacgccccctgcgttgcctggtattacaaatgatactaccattcagcaaggcattagtggactgatcgactcgctgaatgcccgcgacattagcgtcaagatctttgaggattttgcacaatcctggtattggatcctggtggctgtcggccagatgatgagtaccatgttttaccctctagtaactttcgtactgcttctcatttgcattgcctactgggctatgactgccctgtacctcgcaaccagtggtcagccgcagtacgtactttgggcttcaaacatatcctcaccaggctgtgaaaaggtgccgatcaatacgtcttgtaacccgactgcccaccttgtgaattcctcttgtccgggtctgatgtgtgtctttcaggggtactcctctaagggattgatccagagatcagtgttcaacctgcagatctacggggtgcttggactgttctggaccctgaactgggttctggccctgggccagtgtgtgctggctggcgcatttgccagcttttactgggccttccataaaccccaggacatcccaaccttccccctgatcagcgcatttatcaggacattacgttaccacacagggtccctggcctttggggcgctcatcttaaccctggtgcagattgctagggtgatcctggagtatatagaccataagctgcgctag

SEQ ID NO: 135490 - DNA, 1236 bp, Artificial Sequence
  Description of Artificial Sequence: Synthetic coding sequence
tgacgcgatgaggatgatgaggcatacggcaaaccggtaaagtatgacccttcttttagaggacccataaagaatagatcttgcaccgatgtgatctgctgcgttctgtttcttctttttattctgggctacatcgtggtcggtattgtggcttggctctatggagaccccaggcaggtgctgtaccctcgaaattcaaccggcgcgtactgcggtatgggagaaaataaagacaagccctaccttctttactttaacattttttcttgcatcctgtccagtaatatcatctctgtggcggaaaacggcctgcagtgtccaactccccaggtatgcgtgagtagctgtcccgaggatccatggactgttggaaagaatgaattctcccagacagtgggcgaagttttctacaccaagaacagaaacttttgcctgccaggcgtcccctggaatatgactgtgatcacatcactacaacaggagctgtgtccctcatttttgctgccctccgcccctgcccttggacgttgcttcccgtggacaaacgtaactccgcctgcattgcctgggattacaaatgacaccaccatccagcagggcatctctggactgattgattctctcaacgctagggatatttccgtgaagatttttgaggactttgcccagtcttggtattggatcctcgtggccgttggtcagatgatgtcaaccatgttctacccgttggtgacctttgtgctgctccttatctgtattgcttattgggccatgactgctctgtatctcgctacatcaggccaaccacagtatgtcctttgggcgagcaacatctccagccccggatgcgagaaagtgccgattaacacctcatgtaaccccaccgcacacctggtgaacagcagctgccccggtctgatgtgtgtgtttcaggggtattcatcaaagggactaatacaaaggtcagtgtttaacctacaaatctatggcgtcctggggttattctggactctcaattgggttctggccctaggtcagtgtgttttggcgggggcattcgcctccttttactgggctttccacaagccgcaggacataccgactttccctctcatcagcgcctttatccgcaccctgaggtaccatacaggatcgctggcttttggagccttgattctcacacttgtgcaaatcgccagggtaattctggagtacatcgaccataagctccgttag

SEQ ID NO: 135491 - DNA, 1236 bp, Artificial Sequence
  Description of Artificial Sequence: Synthetic coding sequence
tgaagagacgaggatgacgaagcttacggtaagccagtgaaatacgacccaagctttcgcgggccaattaagaatagaagctgcaccgacgtgatttgctgcgtactgttcctactttttattctgggctatatcgtggttggaatagtggcctggctatacggcgaccccaggcaggtgctgtacccacggaatagcacgggggcctattgtggcatgggggaaaacaaggacaagccttatcttctctatttcaatatcttctcctgcatcttgtcatccaatatcatctcagtggccgagaacggactccagtgccctactccacaggtatgcgtttctagctgtccggaggatccctggacagtgggaaagaacgagttctcccaaaccgtgggcgaggttttttatactaagaatcggaacttctgccttcccggggttccgtggaacatgaccgtgattacaagcctccagcaagagctctgtccttcctttctgttaccttcggcgcctgcactggggcggtgcttcccctggacaaacattacccctcctgccctgccaggcataactaatgacacaactattcaacagggcatctcaggtctcattgatagtctcaacgcaagagatatttctgttaagatcttcgaggactttgctcagtcttggtactggatcctcgtggctgttggccagatgatgtcaaccatgttttatccactggtcacctttgtgttgctgctgatttgcattgcttactgggccatgacagctttatacctagccacctccgggcagcctcagtatgtgctgtgggccagtaatatctctagcccgggttgtgaaaaggttccgattaatacgagttgtaaccccacggcccatctggttaatagctcctgtcccggcctgatgtgcgtgttccaaggttatagctcaaaggggttaatccagcgcagtgtgttcaacctacagatctacggtgtcctcggccttttttggactcttaactgggtgcttgctctgggccagtgtgtcttggccggagccttcgctagtttttactgggcatttcacaagccacaggatattccaacctttcctctcatttccgccttcatcagaacattaaggtaccacaccggatcccttgcattcggcgcactgatcctaacactggtgcagattgcccgcgtgattctggagtatatagaccataagctgcggtag

SEQ ID NO: 135492 - DNA, 2133 bp, Artificial Sequence
  Description of Artificial Sequence: Synthetic coding sequence
atgggcgggaagcagagagacgaagatgacgaggcatatggaaaacccgtcaagtacgacccttcctttcgcgggccgatcaagaaccgtagctgtacagatgtgatttgctgcgtgctgttcctgcttttcatactcgggtacattgttgtcggcatcgtagcatggctctacggtgacccccgtcaggtgctgtacccaagaaatagtacaggggcatattgtggaatgggcgagaataaagacaaaccttacctgctatactttaacatcttctcttgcatcttgtcctctaatattatctcagttgctgaaaacggactgcagtgtccaacgccacaggtttgtgtttccagttgccccgaagacccgtggacagttggtaagaatgaatttagccagactgtgggggaagtattctacacgaagaatcgcaatttctgtctgccaggagtgccttggaatatgaccgtaattacttccctgcaacaagagctttgtccctcctttctgctgccgagtgcacccgcccttggcaggtgcttcccttggactaatattacccctccggccctccctgggattactaatgacaccaccatacaacaaggaataagtggcctgatagactctttgaacgcccgtgatatctccgttaagatctttgaggacttcgctcagtcttggtattggattctggtggcattaggggtagcactggtcctgtccctccttttcatcttgctcttgcgattagtggccggccctctggtcctcgttctaattctgggtgtgcttggtgtcctggcttacggtatttattactgttgggaggaataccgagtgctgcgtgacaagggtgccagcattagccagctaggcttcacaaccaacttatcagcctatcagagcgtacaggagacatggctggccgcactgattgtcttggctgtcctggaagccattctcttactcgtgctaatattcttgcgtcagaggattaggattgccatcgcgctgctgaaagaagcttcgaaggcagtggggcaaatgatgagtactatgttttaccccctcgtgacattcgtcctgctgttgatatgtatcgcatattgggcgatgaccgccctatacttggcaacatcagggcagccccagtatgttctctgggccagcaatatttctagcccggggtgcgaaaaagtgcccattaacactagctgtaaccctactgcccaccttgtgaattcgtcctgtccgggactcatgtgcgtttttcaggggtacagcagtaaaggactcatccagaggtcagtctttaatcttcaaatatacggcgttctcggcctcttctggacgttgaattgggtgttagcactggggcagtgtgtactagccggtgcatttgccagcttttactgggccttccacaaacctcaggacatccccaccttccccttaatcagcgcttttatccggaccctccgctatcacactggatcccttgcgttcggcgcattgattctcacactagtccagattgctcgtgttatcttggagtacatcgatcacaaactccggggcgtgcagaatcctgtcgctaggtgtatcatgtgttgcttcaaatgttgcctttggtgtctagaaaagttcatcaagtttctgaaccgaaacgcttacatcatgatcgccatctatgggaaaaacttctgcgtgtctgcaaaaaacgcttttatgctgcttatgcgaaacattgtcagggttgtagttctggataaagtgacggacctgctgcttttttttggcaaattgctggtggtggggggcgtcggagtgttgtcattcttctttttcagcgggcgcatcccaggcctcggtaaagactttaagagtcctcatctgaactattattggctgcctatcatgacatctatcctcggggcctacgtcattgcctccggcttttttagcgtgtttgggatgtgcgtcgatacactcttcctgtgttttctggaagatctggaacgaaataatggaagtctggatagaccgtactatatgagcaaaagcctgttgaagattctgggcaaaaaaaacgaagcaccacctgataacaagaaacgcaaaaaatag

SEQ ID NO: 135493 - DNA, 1236 bp, Artificial Sequence
  Description of Artificial Sequence: Synthetic coding sequence
tagcgcgacgaagatgatgaagcatatggaaaacccgtcaagtatgacccatcgttcagaggtccaattaagaatagatcttgtacagatgtaatatgttgtgtgttgttcctcctcttcatcctgggatacatcgtggtgggcattgtggcttggctgtatggagatccacggcaggtgctttatcccagaaattcaacaggggcatattgcggcatgggggagaacaaggacaagccttatctgctgtactttaacattttctcctgcatcctgtcatccaacatcatatctgtggccgaaaatgggttgcagtgcccaacccctcaagtttgcgtatcttcctgccccgaggatccttggaccgtgggcaaaaacgagtttagccaaaccgttggtgaggtgttctacaccaaaaatcggaatttctgcttacccggcgtgccttggaacatgacagtgataacttctctgcagcaagagctgtgcccaagcttcctgctgccgtcagctcctgccctgggtagatgtttcccatggaccaacatcactcccccggccctgccaggaattacaaacgataccactattcagcagggaatctccggtttgattgacagtctgaacgctagggacatttctgtcaaaatattcgaggacttcgctcagtcctggtattggattctggtggcggtgggccagatgatgtcgacgatgttttatccccttgttacatttgtcctgctcctgatctgtatcgcatactgggctatgaccgcattatacctggcgactagtgggcaaccgcaatatgtgttatgggcctccaacatttcttctccaggttgcgagaaagtgcctataaacacgtcatgcaatcccacagctcatctagttaattccagttgccccggcctgatgtgcgtttttcagggctacagctccaaagggttaattcagaggagcgtgttcaatttacagatttatggggtgcttggcctgttttggactctgaattgggtgctggcactggggcaatgcgtgctagccggcgcgttcgccagtttttactgggctttccacaagcctcaggacatcccaacctttcccctaatcagcgcattcatccgaaccctcagataccacacgggatcactggctttcggggctttaattctaactcttgtgcaaatcgctagggttattctggagtacattgatcataagttgagatag

SEQ ID NO: 135494 - DNA, 2133 bp, Artificial Sequence
  Description of Artificial Sequence: Synthetic coding sequence
atgggaggaaagcagagagacgaggatgacgaggcctacggaaagccggtgaaatacgatccaagtttcagaggcccgattaaaaacaggtcctgtacagacgtaatttgctgtgtactgttcctgctctttatcctgggatacatcgtggttgggatcgtcgcttggttatacggtgatccgcgccaggttttataccccagaaactccaccggtgcttactgcggcatgggtgagaataaggacaagccctacttactttattttaacatcttcagctgcattcttagcagcaatattataagtgtcgccgagaacgggctccagtgtcccaccccccaggtctgcgttagttcctgtcccgaggacccctggacagtgggcaaaaacgaattctctcagactgtcggagaggtcttctacacaaaaaatcgtaacttttgcctccccggagtgccttggaacatgacagttattaccagtctccagcaggagctgtgtccctcctttctactgcctagcgctccagctctgggacggtgctttccctggaccaatgtaacgccccctgctctgcccggaatcacaaatgacaccaccatccagcagggtatcagcgggctgattgattcactaaacgcgagggatatatctgtaaagatttttgaggactttgctcagtcatggtattggatactggtggcccttggtgtcgctttggtgctgtcacttctgtttatcctactcctaaggctggtcgctggaccgttagttcttgtcctcatccttggcgtcctgggtgtcttggcctatggcatctactactgttgggaggaatatcgtgtactacgcgataagggtgccagcatttcacaattgggattcaccaccaatctgtcagcgtaccagagcgttcaggaaacttggctggcagccctcatcgtcctcgccgtgttggaggcaatcctgctcctgatgttaattttcttacggcaaagaatccgcatcgcgatcgctctactgaaggaagcttcaaaggccgtgggtcagatgatgagtactatgttctatcctttggtaacatttgtcctgctcctgatttgcattgcctattgggccatgaccgcattgtatctggcaacgtctggccagccccagtacgtgttgtgggcatccaatatctcttccccgggctgcgagaaggtccctataaataccagctgcaatcccaccgctcatctggtaaattccagttgccccgggctgatgtgcgtattccagggctactcttcaaagggactcatccagagaagtgtgttcaacctgcagatctacggtgtgcttggcctcttttggaccctgaactgggtgctcgcactaggtcagtgcgtgctcgcgggtgcctttgcaagtttttactgggcctttcacaagccccaagacattcctacttttcccctgattagtgcctttatccgcacacttagataccatactggtagtctcgcctttggtgccctgatcctgactcttgtccagatcgcccgagttatcctggagtatatcgaccataagctgcgaggggtgcaaaaccctgtggccaggtgtatcatgtgttgctttaaatgctgcctatggtgtcttgaaaagttcattaagttcttgaacaggaatgcctatatcatgatcgccatctacggtaagaacttctgcgtgtctgctaaaaatgcattcatgttactgatgcggaatatcgtacgagttgttgtcctggacaaggtgactgacctgctgcttttcttcggaaaattgcttgtcgtaggcggtgtgggagtgctgtctttcttctttttctcgggccggatacctggtctcggtaaggacttcaaaagcccacacctgaattattattggctacctattatgacaagtatcttgggcgcctatgtgattgcaagtgggttctttagtgtattcggaatgtgcgtcgatactctgttcctatgtttcctggaggatctggaacgcaacaacggatctctggacagaccttattacatgtccaaatctttgctgaaaatcctcggtaagaaaaatgaagccccccctgataacaaaaaaagaaaaaaatag

SEQ ID NO: 135495 - DNA, 1236 bp, Artificial Sequence
  Description of Artificial Sequence: Synthetic coding sequence
tgaagggacgaagatgacgaagcctacggcaaacctgtaaaatacgatccaagctttcgcggcccaattaaaaacagatcttgtacagatgtgatatgctgcgtgctgtttctcctctttatcttgggatacatcgtggtaggtattgtggcttggctgtacggtgatcctcgccaggtcctctatcctaggaactcgactggcgcatattgcggcatgggcgagaataaggacaagccctaccttctttatttcaatatatttagttgcatcctgagcagtaacattatctcagtggccgaaaacggattacagtgccctacgccacaggtgtgcgtgtctagttgcccggaagatccttggaccgtcggcaagaacgaatttagccagacggttggggaagtgttttacacgaagaatagaaatttttgcctccccggcgtgccctggaacatgaccgtcataaccagtttgcagcaagaactgtgtccatcattcttgctcccaagtgcaccggccctgggaagatgttttccctggactaatgtgaccccccctgccctgcccggcatcacaaacgacactacgattcagcagggcattagtggcctgattgactcactgaatgcgcgggacatttccgttaagatatttgaagactttgcgcagtcgtggtactggatacttgtggcagtcggccagatgatgtccaccatgttttacccccttgtcacgttcgtgctgctcctcatctgcatagcttattgggccatgactgccctgtatcttgccacttccgggcaaccccagtacgtgttgtgggctagcaacatttcctctcccggctgtgagaaagtgcctatcaacacttcttgcaatccaacagcgcatctagttaacagcagctgtcctggtctgatgtgtgtgttccagggctatagctccaaaggcctgatacagcgctctgtattcaacctacagatctatggggtcctcggactcttttggacactcaattgggtgctagcacttgggcagtgcgtcttggctggagcctttgcttccttttactgggcttttcataaaccgcaggacattcccactttcccactgatatcggctttcatccgtacactaaggtatcacacaggctctttggcgtttggcgccctgatactgactctcgtgcagatagccagggtaattttagagtatatcgaccacaagcttaggtag

SEQ ID NO: 135496 - DNA, 1905 bp, Artificial Sequence
  Description of Artificial Sequence: Synthetic coding sequence
atgggtgagaacaaggacaagccttaccttctgtattttaatatctttagttgcatattatcatcaaatatcatttctgtagccgaaaatggactccagtgccccaccccacaggtgtgcgtctccagttgtcccgaagacccttggactgtggggaagaatgaattcagccagacagttggtgaagttttctacacaaagaatcgaaatttctgcctgcctggcgtgccatggaacatgacagtgattacatccctgcagcaggaactctgccctagcttcttgctgccgtctgctccagctctggggagatgctttccatggaccaacgtaactcctcccgcactgcctggcatcacaaacgatacgactattcagcagggcatctccggccttattgattccctaaatgccagggacattagcgtcaagatcttcgaggacttcgcgcagtcttggtactggattctggttgccctgggggtcgctttggttctgtctctgctctttatactgctgctgagactggtggctggtcccctggtactggtgttgatcctcggtgtgcttggagtgctcgcttatggcatctactattgctgggaagaatatcgggtactgcgtgacaagggggcttctatatcccagcttgggttcaccacaaacctgtcagcctaccagtccgttcaggagacttggttggcggcacttatagttttggccgttctggaagctattttgttactgatgcttatcttccttcggcagcggatacggattgccatcgctctacttaaggaagctagcaaagcagtaggtcagatgatgtcgacgatgttctatcccctggtgaccttcgttctgctgttgatctgtatagcctattgggctatgacggccctgtacctggctacaagcggacagcctcagtacgttctgtgggcctcaaatatttcttcacctggctgtgagaaggtgcctattaatacctcctgcaatccaaccgctcatctggtgaatagctcatgtccgggattgatgtgcgtgttccagggctacagctccaaagggttaattcagcggtcagtgttcaacttgcagatctatggcgtgctgggactcttctggacgttaaattgggttctcgcactgggtcagtgcgtgttggctggcgcctttgcttcattctactgggcatttcacaaaccgcaagatatccccacatttcccctgatcagcgcttttattcgcacactacgataccataccggatctcttgcatttggtgcactcatcttaactctggttcagatcgcaagagtaatcctggaatacattgatcataagctgaggggcgtgcaaaacccagtggcccgttgcattatgtgttgttttaagtgctgtctttggtgtctggagaaattcattaaattcctgaataggaacgcctatattatgattgcaatttatggcaaaaacttttgtgtttctgcgaaaaacgcttttatgctgctgatgcggaacatcgtccgggtcgtggtcctagacaaagtgaccgacctgctcctgttttttgggaagctgctcgtggtcgggggggttggagtcctctctttttttttcttctctggcaggattcctggtctgggtaaggacttcaaaagccctcacctgaactattactggctgcctattatgacaagtatcttaggtgcctacgtgatcgcatccggcttcttctcagtctttggaatgtgcgtggacactctgttcttgtgttttctggaggatctggaaaggaataacggaagccttgaccgtccatactatatgtccaaatctctgctgaaaatccttggcaaaaagaacgaggcgcctcccgacaacaagaagcgaaaaaagtag

SEQ ID NO: 135497 - DNA, 1905 bp, Artificial Sequence
  Description of Artificial Sequence: Synthetic coding sequence
atgggagaaaacaaagataaaccctatctcttgtattttaatatcttctcctgcatcctatcgtccaatatcatctccgtcgctgagaatggtcttcagtgcccaactccccaggtttgcgtatcctcctgtcctgaagacccttggacggtgggcaaaaacgaatttagccagacagtgggcgaggtcttttacacgaagaataggaacttctgcctgcctggggtcccatggaatatgacggtgatcacaagccttcagcaggagttgtgtcctagctttcttctcccaagcgcacccgccttagggagatgctttccatggactaacgtaaccccccctgcacttcctggcatcaccaacgatactaccatccagcaggggatatcaggattgatcgacagcctcaatgctcgcgatattagcgttaagattttcgaagattttgcccaatcttggtattggatactggtcgctctgggggttgctttggtgctttctctgctgttcattcttctcctgcggctggtagctggtcccctcgttctggtgctgattctcggggttctgggagttctggcttacggcatttactattgctgggaagagtaccgcgtgctgcgcgacaaaggagcatctatctctcagctcggatttaccactaatctgtctgcttatcagtccgttcaggaaacatggctagcagcccttatcgtgctcgctgtcctcgaagctatcctcttgctgatgctgattttcctgagacagcggatccgtatcgccattgcactgcttaaagaggcatcgaaagcagtgggtcagatgatgtctaccatgttttaccctcttgtgacatttgtgcttcttctcatttgcatagcttactgggcgatgactgccctgtacttggccacgtcgggacagcctcagtacgtgctctgggctagcaatatttcctccccaggatgcgaaaaagtgccaattaatacatcttgcaaccccactgcacacctggtgaactcaagctgccctggtctcatgtgcgtcttccagggatatagctcaaaggggctcatccagcgctctgtctttaatctgcagatctacggtgtacttggtttgttttggacattaaactgggtcctagccctggggcagtgcgtgctggccggggccttcgcaagcttctactgggcctttcataagccacaagatattccgactttcccactgatttccgcttttatccgaacactccggtaccataccgggagccttgcattcggggctctgattttgaccctcgttcagatcgctcgcgtaatcctggagtacattgatcataaactgcgaggcgtgcagaacccagtcgcccgctgtattatgtgctgctttaaatgttgcctttggtgtttagagaaattcattaaattcctgaaccgcaacgcctacatcatgatcgccatttacggcaaaaatttctgtgtcagtgccaagaatgccttcatgctgctaatgcgcaatatagtcagagtcgtagtcttagacaaagtgactgacctgctgctcttttttggaaaactcctcgtggttggcggcgttggtgtcctttccttctttttttttagcggtcggattcctggcttaggtaaggatttcaagtctccccatctgaactactactggctgcctattatgacctccatcctgggggcttatgtgatagccagcgggttttttagcgttttcggaatgtgtgtagacactctgtttctgtgcttccttgaagacctggaacggaacaacggttccttggatcgtccctactatatgtcaaagagcctgctgaaaatcctcgggaagaagaacgaagcacctccagacaacaagaagagaaagaagtag

SEQ ID NO: 135498 - DNA, 1905 bp, Artificial Sequence
  Description of Artificial Sequence: Synthetic coding sequence
atgggggagaataaagacaagccttaccttctgtacttcaacattttcagttgcattttgagtagcaatattatcagcgtcgctgagaatggactccagtgtccaaccccacaggtgtgcgtgtcttcgtgtcccgaagatccttggacagtggggaagaacgagttctcgcagactgtcggagaggtattctatacaaaaaatagaaacttctgcttgcccggtgtaccttggaacatgacggtcatcacgagcctgcagcaggagctgtgtccgagctttctcttgccctccgctcccgccctggggcggtgtttcccctggaccaacattacaccaccggctttgcctggcatcactaacgacactaccatacagcaaggcatttccggactcattgatagcctgaatgctagggacatctccgtaaagatctttgaggacttcgctcaaagttggtattggatcctggtagccctgggggtggctctagtgctgtccctactgtttattctgctgctcagacttgtagctggcccattggtgcttgtacttattctgggagtactcggcgtgctggcttacgggatctactattgttgggaggagtaccgggtgctgagggataagggggcgtctattagtcagctgggtttcaccacaaacctttctgcataccagagcgtgcaggagacatggctcgccgctttaatagtactagcagttttagaagctatcctactgctcgtgttaatttttctcagacagcgtatcagaattgccatcgccctgctaaaggaggcttctaaagcagtcggccaaatgatgtctaccatgttttatcctcttgtgactttcgtcctacttctcatctgtattgcctactgggctatgactgcattatatctggccacgagcggtcaacctcagtatgtgctgtgggcttcgaatatctcaagtccaggatgcgagaaagtgccaattaacaccagctgtaatcctactgcccaccttgtcaattcctcttgcccagggctgatgtgcgtctttcagggatattcaagcaaaggactgattcagagaagcgtttttaacctgcaaatatacggggtgctagggctgttttggaccctgaactgggtgctggccctgggtcagtgcgtgctggctggtgcctttgcctctttctactgggcatttcataagcctcaagatattcctacttttccccttatctccgctttcatacgaaccctgcggtaccacaccggctctctggcctttggtgcactgatactgacactagttcagatcgccagagtgatcctggaatacatcgaccacaagctgagaggggtgcaaaacccagtagctcgatgtattatgtgctgcttcaagtgctgcctgtggtgtcttgaaaagttcatcaagtttttaaatagaaacgcatacattatgattgcgatatacgggaagaacttctgtgtctccgctaagaacgcttttatgctgctgatgcgcaatatcgtacgcgtcgtggtgttggataaggttaccgacttgctgctgttcttcggtaaactgcttgtggtgggaggagtcggggtcctgtctttcttcttcttcagcggtaggatccccgggctaggaaaagactttaaatctccccatctaaattactactggctccccatcatgacttccatcctcggcgcgtacgtgatcgctagcggattcttttccgtgttcggcatgtgcgtcgacacactattcttatgttttctggaggatctcgaacgcaacaatggatctttagataggccctactacatgagcaagtccctgctgaagattctgggaaagaaaaacgaagcacctcccgacaataagaagcgcaaaaaatag

SEQ ID NO: 135499 - DNA, 2007 bp, Artificial Sequence
  Description of Artificial Sequence: Synthetic coding sequence
atgggagggaagcagcgggacgaggatgatgaggcatacggcaagccagtcaagtatgacccgagcttccgcggccccatcaaaaacagatcatgtaccgatgtaatatgttgcgttctcttcttacttttcatactgggatatatcgtggtggggatcgtggcctggctctacggggacccgaggcaggtgctgtaccctcgaaatagcacaggagcctattgcgggatgggggaaaacaaagacaaaccttacctgctatactttaacatcttttcttgcatcttgagcagtaacatcatcagcgtggccgagaatggtctccagtgtcctacaccccaaacagtgattacctccctccagcaagagctttgtccaagtttcttattacctagcgcgccagccctaggacgttgtttcccttggactaacatcacaccgcccgccttgcccggaatcacaaatgatactactatccaacaagggatttcaggattgattgattctctgaacgctcgggatattagcgtgaagatctttgaagacttcgcccagtcgtggtattggattctagtcgcgctgggcgttgccctggtgctgagcctcctcttcattcttttgctccggttggtagccggcccgttggttttagtgctgatactcggagtcctgggggtgctggcctatggaatttattactgttgggaggagtacagagttctccgcgataagggcgcctctatatctcaactcggattcaccacaaatttgtccgcctaccaatctgtgcaggagacctggctggccgccctgattgtgctggctgtgttagaagccattctcctgctggttctgatcttcctcagacagcgcatacgtatcgccattgccctgctgaaggaagcatcaaaggcggtcggccaaatgatgagtacaatgttttatcctctggtcaccttcgtgctcttgctgatatgtatagcctattgggcgatgaccgccctatacctggctacctccggtcagccccaatatgtattgtgggctagcaatatcagcagcccagggtgcgaaaaagtgcccatcaacacctcatgcaatcccactgctcacctcgtgaactcgagctgtccaggattaatgtgcgtttttcaagggtattcttccaaaggtctcattcaacggtccgtcttcaaccttcagatttacggtgtcctggggctattctggaccttgaactgggtgctcgctttggggcagtgtgtgctggcaggagcattcgcgagcttctactgggcttttcacaagccccaagacatcccaaccttccccctaattagcgcatttatccggaccctccgctaccacacaggatcactggcttttggagctctcattctcacactagttcagatcgctagggtcatcctggaatatatagatcacaagttaagaggggtgcagaatcccgtggctaggtgcataatgtgctgtttcaagtgctgtctttggtgtctagagaagtttatcaagtttcttaatcgaaacgcgtacatcatgattgccatatacggtaaaaacttctgtgtgtccgcaaaaaatgcttttatgttactgatgagaaacatagtgcgtgtggtggtgttggataaggtgaccgaccttctactgttcttcgggaaattgcttgtggtgggtggggttggggtcctctcctttttcttcttcagcggccggattcccggccttggtaaggacttcaagtcaccccatctcaattattattggctccctatcatgacatctatcctcggcgcttatgtgattgccagtggattcttcagcgtgtttggcatgtgtgtcgacactctttttctctgttttctggaagacctcgagaggaataacggcagcttggaccgtccgtattatatgagtaaatccctcttgaaaatattaggcaaaaagaacgaggctcctccggacaataagaaacgcaagaaatag

SEQ ID NO: 135500 - DNA, 1905 bp, Artificial Sequence
  Description of Artificial Sequence: Synthetic coding sequence
atgggggaaaacaaggataagccctatctgctctattttaatatcttctcttgtatcctgagtagcaatatcattagcgtggccgaaaatgggctgcaatgccctacacctcaagtctgtgtgagttcatgcccggaggacccttggaccgtaggcaaaaatgaattttcccagacggtcggcgaggtgttctacaccaagaaccgtaatttttgtctgcctggagttccttggaacatgacggtcatcactagtctgcagcaagagttgtgccctagcttcctgctccctagtgccccggctctcggccgatgttttccctggactaacgtgactccgcctgccttacccggcataaccaatgatacaacgatccagcaaggaatttccggcctaattgacagtttaaacgccagagacatcagcgtgaaaattttcgaggactttgcacagtcgtggtactggatcctggtggcgctgggagtcgctctggttctcagtttgctctttattctcctgctccggcttgtcgcaggtcccctggtgttggtcctgatactgggcgtgttaggagtgctcgcctatgggatctactattgttgggaggagtacagggtactgcgggacaaaggtgcgagtatctcccagctgggctttacaacaaacctcagcgcataccagtctgtgcaggaaacttggctggccgcactgattgttctcgccgttttagaagctattctgcttctcatgttgatttttttgcgtcaacgcatcagaattgccattgctctgcttaaagaagcttctaaggccgttggacaaatgatgagtactatgttttatcccctggtgacttttgtcctgctgctgatatgcatcgcctactgggccatgacggccctgtatctggctacaagcggccagcctcagtacgttctgtgggcctccaacatctcgtctcctggctgcgaaaaagttcctatcaatactagttgcaaccctactgctcatcttgtgaacagctcctgcccagggttgatgtgcgtgtttcaggggtactcatccaagggactgatacaacggtctgtattcaacctccaaatctacggagtgctcggtctcttttggaccctcaattgggtgcttgcgcttggacaatgcgtattagccggcgctttcgccagcttctattgggctttccacaaaccgcaggatataccaacctttccacttatctcggcatttatcagaacattaagataccacaccgggagcttggcttttggcgctctcatactgaccctcgtgcagattgccagggttattctagaatatatcgatcacaagctccgtggtgtgcaaaatcctgttgcaaggtgtatcatgtgttgcttcaaatgttgtctgtggtgccttgagaagttcattaaatttttgaatcgcaatgcatacatcatgatcgcgatttatggcaaaaacttctgcgtttctgccaaaaatgccttcatgctcctcatgcggaacattgtgagagtagtggtacttgataaagttaccgacttactgctgttctttggcaaactgctcgtggtggggggtgtcggggtgctctccttcttcttcttctctggccgtattcccggcctgggaaaagactttaaatcgccccatctgaattattactggctccccattatgaccagcatcttgggagcatatgtcatagcctccgggtttttctcggttttcggaatgtgcgtcgataccttgtttctctgtttcttagaagacttagagagaaataacggttctctcgaccgaccctactatatgtctaagtctctcctgaagatcctcggcaaaaaaaacgaagccccgccagataacaagaagaggaagaaatag

SEQ ID NO: 135501 - DNA, 1905 bp, Artificial Sequence
  Description of Artificial Sequence: Synthetic coding sequence
atgggagagaacaaagataagccatatcttctgtactttaatatcttctcttgtatcctgtctagcaatatcatttcagttgccgagaatggactccaatgccccacaccacaagtctgtgtctcttcatgccccgaagacccgtggacggttggcaaaaacgagttctcgcagaccgtgggtgaggtgttctacacgaagaacagaaacttctgtctacctggcgttccctggaacatgacggtgataacctcgcttcagcaggaactgtgcccctcctttctgctcccaagtgcacccgctcttgggagatgttttccttggacaaacgttacacctcccgcactcccaggcatcaccaacgacactacaatacagcagggaatatctggacttattgactcactcaacgccagggacatttcagtcaagatattcgaagatttcgctcagtcttggtactggatcctggtggctctaggcgtggctctggtcctttctttgctctttatactgttacttcggctagtcgcaggtccactggttctcgttctgatcctcggcgttctcggagttctggcgtacggtatctactattgttgggaagaatacagagtgctgcgcgacaagggtgcgtcaatcagccagctgggatttactactaatttaagcgcctaccagtccgtgcaggaaacatggcttgctgcgcttattgtgctggccgtcctggaggcaatactgttgctcatgcttatctttttaaggcagcgtatccgtattgcgatcgccctgctcaaagaagcaagcaaagccgtgggccagatgatgtccaccatgttctacccgcttgtcacattcgtgctgctgctcatctgtatcgcatactgggctatgaccgcactgtacctcgcgacgtctggtcagccccagtatgtcctgtgggcaagcaatattagctcacccgggtgtgaaaaggttccgatcaatacatcgtgcaatccgaccgctcatttggtcaattcttcctgccctggcttaatgtgcgtttttcaggggtattcttcaaaagggcttatccagaggagcgtgtttaacttacagatctatggagtgttaggcctgttctggacacttaattgggtactcgccttagggcagtgtgtgctcgccggggccttcgctagcttctattgggccttccacaagcctcaggacatcccaactttccccctcatcagcgcttttatcagaactctgaggtatcacacaggatcccttgctttcggcgccctcattcttacacttgtgcagatagcacgcgtgatcttggagtacatagaccataagttacgcggcgtgcagaatccggtggcccgctgcatcatgtgctgcttcaaatgctgtttatggtgcctggagaaatttatcaagtttctgaaccgtaatgcctatatcatgattgccatttatggtaagaacttttgtgtgtccgctaaaaatgctttcatgttgctcatgaggaatatcgtgagagtagtcgtcctggacaaggtcacagacttactcctgttcttcggaaaactgttggtggtcggcggggttggtgtactcagtttcttttttttttcaggccgtatccccgggctgggaaaagatttcaaatccccacatcttaattactattggctgcccattatgacgtccattctgggggcctacgtgatcgcctccggatttttttctgttttcggaatgtgtgtggacactttattcctgtgtttcttggaagacctagaacgcaacaatggttcccttgatcgcccctactatatgtctaagagcctactgaagattctggggaagaagaacgaggcgccccccgacaataagaagagaaagaagtag

SEQ ID NO: 135502 - DNA, 2007 bp, Artificial Sequence
  Description of Artificial Sequence: Synthetic coding sequence
atgggaggaaagcagagagacgaggatgacgaggcctacgggaaacctgtgaagtatgaccctagcttccggggccctatcaagaatcgttcctgcactgacgtcatctgctgtgttcttttcctccttttcatattgggttatatcgtcgtgggaatagtagcctggctttatggggaccctcgtcaagtcctatatcctcgaaactcaactggcgcatattgcggcatgggagagaataaggacaagccatacttactatacttcaatattttctcctgcatcctttctagcaatattatatcagtcgcggaaaatggcctacagtgccccactccacaaaccgtgattacttctctccagcaggagctgtgccctagcttcctcctaccgtccgcccctgcattgggtcggtgcttcccgtggactaatgtgaccccgccggcactcccagggatcacgaacgatacgacaatccaacagggtatcagtggcctgattgacagcctcaacgctagggatatttctgtcaaaatctttgaggatttcgcccagtcgtggtactggatattggtcgccttaggggttgccctggtattgtcattgctcttcatactgctcttaagactggttgcagggccactggtgttagtgctgattctgggtgttctaggggtcctggcttatggaatttactattgctgggaggagtatagagtccttagagacaaaggtgcttccattagccaactcggctttactacgaacttgtcagcttatcagtcagtccaggaaacttggctcgctgccctcattgtgctggccgtacttgaagctatcctattgctcatgctgatattcctgcggcagcgaataaggatcgctattgcactgctgaaggaggcatctaaggcagtgggccagatgatgagcacaatgttctacccacttgtgacttttgtactgctgcttatctgcatagcttattgggctatgacagccttgtatctcgctaccagcgggcaaccacagtacgtactgtgggcctccaatatttcctctccaggatgcgagaaagtaccgatcaatacttcttgtaatcccactgcacatcttgtaaacagttcctgtccaggattgatgtgtgtatttcaagggtatagttcaaaaggcctcatacagagatccgtgttcaaccttcagatttacggcgttctggggctcttttggaccctgaactgggttctggctctgggacagtgcgtgctggctggagccttcgccagtttctactgggcatttcacaaaccacaagacataccaacttttcccctgatttctgcttttatacgcactttgagatatcacaccggctcactcgctttcggggctctgattctgactcttgtgcagatcgcccgtgtgattttggagtacatcgatcacaaactgaggggcgtgcagaatcccgtggcgagatgcataatgtgctgttttaaatgctgtttgtggtgtctggagaaattcataaaattcttgaaccgtaatgcatacatcatgattgcaatttatggaaaaaacttctgtgtaagcgcaaagaacgcattcatgctccttatgaggaatatcgtaagggtggtggtgttggataaggtcaccgatttgctgctctttttcgggaaactattggtggtcggaggggtgggagtgctgagttttttcttcttctcaggccgtattccaggtctggggaaggatttcaaaagccctcacctgaactattattggttgcctatcatgacaagcatcctgggcgcctatgtcattgcatcgggcttctttagcgtattcggtatgtgtgtggacactctgttcctgtgcttcctcgaagacctcgaacgtaataacggctctctagaccgcccctattacatgtcgaagtcacttttgaagattctcggaaaaaaaaatgaagcaccgcctgataacaaaaagcgcaaaaaatag

SEQ ID NO: 135503 - DNA, 2007 bp, Artificial Sequence
  Description of Artificial Sequence: Synthetic coding sequence
atgggcgggaaacagagagacgaggacgatgaagcctatggcaaacctgtaaagtatgatccttcgtttagggggcccatcaaaaatcggtcgtgcacggacgtcatctgttgcgtcctctttctgctctttattcttggctatattgtcgttggcatcgtggcttggctgtacggagacccccgccaagtgctatatccacggaacagcactggggcctattgcggtatgggggaaaataaggataaaccttacttactgtattttaacattttttcctgcatactgtcctcaaacatcattagtgtggctgagaatggtttgcagtgcccaaccccccagaccgtgattactagtctgcaacaagagctgtgtccgagcttcctgctgccctctgcccctgctctgggaaggtgtttcccatggacaaatgttaccccacccgccttacctggcataacaaatgacacaaccatccaacaaggcattagcggtctcatagattctttgaacgcacgcgatattagcgtcaagatttttgaggattttgcccagtcctggtattggatactggtcgcgctcggggttgccctggttctgagtctgctctttatcctgctgctgagactggttgccggcccactggtgctagttctcatcctcggggtgctaggtgtgctagcatatggtatatattattgctgggaggaataccgcgttttgagggacaagggggcgagtatctcccagctcgggttcactacgaacttgtctgcataccagagtgtgcaggaaacatggctagccgcactgatagtcctggcggttctggaggccattttgctgcttatgctcatctttctgaggcagaggatccgtatcgcgatcgcactccttaaagaggctagtaaagccgtcggccaaatgatgtcgacaatgttttatcccctggtcaccttcgtattgctacttatttgcattgcctattgggccatgaccgcactctatcttgcaacaagcggccagccacagtacgttttgtgggcgtccaatatctcaagcccagggtgtgagaaggtacccatcaacaccagctgtaatcctactgctcaccttgtcaacagctcttgccccgggctgatgtgcgtcttccaagggtacagcagtaaaggcctgatacagaggtctgtgttcaatcttcagatttacggtgtgctcggattgttctggacattgaactgggtgctggcactgggccaatgcgtgcttgccggcgcatttgccagcttttactgggcgttccataagccacaggatattccaacctttcccctgatcagtgctttcataagaacactgcgttaccataccggttccctggctttcggggctctgatcctgactctggttcaaatcgcccgggttatcctggagtacatcgaccacaagctgcggggggtgcagaaccccgtagccagatgcattatgtgctgttttaagtgctgtctttggtgcctggagaaattcataaagttccttaacagaaatgcctacataatgatagcaatctatggtaaaaacttttgtgtctcggccaaaaacgcctttatgctcctgatgagaaatattgtcagagtcgtcgtgctcgacaaggttaccgatctactcctcttttttggaaaactgttggttgtaggaggagtgggggttttatcatttttcttcttctcaggaaggatccctggtctcggaaaagatttcaagtcccctcacttgaactattattggttgcctatcatgacaagtattctgggcgcatatgtgattgctagtggtttcttctcggtcttcggaatgtgcgtggatacactgttcctgtgtttcctggaggatctagaacggaataatggcagccttgatcggccctactatatgtcaaagagcttattaaaaatccttggaaagaagaacgaagcaccccccgacaacaaaaaacggaagaaatag

SEQ ID NO: 135504 - DNA, 2007 bp, Artificial Sequence
  Description of Artificial Sequence: Synthetic coding sequence
atgggtggaaagcaacgtgatgaggacgatgaagcctacggcaaacccgtgaagtacgatccctccttccgagggcccattaaaaatcggtcctgcacagatgtcatctgctgtgtcctcttcttattgtttattctagggtacatcgtggtaggtatagttgcatggctgtacggtgacccacggcaggtgctttaccctagaaactccactggagcttattgcggcatgggcgagaataaggataagccttacctgttgtatttcaatatatttagctgtatcctgtctagcaacataatctccgtggcagaaaatggcttacagtgccccaccccacaaactgtcataactagcctgcagcaagagctctgcccctcctttctgctcccatccgctcccgcattggggcgttgcttcccttggactaatattacccctcccgctttgccggggattacaaacgataccaccatacagcaaggaatctccggacttattgattcacttaacgctcgcgatatctctgttaaaatatttgaggatttcgcccaatcttggtattggattttggttgcactgggcgtggctcttgtgctgtctttactctttatacttcttctgagattggtggcgggcccactggtgttggtcttaatactcggcgtccttggggtgttagcgtatggaatctactactgttgggaggaataccgagtgttgcgagataagggagcaagcatcagccagcttgggttcaccacaaatctatctgcctatcagtcagtccaggagacctggctggcagccctcatcgtgctggccgtcctcgaagctatacttctactggttctgatttttttgcgacagagaattaggatcgcaattgccctgctgaaagaggcttcaaaggcggtcggacagatgatgtccaccatgttttaccctcttgtgaccttcgtcttacttctgatctgcatcgcttattgggccatgacggctctctatctggcaacatctggtcagccccaatacgtcctttgggcctctaatatcagctcacccggatgtgagaaggtccccatcaatacttcctgcaaccccactgcccatctcgttaattcttcctgtcctggattaatgtgcgtcttccaagggtatagcagcaaggggctgatccaacgctctgttttcaacttacagatctacggtgtgcttggtcttttctggacactgaactgggtgctggcgctcggccagtgtgtgcttgcaggcgccttcgcttccttttactgggccttccacaagccacaggatatcccaaccttccctcttatctccgcattcattaggaccctccgatatcatacagggtccctggcatttggggctctgatacttacccttgtgcagatagcccgggtcattctggagtatatcgaccacaagctgaggggcgtgcagaacccagtggcccgttgcatcatgtgctgcttcaagtgttgcttgtggtgccttgagaagttcattaagtttctaaaccgtaatgcatatatcatgattgcaatctatggcaagaacttttgcgtgagcgccaagaacgcctttatgcttctgatgagaaatattgtcagagttgttgtgttagataaagttacagatctgctgctgttcttcgggaagcttcttgtggtgggcggtgtgggcgtcctgagcttcttttttttttccggccggattcccggattaggtaaggattttaaatctcctcaccttaattattactggcttccaatcatgacatcaatcctcggggcgtacgtgattgccagtggattttttagtgtctttggaatgtgtgtcgacaccttgttcctgtgcttcctggaagatttagaaagaaacaacggctcactggaccgaccatactatatgagtaagagtttgcttaagattctcggtaaaaagaatgaggccccacctgataacaaaaaaaggaagaaatag

SEQ ID NO: 135505 - DNA, 1905 bp, Artificial Sequence
  Description of Artificial Sequence: Synthetic coding sequence
atgggagagaataaggacaagccatacctactgtattttaacattttctcatgtatcctttcatcaaatatcatatccgtggctgagaatggcttgcagtgtccaacaccacaggtttgtgttagctcttgccccgaagacccatggaccgtgggcaaaaacgaattttcgcagaccgtaggcgaggtcttttacaccaagaatagaaacttctgcctgcctggggtgccttggaacatgactgtgatcacatcactccagcaggaactgtgtccttcatttctgctgcccagcgcaccagcattgggacgatgctttccttggaccaacattactcctccagcgctccctggcattacgaacgacacaacaatccaacagggtatttctggcctgattgattccttgaacgctcgcgatatttccgtgaagattttcgaagatttcgcccaatcttggtactggatactcgtcgctctgggggtggccctggttctgtcattgttgtttatactgttgttgcgcttagttgccggccctttggtgcttgtgttaatcctcggtgtgctgggtgtattagcttacgggatctactattgttgggaagagtaccgagttctgagggataagggcgcgtccatcagccagctcggtttcaccaccaatcttagtgcataccaatctgtccaggaaacctggctggctgcccttattgttctcgccgttcttgaggccatcctcctgctggtcctcatttttctgaggcagagaattagaattgcaattgccctcttgaaagaagcgagcaaagccgtcggccagatgatgagcaccatgttttatcccctggtgacatttgtcctcctattaatctgcattgcatactgggccatgaccgccctgtacctggcaacatccggacagccgcagtatgtgttgtgggcctccaatatttcatctcccggctgcgagaaggtaccgatcaacacaagctgtaatcctaccgcccacctggtcaacagtagttgccctggcttaatgtgtgtgtttcaggggtatagctccaaaggtctgattcaacgtagcgtttttaacctccagatttacggggtgctcggcttgttttggaccctgaattgggtgttagccctggggcaatgcgtgttagcgggagcgtttgctagtttctactgggccttccataagccacaggatattccaacatttcccctgatctcagccttcatcagaaccctgcgttatcacaccggcagcttagctttcggcgcactaatcctgactctggtgcagattgctcgcgtcatattggagtacatcgaccacaaactgcgcggtgtgcagaatcccgttgcccggtgtatcatgtgttgtttcaagtgctgcctgtggtgcctcgagaagtttatcaaatttctcaatagaaatgcatatattatgattgccatctacggcaagaacttctgcgtttccgcaaagaacgcattcatgcttctgatgaggaatatcgtgcgggtggtggtcctggataaagtgacagacctgctactgttttttgggaagctcctggttgtggggggggtgggggtgctttcctttttctttttttctggacgtatcccagggctgggaaaggattttaagtccccccaccttaactattactggctccctattatgactagtatcctcggtgcctatgtaatagcttcaggcttcttcagcgttttcggtatgtgtgtggatacgttatttctctgctttttagaggatctcgagaggaataatggctccctcgaccgaccatactatatgtccaaatctctgctgaagattctcgggaagaagaacgaagctcctccagacaacaaaaaacgtaaaaaatag

SEQ ID NO: 135506 - DNA, 2007 bp, Artificial Sequence
  Description of Artificial Sequence: Synthetic coding sequence
atgggtggaaaacagagggacgaagacgacgaggcctacggtaagccagtgaaatacgatccctcttttcggggcccaattaagaatcgcagttgcacagatgttatctgctgtgtgttatttctcctcttcattcttggctatatcgtggtggggatcgttgcttggctttatggcgatccccggcaagttctgtatcctcgcaacagcactggggcttattgcggaatgggtgagaacaaagataagccttatttgctttatttcaacattttctcttgtatcctgtcctcaaacattattagtgtagctgagaacgggttgcaatgccctactccacagacagttatcacatccctgcaacaggaactgtgtccaagctttctcttacctagcgcgcctgccttaggccggtgctttccttggaccaatgtcacccctcctgcccttccagggattaccaatgacaccaccatccagcagggcatcagcggtctcatagattctctcaatgcaagagacatcagtgttaagatttttgaggacttcgcccaatcctggtactggatccttgtcgctctgggtgtagccctggtgctgtcactgctgtttatcctgctgctgagactggtagctggacctctcgttctcgttttaattctgggagtactcggagttctggcatatggaatttactactgttgggaagaatacagggtactgcgggacaaaggcgcatccataagccaattaggcttcactacaaatctctcagcttaccagagtgtgcaggaaacctggctggccgcactgatagtcctggccgtattagaggccattctcctgctaatgctgatctttctgcggcagaggattcgcatcgccatagccttattaaaggaggccagcaaagctgtcggccagatgatgagtactatgttttatccgctggttacattcgtcctcttactcatctgtattgcctattgggcaatgacagccctctatctcgccacgtctggccagcctcagtacgtgctgtgggctagcaatatctcaagcccaggatgtgaaaaagtgccgatcaacacttcatgtaaccctacagcccacctggtgaatagtagctgccctggtttgatgtgtgtgtttcagggctactcttccaagggcctcatccaacgttccgtttttaacctgcagatctatggggtcctgggtttattctggaccctcaactgggtgttggctctgggacagtgcgtattggccggggcattcgcatctttttattgggctttccataagccacaggacattccaacgttcccacttatttcagcctttataaggaccctgcgctaccataccgggtcattggcctttggggccctcatcttgacactcgtccagatcgccagagtgatacttgaatacatcgatcataaattacggggagtgcagaacccagtggcccgatgcattatgtgctgtttcaaatgctgcctctggtgccttgaaaagttcataaaattcctgaaccggaatgcctacattatgatagctatttatgggaagaacttctgcgtgtctgcaaagaatgctttcatgctgctcatgagaaatattgtgagagtagttgtacttgacaaggtgacagacttgctcctcttctttggaaagctgctcgtggttggcggagtgggtgttctgtctttcttctttttctcaggcaggattccagggctgggaaaagactttaaaagtccacacctcaattattactggttacctatcatgacctccatactgggcgcttacgttattgcttcaggtttcttctccgttttcggcatgtgtgttgatacccttttcctgtgctttctggaggatctggagagaaacaacggcagcttagatcggccctattatatgtccaagtctctcctcaaaatcctgggcaagaaaaatgaagccccaccagacaataaaaaaagaaaaaaatag

SEQ ID NO: 135507 - DNA, 2007 bp, Artificial Sequence
  Description of Artificial Sequence: Synthetic coding sequence
atggggggcaaacagagggatgaagacgacgaagcttacgggaagcctgtgaaatatgacccgtcttttcggggcccgataaaaaaccgatcctgcaccgacgttatctgttgcgtgctgttcctcctatttatcctgggctacattgtggtgggtatcgtggcttggctgtatggtgaccccaggcaggtgctgtacccacggaatagtacaggggcttactgtggcatgggggagaataaggacaagccctatcttctgtattttaatatattctcatgtatcctcagctcaaacatcattagtgtggccgagaatggcctgcagtgccccacccctcagaccgttatcacgtccttgcaacaggaactgtgccccagcttcttgttgccctcagccccggcgctgggccgatgttttccctggaccaacatcaccccacccgccctgcctggtatcacaaatgatacaacgattcaacagggaatcagtgggttaatcgacagtctcaatgccagagatatttcagttaaaatttttgaggatttcgcacagtcttggtattggatcctggtggctctgggcgtcgccttggtcctctcccttctgttcattctgttgcttcgactggtagccggccccctggttttggtgttaatcctgggagtcctgggcgtactcgcgtatggtatctattattgttgggaggaataccgggtgctccgcgacaagggagcaagtatcagccagctaggctttactactaacctatcggcctaccagagcgtgcaagaaacttggttagccgccctcattgtcttggccgtgctggaggccatcctcctgctagttcttattttcttgagacagaggattcggatcgcaattgccctcctgaaggaggccagtaaagctgtgggtcagatgatgtctaccatgttttatccactcgtaaccttcgtactgttgctgatttgcatagcctactgggccatgacagccctctatcttgcgacctcgggccagccccagtatgtcctttgggccagtaatatctctagtccagggtgcgaaaaagtgcccattaatacaagctgcaaccctacagcacatctggtgaattcctcatgccctgggctcatgtgcgtttttcagggatactcttctaagggcctgatccaacgctcggtgtttaacctgcaaatttacggcgtgttaggtctcttttggactcttaattgggttctggctttgggacagtgcgtactcgccggagcgtttgccagcttttactgggcttttcacaaacctcaagacatcccaactttcccgctgatcagtgcatttatccgtactttacgataccacaccggcagcctggcatttggagccctgatcctgacgctggtgcagatcgcccgagtcatcctcgagtatatcgatcacaagctacggggagttcaaaacccagtggccagatgtattatgtgttgtttcaaatgctgcctctggtgtctcgagaagtttataaagttcttgaacagaaatgcctacatcatgatcgccatctacggtaagaatttctgcgtcagcgctaaaaatgcttttatgttgctgatgaggaacattgtccgggtggtggttctcgacaaggttacagacttgcttcttttctttggaaaattacttgtagtcggcggcgttggcgtgctgtcattctttttctttagtggtaggattccaggcctgggaaaagattttaagagtccacaccttaattattactggctccccattatgacttctatactcggtgcttacgttattgcatcagggttcttctccgtgttcggaatgtgcgtcgataccctctttctctgcttcctggaagatttagaaaggaacaatggtagcctagataggccgtactacatgagcaaaagtctgttaaagatcctcggaaagaaaaacgaggctcctcctgataataaaaagaggaagaaatag

SEQ ID NO: 135508 - DNA, 1905 bp, Artificial Sequence
  Description of Artificial Sequence: Synthetic coding sequence
atgggtgagaataaggataagccttacttgctgtatttcaacatctttagttgtatactgtcttccaatattatttctgtggctgaaaatgggctccagtgtcccacccctcaggtctgtgtgagcagctgtcctgaagacccttggaccgtgggtaaaaatgagttcagccaaactgtgggagaggtcttctatactaagaacaggaatttctgcctgcccggtgtcccttggaacatgacggtaattacaagcctacagcaagagctgtgcccctccttcctattgcctagcgctccagctctcgggcgatgttttccttggaccaatatcacgccccccgccttgcccggaataactaatgatacaaccatccaacagggaattagtggactgattgacagcttgaatgccagggatatttccgtgaaaatctttgaagacttcgctcaaagctggtattggatcctggttgccctcggagtcgcactcgtcctgtctctcctgtttattctcctgttacgcctggtggctggccctctggtactggtgcttatcctgggagttctgggagtcctggcctacgggatttactactgttgggaagagtacagagtactgagagataagggggcttctatcagccagctgggctttacgaccaacctaagcgcgtatcagagcgtgcaggaaacttggctcgccgccctcattgtcctggccgtcctggaggctatcctccttctcgtcctgatattccttaggcaacgcatccgcatcgcgattgccttgctgaaggaagcatcaaaggcagtgggccagatgatgtccactatgttttacccactggttacattcgtcctgcttcttatttgcattgcatattgggcaatgacagccctgtatttggctactagcggtcaacctcagtacgtcctttgggccagcaacatctcaagtccaggatgtgagaaagttccaatcaatacatcgtgtaaccctactgcacacttggtcaatagctcgtgtccagggctgatgtgcgtctttcagggatactcatccaaaggcctgatccagcggtccgtgttcaatctacagatttatggcgtgctgggactcttctggaccttgaactgggtgctcgctctcggccaatgtgtactggctggggcgtttgcaagcttctactgggcattccacaagccccaggatatccctacctttcccctgatcagcgcttttatccggacgctaaggtaccacaccggtagcttagctttcggggccctgattttgaccctcgttcagatcgccagagttatcctcgagtatatcgaccataagctgagaggagtgcaaaaccctgtggctaggtgcattatgtgttgcttcaaatgctgcctctggtgcctggaaaaattcatcaaattcctgaatcgtaatgcgtacatcatgatcgctatctacggcaaaaacttttgtgtgtctgctaagaacgccttcatgctactgatgagaaatattgttagagtggtggtgctggataaggttacggatctcctcttattctttggcaaactactggtggttgggggtgtaggagttctgtcttttttcttcttcagcggtagaatccccggtctcgggaaagattttaaaagtccccacttgaattattattggctcccaatcatgacaagcattcttggagcctatgttatcgcttccggatttttcagcgtatttggtatgtgtgtggataccctgtttttatgttttcttgaagacctcgaaagaaacaatggctcactcgatcggccatattacatgtccaagagccttctgaaaatcttaggaaaaaaaaatgaggcccctcccgataataaaaaaaggaaaaaatag

SEQ ID NO: 135509 - DNA, 2247 bp, Artificial Sequence
  Description of Artificial Sequence: Synthetic coding sequence
atgatccccgcagcgtcttctacaccgccaggcgacgcactttttccgtcagtagccccccaggatttttggcggtctcaggtgaccggatattcgggcagtgtcaccagacatctttctcaccgcgccaacaatttcaagagacatccaaaacggcgaaaatgcatacgccctagtcctccaccaccaccaaacacaccttgccctcttgagctggtggacttcggcgacctgcacccgcagaggtcatttagggagctgttatttaacggatgcattctcttcggaatcgaattttcctacgctatggagacagcatatgtgacccccgtgcttttgcagatggggcttcccgatcagctgtactctctagtctggttcatcagtcccattctagggttcctgctgcaaccgctcctgggtgcatggtctgacagatgtactagtcgctttggaaggaggcggccctttattctggtcctggcaattggggccctcctggggctttcacttctgttgaacggcagagatatcggcatagctttggcagatgttactgggaatcacaagtggggcttgctgttaactgtgtgcggcgtggtcttgatggatttctctgctgatagtgcagacaatccaagtcacgcctatatgatggacgtctgtagtcccgcggaccaggaccgagggttaaatatccatgcgctgctggctggactgggcgggggatttgggtacgtagttggtgggattcattgggataagaccggatttggtcgcgccctcgggggacagctgcgcgtaatctatctgttcactgctgtcactctttccgttacaaccgtactgacactggtcagcatacctgagcgtccactccgacccccttctgaaaagagagccgccatgaagtctccctccttgccactgccaccctcccctcctgtgctgcccgaggagggacctggagacagcctgccatcccataccgccacaaatttttcaagcccaatcagccccccgagccctttgacacctaagtacggttctttcataagcagggattcatctctgacagggatctcagaattcgcctcatcatttgggaccgcaaatatcgactctgtcttgatagactgtttcactggaggtcatgacagctatctcgcgattcctggcagcgtccccagacctccaatttccgtttccttcccccgcgccccagacggcttctatagacaagatagaggcctactcgaaggtcgcgagggcgctttaacaagcggttgcgatggggatatcctcagagtgggcagtctagacacctcaaaaccacggtcttcagggatcctcaaacggccccagactcttgcaattcctgatgctgctggaggtggagggcctgagacgagccggagacggaacgtgacatttagccagcaagtcgcaaatatcttgcttaatggcgtgaaatacgagtccgagctgacaggttcctcagagagagcagagcagcctctctccgtggggcgcctgtgtagtacgatctgtaatatgcccaaggccttgcgcaccctctgcgtgaaccacttcctaggctggttgtctttcgagggcatgctacttttctacacagatttcatgggggaggtggttttccagggagatccgaaagcaccacacacttcagaggcgtaccagaagtataacagtggcgtgactatgggctgttggggtatgtgcatttacgccttctctgcggcattttactctgctattcttgagaagttggaggaatttctgtcagtgcgcacactgtacttcatagcctatctggctttcggactagggaccggtcttgctactctgagccggaatctgtacgtggtcctgagcctgtgcataacttatggaattttgttctctacgctctgcacacttccatattcacttttatgtgattattatcagtctaagaagtttgcagggagcagcgcagatggtacacggcggggcatgggcgtggacatctccctcttgagctgtcagtattttttagcgcaaattctcgtgtccctcgttctcgggccactgactagcgcagtggggagcgccaacggcgttatgtattttagttctttagtgagctttcttggatgcctatatagtagcctttttgttatatacgaaattcctccaagcgacgcagcagacgaagaacaccgaccactgctgctgaatgtttag

SEQ ID NO: 135510 - DNA, 2349 bp, Artificial Sequence
  Description of Artificial Sequence: Synthetic coding sequence
atgcttcaacaacctggtcctagacctgggcgacagcagccctcaggcgacagggacgcttgtcgactccacccccaaggtcggcccccagctttgccaacaatgattccagccgcttctagcactcccccgggggatgctctctttccgagtgttgcaccacaagacttttggcggtcacaggtcactggttactccggctctgtgacgagacacttatcacaccgagctaataatttcaagaggcatccaaaacgtcgaaagtgcattaggccatctcctcctcctccgcccaacaccccttgtcccctagagctcgtagattttggggatttacacccgcaacggtcttttcgtgaactgttattcaatggatgcatcctattcggcattgagtttagctatgctatggaaacagcatacgtgactccagttctactgcaaatgggcctgcctgatcagctgtatagcctggtgtggttcatctctcctattctgggattcttgttacaacccctgctcggcgcttggagtgatcgctgcaccagccgctttggacgccgaagaccctttatcctcgtacttgccatcggtgccctgctcggcctgtcattgctcctgaacgggagggacatcggtatagcactggcagatgtgacagggaaccataagtggggcctcttgctgacagtttgcggcgtggtgttgatggacttctcagccgatagcgccgacaacccctcacatgcatacatgatggacgtctgctctccagccgatcaggatagaggactcaatattcatgcactgctggccggattgggcgggggtttcgggtatgtggttgggggcattcattgggacaaaaccggattcggtcgggctcttgggggtcagctgcgcgtgatctacctttttacggctgtgacactctctgttactactgtgctcactctggtatctattccagaacggcctcttcgcccaccttccgagaaaagggccgctatgaagtcaccctcacttccattgcctccttcaccacctgtgttacccgaagagggccccggagattctctgccttcgcacaccgctactaattttagcagtcctataagcccaccatccccgttgacacctaaatatggatccttcatcagtcgtgatagctctctgacgggcatcagcgaatttgcatcgtcatttggcacagccaacatcgactccgtcctcatagactgtttcacgggcggtcatgacagttatctcgctatccctggtagtgtgcctaggcctccgattagtgtttcgtttcctcgtgcgccagatggcttttacagacaggaccgggggttacttgaaggcagggaaggagccctgacctctggctgtgacggagacatacttcgggtggggagtctggacacaagcaagcccaggagctcgggtattttgaagcgtccccagactctggccataccggatgccgccggagggggaggccccgagacatctaggaggagaaatgttaccttcagccagcaggtagctaatattctcctgaacggcgtaaaatatgagtccgagctgacaggatccagtgagcgcgccgagcagcctctctctgtaggcaggctctgtagtacaatttgtaatatgccgaaggcgctgcgaactctatgcgttaaccacttcctgggctggctgtcattcgagggcatgctgctgttttatacagactttatgggtgaagtggtgttccagggcgacccaaaggctccacacacttcagaggcttaccagaagtacaattccggggttactatggggtgttggggcatgtgcatttacgcgttcagcgctgctttctattctgccatccttgagaagctggaggaattcttgtcagtccgaacactgtatttcattgcgtacctggcttttggtctgggtacagggctcgcaacacttagtcgtaatctttatgtggtactgtcactgtgcatcacttacgggatacttttttctacgttgtgtacgctgccatatagccttctgtgcgattactatcaatcaaaaaaattcgccggctcctctgctgacggcacaaggagggggatgggggtggatatttctctactgtcctgccagtattttctcgcccagatcctcgtgtccttggttttggggccgctgacctctgcagtgggatcagccaacggcgtgatgtacttttcttccctcgtcagttttctagggtgcctctactcatccttgtttgtcatatacgagattcccccttccgatgccgccgacgaggagcatcgacccctcttgttaaatgtttag

SEQ ID NO: 135511 - DNA, 2247 bp, Artificial Sequence
  Description of Artificial Sequence: Synthetic coding sequence
atgatccccgcagccagttcaacacccccaggcgatgctttgtttccctccgtggctcctcaagacttttggcgcagccaagtgaccgggtattctggttcagtgacccgccatctgtcccaccgagccaataacttcaaaaggcacccgaagcggcggaaatgcatcagaccaagtccacccccacccccaaacaccccatgcccactcgagctggtagactttggggatcttcatccccagcgcagcttcagagagctcctgtttaacggctgtattctgtttggcatcgaattcagttacgccatggaaacagcctatgttacccccgtactcttgcagatgggcctgcctgaccagttatactcccttgtctggttcatcagccccattctgggttttcttctgcagcccctgttgggggcttggtccgataggtgcacctcccgcttcggcagacgacgtcccttcatcctggtgcttgcaatcggggccttgctaggactgtccttgctcctgaacgggcgagacattggaatcgcgctggccgacgtgactgggaaccataaatgggggttactgcttactgtgtgtggcgtcgtgttaatggactttagtgcggacagcgccgacaatccatcacatgcttacatgatggatgtgtgttccccagccgatcaggatagaggactgaacattcacgcccttcttgccggactgggcggtggcttcgggtatgtcgtagggggaattcattgggacaaaactggattcggccgtgcccttggcggccagctgagagtaatttatttatttacagctgtgactcttagcgtcaccacagttctcacactggtgtccatccccgaacgccctctgaggcctccctcagaaaagagagccgccatgaagtccccctctcttcccctgcccccgtcacctcctgtactgcctgaagaagggccaggtgatagtctgccatcccacacggccaccaatttcagttctcctatctctcccccctccccgcttacacccaaatacgggtctttcatctctagagactcctctctaacaggtatttccgagtttgcaagctcttttggcacagctaacattgattcagtgctgattgactgcttcactggcggccacgattcctatcttgccattcccggttcggttccgcgtcctcctatttcagtttccttcccgagggcccccgatggcttctacagacaggacagggggctgcttgagggcagggagggcgctctgaccagtggctgtgatggggacatcctgcgcgtgggtagccttgatacgagcaaacccaggagcagcggaatactcaagcgcccacagactctagccatccctgacgccgcggggggaggcgggcccgaaacttcccggcgaaggaatgtgaccttttcgcaacaggttgccaacatattactcaacggggtaaagtatgaaagcgagctgacaggatcttccgaacgcgccgaacagcctctgagcgttgggcgcctttgcagtaccatttgcaatatgccaaaggcactgagaactctgtgcgtgaatcattttctcgggtggctgagcttcgaagggatgttgctgttttataccgatttcatgggggaagttgttttccaaggcgatcccaaggcaccgcacacaagcgaagcataccagaaatacaatagcggcgttactatgggatgttggggtatgtgtatatatgccttctccgcagctttctactctgctatcctggaaaaattggaggaattcctcagcgtgagaactttgtactttatcgcctatctagcctttggattagggacaggcctggccactctgtccaggaacctgtatgtagttttgtccttgtgcatcacttacggaatcctgttctcgacgttgtgcaccctgccctattctttgctatgcgattattaccagagtaagaagttcgccggatcgagcgccgacggtaccagaagggggatgggcgtggacatttctttgctgtcctgtcagtattttttagcccagatccttgtaagccttgtgctgggaccacttacttcagccgtaggaagcgccaatggagtcatgtacttcagctccctcgtgagttttctgggctgcctgtacagttcacttttcgttatttacgagattcctccttctgatgccgcggacgaggaacatagacccctcctgctaaatgtctag

SEQ ID NO: 135512 - DNA, 1593 bp, Artificial Sequence
  Description of Artificial Sequence: Synthetic coding sequence
atgggatctaattcaggccaggctggacgccatatatataagtccctggcagatgacggacctttcgatagcgtggaaccaccaaagcgccccacgtcccgtctgataatgcactctatggctatgttcggccgtgaattttgctatgccgtggaggccgcttatgtgacccccgtactgctttcagtggggctaccgtcttccctttacagcatagtatggtttctgtctccgattctcgggtttttgctgcaacctgtcgtgggatctgcgagtgaccactgccgttcaaggtgggggagacgtagaccctacatcttgacactcggagttatgatgttggtgggcatggccctttacctaaatggcgcgacagtggtggcagccttaatcgcaaatcccagacgtaagctcgtctgggccatttcagttacgatgattggtgtggtcttattcgacttcgccgctgatttcatcgacggaccaataaaagcctatcttttcgatgtctgtagccaccaggacaaggaaaaagggctgcattatcacgccttattcactggttttggcggcgctcttggctacctcctgggagctattgactgggcacatctggaactgggcagattgctaggaacggagttccaggtgatgttctttttttcagcactagtactcactctgtgctttactgttcacttgtgttcgatctccgaggcgccactgacggaagtcgctaaaggaatccctccccaacagactccccaggacccacctctcagcagtgatgggatgtacgagtacggatccatcgaaaaagtgaaaaatggctatgttaatcccgaacttgcgatgcaaggcgctaagaacaagaaccatgccgagcaaacaaggagagcaatgaccctcaaatccctccttagggccttggtcaacatgccccctcactatcgatacctgtgcatatcacatctgatcggctggaccgctttcctttctaatatgctgttctttactgacttcatgggtcagatcgtctacaggggagatccttacagtgcgcacaactccaccgagttcctgatttacgagaggggtgtagaagtcggatgctggggattgtgtatcaattccgtcttctcttcgctgtactcctatttccagaaggtgctggtctcatatatcgggctcaaaggcctgtactttactggctacctactctttggattgggtactggttttatcgggttgttcccaaatgtttattcgactctggtgctgtgttccttgttcggtgtgatgtcctcaacgctgtacaccgtgcccttcaacttgattactgaatatcatcgggaagaggagaaggaacgccaacaagcgcctggcggtgatcctgataatagcgtcaggggcaaggggatggattgtgccacactcacttgtatggtgcaactcgcccagatccttgtgggcgggggactcgggttcctagttaatactgccggcaccgttgtcgtcgtggtaattacagcctcagctgttgccttgatcggatgctgcttcgttgccctcttcgtacgatacgtagactag

SEQ ID NO: 135513 - DNA, 1416 bp, Artificial Sequence
  Description of Artificial Sequence: Synthetic coding sequence
atgggctctaattccggtcaggcaggccgccatatctataaatctctcgccgatgatggaccttttgattctgtagagcctcccaagcgtcctacaagccgacttattatgcacagcatggcaatgttcggtagggagttctgttacgctgttgaagctgcttacgttacccctgttctgctctccgtggggctgcctagctccctctactccatcgtttggttcctttccccgatcctggggtttctacttcagcctgtcgtggggagcgcatcagatcactgccgatctcggtgggggcgccggaggccctatatcttgaccctaggtgtcatgatgctggtgggtatggcgttgtacctgaatggagctacagtcgttgccgggtttgggggcgcactcggttatctactaggcgcaattgactgggcacaccttgaactgggaagactgctggggactgaattccaggtcatgtttttcttctccgcattggtgctgactctgtgtttcactgtgcacctgtgtagcatcagcgaagcccctcttacagaggtcgccaagggaatcccgccacaacagacgccccaggatcctcccctctcgagcgacggcatgtatgaatacgggtcaatagagaaggtgaagaacggctacgttaacccagaactcgctatgcaaggcgcaaaaaacaaaaaccacgccgagcagactcgaagggcaatgaccttgaagtctctgcttcgggcccttgtgaacatgcctcctcactacagatacctgtgcatctcacatctgatcggctggaccgcgtttctaagcaatatgctttttttcactgattttatgggacagattgtttatcgtggagatccttactctgcacacaatagtaccgagttccttatctacgagcgtggggtcgaagttgggtgctggggcttatgcatcaattccgtgttttccagtctgtattcctacttccagaaggtgctcgtctcttacatcggactgaagggcctgtattttaccggttatctcctgttcgggctgggaacagggttcataggcctctttccaaatgtctactctaccctggtgctgtgctcgctcttcggagttatgtcatccaccctttacaccgtccctttcaatctgattaccgaataccaccgtgaagaggaaaaggaaagacagcaggcccctggaggggaccccgataactccgtcagaggaaagggcatggattgcgcgacattgacctgtatggtccagctggcccagattctggtaggtggcggcctcgggtttctggttaataccgcagggacagtcgtggtggttgtgatcacagccagtgcggtggccctgatcggctgctgcttcgtggccctctttgtgcgctatgtggactag

SEQ ID NO: 135514 - DNA, 897 bp, Artificial Sequence
  Description of Artificial Sequence: Synthetic coding sequence
atgggatccaactccggtcaggccggcaggcacatctacaaaagcctggccgatgacgggccgttcgacagcgtggaaccacctaaacggccaacttcgcgcctgatcatgcacagcatggccatgtttggaagggaattttgttacgcagtggaggccgcttatgtgaccccggtgttattaagtgtgggcttgccttctagtctgtatagcatagtttggttcttgtcccctatcctgggatttttactacagccggttgtaggctcagcatctgaccattgtcgctccaggtggggacgacgaaggccttacattctgactctaggcgtcatgatgctcgtggggatggcactatacctgaatggagccaccgttgtcgcagcgttaattgcgaacccgaggcggaaacttgtttgggcaatatcagtgaccatgattggcgtggtgttgtttgattttgccgccgactttattgacggcccaatcaaagcatacctgttcgacgtttgctcacatcaggataaagagaaaggcctgcactaccatgcactttttacgggcacccggagggcgatgacattaaagtctctgcttcgggcactggtcaatatgcctccccattatagatacctgtgcatttcacaccttattgggtggaccgcctttctttctaacatgttattcttcaccgacttcatgggccagatcgtgtatcgcggggatccttactcagcgcataatagcacagagttcctgatttacgaacggggagtggaagttgggtgctggggcttgtgcataaattcagttttcagtagtctgtacagttgcaagagctttagtctgttgcggatgtcaagcaaatctttctggtcttcaaccacatggatttag

SEQ ID NO: 135515 - DNA, 1383 bp, Artificial Sequence
  Description of Artificial Sequence: Synthetic coding sequence
atgggaagtaatagtggccaggccggacggcacatttataagtctctggccgacgatggcccattcgactccgttgagccccccaagcgacctactagcaggttgatcatgcacagcatggcaatgtttggacgagagttctgttacgcggtagaagccgcttatgtcacacccgttttactgtccgtgggacttcccagttccttgtattcaatcgtttggttcctatcccctattttaggcttcctcctccagcctgtggtggggtccgccagtgatcactgccgttctcggtgggggaggcgcagaccctacattttgaccctgggcgttatgatgctggttgggatggctttgtatctgaatggcgcaacagtggttgctgcattgatcgcaaacccccgtcgcaaactggtgtgggcaatatcggtaactatgataggcgtagtgctcttcgacttcgctgcggattttatagacggccccatcaaagcctatctcttcgatgtctgctctcatcaggataaagagaagggattgcactaccacgccctgttcaccggcttcgggggtgccttgggatatttgttaggagcgatagactgggcccacctggaactcggtaggttactgggcaccgaattccaagttatgttttttttcagcgcattagttcttactctctgcttcacagtccacctgtgtagtatatctgaggccccattaaccgaagtggccaagggcatccctcctcagcagaccccacaggatccccccctatccagcgatggtatgtacgagtacggctccattgagaaggtgaagaacggctacgtgaaccccgagctagctatgcagggggcaaaaaacaagaatcacgcggaacagacccgcagagcaatgaccctgaaaagcctactgcgcgccttggtcaatatgcccccgcattacagatacttgtgtatttcacatctgatcggatggacagcttttctctctaatatgctgttctttacggactttatgggccaaatagtctaccgaggtgacccatatagcgcccataattccacggaatttctgatctatgagaggggagtggaggtgggctgctggggcttgtgcatcaattcagttttctcttccctgtacagttacttccagaaagttcttgtctcctatataggcctgaaaggtttgtactttaccggatacttgctttttggcctgggaactggctttattggcctgtttcccaacgtatacagcactctcgtcctgtgcagtttattcggagtgatgtcttcaactctgtacacagtgccttttaacctaatcaccgagtaccatcgagaggaagagaaggaggtgtgctgccactag

SEQ ID NO: 135516 - DNA, 732 bp, Artificial Sequence
  Description of Artificial Sequence: Synthetic coding sequence
atgggctccaacagcggccaagcgggacgacatatttacaagtccctggcagacgacgggccttttgattccgtggaaccgccaaagcgacctactagcagactgattatgcattcaatggctatgtttggacgcgagttttgttacgctgttgaggcggcgtacgtcaccccagttttgctctctgtcggcctccctagctccctctattccatcgtttggttcctcagcccaattctggggttcctactgcagccagtggtaggctcagctagcgatcactgccggagcaggtggggcagacgtcgcccctacatcttaacccttggcgtgatgatgctagttgggatggcactgtatctgaacggcgcgacagtcgtggccgcactcatagccaatcctaggaggaagctcgtgtgggcaatatccgtgactatgattggcgtcgtgctattcgatttcgccgctgactttatcgacggaccaatcaaggcctatctgttcgacgtttgttcacatcaggataaggagaagggcctccactaccatgctctgttcactgatagtcagggtaatgatattaaagtcacagcggagtcaacaggagaacacgcttcgtctctgcctctgccacttcaccagccgccacactggatggattccctccctgtccaacatgccgttcttcacagattccatggccctgattgcgtaccacgaggctctctttag

SEQ ID NO: 135517 - DNA, 741 bp, Artificial Sequence
  Description of Artificial Sequence: Synthetic coding sequence
atggccttgtatctgaacggtgccactgtggtcgccggctttggcggggccttaggttatctgctcggcgcaatcgactgggcacatttagagctggggagattactgggaacagagtttcaggttatgtttttctttagcgccctagtccttaccctgtgtttcactgttcacttgtgcagcatatctgaggctccccttacagaggtagccaagggaattccaccccagcaaacacctcaggatcctccactcagctctgatggaatgtatgaatacggatccatcgaaaaggtgaagaatggatatgtgaacccagaacttgccatgcaaggcgccaaaaacaagaatcacgcagagcagaccagacgggccatgacactgaaatccttacttcgcgccctagtcaacatgccaccgcactacagatatctttgtatttctcatcttatagggtggaccgcctttttaagcaacatgctcttctttacagacttcatgggacagattgtgtaccgtggcgatccatattcagcgcacaactctactgagttcttaatttacgagaggggcgtcgaggtcggatgttggggcctctgcattaattcagtgtttagctcgttgtatagttacttccagaaggtcctcgtttcctatatcggcctaaaagggctttactttacaggctatttgctctttggccttggaaccggcttcatcggtttatttccaaatgtgtag

SEQ ID NO: 135518 - DNA, 1662 bp, Artificial Sequence
  Description of Artificial Sequence: Synthetic coding sequence
atggtgcaacgactgtgggtgagtagactcctgaggcatagaaaagctcagttgcttctcgtgaatctgcttacatttgggcttgaagtttgtcttgcagctggcatcacctacgttccaccactgctccttgaggtgggagttgaggaaaagtttatgaccatggtgttgggaatcggccctgttcttgggttagtgtgcgttccactcttggggagtgcctccgatcactggcgagggaggtatggccgccgtcggccgttcatttgggctctaagcctcggtatactactctccctgttcctgattccacgggccggttggctagctgggctgctttgcccggacccccggccgctggaactggcattactgattctgggcgtgggtctgctggatttctgcggacaggtgtgcttcacgcccctggaggcccttcttagcgatctttttagagatcctgaccactgtcggcaggcctactctgtgtacgccttcatgatatctcttggtggctgtttgggttatctcctccccgccattgactgggatacaagtgcgcttgctccttacctaggcactcaggaagaatgtcttttcggtctgttaaccctgatattcctgacctgcgtcgcagcaaccctgttggtggcagaggaagctgctctgggcccaaccgagcccgccgagggcctaagcgctccatcccttagtccacattgctgtccatgcagagccagattggccttcagaaacttaggggctcttctgcctcgcctccatcaactctgctgtcgcatgccgcggacccttcgcaggctctttgtggcagaactgtgttcctggatggccctcatgactttcaccttattctacactgactttgtgggagaaggtctttaccagggcgtccctcgagcagaacccggcacagaagcaagacgacactatgatgagggggtcaggatggggagcctaggcctgttcctccagtgcgctatcagcctcgtgttctcactagttatggataggttagtgcaacgatttggtaccagggccgtttacctggcctctgtggcagcatttccagtggctgcgggagcaacctgcctgtcacactcggtcgccgtggttactgcttcagctgcattaaccgggttcactttcagcgcccttcaaatcctgccctacactctcgcgagtctgtatcaccgcgaaaaacaggtatttctgccaaagtatcgcggcgacactgggggcgcctctagcgaggactcgttaatgaccagctttttacctggacccaagccaggagctcctttccctaacggccacgttggtgccggaggctccggcctgctgccccctcccccggccttatgtggtgccagcgcttgtgacgtatcagttcgtgttgtggtcggcgaaccgaccgaagcacgagtggtgccaggacgcggtatatgtctggatctggccatcctggattcagcctttctgctctcccaagttgcgccctctctgtttatgggatcgattgttcagctttcacagtccgtgacagcatatatggtttcagcagccggactgggactagtggcaatctacttcgctactcaggttgttttcgataaatcagatttggccaagtactccgcctag

SEQ ID NO: 135519 - DNA, 1293 bp, Artificial Sequence
  Description of Artificial Sequence: Synthetic coding sequence
atggaagggagcgccagccctccggagaagccacgagcccggccagcagccgctgtactgtgtcgcggccctgtggagcccttggtcttcctggcaaattttgctttggttctgcagggccccttgaccacgcagtacctgtggcaccgattctcggctgacctcgggtacaatggcactcgccagagggggggatgcagcaacagatctgcagaccctacaatgcaagaagtggaaacgttgacatcacactggaccctgtacatgaatgtgggcggatttttagttggcctgttttcctccacgctgcttggcgcatggtctgattcagtgggcagaaggccactgcttgtactggcctcactcgggctgcttctacaggcacttgttagcgtcttcgttgtgcagctgcagctccacgtcgggtacttcgtcctggggagaatcctctgcgcattgctgggcgattttggagggctgctggccgcgtcatttgctagtgttgcagatgtgagttcttccaggagcaggacgtttcgtatggcgctgctggaagcatctataggcgtcgctggaatgttggcctccctgctgggaggtcattggcttagagcccaggggtatgctaatcctttctggctcgcgctggccctcctaattgccatgacattgtacgccgccttttgttttggcgagacccttaaggaacccaaatcaactcggctgtttacatttcggcaccatcgctctattgttcaactatacgtggctcctgcgcctgaaaaatctaggaaacacctggccttatattcccttgcgatcttcgttgttattacggtgcactttggagctcaagacattctgacactgtacgagctgtctacacccttatgttgggactcaaagcttatcgggtatgggtccgcggcccagcacctgccttatctcacctcgctgttggccctgaaactgttacagtactgcctggccgatgcctgggtcgctgaaatagggctcgctttcaatattctcggaatggtcgtgtttgccttcgcaactataacgcctctgatgtttaccggcgccctgttctcagcagtggcgtgcgtgaatagcctggcgatgctgaccgctagcgggtttaattctctgtacccagcaacactgaatttcatgaaagggtttccattcctgttaggggcaggcttgctgctaataccggcagtcctgattggcatgctcgaaaaagcagatccacatctagaattccagcagttccctcagagcccatag

SEQ ID NO: 135520 - DNA, 1380 bp, Artificial Sequence
  Description of Artificial Sequence: Synthetic coding sequence
atggagggttctgctagtcctcctgagaaaccacgggcaaggcctgccgccgctgtcctgtgtcggggacccgtcgagcccctggtattcttagcaaatttcgctttggtccttcagggtcctcttaccacacagtacttgtggcatagatttagcgctgatctggggtacaatggaacgaggcagcgaggtggctgctctaaccgctcagctgacccaaccatgcaggaggtcgaaactctgacatcacactggactttatacatgaatgtgggagggttccttgtgggattgttctccagtacactgctcggcgcttggagcgactcagttggtcgaagaccacttctggtgttagctagtctggggttgcttctccaagcactcgtcagcgtctttgttgtgcagctacagctccacgttggatatttcgtgttgggcaggattttgtgcgctctgcttggtgatttcgggggcttactcgcagcaagttttgcgtccgtcgccgatgtgagctcaagtcgttcaagaacatttagaatggccctcctggaagctagtatcggagtggcagggatgctggcaagcctcctgggcggtcactggctcagggctcaagggtacgctaatccgttttggcttgcactcgctctgctgatcgccatgacgctgtatgcagccttctgctttggggaaacgctaaaggaaccgaagtctacaaggctatttacatttcggcatcaccggagtatagttcagctctacgtcgccccagcgcccgagaagtctcggaaacaccttgcactctacagcctggcaatattcgtcgtgattaccgttcatttcggggctcaggacattctgactttatatgaacttagcacccccctctgttgggacagcaagttgatcgggtacggcagtgccgcacagcacttaccttatctgaccagcctcctggcacttaaattacttcagtattgtctggcagatgcatgggtggctgagataggcctcgcttttaatattctgggaatggtagtttttgctttcgctaccatcacgccattgatgttcaccggctacgggctcctctttctgtcactggtaattacccctgtgatccgggccaagctcagtaaactagtacgcgaaacagagcagggtgctctcttctctgctgtagcctgtgtgaactcattagctatgttgaccgcgagtgggatatttaattcactttaccctgccaccctgaactttatgaagggattccctttccttttgggagccggtctgttactgattcccgctgtcctcattggcatgttggagaaggctgacccacaccttgagttccagcaatttccacagtctccttag

SEQ ID NO: 135521 - DNA, 1428 bp, Artificial Sequence
  Description of Artificial Sequence: Synthetic coding sequence
atgagccccgaggtgacttgtcctaggaggggccaccttccacgatttcaccctcggacctgggtggagcccgtggtcgcatcttcccaggtcgctgcctccctttacgacgccggcctgctgcttgtggtcaaagcatcttatggcacaggggggtcctcaaatcacagcgccagcccatcacctagaggcgctttagaggaccaacagcaacgcgctatttccaatttttacatcatttacaaccttgtggtgggtctgagccccctgctgtccgcttacgggctgggatggctgtcagatcggtaccaccgaaagattagtatatgcatgtcactactaggctttctcctatctcggctgggcttactgttgaaagtgttactggattggccagtggaagtcctgtacggagccgcggccctgaatggactgtttggaggcttctctgccttctggtcgggggtcatggccttgggcagcctaggctctagcgagggtcgtcgatctgtaaggctcatcctgatcgatctgatgctgggcctcgctggattttgcggaagtatggcctctggccacctgttcaagcaaatggcaggccactcaggtcaaggcttgattctcactgcctgcagcgtcagctgcgccagttttgctctcttatattcccttttggtgctgaaggttcccgagtccgtggctaagcccagtcaggagctgccggctgtggatacggtttccggaaccgttggaacctatcgaacactggatcctgaccaactagatcagcaatacgctgtgggtcacccacccagccccggaaaggccaaacctcacaagacaacaatagccctcctctttgtgggtgctataatttatgatctggctgtggtaggcacagtggatgttatcccactgttcgtcctgagagaacccttggggtggaatcaggtacaggttggctacggtatggccgccggatatacaatattcatcacgtctttcctcggtgttttggttttcagccgctgctttagagatacaaccatgattatgatcggaatggtcagctttggttctggagctttgctcctggcgttcgtaaaggagacctacatgttctacatcgcacgtgcggttatgctgttcgctctgatcccagtgacaactatccgcagtgctatgagcaaactaattaaggggtccagttatggaaaagtcttcgtgatcttgcagctatctctcgctttgaccggcgtggtgacatccaccctctacaacaagatctatcagttgacaatggatatgtttgtgggctcttgtttcgcattatcttcttttctctctttcctggctattatccccataagcattgtggcatataagcaggttcctttgagtccctatggagatatcatcgagaagtag

SEQ ID NO: 135522 - DNA, 1713 bp, Artificial Sequence
  Description of Artificial Sequence: Synthetic coding sequence
atggaggctcccgaggagcccgctcctgttcgcggtggccctgaagccacgctggaagtgcgcgggtctcgctgtctgcgcttaagcgccttcagagaggagctcagagccctgttagtgttggcaggccccgcattcctggtacagctgatggtgtttctgatctcgtttattagcagcgttttttgtggccacctgggaaaactcgagctagacgccgtgaccctggctattgccgtcatcaacgtgaccggagtctctgtagggttcggtctgagttccgcttgtgacacgctgatctctcaaacttacggatcacagaacttaaaacatgtgggcgtgatactccagcggtccgcactcgtattgctgctctgttgtttcccatgctgggcgctctttctcaatacacaacatattcttctactcttccggcaggaccctgatgtgtccaggctgacccaaacttacgtcactatattcatccccgcactccctgccacctttctgtatatgctgcaagtgaaatatctactgaaccaggggatcgtcctcccccagatagtcactggcgttgccgccaaccttgtgaatgctctggccaactacctctttctgcatcagcttcacctgggtgtgattggaagcgcacttgcaaaccttatcagccagtacacactggcactgctgctcttcctctacattctgggcaaaaagctacaccaggccacgtggggcgggtggtccttagaatgtctgcaggattgggccagcttcctgaggcttgctatcccatctatgttgatgttatgtatggagtggtgggcatacgaagtgggaagcttcctgtcaggcatattgggcatggtcgaactgggggcgcaaagtatcgtttatgaattagcgatcatagtctacatggttcctgctggcttcagcgtggcggcatccgtgagagtggggaatgcgctgggggctggggacatggaacaggctagaaaatccagtacagtctcccttctcattaccgtcctcttcgccgtggcattcagtgttctgctcctctcctgcaaagaccatgtgggctatatctttacgacggatagggatatcatcaaccttgtggcccaggttgtgcccatatacgccgtctcacatctgtttgaagccctggcctgcacctccggaggggttttaagaggatctggcaatcagaaagttggggctatcgtcaatacaattgggtactacgtcgttggcttacccatcggcattgctcttatgttcgctactaccctcggagtgatgggcctctggtccggcatcatcatctgcacagtgtttcaggcggtgtgcttccttggctttatcatacagcttaattggaagaaggcatgccagcaggcacaggtgcacgcaaatttgaaagtgaacaacgtaccccggagcggaaattcagccctaccccaggacccgttacacccggggtgtcctgaaaacctggagggcattcttacaaatgacgtcggtaagaccggggagccacagtctgatcagcagatgcgtcaggaagagcctctgcctgagcatccgcaggatggcgcgaagctgtccagaaagcagctggtcctgcgccgggggctgttgctgctcggggtatttctcattctactggtgggtatcttagtgcggttctatgtgcgcattcagtag

SEQ ID NO: 135523 - DNA, 1761 bp, Artificial Sequence
  Description of Artificial Sequence: Synthetic coding sequence
atggaagctccagaggagcccgccccagtgcgcggtggtccagaggcgactttagaggtgaggggatctagatgtctgagactcagtgccttccgcgaggagctgcgggccctcttggtgctcgcgggccctgcctttctggttcagttaatggtgtttttgatatcgttcatatccagtgtgttctgtggccacttgggcaagctcgagctcgacgccgtgacactggcaattgccgtgatcaatgtaacaggcgtgagcgtcggtttcgggctgagcagcgcatgtgacacattgatttctcaaacatacggatcccagaatctcaagcacgtaggggtcatccttcaacgcagtgctttagtcctcctcctttgttgttttccatgttgggcgctattcttgaatacacaacacatcctgcttctcttcaggcaggacccagacgtatctaggcttactcagacatatgtgacgatcttcattcctgctctccctgcaacgtttctgtacatgctccaggtgaaatacctgctaaaccagggcatcgtcctcccacaaattgtgacgggggtagcagcaaacctagtaaacgcacttgccaattacctgttcttgcaccagctccatctaggtgtgattggtagtgccctggccaacttaatcagtcagtatacactggccctgctgctgttcctgtacatccttgggaagaagctccaccaagccacatggggaggctggtcactggagtgcctgcaggattgggcctcctttttgcgtctggccatcccaagcatgctcatgttgtgcatggaatggtgggcctatgaggtgggttctttcctgtccgggatacttggtatggtggagttaggagcacagagtatagtgtacgaactggccataattgtgtatatggtgcccgcaggctttagtgtcgcggcaagtgtgcgcgtaggcaacgcactcggggcgggagacatggagcaggcacgcaaaagcagcacggtttcactgctgatcacagtactgtttgccgtcgcctttagcgtcctgttactatcctgtaaggaccatgtcggatatatttttacgaccgatagggacatcatcaaccttgtcgctcaggttgtgcccatttacgctgtgagccatctcttcgaagctttggcttgcacaagcggcggagtgcttagggggagcggcaatcaaaaggtgggcgctattgtgaataccatcggttattatgtggtcggactccccattggcattgcactgatgtttgccactacgctgggcgtgatgggcctgtggagtgggatcattatatgtaccgtgtttcaggccgtgtgctttttgggctttatcattcaactgaattggaaaaaggcctgccagcaggctcaagtgcatgccaatctcaaggtcaataatgtgcctcggagtggaaacagcgctctcccccaggatccactccaccccgggtgccccgaaaatcttgagggaatcctcacaaacgacgtggggaaaacaggcgagcctcaatcagatcagcagatgcggcaggaggagcccttacccgagcacccacaggacggagcaaaactctccagaaaacagctagtgttgcggcgtggcttgttactgttgggagttttcctgattctgctcgctggggtacggtggtgtgatcattccagcctccaaccccgtaccttgggcctgcaggctatcttattgtgccagcctcccgaatag

SEQ ID NO: 135524 - DNA, 849 bp, Artificial Sequence
  Description of Artificial Sequence: Synthetic coding sequence
atggtggaactcggggctcaatctattgtatatgagttagccattatcgtgtacatggtgcccgccgggttctccgtcgcagccagcgtgcgcgtcggtaatgctttaggcgctggcgatatggagcaagcacggaagtcgagcaccgtgtctctgctgataacagtcttgttcgccgttgcgttctcggtgctgttgttgtcgtgtaaggaccacgttggttatatattcactacagatcgggacattatcaatctggtcgcccaggtggttcctatatacgcagtgtcacacctgttcgaggctctcgcatgcaccagtggtggcgtcttgaggggtagtggcaaccagaaagtaggagctatagtaaatactattggttattacgtggtcggcctgcctattgggattgccctcatgtttgcgaccacgttaggagttatgggtctgtggtcgggtataataatttgcaccgtcttccaggctgtctgctttctgggcttcatcattcagttgaattggaaaaaggcatgccaacaggcccaggtacacgctaatctgaaagtcaacaatgtgcccaggtctgggaactctgctcttccgcaggatccgcttcatcccggctgtcccgagaacctggagggcattttaactaacgacgtgggcaaaaccggtgaaccccagagcgatcagcagatgcggcaggaggaacctctgccggaacaccctcaggacggggcgaagctcagccgtaagcagctggtgctccgacgcggcttgttgttgctgggtgtatttctgattctgctggttgggattctggttcgcttctatgttagaatccaatag

SEQ ID NO: 135525 - DNA, 1332 bp, Artificial Sequence
  Description of Artificial Sequence: Synthetic coding sequence
atggaggctccggaggaacctgcacctgtcaggggtggacctgaggcgacgctggaggtacgtggctctcgatgtctcaggctgtcagcttttagagaagagctgcgtgccctgttggtcttggcaggcccagcctttctggttcagctgatggtgtttctgataagcttcatcagtagcgtgttttgtggacacctgggcaagctcgaattggatgcagtgactctggcaatagctacctatgggtcccagaacctgaagcacgtcggtgtgatcttgcagcggagtgcattggtactcctgctctgttgtttcccatgctgggccctgttcctgaatacccaacacatactgctgctttttcggcaagacccagacgtgagtaggctgactcagacttatgtaaccatcttcattccagcactcccagcaaccttcttgtatatgttacaggtcaagtacctgctgaaccagggtatcgtcctaccccaaatcgtgactggcgtggccgccaacctggtcaacgctttggccaactacttattcctgcaccaattacacctgggagttattggatctgcgctggctaatctcatctctcagtacaccttagcgttactgctctttttgtacattttggggaaaaagttacatcaggcaacgtggggagggtggtcccttgaatgtctacaagactgggcttctttcctgcgtctggccatcccatctatgcttatgctctgtatggagtggtgggcttacgaggtcggatcttttctttcggggatactgggaatggtcgagttgggagcccagtcgatagtgtacgagctggccatcatcgtgtacatggtgccagccggattttccgtggcagcatcagtgcgggtagggaacgctttgggggcaggtgacatggagcaagcccggaagagctcgacggtgagcctgttaattacagtgctattcgcggtcgcctttagcgtgctgctgttgtcatgtaaggaccacgtgggatatatttttacaacagacagggatatcattaatctcgtggcacaagtggttcccatttatgcggtctcacacctttttgaggctctcgcttgcaccagcggtggagtgctgcggggaagcggcaatcagaaggttggcgcgatcgtgaacacaattggctattatgtggtgggcctgccaatagggatcgcccttatgttcgcgacgacgctgggtgttatgggctctggcacccggcaatttgagtctaaacaaagagctagcgagtgggaattctgttcgccttctggctccgcttctccgcgcgtgccttag

SEQ ID NO: 135526 - DNA, 738 bp, Artificial Sequence
  Description of Artificial Sequence: Synthetic coding sequence
atgctgatgttgtgtatggaatggtgggcatatgaggtgggttccttcctcagcgggattctcgggatggtggagctgggagcccagtccatagtgtatgaattggccattatagtgtacatggttcccgccgggttttctgtcgccgcgtccgtgcgagtcgggaacgccctgggcgccggtgatatggagcaggctcgaaagtcttcaacagtgtctttgttgatcactgtgctgtttgcagtggccttctctgttttgttgttgtcttgcaaagaccacgttggctatatatttactactgacagggatatcattaatctggtcgcacaggtggtgcctatttatgccgtttcacatctcttcgaggcacttgcttgtacttccggaggtgtgctccgtggcagtggaaaccaaaaagtgggcgccatcgtgaacactatcggctactacgtggtagggctgcctattgggatcgccctcatgttcgcaacaaccctgggcgtgatgggctgccctgagaatctggagggaatcctcacgaacgatgtcggcaaaaccggcgaaccacagtcagatcagcagatgagacaggaggagcccctgcctgaacatccccaggatggagcgaaactgagtaggaaacagttggtgcttcggcggggcctgctgctccttggcgtctttctgatacttctcgttggaatcctggtccgtttttacgttaggatccagtag

SEQ ID NO: 135527 - DNA, 1761 bp, Artificial Sequence
  Description of Artificial Sequence: Synthetic coding sequence
atggaggcgcctgaggaacctgcccccgtgcggggtggccccgaggcaactcttgaggttagaggatctaggtgccttcgtctgagtgctttcagggaggagctacgtgctctgcttgtgcttgccggcccagccttcctggtgcagctgatggttttccttatcagctttattagctcagtgttctgcggacaccttgggaagttagagctcgatgcagtcacgctggccatcgcggtgattaatgtgaccggtgtctctgtcggcttcggcctgtctagtgcctgtgacaccctgatcagccagacctacgggtcacaaaacctgaagcatgttggggtgatactgcagaggagcgccctcgttctactcctctgttgtttcccctgctgggcccttttcctgaatacacaacacattctgctgctgttcagacaggaccccgacgtatcaaggcttacacagacttacgtcacaattttcatacccgccctgccagccactttcctttatatgctccaagttaagtacctcctgaatcaaggcatcgtcttgcctcaaatcgtaactggagtggcagccaacctggtcaacgccttagctaactatttattccttcaccaactccatctcggcgttatcggctccgcccttgccaacttgatctctcaatatacactcgcccttctgctttttctgtatatccttggcaaaaagcttcaccaagccacatgggggggttggagtctggaatgtctacaggactgggcctcctttctgcggttggcaatcccaagcatgctaatgttgtgcatggagtggtgggcctatgaagttggttcattcctttccggcattctgggaatggtggagcttggagcacagagtatcgtgtacgagttagccattatcgtgtacatggtaccggctggatttagtgttgctgcttccgtacgggtcggcaacgcactgggagctggagacatggagcaggctagaaagagcagcactgtaagtctcctcattaccgtattgtttgctgtggcattctcggtcctgctgcttagctgtaaagaccatgtcgggtacatatttactacagaccgcgacataatcaatttggtggcccaggtggttcctatctatgctgtgagtcacctgttcgaggccttagcttgtacctccgggggggtgcttcggggcagtgggaaccaaaaagtcggggccatcgtgaatactatagggtactacgtggttgggttacctatcggcatcgccctgatgtttgccactacactgggcgtgatggggctgtggtccgggattattatttgtaccgtattccaggcagtgtgcttcctgggcttcattatccagttgaactggaagaaagcttgtcagcaggctcaggtgcacgccaacctcaaggttaacaatgtgcctagatcgggaaacagcgctctccctcaggaccccctgcaccctggatgtcctgagaatctggagggcatcctcaccaacgacgtgggcaagacaggggagccacaatcagaccagcagatgcggcaggaggagcccctgcccgagcatccccaggacggcgccaagttaagccgtaagcagctcgttctgaggagggggttgctgctcttaggagttttcctgattcttctcgccggggtcagatggtgtgaccactcctccctccagccaaggacattaggactgcaggctatcctgctatgtcagccaccagagtag

SEQ ID NO: 135528 - DNA, 735 bp, Artificial Sequence
  Description of Artificial Sequence: Synthetic coding sequence
atggaggcacctgaagaacccgctcccgttaggggcggtcccgaagccacccttgaggttcgcggcagccggtgtctcaggctaagcgcgttcagagaagagctgcgggccttgctcgtgttagctggacctgccttcctggtgcagctcatggtcttcctcatctcattcatatcctccgttttctgcggacatctgggcaagctcgagctcgatgctgttaccctggctattgcggttatcaacgttactggagttagtgtaggattcgggctgagctcagcttgcgacactctgatctctcagacttacggctcacagaacctgaagcacgtgggcgtgatcttacagaggtcagccctggtcctgcttctctgctgtttcccttgttgggccctctttctgaacacgcagcacattctactgctgttccgtcaggatccagatgtttcgcgtttaacccaaacgtatgttacgatcttcatccccgcgctgccagctacctttctgtatatgctgcaggtcaagtacctgttgaaccagcgcctgtgtacaggaaagctggattttccagtgcatcctggcagcacccctctctccctgcacccgagggagaagactgccagtagctacatgggccggttggtgcccagagttccagcagggttgggcctcctcccgcctcctggccatccccaacatgcgcacgccgtgcacggtgtcgtggggttatag

SEQ ID NO: 135529 - DNA, 1809 bp, Artificial Sequence
  Description of Artificial Sequence: Synthetic coding sequence
atggacagccttcaggatacagtggcccttgatcacggtggctgttgtccagccctttcaaggttagtgccacgcggtttcggcaccgaaatgtggacactattcgctttaagcggaccactattcctattccaggtcctgactttcatgatttatatagtctctaccgtcttctgtgggcatctgggaaaggtggaactcgcatcagttacgctggcggtcgccttcgtaaacgtgtgcggcgtttccgttggggttgggctctcctcagcctgcgatacacttatgtcacagtcttttggcagtccgaacaaaaagcacgttggagtgatactccagagaggggcgctggtactgctcttgtgttgcctcccctgctgggcccttttcctgaacacacagcacatccttctgctctttagacaagatcccgatgtaagcaggctgacccaggattacgttatgattttcattcccggtctaccagtgattttcttatataatttgctggctaagtaccttcagaaccagggttggctgaagggccaggaagaggagtcccccttccaaacccccggtctgagcattctccaccccagccattcgcatttgtcacgggcaagctttcatctgtttcaaaaaatcacttggccccaagttctgagtggcgtcgtcgggaactgtgttaacggcgtggccaactacgctcttgtgagcgtactgaatctgggagtcagaggcagcgcatatgcaaacataattagccagttcgcccagaccgtgtttctgctgctgtatatagtgttgaagaagctacaccttgagacatgggcgggatggtcctcccaatgccttcaggattggggaccctttttctcacttgctgttccttccatgcttatgatctgcgtagaatggtgggcgtacgaaatagggagttttcttatggggctgctgtccgttgtagatctatccgcccaagcggtaatatacgaggtggcgacggttacgtatatgattcccctcggcctgagcattggagtgtgtgtgcgggtcgggatggcactgggggctgccgacactgtccaggcaaaacggagcgcggtctccggagtgttgtccatcgtgggcatctctctagtcctaggaaccctgattagcattttaaagaaccagctgggacatatctttacaaatgatgaggacgtgatcgctctcgtcagtcaggttctccctgtttatagcgtttttcacgtgtttgaagcaatttgttgcgtatatgggggagtattacgcggaaccggaaaacaagcgttcggcgcggcagttaatgctatcacatactacataattggcctgcccctgggcatcctgttgacgtttgtggtcaggatgcgcatcatgggcctgtggctgggaatgctggcctgtgtatttctggccacggctgcattcgtagcctacacggccagactggattggaaactcgcagcagaggaggccaaaaaacacagtggccggcaacagcaacagagggccgaaagtacagcgacgagacccggaccggagaaggctgtgctatcgagtgtggcaaccggatcctcacctggtatcacattaaccacttattctaggtcggagtgccatgtagattttttccggacgcctgaagaagctcatgcattgtcagccccaacatccagactgagcgttaagcaacttgtaattagacggggagccgcccttggagccgccagcgcaaccctgatggtcggccttaccgttcgaatcctcgcgaccagacattag

SEQ ID NO: 135530 - DNA, 1743 bp, Artificial Sequence
  Description of Artificial Sequence: Synthetic coding sequence
atggactcactgcaagatacagtagccctggaccatggcggttgctgtcctgctctctctcgactggtgccgagagggtttgggacagagatgtggacgctgttcgctctgagcggaccactgtttttgtttcaagtgctaaccttcatgatatatattgtgagtactgtgttttgcggtcatctgggtaaagtggagcttgccagtgtcaccctagccgttgcgtttgtcaatgtatgtggagtgtccgtgggggtcggcctctcatcagcttgtgacacactcatgagccagagcttcggatctccaaataagaagcacgtcggcgtaattttgcagcgtggagccttagtgttacttctttgttgtctaccttgctgggctttgtttctcaatacccagcatatacttcttctattccgacaggatcccgatgtgagccggttaactcaggactatgtcatgatctttattcccggtctgcctgtgatattcctttataatctacttgccaaatatctccagaatcagaagatcacatggcctcaggttctcagtggagtggtgggtaactgtgtgaacggtgtcgctaactacgccctagtgagcgtacttaatttgggagtgcgcggttcagcctatgctaatatcatttcacaattcgcccagactgtcttcctgctgctctatattgtgcttaaaaaactgcacctggagacatgggccggatggtctagccaatgcctgcaggattggggcccatttttcagcctggctgtgccctctatgctgatgatctgtgtcgagtggtgggcctatgaaatcggctcattcctaatgggactgctgtctgtagtggatctgagtgcccaggctgtgatttacgaagtcgcgaccgttacctacatgagacactcccatagattagcctatgcggcccacgtcactcgcatccctctggggctctccatcggagtgtgcgttagggtggggatggccttgggggccgccgatactgtacaagccaagagaagcgcagtctcaggcgttctgtccatcgtcggaatctcacttgttttgggcactctgatatcaattcttaaaaaccaacttggccatatcttcacaaatgatgaggacgtaattgcactggtgtctcaggtgttgccggtgtatagcgtatttcatgtcttcgaggccatctgttgtgtctacggtggcgtgctgcgcgggacgggaaagcaggccttcggggccgctgtaaatgctatcacttactacattatcggcctgcccttgggaatcctactgacgtttgtggtgaggatgaggatcatgggcttgtggctcgggatgctggcctgtgttttcctcgcaaccgccgcttttgtggcatatactgcacggctggattggaagctcgccgccgaggaggccaagaaacacagcggacgacaacagcagcaacgagcagagtccacggcaacacgacctggacccgagaaggctgtattgagtagtgtggccactggcagtagccccggaattacactgactacatactctaggtccgaatgccatgtggacttcttcagaacaccggaggaggctcacgcgcttagcgcaccaacctctaggctcagtgtgaagcagttagtgattcgcaggggggcggctctcggcgcagcttccgccacccttatggtggggcttacggtacggatcttagcaacgcgccattag

SEQ ID NO: 135531 - DNA, 1092 bp, Artificial Sequence
  Description of Artificial Sequence: Synthetic coding sequence
atggatagcctgcaggatacagtcgcactagaccatggggggtgttgccctgctctgtctcgacttgtcccgcggggttttggtacggagatgtggacactgtttgctctcagcggccccttgtttctcttccaagtccttacattcatgatctatatcgtaagcactgtgttttgtggccacctgggaaaggtggaactggcgtcagtcacacttgccgtcgcattcgtgaacgtttgcggcgtgtccgttggcgtaggcttgagctctgcatgcgacacgttaatgagccagtccttcggaagccctaacaagaagcatgtgggcgtaatactgcagcgcggcgcactggtgctcctgttatgttgcctgccatgttgggctctattccttaatacacaacatatactcctgctctttaggcaggaccccgatgtttcaagacttactcaggactacgttatgatattcattcctggtctgcccgtcatttttctctacaatcttctggcaaagtaccttcagaaccagaagatcacgtggccacaggtcttgagcggggtcgtcggtaattgtgtcaacggtgtcgcaaactatgccctggtgagtgtgctgaacctcggggtgagggggtccgcttatgccaatatcattagccagttcgctcagaccgtatttttgctcctatacatagtgcttaaaaaactgcacctggagacttgggccggatggtctagccaatgtctgcaggactggggaccattcttctcccttgcagtgccgtccatgttgatgatctgcgtggaatggtgggcctatgaaattggcagctttcttatgggccttctcagtgttgtcgacttaagtgcccaagcagtaatctacgaagtcgctacggtgacttacatgattcctctgggactgtcaataggggtctgtgtcagagtcgggatggcactgggagccgcagacactgtgcaggccaaacgctccgccgtgagcggagtactgagcatagtgggtatctcccttgtgctaggtacattaatttcaattctgaaaaaccagctgggccatatttttacaaactag

SEQ ID NO: 135532 - DNA, 891 bp, Artificial Sequence
  Description of Artificial Sequence: Synthetic coding sequence
atgatttatatcgtgagcacagttttttgcgggcacttaggtaaagtggagctggccagcgttaccttagcggttgccttcgtcaatgtctgcggagtctccgtcggggtggggttgtccagcgcctgtgatactttaatgtcacagtcttttggtagcccgaataagaagcacgtaggagtcatccttcagagaggtgccctagtgctcttgctctgctgccttccatgctgggcacttttccttaatacccagcacatcttgctgctctttcggcaggaccctgatgtgagtcgattgacacaggattatgttatgattttcatccctggtttgccagtcatttttttatacaacttgctggccaagtacctgcagaatcagaagatcacttggcctcaggtactgtcaggtgttgtcggcaactgtgtgaacggcgtggccaactacgctctggtgagcgtgcttaacctgggggtgcgggggagtgcttatgcaaacatcatctcccagttcgctcagacagtgttcctcttgttgtacatcgtcctcaagaagctccacctggagacgtgggccggatggtcttctcaatgtctgcaggattggggccccttcttctccctggctgtgccatccatgttaatgatatgcgtggaatggtgggcctatgagatcggcagcttccttatgggtctcctgtcagttgtggacctttcagcgcaagccgtaatctacgaggttgctacggtcacgtacatgatccctctgggcctcagcattggtgtgtgtgtgcgggttgggatggcactgggggcagctgatacagtccaggctaagcgtagcgctgtgagcggggtgttgtccatcgcacgaagcgacccgtggtag

SEQ ID NO: 135533 - DNA, 531 bp, Artificial Sequence
  Description of Artificial Sequence: Synthetic coding sequence
atgaaggccagcgggactctgcgcgagtacaaggttgtggggaggtgtttgccaaccccgaaatgtcatacccctccactttacagaatgcggattttcgcccccaatcacgtggtcgctaaatccaggttttggtatttcgtttctcagctgaaaaagatgaagaagtcatccggcgaaattgtctattgtggtcaggtgtttgagaaaagccctcttcgcgtgaaaaatttcgggatttggctgagatatgatagtagatcaggcacccacaatatgtatcgtgaatacagagatttgaccacagcgggtgcagttacgcaatgctacagggacatgggcgcacggcaccgagcccgcgctcacagtatacagattatgaaggttgaggagattgccgccagcaagtgtcgtaggcccgctgttaagcaatttcatgacagtaagattaaattccccctccctcatagggtcctgaggaggcagcataaaccacgatttacaactaaacggccaaatacctttttttag

SEQ ID NO: 135534 - DNA, 1995 bp, Artificial Sequence
  Description of Artificial Sequence: Synthetic coding sequence
atggactcatccacgtggagtccaaaaacgaccgcagtgacccgtccagttgaaacacacgaactaattcggaacgccgcagatattagtattattgtgatttattttgtcgtggtgatggccgtgggtctatgggccatgttctcaacgaaccggggaactgtaggcggattttttctagccggacgctccatggtatggtggccaatcggggccagtctgttcgcgagcaatattggcagcggccattttgtcggccttgccggcactggcgctgcatcaggtatagctatcggcggattcgagtggaacgctctcgtgttggtggtggtgctggggtggctcttcgttcccatctatatcaaagcaggcgtcgtgaccatgcctgagtatctccggaagaggttcggaggacaacgtatccaagtttatctgtcccttttaagtctactgctctacatttttactaaaatctctgcagacatattttcaggcgccatttttataaacttggcactgggtttaaacctttatctggcgatatttctgctgctggctattaccgcactctacacgatcaccggcggtctcgctgccgttatttacacagacacactccaaaccgtgatcatgctcgtgggttccctcatactgacaggctttgcgtttcatgaggtggggggttacgatgcctttatggagaagtacatgaaagctattcccacaattgttagtgacggtaacacgacatttcaagaaaaatgttatactccacgggccgacagcttccatatatttagagatcccctcactggcgacttgccctggcccggctttatatttgggatgtcaatcctcactctgtggtactggtgtacagaccaggtgatcgtgcaacgctgcctttcagccaaaaatatgagccacgtcaaaggtggatgcatcttgtgcggatacctcaaattgatgccaatgttcattatggtgatgccgggcatgatcagccgaatcctgtacacagaaaagatcgcgtgcgtagtgccatctgagtgcgagaaatattgcgggacaaaagtgggatgcactaacatagcctaccccacactggtggtggaacttatgcctaatggactgagggggctgatgctttcggtgatgcttgcaagcctgatgagctctcttacttcgatttttaattccgcctcgaccctgttcaccatggacatatacgccaaagtgcggaagcgtgcctccgagaaggagctcatgattgctggcagactgttcatcctcgtgttgatcggcatatctatcgcttgggtgcctattgtccagtctgctcagtcgggtcagctgttcgattatatacaatctattacatcttacctgggacccccgatcgccgccgtttttttactcgccatattttggaagagagtgaatgaacctggagccttttggggactgattttaggactcctcatcgggatatcccgtatgatcactgaatttgcgtacggaactggctcatgtatggaaccaagcaactgtccaacgattatctgcggtgtgcactatttgtattttgccattatcctgttcgccatcagcttcatcactattgttgttatctcactactaaccaagccaattcccgacgtgcacctctacaggttgtgctggagccttcggaatagcaaggaagaaaggattgatcttgacgccgaggaggagaacatacaggaaggcccaaaagagactatcgagatagagacacaggtcccagagaaaaagaaaggcatttttagacgggcgtatgatcttttttgtgggctggaacagcatggggccccaaagatgacagaggaggaggaaaaagcaatgaaaatgaagatgaccgatacatctgaaaagccgctttggaggaccgtcctcaacgtgaacggaatcatcttggtgacagtcgctgtgttttgccatgcatattttgcttag

SEQ ID NO: 135535 - DNA, 1614 bp, Artificial Sequence
  Description of Artificial Sequence: Synthetic coding sequence
atgccggagtacctgcgcaaacgtttcgggggccagcgcattcaagtatatctctcactgctcagcctattgctctacatatttacaaagatctccgctgatatatttagtggtgccatcttcattaacctggctttgggtctcaacctttacctggcaatttttctgctgttggcgattaccgccctgtacactattactggaggcttggccgccgtaatctacacagacactttgcagacagttattatgttagtcggttccctgattttgacaggttttgccttccatgaggttggaggatatgacgcttttatggagaagtacatgaaggcaattccaactatagtatctgacggtaacaccactttccaggaaaagtgctatacccctcgtgctgattcctttcatatttttagggaccctctcacaggtgacctgccttggcccggctttatcttcggaatgtcaatcctgacactgtggtactggtgtacagaccaagttatcgtgcaacgatgcctgtccgccaagaatatgtcccacgttaaaggagggtgtatcctttgcggctacctgaaactgatgccaatgttcattatggtgatgccgggcatgatctcccggatcctgtacacagaaaaaattgcctgcgtggtcccatctgagtgcgaaaagtactgcggaaccaaggtaggctgtactaacatcgcctaccctaccctcgtggttgaacttatgcctaacggtttacgcggacttatgctgagtgtaatgctcgcttccttaatgagttcgcttacatcaatctttaattccgcttctaccctgtttaccatggacatctacgccaaggtgagaaagcgcgctagtgagaaggagctgatgatcgccggtaggctctttatcctcgtgctaataggcatctccattgcctgggtgcctattgtgcagtctgcccaatctggccagctgttcgattatatacagagtattacttcttaccttgggcctccaatagcagccgtgtttctcctcgcaatattttggaagagagtcaacgaaccaggggccttttggggccttatcctgggcctactgattgggatatccagaatgataacagaatttgcctatggcaccggatcctgcatggaaccaagcaattgtccgactataatctgtggcgtgcactatctgtacttcgcaattatccttttcgcgatatcattcatcacaattgtggtgattagcctgctaaccaagcccatacccgacgtgcacctctacaggctttgctggtcccttcgaaactcaaaagaagaaaggatcgatctggacgcagaggaggagaatattcaggaaggaccaaaggagaccattgaaatcgagactcaggtgccagaaaaaaaaaaagggatcttccgcagggcttacgacctgttttgcggcctggagcagcacggcgcaccaaagatgactgaggaggaggagaaggctatgaagatgaaaatgactgatacctctgagaagcctctctggcgcaccgtactgaatgtgaacggaatcattctggtgacggtcgcagtgttctgtcatgcttattttgcatag

SEQ ID NO: 135536 - DNA, 1191 bp, Artificial Sequence
  Description of Artificial Sequence: Synthetic coding sequence
atggaggtgaagaacttcgctgtctgggattatgtcgtctttgccgctttatttttcattagctccggcattggggtcttcttcgccatcaaggaacgcaagaaagctacaagtagagaattcttggtgggcggcaggcagatgtccttcgggccggtggggctgtctctcactgcgtccttcatgtccgctgtgaccgtgctgggcaccccctctgaagtgtatcgctttggcgcctcattccttgtcttcttcatcgcatacttgtttgtcatcctgctcacttcagaacttttcctgcctgtcttttataggagcgggattaccagtacatacgaatatctgcagttacgatttaataaacctgtcaggtatgcggcaactgtgatatacattgtccagacaattttgtatactggagtggtcgtctacgcacctgcactcgcactgaatcaggttaccgggtttgatctgtggggatccgtgttcgccactggtatagtttgcactttctactgcactttgggaggccttaaggccgtcgtttggacagacgcttttcagatggtcgtgatgatcgtgggcttccttactgttctaatccaggggtccacgcatgctgggggcttccataacgtgctcgagcaatctacgaacgggtcccggctacatatcttcgacttcgatgttgatccgttaaggcggcatactttttggaccataacagtaggcgggacgtttacatggctggggatatatggggttaaccaaagtaccatccaacgctgtatcagctgcaaaactgagaaacacgctaaacttgctctctatttcaacctgttggggttatggattattttggtgtgcgctgtgttcagtggcttgataatgtacagccatttcaaggactgcgacccatggacttccggtatcatctctgcacccgatcagctgatgccatatttcgttatggaaattttcgctaccatgccaggccttccaggcctgttcgtggcgtgcgcattttccggaaccctttcgacagtcgccagttcaataaatgccctggctacagtcacatttgaggacttcgtgaaaagctgtttcccgcaccttagcgataaattgagcacatggataagtaaaggactttgtcgctactcttggtggaccttttattcgatcagctag

SEQ ID NO: 135537 - DNA, 1857 bp, Artificial Sequence
  Description of Artificial Sequence: Synthetic coding sequence
atggaagtcaaaaacttcgcggtttgggactatgtcgtttttgcggccctcttttttatctcatccggaatcggagtcttttttgctatcaaggagcgcaagaaagctacctcacgcgaattcctagttggaggcagacagatgagttttggccccgtcggcttgtccctgacagcgtcttttatgtctgcagtgacagttctgggaaccccatcggaagtttaccgtttcggcgcatctttcctggtgttcttcattgcatacctgttcgtgatcctgttgacctcagaactcttcctgccagtattttatcgcagcggaattacatccacgtacgagtacctgcagttaaggttcaataagcctgtgcgctacgcagccacagtaatttacatcgttcagacaatcctatatacaggagtggtcgtctacgccccagccttggctctcaaccaggttactggctttgatctgtgggggtcagtgttcgcaaccggcatagtgtgtactttttactgtacattggggggactgaaggccgttgtctggactgatgcttttcagatggtggttatgatcgtgggctttttgaccgtactcatccagggatcaacccatgccggcgggttccataacgtgctggagcagtccactaacggtagtcgtttgcatatctttgattttgacgtggacccgctacggaggcacaccttttggacgatcacggtgggaggaacattcacatggttaggcatctacggggtgaatcagagtacgatccagagatgcatttcctgtaaaaccgagaaacacgccaaactggccctctactttaaccttctggggctgtggatcattctcgtttgtgccgtgttcagtggccttattatgtactcccattttaaagactgtgacccctggacatcaggaatcatttctgctccagaccagctaatgccctactttgttatggaaatttttgccaccatgcctggactgcctggcctgttcgtggcatgcgcctttagtggcactctatccaccgtggcaagctcaatcaacgccctggcgactgtcacattcgaggacttcgtgaagtcttgcttcccacacctgagcgacaagctctccacttggatctcaaagggtctctgcctgctctttggggttatgtgcacgtctatggccgttgcagcttcagtgatgggcggcgttgtccaagcatctctgagtatacacggaatgtgtggaggcccaatgttgggtctgttctccctgggcatagtgttcccattcgtcaattggaaaggagcgctcgggggcctcttaacggggattactctgtccttttgggtagctatcggtgccttcatctatcctgcccccgcaagcaagacatggccgctccctctgagcacagatcagtgcattaagagcaacgtgactgccacaggaccccccgtcctcagcagtcgccctgggatcgcggacacttggtactcaatttcgtatctctattatagcgcagtcgggtgtctgggttgtattgtcgctggagtaataatttcccttatcacaggtcgtcagaggggggaagatatccaacctctccttatccgccccgtttgtaacctcttctgcttctggtcaaagaagtacaaaacactctgttggtgcggcgtgcaacatgactcaggcaccgagcaggaaaatctggagaacggaagcgctcgtaaacaaggcgccgagagcgtgctgcagaatggccttcgacgggaaagccttgtacacgttccaggatatgatccaaaggacaagagctacaacaacatggcctttgaaactactcacttttag

SEQ ID NO: 135538 - DNA, 834 bp, Artificial Sequence
  Description of Artificial Sequence: Synthetic coding sequence
atggtggtcatgatcgtgggatttctgaccgtactcattcagggaagcacccacgcagggggtttccacaatgtactcgagcagagtacaaacggtagccgtctccatatctttgacttcgatgttgatcccctccggagacacacgttttggaccatcacggtgggcgggaccttcacctggctagggatctacggtgtcaatcagagcaccatacagagatgtatcagctgcaagacagagaagcacgctaagttggcactgtacttcaatttgctaggtctatggattattctggtctgcgccgtgttttcaggtcttatcatgtactcacattttaaggattgtgatccttggactagtggcataatctcagctcctgaccagttaatgccgtacttcgttatggagatttttgcaaccatgccaggcctgcctggtctcttcgtcgcctgcgctttttcgggcactttgagcacagtggccagcagcatcaacgcacttgccactgtcactttcgaggattttgtgaaaagctgctttcctcacctgtcagataaactctctacatggatctccaaaggactatgtaggtcactgatctggcgggatgtatacctctacggatgcggctgtatttgccatggccggtgctgcgcgggcttcccgcaacatagccgacatgtgtggcggaccaacgcaggtctgattctccctgggaacagagtaccgttctgtgagttagagggttgcacccgccgttcctcctattggaaccatcttgtgatcctgggtggccattgggggctccatcttccctgcacctccctctag

SEQ ID NO: 135539 - DNA, 2019 bp, Artificial Sequence
  Description of Artificial Sequence: Synthetic coding sequence
atggaggagcacactgaggctgggagtgcccccgaaatgggtgcacaaaaggcattgattgataaccccgcagacattcttgtgatcgcagcctatttcttgcttgtgatcggagtgggattatggtccatgtgccgaaccaacaggggaacagtgggcggctattttttggctggccgcagtatggtgtggtggcccgtgggggctagtcttttcgcttctaacatcgggtctggccatttcgtaggactggcaggaacaggagctgctagcggtctggcagtggcaggcttcgaatggaatgctctgtttgttgtattattactaggatggctttttgctcccgtataccttactgcgggcgtgattaccatgccccagtacctgcgcaaacgctttggaggccgccgcataaggctttatctatctgtgttatccctatttctgtatatattcaccaaaatcagtgtagatatgttcagcggcgctgtgttcatccagcaggccctaggatggaacatttacgcctccgtgattgcattgcttggtatcaccatgatttacaccgtaaccgggggacttgcagcattgatgtatactgacaccgtccagaccttcgtgattctgggtggggcctgtattttgatggggtacgcgttccatgaagtcggggggtactccggcctgtttgacaaatacttgggtgctgccacctccttgacggtctctgaggaccccgcggttgggaatattagttcgttctgttaccgcccaagaccagacagctatcacctgcttaggcacccagtcaccggcgatcttccctggccggctctactgcttggccttaccattgtgtctggatggtactggtgttctgatcaggtcattgtgcagcgttgcttggctgggaaatctctcacacacattaaggccggatgtatcctgtgtggatatctgaaactcactccgatgttcctgatggtaatgccaggcatgattagtcgcatcctctatcctgacgaggtggcctgtgtggtgccggaggtctgtcgccgagtttgtgggaccgaggtggggtgctccaatattgcttatccccggctggtcgtcaagttaatgcctaacggactcagaggccttatgcttgccgtgatgctggcagctctcatgtccagtctggcctctatttttaacagttcatccacattattcactatggatatctatacaagattgcggcctcgggcgggcgaccgggagttattgctggtggggcgtttgtgggtggtgttcattgtggtggtgtctgttgcctggcttcctgtggtccaagcggcgcaggggggtcagctgttcgactatattcaggccgtcagcagctatctcgctccccccgtatccgcagtgttcgtcttggcgctctttgtccctcgagtgaacgagcagggggccttctggggcctcattggagggctgctgatggggcttgctcggttgatccctgagttttcattcgggtctgggtcctgtgtgcagccatctgcctgtcccgccttcctgtgtggcgtgcattacttgtatttcgctattgtactcttcttttgctctgggcttctgacacttaccgtgtccctgtgtacggctccaattccaagaaagcatctgcacagactggtgttcagtctgagacattctaaggaggagcgtgaggacttagacgcggatgaacagcagggttcttcgttgcccgttcagaacgggtgccccgagtcggccatggagatgaacgaaccccaggcacccgctcccagtttgtttaggcagtgtctgctgtggttctgcggcatgagtcggggtggcgtggggtcccctcctccactgactcaggaggaagctgctgctgccgcccggcgtcttgaagacattagcgaggaccctagttgggcgcgcgtggtgaatctgaacgctctgttgatgatggcagtcgctgtgttcctgtgggggttctatgcctag

SEQ ID NO: 135540 - DNA, 1377 bp, Artificial Sequence
  Description of Artificial Sequence: Synthetic coding sequence
atggaagaacacactgaggccggatccgctcctgagatgggtgctcagaaagctctgatcgataatccagctgacattctggttatcgcagcttattttctgcttgtcattggagtggggttgtggtctatgtgccggactaaccgcggaaccgtgggtggatattttcttgctggacgctccatggtctggtggcccgtgggagcgtctcttttcgccagcaacatcggttctgggcatttcgtgggtcttgctggcaccggtgcggccagcggtctcgccgtggccggctttgaatggaacgcactgttcgtggtcttattactaggatggttattcgcgccagtctatcttacagcaggagtaatcaccatgccccagtaccttcgaaaaagatttggggggaggcggattaggctttatctctccgtcctctcgctttttctatacatctttaccaagatcagcgtggacatgttctccggcgccgtcttcattcagcaggccctggggtggaatatttacgcttctgtgatcgccttgctggggatcaccatgatctatacggtgaccggagggctggctgcactaatgtacactgacacagttcaaaccttcgtgatcctgggtggggcttgcatcctgatggggtacgcatttcacgaggtgggcgggtactctggcctttttgacaagtacctgggcgccgccaccagtctcacagtatccgaggatccagcagttggaaacattagctcattctgctatcgcccccgccctgattcataccatctgcttaggcaccctgtgactggtgatttgccgtggcccgccttgcttctgggtcttaccattgtgagcggctggtattggtgttctgaccaggtcattgtgcagaggtgtctagcaggtaagtcacttactcacatcaaggctggctgcatactgtgtgggtatctcaaattgactcctatgtttcttatggtgatgccaggcatgataagtcggatcctctatcctgacgaagtggcctgcgtcgtacctgaggtatgccgtcgcgtctgcgggacagaggtcgggtgttcaaatattgcttaccccagattagtggttaagcttatgccgaatggtcgcttgctgggcacacacagggggcccgctgacggccccggaacccccgattcgagggtgctcctcaggctcggccaactctgtgcagcactgggagtaccaagcttccccctgagacgggcactgcctttgctccggcattgtgccgtgctgctgctctggccaccccatccacacgggctgcctgtgcatcgcgcccatccgcagaaggccccaccccctcccggactccaatcgccagcctag

SEQ ID NO: 135541 - DNA, 2157 bp, Artificial Sequence
  Description of Artificial Sequence: Synthetic coding sequence
atgagagcagtgctagataccgccgacatcgctatagtagccttgtacttcatactggttatgtgtatcggattctttgctatgtggaagagtaatcgctctacagtaagtggttacttcttagcaggcaggagcatgacatgggtgacaattggagcatccttattcgtgtcgaatataggcagcgagcacttcattggcctcgccggttcaggagcagcttcaggctttgccgttggcgcctgggagttcaatgcgctgctgttgctacagctgctgggctgggtattcatccccatctacatacggtctggggtgtacacaatgccagaatatctcagtaagcgcttcggtggtcaccggatacaggtgtactttgccgccctgtccctaatcctgtacatcttcaccaagctgagtgttgacctgtattcgggagctctgtttatccaggagagtctaggatggaatttgtacgtttcagtgatactccttattggcatgaccgccctgctcacagtaaccggcggattggtggctgtgatttacaccgatactctgcaagctctgttgatgataataggtgctctgacattaatgattatctcaatcatggagatcggcgggttcgaagaagtcaagagaaggtatatgctcgctagcccagatgtgacatcgatattgctaacctacaacctgagtaacaccaactcatgtaacgtgtcgccgaaaaaagaggctctgaaaatgctgagaaatcctaccgacgaagacgtaccctggcccggatttatcttggggcagacacctgcttccgtctggtattggtgtgctgatcaggttattgtgcagcgtgttctcgcagctaaaaatatcgcacacgcaaagggttcaaccctgatggcgggtttcctgaagctattaccaatgttcatcatcgtggtgcccggcatgatttcccgaattctgtttaccgacgatatcgcttgtatcaaccccgaacactgcatgctcgtgtgcgggtcacgagctggctgctctaacatcgcctatccgagactggttatgaaattggtgcccgtgggactgcggggcctcatgatggcggtgatgatcgccgctctcatgagcgacctggattctatttttaatagtgctagtactattttcacactggacgtgtacaagcttattcgaaagtccgcatcatcgcgggagttgatgattgtcgggcgaatctttgtggcttttatggtggtgatctctattgcctgggtacccatcattgtggagatgcagggaggccagatgtacctctacatacaagaggttgccgactacttgactccgcccgtggccgcactatttcttctagccattttctggaaacgttgcaacgagcagggggctttttatgggggaatggcaggctttgtgctcggcgccgtgagacttatcttggccttcgcctatagggccccagaatgtgaccaacctgataatcgccccggctttataaaggacattcattacatgtatgtggccaccgggctgttttgggtcactgggttgataaccgtaatagtaagcctcttaacaccacctccgactaaagaacagatcagaaccacgacattctggtccaagaaaaacctcgtggtgaaggagaattgttctcctaaggaagagccctaccagatgcaggaaaagagcatcctgcgctgctctgaaaacaacgagactatcaaccacatcatacccaacgggaagagcgaagactccataaaaggcctgcagccagaagacgtcaacttgttggtcacatgcagggaggagggcaatccggtggcctctttgggccacagtgaggctgagactcccgtggatgcttacagcaacggtcaggccgccttaatgggcgaaaaggaacgtaaaaaggagactgacgacggcgggcggtactggaaatttattgactggttttgtggcttcaagtctaaaagtctgagcaagagatccctcagggatctgatggaagaggaggcagtgtgtctgcagatgctggaagagactcgtcaagttaaggtaatcctgaacatcgggttgttcgccgtctgcagcttgggcattttcatgtttgtttatttttctctctag

SEQ ID NO: 135542 - DNA, 504 bp, Artificial Sequence
  Description of Artificial Sequence: Synthetic coding sequence
atggaggcgggaggatttctggatagtctgatttatggggcttgtgtagtgtttactttgggcatgttctcagccggcttgtcagacttgcggcatatgaggatgacgagatccgtcgataatgtgcagtttttgccgttcctgacaacagaggtgaacaatctcggatggctgtcttacggcgccctgaagggcgacggtatcctaattgtggtgaacacagttggtgccgcgctacagacactctatatactggcctatttacattactgtccaagaaaggccaaggtcatacagaccaaaagcactcaatgtctcagctatcccctgactatcgccaccctcctgacttctgccagctggtgcctgtatggattccgtctgcgcgatccctatatcatggtgtccaattttccaggcattgtgacgtcgttcattcgcttttggctcttctggaagtatccccaggagcaggaccggaactactggctccttcagacgtag

SEQ ID NO: 135543 - DNA, 501 bp, Artificial Sequence
  Description of Artificial Sequence: Synthetic coding sequence
atgagaggtttacatccttggcacgtgcttcgccggcctctcggtccccaggcacatgctaacgacccggaatgcggccagcggccagtccccgccctgtcacatcacggctcccagagagtggtgctactgcagacagccacactcctaggggtattactgctcggttatggttatttctggttgctagtccccaatccagaagcccgcttgcagcagctaggcctgttctgttccgtctttacaatatctatgtatcttagtccactggccgatctcgccaaagtgattcagaccaagtccacgcagtgcctgagctatcctcttacaattgccactttgttaactagcgccagctggtgcctgtatgggtttcggttgagggacccatatatcatggtctccaatttccctggcattgtgacctccttcatcaggttttggttattttggaagtaccctcaggaacaagataggaattattggttgctgcaaacatag

SEQ ID NO: 135544 - DNA, 666 bp, Artificial Sequence
  Description of Artificial Sequence: Synthetic coding sequence
atggaggccggaggttttcttgatagtctgatttatggagcctgcgtggtatttacactgggcatgttttcggcaggcctgagcgatctaagacatatgcggatgacgagaagtgtagataacgtccagttccttccattcctgacaacagaagtgaacaacctcggctggctctcttacggagctctgaagggggatggaattctaatcgtggtgaacaccgtgggcgcagccctgcagacattatacattctggcttatctgcactactgcccgagaaaacgagtagtcctcttgcagactgcaacactactgggagttctgctcctgggctatggatacttctggctattagtgcccaatccagaggcgcgattgcagcagctgggattgttctgtagcgtgtttaccatctcaatgtacctctcccccctggcggacctggccaaagtgatacagacgaagtccacccagtgtttatcctacccacttaccatagccactctcctgacatctgcaagttggtgtctgtacgggttcaggctcagggacccttacatcatggtcagcaactttccaggaattgtgacctccttcatccgcttttggctgttttggaagtacccccaagagcaggataggaattattggttgctgcagacctag

SEQ ID NO: 135545 - DNA, 471 bp, Artificial Sequence
  Description of Artificial Sequence: Synthetic coding sequence
atggaggagctggggccccaagcccatgcgaacgacccagaatgcggccagcgccccgtccccgcactttctcaccatggatctcaaagagttgtcctgttacaaacagcaactcttctcggggtgttactattagggtacgggtatttttggcttctggtcccgaaccccgaggcacggctgcagcagcttggactcttttgttccgtgtttactatctcaatgtatctctcacccttggcagacctggccaaggtaatacagactaaatctacccagtgtcttagctatcctctgacgattgccacgctcctcacctccgccagctggtgtctgtatggcttccggttacgggatccttacattatggtaagcaactttcctggaatcgtaacatctttcatccgattctggctgttttggaaatacccacaagagcaggatcgaaactactggctcttgcagacctag

SEQ ID NO: 135546 - DNA, 1929 bp, Artificial Sequence
  Description of Artificial Sequence: Synthetic coding sequence
atggataaactgaaatgcccgtctttctttaaatgcagggagaaggagaaagtgagcgcttcctccgaaaacttccatgtgggcgagaacgacgaaaaccaggatcgaggtaattggtcgaagaaaagcgactacctgctgtccatgattgggtatgcagtgggacttgggaatgtatggcgcttcccctatctgacctactctaacgggggaggcgcctttctcatcccctacgccatcatgctcgccctggccgggctgcccctatttttcttagaatgtagtctggggcagttcgcttcactcgggcccgtgagtgtatggaggattctcccacttttccagggtgtcggtatcacgatggtgctgatctcaatctttgttaccatttactacaacgttatcattgcttattccctgtactacatgtttgcaagcttccaatctgaacttccatggaagaattgctcgagctggtctgataaaaactgctcaagaagtcctattgtcacccactgtaatgtgtccacagttaacaagggtatacaggagattatccagatgaacaagtcttgggttgatattaacaactttacctgcatcaacgggtctgagatctaccagccaggccagctcccttcagagcaatactggaataaggtggccctgcagcgctcctctggtatgaacgaaactggggtaatcgtgtggtaccttgcattgtgtctgctactggcatggttgatcgtaggcgccgccctgtttaagggtatcaaaagctccgggaaagtggtctattttaccgcactgttcccttatgtggtgttactaatattgctggtgcgaggcgctaccctggagggcgcgtcaaagggcatcagttactacattggtgcccaatctaatttcaccaaattgaaggaggcagaggtctggaaggatgctgctacccaaattttttatagccttagtgtggcatggggcggcctggtggccctctccagctataacaagttcaagaacaactgtttcagcgacgctattgtcgtgtgcctgacgaactgtcttacatccgtgtttgcgggcttcgctattttttctatcctcggccacatggcacatatctctggcaaggaggtatcccaagtggtcaagagtgggtttgacctcgccttcattgcttaccctgaagcactagcacagctccccggtggcccgttttggtccatcctcttttttttcatgcttctgacactcgggttggattctcaattcgcgtcgatcgaaaccataacaacaactattcaggacctgtttcccaaggtcatgaaaaaaatgcgcgtgcccatcaccttaggttgctgcctcgtgcttttcctgttaggcctggtctgtgtgactcaggcaggtatttactgggtccacctgatagatcatttctgcgccggctgggggattctgattgccgccattcttgagctggtgggaatcatatggatttatggcggcaatcgcttcatagaagacaccgaaatgatgatcggagcgaaacgttggatattctggttgtggtggcgcgcttgctggttcgtcatcacccctatcctcttaattgccattttcatctggagtctagtacagttccaccgacccaattatggcgctataccttatcctgattggggagtagccctgggctggtgcatgattgtattctgcataatctggattccgataatggccattataaagattatccaggccaaagggaacatctttcagcggctgatctcttgttgccgtccagcgagtaactggggtccttatctggaacagcatcgaggggagcggtacaaagatatggtagacccgaagaaggaagccgaccatgagattcctaccgtctccggaagccggaaacccgagtag

SEQ ID NO: 135547 - DNA, 1539 bp, Artificial Sequence
  Description of Artificial Sequence: Synthetic coding sequence
atgggagttcaatggtggtcacacacccagggcgaggtcgccgtgggacttggtctgggcgactcttatctaactccatgcccttgccccggggtcggatacgctgttatcctgatcgctctctatgtggggttttactataatgtgatcattgcttggagtctctactacttgttctcttcttttacactgaacctcccttggacagactgcggtcacacttggaactcacctaattgcaccgaccccaaattgttgaatggctcagtgctcggcaatcatactaaatacagcaagtataagttcacacccgccgctgagttctatgagagaggtgtccttcacctccacgagtccagtggtatacatgacatcggtcttcctcagtggcagctcctgctgtgccttatggtagtcgtgatcgttctctactttagtctgtggaaaggcgtgaagacatccggcaaggttgtttggattacggctacattgccctacttcgttctcttcgtgctgcttgtgcacggcgtcacgcttcctggagcttccaacggcatcaatgcatatctgcacatcgatttctacaggctgaaggaggcgacagtatggatagacgcagccacacagatattctttagtctcggggccggctttggagtgctgatcgcttttgcatcgtacaataaattcgacaacaactgttaccgagatgccctcctgacgtcatccatcaactgtattacatcgtttgtatcaggattcgctattttttccattctgggatatatggcgcacgagcacaaggtcaacatcgaagacgtagctacagaaggcgccgggttggtttttatcctctacccagaagccatttctactttgagtggttcgacattttgggccgtcgtgttttttgtcatgctgttagcgttgggactggactcttcaatgggtggcatggaggccgtgatcaccggtttagcggatgacttccaggtgttaaaaaggcatcgcaagctttttacgtttggcgtgactttcagtacgtttctgcttgccctcttttgtattactaagggaggaatttacgtgctcacactactggacacatttgctgccggaaccagcatcctcttcgctgtgctcatggaggccatcggcgtctcttggttctacggtgtggaccgattctccaatgacattcagcaaatgatgggcttcaggcccggcttgtactggcgcctatgctggaaatttgtgagccctgcattcctgctgttcgtggttgttgtatctattatcaacttcaaacccctaacttacgacgattacatcttccccccatgggctaactgggtgggctggggcatcgcgctcagcagcatggtgctggtcccgatctatgttatctataagtttctgagcacccaggggtctttatgggaaagactggcatatggcattactccagagaatgagcaccatctcgttgctcagcgggatatcagacagttccagctgcagcactggctggccatctag

SEQ ID NO: 135548 - DNA, 1845 bp, Artificial Sequence
  Description of Artificial Sequence: Synthetic coding sequence
atggatgggaaggtcgccgtacaggagtgcggtccacccgcagttagttgggttcccgaagagggagagaagctggatcaggaggacgaagaccaggttaaggatcggggccagtggacaaacaagatggaattcgtgctgtcagtggctggcgagatcataggcctcggcaacgtgtggaggtttccttatctttgctataagaacggggggggcgctttctttatcccatactttatcttcttctttgtttgtggtatcccggtcttcttcctggaagtagccctgggtcagtacacgtcccaagggtctgtcactgcatggcgtaagatctgtcccctttttcagggaatcgggctcgcgagcgtggttattgagagttatttgaacgtgtactatataataattcttgcttgggccctgttctatctgttttcatcctttacatctgaactcccttggacaacctgcaataatttctggaacactgaacattgcacagactttttgaaccattccggagctggaacagtcacacctttcgagaactttacctcaccagttatggagttctgggagcgaagagtccttggcattacatccggaatccacgacctgggttcactcaggtgggagctcgcactctgtctgctgcttgcctgggtcatttgctatttctgcatctggaagggcgtgaagtccaccggaaaggttgtgtatttcaccgcgaccttcccttacctgatgctggttatcttactgatccgcggagttaccctaccaggcgcgtatcagggcatcatctattacctgaagcccgatctctttcggttgaaagacccacaggtttggatggatgctgggactcaaattttcttctcctttgccatttgtcagggatgccttacagccctaggaagttataacaagtaccataataactgctacaaggactgtatcgccttgtgtttcctcaattccgctaccagctttgtggcaggatttgtcgttttctctattcttggcttcatgtcacaggagcagggcgtgcccatttcggaggtcgcagaaagcggacctgggctcgcattcatagcattcccgaaggctgtgaccatgatgcccctttcgcagctgtggagctgcctttttttcattatgctaattttcctcggcctggattcccagttcgtgtgcgtcgaatgtcttgtgacagcctccatcgatatgtttcctaggcagcttagaaagtccggccgccgcgagctactgattttaaccatcgctgtgatgtgttacttaataggactgtttctcgtcacagaagggggaatgtacattttccagttgttcgattattacgcctcttccggcatatgcctcctcttcctatctctgttcgaagtggtgtgtataagctgggtatacggcgcggatcgattctacgacaacatcgaggacatgattggatataggccctggccacttgtgaagattagctggctgttcctgactccgggcctgtgcctcgcaacctttttgttttccctttctaaatataccccgttgaaatacaacaatgtgtacgtgtaccctccatggggatattcaatagggtggttcttggccctgtcttcaatggtctgcgtgccgttgttcgtagtaattactctgcttaagactcgcggccctttccggaaaaggttacgccagcttatcactccggatagcagcctacctcagcccaagcaacatccttgtctggatggatctgccggtaggaatttcggccccagtcccacacgggaaggcttaattgccggcgagaaagaaacccatctctag

SEQ ID NO: 135549 - DNA, 1845 bp, Artificial Sequence
  Description of Artificial Sequence: Synthetic coding sequence
atggacggtaaggtcgctgtacaggagtgcgggccgccagctgtgtcgtgggtgcccgaagaaggcgagaagctggaccaagaggacgaggatcaggtgaaggataggggacagtggaccaacaaaatggaatttgttctaagcgtggcaggtgagatcataggcttaggcaacgtgtggcgattcccctacctgtgctataagaatggcggaggcgcattttttatcccttatttcattttcttctttgtctgtggcatcccggtgttcttcttagaggtcgccttggggcaatacacgtcccagggatcggtcacagcatggcggaagatttgccccctctttcagggcattgggcttgccagcgtggtcatagaatcttatctaaacgtgtactacatcattattctggcctgggctttgttctaccttttcagttcttttacatccgagctgccttggactacgtgcaataatttctggaatactgagcactgtacggactttctgaaccattccggagccgggacagtgaccccatttgagaactttacctcacccgtcatggagttttgggagcgtcgagtacttggaattacatcaggaatccacgatctggggtccctgcggtgggagctcgccctgtgtctcctgctcgcttgggtcatatgctacttctgtatctggaaaggcgtaaaatccaccggcaaagtggtgtatttcacagccacgtttccatatctcatgcttgttatccttctgatccgtggcgtgaccttgcccggtgcctaccaggggattatctactacttgaagcctgatctgttccgtcttaaggacccgcaggtgtggatggatgccgggacacaaatcttcttttcattcgctatctgccagggctgcttgacagcgctcgggtcttataacaaataccacaacaactgctacaaggactgcatcgccctgtgtttcctcaactctgctacttctttcgtggcgggcttcgtggtatttagcatccttggcttcatgagccaggagcagggcgtgcccatctcggaggtggccgaaagtgggccagggcttgccttcatcgcattcccaaaggcggtgaccatgatgccgctgtctcagttgtggtcctgcctgttcttcattatgttaattttcttgggactagatagtcagttcgtgtgtgttgagtgccttgtgaccgcctccatcgatatgttccccagacagttgcgtaagagcggtcggagggagttgctgatcctgaccatagcggttatgtgttacctgatcggtctgtttctcgtaaccgaggggggcatgtacatttttcagctgttcgattactacgcaagtagcgggatttgcctgctattcttgtccctgttcgaagtggtgtgtattagctgggtgtatggagctgaccggttttatgacaatatcgaagacatgattgggtaccgaccctggccactggtgaagatctcctggttgtttctgacaccggggttgtgcctcgccaccttcctattcagccttagtaaatatactcccctgaagtataataacgtgtatgtctacccaccctggggttacagcatcggatggtttttggccctgagttccatggtatgcgtaccgcttttcgtagtgattacactcttgaagacccgcggccccttccgcaaacgactgcgccaactgatcacaccggactctagtctcccccagcctaagcagcacccctgcctggatggaagcgccggccgaaatttcggcccgagccccacgagggaaggcttgatcgcgggcgagaaagaaacccacctgtag

SEQ ID NO: 135550 - DNA, 1845 bp, Artificial Sequence
  Description of Artificial Sequence: Synthetic coding sequence
atggacggcaaggtcgctgtgcaggaatgcgggccgccagctgtgtcctgggtccccgaggagggagagaaactcgatcaggaagacgaggatcaggtgaaggatcggggccagtggaccaacaagatggagtttgtgctctccgtcgccggggagattatcggcctggggaatgtatggcggttcccttatctgtgttataagaatggcgggggagcatttttcatcccatattttatttttttcttcgtttgtggcatccccgtcttttttttggaggtagcactcggccagtacacaagtcagggatccgtgaccgcatggcgtaagatctgccctctctttcaagggattggcttggcaagtgtcgtaatagagtcatacctcaatgtgtactatatcataatactggcttgggctctgttctacctcttcagcagctttactagtgaactgccttggaccacgtgtaataatttctggaataccgaacactgcactgactttttgaaccactccggggccggcactgtcacgccattcgagaattttacatctcccgtgatggaattttgggaaaggagggtactaggtattacgtctggaattcatgacctcggctcactgcgatgggaactggcactctgtttactcttggcttgggtgatatgttacttttgtatttggaaaggtgttaagtcaaccggtaaggttgtgtattttaccgcaacctttccttacctgatgctggtgattttgctcatacgcggcgttaccctgccaggggcttaccaggggatcatttattacctgaagcctgatcttttccgactgaaggacccacaagtttggatggacgcaggaacccaaattttcttcagtttcgccatttgtcagggatgtttgactgcactgggctcatacaacaagtatcacaacaattgttataaggattgtattgcactttgctttctaaactcagccacatcattcgtcgcagggttcgttgtgttttctattctggggtttatgtcccaagagcaaggtgttcctatttcggaggtcgccgagtccggacccgggttggcattcattgcttttcccaaggccgtcaccatgatgcctctgtcgcagctttggtcttgcctttttttcattatgctgatctttttgggcctcgatagtcaatttgtgtgcgtggaatgcctggtgaccgcctccattgatatgtttccacggcaactgaggaagagcggcagaagagagctactgatcctgaccatcgccgttatgtgctatctgatcggactgttcctggtgacggagggcggcatgtacatttttcagctattcgattattacgcaagcagtgggatttgcttactgtttctgtcactattcgaagtggtctgtatcagctgggtttacggggcggacagattttacgataacatcgaagacatgatcggatacagaccttggcccctggtgaagatctcatggttgtttctgactcccggactgtgtctcgcgacgtttctcttctctctatccaagtatacccctctcaagtataacaacgtgtacgtgtatccgccatggggctacagcatcggatggtttctcgccctatcatccatggtttgcgttccgttgtttgtggttatcaccctattgaaaacccgagggccttttaggaagcgactcagacagctgattacccctgacagtagtcttccccagcctaaacagcatccttgccttgatggatccgctggccgtaactttgggcctagccctaccagggaaggcctcattgcaggagagaaagagacacatctctag

SEQ ID NO: 135551 - DNA, 1845 bp, Artificial Sequence
  Description of Artificial Sequence: Synthetic coding sequence
atggacggtaaggtggctgtgcaggagtgcggccctccagccgtgagctgggtgccggaggagggggaaaagcttgaccaggaagacgaggatcaggttaaggataggggacaatggactaacaagatggaattcgtcctgagcgtggctggtgaaattattggcctaggaaacgtctggagatttccctatctgtgttacaaaaacggcgggggggccttctttatcccatattttatctttttcttcgtctgcggcatccccgtattcttcctcgaggttgctttaggccagtatacatctcaggggtctgtcaccgcttggcgaaagatatgtccattattccagggaattggactggcttcagtagtgatcgaatcctacttaaatgtctactatattattatattagcatgggcccttttctaccttttcagctcattcactagcgagctgccatggaccacttgtaacaacttttggaacaccgaacattgtactgactttctgaaccactctggggccggaacagtcaccccttttgagaactttacttcccctgtgatggaattctgggagcggcgcgtcttaggaatcacctcaggcattcatgatctgggctcgctgcgatgggagctggctctctgccttttgctagcctgggtaatctgttacttctgcatatggaaaggggttaagtctactggcaaagttgtttactttactgcaacctttccctacttaatgctagtgattctgttgatcaggggtgttactcttccaggggcttatcaggggatcatatactacttgaagcctgacctctttagattgaaggatcctcaggtgtggatggatgcaggaacccagatattctttagctttgccatctgtcaaggttgtctaactgcactcggatcatacaataagtatcacaacaactgttataaggactgcatcgctttatgctttctgaattcagccacctctttcgtcgccgggttcgtcgtcttttcaatcctgggctttatgtctcaggaacaaggcgtgcctattagtgaggtggccgagagtgggcccggcctggcctttatcgccttcccaaaagccgtgacaatgatgcccttaagtcaactgtggagctgtttgttttttattatgctcatctttttgggcctggactcacagttcgtctgtgttgagtgtctggtgacagcgagtatcgacatgtttccgcggcaactgcgcaagtcgggaagacgggaattgcttatattgaccatagccgtaatgtgttacctgataggcctatttttggtgaccgaaggcggtatgtatatcttccaattgtttgattactacgcctcttctggcatctgcctcctcttcctttctctatttgaggtggtatgcatttcctgggtgtacggcgccgaccggttttacgacaatatcgaggatatgattgggtaccgtccctggccgttggtgaaaatctcatggctttttttgacacccgggctttgcctcgcgactttcttgtttagcttatccaagtatacgcctttgaaatacaacaacgtatatgtgtaccccccttggggttactcaattggctggttccttgccttgtcttctatggtgtgcgtgcctctgttcgttgtgatcacactcctgaagaccaggggtccttttaggaagcggctgagacagttgatcacccctgattcctcactgccacagccgaagcaacacccctgtctggatggaagtgcaggacggaattttggccccagtcccaccagggaagggcttatagccggtgagaaggagacccatctgtag

SEQ ID NO: 135552 - DNA, 1845 bp, Artificial Sequence
  Description of Artificial Sequence: Synthetic coding sequence
atggatggaaaagtcgccgtgcaggagtgcggtcccccagccgtctcctgggtcccggaggaaggagagaaactggatcaggaggatgaagatcaggtgaaggaccggggccagtggaccaataagatggaatttgtgctgagcgttgctggagaaatcattgggctgggaaacgtgtggcgcttcccatatctgtgctataagaacgggggaggtgcattctttattccgtattttattttcttctttgtgtgcggtattccagtgtttttcctggaggtcgcactcgggcagtatacctcacagggctcagtgaccgcctggagaaagatatgtcctctgttccaaggtatcgggctcgccagtgttgtgattgaatcctatctcaatgtgtactacataattatcctggcttgggcactgttctacctgtttagctcattcacctctgagttgccatggaccacctgcaacaacttctggaatacagagcactgcaccgattttctgaatcactctggcgcaggcaccgtcacgcccttcgaaaacttcacttctccggtaatggaattttgggagaggcgcgttctaggcatcacatctgggatccacgatttaggctccttgagatgggagctcgccttgtgtcttttacttgcgtgggtgatatgttatttttgcatctggaagggcgtgaaatcaacagggaaggttgtgtatttcacagccacattcccctatttaatgcttgtgattctgctcattcgtggggtgacccttcccggagcttaccaaggaatcatctactaccttaaaccagacctttttagactgaaggatcctcaagtgtggatggacgctggtacgcagatctttttctcgttcgccatttgtcagggctgtctgactgctttaggatcatacaataagtaccataacaattgctataaggactgtattgctctttgtttcttaaatagcgccacttctttcgtggcgggattcgtggtgttctcaatcctcggctttatgtctcaagagcagggagtacctatcagtgaggttgccgaaagtggtcctggactcgctttcattgcctttcccaaagccgtaactatgatgcccctgtcccagctttggagttgcctgttttttattatgttaatctttctgggtcttgatagccaattcgtgtgtgtggagtgtcttgtgactgcttccatcgacatgtttccgcggcaactgcgaaagtctggaaggcgcgaattgttgatcctgaccatcgccgtcatgtgctatctcatcggactcttcctggttacagaaggcggaatgtatatctttcagttgttcgactactatgcaagcagtggcatttgcctgttattcctgagcctgttcgaggtggtgtgtatcagctgggtttatggggcggataggttctacgataacattgaagacatgatcggctatcggccctggccactggttaagattagctggttgttcttgactcctggcctttgccttgctacgtttctcttctccctgtcaaagtatacacctcttaagtataataatgtctacgtatatcccccttgggggtattccattggctggttcttagccctgagctccatggtgtgtgtgcctttgtttgtagtgatcacactgctcaagacgcgcggcccctttcgaaagagactgcggcagttaattacacctgacagcagtctccctcagcctaagcagcatccatgtctggacggatctgctggaaggaacttcgggccatcccctacccgggaagggctgattgctggcgaaaaggagacgcacctttag

SEQ ID NO: 135553 - DNA, 441 bp, Artificial Sequence
  Description of Artificial Sequence: Synthetic coding sequence
atggacggaaaagtggcagttcaggagtgcggtccacctgcagtctcctgggtgcccgaggagggtgagaagctcgaccaggaggacgaggaccaggtaaaggatcggggccagtggactaacaaaatggagtttgtgctgtccgtggcaggtgagatcataggtctcgggaatgtctggcggtttccgtatctgtgctacaagaacggtggtggggcattttttattccatattttatctttttcttcgtatgcgggattcccgtgttctttctcgaagtggccctcggccaatacacaagccaggggtctgtgaccgcttggaggaagatttgtcccctattccaaggcattggcttggcaagcgtagtgatcgaatcctatttaaatgtctactacatcataatactggcctgggcccttttctacttgttttcttag

SEQ ID NO: 135554 - DNA, 1908 bp, Artificial Sequence
  Description of Artificial Sequence: Synthetic coding sequence
atggcgaagaagtccgctgagaacggaatttactcggtgtcgggcgacgaaaaaaaaggtcctctgattgcccctggtcccgatggtgcaccggccaagggagatgggccagttggactcggcactccggggggcaggctcgctgtgccccctcgagaaacttggacacggcagatggatttcatcatgtcatgtgttgggtttgcggtaggcctgggtaatgtctggcgctttccctacttgtgttacaagaatggcggaggtgttttccttatcccatatgtgctgatcgccctggttgggggcattcctatattttttctggaaattagtcttggccagtttatgaaagccggctctatcaatgtatggaatatctgtcctctctttaagggactcgggtatgcaagcatggtgatcgtgttctactgtaacacctactatattatggtgctcgcatgggggttctattacctggtgaagagcttcaccaccactctgccatgggccacatgcggccacacttggaacaccccggactgcgtagaaatcttccgacacgaggattgcgcgaacgccagtcttgcaaacctgacatgcgaccagctggcagacagaagatctccagtgatagagttctgggaaaacaaagtattgagactgtccggaggactagaagttcccggggcgcttaattgggaagtgactctctgcctactggcctgttgggtgcttgtgtatttctgtgtctggaagggggtcaagagcaccggtaagatcgtttacttcaccgcgactttcccatacgtggtgctggtagtgctgttagtaagaggagtcctgctgcctggggctctagacgggatcatttactacttgaagcctgattggtccaaattggggagcccccaggtgtggatcgacgccggaacgcaaatcttcttctcctatgcaatcggccttggagcactgaccgccttaggatcctacaaccggttcaacaataactgctataaggatgccattatcctggccctgatcaattcgggtactagctttttcgccgggttcgtcgtgttctccattctgggattcatggcagcagaacaaggagtgcacatctccaaggttgccgagagcggacccgggttagcgtttattgcctatccaagggccgtaactttaatgccggtcgctccattgtgggctgcattgttctttttcatgctgctgctgctaggactcgacagccagttcgtaggggtggagggattcataaccggcctgctggatttacttcccgccagttattactttcgctttcagagggaaatctctgtcgcactatgctgtgctctgtgcttcgttattgacctttcaatggtaacggatggtggcatgtatgtgttccaactgttcgactactattcagcatcggggaccacattactgtggcaggcattttgggagtgcgtggtcgtggcatgggtgtacggcgccgaccggtttatggatgatatcgcttgcatgatcggctataggccgtgcccgtggatgaaatggtgctggtcatttttcacacccttggtctgtatgggaatctttatctttaacgttgtctattatgaacccctcgtgtataacaatacgtacgtctatccatggtggggtgaggcaatgggatgggccttcgctctgagctccatgctgtgtgtaccattgcacttgctaggctgtttgttgcgggctaaaggaaccatggccgaaaggtggcagcacctgactcaacccatctggggtcttcaccacctggaatacagggctcaggacgccgacgtcaggggcctgacgaccctcactcccgtgagcgagagcagtaaagttgtggtggtcgagtcagtcatgtag

SEQ ID NO: 135555 - DNA, 2190 bp, Artificial Sequence
  Description of Artificial Sequence: Synthetic coding sequence
atgctcccaactctccagattcaaggcccagcagcatttgcccccggcgatcgaggtcccggcagacattgtcctttcccagtcccaattaccccgactggcgcactgttgccagtaagtgacagctgtgattccttagtcgatttggtctggccctcagtgacctatctcgcccttggaacacagtctagagtttggcctcaccctttgggtgctcctggccaagccggcgagtcccccgagcaaagaagacagtgcctcgagctatgggacatggcatcaagcttgggagataaagtccctcgggccgcttgtggtaagcgggggcagaccgtgtggcaactgcacctcgcctgtttgtgtctggcacaatttcactcgcctcccgctcagcctccccctctgagtagacggggggggggaccagatcctgatcctatcagcaggagccttccaggacctcctacacccgccttgcccactcactcttactctagccacagcccacgtgcgccacggctgttatcaccccttagaagggctcctaggggttcacccgccccccacagacacgcctcccttcagaccaacgaggcgcccagagagctcccccattgcacatggcccggcttgcctggaagatctctcgctccatctttcctctggagagaaccgtggcttggcgggcagtggggccccctgaacatccctgccaggaaaggcgataggcgaaggtgggaatggggctgcgaaggaggaggcgcgaccgcctctgccgagcaacccgggccccagattgtgtatttcaccgccacattcccttatgttgtgctagtagtcctgctggtgcgtggggtgcttctgcccggcgccctcgacgggattatctactacctgaaaccggattggtctaaactaggctccccacaagtatggatcgacgctggcacccaaatttttttttcctatgcaatcggactgggggccctgacagctctgggtagctataatcgcttcaacaacaattgttataaagatgccatcatccttgccttgattaactcaggtacctccttttttgctggttttgttgtgttttccatccttggattcatggccgcagagcagggggtgcacattagtaaagtggcggagagcggccctggcctcgcctttatcgcgtatccccgagctgtcacgctgatgccagtggccccattatgggctgccctgtttttctttatgctgctcctgctagggctagactcccaggtttgcatgggcttatgggaccgggagcctggcggggggcgccgggagggctgccgccagggcaaaggatggagaaggtgcggcgcacgaccggaactaccatggccccagttcgttggggtcgaggggttcattaccggtctgctggatttgttgcccgcctcctactactttaggtttcaacgggaaatcagcgttgctttatgctgtgctctatgttttgtgatcgatttatcaatggtcacagatgtttcgggcgtagggggcctcccagtgacttccggtggacgtctgccttcaagtctgactggtctctgccctcaaggaggtatgtacgtgtttcagctgtttgattactattccgcatccgggacaaccttgctttggcaagccttctgggagtgcgtcgtcgtagcatgggtgtatggtagatcttggctccgcgccggcctgggggacggaggtggcgaaggccgatctcctgcgtggcctgccagcccccggggtgcagatcggttcatggacgatattgcctgcatgatcggctatcgcccttgcccatggatgaagtggtgctggagctttttcacaccacttgtctgcatggggatatttatttttaatgtggtgtattacgagcctctggtgtataacaatacatacgtgtatccctggtggggagaagctatggggtgggcattcgcgctttcctcaatgctgtgtgtgccgctgcacttactcgggtgtcttctgcgtgccaagggcacaatggcagagcggtggcagcatctcacgcagcccatctggggattgcaccacctggaatatcgagcccaagatgcagatgtgcgcgggctaactacactgaccccagttagcgagtcttctaaagtagtcgtggtagagtccgtgatgtag

SEQ ID NO: 135556 - DNA, 471 bp, Artificial Sequence
  Description of Artificial Sequence: Synthetic coding sequence
ttattacactctccaacctggagctggagctgctgctggtgtgttgagtgttgctgtctggccccctggatggcctccttcaccatctcctccttaacaggtcagagttggggcccgttgtcacccggtcagcttcagcctctgcagcaacagctactgcagtgggatcagctcctttgttggctgagggggctcttacaccctgggttacacgggtgccgagccggacgggcccacctgcaaggcgggcgagtgagagagatttcggtggccttatgttgcgcactttgcttcgtgatcgacctctcaatggtcaccgacggcgggatgtacgttttccagctttttgactattactcagcaagcggaaccaccctattatggcaggccttctgggaatgcgtggtggtggcctgggtgtacggcgccgatcgcttcatggatgatatcgcctgcatgatcggctactag

SEQ ID NO: 135557 - DNA, 339 bp, Artificial Sequence
  Description of Artificial Sequence: Synthetic coding sequence
taattccggcatgaggattgtgcaaacgcttctctggctaatttgacctgcgaccagctcgccgacagaagatcccccgttatcgagttctgggagaataaagtcttaagactgtcaggcgggttggaggtcccgggtgcgttgaattgggaggtcacactctgccttttagcctgctgggtattagtctatttttgcgtgtggaaaggcgtcaaaagtacggggaaggtgcctttggaagcatgctctggcgaaggcgggagtgccctcggcgccggctgtctatgtcaagctcatctgtggcagagggaggttacacgccaatccctcgccctatag

SEQ ID NO: 135558 - DNA, 1563 bp, Artificial Sequence
  Description of Artificial Sequence: Synthetic coding sequence
atgaaagcagggagcatcaatgtgtggaatatttgtcctctgttcaaaggcctagggtacgcctccatggtgatcgtgttttactgtaatacctactatatcatggtactggcatggggcttctactacctggtcaaatcctttaccacaacactgccttgggccacctgcggtcacacgtggaacaccccagattgtgtggagatcttcagacacgaggactgcgctaacgcatcactggcaaacctgacttgtgatcagttggcagatcgcaggtcccccgtcatcgagttctgggaaaacaaggttcttagactgtctgggggtctggaagtgccaggcgctctgaactgggaggtgactctctgcctcctggcctgttgggtgctcgtttacttttgcgtgtggaagggcgtgaaatctaccggtaagattgtgtactttacggcaaccttcccttatgtggttcttgttgttcttcttgtgaggggggtactacttcccggagcgctggatgggataatttactatctgaaacccgattggtccaagctagggtctcctcaagtatggattgacgctggcacccagatcttcttctcctatgcgattggtttgggcgccctgactgctttagggtcctacaacaggttcaataacaactgctacaaggacgcaattatcctggcactgatcaacagtggcacctcattttttgccggatttgtcgtcttctcaattctcggtttcatggctgctgagcagggagtgcacatcagtaaagtggccgaatctggaccaggtctcgcgtttatcgcatatcctagggccgttactctgatgcccgttgctcccctgtgggcagccctcttcttcttcatgctgctactgctgggactagattcacagtttgtgggtgtagaggggtttataactggactgcttgatttactgccagcctcgtactacttcaggttccagagggagatcagtgtggcgctttgttgcgccctgtgtttcgtgattgatttatcaatggtaactgacggaggtatgtacgtcttccagctatttgactattactccgcttcaggcactactctgttatggcaggccttctgggaatgcgttgtggtggcctgggtctacggggccgataggttcatggacgatatcgcctgtatgattggctatagaccttgtccctggatgaaatggtgctggtcgtttttcacacccctcgtgtgtatgggcatcttcatcttcaatgttgtttattacgaacctctggtctacaataacacttacgtgtatccatggtggggggaggcaatgggctgggccttcgctctaagcagtatgctgtgcgtgccactgcacttactaggatgcttactgagagctaagggaacaatggctgagcgatggcagcacctgacccagcctatatggggcctgcaccacttggagtatagagcccaggacgccgacgtgcggggactcacaacattaacaccagtatccgagagcagcaaggtggtggttgttgagagcgttatgtag

SEQ ID NO: 135559 - DNA, 525 bp, Artificial Sequence
  Description of Artificial Sequence: Synthetic coding sequence
tgaatcgatgcaggaactcagattttcttttcctacgccattggactgggtgccctgacagcccttgggtcttataatcgttttaacaacaactgttataatgggacctccttttttgctggattcgttgtgttctcgatcctggggttcatggcagccgaacagggcgtgcacatttctaaagtggctgagtcaggccccggcttagctttcattgcatatccgagagctgtgacccttatgcctgtcgccccgctttgggctgcactatttttcttcatgctcttactgctgggcttggattctcagtttgtcggcgtcgaaggcttcatcacaggtctcttagacctgttacctgctagctattattttcgttttcagagagagatttctgtggcgctttgctgcgcgctgtgtttcgtaattgacctgagcatggttaccgacggaggcatgtatgtatttcagctcttcgattactatagtgcttcgggcaccacgctcctatggcaggccttttggtag

SEQ ID NO: 135560 - DNA, 270 bp, Artificial Sequence
  Description of Artificial Sequence: Synthetic coding sequence
ggcagacatcatcccggctcacaccagcagtgggatcagctgctgtgctggctccgaggattgctacatcctgggttgcatgggtgtcgggcaggacgggcccacctccagggtggcagggtaagggcaggccccggccttcatcgcctgcctgccggatgtcacgctgacgcatcagggcctactcttggctgccctgttttactgcacgcggtcgccgcatggagcaggcaacccggcgtcgaaggctttattaccgggcttctttag

SEQ ID NO: 135561 - DNA, 1863 bp, Artificial Sequence
  Description of Artificial Sequence: Synthetic coding sequence
atgtctaaatccaagtgttctgtcggcctgatgtcaagcgtcgtggccccagcgaaggaaccaaacgcggtggggccaaaagaggtcgaattgatcctcgtgaaggagcaaaatggagtgcagctgacctccagtacactgacaaatcccaggcagagtcccgttgaagcacaagatcgggagacctggggcaagaaaatcgacttcttactttccgttatcggattcgctgtggatctggccaatgtctggcgcttcccatatctttgctataagaacggtgggggggcttttctagtgccttaccttctgtttatggtcatcgctggcatgcctctgttttacatggaactggcgttaggccagtttaacagagaaggcgcagcaggagtctggaaaatctgccctatattgaaaggagtgggattcaccgttattctgatcagtctgtatgtgggattcttctataacgtgattatcgcatgggccctacactacctgttcagctcctttaccaccgaactaccctggatacactgtaataactcctggaattcccccaattgctcagacgctcatcccggagactcaagtggggatagctcaggactgaacgatacctttggcaccactcccgcagctgaatatttcgagagaggtgttctgcacctgcatcagtcacacggcattgacgacctgggtccccctcgttggcagcttacggcttgtttggtgctcgtgattgtgctgctctactttagcctttggaagggggtcaagacctcaggaaaggtggtgtggattactgctactatgccttacgtcgtgctgactgcgctccttttaagaggcgtaacacttccaggggcgatcgatggtattagagcttatctgagtgttgatttttataggctctgcgaggcaagcgtctggatcgatgctgccacccaagtctgtttctctctgggagtaggctttggagtattaatcgccttttcttcttataacaaatttacaaacaattgctatcgcgacgccattgttaccacatcaattaatagtctcacatcgttctctagcggctttgtggtgttttcctttctggggtatatggcgcaaaaacacagtgtgcctattggtgacgtggctaaggatggacctgggctgattttcattatctatcctgaagccatcgctaccctaccactcagcagcgcttgggccgttgtattttttattatgttgttaaccctgggtatagatagcgccatgggcggcatggagtccgtgatcacgggacttattgatgagtttcaattgctgcatcgtcacagggaactgttcaccctattcatcgttctggctactttcctcttgagtttattctgcgtaaccaatggtggcatctatgtctttacgctgctggatcactttgccgccgggacctccatcctgtttggggtgctcattgaggcaatcggcgtagcatggttttacggagtgggtcagttcagcgacgacattcagcagatgacaggccaacggccatctctgtactggagactgtgttggaaactcgtgtctccctgtttccttctgttcgtcgtcgtcgtctccatcgttacctttagacctccacactatggcgcgtatattttccctgattgggcaaatgcactggggtgggtaattgccacatccagtatggccatggtccctatctatgccgcttacaagttttgctctctgcccggatcttttcgtgaaaaactagcctatgcaattgcccctgagaaggaccgggaactggtggatagaggggaggtccgccagtttaccttaagacattggttgaaagtgtag

SEQ ID NO: 135562 - DNA, 1863 bp, Artificial Sequence
  Description of Artificial Sequence: Synthetic coding sequence
atgagcaagtccaagtgttccgtgggtctgatgagctcagtggttgctcctgctaaggaacctaacgctgtgggccctaaggaagtggaactgatcctcgttaaagagcaaaatggagtccagctcacttcatcaacactgacaaaccctcgacaaagtcctgtggaggcacaggacagagaaacttggggcaaaaagatagactttctgctctccgtgataggatttgccgttgatctagccaacgtatggaggttcccttacctttgctataagaacggcggtggcgctttcctggtgccatacttgctgtttatggtgatcgcagggatgccattgttttacatggagttagccctgggacagttcaatcgggagggcgccgctggtgtctggaagatttgccccattctgaagggggttgggttcaccgtgattctcattagcctatacgtaggttttttctacaacgtcatcattgcatgggcattgcactatctatttagcagttttaccacagagctgccctggatacactgtaataacagttggaacagtcccaattgctcggatgcccaccccggagactcctcaggggattccagcggattgaacgatacctttgggactacacccgctgccgaatactttgagcggggcgttttacacctgcatcaatcccacggcattgatgaccttggacctcccaggtggcagttaactgcctgtctcgttttggttattgtgctcctgtatttttcgctctggaagggggtgaaaacatcaggtaaggtcgtgtggattactgctaccatgccttatgtagtgctcacagcgctgttgctgcgaggggtgaccctccctggagccatagatggtatccgggcatatttaagtgtggacttttatcggttatgtgaagccagcgtgtggattgacgccgccacccaagtctgcttctccctgggggtggggtttggggtgctcattgcgttctcctcctataacaagtttaccaataattgttaccgggacgccatcgttacaacctccatcaatagcctgacgtccttttcgtcagggttcgtggtgttctcttttctcggatacatggctcaaaagcattccgtgcccattggagatgtggccaaagatggtcctggcctcatttttattatctatccagaagcaattgccactctgccactgagttctgcctgggcagtagttttcttcataatgctcctgaccctgggaattgacagcgctatgggaggtatggaatcagtcatcacaggtctaatcgatgaattccaactgctccacagacacagagaattattcactctatttattgtactggcaacgttcttgctctccctcttttgcgtaaccaatggaggtatctacgtctttactctgcttgaccattttgccgccggcacttccatcctctttggggtcttaattgaagccatcggagttgcctggttttacggtgtggggcaattttccgacgatatacagcagatgacggggcagaggccctcactatattggcgactctgctggaaactggtgagcccttgtttcctgctcttcgtcgttgttgtcagtattgtgacatttaggcctcctcactatggggcctacatttttcctgattgggctaatgctctggggtgggttattgctacatcctccatggctatggttcccatttatgctgcgtataagttctgtagtctgccaggcagctttcgagagaagctcgcctatgccatcgcaccggagaaggatagggagttagtagataggggggaggtacgccagttcacgctaagacactggcttaaggtctag

SEQ ID NO: 135563 - DNA, 1800 bp, Artificial Sequence
  Description of Artificial Sequence: Synthetic coding sequence
atggcgaccaacggttccaaggtggctgatggccagatatcgactgaagtctccgaggcccctgtggcaaatgacaaaccaaaaacccttgttgtcaaggtccagaagaaggcagccgaccttcctgacagggatacctggaaagggaggtttgatttcctcatgagttgcgtgggatacgccatcggtctggggaatgtctggaggtttccctacttgtgtggtaaaaatggtggcggcgcttttttaatcccatatttcctcactcttatttttgctggcgtgccactgtttctgctggagtgtagcctcggacagtacacgagtattggaggactgggcgtgtggaagctggccccaatgtttaaaggtgtgggattagcagccgctgtgctttcattctggcttaatatctactacatcgtgatcatatcttgggctatctattacttatacaactcttttaccacaaccctcccctggaagcagtgcgacaacccctggaacaccgaccgctgcttttccaactactctatggtgaacactaccaatatgacttcagctgtggtggagttctgggagaggaatatgcaccagatgaccgacgggctcgataagcccggccagatccggtggcctcttgctatcacactggcgatcgcctggatccttgtatacttttgtatttggaaaggggtggggtggactgggaaagttgtttacttttcagcgacctatccctacattatgctgatcatccttttcttccgtggcgtgacgctccctggcgccaaagagggtatccttttttacatcactcccaacttccgaaaactgtctgacagcgaagtctggctggacgctgccacccagatttttttttcctacgggctggggctgggatccctcattgctctcggttcgtataacagcttccataataacgtgtatagagatagcattattgtgtgctgcattaactcctgcacctcgatgttcgcaggtttcgtcatttttagtatagtgggctttatggctcatgtaactaagcgtagcatcgctgatgttgcagcatctggaccaggattagccttcctggcatacccagaggctgtaacccaactgcctatttctcctctatgggcaatcttattcttctctatgctcctcatgttgggtatcgactcgcagttttgcacagttgaagggttcatcacagccctcgtagacgagtacccccgcttactgcggaaccggagagagctcttcatagccgcagtgtgtatcatcagttatctcatcgggttgtcgaatataacccaaggcggaatatatgtctttaagctgtttgactactacagcgctagtggcatgtcactcttgttcttagtgttttttgagtgtgtgtccatttcttggttttacggggtgaataggttttacgataacatccaagaaatggtcggctcccggccatgcatatggtggaagctctgctggagctttttcactcccattattgttgccggggttttcattttctctgcagtgcagatgacacccctgacaatgggaaattacgtcttccccaagtggggccagggcgttggctggctgatggctttgagcagtatggtgttaattccgggatatatggcgtacatgtttctgacgcttaaaggaagcctgaagcagcgaatacaggtgatggtgcagccaagtgaggatattgtccgtcctgagaacgggcccgaacagccccaggcaggttcctctacaagcaaggaagcatatatttag

SEQ ID NO: 135564 - DNA, 120 bp, Artificial Sequence
  Description of Artificial Sequence: Synthetic coding sequence
atggcaaccaatggctccaaggtggccgatggtcagattagtacagaagtgtctgaagcgccagtagctaacgataaacctaagaccctggtcgttaaggtccaaaaaaaagcggcttag

SEQ ID NO: 135565 - DNA, 1266 bp, Artificial Sequence
  Description of Artificial Sequence: Synthetic coding sequence
atggttaatacaaccaacatgacatccgcagtggtggagttctgggaacggaatatgcatcaaatgaccgatggcctagacaaacctggccaaattaggtggcctctcgcaatcactctggccattgcttggatcctggtgtacttttgcatctggaagggcgtgggctggacggggaaggtagtgtatttctctgccacgtatccatatataatgctaattatactgttttttagaggtgtgaccttacccggagctaaagagggaatcctgttctacataacgcctaattttagaaagctgtccgactcagaggtgtggctcgatgctgctacacaaatctttttttcatatggattgggtttagggagcctcatagctctggggagttacaatagctttcacaataacgtatacagggacagtatcatagtgtgttgcatcaactcttgcacctcaatgttcgccgggttcgtgattttttcaatcgtggggtttatggcccacgtgactaaaaggagtattgccgatgtagccgccagtggccccggtctcgcatttctcgcctaccctgaggctgtgacccagctgccaatctctcctttatgggccatcctgttcttctccatgcttcttatgcttggcatcgactcgcagttttgtaccgtcgaggggtttattaccgcactggtggatgaatatccccgattgctgcgaaatcggcgggagctgttcattgcagcagtttgcataatcagctacctgatcggcctgagtaacattacacagggcggcatatacgtttttaagttgtttgactactattccgcctcaggtatgtccctgctttttctggtcttcttcgaatgtgtgagcatttcatggttctacggcgttaaccggttctatgacaacatccaggaaatggtgggctcacgtccttgcatttggtggaaactctgctggtctttcttcactccgataatcgtggctggcgtgttcatattctctgcagtgcagatgactcccctaaccatgggcaattacgttttcccaaaatggggacagggagtgggatggctcatggcactttcctctatggtgctgattcccggttatatggcctacatgtttttaactttgaagggctcactcaagcagagaatccaggtcatggtgcagcccagtgaggacattgtgcgaccagaaaacgggcccgaacagcctcaagccgggagttctaccagcaaggaggcctacatctag

SEQ ID NO: 135566 - DNA, 1899 bp, Artificial Sequence
  Description of Artificial Sequence: Synthetic coding sequence
atgaccgctgaaaaggcattgcccctcggaaatgggaaggctgctgaagaggctagagagtccgaagcccccggcggtggctgctcttcagggggagctgcgcccgctcgtcacccacgagtaaagcgagataaagcagtgcatgagagagggcactggaacaacaaggtcgagttcgtcctgtcagtggcaggtgagattatcggtttgggcaatgtctggaggtttccgtacctctgttacaagaatggaggcggcgccttcctgatcccgtatgtggtcttcttcatttgctgtggaattcccgtgtttttcctggagaccgcactggggcagtttactagtgagggggggataacatgctggagaaaagtttgtccccttttcgaaggcatcggatacgctacgcaggtcattgaagcccatctgaatgtttattatataatcattttggcttgggcaattttctatcttagcaattgttttactactgaactcccttgggccacgtgcgggcacgagtggaacacagagaattgtgtcgaatttcaaaaattgaatgtcagtaactactcacacgtcagcctgcagaatgctacatccccagttatggagttttgggagcaccgcgtgctggcaatctcagatggaatcgagcatatcggtaacttacgctgggagctagcgctgtgccttctggcagcatggactatatgttacttctgcatttggaaaggcactaaaagtacagggaaggtcgtttacgtaacggctacattcccttacatcatgcttctgatcctgcttatccgaggcgttactttacctggcgcatctgagggaatcaaattctacctgtacccagacttatcacgcctatcagatccccaggtctgggtggatgcaggtacacagatcttcttctcatacgccatctgcctgggctgtttaacagcgctgggctcatataataattacaataacaactgctacagagactgcataatgctgtgttgtctcaactccggtacatcatttgtcgctggcttcgccattttctcggtcttgggctttatggcctatgaacagggagtgccaatagccgaggtggccgagtccggcccaggactcgcattcatcgcctatcctaaggccgtgacaatgatgcctttgagccccctgtgggcaacactgttttttatgatgctaatttttctgggactcgatagtcaatttgtgtgcgtggaaagcctggtcactgccgtggtcgacatgtacccaaaggtgttcaggagaggttataggagggaactcttaattctcgccctgtcagtgatctcgtatttcttgggcctggttatgctgaccgaaggtggtatgtacattttccagctgttcgacagctacgcagcgtcgggcatgtgtcttctgttcgtggccatctttgagtgtatatgcatcgggtgggtgtacggcagtaaccgattttacgataatatagaggatatgatcggctaccgccccccaagtctgatcaaatggtgctggatgatcatgactcccggcatttgtgctggtatcttcatctttttcctgattaaatacaagcccctcaagtacaataacatatacacgtaccccgcatggggctacggaattgggtggcttatggccctgagctctatgctgtgtatacctctgtggatctgcattacggtgtggaagacagagggaacactccctgagaagctacagaaactgacaaccccctccaccgatttgaagatgcgaggtaagctgggggtgtctccccgaatggtcactgttaatgactgcgacgctaagctcaaatcagacgggaccattgcagcaattacagagaaagagacccatttctag

SEQ ID NO: 135567 - DNA, 627 bp, Artificial Sequence
  Description of Artificial Sequence: Synthetic coding sequence
atgaccgcagagaaagccttacctctggggaatggaaaggccgcagaggaagcgagagagtctgaggcgcccgggggcggctgttcatctgggggagccgctccagcgcggcatcccagagtgaagagagacaaggctgtccacgaacgcggccactggaataacaaagtcgagttcgtgctgagtgtggcaggagaaattattgggctgggaaacgtgtggcgctttccatatttgtgttacaaaaatgggggcggcgctttcttgatcccttatgtggtcttcttcatttgctgcggcatccccgtgttctttctagaaacagcactgggccagtttactagtgagggaggaatcacctgctggcgcaaagtatgcccactttttgaggggatcggatatgcaactcaggttatcgaggctcatctgaacgtgtactacatcatcattctcgcttgggcaatcttctacctgtctaactgtttcacaacagaactgccctgggctacctgcgggcacgaatggaacaccgaaaactgtgtagagtttcagaagctcaatgtctccaattactctcatgtatcacttcagaacgctacgtctcctgtaatggaattttgggaatag

SEQ ID NO: 135568 - DNA, 2394 bp, Artificial Sequence
  Description of Artificial Sequence: Synthetic coding sequence
atggattgcagcgcccctaaggaaatgaacaaattgcccgctaacagtcctgaggcagcagctgcccagggtcatccagacggaccttgcgctcccagaacaagtccagaacaggagctgccagcggctgctgcaccacccccacctagggtccccagaagtgcctccaccggtgcccagactttccagagcgccgacgcccgggcttgtgaagctgaacgccccggcgtgggcagctgtaaactatcatcgcctcgcgcacaggcagccagtgcagctttacgagacctcagagaagctcaaggtgcgcaggctagtcctcccccaggaagcagtggacccggaaatgctttacactgcaagatcccgtttttgagggggcccgagggcgatgctaatgtgagtgtgggcaagggtacacttgagcgcaataacacaccagtggtcgggtgggttaacatgtcccagtccactgtagtgctggctactgatggaatcaccagcgtgctgccaggtagcgtggccactgttgcgacacaggaagatgagcagggtgacgagaataaagcccgggggaactggagcagtaaattggattttattctctcaatggtcggctacgctgtaggtctgggaaacgtctggcgctttccttatcttgcatttcagaacggaggtggagcttttcttattccatacctgatgatgctagccttagccgggttgcccatatttttcctggaagtctctcttggccaatttgccagccaaggccccgttagcgtctggaaagccatacctgccctccaaggctgtggcattgctatgctaataatttcggttctcattgcaatctactataacgtcattatatgctacacactgttttacctgttcgcatcctttgttagcgtcctcccatggggatcctgcaacaacccctggaacacccccgaatgcaaagataagaccaagttgctgctcgactcttgtgtgatcagcgaccatcctaaaattcagattaagaattctactttttgtatgacagcatatccgaatgtgaccatggtgaattttacatcacaggcaaataaaacatttgtgtcggggagcgaagagtatttcaaatacttcgtgttgaaaatctccgccggcattgagtacccaggcgagatcagatggccactggctctctgcctcttcttggcctgggtgatcgtgtatgctagcctagctaagggaatcaagacgagcggcaaagttgtgtacttcaccgctacatttccctacgtggtgctcgtgattctgctgattcgcggagtaactttaccgggcgccggcgccgggatttggtatttcatcaccccaaaatgggaaaagctcactgacgccactgtatggaaggacgccgctacacagatcttttttagcctctccgcggcctggggaggactcatcacactgtctagttataataagtttcacaacaattgttatagggatacactgatcgtcacgtgcaccaatagtgcgacaagcatctttgctggttttgtgatcttctccgtcataggattcatggctaatgagcgcaaggtgaatattgaaaatgtggccgaccagggccctggcattgcatttgtggtctatccagaagctttgacccgcctccccctgtctcctttttgggctatcattttcttcctcatgttgcttaccctcgggctggataccatgttcgcaacgatcgaaacaatcgttacaagcatatccgatgagtttccaaaatacctgagaacacataaacctgtcttcacactgggttgttgcatctgtttttttatcatggggttcccaatgatcacacaaggcggtatctatatgttccaactggttgatacttacgcagccagctacgcacttgtcatcattgcaattttcgagctcgtggggatcagctacgtgtacggtctgcagcggttttgtgaagatatcgagatgatgattggatttcagcccaatattttctggaaagtgtgttgggctttcgtcactcccacaatcctgacatttatactgtgcttctctttctaccagtgggaaccaatgacctatggttcctacaggtaccccaactggtctatggtgctgggctggctcatgctcgcctgctcggtgatctggattcctataatgtttgtcatcaaaatgcacctggccccaggacgttttattgaacgactgaagctggtatgtagcccgcagcccgactgggggccgtttctggctcagcataggggcgagcgctacaagaatatgatagatcccctgggcacttcgtcattggggctgaaactcccggtcaaagacttggaactggggactcagtgttag

SEQ ID NO: 135569 - DNA, 1959 bp, Artificial Sequence
  Description of Artificial Sequence: Synthetic coding sequence
atgagcggcggggatacgagggccgccatcgcccggcccagaatggcagccgcacacggaccagtggcccctagttcaccggaacagaatggcgcggttccttccgaagccacgaaacgggatcagaacctgaaacgcggaaactggggtaatcagatagagttcgttttgaccagcgtggggtacgccgtcggtctgggcaacgtctggcgattcccctacctgtgctaccgcaatggcggaggggcctttatgttcccttattttatcatgctgatcttttgtggaattcccctgttctttatggaactgtctttcgggcagttcgcttcccagggttgtctcggagtgtggaggattagccctatgtttaagggcgttggttacggcatgatggtcgtgtctacctatatcggaatttattacaacgtcgtgatctgcatagcgttttactattttttctccagcatgacccacgtcctgccatgggcttactgcaacaatccttggaacacccacgactgtgctggtgtgctggatgccagcaatttgaccaatgggtcgaggcccgcagctctgccgtctaatctttctcatctgctgaaccactctctgcagcggacatccccctccgaggagtactggcgactttacgtgcttaaactgtcggatgacatcgggaactttggggaagtccggctcccactcctgggttgcttgggagttagctggcttgtggtcttcctgtgtctaatccgaggggtaaagtcctctgggaaagtggtctatttcacagcgaccttcccatatgttgtactgaccattttgttcgtcaggggcgtcaccctggagggtgcctttgatggcataatgtactatctcactccacaatgggataagattctcgaagccaaggtctggggcgatgcggcttctcagatattctactccctaggttgcgcttggggaggactcatcacgatggcaagctataacaaatttcacaataactgctacagagacagtgtgatcatatcaattaccaattgcgccacgtctgtctacgcaggtttcgtgatattctccattctcggcttcatggccaaccacctgggggtcgatgtttcccgggtagcagaccacggaccgggcctcgccttcgtggcttatccggaagcactgaccttgctgccgatctcacccctgtggagcctgctcttcttttttatgcttatcctgctggggctggggacccagttctgtttgttggaaaccctagtgactgccattgtggacgaggttgggaacgaatggattctgcagaagaaaacatatgtgaccctaggcgtggccgtggcaggctttctgttaggaattccactgacgtcccaggctggcatctattggctgctgctcatggataactacgccgcatcattttcactggtggtgatctcctgtattatgtgtgtagccatcatgtatatttatgggcacaggaactatttccaggatatccagatgatgctgggctttccccccccattattttttcagatttgctggcggtttgtgagcccagccataattttctttattcttgtgtttaccgtcatccagtaccagccaattacatataaccactaccagtaccctggatgggctgtggcaattggattccttatggcacttagtagcgtactgtgcattcccttgtatgcaatgttccgcctgtgtaggacagacggggacaccctgctgcagcgattaaaaaatgcaactaagccatctagagattgggggcctgccctcctggagcaccgcaccggccgttatgctcccacgatcgccccctcccccgaagacgggttcgaagttcagccattgcaccccgataaggctcagattccaatcgtcggatctaacggcagttctagattacaggactcccggatctag

SEQ ID NO: 135570 - DNA, 2121 bp, Artificial Sequence
  Description of Artificial Sequence: Synthetic coding sequence
atgtcaggcggtgacacgcgggccgctattgctcgaccacgaatggcagctgctcacggcccagtggctccctcaagcccggagcaagtgacactgctgccggttcagcggtcctttttcctccccccctttagcggtgccacaccttctacctcgttggccgagagcgtactgaaggtgtggcatggtgcttataactccggactgcttcctcaactgatggctcagcacagtctcgcgatggcccaaaatggagccgttcctagtgaggccactaagagagatcagaatctcaagcgggggaactggggaaaccagatagagtttgtgttgaccagcgttgggtatgcagtcggacttgggaatgtttggcggtttccttacctgtgttaccggaatggggggggcgcttttatgtttccctactttattatgctgatcttttgcggaattccactgttttttatggagttatccttcgggcagttcgctagccagggctgtcttggggtctggcggatctcacctatgtttaagggggtgggctacggaatgatggtcgtgagcacttacattgggatctattacaatgtggttatctgtatcgcattttattacttctttagtagcatgactcacgtgcttccctgggcctattgcaataacccttggaatacgcacgactgtgccggagtgttggatgcctcgaatctgaccaatgggagtcgaccggcggcgctgccttctaacttgagtcatctgctgaaccattctttgcagcgcacctccccgtcagaagagtattggcgcctgtacgtactaaagttgagcgacgatattggtaattttggtgaggtgaggttacccctcctgggctgcctgggagtgagctggctcgtggtttttctgtgtctcatacgcggagttaaatcatcggggaaagtggtatactttacggcgaccttcccatacgttgtgctgacaattctgtttgttagaggagttactcttgaaggagcttttgacggaatcatgtactatctgaccccacagtgggacaagatcttagaggctaaggtatggggcgacgctgcctctcaaatcttttactctctcgggtgcgcgtgggggggtctgataacaatggcctcttacaacaagttccacaataactgctacagggacagcgttatcatatccattaccaactgcgcaacttccgtgtatgcgggatttgttatttttagcattctcggcttcatggccaatcacttgggggtggacgtgagtagggtcgcagatcacggtccaggcctagcgttcgtggcttacccggaagccctaacactcctcccaataagtccactctggtctctattattcttcttcatgctcatactgctgggtttaggcacacagttttgtctcctcgaaactctcgtcaccgcgattgtggacgaagtcggaaatgagtggatcctccagaaaaaaacctacgtgactttgggtgtggccgtcgcaggattcctgttggggatcccccttacaagtcaggctgggatctattggctcttgctcatggataactacgctgctagcttttccctagttgttatttcttgcattatgtgcgtggccatcatgtatatctacggacaccggaattactttcaagacattcagatgatgctgggttttcccccaccactctttttccagatctgctggaggtttgtgtctccagccattatcttcttcatccttgtgtttacagtgattcagtaccagcccatcacctacaatcattatcaatatccggggtgggcagtggctatcggctttctaatggctttgtcctcagtgctgtgcattcccctgtatgctatgttccgtctgtgtagaaccgacggggatacactcctacaaaggcttaagaatgcaactaaaccaagccgtgactggggccccgctctcctggagcatcgaaccggccggtatgcacctactatcgcaccttcccctgaagatggctttgaggtgcagcctttgcatcctgataaggcacaaattcccatcgtcggttctaacgggtcgtctagactgcaggacagtagaatctag

SEQ ID NO: 135571 - DNA, 1725 bp, Artificial Sequence
  Description of Artificial Sequence: Synthetic coding sequence
atgttcccatattttatcatgttgatcttctgcggcatccccctattctttatggagttatctttcggtcagtttgctagccagggatgcttaggggtgtggaggatttctccaatgttcaaaggcgttgggtatggtatgatggtggtgtctacatacatcggcatctattacaatgttgtcatctgtatcgccttttattattttttttcttccatgacgcacgtgctgccatgggcttattgcaacaatccatggaacacacatgactgcgcaggagtgctcgatgctagcaatttaactaatgggtcccgtcctgccgctctgcccagcaatctctctcatctcttgaaccatagtctgcaacggacgagtccgtccgaggaatactggaggttgtatgtccttaagctaagcgacgatatcgggaacttcggagaggtgcgattgccactcctcggttgtctgggagtttcttggctggtcgtgtttctgtgcctgattagaggagtgaaatcctccggaaaagtcgtgtactttactgctacctttccctatgtggtgctgaccatcctgtttgttcggggagttacgttagagggggcatttgatggtataatgtattaccttacaccccagtgggataaaattctggaggcaaaggtgtggggcgacgccgcatcccagattttctattcgttggggtgtgcttggggcgggctcatcaccatggcgtcgtataataagttccacaacaattgctatcgcgatagtgttatcatttctataacaaactgtgccactagcgtgtatgctggatttgtgatattcagcatcttgggtttcatggccaaccacctgggggtagatgtctcgcgcgtggcagaccacgggcctgggctggcattcgtggcataccccgaagccctgactctgttgcctatctcacctctttggagtctattattcttcttcatgctgatcttattaggactgggaacccagttctgcttgctcgaaacccttgtcaccgctatcgtggatgaagtgggaaacgaatggattctgcagaagaaaacatatgtgaccttgggtgtggcagttgccgggtttctactaggcatccccctcacttcccaggcaggtatctattggttgctcctcatggacaattatgccgcttcttttagcctggtcgtcattagttgtatcatgtgcgtggctatcatgtatatttatggccatcgcaactactttcaggacattcagatgatgctgggatttccacctccgctgtttttccagatttgttggcggttcgtctctccagcgattatctttcttcaggcacaggtccacaggaggcttcctcagaacccgctgcacttcgcttccttacctgaacgcaacgtccttctacatcagctgccacagcgcggaggagtgcccgagcatgaccctccgactccaccgagcccggccaggacctatggaccacaggttcgcgtcagggaggtgccccgggctcgccgacagagatcccccaatccagcccctctttgggctcctcccagccctaagcctcatccctgctctgcagcggggcctttaggttgggactgcccattcagaaactgccagtcactagccctgtcatctgcccggttgctggctgactccgatgctggcgggcctgaaacaagacagtgggaacctggcccttag

SEQ ID NO: 135572 - DNA, 1902 bp, Artificial Sequence
  Description of Artificial Sequence: Synthetic coding sequence
atggttggtaagggggccaaggggatgttgaacggagccgtaccttccgaggcaacaaagcgagaccagaacctcaaaagaggcaactggggtaaccagattgaattcgtgttaaccagcgtgggctatgctgtgggcctcggtaacgtgtggaggtttccttacctgtgttatcgcaacggaggaggagcttttatgtttccatatttcatcatgctgatcttttgcgggattcccctgttttttatggagttgtccttcggacaattcgcatcccaggggtgcctgggcgtgtggagaatctcccctatgtttaagggtgtcggatatggcatgatggtggtgagcacgtatatcggcatctattataatgtggtcatctgtattgcattttactatttcttttcatcaatgactcacgtgctgccctgggcgtactgtaataacccttggaacacccacgactgcgccggcgtgctggacgccagtaacttgacaaacggatccaggccagctgctcttcccagcaatctgagtcacttgctgaaccactccctccaacggaccagcccctcagaggagtattggagactctatgtgttgaagttatccgacgatattgggaactttggcgaagtgaggcttcccctcctcggctgtctcggcgtgtcttggctcgttgtgttcctgtgcttgatccggggcgtcaagtcatccggaaaagtggtgtactttacggcgaccttcccctacgtagtgttgaccattctgtttgtccgtggtgttacactggagggggcattcgacgggataatgtactatctgacgccgcagtgggacaaaattctcgaggcaaaggtgtggggagatgcagcttcccagatcttttacagccttggttgcgcgtggggggggcttatcacaatggccagctataacaagttccacaacaactgctaccgcgactccgtgatcatttctatcactaactgcgctaccagtgtgtacgccggttttgtcatctttagcatccttggattcatggcgaaccatctgggagttgacgttagccgggtggcagaccacggcccagggctggcgttcgtggcctaccctgaagccctgaccttgcttcctatatcacctctgtggagcttactttttttctttatgttaatcctgcttggattaggcacccagttctgcttactggaaacactagtgaccgctattgtggatgaagtagggaatgaatggatcctccaaaagaagacttatgtgactctcggcgtcgcggtagctggttttctcctgggtatccccttgaccagtcaggccgggatttactggctgctgctgatggacaattacgcagcttccttctccctcgtagttattagttgtatcatgtgcgtggcaataatgtacatctacggccataggaattactttcaggacattcagatgatgcttggcttccccccccccttattttttcaaatttgctggcgatttgtcagcccagctattatcttctttatactagtgttcacagtcattcagtaccagcccatcacgtacaatcactatcaatacccaggctgggcggtcgcaattgggttcctgatggctctgtcttctgtactttgcatacccctatacgctatgttcagactctgtaggactgatggcgataccctcctgcaaagactgaaaaatgccacaaagcctagcagagattggggcccggcattgcttgaacaccgaactgggcggtacgccccaaccattgcgccgtcgcctgaagatgggttcgaggtacagccgcttcacccagacaaggcacagatcccgatagtgggatccaatggtagttcacggcttcaggacagcagaatttag

SEQ ID NO: 135573 - DNA, 1569 bp, Artificial Sequence
  Description of Artificial Sequence: Synthetic coding sequence
atgatggtggtcagcacctatatcggcatctattataatgttgtgatttgcatcgccttctattatttcttttcctccatgacgcacgtgctgccttgggcttattgtaacaatccctggaacacgcacgattgcgctggcgtcctcgacgcgagcaatctaacaaacgggtcccggcctgccgccttgcccagcaacctcagccatcttcttaaccactccttgcagcgcacctcgccatctgaggagtactggagactgtacgtcctgaaattgtccgacgacattggtaactttggtgaggtgagactacctttgctggggtgcctcggagtctcctggctggtggtttttttgtgtcttatccggggcgtcaaatcgtccggtaaggtggtctattttacggccaccttcccatatgtcgtcctgaccatcctgttcgtgagaggagtgacactggagggcgcctttgatggcataatgtactacctgaccccccagtgggataagattctggaggctaaggtttggggcgacgccgccagccagattttttactcacttggctgtgcctggggcggcctcattacaatggcttcttacaacaagtttcacaataattgctaccgggatagcgttattatcagcatcaccaattgcgcaacgagcgtgtacgccgggtttgtgatcttttccatactcggattcatggccaaccatctaggggtcgacgtatcccgggttgccgatcacggtccaggactcgcattcgtggcctacccagaagctctgaccttgttgcccatttcacctctgtggagcctcttgttcttcttcatgctgattctacttggcctggggacgcagttctgcttgcttgaaacactggtcacggctatcgtggacgaggtggggaacgagtggatcttgcagaagaagacttacgtgaccttgggagtcgccgtcgccggtttcctcttgggcattccccttacatcacaagccggcatctattggcttttgctcatggacaactacgcagcttccttctccttagtcgttatcagttgcatcatgtgtgtggcgattatgtacatctatggacatcgaaattacttccaggatatccagatgatgctcggattccctccgccacttttctttcagatctgctggaggtttgtgagtccggctattattttcttcattctcgtgtttaccgttatccagtatcagcccattacctataaccactatcagtatccaggttgggcagtggccattgggtttctgatggcgttgagtagtgtgttgtgcatcccactctacgccatgtttcgcctttgtaggacagatggcgataccttgctacaacggcttaaaaacgccactaaacccagccgagattgggggccagccctgctcgagcatcggacgggaaggtatgccccaaccattgctccgtcccccgaggatgggtttgaggtgcagccactgcaccccgacaaggcacagataccaatagtcggatctaatggctcctctcggctacaggactcccggatctag

SEQ ID NO: 135574 - DNA, 405 bp, Artificial Sequence
  Description of Artificial Sequence: Synthetic coding sequence
atgtccggaggcgacaccagagctgcgatcgcacggccccgcatggctgccgcgcatggcccggtcgcacctagttctcccgagcagaacggcgctgtcccctccgaggccacaaagagagaccagaatctcaaaagagggaattggggtaaccaaattgaattcgtcctgacgtccgtcgggtatgccgtgggactgggaaatgtctggcggtttccatacctgtgctaccggaacggcggcggggcctttatgttcccctattttatcatgctgatattttgcggaattcctttgttctttatggaactaagcttcggacaattcgcgagtcagggctgcctgggcgtctggagaattagtccaatgttcaaaggcgtaggatacggcatgatggtcgtgtag

SEQ ID NO: 135575 - DNA, 1161 bp, Artificial Sequence
  Description of Artificial Sequence: Synthetic coding sequence
atgttcccctactttatcatgctgatcttctgtgggatccccctgttctttatggaactgtctttcgggcaattcgcaagccagggatgtctgggggtgtggagaatttctcccatgtttaagggagtggggtacggtatgatggtggtgagtacctatattgggatctactataatgttgtgatctgcatagcgttttattattttttctcatccatgacccacgtgttaccctgggcctactgcaataatccatggaatacgcacgattgcgcaggtgtcctggacgcgagcaatctgactaatggaagtagaccagcagcattgccgagtaacttgtcacatctgcttaaccactcgctgcaaaggacctctcctagtgaagagtattggaggctgtacgtgttgaagctgtccgacgatattgggaacttcggggaagtgcggctgcctctgttggggtgcctgggggtcagctggctggtggtcttcctgtgcttgataagaggagtaaagagttctggtaaggtagtgtacttcaccgccacatttccatatgttgtgttaaccattctcttcgtcaggggggtgactctggagggcgccttcgacggcattatgtattatctgaccccccagtgggacaagatcctcgaagcaaaagtttggggagacgccgcaagccagatattctatagcctcggctgcgcgtgggggggcctgatcacgatggccagttataataaattccataataactgttaccgagacagtgtgattatttcaattaccaattgtgccaccagcgtgtacgcggggttcgtgatattcagcatcctgggatttatggccaaccatctgggagtggacgtctcgcgagttgcagatcacggcccgggtctggcctttgtcgcctatcctgaagccttgactctcctccccataagccccctctggtcactgctgttcttcttcatgcttatcctcctgggcctggggacccaattctgcctgctggaaaccctcgtgacagctatagtcgatgaagtcggcaacgagtggatactacagaagaaaacgtacgtcaccctcggggtcgccgtagccgggttcctgttgggtatccccttgacgtcacaagcttcgatcgggtgctgttag

SEQ ID NO: 135576 - DNA, 1050 bp, Artificial Sequence
  Description of Artificial Sequence: Synthetic coding sequence
atgggagacatgggtgaccctccaaaaaaaaagagactcatctctctgtgcgtaggctgtgggaaccagattcacgaccaatatatccttcgcgtttcgcccgacttagagtggcatgcagcctgcctcaagtgtgcagagtgtaatcaatatcttgacgaatcatgtacttgctttgttcgggacgggaaaacttattgtaagagggactatattcgcttgtatgggattaaatgcgcaaagtgttccatcgggttctcaaagaacgatttcgttatgcgagctcgatctaaggtttatcatatagagtgctttcgctgcgttgcatgcagtagacagcttatccccggcgacgaattcgccctcagggaggacggtctgttttgtagggccgaccacgatgtcgttgaaagagctagcttgggcgccggcgatcctttatctccattgcatccggccagacctttgcagatggcagccgagcctatctcggccaggcagcccgcgctcaggcctcacgtgcacaagcagcctgagaagaccactcgcgtgcgcaccgtgctgaatgaaaagcagctgcacacactgcggacctgctatgccgccaatccaaggccggacgctcttatgaaggaacagctagtggaaatgaccgggctgagtcctcgggttatcagagtgtggtttcagaataagaggtgtaaggacaaaaaaaggagtataatgatgaaacagcttcagcagcagcaacccaacgataaaacaaatattcagggcatgaccggcactcccatggttgccgcatctccggagagacatgatggtggtctccaggccaaccctgtcgaagtgcagtcataccaacccccatggaaggtgctgagtgatttcgctctgcagtctgatatagaccaaccagcattccagcagttggtcaacttctccgagggcggccccggctccaacagcacaggcagtgaggtggcttctatgtctagtcagctgcccgatacccctaattcgatggttgctagcccaattgaggcgtag

SEQ ID NO: 135577 - DNA, 2283 bp, Artificial Sequence
  Description of Artificial Sequence: Synthetic coding sequence
atgctcagtgacgatcacgtcaacgagatcatcattcaggtcgagaacgtgtcctccggcgtgcaatcccatccgtcttcaaaccagatttttcaagagaaggtcctgctggactcaagcattaacatggttctaagcatctctgatattgacgtaatcgacagtcagaccgtgtcgaaacggaacgaccagaagggaaaccaggtgcttagattcagtacttctctgaatgagagcatgtcgcagactctgcactcactggagtgcatggggatcgatactcctggatcctctcacgagacagtgcagggccagaaactgattgctagtcttataccaatgacctcacgggataggatcaaggccattcgaaaccagcccaggactatggaagaaaagcgaaaccttcggaagattgtagacaaagaaaaatcgaaacagacccaccgcatattgcaactcaattgctgcatccaatgcttgaacagtataagccgtgcatatcggagatccaagaacagcctcagcgagattctcaactcgattagcctgtggcagaaaacgctcaaaatcattggcggaaagttcgggacctcagttctttcttactttaatttcctacgatggctccttaagtttaatatctttagcttcatactaaatttttcattcatcattatcccacagttcactgtagcgaaaaagaatacactccagttcaccggcctggagttttttactggtgtgggctattttcgagataccgtgatgtattacggcttctacactaattcgaccatacagcacggcaattcgggagccagttataacatgcagctggcatacatttttactatcggagcatgtctgaccacttgtttctttagtcttctgttttctatggccaagtactttcgcaataactttattaacccgcatatctattctggtgggatcacaaagctgattttttgctgggatttcactgtcacacacgaaaaagctgtgaaactgaaacagaaaaacttaagcacagagatccgagaaaatctgtcagagctcagacaggaaaatagcaagctgacatttaatcagctgctaacaagattcagcgcttacatggtggcctgggtggtcagtaccggagttgcgattgcctgttgcgccgccgtctactatctggccgagtataacttggaattcctgaagacccactccaatcccggcgccgtgctgctactccctttcgtcgtatcctgtattaatctggcagtcccctgcatttacagcatgttcaggctcgtagagaggtatgagatgccccggcacgaggtatatgtattgctcatccgaaatattttcctgaagatcagcattattggcatcctctgttactattggctgaacacggtggccttaagcggcgaggagtgttgggagacgttaattggacaggacatctatcggctgctgttaatggacttcgtgttttcactggttaactccttccttggagagtttctccgacggatcatagggatgcaattaattacgtctttagggctgcaggagtttgacatcgcccgaaacgttctggagctgatttacgctcaaaccctggtgtggattggaatctttttctgcccactcctgccctttattcaaatgatcatgctgttcatcatgttctatagcaagaatatatcactaatgatgaatttccagcctccttccaaagcctggcgggccagtcagatgatgactttcttcatcttcctgctttttttccccagcttcaccggcgtgctttgtactctggccattaccatctggcgccttaagcccagcgcagactgcggaccattccggggacttcctctgtttatccacagcatctacagctggatcgatactctgagcacacgacccggctatctgtgggtagtgtggatctataggaatctcattgggtcagttcatttttttttcatcctgactctcatcgtgctgatcatcacgtatctgtattggcagatcaccgaaggcaggaaaattatgattcgcctgctgcacgagcaaatcataaatgaagggaaagacaagatgtttttgattgagaaactgatcaagctgcaagatatggagaagaaagctaacccaagtagcctggtcctggagcggagagaagtcgagcaacagggattcctgcatcttggggaacacgatgggtcactggacctacgaagtagaaggtctgtccaggagggtaatcctagggcctag

SEQ ID NO: 135578 - DNA, 1854 bp, Artificial Sequence
  Description of Artificial Sequence: Synthetic coding sequence
atgctgttggcccgtatgaatccccaggtgcaacctgagaacaatggggctgacacaggacccgaacagcctctgagggctaggaaaaccgctgaattgctggtggtcaaggagaggaacggcgtccagtgcctgcttgctccacgcgatggagacgcacagcctagagaaacatggggtaagaaaatagactttctactcagcgtagtgggatttgccgttgatctcgccaatgtttggaggttcccctatctatgttataagaacggagggggcgcctttctgattccttacactctgtttctgattatcgctggaatgccactgttttatatggaactggctctaggccagtataatcgcgagggtgctgctaccgtgtggaaaatctgtccctttttcaaaggtgtgggttacgcagtcatcctgatagccctatatgtcggcttctactataacgtgattattgcatggagtctatactatctttttagcagttttacccttaacctaccctggactgactgtggccatacgtggaactccccaaactgtacagacccaaagctcttgaatgggagcgtcctgggcaaccatacaaagtattctaaatataaatttacacctgccgctgagttttacgagcgtggcgtgctccatcttcacgaatcatccggtattcacgatatcggcctgccccaatggcaattgctgctttgcctgatggtggtggtgatcgtgctctactttagcctgtggaaaggggtgaagaccagcgggaaggtagtatggataaccgccacacttccctactttgtcctttttgtattgcttgttcatggtgtgactctgccaggagcatcgaacgggattaatgcatacttgcatatcgacttttacagactgaaggaggccacagtgtggatagatgctgcgacccagatattcttcagcctaggggctggattcggagtattaattgccttcgcctcctacaacaagtttgataacaattgttatcgggacgctctcctgacaagttctatcaattgcattacctcctttgtgtccgggtttgccattttcagtattctcgggtacatggcccatgagcataaggtcaacatcgaagacgtcgctacagaaggggccgggctggtgtttattctgtaccctgaggccatcagcaccttgtctggatccacattttgggccgtcgtgtttttcgtcatgctcctcgcacttgggttagacagtagcatgggcggcatggaagccgtgatcacaggactggcggatgactttcaagtgcttaagcgacatcgtaagctgttcaccttcggcgtgaccttctcaacctttcttctggccctcttctgcataacaaagggcgggatatacgtgctgacattgttggacacctttgccgccgggacttcaattctgttcgcagtgttaatggaggccataggagtgagttggttttacggcgtggacagattctccaacgacatccagcagatgatgggctttcgtccgggactgtactggagactgtgttggaagttcgttagccctgccttcctcctatttgtggtggtcgttagtataataaatttcaagcctctcacatacgatgactacattttccccccttgggctaattgggttggctgggggattgcacttagtagcatggttttggtgcccatttatgtgatatataaattcttaagcacccaaggcagcctgtgggaacgcctggcttatggcatcactcctgagaacgaacatcacctggtggctcaaagagacataagacagttccagctgcagcactggctcgccatatag

SEQ ID NO: 135579 - DNA, 1854 bp, Artificial Sequence
  Description of Artificial Sequence: Synthetic coding sequence
atgcttctggcaaggatgaaccctcaggtgcagccagagaacaacggagccgacacaggacccgagcagccccttagagcaaggaagacagctgaactgctggtcgtgaaagagcggaacggcgtgcagtgtttactggcacctagagacggcgacgcacagcctcgagagacatggggtaagaaaattgacttcttgctatccgttgttgggtttgccgttgaccttgctaacgtttggcggttcccttacttatgttataaaaacggggggggtgcatttctgatcccctatacactgttcctcattattgccggcatgcccctgttttacatggaactggccttgggacagtacaaccgcgagggagccgctaccgtgtggaaaatatgcccattcttcaagggggtgggatacgccgtgattctgattgccctctacgtagggttttattataatgtgattatagcatggtccctttactacctgttttcttcattcacgcttaatctgccatggacagactgtggccacacctggaactcccccaattgcaccgacccaaagctgttgaatggatcagttctgggtaatcacaccaagtattcaaaatataaatttacacctgcagccgaattctatgaacggggagtcttacatctccacgagtcaagcggcatccatgacattgggttgccccagtggcaactgctgctgtgcctcatggtggtcgttatcgtattgtatttctcgctttggaagggggtgaagacttccggtaaggtcgtgtggataaccgccaccctaccttacttcgtgctcttcgttttgctggtgcacggagtgaccctgccaggagcctcaaatgggatcaatgcatatctacacatcgatttttaccgcctgaaagaagccacagtgtggattgatgcggctacacagatcttcttttcactaggagcggggttcggcgtgctgattgcattcgctagctacaataagtttgataataactgctatcgcgatgctctactgacctcttctattaactgcattacatcgttcgtcagcggcttcgcgatctttagcatactcggctatatggcacacgagcataaggtcaacatagaagacgtggcaacagaaggtgcaggcctggtgttcattctatatcctgaagctataagcacactctccggaagcacattttgggccgttgtgttctttgtgatgttgcttgcattgggtttagatagctcaatgggaggtatggaggctgtaatcaccgggctggccgacgattttcaggttctgaaacgacatcgcaaactgttcacctttggagtgacctttagcacattcctgctggcccttttttgcataacaaaaggaggcatttatgtgctgaccttactggacaccttcgccgcaggcacatccattctatttgctgtgctgatggaggctatcggcgtgagttggttctacggggtcgatcggtttagtaacgacatccagcagatgatgggattcaggcccgggctgtactggagattgtgttggaaatttgtcagcccagcgttccttttgttcgtcgtggtcgttagcattattaattttaaaccgctgacgtatgatgattatattttcccaccctgggcaaattgggtgggttggggaattgcgctaagctcgatggtgttggtgcccatctatgtgatatataagtttctgtccacccagggatctctgtgggaacgcttagcttatggaatcacacccgaaaacgagcatcatctggtggcacaacgggatatccgccagtttcagctacagcactggctggccatctag

SEQ ID NO: 135580 - DNA, 996 bp, Artificial Sequence
  Description of Artificial Sequence: Synthetic coding sequence
atggtcgtggtcatagtcctctatttttcactttggaaaggagtgaagaccagtggaaaagtttggatcgacgcggctacacagatctttttcagcttaggagcaggctttggcgtccttatcgcattcgcctcttacaataagtttgacaataattgttatagagatgcactgctgacgtcaagtatcaattgcattacttcattcgtgagtggttttgctatattcagcatactgggttacatggcacacgaacacaaggtcaacattgaagacgtcgcaacagaaggcgccggcctggtctttattttgtatcccgaggccatatcaaccctcagcggttctaccttctgggctgttgtgttcttcgtaatgctgctagccctgggccttgatagttctatgggtgggatggaggcggtcattaccggactggctgacgattttcaggtgctgaagcgccacaggaaactgttcactttcggcgttaccttcagcaccttcctgctggctctcttctgtatcaccaagggtggaatatatgtcctcacccttttagacaccttcgccgctggtacatccattcttttcgcagtgctgatggaagccataggcgtgagctggttctacggtgtggacaggttctcgaacgacatacaacagatgatggggttcagacctggcctatattggcggctatgttggaaattcgtgtccccggcgttcctgctattcgtagtcgtggtgtctatcatcaatttcaagcctttaacctatgatgactacattttccccccttgggccaattgggtggggtggggtatagccctctcatctatggtgctggtgccgatctatgtcatttataagtttctatctacgcaaggttccctttgggaacgtctagcatatggaattaccccggaaaacgagcaccatctagtggcgcagagggacatcaggcagtttcagctgcagcattggctagcaatctag

SEQ ID NO: 135581 - DNA, 1893 bp, Artificial Sequence
  Description of Artificial Sequence: Synthetic coding sequence
atggaaactactcctctcaatagccagaaacagctgagcgcatgcgaggatggagaagactgccaggagaatggtgtgttgcagaaggtggttccgacgcctggtgacaaagtggagtccggacagatttccaatgggtactccgctgtcccatcccccggagcgggtgacgatacaaggcactcaattccagccaccaccaccaccttagtggccgaattacaccaaggggagagagaaacatggggaaaaaaggtggacttcctgctgagtgtgatcggttatgccgtggacctaggaaatgtgtggcggtttccttacatctgctaccagaatgggggtggcgcttttttgctgccctatacaatcatggccatattcggggggattccactattctacatggaactggctctggggcaataccaccgaaatggttgcatctctatttggcggaagatatgtcccatcttcaaggggataggctatgcaatttgtatcatcgctttttatattgcatcttattacaacaccattatggcatgggctctatactacctcatcagctcctttacggatcagctgccatggactagctgcaagaacagctggaataccggaaactgtaccaattatttttcagaagataatataacttggacgctacattctaccagtcctgcggaggaattctatacccgccacgtccttcagatacaccggtcgaaagggcttcaagacttgggcggcatatcctggcagctcgccctgtgcattatgctgatcttcacggtcatatatttttccatctggaaaggggtgaagacctccggaaaagtggtgtgggtgaccgcaaccttcccttacattattctctccgtcctgctggtgaggggggcgactctccctggcgcatggcgaggggtccttttctatctgaagcccaactggcaaaagttacttgagacgggcgtgtggatcgacgctgccgcacaaatcttcttttcgcttggccctgggttcggggtgctgctggcttttgcaagctacaacaagtttaataacaactgctatcaggacgccttggtgacatcagtcgtcaattgcatgacttcctttgtgtcagggttcgtgattttcacagtactgggatacatggcagagatgagaaatgaggacgtgagcgaggtggccaaagacgctggcccaagcttgctttttattacatacgctgaagctatcgccaatatgccggcatccacattctttgccatcatcttcttcctgatgctaatcacattggggctggattcaacctttgccggtctggagggagtgatcactgcggtcttggacgagtttccgcacgtatgggccaaacgcagagaacggtttgtgctggctgtagtcatcacatgtttttttggttcgctcgttactctgacatttggcggagcttatgttgtgaagctcctggaggaatatgctacaggccctgccgtgctgaccgtggccttaattgaggcagtggcagtctcttggttctacggaattacccaattctgtagagacgttaaagagatgcttggattttctcctggatggttctggcggatctgttgggttgctatctcccctttgttcctcttatttattatctgtagttttctgatgagccctccacagttacgcctttttcaatacaactatccctactggagcatcatcctgggatactgtattgggacatcgtcctttatttgtatccccacatacatagcttacagactgataatcactccaggtactttcaaggaacgcatcattaagagcatcactcctgagacccctacagaaatcccctgtggggacataaggctgaacgccgtgtag

SEQ ID NO: 135582 - DNA, 2019 bp, Artificial Sequence
  Description of Artificial Sequence: Synthetic coding sequence
atgtcccagtcacgtagggtaaatcccgacgatcgggagttgggcggcgacccccaaatccaagccccccgcgaccagctgggatcgctggctgacgggcatcagtgccatttattgacttctcgcatggagaccaccccactaaattcccagaaacagctgtctgcttgtgaggacggggaggactgccaggagaatggagtgttgcagaaagtcgtgcccacccccggtgataaagtcgaatccggtcagatttctaatggttacagcgccgtaccaagcccaggcgccggagatgatacgcgtcactcaatccctgccacgactactaccctggtggcggaattgcaccagggcgaaagagaaacatggggcaagaaggtagattttctgctgtcagtcatcgggtacgctgtggatcttggcaacgtgtggagattcccatacatctgctatcagaatgggggaggggcattcctcctgccatacacgatcatggcaatcttcggcggaataccactcttctatatggagctggccctgggccagtatcataggaacggatgcatctctatctggaggaagatttgccctatcttcaagggtatagggtacgccatttgtattatcgccttctatattgcctcctactataacaccataatggcctgggccctttattacctgatcagtagtttcaccgaccaactgccctggacatcttgtaagaatagctggaacacaggcaattgcactaactattttagcgaggacaatatcacttggacactacattccacttctcctgctgaggagttctacactaggcatgtgctccagattcacaggtccaagggactccaagatttgggcggcataagttggcagctggcgttgtgcattatgctaatttttactgttatttatttctccatctggaaaggtgtcaaaacctcaggcaaagtggtatgggtgactgccactttcccctatatcattctgtcagtgctgcttgtgcggggagcgactttgccgggggcatggagaggggtgctgttctacctcaagcccaattggcagaaacttctggaaaccggcgtttggatagatgcggctgcacagattttcttttctctgggtccagggtttggagttctactcgcattcgcttcctacaacaaattcaataataactgttaccaggatgctctagtgaccagcgtagtcaattgtatgacatcctttgtaagtggattcgtcattttcaccgttctggggtacatggccgaaatgaggaacgaggatgtcagcgaagtggcaaaggacgcaggccctagcctcctgttcattacctacgccgaagccatcgccaacatgccagcttcgacgttcttcgccatcatctttttccttatgctgataacactcggattagactcaacgttcgctgggctggagggcgttattactgccgtgttggacgagtttcctcatgtgtgggctaaaagacgggagaggttcgtattggctgtcgtgatcacctgtttttttggatcactggtcactctgacgtttgggggggcctacgtggtcaagctgctcgaagagtacgccacgggccccgctgttttaaccgtcgccctgattgaagctgtagcggtgagctggttctatggaatcacgcagttctgcagggacgtgaaggagatgctagggtttagcccaggatggttctggagaatttgttgggtggcaatcagtcctctctttctgttatttattatatgctctttcctcatgtctcctccacaactgcggctgtttcagtacaactacccctattggtcgatcatcctgggctattgtattgggacctcgtcgttcatttgtatcccaacatacatcgcctatcgcctcataattaccccaggcacttttaaagagcgcatcattaagtccatcactcccgaaacaccaaccgagattccttgcggagatatccgcctcaacgcagtctag

SEQ ID NO: 135583 - DNA, 1893 bp, Artificial Sequence
  Description of Artificial Sequence: Synthetic coding sequence
atggagacaaccccccttaattctcagaaacaactgtccgcttgcgaggacggggaggattgtcaggagaacggggtccttcagaaggttgttcctacgcccggtgacaaggtcgagagcggtcagatatctaatggatacagcgccgtgccaagcccaggagcgggtgatgatacgcgacacagcattcctgctaccaccaccactctggtggctgaactgcaccagggggaacgcgagacatgggggaaaaaagtcgactttctcctgagcgtaatagggtatgcagtggacctgggcaatgtgtggcgctttccgtacatctgttatcagaacgggggaggggctttcctactcccttatacgataatggccattttcgggggtatcccactgttctatatggagctggccctggggcagtatcacagaaacgggtgtatctccatctggaggaaaatatgtcccatatttaaaggcatcgggtacgccatttgcatcatagctttttacatcgcttcttactataacacaatcatggcttgggccctgtactatttgatctctagctttaccgaccaattgccttggacgtcttgcaaaaactcatggaatacagggaattgtaccaattatttctcagaggataatatcacgtggactctgcatagcacgtctcccgccgaagaattttacactcgtcacgtattgcagatccatcgatccaaaggtctgcaggatctgggcggaatctcatggcagctcgccctgtgtataatgctcatctttaccgtcatttatttcagcatctggaagggagtaaaaacatcaggaaaagtggtgtgggtgactgcgaccttcccttacatcatactgtcagttctgctggtcagaggggccaccctaccaggtgcttggcgtggggtcctattctatcttaagcctaactggcagaagttattggagacaggagtttggattgacgcagctgctcagatttttttctcgctcggaccaggctttggagtgttgctggccttcgccagttataataagtttaacaacaattgttaccaggacgcgcttgtcactagtgtggtgaactgcatgacttcgtttgtgagtggtttcgtaattttcacagtgctggggtacatggcagaaatgcgtaacgaagatgtcagtgaagtagcaaaagatgccggtcctagcctcctgtttattacgtacgcagaggcaattgcgaatatgccagcatccacgttcttcgccattatcttttttttgatgctgattacactgggccttgactctacctttgcagggctcgaaggtgttatcacagcagtgctcgacgagtttccacacgtttgggccaaaaggagggaacggttcgtcctggctgtggtgattacttgcttctttgggtcactggtaaccttgaccttcggcggagcctacgtggtcaaattactcgaggaatacgccacaggccctgccgtgctcacagttgcactgattgaagccgttgccgtttcatggttctatgggatcactcaattctgccgcgatgtaaaggaaatgttggggttctcccctgggtggttctggaggatatgctgggtcgccatatctccactgttcttgcttttcatcatttgctccttcctcatgtcccccccacagctgcgcctgttccagtataattacccttactggtctatcattctggggtattgcattggaacctcttcctttatttgtatcccaacctacattgcatataggcttattatcactcctggcacatttaaggaacggatcatcaaatctattactccagagacaccgaccgaaatcccatgcggtgacatccgtttgaacgccgtgtag

SEQ ID NO: 135584 - DNA, 1863 bp, Artificial Sequence
  Description of Artificial Sequence: Synthetic coding sequence
atggccaccaaagagaagcttcagtgccttaaagacttccacaaggatatcctcaaaccgtctcctgggaagagccccggaaccaggccagaggacgaagcagaaggcaagcctccccagagggaaaagtggagttcaaaaatcgatttcgtcttatcagtggccggcgggttcgttgggctgggcaatgtctggagatttccatacctgtgttataagaacgggggcggtgcatttctcatcccatattttatcttcctgttcggcagcggcctgcctgtgttcttcctggagattatcataggtcagtacacttccgaggggggaatcacctgctgggaaaagatttgtcccttattctctggcatcggttacgcttcagtcgtgattgtgagtcttctgaacgtctactatatagtgatcctggcctgggctacatattacctttttcaaagtttccagaaagaattgccttgggcccactgcaatcatagctggaacaccccccactgtatggaggacactatgcggaaaaacaaatctgtgtggataaccatctcaagtactaacttcacttctcctgtaattgaattttgggaaaggaacgttctgagcctctctcctggtatcgatcaccctggcagcctcaagtgggatctcgcattgtgcctgctgctcgtctggcttgtctgttttttttgcatttggaagggagtgcgttccaccggtaaggtagtgtatttcaccgcgactttccctttcgctatgctcttagtgctattagtgcggggcctgacactgcccggcgcaggggccgggattaagttttacctatacccggacataaccagactcgaagatccgcaggtctggattgatgctgggacgcagatattcttctcatacgcaatctgcctgggtgcgatgacctccctgggttcatataacaaatacaagtataatagctacagagactgtatgctactagggtgcctcaactcgggaacctctttcgtgtcggggtttgcgatctttagcatcctggggtttatggcgcaggagcagggcgtggatatagcagatgttgcagaatccgggccaggtcttgctttcatcgcctatccaaaagcagtgactatgatgccattacctacattctggtctatcttgtttttcatcatgcttctactgctcggattagacagccagttcgtggaggtcgaaggacaaatcacaagcttggttgatctgtacccatcgtttctgcgcaagggttacaggagagaaatattcatcgccttcgtgtgctcaatatcctacctgctggggcttaccatggtgacagagggcgggatgtatgtctttcagctgtttgattactatgccgcctccggagtctgcctcctttgggttgctttcttcgagtgtttcgtcatcgcctggatttatggaggggataatctctacgatggaatcgaggacatgattggataccggcctggaccttggatgaagtacagttgggctgtgataactccggttctgtgtgtgggctgtttcatattctcgctggtgaagtacgtgcccctcacatataacaagacttatgtgtatccaaattgggcaatcggtctcggctggagcctggcacttagtagtatgctttgtgtgcctctggtgattgtgatacgcctgtgtcagacagagggcccattcctggtgcgcgttaaatatctgttgactccaagagaacccaaccgatgggctgtggagagagaaggagcaacaccttataattctcggacagtgatgaatggtgccctggtcaagccaacccatatcatcgtggagacgatgatgtag

SEQ ID NO: 135585 - DNA, 603 bp, Artificial Sequence
  Description of Artificial Sequence: Synthetic coding sequence
atggcgacaaaggagaaattgcaatgtctcaaagattttcataaagacatcctgaaaccctccccaggtaagagtcctggcacaagaccagaagatgaggccgagggaaagcctccccagagggaaaagtggagctcaaagatcgacttcgtcctaagcgtggcaggaggattcgttggcctgggaaatgtgtggcgctttccatatctttgttacaagaatgggggtggagcattccttattccctactttatctttctgttcggctctggattgcccgtgttcttcttggaaattatcatcggacagtacaccagcgagggcggcatcacctgctgggagaaaatttgtccgctgttttcaggtatcgggtacgcgtcagtggtgatcgtcagcctactgaacgtgtactacattgtcattctggcatgggcaacctactatctgtttcagagcttccagaaagaactcccatgggctcattgtaatcattcatggaatacaccacactgcatggaagataccatgcgtaagaataagtctgtttggatcaccattagctctaccaactttacctctcccgtcatcgaattttgggagtag

SEQ ID NO: 135586 - DNA, 1080 bp, Artificial Sequence
  Description of Artificial Sequence: Synthetic coding sequence
atggcaactaaggaaaagctgcagtgcctcaaggatttccataaagacatactgaagcccagcccagggaagagccccggtacccgccctgaggacgaagcagagggcaaaccgcctcaacgggaaaagtggtcctcaaaaatcgactttgtgctgtcagtcgctggtgggttcgttggtttgggaaacgtctggcggttcccctatttatgttataagaatggcggcggagcttttctgattccctacttcattttcctgttcggctctgggctgcccgtgttttttctggagatcataattggacagtatactagcgagggcggtatcacatgttgggagaaaatctgcccactgttcagtggcattggatacgccagtgtggtcattgtctctctgttgaatgtatattatatagtcatcctagcctgggccacctactaccttttccagagcttccagaaggagcttccatgggcacactgcaaccacagctggaatacccctcattgtatggaggacaccatgcgaaaaaataagagtgtttggattacaatctccagcaccaactttacgtcccccgtcatcgaattttgggaaaggaacgtcctgagcttaagcccgggtatcgaccatccagggagtctgaaatgggaccttgcactttgtttgcttctggtctggctcgtgtgttttttctgtatctggaaaggggtgagatctacaggcaaagtagtgtactttacagccaccttccctttcgccatgctgctcgtcctgcttgtgcggggcctgacattaccaggtgcaggcgctgggattaagttctatctgtatccagatattactagactggaagatccccaggtctggattgatgccgggacccagatatttttttcatatgccatctgcctgggcgccatgacttccctcggcagctacaacaagtacaagtataacagctacagatcttggcctggactccactgccttcctaaaagttgcgacaatgacgcggcagcacatatccttgttcacagctttttctattacgccagcttggcttggaccgggtag

SEQ ID NO: 135587 - DNA, 330 bp, Artificial Sequence
  Description of Artificial Sequence: Synthetic coding sequence
atggccacaaaggaaaagctgcagtgtctgaaggactttcataaggatattctgaaaccttccccgggaaagtctcctggtacgcgccccgaagatgaagctgaaggaaagccgcctcagcgcgagaaatggtcttcaaagatcgactttgtgctgtccgtggctggaggatttgttggactgggaaacgtgtggagatttccatatttatgctacaagaacgggggaggcgcatttctaatcccatacttcatcttcttgtttgggagcggcctaccagtattcttcctggaaataatcatcgggcagtataccagcgaagggggttag

SEQ ID NO: 135588 - DNA, 1863 bp, Artificial Sequence
  Description of Artificial Sequence: Synthetic coding sequence
atggctacaaaggaaaaactgcagtgtttaaaagacttccataaagacattctgaagccaagtcccggcaaatccccaggtaccaggccagaggatgaagcagaggggaagcctcctcagcgcgagaagtggtcttcgaaaatcgatttcgtgctgtcagtagctggcggctttgtcggcctgggaaatgtgtggcgtttcccctatctgtgttacaagaacggaggaggggcctttcttattccttactttatcttcctcttcgggagcggactccccgtgtttttcctggaaataatcattggacagtacaccagcgagggcggtatcacgtgctgggagaagatctgccctctgttctctggcattggctatgcaagcgtcgtgatcgtttccttacttaatgtgtattatatagttattctggcctgggccacatattacctgtttcagagcttccaaaaagaacttccgtgggcgcactgtaatcacagctggaacactcctcattgcatggaggacacaatgcgaaagaacaaatcggtttggattacaatttctagtacaaatttcacctcccccgtgatcgaattctgggaacggaacgtattgagcctctcaccaggcatagaccatcctggctctctgaagtgggatttggccttgtgcctcctcctcgtctggctggtgtgctttttttgcatctggaagggcgtaaggtcgaccgggaaggtggtgtactttaccgcgacattcccttttgccatgctgctcgtcctcctggtacggggtcttactttgccgggtgccggggcaggtattaaattctacctctaccccgacattacgagattagaggaccctcaggtctggattgacgctgggacccagatctttttttcctatgccatatgcttgggagctatgacctctctcggctcttataacaaatacaaatataactcatatagagattgtatgctgttgggttgccttaattcgggaacatccttcgtctccggcttcgccatcttctccatcttgggcttcatggcacaagaacaaggcgtggatattgccgatgtggcagagtcagggcccggcctcgccttcattgcttatcccaaagctgttaccatgatgcccctcccaaccttttggagtatacttttttttataatgttactgttgctgggactggactcacagttcgtcgaggtggaaggacagatcacgtccctggtcgatctgtacccctctttcctgcgtaaaggttacagacgggaaatttttatcgctttcgtttgctccatatcatacctgctgggtctgaccatggttaccgaaggagggatgtatgtgttccagctatttgattactatgccgccagtggcgtgtgtctgctgtgggtggcattttttgagtgctttgtaattgcctggatctacggcggggataacctgtatgacggtatcgaagacatgattgggtatagacccggcccatggatgaagtattcttgggccgtgattacccctgtcctgtgcgtcggttgtttcatattttctctggtgaaatatgttcctctgacatacaacaagacctacgtatatcccaactgggcaatcgggctgggatggagcttggcactttcaagtatgctgtgtgtgcccctggtgatagtcatacgtctgtgtcaaacagaggggccattcctggtaagggtgaaatatctcctgaccccaagggaaccaaaccgatgggccgtcgaacgggaaggcgcaacaccttataatagtcgcacggtcatgaacggtgccttggtaaaacccacacatattatcgtggagactatgatgtag

SEQ ID NO: 135589 - DNA, 1080 bp, Artificial Sequence
  Description of Artificial Sequence: Synthetic coding sequence
atggccaccaaagagaagcttcaatgcctgaaggatttccataaggatatccttaagccgagtcccggaaagagtccaggcacccgccctgaggatgaagccgaagggaaaccaccccagcgggagaagtggagctctaaaatagatttcgtgctgagcgtggccggcggtttcgttggactgggcaatgtctggaggtttccctatttgtgctataagaacggaggcggtgcattcctgatcccatactttatctttctcttcggatccggactgccagttttttttctggaaattatcattggacagtatactagcgaaggcggaatcacttgctgggagaaaatatgccctctttttagcgggattggctatgcgtccgtggtcattgtttctctactgaacgtgtactacatagtcattctcgcatgggcaacctattacctcttccagtctttccagaaagaattaccatgggcccattgtaatcactcctggaacactcctcactgtatggaagataccatgcggaagaacaaatccgtctggatcaccatctcctctaccaactttacatccccggttatcgagttttgggagcgcaacgtcctcagcctgtcccctggaatcgaccaccccggctctctgaaatgggacctggctctgtgtcttctcctcgtctggttggtctgtttcttctgcatctggaagggtgtgaggtccacgggaaaagtggtttactttaccgctaccttcccctttgcaatgttattagttcttttagtgagggggctgaccctgcctggggccggcgccggcataaaattctacctctatcctgatatcactagacttgaggatccgcaggtctggatcgatgccggaacgcaaatcttcttcagttatgctatctgcttgggcgccatgacctcactcggcagttataataaatacaagtataactcataccgctcatggccaggcctgcactgcctccctaagtcctgtgacaacgatgcggctgctcatatccttgtccatagcttcttttactacgcctcacttgcctggaccggctag

SEQ ID NO: 135590 - DNA, 1905 bp, Artificial Sequence
  Description of Artificial Sequence: Synthetic coding sequence
atggtgcgcctggtgctcccaaatcctggtcttgatgcacgcatcccctctctagccgagctggagacgatcgagcaagaagaagcctcgagcaggcctaaatgggacaacaaggcgcaatacatgttgacatgcctgggtttttgtgtaggcctcggtaacgtctggcgctttccttacctgtgtcagagtcatggcgggggggcctttatgataccttttctgattctcttagtgctggaaggaattccactgctgtacctggaatttgctatcgggcagaggcttaggcgcggatcactcggggtgtggtcaagcattcaccccgcactgaagggtctggggcttgcctccatgctgaccagcttcatggtaggactgtactataacaccatcatctcttggattatgtggtaccttttcaacagtttccaggaaccgttgccttggtctgactgcccgttgaatgagaaccaaactggttatgttgacgagtgcgccaggtcctcaccggtcgattacttttggtatagggagacccttaatatcagtacaagcatctctgacagcggcagcattcaatggtggatgctgctttgcctcgcatgcgcctggtctgtattgtatatgtgtaccatcaggggaattgaaacgaccggtaaggcggtgtacattacgagcacccttccctatgtagtccttaccatcttcctcatccgaggactaaccttaaaaggcgccaccaatggcatcgttttcttgttcacaccaaatgtgactgagttagcccagccagatacctggttggacgcaggggctcaggtgttcttctcatttagcctggcattcgggggtcttatctccttcagttcctacaatagcgtccataacaactgcgaaaaagattccgttatcgtcagtatcattaacgggttcacgtccgtttacgtggccatagtggtgtactcagtcataggcttcagagccacacagcggtacgacgattgttttagcaccaacattctgacactgattaatggctttgacctccccgaggggaacgtgacccaggaaaacttcgtggacatgcagcagaggtgcaatgctagcgaccccgccgcctacgcccagctcgtgtttcagacgtgcgacattaacgcctttctttcagaggctgtggaagggacagggctcgcattcatcgttttcaccgaagccatcacaaagatgcctctctcaccactgtggtctgttctgttcttcattatgttattttgtctcggactttcgtccatgttcggaaacatggaaggagtggtcgtgccactccaagatctgagagttattccaccgaagtggccaaaagaggtcctcaccggactcatatgtctcggaacattcctgataggctttatcttcacgttgaatagtggacagtactggctcagcctgttggacagttatgcaggcagtatcccattacttattatagcattttgcgaaatgttttcggtcgtgtatgtgtatggagtggatcgattcaataaagacattgagttcatgattgggcataagcccaatattttctggcaggtgacctggcgggtcgtttccccactcctaatgcttattatttttctgtttttttttgtcgttgaggtttcacaggaactgacatattcaatctgggaccctggctacgaggagtttccgaagtcccagaagatctcatacccaaattgggtttacgttgttgtcgtgatagtggccggtgtacctagcttgactataccggggtatgccatctataaactcattaggaaccactgccagaaaccgggcgaccaccagggactggttagcaccctgtccactgccagtatgaacggggacctgaagtactag

SEQ ID NO: 135591 - DNA, 1668 bp, Artificial Sequence
  Description of Artificial Sequence: Synthetic coding sequence
atggagaaagctagacccctgtgggctaatagcctccagttcgttttcgcctgcatctcctatgccgttggcctggggaatgtgtggcggttcccctatctttgccagatgtacggcgggggcagcttcctcgtcccctatattatcatgctaatcgtcgaggggatgccgctgctgtacctggagttggcagtcggccagcggatgcgccagggctctattggagcctggagaaccatctcgccatacctttctggcgtcggtgtggcctcagtggtggtctcttttttcctctccatgtactacaatgtcatcaatgcatgggccttttggtatctgttccattccttccaggatcccctgccctggagcgtgtgtcccctgaacggcaatcacactgggtacgacgaagaatgtgaaaaagcttcctccacccagtacttttggtatcggaaaactctcaatatctccccctctcttcaagagaatggcggggttcagtgggagcctgcgctgtgtctcctgctggcctggctagttgtatatctctgtattctccgaggcactgaatccacaggcaagatcgaacagctggccaacccaaaggcatggattaatgccgccactcaaatctttttctcgctgggtctgggatttggctccctcattgctttcgcgagttacaacgagcctagcaataactgccaaaaacacgccatcatcgtgagcctcataaattcctttacatcaatttttgcttccatcgtgacattttcaatttacgggtttaaagcgacattcaattatgagaattgcctcaaaaaagtaagcctgctactgaccaatactttcgatctggaggatggctttctgacagcttccaacctagagcaagttaagggctacctggcctccgcctatccaagcaaatacagcgagatgtttcctcagataaagaattgttccctggaatcagagctggataccgcggttcaaggtacaggtctggcctttattgtttacactgaggccatcaagaatatggaggtctctcagttgtggtctgtgctctatttctttatgcttcttatgctgggcataggaagtatgttgggcaatactgcagctattctcacaccgctcactgactccaaaatcattagtagtcacctccctaaagaagcgatcagtgggctagtatgcctggttaattgcgctattggcatggtttttaccatggaggccggaaattattggttcgatattttcaacgattacgcggctactctctccctcctcctcatagtgttggtggaaaccatcgctgtctgttacgtgtatgggttgagacggttcgaatccgacctcaaggccatgactggaagggctgttagctggtactggaaagttatgtgggccggagtttcgcctctgttgattgtctctctgtttgtgttttacctgtccgactacattctgacaggcactctcaagtaccaagcctgggatgccagtcaaggccagttagtcactaaggactatcccgcctatgctctggctgtgattggcttgctggtggccagcagtaccatgtgtattcccctggccgcccttgggacctttgtccaaagacggctcaagaggggagacgcagatcctgttgcttag

SEQ ID NO: 135592 - DNA, 1779 bp, Artificial Sequence
  Description of Artificial Sequence: Synthetic coding sequence
atggaaaaagcccgccctctgtgggcaaattcattacaattcgtcttcgcatgcatttcttacgccgtaggcctgggaaatgtgtggcgttttccatacttgtgccaaatgtatggcggtggtagcttcctcgtgccctatatcatcatgttaatcgtggaaggaatgccccttctttacttggagctcgcggttgggcaacggatgaggcagggtagcattggcgcttggcgaacaatcagcccctacctgtcaggcgtgggagtggcctcggtggtcgtgagtttctttctgtccatgtactataatgtcatcaatgcttgggcattctggtacctattccattcatttcaggaccctctgccttggtccgtatgcccactgaatggaaatcacacaggttacgatgaggagtgcgaaaaagcttcttccactcaatacttttggtatagaaagaccctgaatataagtccgtctctacaagaaaacgggggtgtccagtgggaaccagcattgtgcctactcctggcttggctggttgtgtacttgtgtattcttcggggtaccgaatccacgggaaaggttgtctatttcacagcttctctcccgtactgcgtgcttatcatttacctgattagggggctgaccttacacggtgcgacaaatggcctgatgtacatgtttacaccaaagatcgagcagctggctaatcccaaggcctggatcaacgccgccacacagatcttcttcagcctggggctgggcttcggatcccttatcgcatttgctagctataatgagccatccaataattgtcagaaacacgctattattgtatcactcatcaattctttcactagcattttcgcctcgatagtgactttctcgatctatgggttcaaagcaacatttaactacgagaactgcctgaagaaggtgagtctgctcctcactaatacctttgatctggaagacgggtttttgacggcctctaacctcgaacaggtgaaaggctacctggcttccgcttacccaagtaagtattctgagatgttccctcaaatcaagaactgttctctagagtctgagttggacactgccgttcaggggactggattggcatttatcgtatatacggaagctatcaagaatatggaggtgtcccaactgtggagtgtcctgtattttttcatgcttctgatgctcggaatcggttctatgctcggcaatactgccgcaattcttacacccctcactgacagtaaaataatctcaagtcacctgccgaaggaggccatctccgggcttgtctgccttgtgaactgcgccatcggtatggtgttcactatggaggccggaaactactggttcgacattttcaatgactatgctgcaacactctcgctgctgctgatagtgctcgttgaaaccatcgcggtctgctacgtttacggcctgaggcgattcgaatcagacttaaaggcaatgaccgggagggccgtgtcctggtactggaaggtcatgtgggcaggtgttagtcccctgctcattgtctctctgttcgtcttttatctttctgattatattctgacaggcactctgaagtaccaggcttgggatgccagccagggtcaactggtgaccaaagactaccccgcctatgccctggcagtaattggactacttgtcgcctcttcaacaatgtgtatccccttggctgccttgggcactttcgtccagagaagattgaaaaggggcgatgccgacccagtcgcttag

SEQ ID NO: 135593 - DNA, 1644 bp, Artificial Sequence
  Description of Artificial Sequence: Synthetic coding sequence
atggagaaggcaaggcctctgtgggccaattcactgcaatttgtgtttgcttgtatctcttatgcagtcgggctcggaaacgtgtggcgttttccttatctgtgccaaatgtatggcggtggctcttttttggtgccttacattataatgctgatcgtggaaggtatgccactgctgtacctggaactcgctgtcgggcagagaatgaggcagggtagcatcggagcctggcgcactatctccccttatctgtctggcgtaggagtggcaagtgtggtcgtgagcttcttcctatctatgtactacaacgtgatcaatgcgtgggcattctggtatctcttccattctttccaagatccattgccctggtccgtgtgtccgctgaacggtaatcacactggctatgatgaagaatgtgagaaagcctccagcacccaatacttctggtaccggaagacactcaacatcagtccatctctccaggagaatggcggagtgcagtgggaacctgctctctgcctactgctggcctggctggtggtgtatttatgcatcctgcgcggcaccgaaagcaccgggaaggtggtgtattttaccgcatctttgccttactgtgtgttgatcatttaccttataagagggctcacactacatggtgcaaccaacgggctgatgtatatgtttactcccaagatcgaacaactggcgaaccctaaggcgtggatcaatgccgccactcagatcttcttttctctcggcctcgggtttggctcactgatcgcattcgcctcctacaacgaacctagcaacaattgtcaaaagcatgcgataatagttagcctgatcaacagcttcacctccatctttgcctcaattgtgacatttagcatctacggcttcaaggccacattcaattatgagaactgcctgaagaaggttagcctgctcctcactaatacctttgacctggaggacgggttcttgacggcctctaatctcgagcaggtcaagggatacctggcaagcgcataccctagcaagtattccgagatgtttcctcagattaagaattgctcactggagagcgagctggacactgcagtccagggcacggggctggcgttcatcgtttacacagaggcaattaagaacatggaggtcagccagctgtggtcagtcctgtatttctttatgctgctgatgctggggattgggagcatgttaggcaacaccgctgccatcctgactcccttaacagacagtaagataatttcttcccacctccctaaggaggctataagcggacttgtttgtctggtgaattgtgctattggtatggtctttaccatggaagccgggaattattggtttgatatcttcaacgattacgccgccaccctcagccttctgctgattgtcttagtcgagaccattgccgtgtgctatgtgtacgggctccggcgattcgaaagcgatttgaaggccatgacggggagagcggtaagctggtactggaaggtaatgtgggccggcgtcagccctctactcatagtaagcctattcgttttttacctgtcagattacattttaaccggaacacttaagtaccaggcatgggatgcatcccaggacgacaaattgtag

SEQ ID NO: 135594 - DNA, 1194 bp, Artificial Sequence
  Description of Artificial Sequence: Synthetic coding sequence
atggcccacgctcccgagcctgacccagccgcatgcgacctgggagatgaaagaccaaaatgggataataaggcccagtaccttctgagttgtacagggtttgcggtcggccttggaaacatatggcgcttcccttacctttgccaaacatacggaggaggagctttcctgatcccctacgtaatcgctctggtttttgagggcatacccattttccacgtcgaactggccatcggacagaggctcagaaaggggtcggtgggcgtgtggactgcgatatcaccttatctttcgggcgtgggattgggatgcgtcacgctatcctttctgatttctttgtactacaacacaatcgtggcctgggtcctatggtacctgttgaattcttttcagcaccctctgccctggtcatcctgtcctccagatctcaacaggaccggtttcgtcgaagagtgtcagggatccagcgccgttagctacttttggtacaggcagaccttaaacattacagctgacatcaatgactctggttccatccagtggtggctgctaatatgccttgcagcttcctgggctgttgtttatatgtgcgtgattcggggaattgagacaaccggaaaggtgatttacttcaccgcattgtttccatatctggtgctgactatattcctgatccgagggcttacgctcccaggcgctacgaaaggtctgatatatctgttcaccccaaacaatccccgagtctggttagatgccgctacccagatctttttctccttatcgctggcctttggcgggcatatcgcttttgccagctataattcacccagaaacgattgccagaaagatgctgtcgtcatcgcactggtgaaccgtatgaccagtttgtatgctagtatcgcggtgttttcagttctcggcgcaagtgggcctggcctggcattcgttgtattcacggaaactgaccttcacatgccgggcgctcccgtgtgggccatgctgttcttcggtatgctcttcacgttggggctgagcactatgtttgggacggtcgaggctgtgatcacccccctcctggactctgggaactactggttagaaatctttgacaatttcgctgcttccccgaaccttttgatgctcgcattccttgaggtggttggggtcgtgtacgtatacggcatgaagcgttag

SEQ ID NO: 135595 - DNA, 1887 bp, Artificial Sequence
  Description of Artificial Sequence: Synthetic coding sequence
atggcccatgcccctgagcctgaccccgcagcctgcgatttgggtgacgagcggcctaaatgggataataaggctcaatacctgctgtcttgcactggcttcgccgtagggttaggcaacatttggagattcccatatctgtgccaaacctacggcggcggcgcatttctgattccctacgtgatagcacttgtatttgaaggcatccctatatttcacgtcgagttggcaatcggccaaagattgcgaaaaggctccgtaggggtctggactgccatttccccctacctgtcaggcgtgggactcggctgtgtaactctctcgttccttataagcctgtactacaatacaatcgtcgcatgggtcctctggtacttgttaaactcttttcaacaccctttaccttggtcttcttgtcctcctgatctcaaccgcacgggctttgtggaagagtgccagggatctagtgcagtgtcatatttctggtataggcagaccctgaatattaccgcagatattaatgactcggggtccatccagtggtggttgctaatatgtctcgctgcatcatgggcagtggtgtacatgtgtgtgatccgaggtatagagacgactggaaaagtgatctactttacagccctgtttccttacctcgtcctcacgatctttttgattagaggtctgacactgcctggcgcaaccaagggcctcatatatcttttcactcccaatatgcacatacttcagaaccctcgggtctggctggacgctgccactcagatcttttttagcctgagcttagcttttgggggacacattgcttttgctagctataactcgcctaggaacgattgccaaaaggacgcggtggtcatcgccttggtgaacaggatgacatcattatatgccagcatcgccgtgttttctgtgctcgggttcaaagctactaacgattatgagcattgtcttgacagaaatatactgtccctgattaacgacttcgatttcccagagcagtccatctctagagatgactatcctgccgtattgatgcatttgaatgccacatggccgaagagggtggctcagttgcccctcaaggcatgcctgctcgaggattttctggataagagcgcgtcaggcccgggcttagccttcgtggtgttcaccgagacagatttgcacatgccaggggctcccgtttgggcaatgctgttcttcgggatgcttttcaccttgggcctctcaaccatgttcggcactgtggaagctgtgatcacaccccttctggacgtgggagtcctgccgcgctgggtgccaaaggaagcgctgacagggctggtgtgcttagtatgtttcctgtccgccacatgttttaccctgcaatctggtaattattggttggagatcttcgacaatttcgctgctagccctaacctgctgatgttagcatttctggaagtcgttggggttgtttacgtttatggcatgaagcgcttttgtgatgatatcgcgtggatgaccggtcggaggccatctccatactggcggctgacctggagggtggtaagtccgctccttttgacaatctttgtggcgtatataatacttctgttttggaaacccctgcgctacaaagcttggaatcccaagtacgagctcttcccaagtcgacaggagaaactgtacccaggttgggctcgcgccgcttgcgtcctgctttcactcctcccagtgctgtgggtgcctgttgcagccctcgcacaactgctaacaagaaggcgtcgcacctggcgagaccgggacgcacgtcccgatacagacatgaggcctgatacggacactcggcctgatacggacatgaggcccgataccgatatgaggtag

SEQ ID NO: 135596 - DNA, 1548 bp, Artificial Sequence
  Description of Artificial Sequence: Synthetic coding sequence
atggaggccagggagcctggacggcctacccctacctaccacctggtccccaacacaagccagtcgcaggtggaagaggacgtgagctcacccccacagagatcgagtgagacaatgcagctgaaaaaagagatttccctgctgaatggggtgtctctggtcgtaggaaacatgatcgggtccgggattttcgtgtcgcctaagggcgtcctggttcacaccgcctcctacggaatgtctttgatcgtttgggcaatcggcggactgttctcagtggtcggtgctctttgctacgccgaacttggtaccaccatcactaagtcaggggcatcatacgcatatatactggaggcttttgggggctttattgctttcattaggctgtgggtttcactgctcgtagtcgaacccaccggacaggctataattgcaatcacctttgcaaattacattatccaacctagcttcccctcctgcgacccaccgtatctggcctgcagactacttgctgccgcctgcatttgtcttctcacctttgtgaattgtgcgtacgtgaaatggggcacccgggtccaagatacattcacgtacgccaaggtggtggctttaatcgccattatcgttatgggtctcgtgaagctgtgccaaggacatagtgagcacttccaggatgcgttcgaaggctcttcctgggacatgggcaacctcagcctggctctgtactccgcactgttcagttattcaggatgggacacactgaactttgtgaccgaggaaatcaaaaatcccgagaggaacttacccctggcaattggtataagcatgccaatcgtcactctgatttacattctaacaaatgttgcctactacactgtgctgaatattagtgacgtattaagttcagatgctgtggccgtgacgtttgccgatcagactttcgggatgtttagttggaccatcccgatagcggtcgccctgtcttgcttcggcgggctcaacgccagcatattcgcctcctccagattgttcttcgtcggcagtcgagaaggccacctgcccgatctactcagcatgattcatattgaacgtttcactcccatccctgctcttctgtttaactgcacaatggcactcatttacctgatcgttgaggacgtgtttcagctaatcaattacttttccttctcttattggttctttgtgggtctgagcgtggttggccagttgtacctgcgctggaaagaacccaagcgtcctagacctctcaagctctctgtcttctttcccatcgttttctgcatttgctcggtgtttctggttattgtccccctttttacggataccattaactccctaatcgggattgggatcgcacttagtggcgtccctttttattttatgggggtatacctcccagaatcacggcgcccgcttttcattaggaatgttctggccgccattactaggggcacccagcaattatgcttctgcgtattaaccgaactcgatgtagcagaagaaaagaaggacgagaggaaaactgactag

SEQ ID NO: 135597 - DNA, 1524 bp, Artificial Sequence
  Description of Artificial Sequence: Synthetic coding sequence
atggctggcgcaggcccaaaacggcgggctctcgccgcccccgcggcggaagaaaaggaagaggctcgcgagaagatgctggctgcgaagtcagcggacgggtcagctccagcaggagagggtgagggcgtgactcttcagcggaacattactttattaaacggagtggcaatcattgtcggcaccatcatagggtctggtatcttcgtgactccaactggcgtcctcaaggaagcagggtcccctggtctcgctctggtagtttgggccgcttgtggggtgttctctatcgtcggcgcgctgtgctacgccgaactcgggacaaccatatccaagtccggcggggactacgcgtatatgttagaggtgtatggctctttacccgctttcctgaaactgtggatcgagctgctgatcatccggccctcctcccagtatattgttgcattagtattcgcaacatatctgttgaagcctctcttccccacatgtccagtacccgaggaggccgccaaacttgtggcttgcctttgcgtacttctgcttacggccgtgaattgctattccgtgaaggctgctacacgcgtccaggatgcctttgctgcggctaaactgctcgcccttgccttaatcattctgctcggatttgtgcagatagggaagggggacgtctctaacctcgatccaaacttcagtttcgaggggaccaaacttgatgtgggtaacatcgtgttggccctgtattcaggattgttcgcctatgggggatggaattatctcaatttcgtgacagaagaaatgatcaacccctatcggaatctaccactcgcgatcatcattagtcttcccatcgtcacacttgtgtatgtgctgactaacctggcctattttacaacgcttagcaccgaacagatgctgtcttccgaggcagtggctgtggattttggcaattatcacctgggcgtgatgagttggatcatcccagttttcgtcggactcagctgttttgggtccgtcaacggttctctgtttaccagttcaagattgttcttcgtgggaagcagagagggccacctacccagtatactctcaatgattcatccgcaattattgaccccagtaccaagtctggtgtttacgtgcgtgatgacattactttacgccttttccaaagatatctttagtgtgatcaactttttttctttctttaattggctttgcgttgcactggctatcatcggcatgatttggcttagacaccgaaagcctgagctggaaagacccataaaagttaatctggctctgcctgtgttctttattctcgcgtgcctcttcttgattgccgtttcattttggaaaacgcctgttgagtgtggaattggctttacaatcatcctcagcggactccccgtctacttcttcggtgtgtggtggaagaacaagccaaagtggttgttgcaaggtatcttttctactacagtcctgtgccaaaagctgatgcaggtcgtgccgcaagagacttag

SEQ ID NO: 135598 - DNA, 846 bp, Artificial Sequence
  Description of Artificial Sequence: Synthetic coding sequence
atgtcccacggaacatactacgaatgcgagcctcgagggggtcaacagcctctcgaattcagtggcggacgcgcgggaccaggagaactgggcgatatgtgcgagcatgaggcttcaattgacctgagcgcttatattgaatcgggggaggagcagctgctatctgacctgttcgccgtgaaaccagcccctgaggcacggggcctcaagggaccgggcacacctgcctttccacactatcttcctccagacccacggcccttcgcctacccccctcatacttttggacctgacaggaaggccctggggcccgggatatactcaagccccggcagttacgacccccgggctgtcgcggtgaaagaggagcctaggggtcctgaaggcagtcgggctgcttcgcgtggatcatacaatccactccagtatcaagtcgcccactgcggccagaccgctatgcatctacctcctacactggccgcccctggacagccactcagagtcctcaaggcccctctggccacagcagctcccccatgcagcccattgctcaaggcacctagccccgccggaccactgcacaaagggaagaaagctgttaataaagatagtcttgagtaccgcctcaggcgagagaggaataatattgctgtgcggaagtctagagacaaggccaaaaggaggattctggaaacgcagcaaaaagttttagagtacatggccgagaacgaacggctgcgaagccgtgtagaacagttgacccaggaactggacactctgcgcaacctttttagacagatcccagaggccgccaacctgattaagggagtgggcggatgcagctag

SEQ ID NO: 135599 - DNA, 1608 bp, Artificial Sequence
  Description of Artificial Sequence: Synthetic coding sequence
atggaggaaggtgcccggcatcgcaataacacagaaaagaaacaccccgggggcggcgagagcgatgcttctcccgaagccgggagcggaggcggcggtgttgctctgaagaaggaaatcggcctggtatcagcatgtggaatcatcgtggggaatattatcggaagtggaatctttgtgtcgcccaagggtgtgcttgaaaatgccggtagcgttggcctggctttgatcgtgtggatcgtgacaggctttatcacagtcgtgggagctttatgttacgccgagcttggagtcaccatccctaagtctggcggtgattacagctacgtgaaagacatttttggtggactcgccggatttctgcgactgtggattgccgtgcttgtgatttaccccacaaaccaggccgtcatcgctctgactttcagcaattatgtcctccagcctctcttccccacttgttttccaccagagtccgggctgcgcttgctagccgccatttgcctacttctcctgacatgggttaactgcagctctgtgcgctgggccacccgtgttcaggacattttcacagcagggaaactcctggccttggctctgataattataatgggcattgtccagatctgtaagggagagtacttttggctagagcctaagaatgctttcgaaaattttcaggaacccgacattgggctggtagcccttgcattcctgcagggcagttttgcctacgggggttggaacttcctgaactatgtgacagaggagctcgtggacccatataaaaacctgcctagagccatctttatctctatccctctggtcaccttcgtctacgtattcgccaacgtagcgtacgtgacagctatgtctccacaagaactgctggcaagcaatgccgtggcagtcaccttcggagaaaagctgttaggggtgatggcgtggatcatgccaatcagtgtggcactctccaccttcggcggtgtcaatggttctctgtttacctctagccggttgttcttcgcaggagcgcgcgagggtcatctaccaagtgtcctggcaatgattcacgtcaaacgctgtaccccaatccccgccctgctctttacctgcatctctactctgctgatgcttgtcacatctgacatgtatacattgatcaactatgttgggttcatcaactacctgttttatggagtgaccgtcgcgggtcagatagtgctgcgctggaaaaagccagatattcctcgacctataaagatcaatttgctgttcccaattatctacctgctgttctgggccttcttgttggtattttccctttggtccgaaccagttgtttgcggaattggcttggcaataatgttaaccggagtgccagtgtattttctgggcgtgtactggcagcacaaacccaaatgcttttccgatttcatcgagcttctgacactcgtgtctcagaaaatgtgtgtggttgtatatccggaggtggaacgggggtctggcactgaggaggccaatgaggatatggaagagcagcagcagcccatgtatcaacctaccccgaccaaagataaggacgtagctggccagccccagccatag

SEQ ID NO: 135600 - DNA, 633 bp, Artificial Sequence
  Description of Artificial Sequence: Synthetic coding sequence
atggggatcgttcagatttgcaagggagagtacttctggcttgagccaaaaaacgcattcgaaaacttccaggaacctgacatcggccttgtggcgcttgcctttctacagggcagtttcgcatatggcggctggaattttctcaactatgtgacagaggagctggttgatccgtacaagaatctgcctagggctattttcatctctatccctctagtgacgtttgtttatgtcttcgctaacgtggcatacgtgaccgctatgtcaccccaggaactcctcgccagtaatgccgtcgccgtcaccttcggcgagaaacttttgggagtgatggcctggataatgccaatctccgtggcgctgagtacattcggaggggtgaatggttcgctccacctgctgagcgctgttctacgttggtcaccaagaggaccaccttctcaatgcgtggggcatgatccccgggaggctttgcatcccaacccatctcctgcccttcatatgcacctgcacccggccgacgccggccaccagcgccacgtccacacccaccagctttgtgggctgcatcagctccccctcctttgggggcacggatgttggacagattccccatcattggaagaagcatag

SEQ ID NO: 135601 - DNA, 693 bp, Artificial Sequence
  Description of Artificial Sequence: Synthetic coding sequence
taatgtctccaggaacacagtcagccctcacagctcctgtgtacattgctgttatgttggtgcgtcctggggcgtgagcgccccttccgtaaggcccagtctacatcttcgcctctggagggagtccccaggtttttgaagcgcttgctcttgacttgggtcaattgcagttctgtccgctgggcaactcgcgtacaagacatcttcaccgccgggaagctcttagctttagcgctgatcattataatgggcatcgtacaaatctgcaagggcgagtatttctggttggagcccaagaatgcatttgagaatttccaggagccagatattggactggtggccttggcctttctgcaaggcagctttgcctacgggggctggaacttccttaactacgtcacggaggagttggtggatccatataagctgttttttgccggagctcgagaaggccacctgcccagcgtccttgctatgatccatgtcaagcgctgtacacccatccccgcacttctgtttacctgtatcagcaccctgctcatgctcgttacatctgatatgtatacattgataaactatgtcgggttcattaactaccttttttatggagttaccgttgctgggcagatagtcctgaggtggaaaaaaccagatatccccagacccatcaagccactgccctaccagggatag

SEQ ID NO: 135602 - DNA, 936 bp, Artificial Sequence
  Description of Artificial Sequence: Synthetic coding sequence
atgggtcaactgtttcaatgcgcggtgggacatcctggttcacgtcatctccacagctgggaggccccagggttgggccctgattatcaccatggagattgcaccgatatgcagcggaatcttccccgcgctattttcatcagtatacccctcgtgacattcgtgtatgtgtttgcaaacgtggcctatgtgacagcaatgtcccctcaggagcttctggcctccaacgcagtggctgtgaccttcggagaaaagctactcggcgtaatggcctggattatgccgatttccgtggcattaagtacttttggcggggttaatggctctctgtttacttcaagcagacttttttttgccggggcacgggagggccacctgccgagcgtcctcgccatgatacatgttaaaaggtgcactcctattcccgcgctgctctttacatgtatctctacattgctgatgcttgtcaccagcgacatgtacactttaataaactacgtcgggtttataaactatctcttctatggtgtgaccgtagcaggccagattgttttacgctggaagaagcccgatatccccagaccaatcaagataaacctcctctttcccataatctacctgctcttctgggcctttctgctggtgttcagcttgtggagtgagccagttgtctgcggtatagggcttgccatcatgttgacgggtgtcccggtttatttcctgggggtgtattggcaacacaagccaaagtgcttttcagatttcatcgagctgctcacactggtctcgcagaaaatgtgtgtggtcgtgtatcctgaggtggaaagaggaagcgggacagaggaggctaacgaggatatggaagaacagcagcaacccatgtaccagccgacccctacaaaagacaaggacgtagcaggacagccccaaccctag

SEQ ID NO: 135603 - DNA, 999 bp, Artificial Sequence
  Description of Artificial Sequence: Synthetic coding sequence
atgggcattgtgcagatatgtaagggcgaatacttttggttggagcccaagaacgcttttgagaactttcaggagccagacattggactggtcgctttagctttcctccagggcagtttcgcttacggggggtggaacttcctcaattacgtgaccgaggaactggtcgacccgtataagaaccttcccagagccatttttatttccattcctctggtcacttttgtgtacgtgttcgctaatgtggcttacgtgaccgcaatgtccccgcaagagctcctcgccagcaacgccgtcgcagttacctttggagagaagctgctaggagtaatggcctggatcatgcccatctcagtggctctgtctacttttggaggggtgaatggtagtctctttacgtcttcgcggctgttctttgcaggcgcccgggaagggcatctccccagtgtcttagccatgattcatgttaaacgctgtacccctatccctgcccttctgtttacctgcatcagcacccttctcatgttggtgacatcagacatgtatacactcataaactacgtgggcttcatcaactacctcttctatggcgttactgttgcaggccagatcgtattgcgctggaagaaacctgacataccaagacctatcaagataaatctgttgttcccaataatctacctgttgttttgggcctttttgcttgtgtttagcctgtggtcagagccagtagtgtgcggaattggcctggccatcatgctcaccggagtacccgtgtatttcctcggagtttactggcaacacaaacccaagtgcttcagtgacttcatagagctgttgactttagtgtcgcaaaaaatgtgtgtcgtcgtgtatccagaggtcgaacgcggttcaggaaccgaggaggctaacgaggacatggaagagcagcagcagcctatgtatcagccgacacctaccaaggacaaggacgtggctggacagccccagccgtag

SEQ ID NO: 135604 - DNA, 285 bp, Artificial Sequence
  Description of Artificial Sequence: Synthetic coding sequence
atggaagagggagcgagacatagaaacaatactgagaaaaaacaccccggtgggggggaaagcgacgctagtcccgaggcaggctccgggggcggtggtgtggccctgaagaaagagatcggccttgtcagcgcctgcggcataattgtgggaaacattattgggtccggcatatttgtgtcaccaaagggcgtgttggagaacgccggctctgttgggctggctttgatcgtctggatcgtgacaggcttcatcacagtcgttggagccctctgctacgcatag

SEQ ID NO: 135605 - DNA, 237 bp, Artificial Sequence
  Description of Artificial Sequence: Synthetic coding sequence
atggaggagggcgcacggcaccggaataataccgagaagaaacatcccggaggaggggaaagtgacgctagcccagaagcagggtcaggaggcggtggcgtcgccctaaagaaagaaataggcctggtgtcagcctgcggtatcattgtggggaatattatcgggtccggaatcttcgtcagccctaagggtgtccttgaaaacgctggatcggttgggctcgcactaattgtctag

SEQ ID NO: 135606 - DNA, 1293 bp, Artificial Sequence
  Description of Artificial Sequence: Synthetic coding sequence
atgggtcagtatggccaggagcttagctggaagtgcctagtgaaagcagtttgtttgcaggagcattcacagccatctcagttgctgtgcactctgctgctctgttggtgcgtactgggaagagagaggccttttagaaaggcacaatctactagttcccctctggagggcgtgcctcgatttctaaaacgcctactcctgacatgggtcaattgttcatccgtgcgttgggcaaccagagttcaggatatctttactgcaggcaaactcttggcactcgccctgattatcattatgggcattgtgcagatctgcaaaggagagtacttctggctggaacccaaaaacgcctttgagaattttcaggaaccggatattggtctagtggcattggcgttcctccaggggtcctttgcttacggcggttggaactttctgaactatgtaacagaagaattagtggatccttataagaacctgccccgagctatcttcattagcatccccctcgtcactttcgtgtatgtgttcgccaacgtggcctatgtgaccgctatgtcaccacaggagcttctggcatcaaacgcagtggccgtgacttttggtgagaaactcctgggcgttatggcatggatcatgcccatcagcgtggctctttctacattcggaggcgttaacgggtccctatttaccagtagtcggctgttcttcgccggagcgcgcgagggccacctgccatcagtcttagccatgattcacgtgaaaaggtgcacccccatccctgccctgttgtttacatgcatttctacgctcctcatgctcgtgacaagcgatatgtacactctgatcaactatgtcggctttattaactacctattttatggtgtgacagtcgccggccagatcgtgctacggtggaagaagcccgacatacctaggccgatcaagatcaacctcttgttcccaatcatctacctcctattctgggcttttctattagtattctccctatggagcgagcctgtggtgtgcggcatcgggttggctattatgttgacgggtgtgccggtgtacttcttgggcgtttactggcagcacaaacccaaatgctttagcgatttcattgaactcctcactttggtcagccagaaaatgtgcgtagtggtttaccctgaagtagaacgcggaagcggcaccgaggaggctaacgaagacatggaagaacagcaacagccaatgtaccagcccactccaacaaaagacaaggacgttgccgggcagcctcagccatag

SEQ ID NO: 135607 - DNA, 1968 bp, Artificial Sequence
  Description of Artificial Sequence: Synthetic coding sequence
atggtgctgtacactacccctttccctaatagctgcctgtctgcactgcactgtgtatcatgggccctgatcttcccgtgctattggttggttgataggctggcagcgtcctttattcccactacctacgaaaagcgacagcgggccgacgacccctgctgtttgcaattgctctgtactgccctgttcaccccaatctacctggccctgctagtcgcttcactgcctttcgccttcctcgggtttttgttttggagcccgctgcagtccgctaggcgcccatacatctatagtaggctcgaagataaaggcctggctgggggagctgctttattaagcgagtggaagggtacggggcctggcaagagtttttgcttcgcgacggcaaatgtgtgtctgcttccggactccctcgcccgggttaacaacctctttaatactcaggctagggccaaggaaattggccagcgcatccgtaacggtgccgctcgccctcaaataaagatctatatcgattctccaacaaatacgtccatcagcgctgcctcctttagctcattagtgtctccacaggggggcgatggtgtcgcacgcgccgtgcctggctctatcaaacggactgccagtgtagagtacaagggagatggaggacgacaccctggtgatgaggctgctaatggacccgcgtcaggagatcctgtagactccagctcccccgaggatgcctgtatcgttaggatcggaggcgaggagggcggcagaccacctgaggcagacgacccagtccccggcgggcaggcacgcaatggagctggtggtgggccccgcgggcaaacacccaaccataatcagcaggacggcgacagtggaagtcttggatcaccctcggcttctagggaaagcctagtcaaggggcgggcagggccggacacatcagcaagcggcgaacctggagctaacagtaaactcctgtataaagcaagcgtcgtaaagaaggcagcggcacggcggaggcgccaccccgacgaggcattcgaccatgaggtgtccgcatttttcccagcaaacctggactttctgtgtttgcaagaggtgttcgacaagagggccgccacaaagctgaaggaacagctgcacggctattttgagtatatcctctatgatgttggagtatacggctgtcagggatgttgttcctttaaatgtcttaattccggcctcttatttgcctcaagatatccgatcatggatgtcgcataccattgctatccgaataagtgcaacgatgacgcattggcctctaagggcgctctgttcctcaaagtccaggtgggatcaacccctcaggatcagcgcatcgtagggtacatcgcgtgcacacatctccacgctcctcaggaggactctgcaattcgatgtggacagctcgatttgttgcaggattggctggccgacttcaggaaaagcacttcgtcttcaagtgctgccaatcctgaggagctggtagcatttgacgtggtgtgcggcgactttaactttgataactgtagtagcgatgacaaattggagcaacagcacagcctgttcactcactacagagatccctgccgattgggtccaggagaagaaaaaccctgggctatcggcaccctcttagatactaatggtctgtacgacgaggatgtctgcacccccgataacctgcagaaggtgctagagtcagaggaaggcaggagggaatacctcgcattccccacctccaaatcatctggccaaaaaggtaggaaagagcttctcaagggaaacggcagacggatcgattatatgcttcatgccgaagaaggactctgcccggattggaaggccgaggtggaagagttctctttcatcacacagttgtccggcctcaccgatcacttacctgttgcaatgcgcctcatggtctcttccggagaagaggaggcctag

SEQ ID NO: 135608 - DNA, 690 bp, Artificial Sequence
  Description of Artificial Sequence: Synthetic coding sequence
atggaagctagggagcctggccgccctactcctacctatcacttggttcctaatacatctcaatcacaggtcgaggaggacgtgagctcaccaccacagcgctcatcagaaaccatgcagttaaaaaaagagatcagccttcttaacggcgtgtctctggtcgtgggcaacatgatagggagcggcatattcgttagccccaaaggagtgctggtgcacacggcttcatatgggatgtccttaatagtctgggccattgggggcctgttttcagtggttggggccctttgctatgcagagttgggcactaccattacaaaaagtggggcttcatacgcatatattctggaagccttcgggggattcatcgctttcatcaggctgtgggtatccctgttagtcgtggagccaacaggacaggccataatcgccatcacattcgcaaactatataatccaaccctcgttcccatcttgtgatcccccatacctggcttgtcgccttctggctgctgcctgcatctgcttactgaccttcgtgaactgtgcttacgtgaagtggggaaccagggtgcaggatacgttcacctatgccaaggttgtcgccctgatcgccataatcgtgatggggctagtgaaactgtgccaggagatctgcccctggcctctcggatttctttgccagttatag

SEQ ID NO: 135609 - DNA, 1536 bp, Artificial Sequence
  Description of Artificial Sequence: Synthetic coding sequence
atggtggactccaccgagtatgaggtggctagtcaaccggaagttgaaacgtctcccctgggcgacggggcgtccccaggtcccgagcaagtgaaactcaaaaaggaaatcagcctgctgaacggtgtctgtctaatagtcggcaacatgatcggctcggggatatttgtgagccccaaaggcgtgctgatctactcggcctcattcggcctctccctggttatttgggcggttggagggttattctcagtgttcggagcgctctgctatgccgaattgggcacaaccattaagaagagtggcgcatcctatgcctatatactagaagcctttgggggattcctggcgttcatcaggctctggacctcgctgttgattatcgagccaacaagccaggcgatcattgcaataactttcgccaattatatggtccagccgcttttcccctcatgcttcgctccctacgccgcttcacgattgctagccgccgcgtgcatctgtctgctcacattcatcaattgcgcgtacgtcaagtggggtactcttgtgcaggatattttcacgtacgcaaaggttcttgccttgatcgcggtcatagtcgctggcattgtacgtctgggccagggggcttccacccacttcgaaaactccttcgagggatcttcattcgctgtcggcgatatcgcccttgccctttactctgccctattctcctactccggatgggacactctgaactacgtaaccgaggagataaagaaccccgagagaaatctccctctttccatcggcatttccatgccgatcgtaactataatctatatacttacgaatgtcgcttactacaccgtgctggacatgagggatattcttgccagtgacgccgtcgccgtgaccttcgctgaccagatattcggcatttttaattggatcattcctctgagtgtcgcgctcagttgctttggggggctgaacgcctccatagtggctgcttctcggttgttttttgtagggagtcgagaaggccacctaccagatgctatttgtatgatccatgtggagaggttcacccctgtgccttccctgctgttcaacggtattatggcactcatctacttgtgcgtcgaggacatttttcagctgattaattattactctttcagttactggttctttgttgggctgagtattgtgggccaactatacctccgctggaaagagcctgacagaccacgtcctctaaagctgagcgtgtttttccccatcgtgttctgtctgtgtacgatttttctcgtcgctgtgcccctgtattctgatacgatcaatagcctgatcggcatcgctatcgccctgtcaggtctgccattttatttcttaatcattcgggtccctgagcataaaagacctctttatcttagacgtatagtggggagcgctacacggtacctccaggtgctgtgcatgtctgtggcagccgagatggatcttgaggacggcggggagatgcccaaacaacgcgatccgaagtccaattag

SEQ ID NO: 135610 - DNA, 1536 bp, Artificial Sequence
  Description of Artificial Sequence: Synthetic coding sequence
atggtcgattccaccgaatatgaggtagccagtcagcccgaagttgagacatcccctctgggggatggagcaagccctggccccgagcaggtgaagctcaagaaggagatttcccttctcaacggagtttgtctcatcgtgggtaacatgattggctcaggcatattcgtctccccaaagggtgtactgatctatagcgcttccttcggcctgtcattggtcatctgggccgttggcggcctgtttagcgtgtttggagccctgtgttacgcagagttgggcacaacaatcaagaagagcggcgccagttatgcctacatcctggaagcctttggaggattcctcgcttttatcaggttatggacaagcctcctaattatcgagcccacctcacaggccattatcgccattacctttgctaactacatggttcagcctctgttcccatcttgcttcgcaccgtacgcagctagccgcttgctggctgcggcttgcatctgcctccttaccttcattaactgcgcctatgttaaatggggtaccctcgtccaggacattttcacctatgcgaaagtgttggccctaatcgcagtcattgtggcgggtatcgtacgccttgggcaaggggcttcgacacacttcgagaactcctttgagggcagctctttcgccgtaggcgatatcgccttagccctttatagcgctctttttagttacagcggctgggacaccctaaactacgttacggaagagatcaagaatcccgaaaggaacctgcctttatcaatcggtatttcgatgccaatcgtgaccatcatctatattttaacaaatgtggcttattataccgtcctggatatgagagatatcctggctagtgacgcagtcgctgtgacttttgctgaccagatatttgggatttttaactggataatcccgctgtcagtggccctgagctgctttggaggactcaacgccagcatagtggcagccagccggctgttttttgtgggttcaagagaagggcatcttccagatgctatttgtatgatccacgtcgagcggttcacgcccgtgcctagtctgctctttaatggcattatggccctgatctacctgtgcgtggaggacatcttccagttgatcaattattacagttttagttactggttttttgttgggttgtccattgttggacaactatatcttagatggaaggagcccgatagaccgagacccctcaaactgtccgtcttctttcccatcgtattctgcctgtgcaccatcttcctggtcgcggtgcccctgtactccgacacaataaactcccttataggaatagcgattgctttgtcgggactgccgttctattttctgataatccgggtgcccgaacataagaggcctttatatctccgccggatcgttggcagcgccacgcggtaccttcaggtcctctgtatgtccgttgccgccgagatggacctggaggatgggggagagatgcctaagcaaagggatcctaagtcaaattag

SEQ ID NO: 135611 - DNA, 1536 bp, Artificial Sequence
  Description of Artificial Sequence: Synthetic coding sequence
atggtagactccacagagtatgaggtggcctcccagccggaggtcgagacatcacctctgggggacggcgcaagcccaggcccagagcaggtgaaattgaaaaaagaaattagccttctgaatggagtgtgcctgatcgtgggcaacatgatcggctctggcatcttcgtatccccaaagggcgtgctcatttatagcgcttccttcgggctgagtctggtgatctgggctgttggaggactgttctcagtgtttggcgctctgtgctacgccgagctcgggactacaatcaagaaaagtggcgccagctacgcctacattctggaggccttcggcggatttctcgcttttatcagactgtggacctccctccttatcatcgagcctacctcacaggcaatcattgcaataacgttcgccaattacatggttcagccactgttcccctcttgttttgctccttacgccgccagccgactcctcgcagcagcctgcatttgcctgttaacgttcatcaattgtgcatacgtgaaatggggcaccctcgttcaggatatctttacttacgctaaagtgctagcgctaatcgcagtcatcgttgcgggcatcgtgaggctgggacaaggcgcctccacccactttgagaacagctttgaaggatcttctttcgcagtcggggacatagcactggccttatactccgccctattcagctattccgggtgggataccctaaactacgtcaccgaggaaattaaaaaccccgagcggaatctgccattgagcataggaataagcatgcccatcgtgacaattatctacatccttaccaacgtggcgtactacactgtgttggatatgagagacatcctggcctcagacgctgtggccgtgacctttgcagaccaaatattcggaattttcaactggattattccattgagtgtggctctgagctgctttgggggcctgaatgcctccatagtggcggcttcacggctgttctttgtcgggtcaagggaaggccacctccctgacgccatttgcatgattcacgtcgaaagattcacccctgttccatcattactcttcaacgggatcatggccctgatttacctgtgtgtcgaggacatctttcagctgatcaattactatagcttctcctattggttcttcgtgggactgtccatcgtgggtcagttgtacctgaggtggaaagaaccagatagacccaggcctttgaagctatccgtgttttttccaatcgtcttttgcctgtgcacaatcttcctcgtggcggttcctctttactccgatactatcaatagcctgataggcattgctatagccctttcaggcctgcctttctacttcctcattatccgggttcctgagcacaagagacccctttacctgaggcggattgttggatcagccacaagatatcttcaggtcttatgtatgtcagtcgcagctgaaatggacctggaggatggaggggaaatgcctaaacagcgcgatcccaaatccaactag

SEQ ID NO: 135612 - DNA, 1536 bp, Artificial Sequence
  Description of Artificial Sequence: Synthetic coding sequence
atggttgacagtactgaatacgaggttgcttcgcagcctgaggtggagacctctccccttggggacggggccagcccagggcctgagcaggtgaagctcaagaaagagatcagcttgctcaatggagtttgtttaatcgttggcaatatgatcggcagtggcatctttgtgagtcccaaaggagttctgatttactctgccagcttcggactgagcctagtcatttgggctgtcggcggccttttttccgtgttcggtgctctctgctacgctgaattaggcaccacaatcaagaagtctggcgctagctatgcttatatattagaagcctttggtggcttcctcgcttttatccggctttggaccagcttgctaatcatagagcccacctcgcaggccattatcgctatcacctttgccaattatatggtgcagcccctgttccccagctgcttcgctccctatgccgcttcccggcttctcgctgctgcttgtatttgtctgctaaccttcattaactgtgcatatgttaagtggggcaccttggtgcaggacatattcacctatgctaaagttctcgctctgattgcagtgattgtcgctggaattgtccggctgggtcaaggtgcatctactcacttcgagaactcattcgaagggtcatcctttgccgttggtgacatcgccctcgccctgtattccgcgctctttagttatagtggatgggatacactcaattacgttacagaggaaatcaaaaatccagaaagaaacctccccctgtccatcgggatatctatgccaatcgtcacgattatttacatactaaccaacgtagcctactacaccgtgctggatatgcgtgatatcctcgctagtgacgcggtcgccgttactttcgcagaccagattttcggaatctttaactggattatcccactgagcgttgcactctcctgtttcgggggacttaatgcctccattgtggctgcctcaaggctcttctttgtggggtccagagagggacatttgcccgacgcgatttgcatgattcacgtggagcgttttacaccagttccaagcctgctgttcaacgggataatggcgctcatctatctgtgtgtggaggacatttttcagcttattaattactattcattctcatactggttcttcgtggggctgtctatcgtgggtcagctgtacttaagatggaaagagcctgaccgaccacgccctctgaagttgtccgtgttctttccaatcgtgttctgtttgtgcacaattttcttggtggccgtgcctttatatagcgatacaattaactctctcatcggtatcgccatcgccttgtccgggctacctttctactttctgattatcagggttcccgagcataaacgcccactctatttgcgtcggattgtgggaagcgccacgcggtatcttcaggtgctttgtatgagtgtggccgctgaaatggatctggaagacggaggcgagatgcccaagcaaagggacccaaagagcaattag

SEQ ID NO: 135613 - DNA, 1455 bp, Artificial Sequence
  Description of Artificial Sequence: Synthetic coding sequence
atggtagactccactgagtacgaggtagcgagtcagccagaagtggaaaccagccctctgggcgatggggcatcgcccggccccgaacaggtgaagctgaaaaaggagatctatagtgcctcttttggcctgtccctcgtcatttgggccgtgggcgggctctttagcgtcttcggggcgctctgctatgctgaattggggactactatcaagaagtccggtgcgagctacgcttatatcttggaggcatttggcgggttcctggccttcattcgtctttggacttcgctgctcattattgaacctacatctcaggccatcattgcaattacctttgccaattacatggtgcagcccctcttccctagctgctttgccccatatgccgcttctaggctgctagctgccgcctgcatctgcctgctaaccttcatcaactgcgcctacgtgaaatggggaacgcttgttcaggatatttttacgtacgccaaggtacttgcgcttattgccgtaattgtcgccggcattgttagactaggacagggagcctcaacacatttcgagaacagtttcgaaggcagcagcttcgccgtgggagacatcgccctagcactgtactccgccctttttagttattcaggctgggatactcttaattatgtcactgaagaaatcaagaacccagagcgaaacctgcccttgagcatcggcatctccatgcctatcgtgaccatcatctatattctgactaacgtggcctattatacggtgttagacatgagggatattctggcctccgacgcggtggccgtgacgttcgccgaccagatattcgggatctttaattggattatccccctgagcgtcgccttatcttgtttcggaggcctcaacgcttctatcgtcgccgcatctcggctgttctttgtaggtagtagagaagggcatctgccagacgccatctgtatgattcacgtggagcgcttcactccggtaccctccctgttatttaatggtattatggcccttatttacctgtgcgttgaggacatctttcagcttatcaactactattctttttcatactggttttttgtgggactgtctatagtcggtcaactctacctccggtggaaggagccagaccgaccccgaccgctgaaactctcggtattcttccctatcgtcttctgtctctgtaccatattcttagttgctgtgccactgtactcagatacaattaacagtctcatcgggatcgcgatcgcgctctccggacttccattctacttcctcatcatcagagtccccgaacacaaaagacctctgtatttacggcggatcgtgggtagcgccaccaggtacctgcaggtcctctgcatgagtgttgcggccgagatggacctggaggatggtggtgagatgcctaaacaacgcgaccccaagagcaactag

SEQ ID NO: 135614 - DNA, 426 bp, Artificial Sequence
  Description of Artificial Sequence: Synthetic coding sequence
atggtggatagtacagagtacgaagtggcctcccagccagaagttgagacatctcctcttggtgacggcgcaagcccaggcccagaacaggttaaattgaagaaggagatttctctattgaacggcgtctgcttaatcgtcgggaacatgattggaagcggaattttcgtctccccgaaaggggtcctgatatacagcgccagcttcgggttgtcactcgtgatctgggccgtgggagggctattcagcgtcttcggtgccctctgttatgccgaattgggaaccacgatcaagaagagcggtgcctcctacgcttatattctagaggccttcggaggattcctggcttttattcgcctgtggacctctctgttgattatcgaaccgacttctcaggcgattattgctattacatttgcaaactag

SEQ ID NO: 135615 - DNA, 135 bp, Artificial Sequence
  Description of Artificial Sequence: Synthetic coding sequence
atggttgattccactgagtacgaggtagccagccagccggaagtggagacctctcctctcggtgacggagcctcacctggtcctgagcaggtcaagctaaagaaggagatctccctgttgaacggtgtctgttag

SEQ ID NO: 135616 - DNA, 495 bp, Artificial Sequence
  Description of Artificial Sequence: Synthetic coding sequence
atggttgacagcaccgaatacgaggtggcctctcaacccgaggtggagactagcccactgggagacggagcttctcccggcccagaacaagtcaagctgaagaaggaaattagtctcctgaatggcgtgtgtctcatagttggtaacatgataggatcggggatctttgtgtcgccgaagggcgtgctgatttattccgcctcctttggtttatctctggtgatttgggccgtgggaggcctctttagcgtgttcggtgcactgtgttacgccgaactggggactactattaaaaagtcgggggcatcctatgcgtatattctggaggcttttggcggttttctggccttcattaggctgtggacgtccctcttaatcatcgagcctacctctcaggctatcatcgctatcactttcgctaattatatggtgcagcccctcttcccctcatgtttcgctccctatgcagcttcaagactgctggccgcagcctag

SEQ ID NO: 135617 - DNA, 369 bp, Artificial Sequence
  Description of Artificial Sequence: Synthetic coding sequence
atggtggacagcaccgagtacgaagtggccagtcagcctgaagtggaaactagccctctcggtgatggtgccagccccggccccgagcaggtgaaactgaaaaaggagataagccttctgaacggtgtgtgcttaattgtggggaacatgattggttccggcatcttcgtcagcccgaagggcgtgctgatttactccgcttcttttggtctgagcttagtaatttgggctgttggcggactgttcagcgtctttggggctctctgctatgcggaactggggaccacaatcaaaaagagtggggcctcttatgcctatatcctcgaggcctttggtgggtttctcgctttcatccggttgtggacttag

SEQ ID NO: 135618 - DNA, 1536 bp, Artificial Sequence
  Description of Artificial Sequence: Synthetic coding sequence
atggtcgactccaccgagtacgaggtggcatcacagcctgaagtcgaaacaagtcctctgggggatggtgcctcccccggcccagaacaggtgaaactcaaaaaggaaatttccttgctcaacggcgtatgcctcatcgtcggtaatatgatcggcagcggcatattcgtgtccccaaaaggtgtactcatttattcggcctcctttggactctcattggttatttgggctgtgggtggcctattttccgtcttcggcgctctttgctatgcagagctggggactacaatcaaaaagagcggtgcgagctatgcttacatcctggaggcattcggaggatttcttgcctttatcaggctgtggacttccctgcttataatcgagccgacaagtcaggccataatcgcaatcacatttgctaattatatggtgcagcccctctttccatcctgctttgccccctatgctgccagccggttactggcagctgcgtgtatttgcctgctgacatttatcaattgtgcttacgttaagtggggcaccctcgtgcaggatatatttacctacgcgaaggtcctcgcacttatcgccgttatcgttgcaggtatagtgcgcctgggccaaggagcctctactcatttcgagaattcattcgaagggtcctccttcgcagtcggagatatcgccctggccctctactcagctttattttcatattcagggtgggacaccctaaactacgtaacagaagagatcaagaatcctgagagaaatctcccgctttccattggtatatccatgccgatcgtgacaatcatttacatcttgacaaacgtagcttactacacggtcttagatatgagggacattctcgcatctgacgcggtcgccgtgaccttcgctgaccagatctttggaattttcaattggattattccactgagtgtcgcattgtcctgctttggcgggcttaacgcttcgattgtggctgcatctcgactattttttgtgggctcacgagagggccatctgcctgacgcgatctgcatgattcacgtcgaaaggtttacacctgtcccttctctgctgttcaacggaattatggccctgatctacctctgtgtcgaggacatattccaactgattaattattactccttctcctattggttttttgtcgggctgtctatagtcggccagctgtatctccgctggaaagaaccagatcgtcctaggcccctcaaactttcagtcttttttcccattgtgttttgcctatgcaccattttcttggtcgccgttcctctgtattcagacacaatcaatagcctgatcgggattgccatagccctctcagggttgccgttttacttcctgataatccgtgtccccgagcacaagcgaccactgtatttgcggaggattgtaggcagtgctacacgttacctccaggtcctctgcatgtccgtggctgccgagatggatttagaggatggcggcgagatgcctaaacagagagatcccaaatctaattag

SEQ ID NO: 135619 - DNA, 348 bp, Artificial Sequence
  Description of Artificial Sequence: Synthetic coding sequence
atggtggactctaccgaatacgaggtggcaagccagcccgaagtagaaacgagcccattgggagacggtgcctctcctggccccgagcaggtcaagcttaaaaaagaaatttccctgctgaatggcgtgtgcctgatcgtaggcaatatgattggttccggaatttttgtttcccccaagggagttctgatctatagcgcaagcttcggactgtctctcgttatttgggccgtcggggggttgttttcagtgtttggagccttatgttacgccgagctggggaccacaattaagaagtccggggcctcctatgcctacattctggaagcattcgggggatttctctag

SEQ ID NO: 135620 - DNA, 93 bp, Artificial Sequence
  Description of Artificial Sequence: Synthetic coding sequence
atggttgacagtacagaatacgaagtcgcgtcccagcccgaagtggagacctcccccttaggcgatggcgcaagcccgggcccggaacagtag

SEQ ID NO: 135621 - DNA, 933 bp, Artificial Sequence
  Description of Artificial Sequence: Synthetic coding sequence
atggtggatagtacagagtatgaggtggcctctcagccagaagttgagacaagcccattgggcgacggagcatccccggggccagaacaagttaaattaaagaaggagatctccctattaaacggagtgtgtcttatcgtcggcaatatgattggtagcggtatattcgtgagcccaaagggcgtgctcatttatagcgcctcttttgggctgagccttgtgatctgggcggtggggggactgttttccgtattcggtgccctctgctacgccgagttaggcaccactatcaagaagagtggggcatcttacgcctacattttagaggcatttgggggatttcttgcgtttattaggctttggacgagcctgctgatcatcgaaccaacgtcgcaggccatcattgccatcacttttgcaaactatatggttcaacctctcttcccctcttgttttgccccatacgctgccagccgtttgctggcggcggcctgcatctgcctcttaacatttattaattgcgcttacgtgaaatggggaacactggtgcaggatatcttcacgtacgccaaagtgctagccctcatcgcagttattgttgcgggaatcgtgcgactcggccagggggccagtacacattttgagaatagtttcgagggctcgtcctttgccgtcggcgacattgccctcgctctctactccgccctgtttagttactcaggctgggatacattgaactacgtgacggaagagattaagaaccccgaacgtaacctgcctctgtctattggcattagtatgcccatcgtgactatcatttacatattaacaaatgtcgcctactatactgtgttagacatgcgtgacatcctcgcgtctgatgccgtagcagtagccttcctttgcggacttaaacgtcgaccgtctccctag

SEQ ID NO: 135622 - DNA, 321 bp, Artificial Sequence
  Description of Artificial Sequence: Synthetic coding sequence
atggtggatagcacagaatacgaggtcgcctcacagcccgaggtggaaacatctcctctcggggatggcgccagcccgggccctgagcaggttaagctcaaaaaagagattagtctcctgaatggcgtgtgtctcattgttggtaacatgattggatccgggattttcgtgagccctaagggagtcctgatatacagcgcgtcatttggacttagtctcgttatttgggccgtgggcggcttattctcagtctttggagccctatgctacgctgaactcggcaccaccatcaaaaagagcggcgcttcttatgcatactag

SEQ ID NO: 135623 - DNA, 351 bp, Artificial Sequence
  Description of Artificial Sequence: Synthetic coding sequence
atggtagactcaacggagtatgaggtggcttcacaacctgaagtcgagacttccccccttggcgatggcgcgtccccgggcccagagcaggtgaaattgaagaaagaaatctctctactgaacggcgtttgcttaatcgttggtaacatgattgggtctgggatctttgttagccccaaaggcgtactgatttactccgcgtcttttggtttaagtcttgtcatctgggctgttggggggcttttctctgtattcggcgcactgtgttacgctgagttaggcaccaccattaagaagagcggggcatcgtacgcttatatcctggaggcttttgggggctttctagcatag

SEQ ID NO: 135624 - DNA, 1890 bp, Artificial Sequence
  Description of Artificial Sequence: Synthetic coding sequence
atggggtgtaaggtcctgctcaatattggccaacagatgcttaggcgcaaggtggttgattgttctcgggaggagactcggctttctcggtgtctaaacacttttgatctcgtggccctcggggtcggatcgacgctgggagctggagtgtacgtattggccggggccgtcgcccgcgaaaacgccggtcccgctatcgtgatctcttttctgatcgctgcacttgcctccgtgctggccggactctgttatggcgaatttggggcccgagtgcccaagacagggtcagcatacctgtactcttacgtgaccgtgggagagctgtgggcattcattaccggttggaatctcatcctctcttatataatcgggacgtcatccgtggcgagagcctggtcagccaccttcgacgaactgatcggccgtcccatcggagagttcagccggacacacatgactctgaatgctcctggcgtgctggccgagaacccggacatttttgctgttatcataattctaattctcacgggcctactgacactcggcgtgaaggagagcgccatggtgaacaaaatctttacctgtataaatgtgctcgtactgggtttcatcatggttagcggcttcgttaagggcagtgtgaagaattggcagctgactgaggaggactttgggaacacatcaggccgcttgtgcctcaacaacgacacgaaggagggaaagccgggcgtaggcggcttcatgccattcggcttctccggcgttctgtcaggcgccgccacgtgcttctacgccttcgtgggctttgattgcatcgcgacaactggggaggaagtgaaaaacccccagaaagccattccagtcggtattgtggcctcactgttaatctgctttattgcttatttcggcgtgagcgccgcacttactcttatgatgccatacttttgccttgataacaactcgcccctacccgacgccttcaaacacgtagggtgggagggcgccaaatacgcagtcgcagttggatccctgtgtgcgctctctgcttccctgctgggctctatgtttcccatgcctagagttatttacgccatggccgaagatggactgctatttaaatttttggcgaatgtaaacgatcgaaccaagacaccaatcatagcgaccctggctagcggcgccgttgcagctgtaatggcatttctctttgatctcaaagacttggtggacctgatgagtatagggaccctgctggcttacagcttagtggctgcctgcgttctcgtgctgcgatatcagcctgaacaacctaacttagtctaccagatggcttcaacctccgacgagctcgaccccgcggatcagaatgaactggctagcactaatgatagccagctggggtttctgcctgaagctgaaatgttcagcctcaagaccatcttatcgcctaagaacatggagcctagcaagatttccgggctgattgtgaacattagtaccagcctgattgcagtgttgatcatcactttttgtatcgtgaccgtccttggacgggaagccttgacaaaaggcgccctgtgggctgtgtttctgctggccggcagtgccctgctctgtgctgtggtgacgggagtcatatggcgacagcctgagagcaagactaagctctcattcaaggtaccctttctgccagtgctgcctatcctcagcatctttgttaacgtgtatcttatgatgcaacttgaccaaggaacttgggtccgcttcgcagtttggatgttaattggattcatcatctacttcgggtatgggctatggcacagcgaggaggccagcctggacgctgaccaagctagaaccccagatgggaatctggaccagtgtaagtag

SEQ ID NO: 135625 - DNA, 366 bp, Artificial Sequence
  Description of Artificial Sequence: Synthetic coding sequence
atgggctgcaaggtattactcaatatcggtcagcaaatgttgcggagaaaagtggtggattgcagcagggaagagacccgattatctaggtgtctgaatactttcgatctcgtggccctgggcgtggggagcactctgggcgccggtgtttacgtgctcgccggcgccgtggcaagagaaaatgctggaccagcaatcgtgatcagctttctgatcgctgctctggcttctgtgctggccggactttgttacggggaatttggtgcgagggtgccaaagaccgggagtgcctacttgtatagttacgtgacagtcggagagctatgggctttcattaccggttggaacctgatactctcctactag

SEQ ID NO: 135626 - DNA, 2097 bp, Artificial Sequence
  Description of Artificial Sequence: Synthetic coding sequence
atgaagatagagacctcgggctataattctgacaagctgatttgccgaggctttattggtacacccgccccacccgtgtgtgattccaagttcctgctgtctccctctagtgatgttcgtatgatcccgtgcagagccgcactgaccttcgcccgatgtctgatcagacgcaagatagttacacttgatagcctcgaagataccaaattgtgtcgctgcctgtccaccatggacctgatcgccctcggagttggaagcaccctgggcgccggcgtgtacgtgcttgcaggggaagttgccaaagccgactctggcccctcaatcgtggtttcgtttctcattgctgcacttgcaagcgtgatggccggactatgctatgctgagtttggggcgcgcgtgcctaagacaggcagcgcatacctgtatacttacgtcacggttggcgaactgtgggcttttattacggggtggaacctgatccttagctacgttataggcacaagtagtgtggccagggcttggtccgggactttcgacgagctcctttccaagcaaataggtcagtttcttaggacctatttcagaatgaactatacaggtttggcagaatacccagattttttcgctgtgtgtttaattcttctgttggcaggacttcttagctttggtgtgaaggaaagtgcctgggtcaataaagtgtttaccgccgttaacatcctagtgctgctattcgtgatggtggccgggttcgtgaagggtaatgtcgctaattggaaaatctcagaggaatttttgaaaaatatcagtgcctcagccagagagccgccatctgagaatggaactagcatttatggcgcggggggtttcatgccgtatggctttactggaacactggctggagccgccacctgtttttacgctttcgtgggatttgattgcatcgctaccacaggcgaggaagttcggaacccccagaaggccatccctattgggatcgtgacatctctgctcgtgtgcttcatggcctactttggtgtgtctgccgccttgactcttatgatgccatactaccttctggacgagaaatctccgttgcccgtggcgttcgaatacgttgggtggggacccgcgaagtacgtggtcgctgccggctctctctgtgcgctgtccacatctctgctgggaagcatatttcccatgccccgcgtgatctatgctatggcagaagatggcctgctctttaaatgcctggcacagataaacagcaagacaaaaactccgatcatcgctaccttatcctccggcgccgtggcagcgcttatggccttcctgttcgacttgaaggccctggttgacatgatgtcaataggtactctaatggcatactccttggtagccgcctgcgttctcatactgaggtatcagcccggcttgtcctacgaccaaccaaagtgttctccagaaaaagacggcctaggctcctcgccacgcgtaacctccaagagcgagtctcaggtgacaatgctacagagacaaggattcagcatgcgaacactgttctgtcctagtctcttgcccacccaacagtcggcttccctggtgtcttttcttgttggcttcctggccttcctcgtcttaggcctgagtgtcctgaccacatacggcgtccacgcaatcactagactggaggcttggagcctggccctgctggccctcttcctggtgctcttcgtggccatcgtgctaaccatctggagacagccccagaaccaacagaaagtagcgttcatggtgcctttcctgccctttctacccgcctttagcattctggtgaatatctatcttatggtccaactgagtgcagacacttgggtgaggttctctatttggatggccattggattcttgatatacttcagctatggaattaggcattccctggagggtcatttgcgggatgagaacaatgaggaagatgcttaccctgacaatgtccacgctgcagccgaagaaaaatctgccatccaagcaaatgatcaccacccccgcaatctgagcagcccattcattttccacgaaaagacaagtgaattctag

SEQ ID NO: 135627 - DNA, 2094 bp, Artificial Sequence
  Description of Artificial Sequence: Synthetic coding sequence
atgaagatcgaaacgagtggctacaactccgacaagctcatctgtaggggcttcattggaacacccgcccctcctgtgtgcgactcaaagttcctgcttagcccttcctctgatgtgcgcatgatcccctgtcgcgccgctctaacattcgcccgttgtctcattcgcagaaagatcgtgacgctcgactcactcgaggacaccaagctatgtcgctgtttaagtactatggacttaattgctctgggagtcggaagcacactgggcgctggcgtgtacgtgttagccggagaggtcgccaaggctgactctggccccagcatcgtagtgagcttcctgatcgcagctctggcctccgtgatggccggcttgtgttacgctgaatttggggcaagggtccctaaaaccggttccgcctacttgtacacctacgtcaccgttggtgagttatgggccttcatcacgggctggaatttgattctgagctacgttattggaacttcctcagtggcaagggcctggtccgggacttttgacgagcttctgtcaaagcagataggccagtttctaaggacttactttcggatgaactatactgggctggcagaatacccggacttcttcgccgtatgtctgatcttactattagctggcctgctttcatttggagtgaaggaaagcgcctgggtgaacaaggtgttcaccgccgttaatattctggtgctcctcttcgtgatggtcgcagggtttgtgaagggcaatgtggccaactggaagatttctgaagagttccttaagaacatctctgcttctgcgcgagaacctccgagtgagaacggaacctccatatatggggcaggggggttcatgccatacggtttcacgggaaccctggctggagccgcgacttgtttctacgcattcgtcgggtttgattgtatcgcaaccacaggggaggaggtgagaaatccccagaaagccattccgatcggcatagtaacaagtctcttagtgtgtttcatggcatacttcggtgtctccgcagctttgacactgatgatgccgtactacttgctggacgagaaatcccccctcccagtggcgtttgagtatgtgggttggggaccggctaagtacgtcgtagctgcagggagcctgtgcgcattgagtacatcattgctgggctcaatgtttcctcttcctcggatcctgtttgcaatggcaagggacgggcttctctttaggttcctggccagagtgagcaaaagacaatcacctgtcgcagccactttgaccgccggcgtaatctcggctttaatggcatttttgttcgaccttaaagctctggttgatatgatgagtattggcaccttgatggcctactccctggtggccgcatgtgtacttatactgcgttaccaacccggcctgtcatacgaccaacccaagtgtagtcccgagaaagatggccttggctcctctcccagggttacctctaaatccgagagccaggtgactatgttgcagcgacagggcttctccatgaggactctgttctgtccctcactgttgcccacacagcagtctgctagcttggtttcctttcttgtgggatttctggcctttctggtcctaggcctgagtgttttaactacctacggtgtccacgcaatcacacgacttgaagcttggagcctggccctgttagccctgtttcttgtcctgttcgtcgcaatcgtgctcacaatttggaggcaaccccagaaccaacagaaagtcgccttcatggtaccttttctgcccttcttacctgcctttagtatcctagtaaacatatatctgatggtgcaactgagcgccgacacatgggttaggttcagcatctggatggcgatcggcttcttgatctacttctcctacggcataagacactcgcttgaaggccacctgcgcgacgaaaacaatgaagaggacgcttatcctgataatgtgcatgccgcagcagaggagaaatctgccattcaggctaacgaccatcacccccgaaatcttagcagtccattcatttttcacgaaaaaacgagtgagttctag

SEQ ID NO: 135628 - DNA, 2094 bp, Artificial Sequence
  Description of Artificial Sequence: Synthetic coding sequence
atgaagatcgagacgtccggctacaattcagacaagttaatttgcagaggattcatcggtaccccagctccaccagtctgtgattctaagtttctgctttcccccagcagcgacgtgcggatgatcccttgtcgcgccgctctcactttcgctaggtgtcttatccgccgaaagatcgtgactctcgactccctcgaggatactaaattgtgccgctgtctgagcactatggatctcatagctttgggggtcggttctacgctcggcgctggcgtgtatgtgctcgctggcgaggtggctaaagccgactccggacccagcatcgtggtgagctttcttatagcagcactagcctctgtcatggccgggctgtgctacgctgaattcggcgctcgggtgccaaagacgggctctgcatatttatatacatatgtgacagttggcgaactgtgggcattcattacagggtggaaccttatcctaagctacgttatcggtacgagtagcgtggcacgtgcctggagcggaaccttcgatgaactgctgtcaaagcagattggccaattcctaagaacatattttaggatgaactatacaggtttggcagagtaccctgacttctttgcagtttgcctgatcttacttttggccggcctgctaagtttcggggttaaagaaagtgcctgggtcaataaggtttttacggccgtgaacatcctggtgctgctttttgtgatggtggccggcttcgtcaaaggaaacgttgcaaattggaaaatctcagaggagtttctgaagaatataagtgcctctgcacgagagcctccatccgagaatggaacaagtatatacggcgccggcggcttcatgccatacggattcactggaacactagccggagccgctacctgtttctacgccttcgtcggcttcgactgcattgccacaacaggggaagaggtcaggaatcctcaaaaagccatacctatcgggatcgtgacttccctgctggtgtgcttcatggcttactttggcgtctccgccgcattgacactcatgatgccgtactacctactagacgagaaaagtcctcttcccgtggctttcgaatatgtcggctgggggcccgctaaatacgtagtggcggctgggtccctgtgtgcattaagcacttcactgctcggatcaatgttccctcttcctaggattttgttcgctatggccagggacggcctgttgtttagatttctcgctcgggtgtccaaacgccagagccctgttgcagccacactcacagctggagtaattagtgctctgatggctttcttgttcgacctgaaggcactagtggatatgatgtctattggaactctgatggcgtactccctcgtggcagcttgtgtgctgatcctgaggtatcaaccgggactaagttacgaccaacccaaatgctctccggaaaaggatgggttgggttctagcccaagggtgacctcaaaatcagaatcccaggtcactatgttacagcgtcaagggttttccatgcgcacactgttctgcccctccctgttgccgactcaacagtcagccagcttagtgtctttcctggttggatttcttgcgttcctggtcctgggactctccgtgcttacaacatacggcgtgcacgcaataacccgcctggaggcttggagtctggcactgcttgctctgttccttgttctcttcgttgctatcgttctgaccatatggagacagccccagaaccagcaaaaagtggctttcatggtcccatttctgcccttcctgccagccttcagtatactcgtcaacatctacctgatggtgcagctctccgccgatacgtgggtcaggtttagcatctggatggccatcggtttcctgatttatttctcctacggtatccgacattcgctggaggggcatctgcgcgatgagaataacgaggaggacgcttatcctgataacgttcacgctgctgctgaagagaagagcgccattcaggctaacgatcatcatccgcgcaacctgtctagcccttttatcttccacgaaaaaacatcagagttctag

SEQ ID NO: 135629 - DNA, 1977 bp, Artificial Sequence
  Description of Artificial Sequence: Synthetic coding sequence
atgattccatgcagggccgccctgacatttgccagatgtctcatccgccggaaaatcgtaacacttgattcattggaagacaccaaactgtgtcgatgccttagcaccatggacctgatcgcactgggcgttgggtctactttaggcgctggtgtgtatgtgctcgccggtgaggtggctaaagcagacagcggtcccagcatcgtcgtgagctttctgattgctgcgttggctagcgtgatggctggtctgtgttacgctgagtttggagcacgcgttccaaaaaccggcagtgcctacctatatacttatgtgacggtaggggaactgtgggcgttcattacagggtggaacctcattcttagctacgttataggtacctcttctgttgctagagcttggtcagggacctttgacgagcttctgagcaaacaaataggacagttcctgcggacgtactttcggatgaattatacagggctggccgagtacccagacttctttgctgtatgtctcatcctactcctggcgggcctcctgtccttcggggtaaaagaaagcgcctgggtgaataaggtgttcaccgccgtgaacatcttggtcctcctctttgttatggtcgcagggtttgtcaaagggaatgtggccaattggaaaatctcagaagagtttctgaagaatatctctgcttctgccagagagccaccctctgaaaacggtactagcatctacggggcaggcggattcatgccctatggttttactggtacccttgccggagccgcaacctgcttctatgcctttgttggcttcgattgcattgctaccacaggcgaggaggttcgaaatcctcagaaagctatcccaatcggaattgttacctccctactggtttgttttatggcctatttcggggtttcagccgcattaacactaatgatgccatattatctgctagacgaaaagagtcccctccccgtcgcctttgagtacgttggttggggccccgctaagtacgtggtagctgcagggagcctctgtgcactgagcacctctctactggggtctatatttcctatgccacgggtgatctacgccatggccgaggacggactgctgttcaagtgcctggcccaaatcaatagcaagacaaaaactccaataatagcaacattaagtagcggagccgtggccgccttgatggcattcctgttcgatctgaaggcgctggtcgacatgatgagcatcgggactctgatggcatatagcctcgtggctgcttgcgttttaatcctgcggtatcagccaggcctgagttacgaccagcccaagtgttcaccagaaaaggatggattaggatcatcccccagggtgacatccaagagtgaaagccaggtcactatgctacaaaggcaggggttctccatgcggaccctcttttgtccatctctgctgccaacacagcagagcgcgtctctggtttctttccttgtggggtttcttgcatttctggtactgggactgagtgtgctgacgacatacggagtccacgccatcacacgactggaggcctggtcccttgctctgctcgccctttttcttgttctgtttgtggccattgtcctgacaatttggcgtcaaccacaaaaccagcagaaagttgcttttatggtgccttttttaccattcctgcctgcatttagtattctggtgaacatctatttgatggtgcagctctcagctgacacgtgggttaggtttagtatttggatggcaatcggctttctgatttatttctcctacggaatcaggcactctttggagggccacttgcgagacgaaaacaatgaagaggatgcatacccagataatgttcacgcagcggccgaagagaagagcgctattcaggcaaatgaccatcatcctaggaatctcagttccccattcatcttccatgagaagacatccgaattctag

SEQ ID NO: 135630 - DNA, 1977 bp, Artificial Sequence
  Description of Artificial Sequence: Synthetic coding sequence
atgatcccatgccgagctgccctgaccttcgccaggtgcctcatcaggagaaagatcgtgacgttggactctctcgaggataccaagttgtgtcgttgtttaagtactatggacctcatcgcactcggcgtcgggtctacactgggcgcaggagtttatgtactggccggggaggttgccaaggccgattctggcccctccatagtcgttagcttcttgatagccgctcttgcgtctgtcatggctggactctgttatgcggagtttggggcacgtgtgccaaaaaccgggtcggcctatctctacacatatgtgacagtaggggaactatgggccttcatcacaggctggaaccttatcctgtcatatgttattggcacaagctctgtcgcgagggcctggagcgggacatttgatgagttactgtctaagcaaataggccagtttcttcgcacctatttccgcatgaactacacgggccttgcagagtatccagacttttttgctgtctgcttgattcttttgctggccgggctgttgagcttcggggtgaaagagagcgcctgggttaacaaggtgttcactgcggtgaacatcctagtcctgctgtttgttatggtagccggcttcgtaaagggtaatgtagccaattggaaaatcagcgaggagtttctgaaaaatattagtgcgagcgcaagggagcctccatctgagaacggcaccagcatatacggagcaggcggctttatgccgtacggttttaccggtactttagccggcgccgctacctgtttctatgccttcgtaggctttgactgtatagctacaaccggggaggaggtcaggaatcctcagaaagccattcctataggaatcgtgacaagcctcctcgtttgtttcatggcatatttcggggttagcgcagccctcacgctgatgatgccctactacctgttggacgaaaagagtccacttcccgtggcgttcgagtatgttggttggggccctgctaagtacgtggtggccgctggcagcctgtgtgcattgtctacgtccctgctgggatccatctttcccatgccaagggtgatctacgctatggctgaggacggcctcctttttaagtgcttagcccagattaactcaaagacaaagactccaatcatagccacgttatcaagcggcgctgtagccgcactcatggcctttttgttcgatctgaaggccctggtggacatgatgagtataggcactctaatggcatacagtcttgtcgctgcctgcgtactgatcttgcggtatcagccaggattgtcttatgaccagccgaaatgttctcctgagaaagatggtcttggctcaagtccacgggttacatcgaagtctgaatctcaagtcacgatgctgcaacggcaggggttctctatgaggaccctgttctgcccctctttgctccctacgcagcagagcgcctccctggtcagttttttagttggctttctggctttcttggttttagggctcagcgtgttgacaacctatggggtccatgcaattacgcgccttgaggcgtggagtttagccctgttggcattgtttctcgtgctctttgtagctatcgtgctgacaatttggcgtcagccgcaaaatcaacagaaagtggcttttatggttccattccttccctttttgccagcattctctatactggtaaacatctatttgatggtgcaactaagcgctgacacctgggtccggttttcaatttggatggccatcggatttctaatctacttctcttatgggattagacacagcttggagggtcatctaagggatgagaataacgaggaggatgcttacccagacaacgtgcacgccgccgctgaagagaaatccgctattcaggctaacgatcaccacccgaggaacctatctagtccctttatcttccatgaaaagactagtgagttctag

SEQ ID NO: 135631 - DNA, 1464 bp, Artificial Sequence
  Description of Artificial Sequence: Synthetic coding sequence
atgggcgatacgggcctgcggaaacgaagggaagacgaaaagtccatccagagccaggagccaaagaccaccagtttacagaaagagctggggctgatttccgggatatctatcatagtggggacaatcatcggctccgggatctttgtgtctcctaagagcgtcctgtccaacaccgaagccgtcggcccttgcctgatcatttgggccgcatgtggcgtgctggcaactttgggggcactttgtttcgccgaattgggcacaatgattaccaagtccgggggggagtacccttacttaatggaagcctacggtcccatacccgcctacctcttctcatgggcctctctgatcgtaattaaaccgacctcattcgctatcatttgcttatcttttagtgagtatgtgtgtgcgcctttttacgtgggctgtaagccaccacagattgtcgtcaaatgtctcgcagctgccgcgattttgttcatctccaccgtgaactctctttcagtgcggctgggatcctacgtgcagaacattttcactgccgcaaagctcgtaatagtggctattataatcatctctggccttgtgctgttagcccagggcaacacaaaaaattttgacaatagctttgagggagcccaactttccgtgggggccatcagcctcgctttctacaatgggctgtgggcatatgatggttggaaccagctgaactatattaccgaggagcttaggaacccttaccgcaatctcccattggcaataattatcgggatcccgttggtgactgcctgctacatcctgatgaatgtatcctactttaccgtcatgaccgctaccgagcttttgcagtcacaggccgtcgccgtcacttttggcgatcgtgtgttgtaccccgcatcttggattgtccccctgtttgtggctttctcaacaattggggccgccaacggcacgtgcttcactgccgggaggttaatctatgtggctgggagagagggccatatgctgaaagtgctatcatatataagtgtgcgtcgcttgacacccgcccccgcaataatcttttacgggataatcgccaccatttacattatcccgggcgacatcaactcattggtgaattactttagtttcgctgcctggttgttctacggcctaactatcttgggactgatagtcatgaggttcacgcggaaggaattagaaaggcccatcaaagtcccagtcgtcatcccagttcttatgacccttatctctgtgttcttggtgcttgccccaataatcagtaaacccacctgggagtatctttactgcgtcctctttatcctatctggcctccttttttacttcctgtttgtgcactataagttcggatgggcacaaaaaatcagcaagcccatcactatgcacctgcagatgctcatggaagtggtcccacccgaggaagacccagaatag

SEQ ID NO: 135632 - DNA, 1464 bp, Artificial Sequence
  Description of Artificial Sequence: Synthetic coding sequence
atgggggataccgggctccgcaagagaagagaggatgaaaaatctattcagtcgcaggagcccaaaacaacctccctccagaaggagcttggcctgatctccggcatctccatcatcgtcggaaccatcatcggctccggaatttttgtctcccccaagtccgtactgtccaatacagaggccgtggggccctgtctaatcatctgggccgcttgtggcgtcctcgccaccctgggggctttgtgttttgcagaactaggtacaatgatcacaaaaagtggaggggagtatccctatttgatggaagcttatggccccatccctgcgtatctcttcagctgggccagcctcatcgttataaaacccacctcttttgctatcatctgcctgtcattcagcgagtatgtatgtgcacccttttatgtaggttgtaagcccccacagattgtcgtgaagtgtctggccgccgcggcaattttattcatatctactgtgaattctctaagtgttcgcctcggctcttacgttcagaacatctttacagccgctaaattggtcattgtcgctataattatcatatcgggtctggtactgttggcacagggtaacaccaaaaacttcgacaattctttcgagggcgctcagcttagcgtcggtgccattagcctggcattttacaacggtctgtgggcatacgatggttggaaccagctcaactatattactgaggagcttagaaacccctatagaaacttaccactggccattattattggaataccactcgtcactgcctgctacatcctcatgaacgtgtcgtactttaccgtgatgaccgcgacagagctactgcagagccaggctgtggccgtaaccttcggcgatcgcgttctataccccgcgagctggattgtgcccctttttgtggccttttctaccatcggggccgcaaatgggacttgtttcacagccgggaggttgatctatgtggccggacgcgagggacacatgttgaaagttctctcgtacatcagcgtccggaggctgactccagcacctgccatcatcttttatggtatcatagccaccatctatatcataccaggcgacattaactccctggtgaattatttcagtttcgccgcatggctattctacggactcaccatccttggattaattgtaatgcgtttcacacgcaaggagctcgaaaggcccatcaaggtcccagtggtgattccagtgctgatgactcttatctcagtgttcctagtgttggccccaatcattagtaagccaacctgggagtacctgtattgtgttctatttatcttgagcggattactgttctacttcttgtttgtgcactacaagtttgggtgggcacaaaagatatccaaacccataacaatgcatctgcaaatgctcatggaggtcgtgcccccggaggaagaccctgagtag

SEQ ID NO: 135633 - DNA, 1908 bp, Artificial Sequence
  Description of Artificial Sequence: Synthetic coding sequence
atggcgcgtgggctccctacaatcgcatccctagcgaggctttgtcagaaattgaatcggttgaaacccttggaagactccacaatggaaacatcgcttagacgctgtctaagcacactggacctgaccctgttaggcgtgggtgggatggtcggctctggcctctatgtcctgactggagccgtagctaaggaggttgcaggccctgcggtgttgctctccttcggagttgccgcggtagcaagcctattggctgcactgtgctacgcagagttcggcgcccgtgtgccaagaacgggatctgcttacctgtttacttacgtttctatgggtgagttatgggcttttctgatcggatggaatgtcctgctcgagtacatcatcggtggagcggctgtggcccgagcttggagtggctacttagatagtatgttttcgcacagcattagaaactttactgaaactcacgtcggatcgtggcaagtgcctcttctgggccactatccagattttctagctgccggaatcatcctcctggcctcagccttcgtctcatgtggagctagggtctcatcctggttgaatcacactttctcggccattagtctcttagtgatacttttcatagtcatcctcggcttcatcctggcacagccccataactggtcagctgacgaaggcggattcgcccccttcggatttagcggggtcatggcaggcacagccagctgcttctatgctttcgttggttttgacgtgatcgcagccagctccgaggaggcccagaatcccagacgcagcgtccccctggctatagctataagtttagctattgcagcaggggcctacatcctggttagcacagtgctcactcttatggttccttggcacagtctggatcctgacagtgccctggcagacgctttctaccagcgcggatataggtgggcgggcttcattgtggcggccggttccatctgtgctatgaacactgtgcttctctccttgctcttctcattaccacgtatagtctatgcaatggcagctgatggcctgttttttcaggtgtttgcacacgttcatcccaggacacaggtaccagtcgcagggactctggcgtttggcctcctgactgcatttttagctctcctgttggacttggagtcgctggtccagttcctgtctttgggcaccctgctggcatacacatttgtggctacgtctatcatcgtgctcagatttcaaaaaagcagtccacccagcagcccaggaccggcctccccaggaccgctgactaagcagcaatcctcattttcggaccatctgcagctggtgggtacggtgcacgcctcagtgcctgagcccggcgagcttaaacccgcacttcgcccctacctcggattcctggatggatattctcctggcgccgtcgtcacctgggccttaggggttatgctggctagtgcgataaccatcggctgcgttcttgtctttggaaactctaccctccatttgccccactgggggtatatactgctgctactcttaacatctgtaatgttcctccttagcctgctggtactcggggcccaccagcagcagtatcgcgaggacctgttccagattccaatggtccctctgatacccgcgctcagcatcgttttgaatatctgcctcatgctgaagctctcttatctgacatgggtaagattttccatttggctgctgatgggtctggctgtgtacttcgggtatggaattcggcattccaaagaaaaccagcgcgagctcccaggtctcaactccacacattatgtcgtgttccctcgcggatccctggaggaaaccgtgcaggcaatgcagcctccaagtcaggccccggcacaggaccccggacacatggaatag

SEQ ID NO: 135634 - DNA, 1908 bp, Artificial Sequence
  Description of Artificial Sequence: Synthetic coding sequence
atggcccgaggactgcctactattgcctccttagcccggttgtgccagaagcttaaccgacttaagccactggaggatagcactatggagacatcactcagaaggtgcctaagcaccctcgacctgactctgctgggtgtaggcggcatggttggctctggactgtatgtactgactggcgccgtggcgaaagaggtcgcaggccctgcagtcttattaagcttcggggtcgccgctgttgcctcattgttagctgctctgtgctacgcagagtttggcgccagggtcccgaggacagggtccgcctatctgttcacttacgtctccatgggtgaactgtgggcgtttcttattggatggaatgttctgctggaatacatcattggtggggctgctgtggcgagggcatggagcggatacctggactccatgttctcccactccatcagaaactttacagagacgcatgtaggctcgtggcaggtgccacttctgggacactacccagatttcttggccgccggcattatcttgctcgccagcgcattcgtgtcgtgtggagcaagggtgagtagttggctaaaccatactttttccgccatcagcctacttgttatcctgtttattgtgatcctggggttcatcctggcccagccacacaattggagcgccgacgaaggaggatttgctccattcggcttctctggagtgatggcaggtacagcctcctgcttttatgctttcgtgggatttgatgtgatcgcagctagctcggaggaggcgcagaatccgcgccggagcgtgccattggctattgccatcagtctggccatcgccgccggggcgtacattcttgtctccaccgttttgactctcatggtcccctggcactctctagaccctgacagtgctttagccgatgccttttaccaaaggggctaccgctgggcagggttcatcgttgccgcaggctccatttgtgcaatgaacacagttttgctctcactgctgttttccctgccccgcatcgtgtacgctatggccgccgatggactgtttttccaagtttttgcacatgtgcacccaaggacacaagtgcctgtggccggcacactagccttcggcctgctcaccgccttcttggcacttctgctggatttggaatccctcgtgcaattcctgagccttggtaccctcctagcttacacattcgtcgccactagcatcattgtgttgcggtttcaaaagtccagccctccttcaagtcctggccccgccagtcccgggcccctgactaagcaacagtcctcctttagcgaccatctgcagctcgtcggcaccgtgcatgcgtcagtgccagagcccggggagctgaaacccgccctgcggccttatctggggttccttgacgggtactcaccgggcgccgttgtgacatgggcgttgggcgtaatgttagcgtccgccattactattggctgtgtgctggtctttggcaattctaccctacatctgcctcactggggctacatactcctgctgctgctcactagtgtcatgtttctgctctccttgttggtcttgggtgctcaccagcagcagtaccgcgaagatctgtttcaaattccgatggtccccctgatccctgcgctctccattgttcttaatatctgtctgatgctcaaactttcctacctcacgtgggtgagattcagcatctggttgctcatgggactggcagtttattttggctacgggattcggcatagtaaggaaaaccaacgggagctacctggactcaactcaactcattatgtggtatttccacgcggctcactggaggagactgtgcaggccatgcagcctccttctcaggcgccagcgcaagatccaggccacatggaatag

SEQ ID NO: 135635 - DNA, 249 bp, Artificial Sequence
  Description of Artificial Sequence: Synthetic coding sequence
atggccagagggctccccacgattgcgagcctcgcacgtttatgccagaagctgaaccgcctgaaaccactggaggatagcaccatggaaacgagtctcaggaggtgtttaagcaccctggacttgactttgcttggggtgggaggcatggtggggtcaggcctctatgtattaactggggctgtggccaaagaagtcgctggccccgctgtcctgctgtcattcggggtggccgccgtggcttcttag

SEQ ID NO: 135636 - DNA, 2922 bp, Artificial Sequence
  Description of Artificial Sequence: Synthetic coding sequence
atgtacaacatgcgccgcttgagcctgagccctaccttttcaatggggttccacctgctcgtcacagtttcactgctgttttcccacgtcgaccacgtgatcgccgagactgagatggagggggaaggtaatgaaaccggcgaatgcacgggttcttattattgtaagaagggggtaattctcccaatctgggaacctcaggaccccagtttcggagacaagatcgcccgggctacggtgtatttcgttgccatggtgtatatgtttttaggagttagcatcatagctgaccggtttatgagctccatcgaggttatcacatcacaggaaaaggagattactattaaaaaaccaaacggagaaacgacaaaaaccacagttcggatttggaacgagaccgtgagcaatttgaccttgatggcactagggagctccgccccagagattttactgagtgtgatcgaggtgtgtggccacaatttcactgcaggcgatctggggccttccactatagtgggcagcgcagcttttaatatgtttataatcattgctttgtgtgtatatgttgttcccgacggcgagaccaggaaaatcaaacacctgcgcgtgttctttgtcaccgcagcgtggtccatattcgcttacacatggctctatataatcctatccgtaatctccccaggagtggtagaggtgtgggagggcctcctgacattcttcttcttcccgatttgcgttgtcttcgcttgggtagccgatcggagactcctgttctacaagtatgtgtacaaaagatacagggccggtaagcaacggggaatgatcatcgagcacgaaggggatcggccgtcttccaaaactgagatcgagatggatgggaaagtcgtgaattctcacgtggagaactttctcgatggcgcactagtgttggaggtggatgagcgcgaccaagacgacgaggaggcaaggagagagatggcaagaatcttaaaggagctgaagcagaagcaccccgacaaagagattgagcagctgatagaactcgccaactaccaggtgctgagtcaacagcagaaatcccgagctttctacaggatccaagcaactagactgatgacgggcgccggcaatatcctgaaaaggcatgctgctgatcaggcccgcaaagcggtgtctatgcacgaagttaacacagaggtcaccgaaaatgatccggtgtcaaagatcttttttgaacaggggacttaccagtgtttggagaattgcggcaccgttgcactcacaataatccggcgtggaggggacctcactaataccgtttttgtagacttcagaaccgaggacggaaccgccaacgccgggtcggactatgagtttactgaagggacagtggtttttaagcccggggatacacagaaagagattcgcgtcggcatcattgatgacgatattttcgaggaggatgagaactttttggtgcacttatccaatgtgaaagtctctagcgaggcctccgaggatggcatcctggaggccaaccacgtgtcaacactcgcctgcttagggagcccctccactgccacagttactatctttgacgacgaccatgctggaatcttcactttcgaagagcctgtaacacatgtaagtgaaagtatcggaattatggaggtcaaggtcctgcgcaccagcggggctagagggaatgttatcgttccatataagactatagaaggaaccgcacgggggggaggagaggattttgaggacacatgtggtgaattggaattccagaacgatgaaatagtgaagacgatctcagtcaaggttattgacgatgaagagtacgaaaaaaataagacattcttcttggagattggcgaacctcggcttgtggaaatgagtgaaaagaaagctctcctactgaacgagcttggcggatttactataacaggaaagtatctcttcggacaacccgttttccgcaaagtgcacgcccgtgagcatcctatactctcgactgttatcacgattgctgacgagtacgacgacaaacagcccctgaccagcaaggaagaggaagagcgccggatcgctgaaatgggacgaccgattttaggagagcacactaagctcgaagtgattattgaagaatcgtatgagttcaaatctacagtggataaactgattaagaagactaacctggccctcgttgtcgggacaaattcctggagagagcaatttatagaagctatcactgtgtctgccggtgaggacgacgatgatgacgagtgcggcgaggaaaagttaccaagctgctttgattacgtgatgcatttccttactgtgttttggaaggtccttttcgctttcgtgccacccaccgagtattggaacgggtgggcctgtttcattgtatccatccttatgattggactgcttacagcattcataggcgatctagcctcacatttcggttgcactatcggtttgaaggactcagtgactgccgtggtcttcgtggcactgggaactagcgtccccgatacttttgctagcaaagttgcagcaactcaggaccagtacgcagatgcttcaatcggaaatgtaaccgggtccaatgcggtcaatgttttcctgggcatcggcgtcgcctggtccattgctgcaatctatcatgccgctaatggagaacagttcaaggtctccccgggcaccctggctttttccgtgaccttgttcactatcttcgccttcatcaatgtcggcgtgctgctataccggcgacgtcccgagattgggggggaactgggtggaccccggactgccaaactgcttacttcttgcctattcgtgctcctctggctgctctacatctttttcagcagtttggaggcatattgtcacattaaaggtttctag

SEQ ID NO: 135637 - DNA, 2922 bp, Artificial Sequence
  Description of Artificial Sequence: Synthetic coding sequence
atgtacaatatgagaaggttgagcctgtctccgaccttcagcatgggttttcacttgctcgtgaccgtgtccctgctgttttcgcatgtcgaccacgtgattgccgagactgagatggagggcgaagggaatgaaactggggagtgtacagggagttattactgtaaaaagggagtgatcctgcccatttgggaaccacaggatccctcctttggcgacaagatagcgcgagccaccgtgtacttcgttgccatggtgtatatgtttctgggagtgtccatcattgctgaccgcttcatgtcctctattgaggtgattacatcccaggagaaggagataacaattaaaaaacccaacggcgaaaccaccaagactacagtgcgtatctggaatgaaaccgtatcaaatctaactcttatggcattagggtccagcgcccccgagattctgctctccgtgatcgaggtgtgtggacataatttcaccgccggggatttgggcccaagtactattgttggaagcgccgcttttaatatgttcattattattgcactatgcgtgtatgtagtacccgatggcgaaacacgcaaaatcaagcacctgcgtgttttttttgtcacggctgcatggtctatcttcgcgtacacctggttatacattatcctaagcgtgatttcacctggcgtggtggaagtgtgggagggtcttctcaccttcttcttttttcccatctgcgtcgtttttgcctgggtggcagatagacggctcttgttttataagtacgtctacaaacgctaccgcgcaggaaagcagcgcggcatgattatagagcacgaaggcgaccgcccgagctcaaaaactgaaattgaaatggacggaaaggtggtcaatagccacgtcgagaatttccttgacggggctctcgttctggaagtggacgaacgggatcaagacgacgaggaagcgagacgggagatggcccgaatccttaaggagttgaaacaaaaacaccctgataaggaaatcgaacagctgatcgagctcgcaaattatcaggtcctgagtcaacagcagaaatccagggcattttaccggatccaagccaccaggcttatgactggagccggcaatattctgaaacgccatgccgcggaccaggctcgtaaggcggttagcatgcatgaagtgaatactgaagtcactgagaatgacccggtatccaagatattcttcgagcagggcacttaccagtgtctcgaaaactgcgggactgtggcgctcacaatcatcagaaggggtggagacctcacgaacacggtcttcgttgatttcagaactgaagacgggacagccaatgcaggctctgactacgaatttactgaaggcacagtcgttttcaagcccggcgatacccaaaaagagataagggtgggaattatcgatgacgacatcttcgaggaggatgagaactttctggttcatctctccaacgtcaaggtctcttccgaagcatctgaggacgggatcctggaggccaatcatgtgtcgacattggcatgtctgggctcaccaagtacagccaccgttactatttttgatgacgatcacgctggaatttttactttcgaggaacccgtgacgcacgtgtccgagagtatcgggataatggaagtgaaagtgctgcgaacatccggggcgagaggaaacgttatagtcccatacaagaccattgagggtactgcaaggggtggaggggaggattttgaggacacctgcggcgagctagagtttcagaatgatgagatagttaagaccattagtgtgaaggtgatcgacgatgaggagtacgaaaaaaataaaacattctttctggaaatcggggaacctcggctggtcgaaatgtctgagaagaaagcattactattgaacgaactgggaggatttactattacagggaaatatctgttcggccagccagtcttcagaaaagtccatgcaagagagcatccaatcttgtcaacagtgataactattgcggatgaatatgacgacaaacaacccttaacatcaaaagaggaggaggagaggagaatcgcagaaatgggcagacccattcttggggagcatacgaagctagaggttatcatcgaggaaagctacgaatttaaatctacggttgataaacttattaaaaaaacaaaccttgccttagtagtggggaccaattcgtggcgcgaacagttcattgaagctatcactgtatccgctggcgaagatgatgacgatgatgaatgtggagaagagaaattaccttcttgcttcgattacgttatgcatttccttacggtcttctggaaagtactgtttgcttttgtcccccctactgagtattggaatggttgggcttgtttcattgtgtccatcctcatgatcgggcttctgacagcattcattggagacttagctagccacttcggatgtaccatcgggctgaaagactctgtgaccgctgtcgtgttcgtggccctgggcacatctgtccccgataccttcgccagcaaagtagccgctacccaggaccagtatgccgacgcctctattggcaacgtgactggatcaaatgccgtgaacgtcttcctgggaattggggtggcctggtctatcgctgctatctatcatgcagccaacggagaacagtttaaagtcagccccgggactctcgcatttagcgtgacattattcacaatcttcgcctttatcaacgtgggggttctgctgtaccggcgtcgacctgaaatcggcggagaactcggcggacctcggactgccaagctgctgactagctgtctttttgtgctgctgtggctgctttacatcttcttcagcagcctggaggcctattgccatatcaagggcttctag

SEQ ID NO: 135638 - DNA, 2814 bp, Artificial Sequence
  Description of Artificial Sequence: Synthetic coding sequence
atgtacaatatgaggcgactgtccctctccccaacatttagcatgggttttcatttgttagtcaccgtgtctctgctcttttctcacgtggatcatgtgattgctgagacagaaatggagggagaaggaaatgagaccggtgagtgcaccgggtcctactattgtaagaaaggcgtgattctgcctatatgggagcctcaggacccaagctttggcgataagatcgctcgggccacggtttacttcgtggccatggtgtatatgttcctgggggtcagcatcattgccgacaggttcatgtcgtcaattgaggttatcacaagccaggagaaagagattactatcaagaaaccgaacggagagactacaaagacaaccgtgagaatttggaatgagacagtgtccaacctgacactgatggcgctgggatctagcgcccccgaaatcctgctgtcagtgatagaggtgtgcgggcataacttcactgccggcgacctgggtcccagtaccattgtgggcagcgcagccttcaacatgttcattattattgccctgtgcgtgtacgtggtgccggatggagagacccggaagattaagcacttgcgggtgttctttgtcaccgctgcatggagcatcttcgcttatacctggctatacattatactgtccgtgatctctccaggtgtcgtggaggtttgggaggggcttttaacttttttcttctttcctatttgtgtggtgtttgcttgggtcgccgatcgaagactgcttttctacaaatatgtctacaagcgatatcgggctggaaagcagcggggaatgatcattgaacacgaaggggaccggccatcctcaaaaaccgaaattgagatggacggtaaggtcgtgaacagccatgttgaaaatttccttgacggcgcactcgtactggaggtggatgagcgagaccaggacgacgaggaagccagaagagagatggctaggatactcaaggaactaaagcaaaaacaccctgacaaagagattgaacagctgattgagctggccaactaccaagtcctatctcagcaacagaagagtcgcgctttctaccgaatacaagctacacggttgatgacaggcgcaggaaacatccttaagcgacatgcggctgaccaggcccggaaagccgtgtctatgcatgaggttaacacagaggtgaccgagaatgatccagtcagtaaaattttttttgagcaaggtacctaccagtgcctggaaaattgcggaacggtggcactgaccatcatccgccggggaggggatctgacgaatactgtctttgtagatttccgtaccgaggatgggaccgccaacgctggatccgattatgagttcacagagggtactgtagtatttaaaccaggcgatacacagaaagagattagagtcggtatcattgacgatgatatttttgaggaggacgagaattttttagtgcaccttagcaacgtgaaggtgtcttcagaggcttcggaggacggtattctggaggctaaccacgtgtccacactggcgtgcctgggtagcccctctaccgcaacggttaccattttcgacgatgatcacgctggaatcttcactttcgaggagcccgtgacccacgtcagcgaaagcatcgggatcatggaggtcaaagtgctaagaacttcaggggctaggggaaatgtgatcgtaccatacaaaactattgagggtaccgctcgaggaggaggcgaggactttgaggatacatgtggtgaacttgaatttcaaaatgatgagatagtgaagatcatcaccattcggatatttgacagagaggagtacgagaaggaatgcagtttttcattagtgcttgaagagcctaagtggattcggaggggtatgaagggcggctttacaataactgatgagtatgatgacaagcaaccactcacttccaaagaggaggaagagcggcgcattgccgagatggggcggcctatcctcggtgagcatacaaaattagaggtgattattgaggagagttacgagttcaaaagtaccgtggacaaactgatcaaaaagaccaacctggccctagtggtggggaccaactcatggcgggagcagtttattgaagcaatcacagtgtccgctggcgaagatgatgacgatgatgagtgcggggaagaaaaacttcccagttgctttgattacgtaatgcatttcctgaccgtgttctggaaggttctgtttgcgttcgtccccccaaccgaatattggaacggctgggcctgctttatcgtgagtattttgatgatcggtcttctcacagcattcattggcgatcttgcatcacacttcggctgcactatcggtttgaaagacagcgtgaccgcagtggtgtttgtggcactggggacaagcgtgccagacaccttcgctagtaaagttgccgcgactcaagaccagtatgcagacgcatccattggaaacgtgacaggctctaacgcggtcaatgtattcctaggtattggcgtcgcctggtctatcgccgccatctaccacgccgccaatggtgagcagtttaaagtgagtccgggtaccctggcgttcagcgtcaccctgttcacaatctttgcattcataaacgtaggagtcctgctgtacaggcgacgaccagagatcggaggagaattaggaggccccagaacagcaaagctgctgaccagctgcctctttgtgttgctttggctgctgtacatctttttctcaagtttggaggcatactgtcacatcaaggggttctag

SEQ ID NO: 135639 - DNA, 2922 bp, Artificial Sequence
  Description of Artificial Sequence: Synthetic coding sequence
atgtacaacatgcggaggctcagtctatcacccacatttagcatgggtttccacctgctcgtaacagtgtcattgctgttcagtcacgtggaccatgtaatcgccgagactgaaatggagggtgagggcaacgagactggggaatgcacggggagttattattgcaaaaaaggcgtgatactgccaatatgggaaccccaggacccaagcttcggggacaagattgctcgtgcaactgtctactttgtcgccatggtttacatgtttctgggtgtgtcgatcatagccgatagatttatgagttcgatcgaggtgattacgtctcaggaaaaggaaatcaccattaaaaagcctaacggagagacaaccaagacaaccgtgcgaatatggaatgagaccgtatcaaacctgactttgatggcactgggctccagcgccccagaaatcctgttgtccgtaattgaagtgtgcggacataacttcacggcgggcgatctaggaccctctaccatagtaggaagcgccgctttcaatatgttcattattatcgccctttgcgtctatgtggtcccagacggggaaactagaaagatcaagcatttgcgcgtgttctttgtcactgccgcatggagcattttcgcctatacatggttatacattatactctcagtgatttcccccggtgtggtggaggtatgggaaggactcctgaccttcttcttctttcccatatgtgtcgtgttcgcatgggtcgcagatcggcgcctcttattttataaatatgtgtataagcgataccgcgcaggcaagcaaagggggatgattatcgagcatgaaggagatcgacccagcagtaagactgagattgaaatggacggaaaggtcgttaactctcatgtggaaaactttctcgacggtgctctggttcttgaagttgacgagcgggatcaggatgatgaggaagccagacgggagatggctagaatcctcaaagaattaaagcagaagcaccccgacaaggagatcgagcagcttatcgaactggccaattaccaagtgctgtctcaacagcagaagagccgtgccttctatcgtattcaggcaacacgtctaatgaccggagcaggcaacattctgaagcgccatgcagccgaccaagcacgcaaggccgtttccatgcacgaagtgaacaccgaagttacagagaatgacccggtgagcaagattttttttgagcagggaacataccagtgtttggagaactgtgggaccgtggcgctgacaatcatcagacgcgggggagacctgactaacaccgtgtttgtggatttcaggaccgaagacggtaccgccaacgccggttcggactacgagtttaccgaaggaactgtcgttttcaaacccggagacacgcagaaagagattcgggtgggcattatagacgacgacatctttgaggaggacgaaaacttcctcgttcatctatccaatgtcaaagtgtcaagtgaggccagcgaggatgggatattggaggcaaatcatgtgagcactttggcatgtctgggctcccccagcacagccacagtgacaatcttcgatgatgatcacgcaggcattttcacctttgaagaacctgtcacacatgtgagcgagtctataggtatcatggaggtgaaagtgctacggacctcaggagctcgggggaacgtcatcgtcccatataagacaattgagggaactgccagaggaggaggggaagacttcgaagatacatgcggcgagctcgaattccaaaatgacgaaattgtgaagactattagcgttaaggttattgatgacgaagaatatgaaaagaacaagacattctttctcgagattggcgagccacgactggtggaaatgtccgagaaaaaagccttactgctgaatgagctgggaggcttcacaatcacaggtaagtatctcttcggccagcctgtctttcgtaaggtacacgccagggaacaccctattctgtctaccgtaattactatcgctgacgaatacgacgataaacagcctctcacctcaaaagaggaagaagaaaggcggattgccgaaatgggacgccccatcctgggagagcacacgaaactggaggtgataattgaggagagctatgagttcaagtccaccgtggacaagttaataaagaagacgaatcttgcactcgtcgtaggcaccaattcatggcgggagcagttcatcgaggctatcacagtctccgccggggaggacgatgacgacgacgaatgcggagaagagaaactgcccagctgtttcgactacgtgatgcatttcttgactgtgttctggaaggttctgtttgcctttgtgccgcccaccgagtactggaatggctgggcttgtttcatagtcagtattttaatgattggcctgctgacggcctttatcggggacctcgcctcacacttcggatgtaccatcggacttaaggactccgtgactgccgtcgtttttgtagctctgggcacgtctgtgcccgacacgttcgcttccaaagtagctgctacacaggatcagtatgcggacgcatctatcggcaacgttacggggagtaatgcagtaaacgtctttctgggcattggcgtggcttggagcatagccgccatctaccacgcagctaacggcgagcagttcaaggtgagccctgggaccctggccttctcagtaaccctgtttacaattttcgcctttatcaatgtgggcgtgctgctgtacaggcggaggcccgagattggaggagaacttgggggtcctcgcacagccaagctgttgacctcctgtctttttgtgcttctttggttattgtacatttttttctcatccctggaggcctactgtcatataaagggattttag

SEQ ID NO: 135640 - DNA, 2814 bp, Artificial Sequence
  Description of Artificial Sequence: Synthetic coding sequence
atgtataacatgcggaggctgtctctcagtccaaccttttctatgggtttccacctccttgttactgtgagtctcttgttttcacatgtagatcatgtgatcgcggagactgagatggagggggaggggaatgagacaggtgagtgcacaggttcctattattgcaaaaaaggcgtcattctccccatttgggaaccccaggatcccagctttggggacaagatcgccagggcaactgtgtacttcgtagctatggtatacatgttcctgggcgtatctattatagccgacagattcatgagctctattgaggttatcactagccaggaaaaagaaattacaattaagaagcctaacggcgaaacaaccaaaactactgtgcggatctggaacgagacagtcagcaacttgacactgatggctcttggcagcagcgcccctgagattctgctatctgtgatcgaggtgtgtggtcataactttactgccggggacctgggccccagtaccattgtcggaagtgcagccttcaatatgttcatcatcatcgcgctgtgtgtttacgtggtgcccgacggggagactcgtaaaattaagcacttacgcgtgttttttgtcacagccgcatggtctatcttcgcgtacacctggttgtatatcatcctgagcgtaatcagccccggagttgtagaggtttgggaagggctcctcacattcttcttcttcccgatctgcgttgtgtttgcatgggttgccgacagacggctgctgttttataagtatgtctataaacgctaccgagccggtaagcaaagaggtatgatcattgagcatgaaggagaccgtcctagtagcaagaccgaaatcgagatggacggcaaggttgtgaacagccacgtcgaaaattttctggatggggcgctcgtgctggaagtagatgaaagagatcaggacgacgaagaggctagacgggaaatggctaggatactcaaggaactgaagcaaaaacacccagataaagagattgaacagttaattgagctcgccaattatcaggtgctgagtcaacagcaaaagtccagggctttctataggatccaggccacccgcttgatgactggtgctggaaacattctgaaacgtcatgccgctgaccaagctcgtaaggccgtctccatgcatgaagtgaacaccgaagtgacggagaatgatccagttagcaagatcttcttcgagcagggcacctatcagtgtctagagaattgtggtaccgtggcactgacaattatccgtcgcggaggagacctcaccaacactgtttttgtggacttcagaacggaggatggaactgccaatgccggaagtgattacgaattcactgaaggcaccgtggtgttcaagcctggcgacacccagaaggagataagggttggtattatcgacgatgatatttttgaggaagatgaaaacttcctcgtgcatctgtcgaatgttaaggtttcctccgaagccagcgaggacggaatccttgaggcgaaccacgtctctactctggcctgcttaggctctcccagcactgccaccgtcaccatatttgacgatgatcacgctggaatctttacatttgaggagcccgttacccacgtgtcagagtccattggaattatggaagtgaaagtcctaagaacctcaggtgctcggggaaacgtgattgtgccctataaaaccattgaggggacggcaagaggcgggggagaggatttcgaggatacctgtggggaattagagtttcaaaatgatgaaatcgtaaaaattatcactataagaatatttgacagggaggagtatgagaaggaatgcagctttagtctcgtgttagaagagcccaaatggattcgaaggggcatgaaggggggctttacaattaccgacgaatatgacgataaacagcccctcacaagcaaggaggaagaggagcgccgtattgcagagatggggaggccaatattaggggagcatacgaaactggaagttattattgaggaaagctacgagtttaaatccaccgtagacaaactgatcaagaaaaccaatctggccctggtggttgggaccaatagctggagggagcagtttatcgaagcaattaccgtttccgccggcgaagatgacgatgatgacgagtgcggcgaggagaaactaccctcttgcttcgactatgttatgcactttttgaccgttttctggaaagtgctgttcgcttttgtgccgcctacagaatactggaacggttgggcctgttttatagtcagcatcctcatgatcgggctgttaactgcctttatcggtgatctggcttctcacttcggctgcactattggtttgaaagactccgttaccgccgtggtgttcgtagccttaggaaccagtgtgccggatacttttgctagtaaggtggcagccactcaagaccagtatgccgacgccagcattggtaatgtgactggcagcaacgctgtaaacgtgttcctaggcattggcgtggcgtggtcaattgcggctatataccatgcagcgaacggcgagcaatttaaggtgtccccgggaaccttagctttctctgtaacactattcactatttttgctttcattaatgtgggggtcctcctttatcggaggcgtcccgaaattgggggagagctgggtggcccccggacagctaagctgctcaccagctgtctgttcgtactgctgtggttgttgtacatctttttctcaagtctcgaggcatactgtcatatcaaaggattttag

SEQ ID NO: 135641 - DNA, 2907 bp, Artificial Sequence
  Description of Artificial Sequence: Synthetic coding sequence
atgtacaacatgagacggctttcactttcgccaaccttctccatgggcttccaccttttggtgacagtctcactgttattttcccacgtggaccatgttatcgctgagacagagatggaaggcgagggtaacgaaaccggcgagtgcaccggctcttattactgcaagaaaggggtgatcctccccatctgggaacctcaagacccctccttcggcgataaaattgctcgggctacagtgtatttcgtggccatggtctacatgtttttgggggtgagcatcattgctgatagattcatgtccagcattgaggtaatcactagccaagagaaggagattacaatcaaaaaacctaatggagagacaactaaaactactgtgcggatctggaatgagactgttagcaatctgaccctcatggccctgggtagctcagcccctgagatccttctgtctgtcattgaggtgtgcgggcacaatttcactgcgggcgatcttggcccttcgaccatagttggctctgccgcttttaacatgtttattataatcgccctttgcgtttacgtcgtccctgacggcgagacacggaaaataaaacacctacgcgtgttctttgtcactgccgcctggagtatttttgcttacacttggctgtacataatcttgagcgtgatctcgcctggcgtggttgaggtatgggaggggctcctgacgtttttcttctttccaatttgcgtcgtgttcgcatgggttgcggatcgcagattgctattttataaatatgtctataaacgctaccgggctggaaagcagcgaggcatgatcattgagcacgagggcgacaggccatccagcaagacagagattgaaatggatggcaaggtcgttaacagtcacgtcgaaaactttctcgatggcgctctggttctggaagtcgacgaaagggatcaggacgacgaggaggcacggagagagatggctaggattcttaaggaattgaagcagaagcatccagacaaggaaattgaacagctcatagaactggcaaactatcaggttttgagccaacagcagaaatctcgcgccttttaccggatccaagccacccgccttatgaccggtgccggtaacattctgaagcgacacgccgctgatcaggcacggaaggctgtgagcatgcatgaagtaaacaccgaagtcactgaaaatgatcctgtcagcaaaatcttttttgaacaagggacttatcagtgtctggaaaactgtggtaccgtagcactgactattattcgcagaggtggtgacttgacgaatacagtctttgtggactttcgcacagaggacggcacggctaatgccgggagtgactacgagtttacggaggggacagtggtgtttaagccgggtgacacccaaaaggaaatcagggtggggattattgatgacgacatatttgaggaggatgagaacttcttggtgcatctcagcaatgttaaggtgagttccgaagcctcagaagacggtattctggaggctaaccacgtgtccactctggcttgtttggggagcccatccactgccacggtgacgatcttcgatgacgaccacgccgggattttcacattcgaagaaccagtaactcacgtatccgagtccataggaataatggaagtgaaagtgttacggacaagtggtgccagagggaacgtcattgtgccttacaagaccatcgagggcacggccagaggaggcggtgaggactttgaggacacatgcggagagttggaatttcagaacgatgaaatagttaagaccatttccgtcaaggttatcgacgacgaggaatacgagaaaaataagactttcttcttagaaattggggagcccaggctggttgagatgtccgagaagaaggcacttctgctaaatgaattgggagggttcacaatcactggccagcctgtctttagaaaggtgcacgctcgggagcacccgatcctgagtaccgtgatcacaatcgctgacgaatacgatgacaagcagcctctcaccagcaaggaggaagaagaaaggcgtatagccgagatgggcaggcccatcttaggtgagcatactaagttagaggtcattatcgaagagagttatgaatttaagtccactgtggacaaactcatcaagaaaaccaatctagccttggtggtgggcaccaacagctggagagagcagtttattgaggccatcacagtatcagccggggaggacgacgacgatgacgagtgcggagaagaaaaactaccatcatgcttcgactatgttatgcatttcttgaccgttttttggaaggtactctttgcattcgtaccaccaactgagtactggaatggatgggcctgcttcattgtcagtattctgatgatcggcctcttgacagcgttcatcggagacctggctagccattttggatgtaccatcggcttgaaggacagcgtaacagctgttgtgttcgtcgccctggggacgtccgtaccggacacctttgcatctaaagtggctgccacccaggaccagtacgccgacgcttccatcggtaatgtcaccggttcaaatgcagtgaacgtgttccttggtatcggtgtcgcgtggagcatagcggccatttatcatgctgctaatggggaacaattcaaggtgagcccgggaacacttgcctttagcgtgaccctgttcacaatctttgccttcataaatgtcggggtgctgctctaccggaggaggccagaaattggcggggagctgggcgggccacggaccgcgaaacttctaacctcttgtctcttcgtgctgctctggcttctgtacatcttcttcagtagtttagaagcttactgccacattaagggattctag

SEQ ID NO: 135642 - DNA, 2814 bp, Artificial Sequence
  Description of Artificial Sequence: Synthetic coding sequence
atgtataacatgcggcgcctttcactaagccctactttctccatggggttccacttgctcgtaacagtgagtcttctgttctcccacgtggatcatgttattgctgaaaccgagatggaaggtgagggcaacgagaccggggagtgcacaggatcctattactgtaagaagggggtgatcttgcctatttgggaaccgcaggacccatcattcggcgacaaaatcgctcgtgctaccgtgtatttcgtggcgatggtctacatgttcttaggcgtgtctatcatcgcggatagatttatgagctcgatcgaggtgattacttcacaggaaaaggaaatcacaatcaagaaacctaatggcgagacaacaaagacaacagtgcggatctggaacgaaactgtcagcaacctgacactaatggctcttgggagcagtgctccagaaattctattatccgtcatcgaggtttgtggacacaatttcaccgctggcgatctcggccctagcacaattgtgggcagtgcggccttcaacatgttcatcatcatcgccctgtgcgtttacgtagttccggacggggagacaaggaaaatcaaacatttaagagtcttcttcgtgaccgccgcctggtccatctttgcgtatacatggctgtatatcatcctctcagttatttctcccggcgtggtggaagtttgggagggactcttaaccttcttcttcttccctatctgcgtggtctttgcatgggtggcagaccgaaggttgcttttctataagtacgtatacaagaggtaccgagcaggcaagcagagaggcatgattattgagcacgaaggagatcggcctagtagcaagactgaaatagagatggatggtaaagttgtaaacagtcatgtggagaattttttggacggcgccttggtgttagaggtggatgagagggaccaggatgacgaggaagccagaagagaaatggcacggatccttaaagaactcaagcagaaacaccctgataaagagatcgagcagcttatcgaactcgccaattatcaagtcctgagccagcagcaaaaatccagagccttttacaggatccaagcaacaagactgatgactggtgccgggaatatactgaaacgacatgctgcagaccaggcgcggaaagccgtgagtatgcacgaggtcaacactgaagtgactgaaaacgatccagtgtccaaaatcttctttgaacagggtacttatcagtgtttagagaactgcgggaccgtcgcattgacgataataaggagggggggtgacttaacgaatactgtgtttgtggacttcaggacagaagacgggacagctaatgctgggtcagattatgaatttaccgagggaaccgtggtttttaaacccggcgatacacagaaagaaatccgagtagggattatcgacgacgacatcttcgaggaagacgagaacttcctggtgcacctctctaatgttaaagtaagttcagaggccagcgaggatggcatccttgaagccaaccatgtgagcaccctggcatgcctagggtcaccttccaccgctacagtgacgatctttgatgacgaccatgcaggtatattcacttttgaagaaccggtcacgcacgtcagtgagagtatcggcattatggaggttaaagtactccgcactagtggcgcgcggggaaatgttatagtaccttacaaaacaatagaagggacggcaaggggaggtggtgaagacttcgaagacacctgtggtgaactcgagtttcaaaacgacgagatagttaagatcattaccattcgcattttcgatcgggaagagtacgaaaaggaatgctcctttagtttggtgcttgaggaaccaaaatggattagacgtggtatgaaggggggtttcacaattaccgacgaatacgatgacaaacaaccgctgacaagtaaggaggaggaggagcggaggattgcggagatggggagacccatcttgggcgaacacacaaagttggaggtgatcatcgaagagtcctacgagtttaaatccacagtcgataagctaatcaaaaaaactaatctcgccctcgtggtgggcaccaatagctggagggagcaatttattgaagcgattaccgtatctgcgggcgaagatgacgatgatgatgaatgcggtgaagaaaaactgcctagctgcttcgattacgtcatgcattttctgacagtgttctggaaggtgctgttcgctttcgtgccaccaaccgaatattggaatggatgggcttgctttatcgtttctatcctcatgatcgggctcctcacagccttcattggggatctggcctctcacttcggctgtactatcggactcaaggatagtgtgaccgcagtggtgtttgtggccctcggcactagcgtcccggacacatttgcttccaaagtggccgcaacacaggaccaatacgcagacgccagcatcggcaacgtgaccggaagtaacgcagtgaacgtctttctcggtataggcgttgcctggtcgatcgcggctatctatcatgcggccaatggagaacaatttaaagtaagtcccggcacacttgccttttctgtgaccctcttcacaatttttgcttttattaatgtgggcgtgttactttaccggcgaaggccggaaattggtggcgaattgggcggcccacggaccgccaagttactcacaagttgcctgtttgtgttgctctggttgttgtacatctttttttccagcctcgaagcatactgccatataaaaggcttctag

SEQ ID NO: 135643 - DNA, 2814 bp, Artificial Sequence
  Description of Artificial Sequence: Synthetic coding sequence
atgtataatatgagaaggctctcactatctcctactttcagcatgggttttcatttactggttacagtgagtctccttttctcccatgtcgaccacgtgatagcagagacggagatggaaggggagggaaacgaaaccggagagtgtacaggaagttactactgtaagaaaggtgtgattctccctatctgggaacctcaagacccctccttcggcgataagatagctagagccactgtgtattttgttgcgatggtgtacatgttcctcggcgtgtccattattgcggaccgatttatgtcaagcatcgaggtcattacttctcaagagaaggagattacaatcaagaaacctaatggtgaaaccaccaagactacagtgagaatttggaatgagactgtttctaacctgactctgatggctttggggagcagcgcgccagagattctgctgagcgtgatcgaagtctgcggacacaattttacggccggagacctcggtccatctactatcgtggggagtgccgcctttaatatgttcattatcattgctctttgcgtctatgtagtgccggatggggagacacggaagattaagcatttacgggtgttctttgtaaccgctgcctggagcatctttgcctacacttggctttatattatcttgtcagtcatctcacctggcgttgttgaggtgtgggagggactcctaactttctttttctttcccatctgcgtcgtgtttgcttgggtagctgacaggcggttgctgttctacaagtatgtttataagaggtaccgagcgggtaaacagcggggtatgatcatagaacacgagggggatcgacctagctcgaagaccgaaatagagatggacgggaaagttgtcaattctcatgtagagaacttcctagacggggccctggtattggaagtagatgagcgtgatcaggatgacgaggaagccagacgggaaatggcccgcatattgaaggaactgaaacaaaaacatcctgataaggaaatcgaacagctgatcgagcttgccaactaccaagttttatctcagcagcaaaaatctcgcgctttttaccgcatccaggccactagattgatgacaggggccggaaacatccttaaacgccacgctgccgaccaggcgaggaaggctgtgagcatgcacgaggtaaacactgaagtgaccgaaaacgaccccgtgtccaagatcttcttcgaacagggcacatatcagtgcctcgaaaactgcggcaccgtggccctaactatcatccggcgcgggggtgacctgactaacaccgtttttgtcgattttcgcactgaagacgggactgcgaatgcagggagcgattacgagttcaccgagggtacagtggtgttcaagccgggggatactcagaaagagatcagagtcggtattattgatgacgacattttcgaagaggacgagaacttcctcgtccacctctctaatgtgaaagtttcatcagaagccagcgaagacggtatcctcgaagccaaccacgtctccacattagcttgtttgggctcgcctagcaccgccaccgtcaccatcttcgatgatgatcatgctggcatttttacctttgaggagcctgtgacccatgtttccgaatccattggcattatggaagttaaggtccttagaactagcggggctaggggaaacgtgatcgtcccttacaagactatagagggcactgctaggggcggaggggaagacttcgaggatacttgcggagaattggagtttcagaacgacgagatcgtaaagatcattacaataaggatctttgatcgcgaggaatacgagaaggaatgcagctttagcctggtcctggaggagccaaagtggattagacgcggcatgaagggaggatttactattaccgatgaatatgatgacaagcagcctttgacatctaaggaggaggaagaaaggagaattgctgagatggggcgccctatccttggcgagcatacgaaactggaggtgatcatcgaggagagttacgaatttaaatcaaccgttgacaagctcataaagaagacaaacttagccctagtggtgggcactaatagttggagagagcagtttatcgaagctatcaccgtgtccgctggtgaagacgatgatgatgatgagtgcggtgaagagaaactaccaagctgctttgactatgtgatgcactttttgacagtcttctggaaagtgctgtttgctttcgtcccacccaccgagtattggaacggctgggcctgcttcatcgtgtctattctgatgattggactgctgactgccttcatcggagatctagctagccatttcggttgtaccattgggctgaaggacagtgtgaccgcggtcgtgtttgtggccctaggcacaagcgtgcccgacaccttcgcatctaaggtagccgccacccaggaccagtatgctgatgcttctatagggaacgtgacagggtccaacgcggtgaacgtattcctgggaatcggagtggcatggagtatagcggcaatataccacgcggccaacggtgagcagttcaaagtgagtcccggcacactggcatttagcgtgacattgtttacgatcttcgcttttattaacgtcggggtcctgctgtatcggcggagaccagagataggcggtgagctcgggggcccacgtaccgcgaaactcctgacatcctgcttgttcgtgctcctatggctcctgtacatctttttctcctcgctggaggcttattgtcacataaagggattctag

SEQ ID NO: 135644 - DNA, 1995 bp, Artificial Sequence
  Description of Artificial Sequence: Synthetic coding sequence
atgagaaggctcagcctttcaccgacattctcaatgggattccacctgctagtcaccgtctctctcctgtttagccacgtcgaccacgttatcgcggagaccgagatggaaggggaagggaacgaaaccggggagtgcactgggagttattattgcaaaaagggcgtgatcctgccgatctgggagccccaggatccatccttcggcgataaaattgcgcgcgccaccgtatatttcgtcgcaatggtgtacatgttcttaggggtgagtattatcgccgaccgatttatgtcttctattgaggtcattacatcacaggagaaggaaatcactatcaaaaaacctaacggggagacgaccaaaacaactgtacgtatatggaacgagaccgtgtccaatttgacactgatggccctcgggagtagcgcacccgaaattttgctgagtgttattgaggtgtgcggacacaactttaccgcgggcgacctgggcccctctactattgtgggaagcgcagcctttaatatgtttatcattatagctctttgcgtttatgtcgtccccgacggtgaaacaaggaaaattaaacacctgagggtgttctttgtcacggctgcttggtcaatcttcgcatacacctggctttacatcatcctgagcgtaatatcccctggagtggtggaggtgtgggaaggtctgctgacgttttttttctttcccatctgtgtagttttcgcatgggttgccgacaggcgactcctgttctataagtatgtgtataagaggtaccgggctggtaaacagcgtggaatgatcattgaacatgagggagataggcctagttccaagaccgagattgagatggatgggaaagtggtcaactcccacgtggagaactttttggacggagccctggtgctggaggtggacgagcgggaccaggatgacgaggaagccagacgcgagatggcccgcatcttgaaagagctgaaacaaaagcaccctgacaaggagatcgagcagttgatcgaactggccaattatcaggtgctgtcccagcagcagaagagtagagcattctatcgaatccaggccaccaggctaatgaccggtgcgggtaacatactgaagcgccacgccgcggaccaggctcgcaaagcagtaagcatgcatgaggtgaatactgaagtaactgaaaacgatccagtatctaaaatttttttcgagcagggaacataccagtgcttggaaaattgtggcacagtggcactgacaattatccgccgaggcggcgatcttaccaataccgtcttcgtggactttagaacagaggatggcacagccaatgcgggctctgactacgaattcaccgaggggaccgtggtgtttaaacctggtgacacccaaaaagaaattagagtcgggattatcgacgacgatatcttcgaggaagacgagaacttccttgtgcacttaagcaatgtgaaggtcagctcagaggctagtgaggacggtatcttagaggctaaccatgtgtcaacattggcttgtttgggcagcccttcgacagcaaccgtcactatctttgacgacgaccatgccggaatattcaccttcgaggagcccgtgactcacgtaagcgagtccataggtattatggaagtgaaagttctccgtactagcggtgcccgagggaacgtcattgtcccctataagaccatagaagggactgcacggggaggcggggaagactttgaagatacgtgtggggaacttgagtttcagaatgacgaaatcgtgaagactatcagcgtcaaagttatagacgatgaagaatatgaaaagaacaagacgttcttcttggagataggcgagcctcggcttgtggagatgtctgaaaagaagggcagaagtcttcccctggaatatctaaccgtgcggaacatgcgaaaatccgcagtgagtccgctctgtctgagaaaccagaatggatag

SEQ ID NO: 135645 - DNA, 2898 bp, Artificial Sequence
  Description of Artificial Sequence: Synthetic coding sequence
atgtataatatgaggcgcttgagcttgtcaccaaccttctccatgggctttcacctactggttaccgtgagcctgctgttcagtcatgttgaccatgtaatcgcggagactgaaatggagggggagggcaatgaaaccggggagtgcactgggagttactactgcaaaaagggtgtgatcctgcccatctgggagccccaggaccccagctttggagataaaattgctagagcgactgtgtatttcgtcgcgatggtttacatgtttctgggcgtgtccatcatcgcggatcgttttatgagcagtatagaggttataacttcccaggaaaaagaaatcacaatcaagaagcctaacggagagaccaccaagaccacagttcgtatctggaacgagacggttagcaacctgactctgatggcacttggttcttcagcgcctgagatcctactgagcgtgattgaggtgtgcggtcacaacttcactgccggtgatcttgggccctcaacgattgttggctctgccgctttcaacatgttcataatcatagcactgtgcgtctacgtcgtaccagatggtgaaaccaggaagatcaaacacctcagagttttcttcgtaacggccgcctggagcattttcgcttatacttggctctatataatcctgagcgtcattagccctggtgtggtggaagtctgggaggggcttctgacatttttttttttcccgatctgcgtggtcttcgcttgggtcgctgatcgacgcctgctgttctacaagtatgtctataaaagataccgcgccggcaaacagcggggcatgatcatcgaacacgagggcgatagaccctcgagcaagactgagatagagatggatggcaaagtggttaacagccacgtcgagaactttctcgatggcgcactagtcttagaagtcgatgaaagggaccaggacgacgaggaagcccgccgcgaaatggctcggattctgaaggaattaaagcagaaacatcccgacaaggaaatagagcagctaatcgagctggctaactaccaggtgctgagccaacagcagaagtcgagggctttctatagaatccaggccactagactgatgacaggcgctggtaacatcctgaagcggcacgccgcggaccaagctaggaaagcagtttcgatgcatgaggtaaatactgaagtcacagagaacgacccagtgtcaaagatattcttcgaacaagggacataccagtgtctggagaactgcgggaccgtggcactgaccatcataagacgggggggcgacctgactaacaccgtctttgtagatttcagaacagaagacggtaccgctaatgccggtagcgactatgaatttactgagggaacagtggtattcaaacctggggacacgcaaaaagaaatacgcgtgggtattatcgatgatgatatttttgaagaggatgaaaacttcttggttcacctatctaatgtcaaagtgagcagtgaagcgtccgaagatggtatcctcgaggccaaccatgtgtcaacactcgcttgcctgggaagtcccagtacggctactgtgacaatctttgacgatgaccatgccggtatttttacatttgaggaacctgtaacccacgtgtcggagagtatcgggatcatggaagttaaggtgctgcggacatctggagccaggggtaatgtgatcgtaccatataaaactatcgagggcacagcccgaggcgggggggaagacttcgaagatacatgcggcgaacttgaattccagaacgacgaaatcgtcaaaattatcaccatcaggattttcgaccgggaggagtacgagaaggagtgttcattctccttggtgctggaggagcctaaatggatcaggcgcggtatgaagggggggttcacaatcacgggcaaatacctatttggacagcccgtgtttcggaaggttcacgcacgcgaacatcctatcttatccaccgtgataactatcgcggatgagtatgacgacaaacagccccttacatcgaaggaggaggaggagcggcgcattgcagagatgggccgaccaatcctgggagagcataccaagctcgaagtgataatagaggagagctatgagtttaagtcgacagttgataagctgatcaaaaagaccaacttggccctcgttgtaggcacaaatagctggagggagcaattcattgaggcaattactgtcagcgcgggcgaagacgacgatgacgacgaatgcggcgaggagaagctgccttcatgttttgattatgtcatgcacttcctgactgtgttctggaaggtcctatttgccttcgttccacctacagaatactggaacggctgggcatgcttcatcgtaagtatacttatgatcggactgctgaccgccttcattggcgacctggcttctcatttcgggtgcactattggccttaaggatagtgtcaccgcagttgtgttcgtagccctgggcacttcagtgcccgacacgttcgcatcaaaggtcgctgccactcaggatcagtatgctgatgcgagcattggcaacgtcacggggtctaacgccgtcaacgtgtttcttggtataggcgtcgcatggtccattgccgcaatataccacgccgctaatggcgagcagtttaaagtttcgccaggcactcttgccttttccgtgactctgttcaccatttttgcgtttattaacgtgggcgtcctgctgtacaggcgacgacctgagatcggcggcgagctgggaggcccacgcacagctaaactcctcacgtcatgtctcttcgtgctgctctggctgttgtatatatttttcagtagcttggaggcatactgtcacatcaaaggcttttag

SEQ ID NO: 135646 - DNA, 222 bp, Artificial Sequence
  Description of Artificial Sequence: Synthetic coding sequence
atgtacaacatgagacgactctccttatctcccacttttagcatggggttccacctgcttgtcaccgtctcactgctcttcagccatgttgatcatgttattgctgagaccgagatggaaggagaagggaacgagactggagagtgtaccggctcctactattgtaagaagggagtaatcctgccaatttgggagcctcaggatccatccttcggcgattag

SEQ ID NO: 135647 - DNA, 264 bp, Artificial Sequence
  Description of Artificial Sequence: Synthetic coding sequence
atgtacaacatgcgtcgtctgtcactatcccccaccttcagtatggggtttcatctgctggtgacagtcagcctgctattttcacacgtggaccacgtaattgccgagacggaaatggaaggagagggaaacgaaacaggtgaatgcaccggaagctactactgcaaaaaaggggtaattttgcccatttgggaaccccaggacccatctttcggggataagattgcccgagccacagtgtacttcgtggctatggtctactag

SEQ ID NO: 135648 - DNA, 264 bp, Artificial Sequence
  Description of Artificial Sequence: Synthetic coding sequence
atgtacaacatgcgtagactatcgctcagcccgactttcagcatggggttccatcttttagtgacagtgtccctactgttttctcacgttgaccacgtcatcgccgaaacagagatggagggcgaaggcaatgagaccggggaatgcacgggatcttactactgtaaaaagggagtaatcctgccgatctgggaaccccaggacccgagctttggggacaaaatagccagggcaacagtgtattttgtcgccatggtctactag

SEQ ID NO: 135649 - DNA, 2883 bp, Artificial Sequence
  Description of Artificial Sequence: Synthetic coding sequence
atgtataatatgcggcggttaagcctgtccccaacattctccatggggtttcacttactagtcactgtttccctgctgttcagtcatgttgaccatgtgattgcagagaccgaaatggagggcgaaggtaacgagacaggcgagtgtactgggagctattattgcaagaagggagtcatcttgcctatttgggaacctcaggatccttcgtttggcgacaaaattgcgagagccactgtttacttcgttgcaatggtgtacatgtttttaggcgttagtatcattgcagatcgctttatgagcagcatcgaagtgattaccagccaggaaaaggagatcacaatcaagaaacctaacggggagaccacgaagaccacagttagaatctggaatgagaccgtaagtaatctgactctcatggcgctgggcagctcagcccctgagatactgttgagtgtcattgaggtttgcggtcacaatttcaccgccggcgatctcggaccgtcgactattgtgggcagtgccgcctttaatatgtttattattatcgcactttgtgtctatgtggtgccagacggtgagaccaggaagatcaagcacctgcgagttttcttcgttacggccgcctggagtatctttgcgtacacctggctgtatattatcctaagtgtcatatcccccggcgtggtagaggtttgggaaggcctcctgaccttttttttctttcccatctgcgtggttttcgcctgggtagctgatcggagactgctgttctacaagtatgtgtataaacgctatcgagcaggaaagcagcgtgggatgatcatcgaacacgagggcgaccggccgagctccaagacagagatcgagatggacggaaaagtcgtcaactctcacgtcgagaatttcctcgatggagcgctggttctggaggtagacgagcgggaccaggacgatgaggaggccagacgggagatggcacgaatcctgaaagagctgaaacagaaacatccagataaagaaattgagcagctaatcgagctcgcaaattaccaggtcctgtctcagcaacaaaagagccgcgccttctacagaatccaggcaacacgccttatgaccggtgctggcaacatcctgaagagacatgcagccgaccaggctcgcaaggcagtctctatgcacgaagtaaatactgaggtgacagaaaacgacccagtgtcaaaaatcttctttgagcagggtacatatcagtgcttagagaactgtgggacggtggctcttaccattattaggagagggggcgacctgacgaacaccgtgtttgtcgacttccgcactgaagatggcacagctaatgcagggtccgactacgagttcaccgaaggaactgtagtctttaaaccaggcgacactcagaaagagattagggtcggtatcatcgatgatgacatattcgaggaagacgagaactttttggtgcacctgtccaatgttaaagtgagttccgaagcaagcgaggatggaatcttagaggccaaccacgtaagcaccctggcctgcctggggtctccatctactgctacagttactatcttcgacgacgaccacgccggtatctttacgtttgaggagcctgtaactcatgtctcagagagtattggaattatggaagtcaaggtactcaggaccagtggggctcgaggaaacgttattgtcccttataagacaattgagggtaccgccagaggtgggggtgaggattttgaggatacttgtggagagctcgagttccagaatgatgaaatcgtaaagataattactatccgtatcttcgaccgggaagagtacgagaaggaatgcagcttctcactggtccttgaggaaccgaagtggatccggagaggaatgaaagaaggattctggctgtcctctcagcctgtgtttagaaaagtccacgcgagagaacacccaatcctgtctacagtcatcactatcgcagacgagtacgacgacaaacagcccctcacatctaaagaagaggaagagagaaggatcgccgagatggggaggccaatcctgggggagcatacaaagcttgaggtgattattgaggagagttatgaattcaaaagtacagtggacaagcttatcaagaagactaaccttgcactggtggtaggcactaacagctggagggagcaattcatagaggctatcactgtgtctgctggggaagatgatgacgacgacgaatgtggagaagagaagctgccctcttgttttgattacgtaatgcactttcttacagttttttggaaggtcttattcgcctttgttccccctaccgagtactggaacggctgggcatgcttcatcgtatccatattgatgataggcctgctaactgctttcatcggtgaccttgcgtcccattttggctgtactatcgggctcaaagacagcgtgactgctgtagtcttcgtggcactgggaacgagcgtgcctgacacttttgcttcaaaggtggccgccacccaggaccagtacgcagatgcaagtataggcaatgtaaccggaagcaatgccgtcaatgtgtttctgggcatcggggtggcttggtcgattgccgctatttaccatgccgctaacggcgaacagtttaaggtttctcctggaactctcgccttcagcgtgactttgtttacaattttcgcttttataaatgtaggagtactcctgtatcgaaggagacctgagatcggaggcgaattgggagggccacggacagccaagcttttaaccagctgtctgtttgtacttttatggctcctctatatttttttttcttccctggaggcatactgtcacattaagggattctag

SEQ ID NO: 135650 - DNA, 2814 bp, Artificial Sequence
  Description of Artificial Sequence: Synthetic coding sequence
atgtacaacatgcgtcgattgagtttgtctccaactttcagtatgggcttccaccttctggtaacagtgtccctgttgttttcacatgtggaccacgtgatcgccgaaacagaaatggaaggcgaggggaatgagaccggcgaatgtaccggcagctattactgcaagaaaggtgttattctccccatctgggagccccaagacccgtctttcggtgataaaatcgcccgagccacggtttatttcgtggccatggtctatatgttcctgggcgtctctattatcgctgacaggtttatgtcgtccatcgaggtgatcacatcccaggagaaggaaatcaccataaagaaacccaacggcgaaaccactaagacgactgtgcggatttggaacgagacagtcagtaacctgaccttgatggcactgggatcctcagccccagaaatcctcctgagtgtcatcgaagtgtgcggacacaatttcacagccggcgatctgggcccatctaccatcgttggttcagctgctttcaacatgttcataataatagccctttgcgtgtacgtcgtgccagacggcgagacacggaagatcaaacaccttagggtcttctttgtgactgcagcatggtcaatttttgcttatacttggttatacataatcctgtcagtcatttcacccggagtggtcgaagtgtgggaaggcttgctaacctttttcttctttccaatctgcgtggtcttcgcatgggtggcagacaggaggctgctgttctacaaatacgtgtataagcgctacagagcaggcaagcagcgcggtatgattattgagcacgaaggcgaccgcccatcttcaaagaccgaaattgagatggatggaaaggtcgtgaactctcacgtggagaatttcctcgatggcgcgctggtcctagaggtggacgagagggaccaagatgacgaggaggctcgtcgggagatggccagaattcttaaggagctgaaacagaaacacccagataaagagattgagcagctcatagagctcgcgaactatcaggtgctgtcacagcagcaaaaaagtagggcgttctataggatccaggccacaaggctcatgactggtgccgggaacatcttgaagagacacgcagccgaccaggcccgtaaagctgtatctatgcatgaggttaatacggaggtgacagagaatgacccagttagcaagatcttcttcgagcaaggtacttatcagtgtctcgagaactgcggaaccgtggctctcacaatcattagaagggggggcgatctgacaaatacggttttcgtcgattttaggactgaggacggtacggctaacgcaggatccgattacgaattcacagaggggacagtcgtgttcaagcccggcgatacacagaaggagatccgggtaggaataattgacgacgacatcttcgaagaagacgaaaattttcttgttcacctgagcaatgtgaaggtgagttctgaagcatctgaggatggcattttggaagctaaccacgtgagcaccctcgcttgcctggggtctccctcaactgctacagtaaccatcttcgatgatgatcacgccggcatattcacgtttgaagaaccagtgactcacgtgtctgaaagtattggaatcatggaagtgaaggtactcaggacctcaggtgcccggggaaacgtcatcgttccatataaaacaattgagggcactgcaaggggcggcggcgaagatttcgaggacacatgcggggaacttgaattccaaaacgacgagattgtcaaaatcattaccatcagaatttttgacagggaagagtatgagaaggaatgcagcttctccctcgtgttggaggaacctaaatggatccgaaggggtatgaaggaggggttctgttttacggatgagtatgatgataagcaacccctcacttctaaggaggaggaagaaaggaggatcgcagagatgggccgccccatcctgggcgaacacaccaagttggaggtcatcatcgaagagagctacgagtttaaatccaccgtggataaactcatcaagaagactaacctggccctcgttgttggtaccaatagctggcgggaacagttcattgaggcaatcacagtctccgcgggtgaggacgacgatgacgacgagtgtggtgaggaaaaactgccctcgtgctttgactacgtgatgcattttctgaccgtgttctggaaggtgctgttcgcatttgttcctcctacagaatattggaatggatgggcatgcttcattgtgagcatcctgatgattggcctgttgaccgcatttattggagatttagcatcacatttcggatgtacaataggccttaaagattcagttactgcagttgtgtttgtagcgctagggaccagcgtcccagacacgtttgcaagcaaagtggccgccactcaggatcagtacgctgatgcttccatagggaacgtaacaggttcaaatgccgtgaatgtgttccttgggattggcgtggcgtggagcatagcggccatttaccatgctgcaaatggggaacaattcaaagtcagccccggaaccctggcattctcagttaccctgtttactatcttcgcgttcattaatgtgggcgtgctactgtatcggcgaaggccggagattgggggggaactgggcggacctagaacagcgaaactcttgacctcatgtctgtttgttttactgtggctgctgtacatctttttctcctctctcgaagcatactgtcacataaagggtttttag

SEQ ID NO: 135651 - DNA, 417 bp, Artificial Sequence
  Description of Artificial Sequence: Synthetic coding sequence
atgtacaacatgaggagactgtccttgtccccaacgttctccatgggcttccacttgcttgtcactgtgtcactgctcttttcacatgtggatcatgttattgctgaaaccgaaatggagggagaaggaaatgagacgggcgagtgcaccgggtcctattattgtaagaagggggttattctgccaatatgggagccacaagacccttcttttggcgataagatcgcccgcgccactgtgtactttgtggctatggtgtatatgttcctcggggtgagcattatcgccgaccggttcatgagtagtatcgaggttatcacttctcaggagaaggaaattaccattaagaagcctaatggggaaactaccaaaactactgttcgaatttggaacgaaacagtaagtaacctgacctag

SEQ ID NO: 135652 - DNA, 2907 bp, Artificial Sequence
  Description of Artificial Sequence: Synthetic coding sequence
atgtacaacatgaggaggctcagcctttccccaaccttttcaatgggtttccatctactggtaacagtgagcctgctgttctctcatgtcgatcatgtcatcgctgagactgagatggagggtgaaggtaatgaaacaggagagtgtacaggaagctactactgcaagaagggtgttatcctgcctatatgggagccgcaggaccctagttttggtgacaaaattgctcgcgctaccgtgtactttgtagccatggtttatatgtttctgggagtctctattatcgcggacagattcatgtctagtatcgaggtcataactagccaggagaaggagatcacaatcaagaagccgaacggggaaacaactaagaccacggttcggatttggaatgagacagttagcaacttgactctgatggcgctggggtcaagcgcccctgaaatcttgttgagcgttatcgaggtatgcgggcataactttacggccggagatctggggccgagcaccatagttggatcagcggccttcaacatgtttataatcatcgcgctttgtgtgtacgtggttcctgatggggaaacaagaaagatcaaacatctgcgcgtgttcttcgtgaccgccgcttggtcaattttcgcctacacctggctgtatatcatactcagcgtgattagccctggagtggttgaagtgtgggagggcctattaacattcttctttttccccatatgtgtcgtgtttgcatgggtagccgaccgccgcctcctgttttataagtacgtctataagcgctaccgggccggcaagcaacgaggcatgatcatcgagcatgagggagatcgcccctcctcaaagacagagattgaaatggatggtaaggtggttaatagccacgtcgaaaacttcctggatggagctctggttctggaagttgacgagcgggaccaggatgacgaggaagcccgtagggagatggctcggatcttgaaagagttaaaacaaaaacaccctgacaaggaaatcgagcagttgatagagctcgccaattaccaagtcctgagccagcaacagaagtcccgggccttctaccgcatccaggcaacgcggctgatgacaggggcaggcaatatccttaaaaggcacgcggcagaccaggcccggaaggccgtgagcatgcatgaggtcaacacggaagtcaccgagaacgatcctgttagcaagatcttcttcgagcagggcacttatcagtgtcttgaaaattgcggcactgtggctttgacaattattcgcaggggtggagacctgaccaacacagtttttgtcgattttcggacagaggatggcacagccaatgccgggagtgattatgaatttactgaggggaccgttgtctttaaacccggcgatacccagaaagaaattagagtggggatcattgatgacgatatcttcgaggaggacgagaactttctggtacatctctccaatgttaaggtgtcatccgaagctagcgaggatggaattcttgaggctaaccatgtgagcactctagcctgcctgggaagcccatctacagccactgtgaccatttttgatgatgaccacgcagggatctttacattcgaggaaccagtcacacatgtatcggaatcaattgggattatggaggtgaaggtcttacggacttcaggcgcgcggggaaacgtcattgtaccttataagactatagagggtactgctcgagggggaggcgaggacttcgaggacacatgcggcgagctggaatttcagaacgatgagatcgtcaaaacaatatccgtcaaagtaattgacgatgaggagtatgagaagaacaaaacctttttcctggagattggagagccaaggcttgtggaaatgagcgagaagaaagcgctgctgctgaacgagctcggaggctttacgatcactggccagcccgtgttccgcaaggtccatgcccgggaacaccccatccttagcacggtcataacaattgctgacgaatatgatgataagcaaccactaacgtctaaggaggaggaggagaggcggatcgccgaaatggggagacctatcttaggcgagcatactaagttggaagtgattatcgaagagtcctatgagttcaaatctaccgtggacaagctgattaagaagacaaacctggctcttgtcgtgggaaccaattcttggcgggagcaattcattgaggctattacagtgtctgctggcgaagatgatgatgacgacgagtgcggagaggagaaacttccttcttgcttcgactatgtcatgcactttctcacagtgttctggaaagtgttgtttgcatttgtcccacccactgaatattggaacggctgggcatgttttattgtctccattctgatgatcggtttgctgactgcgttcatcggggaccttgccagccactttggctgcaccatcggattaaaggatagcgtaactgctgtggtttttgtcgcgctcggcaccagcgttcctgatacctttgcatcaaaagttgctgctacccaggaccaatatgccgatgcatctatcggtaacgttaccgggagtaacgcagtgaacgtgttcctgggcattggggtggcttggagcattgccgccatataccatgccgcaaacggcgaacagttcaaggtgagccccggtacattagcctttagcgtcaccctgttcactatattcgccttcattaacgtcggagtcctgctgtacaggcgccggccagaaataggtggggagctgggcggccccagaactgcgaaactgctaacctcctgcttattcgtgttgttatggctactgtatattttcttctcgtccctggaggcttactgccatattaagggattctag

SEQ ID NO: 135653 - DNA, 2766 bp, Artificial Sequence
  Description of Artificial Sequence: Synthetic coding sequence
atggctccactggcgctcgtcggcgttaccctgctgcttgctgcaccaccttgctctggagccgcaacacccactcccagcctgcctccaccacccgccaatgacagtgatacaagcaccggaggatgtcaagggtcttaccgctgtcaacccggtgtgttactgcctgtgtgggaacccgacgatccatccctgggcgataaagccgctcgggctgtagtgtatttcgtagccatggtctacatgttcctaggcgtatctatcatcgctgaccgctttatggcggccattgaggtgatcacatccaaagagaaagagattactatcaccaaagccaatggagaaacctcagtgggcaccgtgcgcatttggaatgagactgtgagtaaccttactcttatggcactcgggtccagcgcccccgaaattttactcagtgtgatcgaagtctgtggacacaactttcaggcaggcgagctgggcccaggcaccatcgttggaagtgccgcttttaacatgttcgtggttattgccgtgtgtatctatgttatcccagccggcgagtctaggaagatcaaacacctgcgagttttcttcgtaactgcttcttggtccatttttgcctacgtgtggctgtacctcatcctagcggtcttcagtcctggtgttgtccaggtgtgggaagctttgctcaccctagttttttttcccgtctgtgtggtgtttgcctggatggctgataagcgcctgcttttctataagtatgtctacaagcgatatagaaccgatccccgctcaggcatcattatcggcgccgaaggcgatcctcccaagtcaattgaactcgacgggaccttcgtgggtgctgaagcacccggtgagctgggggggctggggcccgggcctgccgaagcgagagagcttgatgcgtcacgccgcgaagtgattcagatcttgaaagatcttaagcagaaacatcccgacaaggacctagagcaactggtggggattgcaaattactacgcactcctccatcagcagaagtccagggctttctaccggatccaggctacgaggctaatgacaggcgctgggaatgtgctgcgcaggcacgccgctgacgcttcccgacgtgcggcgcctgctgaaggagctggggaagacgaagatgatggcgcatctagaatcttttttgagccatccctgtaccattgcctggaaaactgtggttcagtccttctctcggtcacttgtcagggcggggagggcaacagcacattttacgtcgattacaggacagaggatgggtccgccaaagcagggtcggactacgagtactctgaaggtacacttgtgttcaaaccaggcgaaacacagaaggaactgaggattgggattatcgatgacgatatctttgaggaggacgagcacttcttcgtgagactgctcaatctccgggtaggggacgcccagggaatgttcgaacctgacggcggaggccgccccaagggcagattggtcgcaccactgttggctactgtgaccatactcgatgatgaccacgctggtatcttcagttttcaggatcgcctcctacatgtttccgaatgcatggggacggttgatgtgagggtcgtgagatctagcggcgcacgaggcactgtccgcctgccctatagaacagtggatggcacagcaagaggaggcggggtccactacgaggatgcctgcggcgagctggaattcggggatgacgaaacgatgaagacattgcaagtcaaaatcgtggacgatgaagaatatgaaaagaaagataatttcttcattgagttgggtcagcctcagtggctcaagagaggcatctccgctctcctccttaatcagggcgatggagataggaaactcacagccgaggaagaggaagcacggcggatcgcagaaatgggaaaaccagtgcttggcgagaattgccgactcgaggttatcatcgaagaaagctatgattttaaaaataccgtggacaagttaatcaagaaaacaaaccttgcactggtgatcgggacacactcatggcgggagcagtttctggaagcgataactgtctccgcaggcgacgaagaggaggaggaagacggcagccgagaggaacggctgccatcttgtttcgattatgtcatgcactttctgaccgtgttttggaaggttttatttgcatgcgtgcctcctacagaatattgtcatggatgggcatgtttcggagtctctatcctggtgatcggactcctgacagccctgattggggatctggcctcccattttggatgcacggtgggcttgaaggatagcgtgaacgctgttgttttcgttgcactggggacatcaatacccgatacatttgcctccaaagtggccgcattgcaggatcagtgcgcagacgcttccatcggcaacgtgacagggagcaacgcagtcaatgttttcttggggttaggagtggcctggagcgtggcagccgtgtactgggccgtgcagggcaggccttttgaagtgcgaacagggacacttgcattctctgtgactctgtttacagtctttgctttcgtggggatcgctgtgctgctgtaccgtaggcgccctcacataggcggagaactcgggggtcctagaggccccaagttagctactactgcgctatttctaggactgtggctactctatattctcttcgccagtctggaggcatattgccacattcgcggcttctag

SEQ ID NO: 135654 - DNA, 2478 bp, Artificial Sequence
  Description of Artificial Sequence: Synthetic coding sequence
atgttcgtcgtgattgctgtctgcatctatgttattcccgccggagaatccaggaagatcaagcatctcagagtcttctttgttaccgctagctggagtatctttgcctatgtgtggctgtacttgatactggcagtgttcagtcctggggtggtgcaggtgtgggaggctttgctgacactggtcttcttcccagtgtgcgtggtatttgcatggatggctgacaaaaggttactgttttacaagtacgtttacaagcggtaccgcactgaccccagatctggaatcatcataggtgctgaaggggaccccccaaaatcaatcgaattagatggaacctttgtaggtgcagaagcgcctggagaattaggaggcctcggtccgggacccgctgaagcaagggaactagatgcttcacgccgggaggttatccagatattgaaagacttgaaacaaaagcatcccgataaggaccttgagcagttagtgggcatcgcaaattactatgcactactgcatcagcagaagagcagggctttctaccgaatacaggccactaggctcatgactggcgccggaaacgtgctgcgccggcatgctgcggatgccagtcggagagctgcacctgccgagggcgcaggggaggacgaagatgatggtgcatcaagaattttctttgaaccttccctctatcattgcctggagaattgcggatcagtgctcttgtcagtgacatgccagggcggggagggaaacagcaccttttacgtcgattacaggacggaagacggctctgcgaaagctggcagtgactatgaatacagcgagggaactcttgtgttcaaacctggagagactcagaaagaactgcgcattggtataatcgacgatgatatcttcgaagaggatgaacatttcttcgtgaggctcctgaatctgagagtgggggatgcccaaggaatgttcgagcccgatggaggggggcgccccaaaggccggttggtcgcacccctcctcgctactgtgactatactcgacgatgaccatgccgggattttctcctttcaggacagacttcttcacgtgtccgaatgcatgggtactgtggacgttcgtgtggtccgcagcagtggtgcgcgcggtactgtgcgccttccctaccgcactgttgacggtaccgcacgggggggcggggtgcactacgaagacgcatgtggggaactggagtttggtgatgacgagacaatgaaaactttgcaggtgaagatcgtcgacgacgaggagtatgaaaaaaaggataatttctttatcgagttaggacagccccagtggctgaaacggggcatttctgccctgctccttaatcagggcgatggtgatcgcaagcttactgctgaggaagaggaggcccgtagaattgcagagatggggaagcctgtactgggggagaattgcaggttggaggtcattatcgaggagtcctacgatttcaagaacacggtggataagctaataaagaagacgaacctggcattggtcattgggacacatagttggcgggagcagtttctcgaggcaatcactgtgtctgcaggggatgaagaagaagaggaagacgggtctcgggaggagcgactccctagctgttttgactatgtgatgcactttctcactgtcttctggaaggtactgttcgcatgtgtgccgcctacggaatattgccatggatgggcttgctttggagtcagcatactagttattggccttctaactgctctgatcggagacttagcatcacacttcgggtgtactgtagggctgaaggatagcgtgaacgctgtggtttttgtggccctcggtacaagtatccctggtaacaccctcggagatttcggcggtgtgggatctcagatgagccaggccggggccacccaggacccagctaaaatgcggcatgtgcgacagcaaggcgggggggcagcggggccagtcagacgtcgcgtccacagacagagggaccgactacaacgcggcgaaagagtgccctggccaggcaggcggcttgtctgtggccggagagtgctgggcggagccgggcctccactgcggggagctcattggcatgcaggcctgttaagacacgccctccaccgactcagactacgtggacactgccgagccgccgttcccgcacccgctgctcacaggcggagagctggacgaccagcaagaacccaggctcggcaccacagggccttgccggggccattagcaccagttcatcctttgcgacagcccggcggggtgctgccacatccaggtctccttggtcctcgagctgagactagaccccataggcctcccggagccagggacagtgcagctccagcattaggcccttggagcccctttccaccaagactgggattgctttcatgggatagcgcaagcctgttgagaccgctcccctggctgtag

SEQ ID NO: 135655 - DNA, 1155 bp, Artificial Sequence
  Description of Artificial Sequence: Synthetic coding sequence
atgggcactgtcgacgtcagagtcgtgagaagctccggtgcacgggggacggtccgcctgccctacagaactgtcgatggaactgcccgggggggaggagttcattatgaggatgcttgcggcgagctggaatttggggacgacgagactatgaaaacattgcaggtgaagatagtggacgatgaggaatacgaaaaaaaggacaatttttttatagagctgggacagccacaatggctgaagcgagggatctcggctcttctgctgaaccaaggcgatggtgacaggaagctcaccgcggaagaagaggaggccagaaggattgctgagatgggcaagcccgtactcggcgagaattgcaggctcgaagttattattgaagagagttacgacttcaagaacacagtcgataaattaattaagaaaacaaacctcgcccttgtgatcggcactcatagctggcgggaacagttcctggaggctataacggtgagtgccggcgatgaggaagaagaggaagacggttcccgcgaggagcggctccccagttgtttcgactatgtgatgcatttcctgactgtgttttggaaggtcctgttcgcgtgtgttcctccaaccgaatactgtcatggatgggcatgctttggggtgagtatacttgtgatcggcttgctaaccgcattaatcggggacctcgcgtcccattttggatgtacagtaggcttaaaagattccgttaacgccgttgtgttcgttgccttagggacctcaatcccagacacatttgcctccaaggtggccgccctgcaggaccagtgcgccgatgcttccatcggcaacgtgaccggatccaatgccgtgaatgtctttctgggactgggcgttgcatggagcgtagcagcagtgtactgggccgtacagggacggccattcgaagttcgtaccggaacactggcctttagtgttacactgttcacagtcttcgccttcgtgggcatagcagtgctcctctatcggcgaaggcctcacattggaggagagcttggcgggccccggggccctaaactcgccaccactgccctgttcttgggactgtggctgctgtatatactgttcgcaagcctggaggcttactgccacatcaggggcttttag

SEQ ID NO: 135656 - DNA, 2034 bp, Artificial Sequence
  Description of Artificial Sequence: Synthetic coding sequence
atggcagataaaaggctgcttttttataaatatgtgtacaagaggtaccggaccgaccctcgttccggcatcatcattggtgctgagggggacccccctaagtcgatcgaattagatggtacgttcgtgggagcagaagcgcctggtgaacttgggggactcgggcccggccctgccgaagctagggaattggatgcgagcagacgggaagtgattcagatcctaaaagatttgaagcagaaacacccggataaggacctagaacagctggtgggtattgccaattactacgccctactgcaccagcagaagtcgagagccttttatcgcattcaggcaacacggcttatgacgggagctggcaacgtgttgagacgacacgctgctgatgcatcgagacgagccgcccctgccgagggggccggagaagacgaagatgatggggcctcccgcattttttttgaacccagtctctaccactgtctggagaattgtggaagtgtactgctttcagtcacgtgccagggcggggagggcaactctaccttttatgtcgactatcgcaccgaagacggaagcgccaaagccggaagtgactatgagtattccgaaggaactctggtatttaaacctggagagacacagaaagagctcaggataggcataatcgacgacgatatttttgaagaggatgagcactttttcgtgcgcctgttgaacctgcgcgttggggacgctcagggtatgttcgagcccgatggaggaggtagacctaaaggaaggttggtcgcacctctcctggctacggtgacaatcttagatgacgaccatgccggcattttctcatttcaagaccgtctactgcatgtgagcgagtgcatgggcaccgtggacgttcgcgtagtcagatcatctggtgcacgaggtacagtgagactgccatacaggacagttgacggaactgctcgcggcggtggtgtgcattacgaggatgcgtgcggcgaacttgagttcggcgacgacgagaccatgaagactctccaggtaaagattgtggacgacgaggagtatgaaaaaaaggacaatttcttcatcgagttagggcagcctcagtggttgaagagaggaattagcgccttgttgctaaaccagggggacggtgaccgtaaactgaccgcagaggaggaggaggccaggcggatagcagaaatgggcaagccagtgctgggtgagaactgccgacttgaagtgataattgaggagtcctacgatttcaaaaatacagtagacaagctcatcaagaagaccaatctagccctggtcattgggactcattcttggagggagcagttccttgaagcaatcacagtaagcgcaggagacgaagaagaagaggaagatgggtccagggaagaacggttgcccagttgtttcgactatgtgatgcactttctgacagtattctggaaggtgttatttgcctgcgtgcccccaactgagtattgtcacggatgggcgtgtttcggtgtgtctattctggtcatcggcctcttaacagctcttatcggggatctggcttcccactttggctgtaccgtggggctgaaggacagcgtgaatgcagtcgtttttgtggcacttggaactagcatccctgatacatttgcctcgaaagtcgcagcgctgcaagaccagtgtgccgacgcatctattggcaacgtcacaggttcgaatgcagtgaacgtatttctgggactaggcgtggcttggtcagtcgccgcggtatactgggctgtccagggccggccatttgaggtgagaaccggcacactggccttctccgttactttgttcaccgtgttcgctttcgtagggattgctgtcctactgtaccggagacggcctcacatcggtggcgagttgggtggaccaagagggcctaaactggccacaactgcactgttcctgggtctgtggctattgtatatcctcttcgcttccctagaggcttattgccatattcggggattttag

SEQ ID NO: 135657 - DNA, 2448 bp, Artificial Sequence
  Description of Artificial Sequence: Synthetic coding sequence
atggtactgcggagcggcatatgcggtttgagcccacatcgcatctttcctagtttactcgtggtcgttgcgctggtcggccttcttccagtgctccgatctcacggcctgcagctctcccctactgcatctaccattcggagcagtgaacctcctagagaacggtctataggcgacgtgacaaccgccccaccagaggtgactcccgagtcccgccctgtgaatcattcagtcaccgatcatggcatgaagccacgcaaagccttccccgtcctggggattgactacacccacgtcagaactccatttgagattagtttatggatactacttgcctgcctcatgaagataggctttcacgtcattccgactatcagttcaatagtgcccgagtcatgtctgttgatcgttgtgggccttcttgttggtggactgataaagggtgtgggagaaacccctcccttcctccagagcgatgtgttctttctgtttctgctcccccctatcattttagacgctgggtacttccttccattgaggcagtttacagagaaccttggaacaattctgatctttgctgtggttggaaccctctggaatgcattttttctgggcggactaatgtacgccgtctgtcttgtgggtggagagcagattaataatatcggccttctcgataacttgttgtttggaagtattatctccgctgtcgatcccgttgcagtgcttgcagttttcgaagagattcacatcaatgagctcctccacatattggtgtttggtgagtccttactgaatgacgccgtcaccgtggtcctctatcatctgttcgaggagttcgctaactatgaacatgtcgggattgtggacatctttctgggttttctctctttctttgtggtggccttggggggcgtgctggttggcgttgtttatggtgtcattgccgcatttacttcaagattcacatcacacatccgagttatcgagccactgtttgtcttcctctattcctacatggcttacctgtcagccgaattattccatctgagcggcattatggcccttatcgctagcggagttgtaatgcggccttacgtggaggccaatattagtcacaagtcccacacaacaattaagtacttcctaaagatgtggagctctgtgtccgaaaccttgatctttattttccttggggtttctaccgtagccggtagccaccattggaactggactttcgtgatctccacgttgttattttgtctgatagcccgcgttttgggggtcctgggccttacatggttcattaacaagttccggatcgtaaaacttacaccaaaggaccaatttatcatcgcctacggaggattgagaggcgcgatcgcgttcagccttgggtatctgctggataaaaagcactttcctatgtgcgacctcttcttgaccgcgatcataacggtcatctttttcacagtgtttgtgcagggcatgactatcagacctctggtggatctgctagcagtgaaaaagaagcaggagaccaaacgctccattaatgaagagatccacacgcagtttctcgaccatctgttgacgggaatagaggacatttgtggacactacggacaccaccactggaaagataagctgaatcgatttaacaagaaatacgtcaagaagtgccttatcgctggggaacggtcgaaggaacctcagctgattgccttctatcacaagatggagatgaagcaagccattgaacttgtcgagtccgggggaatgggcaaaatcccctcagctgtgagcacagtgtctatgcagaatattcatccaaaaagtctgcccagcgagcgaatcctaccagctctgagtaaggacaaggaagaggaaattaggaagatactccgaaacaaccttcagaaaactcggcagcgtcttaggagttacaaccgtcacaccttagtcgccgatccttacgaggaggcctggaatcaaatgcttttgaggcgccagaaggcaaggcagctcgagcaaaagatcaataactatttaactgtgccagcgcacaaattggactcacccacaatgagtagggctcgtattggatccgatccgctggcctacgaacctaaagaggatctcccagtcatcacaatcgatcctgcgtcaccgcagtctcctgaatctgtcgatttggtaaatgaggaactgaagggcaaggtcctggggctctcacgcgatccagcaaaggtggccgaggaagatgaagatgacgatggtgggattatgatgagatcaaaagagaccagctcccccggtactgatgatgtgttcacccctgctccctccgattcccccagttcccaacgcatccagagatgtctgtccgatcccgggccacacccagaaccgggcgagggtgagccatttttccccaaaggccagtag

SEQ ID NO: 135658 - DNA, 408 bp, Artificial Sequence
  Description of Artificial Sequence: Synthetic coding sequence
atggtcttgcggagtggtatctgcgggctgtctcctcatagaattttcccttccctcctggtggtggtggctttggtggggctcctaccagtcttaagatctcatggtctacagctgtcacccacagcctctaccattcggagttcggaaccgcccagagaacgttctattggagacgtgaccacagccccacccgaggttacccctgaatctcgccccgtgaaccactccgtcacagaccacggaatgaaacctcgtaaggcctttcccgtccttggaattgactacacccacgtccgtactcccttcgagatcagtctttggattctgctcgcatgtctcatgaagatcggctttccatgcgacccccactacttgaaacaccgccccggagaactgccagcctag

SEQ ID NO: 135659 - DNA, 1668 bp, Artificial Sequence
  Description of Artificial Sequence: Synthetic coding sequence
atggtgctgagatccggcatttgcggactgtctcctcaccgaatttttcccagcctgctggtggtagttgcactggtggggctgttacccgtgcttagaagccacggcctgcaattatcacccacagcctccactattcgaagttccgaacccccacgcgagcgtagcattggagatgtgaccacggctcccccagaagtgactccggaatcgcgcccggtaaaccattccgttaccgaccacggcatgaaacctaggaaagctttcccagtacttgggatcgactatactcacgttcggacacctttcgagatcagtctgtggatactcctcgcttgcttgatgaagattggctttcatgtaatacccactatttcctccatcgtgcccgaaagctgccttctaattgtcgtggggctgttggttggaggccttatcaaaggggtaggagaaaccccacccttcttacagtcagacgtgttcttcctgttcttgctcccaccaatcatcctagatgccggctactttcttccattgaggcaattcacggagaatttggggaccatactgattttcgctgtggtgggcacactttggaacgcatttttcctgggtggactgatgtatgcagtttgcctcgtggggggcgaacagataaataacattggacttctggacaacctcctgttcgggtcaataatctcagcggtcgaccctgtcgccgtactcgctgtgtttgaggaaatacacatcaacgaactcctgcacatcctggtttttggagagagcctgcttaatgatgccgtaactgtggtcctctaccacctgttcgaagagtttgctaattatgaacacgtggggattgtcgacatctttcttggattcctctcctttttcgtcgtcgcacttggcggcgtcctggtcggagtggtgtatggggttattgcagcgttcacaagccgctttacctcgcacatccgcgtgattgaacccctcttcgtattcttgtacagctatatggcctacctgagcgctgagctgtttcacctgtcaggcatcatggcacttatagccagcggtgtggttatgagaccttacgtggaggcaaacatctcacacaaatcccacactaccatcaaatactttctgaagatgtggagctctgtgtccgagacactgatttttattttcctcggcgtgtctactgtagccgggagccaccactggaattggacattcgtgattagcaccttactgttttgcctcattgctagggtactgggagtactcggcttaacatggtttatcaataagtttcggatcgtgaagctcactcctaaagaccagttcataatcgcttatggcggtcttcggggagctatcgctttcagcctaggctatttgcttgataaaaaacactttcccatgtgcgacttgttcctgaccgcgataatcacagtgatcttctttaccgttttcgttcaggtgctgggtcaaggccgagctggcccatgccttggggatccccatagactgttcccctggaaagaaaggaaggcgtgtgacctgaagtgcgattcctctccgagctcgacaaccaatctgctgtgtgacctggggagagccacccccccattttgggcctcagtgtccagcatagtgaagtag

SEQ ID NO: 135660 - DNA, 960 bp, Artificial Sequence
  Description of Artificial Sequence: Synthetic coding sequence
atgaccatccgccccctcgtcgatctgttggcggtgaaaaagaaacaagagacaaagaggtcaatcaacgaagagatccacacccaattcttggatcacttattaacaggcattgaagatatatgtggacactacgggcaccaccactggaaagacaaactgaatagattcaataaaaagtacgtaaagaaatgtctcattgcaggcgaacgttctaaggaaccacagcttatcgccttttatcacaaaatggaaatgaaacaggcaatcgagcttgtggaatcaggaggcatggggaagattcccagcgccgtaagcactgtgtctatgcagaatatacaccctaagtcactgccctccgagagaatacttccggctcttagtaaggacaaagaggaggagatcagaaagatcctaaggaataacctgcagaaaaccaggcagcgccttaggagctacaaccgtcacaccttagtggccgatccctacgaagaggcttggaaccaaatgcttcttcgcaggcagaaagcccggcagctggaacagaagatcaataattacttgactgttcccgcccacaagttagactctcccacaatgagtcgcgcccgcattggcagtgaccctcttgcatacgaaccgaaagaagacttgcccgtcattacaatcgaccccgcctcacctcaaagcccagagtctgtggacctggtcaatgaggaactgaaagggaaggttctaggcctgtctagagatcccgccaaggtagccgaggaggatgaggacgatgatggcggtatcatgatgcgcagcaaagagacctcctctcccggaactgatgacgtgtttaccccagcccctagtgactcccctagctcccaacgcatccagcgctgcctcagtgaccctggcccccaccctgagcccggagagggtgagcctttcttccctaaaggccagtag

SEQ ID NO: 135661 - DNA, 675 bp, Artificial Sequence
  Description of Artificial Sequence: Synthetic coding sequence
atggagatgaagcaggcaatcgaactagtggagagtggagggatgggaaaaattcccagcgcagtatctactgttagtatgcaaaacatacatccaaagtctctgccctccgagaggatacttcccgcgctttccaaggacaaggaagaggagataagaaagattttacgaaataaccttcaaaagacgaggcagcggctgagatcttacaatcgccacacactggtagccgatccttacgaagaagcctggaaccagatgcttcttaggcgccagaaggcacggcagctggagcagaagattaacaattacctgactgtgccggctcataagttggactcccccaccatgtctagggccaggattgggtctgacccacttgcctatgagcccaaggaggacctgccagtgatcaccattgacccagcctcaccacagtcaccggaatccgtggatctcgtgaatgaggagctcaagggtaaagtgcttgggctatcccgcgacccagctaaggtggctgaagaggacgaagatgatgatggaggcattatgatgaggtccaaggagaccagcagtccaggtactgatgatgtgttcacacccgctccttccgactcaccgtctagccagcggattcagcgttgcctgagcgaccctggtccacaccccgaatag

SEQ ID NO: 135662 - DNA, 1431 bp, Artificial Sequence
  Description of Artificial Sequence: Synthetic coding sequence
atggcctatctctctgcggaactgttccatctctccggaatcatggccctgatcgcatctggcgtggttatgcgcccttacgtggaagctaatatctcccataagagtcacacaaccatcaagtacttcttgaagatgtggtcctcagtatccgaaactcttatattcatctttcttggcgtgtccaccgtggccggtagccaccactggaactggacctttgttatctcaaccctgctgttctgcttaattgcacgcgtgctgggggtcttaggtctgacctggttcatcaacaagtttaggattgttaaactgacccctaaagatcaatttataattgcatatggcggactccggggggctatagcgttctctctggggtaccttctcgacaagaaacatttccccatgtgcgatctgttcctgactgccataattacggtgatatttttcaccgtcttcgtgcagggaatgaccatccggcctctggttgacctgttagcagtgaagaagaagcaggagacgaagagaagtattaatgaagaaatccatacccaatttttggaccatctactgacaggaattgaggatatctgtgggcattacggccaccatcactggaaagacaaactgaataggttcaataagaagtatgtgaaaaagtgcttgatcgctggggaaaggtctaaggaaccccagctaatcgccttttaccataagatggaaatgaaacaggccattgaactggtggagtcaggcggtatggggaaaatcccttcagccgtgtcaacagtgtcaatgcagaacattcatcctaagagcttgcccagtgagcggattttgcccgccctgagtaaggacaaggaggaagagatccgcaaaattctaagaaacaatctacagaagactcgccagcgcctgcgaagctacaaccgtcacactctggtagccgacccctatgaagaagcctggaaccaaatgttacttcggcgacagaaggcaaggcaactcgaacagaagatcaacaactacctgaccgtgcccgcacacaaattggatagccctaccatgtctagggccagaatagggagcgaccctctggcctatgaaccaaaagaagaccttccggtgatcaccatcgatccggcaagccctcagtcccctgagagcgtggatcttgtgaatgaggagctcaagggcaaggtgctcgggctgagtagggacccagccaaagtcgccgaggaggatgaggatgacgatggcggcattatgatgagatccaaggagactagctctcctggcactgatgacgtattcacgccagcccctagcgattccccctccagccagcgcatccagaggtgcctgagtgaccctggcccacaccctgaacctggggaaggggagcccttttttcccaagggtcagtag

SEQ ID NO: 135663 - DNA, 1626 bp, Artificial Sequence
  Description of Artificial Sequence: Synthetic coding sequence
atgaattgtcgggagttgccattaacactgtgggttctgattagtgtttcaacagctgagtcctgtacaagccgtccccacatcaccgtggtggagggggaaccattctatttgaagcattgcagctgttcattggcgcatgagatcgagacaactactaaatcttggtacaaatcatctggcagccaggagcacgtcgaactgaatcctaggagctcctctcggatcgctctccatgattgtgtgctcgagttctggcctgtcgagctaaatgacacggggtcttatttttttcagatgaagaactacacccaaaagtggaagctgaatgttataagaagaaacaagcactcctgcttcaccgaaagacaagtgacaagtaaaattgtggaggtcaaaaagtttttccagattacctgcgagaatagctattaccagactctggttaacagcaccagtctgtataaaaactgtaagaagttgctcctggagaataacaagaaccctaccatcaagaagaacgctgaattcgaggatcagggctactactcttgtgtgcactttctacatcacaacggcaagttattcaatataacaaaaacattcaatattacaatcgtggaagaccggtcaaatatcgtccccgtgctgctgggtcccaagctgaaccatgtggcagttgaactgggcaagaatgtgagacttaactgcagtgctctgctcaacgaggaagatgtgatctactggatgttcggtgaggagaatggaagcgatcctaacatccacgaggagaaagagatgaggattatgacaccagagggaaaatggcacgcttccaaggtcctgagaatcgagaacattggcgagtcaaatcttaacgtcctctacaactgtactgtggccagcacgggtgggaccgatacgaagagctttatcctggtcaggaaggctgacatggccgacattcccgggcacgtgttcactaggggaatgattattgctgtgctgatactggttgccgtggtatgcctggtcaccgtctgtgtcatttatagggtggatctggtcctattctacaggcatttaactagaagggatgagactcttacagatggcaagacctatgatgcttttgtgtcctatttgaaggagtgtcgccctgagaacggcgaggaacatactttcgctgtggaaatcctgcctcgtgtcctcgagaagcactttggatacaaactgtgtatttttgagcgtgatgtggtgcccggaggcgctgtcgttgatgagattcactcgctcatcgaaaaatccagacgccttatcatcgtgctgagtaaatcatacatgtccaatgaggtgcgatatgagttggaaagcgggctccacgaagctcttgtggagcggaagatcaaaatcattttaattgaatttacgcccgtcacagactttacttttctgccacaatctcttaagctcctcaagagtcaccgcgtgctgaaatggaaggccgataaaagcctaagctacaactcaagattttggaagaatctgctctacctcatgccggctaagacggtgaaaccgggcagggatgagcccgaagttctgccagtgctatctgagagttag

SEQ ID NO: 135664 - DNA, 2505 bp, Artificial Sequence
  Description of Artificial Sequence: Synthetic coding sequence
atgtggggccttggagcgagaggtccggataggggtctcttactggcacttgccctgggcgggctggctcgggctggcggagtagaggtcgagcctggaggcgcccacggagaatccggtggattccaggtggtaacatttgagtgggctcacgtgcaggacccgtacgtaatcgccctgtggattctggttgctagtttggccaaaataggattccatctaagtcacaaagtgacctccgttgtaccagaatccgctcttcttattgtgctggggctggtacttggaggtattgtgtgggccgccgatcacatcgcctctttcacactaaccccgacagtattcttcttttacctcctccctcctatcgtgctagacgccggctactttatgccgaaccggctctttttcggcaacctgggaacgattctgctatacgccgtggtgggtaccgtgtggaatgccgccaccaccggactgtctctatatggtgtgttcctatcaggcctcatgggggatctccagattggtttgctggattttctgctgttcgggtcactgatggcagcagtagacccagtcgcagtcctggccgttttcgaggaagtgcacgtaaacgaggttctctttattattgtattcggcgagagcctgttgaatgatgcggttaccgtagtactgtacaacgtgttcgaaagtttcgttgcactcggtggtgacaatgtaaccggcgtggactgtgtaaaagggatcgtctccttttttgttgtaagtctcgggggtactctggtcggcgtggtgttcgctttcctgttgtcacttgtgactagatttaccaagcatgttaggattatcgaaccagggttcgtcttcattattagttatttatcctatctgacatcggagatgttaagtttgagtgccatcctcgcaattacattctgtggtatctgttgccagaaatacgtgaaggccaatattagcgagcagtcagctaccacagttcgttacacgatgaaaatgctagcctcgtccgcagaaacaatcatctttatgttcttgggaatcagcgcagtcaaccctttcatctggacgtggaacacagccttcgtgctcctgacgcttgtgtttatctcagtctaccgagccattggagtcgttctacagacatggctcctgaataggtacagaatggttcaattagagccgattgatcaagtggtcctctcatacggcggtttgcgaggtgcggtggctttcgccttagtcgtgttgttggatggggataaggttaaggagaagaatctgttcgttagcacgacaataatagttgtgttttttacagttatctttcagggtctgactatcaagcccctggtccagtggcttaaagtaaaacgttccgaacaccgggagccgcgcttaaacgaaaaactgcacggtagagccttcgaccacatcctttccgccatagaggatatctcagggcagatcggccacaactacctgagggataagtggtctcacttcgatcgaaagttcctctcacgcgtgctaatgcggcgctctgctcagaagagcagggatagaatcctgaatgtgttccatgagcttaacctcaaggatgccatttcatacgtggctgagggggagagaagagggagtcttgcattcatacgtagcccaagcaccgacaacgtggtgaacgtggatttcacaccccggagttctaccgttgaagcaagcgtgtcatacctgctccgggagaacgtgtcagcagtatgcttggacatgcaaagcctggagcaaagacgacgtagtatccgtgatgctgaagacatggtcacccaccatacactgcagcagtatctgtataagccccgacaggaatacaaacacctgtattcccgtcacgagctgacaccaacggaggacgagaaacaagaccgagagatatttcatagaacgatgcgcaaacgcctggagtcattcaagtccactaagcttggactgaatcagaacaaaaaagctgcaaagctatacaagagggagcgggcgcaaaagagaaggaattcatccatccccaatggaaagttgcctatggagagccctgcacagaacttcaccatcaaggaaaaggatctggaactcagtgacacggaagaacctccgaattacgacgaggaaatgagcggcggaattgagttcttggcctcagtgacaaaagataccgcttctgattctcccgccggcattgataacccggtgttttccccagacgaagcactggaccgttcgctgctggctcggctacccccctggctctcccctggcgagaccgtggtgccatcgcagcgggctcgcacccagattccttactctccaggaacattttgccgcctcatgccatttcgactgagtagtaagtccgtggacagtttcctgcaggccgacggacccgaagaacggcccccggccgcattgccagagagcacgcatatgtag

SEQ ID NO: 135665 - DNA, 1077 bp, Artificial Sequence
  Description of Artificial Sequence: Synthetic coding sequence
atgtccgctgatgctgctgccggtgctccccttccaagattgtgttgtttggagaagggacctaatggctacggcttccacttgcacggggagaagggcaaactggggcagtacatcaggcttgttgagccaggatccccggcggagaaagcgggactcttggccggagatcgattggtggaggtgaatggagaaaatgtggagaaggagacacatcagcaggtggtgtctcggatcagagcggccctgaatgcggtgagactcctggtggtagatccagagactgatgagcagctccagaagctgggcgtgcaggtccgagaagagctcttgcgggcccaggaagctccgggccaggccgagccccccgccgctgctgaagtccaaggcgccggaaatgaaaatgaaccacgggaggccgataagtcgcaccccgagcagcgcgaactgagacccaggttgtgtacaatgaagaagggcccgtcaggctatgggttcaacctacacagtgacaagtccaagcctggtcaattcataagaagcgtggacccggattctccagccgaagctagcggcttaagggcgcaagatcgcattgtggaggtaaatggagtgtgcatggaaggaaaacagcacggagatgtggtcagtgctattcgggcagggggagacgagactaagctcctggtcgtcgaccgagaaaccgacgagttcttcaaaaaatgcagagtgattcccagccaggagcacctgaatgggcccttgcccgttcccttcactaacggagaaattcagaaagagaactctcgcgaggctttggcggaagccgcactggaatccccaaggccagctttggtaaggagtgcgtcctccgatacaagcgaagagctcaattctcaagatagccccccgaaacaggacagtacagcacccagctctacctctagcagcgaccccatcctcgacttcaacattagcctggccatggccaaagagcgggcacatcaaaaacgatcttccaagcgcgctccccagatggattggtctaagaagaacgagctgttttctaatctctag

SEQ ID NO: 135666 - DNA, 822 bp, Artificial Sequence
  Description of Artificial Sequence: Synthetic coding sequence
atgagcgctgacgcggcagccggtgctccactccccagattgtgttgtctggagaaagagacccatcaacaggtcgtcagtaggatccgcgcagccttgaatgccgtccgccttctggtggttgatcccgagactgatgagcagcttcagaagctcggagtacaggtcagggaggagctgctccgtgcccaggaggcccccggccaggccgagcccccagcggcagctgaagtccaaggggccggaaatgagaacgaacctcgcgaagctgataagagccaccccgaacagagggaactgaggccacggctgtgtactatgaagaagggcccctccggttacggatttaatttgcactctgataaatcgaagccaggacagtttatcagaagtgtggatccagacagtccagccgaggccagcgggctgcgagcgcaggataggatcgtggaggtcaacggggtgtgtatggaagggaagcagcacggggacgtcgtcagcgccatcagagcaggcggagatgggagcggaggtggtaaccagcgcggggccgagtttccacgccaaccgccgaagaccgggctgcactcagccctggtgtacctgttgttgaggcctcatcctagactgcagcacctccccggacacggacagcgtgaggggcctcccgaaacacaacagcaaacagggcctgcagatggactggaacaggagaaaagaacactgcagcagcctctctctgcactgctgccaccttccgactggcagggccgagcttcaatccctcctcatctattcccatctcctcagctccttccttag

SEQ ID NO: 135667 - DNA, 1014 bp, Artificial Sequence
  Description of Artificial Sequence: Synthetic coding sequence
atggcggcacctgagccgctgcggccgcgcctgtgtcgtttggtgcgaggagagcagggctatgggttccatctccacggcgaaaaggggcgcaggggtcagttcataagaagagtcgagcctggttcccctgctgaagcagctgctttgagagccggtgatcgccttgtggaggtgaatggcgttaacgtggaaggcgagacacaccatcaggttgtgcaacgcattaaggccgtggagggccagactcgacttttggtggttgaccaggaaacagatgaggaactgcgccggaggcagctcacctgcacagaggagatggcgcagagaggcctgcccccagcccatgatccttgggaaccgaagcctgactgggcccataccggtagtcactctagcgaagcaggaaaaaaagacgtgagcggaccactaagagaactgcgaccacggctctgtcatctgagaaaaggccctcagggctatggatttaatctgcatagtgataagtccaggccaggccagtacattcgatccgttgatcctgggtcccctgcggccaggtctggactgagagcacaggatcgtctgattgaagtcaatggccagaatgtggagggcctccggcacgccgaggtagtcgctagtattaaagcacgggaagacgaagctagacttttggtagtggatcctgaaactgacgagcattttaaacgcctgcgtgtgacacccacggaggagcacgtcgaggggcccctcccaagtcccgtgacgaatgggacctcccccgcccagcttaacggcggatccgcttgctcgtcccgtagcgaccttcccggaagcgataaggataccgaagacggctctgcgtggaagcaggatccctttcaggagtcaggactgcatctgagtcccaccgccgctgaggccaaggaaaaggccagggcaatgagggtcaataaaagagccccacagatggattggaacagaaaaagagagatcttctctaacttttag

SEQ ID NO: 135668 - DNA, 981 bp, Artificial Sequence
  Description of Artificial Sequence: Synthetic coding sequence
atggctgcccccgagcccctccgacccagactttgccgtctggtgagaggggagcagggttacggtttccacctacacggagaaaaagggcgcagaggtcagttcatcagaagggtggagcccggatcacccgcagaggcagcggccctgcgcgcaggcgatcgtcttgtggaggtgaacggcgtaaacgttgagggggagacccatcatcaggtcgtgcagcggatcaaggccgtggagggtcaaacacggctgctggtggtcgatcaggaaactgacgaggagctgcggaggcgccagctaacttgcacagaagaaatggcccagaggggtttaccccctgcacacgacccctgggagcccaagccagattgggctcatactgggtctcactcctccgaggcagggaagaaagatgtctctggcccactgcgcgaactccggccccgtttatgtcacctccgcaaaggaccgcagggctacgggtttaatctgcattccgataagagccgacccggccagtatatcaggtccgtcgatcctggcagccctgcagcgcgatcaggactgcgggcccaggataggctaatcgaggtcaacggccagaatgtggaaggactccgtcacgcagaagtcgtggctagcatcaaggctcgggaagacgaagctaggctcctggtcgttgacccagaaactgatgagcattttaagcgactccgtgtcacacccacagaggagcacgtcgagggccctctcccgtcacccgtaacgaacggcacatcacctgcccaacttaatggcggatccgcttgctcgtcaaggtctgatttgcctgggagcgacaaggacactgaagagtcaggcctccacctgagccctacagcggccgaggcaaaggaaaaagcacgggcaatgagggtcaataaacgagcaccccagatggattggaatagaaaacgcgagatattcagcaacttctag

SEQ ID NO: 135669 - DNA, 2397 bp, Artificial Sequence
  Description of Artificial Sequence: Synthetic coding sequence
atggccctgcagatgttcgtcacttactcaccttggaattgtctgttgctcctggtggccctggagtgctccgaggcaagtagtgacctcaacgagagtgcgaatagtactgctcaatatgctagcaatgcatggtttgccgcagcctctagtgaaccggaggaagggattagcgtgttcgaactggactatgattatgtacaaattccatacgaggtaaccctgtggatcctccttgcgtccctggcaaaaattgggttccatctgtaccacaggctcccggggttgatgcccgagtcatgcctgttaattctggtgggagccctcgtcggcggtataatattcggtaccgaccacaagagcccccctgtcatggattcctccatttattttttatacctgctccctccaatcgtcttggaggggggttactttatgcccacacggcccttttttgaaaatattggatctattctgtggtgggccgtgttgggggcactgataaatgccctcgggattggattgagcctgtacctgatttgccaggtcaaggccttcggcctgggagacgtaaacttactacaaaacctgctgttcgggtcccttatctcagcagtggatccagtggccgtattagccgtatttgaggaggctcgcgtaaacgagcagctgtacatgatgatatttggagaggcgctcctcaatgacggcatcacggttgtcctgtataatatgttaatagctttcacaaagatgcacaagttcgaggatattgagaccgtagatatcctggcaggttgcgctcggttcatcgtcgtaggattggggggtgtgctgttcggaatagtgttcgggttcatctctgcattcatcacaaggttcacgcagaacatcagtgcaattgaaccactgattgtgttcatgttctcttacctgtcttacctggctgctgaaaccttatacctgtccgggatccttgctataactgcctgtgcggttacaatgaaaaaatacgttgaagagaatgtctcccagaccagctacactacaattaagtattttatgaaaatgctgtcttccgtgagcgagaccttgatattcatattcatgggagtctccacagtcgggaaaaaccacgagtggaattgggccttcatctgtttcacgctggctttctgtcagatttggcgggccatcagcgtgttcgcactcttctacatctctaaccagtttcgcaccttccccttcagcatcaaggaccagtgtataattttctattcaggagttcgcggcgctggttcttttagcctcgcattcctccttcctctttccctgtttcctagaaaaaagatgttcgtcactgcaaccctggtggtgatttatttcacggtgtttatacaggggattaccgtcggtccactggtgcggtacctggatgtgaaaaagacgaacaaaaaggagtcaatcaatgaggaactgcatattcgcctcatggatcacctcaaggccggcattgaggatgtttgcgggcactggtctcactaccaggtgcgagacaagtttaagaagttcgaccaccgttatctccggaagattttaattcggaaaaaccttcccaagtcctccatagttagtttgtacaagaaactagaaatgaaacaagcaatcgagatggttgaaactggaatcctaagctctactgccttcagtatccctcaccaggcacagcgcatccagggcattaagcggcttagtcccgaggacgtcgagtccattagggatattctgacaagcaacatgtaccaggtgagacagcgcactctatcttacaacaagtataatctgaagccacagacatcagaaaagcaagccaaggagatcttaataaggaggcagaacacactacgggaatcaatgagaaagggacacagtttgccatggggcaaacccgcaggcacaaagaatatacgatacttgtcgtacccctacggaaatccacagagcgctggcagggacacaagggccgctgggttctctgacgatgacagtagcgaccccggatcccccagtatcaccttctcagcttgtagccgtataggcagcctacaaaaacaggaagcacaggaaatcattccaatgaagtcactgcaccgcggccgcaaggccttctcttttgggtaccaacggaatacatcccaggaagagtaccttggaggcgtccggagagttgctcttagacccaaacctctctttcatgccgtggacgaggaaggggaatctggcggagagtctgagggtaaggcctcgcttgtggaggtcaggtccagatggacagccgaccacgggcacggacgtgatcatcaccgctcacatagccccttgttgcaaaaaaaatag

SEQ ID NO: 135670 - DNA, 2691 bp, Artificial Sequence
  Description of Artificial Sequence: Synthetic coding sequence
atgttaagggcagcccttagtctgttggccttgcctcttgccggggcagccgaggaacccacccagaagcctgagagccctggtgaaccacctccgggcctcgaactgttccggtggcagtggcatgaagttgaggctccttacctggtagctctgtggattttagtggccagcctagccaagatagtatttcatctttccaggaaagtcaccagtctggtcccagagagctgcctgctaatactactgggcctggtactaggcggcattgtcctcgcagtagcaaagaaggccgagtatcagctggagcccgggaccttctttttgttcctcttgccccccatcgttctggactcaggttactttatgccttctcgtttatttttcgataatctgggtgcgatcctcacctatgccgtcgtgggcaccctgtggaacgcattcacaaccggggctgcactttggggtctacagcaggccggtttggtggcacctagggtgcaggctgggctcctggacttcctgctatttgggtcacttatcagcgcagtcgatcccgtggcggtattggcagtcttcgaggaggtccacgtgaacgaaacactgtttatcatcgtgtttggcgagtctttactaaacgacgcggttactgtggtgctgtacaaggtttgcaactccttcgtggagatgggaagcgctaatgtgcaggctacggattacctcaagggcgtggcgtccctgtttgtggtaagtctggggggagctgctgtgggcctggtcttcgctttcctgcttgccctaacaacccgtttcaccaagcgagtacgcataatagagcccctgctcgtttttttactggcctacgcagcctacttgacggccgagatggcgtcactgagtgcaatcttggctgtcacgatgtgtggtctgggttgtaagaaatatgtggaagctaatatttcgcataagtcacgcacaactgtgaaatacactatgaaaactctggccagttgtgccgagaccgtcatcttcatgttacttggtatttcagcagtggactcatccaaatgggcgtgggatagcggtctcgtgctaggtactctgattttcattttgttcttccgtgcattaggggtagttttacaaacatgggtgctgaatcagttcaggctggtgccccttgacaagattgatcaggtggtgatgtcatatggcgggctcagaggcgctgtagcattcgctctggttatactgttggaccgcacaaaggtgccagcgaaggactatttcgtcgcaaccaccattgttgtggttttcttcacggtgatcgttcagggtctgaccattaaacctctggtgaaatggctcaaagtgaaacgaagcgaacaccataagcctaccctgaaccaggagctacatgagcacacttttgaccatatcctcgccgccgtggaggacgtagtgggccaccatggctatcattattggcgcgatcggtgggaacagttcgacaaaaagtatctgtcccaactgttaatgcgccgttccgcctacaggattcgggaccagatttgggatgtgtattataggttaaacattagggatgcaatatcatttgttgatcagggcgggcacgtgttatcaagcaccggcctaactctgccctcgatgcccagtagaaatagcgttgctgagacaagcgtgactaacctgctgcgtgagtccggaagcggggcatgtctcgaccttcaggtgattgatactgtgcgatcaggtagagatagggaagacgccgtgatgcaccatctgctgtgcgggggactgtacaagcccaggaggcggtataaggcctcttgtagccggcatttcatctctgaggacgctcaggagcggcaagacaaagaggtcttccagcagaatatgaagcgtaggcttgaatcgttcaaatctacaaagcataatatctgttttacaaaaagcaaaccccgccctcggaagactggacgccggaagaaagatggcgtcgcaaatgcagaagcaaccaatggaaaacacagaggattgggattccaggatacagcagccgtgatactgacggtcgaatcagaagaggaagaggaggaaagcgattcctcggaaaccgaaaaggaggatgatgaaggcataatattcgtcgcgcgggcgaccagcgaggttctgcaggaaggcaaggtctcagggagtttagaagtatgtccttccccccgcatcataccaccttcacctacttgtgctgaaaaggaactgccctggaagagtggacagggcgatctcgccgtatatgtttcctccgaaactacaaaaatcgtgcctgtggatatgcaaaccggatggaaccagagcatcagtagcttagagagtctagctagccccccctgcaaccaggctcccattctaacttgcctgccaccccatcccagaggaaccgaagaacctcaagtaccattgcatttgccctctgacccaaggagttcgtttgctttccctccctctctggcgaaagccggcaggtcacgaagcgagtctagcgcggatctgccccaacagcaggaactgcagcctcttatgggccacaaggaccacacccatctgtccccaggtacggcaaccagccattggtgcatccaatttaaccggggctccaggctgtag

SEQ ID NO: 135671 - DNA, 1308 bp, Artificial Sequence
  Description of Artificial Sequence: Synthetic coding sequence
atgcgaaggtccgcctatcgtatccgggatcagatctgggatgtctattaccgtctgaacatcagggatgctatctcatttgtggatcagggcggacatgtcttgagctccacaggcctgacgctgccatccatgccaagccgcaacagcgtagctgagacctctgtcacaaatctgctgagggaaagcggctccggtgcctgcttggaccttcaggtgattgacacagtgaggtctggcagggaccgagaggatgccgttatgcaccacctgctgtgtggaggcttatataaacctaggcgacggatcgaactccgcacggagccttgcggcatgcttctcaagacgtttcttcagaccgatatggatcaggccttcctgggcaccaaaccagctgccgtggccaccagctctcagcggatgagacggtccgggcgtacgcgacgcagtagtagccgtatgaagcggagactggaaagctttaaatccaccaagcataatatatgctttaccaaatccaagccacgaccacggaaaactggacggcggaagaaagacggggtggcaaacgccgaggcaactaatggcaagcaccggggactgggatttcaggatactgctgccgtgatcctgacagtggaaagtgaggaggaagaagaggaaagtgatagctctgaaacagaaaaggaggatgatgagggcattatctttgtggcgcgcgccaccagcgaggtgctccaggaagggaaagtatcgggatccttggaggtgtgtccatcaccacgcattatccctccctctcctacttgcgctgagaaggagctcccatggaagtcgggacagggcgacctggcagtgtacgtctccagcgaaacgacaaagatcgttccggtggacatgcagaccgggtggaatcaaagcatttcaagcctagagtctttagcttctcctccttgtaaccaagccccaatcttaacatgcctgcccccccacccccgcggcaccgaagagccccaggtaccgcttcacttgccttcagatcctcggagtagcttcgcatttcctcccagtttggccaaagctggcttggcagtaagagcagccttgacttctcctagcagtcggtcctgttctcccagctgggctacaaggaccacccccattagtgctcaggctcccctaccacctacgggagcgtcgtcttcgacagaggctgctggctgctcttcccgccctaggggaggggccggagggggcatccccgtcggctcagccccatgggtgatgggacgagcattagagacttag

SEQ ID NO: 135672 - DNA, 2106 bp, Artificial Sequence
  Description of Artificial Sequence: Synthetic coding sequence
atggcaagacgtggttggagacgggcccctcttcggagaggagtggggagctcacctcgcgccagacgccttatgaggccactctggctgctcctggccgtgggcgtgttcgactgggctggagcgtcagatggtggcggcggcgaagcacgggcgatggatgaggagattgtgtctgaaaagcaggcagaagaatcccaccggcaggactctgcaaatctgctgatcttcatcctcctactcaccttgaccattttaacaatctggttgttcaaacaccgtagggctcgatttcttcacgagactggtttggccatgatctacggactgctggtaggactggtgttacgctacgggattcacgtgccaagcgatgtgaacaatgtaactttatcttgtgaggtgcaatcttcacctacaacattgctggtaaatgtatccgggaagttttatgagtacatgcttaagggggagatatcatctcacgagcttaacaacgttcaggataatgagatgttgcgcaaagtgaccttcgatccagaagtattcttcaacattcttttacctccaattatcttctacgccggctattccctgaagagaaggcattttttccgtaacctgggaagcattctggcctatgcctttctgggcactgctatctcttgttttgtcattgggtccattatgtacggatgcgtaaccctaatgaaggtcacgggacagctggctggagacttctatttcacagactgcctgctttttggagcaatcgtttccgcaactgacccagtgactgtcctcgccattttccacgagttgcaggtcgatgtcgaactgtacgcactcctgttcggcgagtctgtgctgaacgatgcagtggctatagtgctttccagctctatagtggcctaccagccggctggagacaatagccataccttcgatgtaaccgcaatgttcaaatccataggcatttttttgggcatcttttctggatccttcgccatgggggccgccacgggtgtggtgaccgcactggtgactaagttcacgaagctgagagaattccagctactggagacggggcttttcttcctgatgtcctggagcaccttcttgctggcagaagcgtgggggtttacaggagtggtcgcggtgctgttttgcggaatcacgcaggcgcactatacttacaacaatctctccactgaatctcagcacaggacgaaacagttattcgagttattgaacttccttgcagaaaattttatcttctcctatatgggtctgacgctctttactttccagaaccatgtgttcaaccctacttttgtggttggcgcctttgttgccatattcctagggcgcgccgccaatatctatccactgtctttattgctcaacctcgggagaagatctaagattggatccaactttcagcatatgatgatgttcgcaggcctcaggggagccatggctttcgcactggctattcgggacacagccacttatgcccgccagatgatgtttagcaccactctgctgatagtgttttttacagtgtgggtttttggcgggggcacaaccgctatgctgtcatgcctccatatcagagtgggcgtcgactccgaccaagaacatctgggcgtacctgaaaatgaacgtcggactactaaagccgaatctgcctggctgttccggatgtggtataatttcgaccataattacctgaagccactgttgactcattcaggaccacctctgacaacaactctgcctgcctgttgcggacccatagcccgttgcttgacgtcaccccaggcatatgagaaccaagaacagctgaaggacgacgattcagatttgatactgaatgatggcgacatcagtctcacatatggagatagtactgtcaacaccgagcccgccacatcttcagccccgcgaaggttcatgggtaattcatctgaggatgctttggatcgcgagctggcctttggggaccatgaactcgtcatccgaggaacaaggctggtgctccccatggacgactccgaacctcctctcaatcttctagacaatacacggcacggacctgcttag

SEQ ID NO: 135673 - DNA, 2010 bp, Artificial Sequence
  Description of Artificial Sequence: Synthetic coding sequence
atggcccgtagaggatggagacgcgcgccgttgaggagaggcgtaggttcgtctccacgggcccgcagactgatgcggcccctttggctgctcttggcggtcggtgtgttcgattgggctggggcgtccgacggtggtggaggtgaggcgagagcaatggatgaggagatcgtatcagaaaagcaggcagaagagtctcataggcaagattcagcaaacttattgatttttatcctgctcctcacgctgacaattttgactatttggttgtttaagcaccggcgcgctcggttcctgcacgaaaccggtctggctatgatctacggtttgctcgtgggcctggtattgcgctacggtatccatgtgccctccgatgtgaataatgtgactctgtcatgcgaagttcagtcttccccaacgaccctcctagtgacgttcgatcctgaggtcttttttaatatcctgcttcccccaattatattttacgccggctacagcctaaagagacggcacttctttagaaacctgggctctatactagcctacgcctttcttggaacagcaatatcctgttttgtgattggctccatcatgtacgggtgcgtgaccctgatgaaagtcactggtcagcttgcgggcgatttttactttacagactgtctgctcttcggtgcaatcgtaagtgccacagatcctgtcactgtcctggcaatcttccatgagcttcaggtggacgtcgagttgtatgcgctgctgttcggggaatcagtgctgaatgacgctgtcgccattgtcctgagcagcagcattgtggcctaccagccagcaggggacaactctcatacttttgatgttacagccatgtttaagagtatcggcatttttctcgggatctttagcgggtcttttgctatgggagccgcaacgggcgtcgttaccgctctcgttacgaaatttactaaactccgggaatttcaactgctggagacaggtctgtttttcctcatgtcttggtccaccttcctattagcagaggcttggggatttactggcgtggttgcagtcctgttctgtggcattacgcaagcgcattacacctataataacctgagtacggagagtcaacacaggactaagcagttatttgagttgctcaacttcctggccgagaatttcatcttctcatatatgggcctgactctgttcaccttccagaaccacgtatttaaccctacattcgtagttggggcgtttgtagctatctttttaggcagggccgctaacatataccctttgtccttactcctcaaccttgggagaaggtcgaagatcggatcaaactttcagcacatgatgatgttcgctgggctgcgcggggcaatggcttttgctctggccatacgggacaccgctacatatgcccgccagatgatgttctctaccacacttctgatcgttttttttactgtgtgggtgtttgggggtggtactaccgccatgctaagctgtctgcacattcgcgtcggggttgactcagaccaggaacacctgggcgtcccagaaaatgagcgtagaactaccaaagccgaatccgcatggcttttccgcatgtggtacaacttcgaccataattatctgaagcccctgttaacccactcaggaccacctctgacaacaaccctgcccgcctgttgcggtcccatcgcacgatgcctgacaagcccacaggcttacgaaaatcaagagcagctgaaagacgacgacagcgatctgattcttaatgatggagacatttcattaacatatggcgattccaccgtcaatacggagcccgccacttcgtcagccccccggagattcatgggcaacagttctgaagacgccctggaccgagagcttgcctttggcgatcacgaattggtgatacgaggcaccaggttagttcttccgatggacgatagcgagcctcccctgaacctcctcgacaacactcgccacgggccagcgtag

SEQ ID NO: 135674 - DNA, 1950 bp, Artificial Sequence
  Description of Artificial Sequence: Synthetic coding sequence
atggacgaagagattgtgtcagaaaagcaagcagaagagagccatcgacaagactccgccaatttgcttatcttcatcctacttttaacattgaccattctgaccatctggcttttcaagcaccggcgggcccgattcctgcacgagactggccttgcgatgatttatggcctccttgtggggcttgtattgaggtatggcatacacgttccgagcgatgtgaataacgtaacgttatcttgcgaagtccagagctctcctaccaccctactggtgaacgtgagtggcaaattttatgaatacatgctgaaaggagaaatctctagccacgagctaaataatgtccaggacaatgagatgctgcgcaaggtcacatttgaccccgaggttttttttaatattcttctgcctcccattatattctacgctggatattccctaaagagacgtcatttttttcggaacttgggttccatcctcgcttatgcattcctcggtacagcaatcagctgctttgtaattggtagcattatgtacggatgtgtgactctgatgaaagtaacaggccagctagctggagatttttacttcacagactgtttattgtttggcgctatcgtgtcggctacggaccctgtcacagtactcgccatctttcacgaattacaagtcgatgtggagttatacgcgctcttgtttggtgaatctgtgttgaatgatgccgtggccatagtcctgtcatctagcatcgtggcctaccagccggccggggataactctcatacctttgatgtgacagccatgtttaagtcaatcggcatcttcctaggaatcttcagcggaagtttcgccatgggagccgccacgggcgttgtcacagcgttggtgaccaaattcaccaaacttagggaattccaactcttggaaactggcctgttttttctgatgtcttggtctacctttcttctggccgaggcgtggggcttcactggcgtcgtagccgtgctgttctgcggaattacacaggcccattatacctataacaacttgagcaccgagtcacagcatagaaccaagcagctttttgagttgctgaactttctggctgagaatttcatcttctcttacatgggcctgactctgttcacgttccagaatcacgtctttaaccctacattcgttgtgggagctttcgtggccatcttcctcggccgcgcagctaacatttacccactgtctttgctcctgaatttggggcggcgttccaagatcggctccaattttcaacatatgatgatgttcgccggcctccgcggcgcaatggctttcgctcttgctatcagggacacagctacctacgctcgccagatgatgttctctacgacactgctgatagttttcttcaccgtttgggtgtttggagggggcactaccgctatgctgtcttgccttcacatccgggtaggcgtggactccgaccaagaacatctcggtgtaccagagaacgagaggcgaacaactaaggccgagtcggcatggctgtttcgcatgtggtacaatttcgaccataactatttaaagcccttacttacccacagcgggccgcctttaaccactacactgcccgcctgctgcggtcctattgctaggtgcttgacatcgcctcaggcttacgagaatcaggaacaactgaaggatgatgactcagatctgatattgaatgacggcgatatttctctgacatacggggatagcaccgttaatacagaaccagcgacttcctctgccccaaggcgattcatgggcaactcttccgaggatgctctggatcgggagctggcttttggcgaccatgagctggtcatccgaggcaccagactggtgctgccaatggatgatagcgaaccgccccttaaccttctagacaatacacgacatggtccagcttag

SEQ ID NO: 135675 - DNA, 2178 bp, Artificial Sequence
  Description of Artificial Sequence: Synthetic coding sequence
atggaacccggcgatgccgcaagaccaggcagcggaagagccacgggggccccacctccgagattgctcctgctgccactgcttctcgggtggggactacgggtggcggctgccgccagcgcgtcttcgagtggtgctgcggcagaggactcctccgctatggaggagctagcaacggagaaggaagccgaggagtctcacagacaggacagcgtatctctgctgacctttatcctccttcttacacttactatcctgactatctggcttttcaaacacaggagggtaagatttttgcacgaaaccggactggcaatgatatacggactcattgtgggggtgatcctgaggtacggaacgccggcgaccagcggtcgcgacaaaagtctgagttgtacccaggaggacagagcattttccactctgcttgtgaatgtgagcgggaagtttttcgagtatactttgaaaggggagatatcgcctggaaagattaattccgtggaacaaaacgacatgctgcgaaaggtgacctttgatcccgaagtgttctttaatatccttctaccaccaattattttccatgctggttattctttgaagaaacgacactttttccggaacctgggcagcatcctcgcttacgcctttctgggaactgccgtctcatgtttcatcattggcaatcttatgtatggggtggttaaactgatgaaaatcatgggccagctgagtgacaaattttactacacagactgtttgttttttggagccattatctctgctactgatccagtgacagttttagcaattttcaacgaactacatgcagatgttgacttgtacgcgttgctgtttggagaaagtgtgctcaacgacgccgttgcaattgttctgtcaagttcgattgtggcttaccagcccgctgggttgaacacacacgcttttgatgccgccgccttttttaagagtgtggggatattcctcggaatcttttctggatcgttcactatgggtgccgtcacgggcgtaaacgctaatgtaaccaagttcaccaagttacattgtttccctctgttggagacagctctattttttttgatgtcctggtccaccttcctcctcgccgaggcctgtggatttacaggggtcgttgcagtgctgttctgcggcattactcaagcacactacacttacaataacctttctgttgaatcacgaagccgcactaaacaactgttcgaagttcttcactttctcgctgagaacttcatattttcctacatgggcctcgctctgtttacctttcagaaacacgttttttctcccatcttcattatcggggctttcgtggcgatcttcttaggccgtgctgctcatatttatccactcagtttctttttgaacctgggcagacgccacaaaatcggctggaacttccagcacatgatgatgttcagcggtctccgtggagctatggccttcgcacttgccatcagggatactgcatcatacgcccggcaaatgatgttcaccaccactttgttgatagtgttttttacagtgtggatcatcggaggcggcacaacaccaatgctctcgtggctcaacattagggttggtgtcgaggaaccatcagaggaggaccagaatgagcaccattggcagtacttcagagtcggtgttgatcccgaccaggatcctccacctaacaatgactccttccaagtccttcagggcgatggcccggactccgcaagaggcaatcgaactaagcaggaatccgcctggatctttcgcctatggtactccttcgatcataattatctaaagcctatacttacccactccggccctccgttgactacgactctgcctgcctggtgtggcttactagccaggtgcttgactagtccgcaagtttatgacaaccaagaacccctccgggaggaagactctgacttcattttgaccgagggcgacctaactctgacttacggtgactcaaccgtgaccgcaaatggcagcagtagctcccacaccgccagcacttccttagaaggaagcaggcgcaccaagtcaagctccgaagaagtactggagagggacctgggcatgggcgaccagaaagtgagtagcaggggcaccaggctggtgtttccgcttgaggataacgcttag

SEQ ID NO: 135676 - DNA, 1746 bp, Artificial Sequence
  Description of Artificial Sequence: Synthetic coding sequence
atgggcgagaaaatggccgaggaagagagattccctaatacaacacacgagggattcaatgtgaccctgcatactacactggtggtgacaactaagctggtccttccgacccccggcaagcctatccttccagtgcagacaggtgagcaggctcagcaggaagaacagtcaagtggcatgactatcttttttagcctgctggtactggcaatttgtatcatcctggtccacctgctgatacggtataggctgcacttcctcccggagtccgtggccgtggtgtctctgggaattctgatgggggcagtaatcaaaattatcgaattcaagaagctggccaattggaaagaggaggagatgttcaggccgaacatgttctttttgctgctcctacccccgatcattttcgagagcggttattccctccataagggcaattttttccagaatatcggaagcattacattgtttgctgtgtttggtacagctatttcagccttcgtcgtggggggcgggatatacttcttgggacaagccgatgtgatatcaaagcttaacatgaccgactctttcgccttcggcagcttgattagcgccgtggacccagtggctacgattgctatttttaatgctctgcatgtggaccctgtgttaaacatgctggtgttcggcgaatccattctgaatgatgctgtgtccatcgtactcacaaacacggccgagggattgaccagaaaaaacatgtctgacgtcagcggctggcaaacgttcttgcaggccctagactactttcttaagatgtttttcggttcggcagctcttgggaccctcacgggactgatcagcgcattggtgttaaagcacatagatttgcgtaagacgcctagcctggaatttgggatgatgattattttcgcctacctgccatatggactggctgagggtatctccctgtctgggataatggccattctcttctcaggtatcgtgatgagccactatactcatcacaacctatcccccgttacacagatcctcatgcagcagaccttacgtacggtcgccttcttatgcgaaacatgtgttttcgcctttctgggcttatccatcttcagctttccacataaatttgaaatcagtttcgtgatctggtgcattgtgctagtcttgtttggcagggccgtgaatatatttcctctctcctatctgctcaatttttttcgagatcacaagatcacccctaaaatgatgttcattatgtggtttagcggtctacgcggggccataccctacgcactcagtctgcatctggatctggagcccatggaaaaacgccagctgatcggaacaaccactattgtgatcgtgctgttcaccatcttgctgctgggaggatctaccatgccactcatcaggttgatggatattgaagacgccaaggctcacagacggaataagaaggacgttaacctgagcaagacagagaagatgggaaacacagtggaaagcgagcatttgtctgagctcactgaggaggaatacgaggcacactatattcggagacaggacctgaaggggtttgtgtggttggatgctaagtacctgaatccatttttcacccggagactgactcaggaggacctacaccatggcaggatccaaatgaagacactgactaataaatggtatgaagaggtaaggcaggggccctctggatccgaggacgacgaacaggaactgctgtag

SEQ ID NO: 135677 - DNA, 1794 bp, Artificial Sequence
  Description of Artificial Sequence: Synthetic coding sequence
atgggggagaaaatggcagaggaagaaagattccctaacacaacccacgagggctttaatgtaacactccacaccactctcgtagtaacaacaaaactggtccttccgacccccggtaagcccattctgccagttcaaactggtgagcaggctcagcaggaagagcagagttcaggcatgaccatattttttagtctcctcgtgctggccatatgcatcatcctggtgcacctgctgatccggtatcgcctccactttctgcccgagtcagtggcggtagtcagtcttggcattctgatgggagccgtgattaagattattgaattcaagaaacttgctaattggaaggaagaggaaatgttccgcccaaacatgttcttcctcctacttctgccacccataatctttgaatccgggtatagcctccataaggggaatttttttcagaacattgggtccattaccttgttcgccgtgttcggaaccgccatttcagccttcgtagtggggggcggcatctactttctgggacagggttttttctttgtgtgtgtgtgtgttttcgtgtgctttatattgcaggccgatgtgatatcaaaactgaatatgactgattcattcgcttttggttctctgatctccgccgtggatcctgtggccacaattgccatctttaatgccctgcacgtcgatcctgttttgaatatgctggtgttcggagagtccattctcaacgatgccgtcagcatcgtgttgactaacacagcggaggggcttacaagaaaaaacatgtcggacgtgtccggctggcagaccttcttgcaagctttggactacttcttgaagatgttcttcggttctgctgcccttggcacgttgacgggcctcatcagtgccctcgttctgaaacacatagatctaaggaaaacaccaagtcttgaattcggcatgatgatcatcttcgcgtacctgccctacggcttagctgagggtataagtcttagtggtataatggctattctctttagtgggatagtgatgagccactatacccatcataacttgagtccagtgacgcagatacttatgcagcagactctccgtacggtcgcatttctttgtgagacatgtgtcttcgctttcctgggcctctccatcttcagctttcctcacaagttcgagatcagctttgtcatctggtgcattgtcctggtgctttttgggcgagcagtgaacattttcccgttatcttatcttctcaacttctttcgcgatcacaagataacccccaagatgatgtttattatgtggttctccgggcttagaggagccattccatacgccttgtccctgcacctggatctggaacccatggagaaacgtcagctgataggcacgactactattgttattgtacttttcactatcttactccttggcgggtctactatgcccttgattcggttaatggacatagaagacgcgaaagcccatagaaggaacaagaaggacgtgaacctgtccaaaaccgaaaagatgggaaatacggtagagtccgagcacctgagtgagctgacagaggaagaatacgaggctcactatatacgacgacaggacctcaaaggttttgtgtggcttgacgcaaagtacctcaatccattcttcactcgaagactgacccaggaagatctacatcacggacgaatacagatgaaaacactcacgaataaatggtatgaagaagttagacaaggcccaagtggctccgaggatgatgagcaggaactgttgtag

SEQ ID NO: 135678 - DNA, 1089 bp, Artificial Sequence
  Description of Artificial Sequence: Synthetic coding sequence
atgcttgttttcggcgaatctatcctaaatgacgccgtgagcatcgtgcttactaacacggctgagggcctgacccgaaaaaatatgagcgacgtgagtgggtggcagactttcctgcaagcgctagactactttctgaaaatgtttttcggcagtgctgcactggggacgctgactggattgatttctgccttagtcctgaagcatatcgaccttcggaagaccccgagcctggaattcggaatgatgattattttcgcatacctcccctacgggctggctgaaggaatctccctgagtggcatcatggccattctgttctctggcatagtcatgtctcattatacacaccataacttgtcaccggttacgcaaattttaatgcagcaaaccctgcggaccgtcgcatttctctgcgagacatgcgtcttcgcctttcttgggctgtccattttctcatttccccataagtttgagattagtttcgttatctggtgtattgtcctggttctcttcggcagagccgttaatattttccctctgagctaccttcttaacttcttcagagaccataaaattacaccaaagatgatgtttattatgtggttttcaggtttacgcggcgccatcccttacgcgctgagcttgcatctcgaccttgaacccatggagaagcggcagctcatcggcacaaccactatcgtcatagtgctattcaccatcttactgctaggcgggtctactatgcctttaatccggctcatggacatcgaggatgccaaagctcaccgcaggaacaagaaggacgttaacctcagcaagacagaaaagatgggtaacactgtggaatcagaacacttaagtgagctcacagaagaagagtacgaagcacattacattagaaggcaagacttaaagggctttgtctggctggatgctaagtatctcaatcctttcttcacccggcggctcacgcaggaagatctccatcacgggaggattcagatgaagactctcaccaacaagtggtatgaggaggtgcgccaaggccccagtgggagcgaggacgatgagcaggaattgctgtag

SEQ ID NO: 135679 - DNA, 846 bp, Artificial Sequence
  Description of Artificial Sequence: Synthetic coding sequence
atgatgatcatcttcgcctatctgccatatggactcgcagagggcatatctctgtctggaataatggcaattctcttctctggaattgtgatgtcacactacacacaccataacttgagcccagtaacgcagatactgatgcagcagaccctgagaacggtcgctttcctgtgcgaaacatgcgtgttcgcctttttaggcctgtccatcttcagcttcccccataaattcgagataagtttcgtcatttggtgcattgtacttgttctctttgggagggcagtcaatatattccctctcagctacctactgaattttttccgtgatcacaaaattacccccaaaatgatgttcatcatgtggttttcagggttgcggggggctatcccctatgctttgagcctccatctggatctggaacccatggaaaagcgtcagcttatcggaacaacaaccatcgtaatcgtccttttcacaattctgctgctgggggggagcacaatgccacttatccggctgatggacatagaagatgcgaaggcacatcggcggaacaagaaagatgtgaatctgtctaagacggaaaagatgggaaacacagttgaatcagagcacttgtcagaattaactgaagaggagtacgaagctcactacattaggaggcaggacctgaagggcttcgtatggcttgacgctaaatatctgaatcccttcttcacaaggaggttgactcaagaggatttgcaccacggaagaatacagatgaaaactctgaccaacaagtggtatgaagaagtcaggcaaggacctagtggctccgaggatgacgagcaagaattactgtag

SEQ ID NO: 135680 - DNA, 1938 bp, Artificial Sequence
  Description of Artificial Sequence: Synthetic coding sequence
atggaaaggcagagccgcgttatgagcgagaaggatgagtaccagttccagcaccagggcgcagtggaactgcttgttttcaacttcctgctgatattgacaatccttactatctggctctttaaaaaccaccgattcaggtttttgcatgagaccggaggtgccatggtgtacggactgatcatgggattaatcctgcgctacgccacggctcccaccgacatagaatccggcaccgtttatgactgtgtaaagctgaccttctcccctagtaccttgctcgtgaatataaccgaccaagtctacgagtataaatataagcgtgagatctcccagcataatataaaccctcatcagggcaatgcgattctggagaagatgactttcgacccagagatattctttaacgtactcttgccacccatcatctttcacgctggctacagcttaaagaaaagacatttcttccagaacctgggcagtattctaacttatgccttcctgggcacagccatctcctgcattgtcattggacttattatgtacggctttgtaaaagctatgattcatgccggccagttaaaaaatggcgatttccacttcaccgattgcttatttttcgggtctcttatgtcagcaaccgatcccgtgaccgtgcttgctatcttccacgagctgcacgtggatcctgacttatacacgctgttattcggcgaaagtgtgcttaatgatgcggtagctatcgtgttgacgtacagcatctctatttactcccctaaagaaaatccaaacgcatttgatgcggctgccttcttccagtccgtgggaaactttttaggcattttcgcaggctccttcgccatgggaagcgcctatgcgatcatcaccgccctgttgaccaaatttactaagttgtgtgagttccctatgttagaaacaggcttattttttctgctgtcctggtctgcatttttaagcgccgaggcggctggtctaacagggattgtcgcagtgctgttttgcggcgtgacccaagcccattacacctataataatttgtcatctgacagtaaaattcgcacaaagcagctgttcgagtttatgaacttcctggccgagaatgtaatcttctgctatatgggcctggccctcttcacctttcaaaatcacatcttcaatgccttgttcatcctgggcgcattcctggctatttttgtggccagagcctgtaatatttaccctttatccttcctgctaaacctagggaggaagcaaaaaatcccttggaattttcagcacatgatgatgttcagcggcctaagaggggccatcgcctttgccctggcaatccggaacaccgaaagtcagcccaaacagatgatgtttaccactacactgctgctggtgtttttcacagtttgggtctttggcggagggactacacccatgttgacatggctgcagatcagggtgggggtcgacttggatgagaacctgaaagaagatccatcttcccaacatcaagaagcaaataatctcgacaaaaatatgaccaaagcggagagtgcacggctgttcaggatgtggtactccttcgatcataagtatttaaagcccatccttacgcactccggccctccactcactacaaccctgccggagtggtgtggaccaatttctcgcctgttgacttcgccccaagcatatggcgagcagctgaaagaggatgacgtggagtgtattgtgaatcaggatgagctggctatcaattaccaggaacaagccagtagcccctgttctccaccagctagactgggccttgatcagaaagcttctccacaaacacccggtaaggagaatatctacgagggggatctgggccttggaggatacgaattgaaactcgaacagaccctcgggcagagccagttgaactag

SEQ ID NO: 135681 - DNA, 978 bp, Artificial Sequence
  Description of Artificial Sequence: Synthetic coding sequence
ctgcggctccaatcctcctgggagcaaatgacgtttgacccagaaattttctttaacgttctgcttcctcccatcatttttcatgctggatactctctcaagaagaggcatttcttccagaacctgggatccatcctcacttacgcattcctaggaaccgctatcagttgcatagtgattggcctgataatgtacggctttgtgaaagccatgatccacgcagggcagctgaagaacggcgactttcactttaccgactgccttttctttggatcccttatgtctgctacagacccagtgacagtgctagccatttttcacgaactccacgtggacccagatctctatacccttttgttcggagagtccgtgcttaatgacgctgtcgccatcgtgctcacatacagcatctccatctacagcccaaaagagaacccaaatgctttcgacgcagccgcattcttccaaagtgtcggcaattttctagggatcttcgcgggctccttcgccatgggatcagcctacgctattatcaccgctctgctcactaagttcaccaaactttgcgaatttcccatgttggaaaccgggcttttctttctactgagctggtctgcttttttgtctgccgaggccgccggtttgactggaattgtggctgtgttattttgtggcgtgactcaggcacactatacatacaacaatttaagctcggattctaaaatcaggaccaaacagctgtttgagttcatgaacttcctggccgaaaacgtgatattttgttatatgggcttggcgctgtttacttttcagaaccacatctttaacgctcttttcatcctcggagcattcgtcagcattttcctcgcaagggctcataccgaactgaagaatctacttttcttcttggcctcgtttctctgctacttttcccatagaagcaaaggcctcccgatggctggttgtgcgctcccttag

SEQ ID NO: 135682 - DNA, 3534 bp, Artificial Sequence
  Description of Artificial Sequence: Synthetic coding sequence
atggctggcatttttaaggaattctttttttctaccgaagacctgccagaggtgatcctgactctgtctctcatctcctctataggcgcctttctcaacagacatctggaggattttcctatccccgtcccagtaatactgttcctgctcgggtgcagctttgaggtgcttagttttacgtccagccaagttcagcggtacgccaatgcgatacagtggatgagccctgatttattcttcagaatctttacccccgtcgtctttttcaccacagcattcgatatggacacttatatgctgcagaagctcttttggcaaatacttctgatctctatcccgggctttctggtgaattatattctggtcctctggcacctcgcttccgttaaccagcttcttttgaagccaacccaatggcttctcttctcagccatcttggtgagttccgaccctatgctaactgccgcggccattagagacctgggactctccaggtctttaatttcattgataaatggagaaagcctgatgacttcagttatttcattaatcacattcacgagcattatggacttcgatcaacgcctccagagcaaacggaaccatacattggctgaggaaattgtgggcgggatttgcagctacatcattgcaagctttctgttcggtatattatcatctaagctaatccaattttggatgagtacagtctttggcgacgacgttaatcatatttcgctgatcttttccatcttgtacctgatcttctacatatgtgaactagtaggaatgtctggtatttttaccctagccattgtgggtttattgcttaacagcaccagtttcaaggcagccatcgaggaaacgctgctgttggagttctggacttttctgtctcgcatagcatttctgatggtgttcacattcttcggcttgcttattcctgctcacacgtacctgtatatcgagttcgtggacatttattattccctgaatatctatttgaccttgatcgtgctcaggtttctcactttattattgatcagcccagtgctgagcagggtgggccacgaattctcctggcggtggatttttattatggtgtgctctgaaatgaaaggaatgccaaacattaatatggctctgttgttagcatacagcgacctttacttcggcagtgacaaggagaagagccagatactcttccatggcgttctcgtatgcctgattactctggtcgtgaacaggtttatacttcccgtcgcagtgactatattgggactgagagatgcaacttccaccaaatataagagcgtgtgctgcaccttccagcatttccaggagctgacaaaaagcgcggcctccgctctgaaattcgacaaggatctggccaacgccgattggaacatgatcgagaaggcaattaccctggagaacccatatatgctaaatgaagaagagactacggaacaccagaaggtcaagtgtcctcactgcaacaaagagatcgacgagatctttaacacggaagccatggagttagcaaataggcgcctgttgtcagctcagattgcctcataccaacggcaataccgcaatgaaattttgtctcagagcgccgtgcaggtcctcgtgggcgcggctgaaagcttcggcgaaaaaaagggcaagtgtatgagccttgatactattaagaactattccgagagtcaaaagacggtgacctttgcgaggaagttacttttgaactgggtctataatacgcgcaaggagaaagagggcccctccaagtacttcttcttccgcatatgccatactattgtatttactgaggaatttgaacacgtgggatatttggttattttaatgaatatattccccttcattatatcttggatatcccaattaaacgtcatttaccactcggaactgaaacatacaaattattgtttcctgactctctatatcctggaggccctgctcaaaatcgctgcgatgcgaaaagacttttttagtcacgcttggaatatctttgaactcgctattactctcatcggtattctgcacgtgattttaatcgaaatagacacaattaaatacattttcaatgagacagaggtgattgtcttcattaaagtggtccaattcttcaggatccttagaattttcaaacttatagcccctaagctactacagattatcgacaagcgcatgtctcaccagaaaactttttggtacggaattctgaaagggtatgttcagggggaggctgacattatgaccattatcgaccagattaccagcagcaagcagatcaagcagatgctgctgaagcaagtgattaggaatatggagcacgccataaaagagctggggtatctcgagtatgatcaccctgaaattgccgtgaccgttaagacaaaagaggagatcaatgtgatgctgaatatggctacagaaatactgaaggcatttggtctcaagggcatcatttccaaaacggagggtgctggcataaataagcttataatggctaagaagaaagaggtgctcgactcacaaagtattatccgtccgttaacagtggaggaggtgctttaccacataccttggttggataagaataaggactatatcaatttcatacaggaaaaggccaaagtagtaacattcgactgcggcaatgatatttttgaagagggggacgagcctaaaggtatctatattattatctcaggcatggtgaagttggagaagtcaaaaccagggctgggcattgatcaaatggtggaatctaaagagaaggacttcccgattattgatacagactacatgctgtctggcgaaatcattggtgagattaactgtttaacaaacgaacctatgaagtattccgccacttgcaagacagtggtcgagacgtgcttcattcccaagacacacctttacgacgcattcgaacagtgttcccccttgattaagcaaaaaatgtggctgaagctgggactggcgattactgctagaaaaatacgcgagcatctgtcctatgaggattggaactataatatgcagctcaaactttccaatatttatgttgtcgatatcccgatgtccactaaaacagatatttacgacgagaacctcatctatgtcatactgattcacggggcggtggaggattgcctgctgcggaagacctacagggctccatttctgataccgattacatgccatcagatacagtctattgaagacttcactaaggttgtgataatccagactcccatcaacatgaagacattcagacgcaatatcagaaaatttgtccccaaacacaagagctacctcacccctggactcataggaagcgtggggacactggaagaaggcattcaggaggagcgtaatgtcaaagaggatggagcccattcagctgccacggcccggtcccctcagccttgcagtcttctgggaacaaagttcaactgcaaagaatccccccggatcaacctcaggaaggtgagaaaggaatag

SEQ ID NO: 135683 - DNA, 3390 bp, Artificial Sequence
  Description of Artificial Sequence: Synthetic coding sequence
atggcggggatcttcaaggagttttttttctccactgaggacctgcctgaagtcatattaactttatccctgattagtagtatcggcgcattcctaaatagacatctggaggattttcctattcccgtgccagtcatcctctttttgctgggctgttctttcgaagttctttctttcacctcttcccaagtgcaaaggtatgctaacgcaatacaatggatgtctcctgatttgttcttcaggatctttacaccagtggtatttttcactaccgcattcgatatggacacctatatgctgcagaaacttttttggcagatcctgctgatttctatccccggttttctggtgaattatatcctggtcctgtggcacttggcctcggtcaatcagctgttgttgaagccaacgcagtggctactctttagtgcaatcttggtgtcatctgaccctatgctgacagcagccgcaatccgggacctagggctgtctcggagcttgattagcctgatcaacggtgagtcactcatgacatcggtcatatccctgattacattcactagcatcatggacttcgaccagcgcctgcagtctaagaggaaccacaccctggcggaagaaatcgtgggagggatctgctcttatattatcgcctcttttctcttcggtatcttgtcaagcaaactcattcagttttggatgtcaacagtgttcggtgatgacgttaatcatatcagtctcattttctcaatcctatatttgatcttctacatctgcgagctggtcgggatgtccgggatttttactttagcaatcgttggcctcctgttgaacagcaccagcttcaaagctgccatagaggagacccttcttctggaattcttgacactcctgctgatctctcctgtcctttcccgggttggtcacgagttctcttggcggtggatcttcataatggtgtgctcagagatgaaaggtatgcctaacattaacatggctctgctccttgcatatagtgatctgtacttcggttctgataaggagaagtcacagatcttgttccacggagtgcttgtgtgtctgatcaccctagtggttaacagattcatactcccagtagcagtgaccatcctcggactgagggatgctacctctactaagtataaaagcgtgtgctgcacgtttcagcactttcaggagctaacaaaatctgccgctagtgcactaaagtttgataaggacctcgctaacgcagattggaacatgatcgaaaaggccattacgttggaaaacccatacatgctgaacgaggaagagaccaccgagcaccagaaagtgaaatgcccccactgtaataaagaaattgacgaaatctttaataccgaagccatggaactcgccaataggcggttactgtctgcccagatcgccagctatcagagacagtatcggaacgagattctctcccagtctgccgtgcaggtcttagtgggcgccgcagagagcttcggggagaaaaaaggaaagtgtatgagcctcgataccattaaaaattattccgagagtcagaaaaccgttacattcgctaggaaactgctgcttaactgggtgtacaatacacggaaggaaaaggagggaccatctaaatatttcttcttccgcatttgccacactatagtgttcaccgaggagttcgagcatgtggggtacttggtgatccttatgaatatctttcctttcattatctcttggatcagccagctcaacgtgatctatcattccgagctgaagcacactaattattgcttcctgactttatatatattggaggcccttctgaaaatcgccgctatgcgcaaagacttcttttcacacgcttggaacatcttcgagcttgcaatcactcttatcggaattctgcatgtcatccttatcgagatcgacacaataaagtacattttcaacgagacagaagttatcgtttttattaaagtggtgcagttcttccggatccttcgtatttttaagttgattgcgcctaaacttctgcagattattgataaaagaatgagccatcagaaaacattctggtatggcatcttgaaggggtacgttcaaggggaagctgacatcatgactatcattgatcaaattacatcatccaaacagatcaagcagatgctgctaaagcaggtgataagaaacatggagcatgccataaaggagctgggatatctggaatacgaccatccagaaatcgccgttaccgtgaagacgaaagaggaaatcaatgtcatgctgaacatggcaacagagatattgaaagccttcggactcaagggtataatctccaagactgagggagcaggtatcaataagctcatcatggctaaaaagaaggaagtcctcgattctcagagtattataagaccattaaccgtggaggaagtgctctaccatattccttggctcgataagaataaggattatattaattttatacaggaaaaggccaaggtggttacctttgattgcggtaatgatatttttgaggagggcgacgagcccaagggaatttatattatcattagtggcatggtcaaactggaaaagtccaaacccggcctcggaattgaccagatggtggagtctaaagaaaaggacttcccgatcattgacacggattacatgcttagtggcgaaataataggcgagattaattgtctcacgaatgaacccatgaaatattccgcaacatgtaagacggtcgtagagacctgtttcattcctaagacgcacctgtacgacgcgtttgagcagtgctcccccctcattaaacagaagatgtggctcaaactgggactggccattacagcaaggaagatccgggagcatttgtcatacgaagactggaactataatatgcaactgaaactctccaacatatatgtggtggatatcccgatgagcaccaagactgatatctatgatgaaaacttaatatatgtgatcctcatccatggtgccgtggaggactgcttactccgcaaaacctatagggctccgttcctaattcccatcacatgccatcagattcagtcaatcgaagactttacaaaggtggtgatcatacagacacccattaacatgaagacttttagaagaaacattaggaagttcgtgccaaaacacaaatcatatctcactcctggcctaattggcagcgtgggcactctagaggaagggattcaggaagaaagaaacgtgaaagaagacggagcacactccgcagcaaccgcaaggtcgcctcagccttgctctcttctgggaaccaagttcaactgtaaagaatcaccccgaatcaaccttaggaaagttcgaaaggaatag

SEQ ID NO: 135684 - DNA, 2079 bp, Artificial Sequence
  Description of Artificial Sequence: Synthetic coding sequence
atgcagggcaagaagcctggaggttcatcaggggggggcagaagtggcgaactgcagggagatgaggctcagaggaataagaagaagaagaaaaaggtgtcctgcttcagcaatatcaaaatattcctagtaagcgaatgtgctttgatgctcgctcagggcaccgtgggcgcctatctcgtctctgttttgacgacattggaacgccggtttaacctgcagtctgcagatgtgggcgttatcgcctcctccttcgagatcggcaacttggcccttattttattcgttagctactttggggctcggggacaccggccacggctgataggctgcggcggtatcgtgatggccctcggcgccctgcttagtgctttgcctgaatttctcactcaccaatacaagtacgaggctggcgaaatcaggtggggagccgaaggcagggacgtatgcgcagcaaatgggagtggcggggatgaggggcccgatccagatcttatttgtaggaatagaacagctaccaacatgatgtaccttctgctgatcggggctcaggtattgctgggcataggtgctacccctgttcagccgttaggcgtgagctacattgacgaccacgtgcggaggaaggactctagtctatacattggcatcctgtttactatgttagtgttcggaccggcgtgcggatttattttgggcagtttctgtaccaaaatatatgtggacgctgtcttcattgatacaagtaacctggacatcacccccgacgacccacggtggatcggcgcatggtggggtggttttttactgtgcggcgcactcttgttcttttcaagcttgctcatgttcggctttccacagagcctgccacctcactctgagcctgctatggagtcagagcaggcgatgctgagtgaacgagaatacgaaaggcctaaaccatccaacggggtactccgccatcccctcgagcccgactccagcgcatcatgctttcagcaactccgggtcattccaaaggtgacaaagcacctgttgtcaaatccagtttttacatgcatcatccttgctgcttgtatggagatagccgttgttgccgggttcgctgcgttcctgggcaagtatctggagcagcaattcaacctgacaacgagcagcgctaatcagctgcttggcatgactgctatcccgtgcgcctgcctggggatctttctagggggactgctggtgaagaagctgagcctgagcgccctaggcgcgatcaggatggctatgctcgtaaatctggtctctacagcctgttatgtgtctttcctgttcctgggatgcgataccggaccggtggccggggtcacagtaccatacggcaactccaccgctcccggttcggcgctggacccttattccccatgcaacaacaactgcgaatgtcagaccgacagcttcactcctgtctgtggtgcagacggtatcacctacctttctgcttgttttgccgggtgtaattctaccaatctgaccggctgtgcctgcctcacaacggtacccgccgaaaatgcaaccgtggtcccgggcaagtgcccttctcctggatgccaggaggcattcctgactttcctctgtgtgatgtgcatctgtagtcttatcggagcgatggcacagacaccttccgttattatcttgattcgtacggtctctcccgagctcaagtcttacgccctgggcgtgctgtttctgctcctacgattactcgggtttattcctcccccactcatcttcggcgcaggcatcgattccacttgtttgttttggagtaccttttgcggggaacagggtgcatgcgtactgtacgataatgtcgtgtatcggtatctttacgtgagtatcgcgattgcattgaaatcattcgcttttatcctgtataccactacctggcagtgtcttcggaagaactataagaggtatatcaagaaccatgagggtgggttaagcacgagtaccgagtaccaggatattgaaaccgagaagacgtgcccagaatcgcattctcctagcgaggacagcttcgtgcggagttag

SEQ ID NO: 135685 - DNA, 2076 bp, Artificial Sequence
  Description of Artificial Sequence: Synthetic coding sequence
atggatcagaaccaacatctgaacaagacagccgaagcccagccttctgagaataagaaaacacggtattgcaacggattgaaaatgttcctcgctgcgttgtctctgagctttatagccaagacattaggagccatcatcatgaaaagtagcattatccatatcgaacggcggtttgaaattagtagtagcctggtggggttcatcgacggatcgtttgaaataggtaatctccttgtgatagtgtttgtgtcctactttgggtcaaagctgcatcggcctaagctgataggcattggctgcttcatcatgggaattgggggcgtcctcaccgctttgcctcatttctttatgggctactataggtactctaaagaaacaaacattaactccagcgagaactccaccagtaccctgagcacctgcctgattaatcagatactgagtctgaatcgggctagccctgagattgtgggaaagggatgtctgaaggagtctggaagctatatgtggatctacgtatttatgggcaatatgctgcgagggattggagaaactcctatcgtcccacttggcttgtcatacattgacgattttgccaaggaggggcactccagtctctacctcggcattctgaatgcaattgctatgattgggcctatcattgggttcaccctcggttctcttttttctaagatgtatgtggatatcgggtatgtagatctctccacgatccggattactccaacagattccaggtgggtgggagcttggtggcttaatttcctcgtgtctggtcttttctctataatctccagtattcctttttttttcctgccccagacacctaacaagccccagaaggaaaggaaggcatccctgtctttgcatgtcctggaaactaacgatgaaaaagaccagactgccaacctcactaaccaaggcaagaacatcaccaaaaacgttaccggattttttcagagcttcaagtccattctgactaatcctctgtatgtaatgtttgtcttgctgacacttttgcaagtcagctcttatattggcgcgtttacctacgtttttaaatacgtggagcaacaatatggccagccatcgtccaaagccaacatactcctcggggtgatcacaattcccatcttcgccagcggcatgtttctgggtggctatatcataaagaaattcaaacttaacacggtcggtattgctaagttttcatgcttcacagccgtgatgagtttatcgttttacctgttatacttctttattctctgcgagaataaaagcgtggccggtctcacaatgacatacgacgggaacaatcctgtcacctcacatcgcgacgttcctctgagctactgcaatagcgactgcaactgcgacgaatcccagtgggagccagtttgcggcaacaatggcatcacctacattagtccctgcctggcgggttgcaagagctctagcgggaataagaaacctatagtattttataactgtagctgtctggaagtgactggtttgcaaaatcgtaattattcagcacacctcggcgaatgccctcgggacgatgcctgcacacgaaagttctatttcttcgtggccatacaggttttaaacctgtttttctccgccctgggcgggacctcccacgttatgctgatcgtgaagattgtacagcctgagctcaagtcattagcattgggctttcactccatggtgattcgggcactggggggcattctagccccaatatacttcggtgccctaatcgatacaacttgtattaagtggtcaacgaacaactgcggcacaaggggcagctgcagaacatacaattcaaccagtttctcaagagtgtacctgggactatcttccatgctgagggtgtcctctctagtgctctacatcattctgatctacgccatgaagaaaaagtatcaggagaaggatattaacgcctcagagaacggctccgtaatggatgaagccaacttggagagcctgaacaagaataagcactttgtgccctcagccggagcggatagcgaaactcactgttag

SEQ ID NO: 135686 - DNA, 2109 bp, Artificial Sequence
  Description of Artificial Sequence: Synthetic coding sequence
atggatcagcatcagcatctgaataagacggcagagtccgcctctagtgaaaagaaaaagaccaggaggtgtaacgggtttaaaatgtttttggccgcactgtccttttcatatattgccaaagccctgggagggattatcatgaagatttccattacacagatcgagagacgctttgacatcagctccagcctggctgggctcattgatggctctttcgagatcggtaacctcctggtcattgtctttgtgtcttacttcggatccaaactgcacaggccaaagttgattgggatcgggtgtcttcttatggggacaggctccattcttacatctctaccccattttttcatggggtactataggtactccaaagagacgcacataaatcctagtgaaaattcaacttccagcctctcaacttgcttgatcaatcagaccctctctttcaacggaacaagccctgagattgtggaaaaagactgtgtcaaagagagcggctcccacatgtggatatatgttttcatgggcaatatgctgcgtggcatcggggaaactcctatcgttccccttggcatttcttacatcgatgacttcgcaaaagaggggcacagctctctgtatctgggctccttaaacgcgatcggtatgattggccccgtaattgggttcgctttaggatccctgtttgccaaaatgtatgtggacattggctatgtggacctgtctacaattcgcattacccccaaagatagcaggtgggttggcgcttggtggcttggatttctggtctccggtctcttcagcattatcagttctataccattcttctttcttcctaagaatccaaacaagcctcagaaggagagaaaaatctcactgtcactgcacgtgctcaagaccaacgacgatcggaaccaaaccgctaatctgaccaatcagggtaaaaatgtgaccaaaaacgtcacaggcttcttccagtctttaaagtctatccttaccaaccccctttatgttatttttctactgctgacgctactacaggtgtcttcgtttatcggatccttcacgtatgtgtttaaatacatggagcagcagtacggccaatcagcctcccacgcaaatttccttctgggcataattacgattcctaccgttgctaccggcatgtttctgggcggattcatcatcaagaaattcaaattaagccttgttggcatcgcaaaatttagcttcctcaccagcatgattagttttctgttccagctgctatactttcccctgatttgcgagagcaagtccgtcgcaggcttgaccctcacctacgatgggaacaactccgtcgcttctcacgtcgatgtgcctctgagttactgcaacagcgaatgcaactgtgatgaatctcagtgggaaccagtgtgcggtaacaatggcattacatacttatccccatgtctggcagggtgcaagtccagctctggcatcaagaaacacacagtcttctacaactgctcatgcgtcgaggtgaccggcctccagaaccgaaattattctgcccacctaggggaatgccctagggataatacatgtacaaggaagttcttcatctatgtcgctattcaagtgattaattccctgttttccgctactggggggactacatttatcctgctgaccgtgaaaatagtccagcccgagctaaaagccctcgcaatgggctttcagtcaatggtaatacggactctcggagggattctggcccccatctactttggcgcactgatcgacaaaacttgcatgaaatggtcgactaacagctgcggggctcagggcgcgtgccggatctacaacagcgtattctttgggcgcgtctacctcggactgtccatcgctctgcgattcccagcactcgtgctttatatcgtgtttatctttgcgatgaagaagaaattccagggtaaggacacaaaagctagcgataatgagcgtaaggtcatggacgaggcaaatctggagtttctgaataatggagaacatttcgtgcctagcgccggcacggactccaaaacatgcaatctggacatgcaggataacgcagcggccaactag

SEQ ID NO: 135687 - DNA, 2109 bp, Artificial Sequence
  Description of Artificial Sequence: Synthetic coding sequence
atggaccaacatcaacacctcaacaaaacggctgagagtgccagcagcgagaagaagaagactcgtcgatgtaatggattcaaaatgttcctcgccgctctgagtttctcctacatagcaaaagctctgggggggattatcatgaagatcagcattacacaaatcgagagaagatttgacatatccagttccttagccggattgatagatggttctttcgagatcgggaacctgctagtgattgtcttcgtaagctactttggctctaaattgcatcgccccaaactcatcggcatcgggtgtttactcatgggcactggatctattctgacttcactgccgcacttttttatgggatactacagatattcaaaggaaactcacattaatcccagcgagaactccaccagcagtttgtcaacttgtctgatcaaccagactcttagcttcaatggcacgtcaccagagatagttgagaaagactgtgttaaggagtcaggatcgcacatgtggatctatgttttcatgggcaatatgctgaggggaattggtgaaactcccatcgtaccactgggcatttcctatatcgacgatttcgccaaggagggccatagtagcctctacttagggtctctgaacgctatcgggatgattggacccgttattgggtttgccctgggcagtctctttgctaaaatgtatgtcgatattggttatgtcgacctcagcacaatacgaattaccccaaaagatagccgatgggtgggagcctggtggctgggttttcttgtgagcggactcttctcaatcatcagcagtatcccattctttttcctgcctaagaatcccaacaagccacagaaagaaagaaagatcagcctctcacttcacgtgttaaagactaacgacgaccggaatcagacagccaacttaactaaccaggggaagaacgtgaccaaaaacgtgaccggattcttccagtctctgaaatccatccttactaatccactatacgtcatttttctgttattaaccttgcttcaggtgtcttcctttattgggtcctttacctacgtgtttaagtacatggaacagcagtacggccagagcgccagccacgcgaattttctcctggggataatcactatcccgacagttgctactggcatgtttttggggggatttattattaaaaagtttaagctgtcgctcgtaggcatcgccaagttttccttcctgactagcatgatatcgtttctctttcagctgctgtattttcctctgatatgcgagagcaagtctgtggccggactgacgttgacctacgacggcaataattctgtggcatcccacgtggatgttcccctgtcctattgtaatagcgagtgcaattgtgatgagtcccagtgggagcccgtatgtgggaacaacggcatcacatacctcagtccatgcttggccgggtgtaaatcaagctccgggattaaaaagcacactgtcttttacaactgctcttgtgtggaagtcaccggactccaaaatagaaattactcagcccatctcggagaatgcccccgggacaatacatgtacccgcaaatttttcatctacgtcgcaatccaggtgataaatagccttttcagcgcaactggaggcaccacatttatcctgctgaccgtcaaaatcgttcaaccagaattgaaggccctggccatgggtttccaaagtatggtgattcggacactcggcggaattcttgcaccaatctacttcggcgctcttatagacaagacttgcatgaagtggagcactaatagttgcggcgcgcagggcgcttgccgtatctacaactccgtcttttttggccgggtgtatctgggactgtcgatagcgctgagatttcctgctctggtgctgtatattgtcttcattttcgccatgaaaaagaagttccagggtaaagatacaaaggcaagcgacaatgagagaaaggtgatggatgaagccaacctcgaattcctgaataacggcgaacatttcgttccttccgccgggaccgactcaaagacttgcaacctcgacatgcaagacaatgcggccgcaaactag

SEQ ID NO: 135688 - DNA, 2247 bp, Artificial Sequence
  Description of Artificial Sequence: Synthetic coding sequence
atggatcagcaccagcatctaaacaaaaccgccgagtctgcctcctctgaaaagaaaaaaacccggcggtgcaatgggttcaagatgttcttagctgcactgtcctttagttatattgccaaagccctgggcggtataattatgaaaataagtatcacacaaatagagagaagatttgacattagctcatctctggcaggactgatagatggcagcttcgaaattggcaacctgttagttattgttttcgtaagctattttgggtccaagctgcaccggccaaagttaatcgggattggatgtctacttatgggaacggggtcaatcttaacatcactgccacatttttttatgggatattatcgctattccaaggaaactcacataaatccctcagaaaatagtacgagttcactttcaacgtgcctgatcaaccagacgttgagcttcaatgggactagccctgagatcgttgaaaaagattgtgtgaaggaaagcggttcccacatgtggatctacgttttcatgggaaacatgttaagaggaattggcgaaactcccatcgtgcccctgggaatttcatatattgacgatttcgccaaagaaggacactcaagcctctacttaggatcgctgaatgccatcggcatgataggaccagtgatcgggtttgccttgggatctcttttcgccaaaatgtatgtcgacattgggtacgttgacctcagtacaatcagaattacgcctaaagatagcaggtgggtcggcgcttggtggttggggtttctggtttcagggttgttttccatcatttcttctatcccatttttcttcttacccaagaatccgaacaagccacaaaaggaacggaaaatctcgctttccctgcacgtcctcaagacaaacgacgacagaaaccagactgcaaacctgacaaatcaaggtaagaatgtgaccaagaatgttaccggtttcttccaatccttgaaatcaatcctgacaaatcctctgtacgttattttcctgctgctgactctgctccaggtgagttctttcattggatcgttcacgtatgtgtttaagtacatggagcagcagtatgggcaatctgcgtcccatgcaaattttcttcttggcatcattaccatacccactgtcgccactgggatgttcctcggtggcttcataattaaaaagtttaagttatcactcgtggggatagccaagttctcctttctcacctcaatgatctctttcttattccagctgctctattttccgttaatctgtgaaagcaaatccgtggcgggtcttaccctgacatacgacggcaacaattccgtcgcctcacatgttgatgtgcccctgagctattgcaattccgagtgtaactgtgatgaatctcagtgggagccagtgtgtggcaataatggcatcacttacctgtcaccctgtctggcaggctgcaagtcctctagtgggattaagaaacacaccgttttctacaattgttcctgtgtcgaagtcaccggccttcagaatagaaactattcagcccacctgggggagtgccctcgggataacacctgtactaggaaatttttcatatatgtagccatccaggtgatcaactccctatttagtgcgactggtggaactacctttattcttctcaccgtcaagattgtgcaacccgaacttaaagctctggccatgggatttcagagcatggtgatccggaccctcgggggaatcttggctccaatctatttcggagcactcattgacaagacctgcatgaagtggtctactaactcgtgtggggcacagggagcttgccggatctacaacagcgttttctttggaattgtgcaacctgagcttaaggccctcgctatcggcttccacagcatgatcatgcggtccttgggtggtatcctagtcccgatctacttcggggctttgatcgatactacttgcatgaaatggtctaccaattcctgcggggcccggggagcttgccgtatatacaatagcacttatctgggcagggcattctttggacttaaagtagctcttattttccccgtcctggtgctgcttaccgtttttatttttgtggtacgcaaaaagtcacacgggaaagacacaaaggtgctggaaaacgaaagacaggttatggatgaggcaaatctggaattcctgaatgactcagagcacttcgttccgtctgcagaggaacagtag

SEQ ID NO: 135689 - DNA, 2139 bp, Artificial Sequence
  Description of Artificial Sequence: Synthetic coding sequence
atggatacatctagcaaagagaacattcagttgttctgtaaaaccagcgtgcagcctgtgggtcggcccagtttcaaaacggagtatccctcatctgaggaaaagcaaccttgttgtggcgagttgaaagtttttctctgcgcactgagttttgtttactttgccaaggccctggcagaggggtacctgaagtccacaatcacccaaatcgagagaagatttgacatcccgagtagcttagtaggagtgatcgatggctcattcgaaatcggcaatctgctcgtcatcaccttcgtgtcctatttcggcgcaaaattgcaccggcctaagataatcggcgccgggtgtgtgataatgggggttggaacactcctgatcgcaatgccacagtttttcatggaacagtacaaatacgagcgctactccccatcctctaacagcacattgagcatttcaccctgcctgctggagtcctcttcacagctcccagtcagtgtcatggaaaagagtaagagtaagatatctaatgagtgcgaagtcgataccagtagtagcatgtggatctatgtattcttgggcaacctcctgagaggaatcggtgagacgcccatccagcctcttggcatcgcgtacctcgacgattttgcatccgaggacaacgccgcgttttacatcggctgcgttcaaaccgtggccatcatcggccccatcttcggcttcttgctcgggtccctgtgcgccaagctctacgtagatattggcttcgtaaacctggaccatattactatcactccgaaggacccacagtgggtgggggcctggtggctggggtaccttatcgcaggaattatttctttactggctgccgtgcccttctggtatctgcccaagagtttgcctcggtctcagtcccgggaggattccaacagtagtagtgagaagtccaagttcatcattgacgaccatacagattatcaaacccctcagggagaaaatgccaaaattatggagatggctagagacttcctcccatctctgaaaaatcttttcggaaatccagtgtattttctttacctgtgtacatcaacagtgcaattcaactctttatttggtatggtaacatataagcctaaatacatcgagcaacagtacgggcagtcgagctctagagcaaatttcgttataggtctcattaacatccccgcagtcgctctgggcattttctccggaggcattgtgatgaaaaaattccggattagtgtttgtggggctgccaagctatatctcggttcatccgtgttcggttacctgctgttcctgtcactgttcgctctgggctgcgaaaactctgacgtggctggtctgactgtgtcttaccaagggacaaagcccgtgtcatatcacgaacgcgctcttttctcagactgtaacagtaggtgcaagtgttctgaaaccaaatgggagcctatgtgcggggaaaatggcattacctacgtgtccgcctgtcttgccggctgccagacatcgaaccgctctggaaaaaatatcattttttacaactgtacctgtgttggcattgccgcctcaaagagtggcaactcttctggcattgtgggcaggtgccagaaggataacggctgccctcagatgttcctgtattttctagttatcagcgtaattacgagctacacattatcgctcggaggtattcctggctacatcttgctccttagatgcatcaagcctcagctgaaaagcttcgccttaggcatttacaccctcgccataagagtgttagcaggcatcccagctcctgtgtattttggagttctcattgacaccagctgcctgaaatggggcttcaaacgctgtgggagcagggggagttgtcggctatatgacagcaacgtgttcaggcacatctatctcgggttgactgtaattctgggcacagtgtccattctgcttagcatagctgtcctgtttatcctgaaaaaaaattatgtgagcaagcatcggagctttattaccaaaagggagagaaccatggtctccacacgctttcagaaagaaaattacaccacgagcgaccacctcctgcaacctaactactggcctggaaaggagactcagctgtag

SEQ ID NO: 135690 - DNA, 2193 bp, Artificial Sequence
  Description of Artificial Sequence: Synthetic coding sequence
atggacacgtcctctaaggaaaacatccagctgttctgtaagacaagcgtgcagccggtcggtcgccctagcttcaaaactgaatacccatcatctgaagagaagcagccgtgctgtggagagctgaaggtttttctgtgcgccctttccttcgtgtactttgccaaagccttggccgagggctacctgaagtctactattacacagattgaacgacgatttgacattcctagttcattggtgggcgtcatcgacgggagcttcgaaatcggaaacttgttggttataaccttcgtgagctatttcggagcaaagctgcacagacccaagataatcggggcaggatgtgtgatcatgggcgttggtactctcctgatcgctatgccacagttttttatggaacaatataaatacgagcggtacagtccttcaagcaactccacactttctatcagtccatgcctgttagagagcagctcacagctccccgtgtctgtgatggagaagagtaagagcaagatcagcaacgagtgcgaagtagatacaagttcttccatgtggatctacgtgttcctggggaacctgctgaggggaatcggagaaacccctatccagccactgggaatcgcgtacctggacgattttgctagcgaggacaacgcagccttttacatcggatgcgtgcagaccgtcgccattattggtccaattttcggttttctgcttgggagtctgtgcgccaaattatacgtggatattggcttcgtgaatttggaccacattacaataacaccgaaggatccgcagtgggtgggcgcctggtggctgggctacctaatagcaggtattatttctttgctggccgccgttccgttctggtacctacccaagagccttcccagaagccagtcaagagaggactcaaatagttcaagcgaaaagagcaagtttatcattgacgatcacactgattaccaaaccccacaaggagaaaacgcaaaaattatggagatggcaagggacttcctaccgtccctcaagaatctattcggcaatcccgtgtacttcctgtacctttgcactagcacagtccagttcaacagtttatttggcatggtgacttacaaacctaagtatatcgaacaacagtatggacagagttcgtctcgcgcaaacttcgtgatcggcctcattaatattcccgcagtcgctctaggcatcttcagtggagggattgtaatgaaaaaattccgtatcagcgtatgcggcgcggccaaactgtatctgggcagttccgtgttcggctacctactgtttctgtccctcttcgcgttgggctgcgagaactcggacgtggcaggattgaccgtttcctaccagggtactaagcctgtgtcctaccatgaaagggccctgttctcagattgtaattcccgctgcaagtgcagtgagacaaagtgggagccaatgtgcggagaaaatggcattacttatgtttcagcttgtttggcaggctgccaaacatctaaccgttccggcaagaacatcatcttctacaattgtacctgcgtgggtatagccgcatctaaatcaggcaattcgtctgggatcgtcggcaggtgccagaaagacaatgggtgcccccaaatgtttctgtatttcctggtgatttcagtgatcactagctacacgctctccctgggcggcatccccggatatatcttgctgctccgctgtataaagcctcagctgaagtccttcgcactgggcatttataccctcgccatacgggtcctggcaggcattccggcgcctgtgtattttggcgtcctcatagacacctcttgtcttaagtggggatttaagagatgtggaagcagaggaagctgtaggttgtatgattctaatgtgtttcgatatcagatcaaaagcattccagcctcacattgctacagcatacctgacctgcacaacgccactgacacgaataagttcagctgtcacttcacagcctgtaaaacctacatttccgggacaaactgcgatactgggcactctgtgaattcccctaagcattgcagtacattccatttcaaggaaaaactctgctttaagacccagaagttctacaaccaggagagaaaaaataatggcgtctacaagattccaaagggaaaactacactataaatag

SEQ ID NO: 135691 - DNA, 1992 bp, Artificial Sequence
  Description of Artificial Sequence: Synthetic coding sequence
atggatacttctagtaaggaaaacattcagctcttttgtaaaacatccgtccagccagtgggacgtccctcatttaaaaccgagtaccctagtagtgaggagaagcagccctgttgtggagaactaaaggtttttttatgcgcattgagcttcgtctacttcgccaaggcactagccgaaggctatctaaagtcgactatcacacagattgaacgacgctttgacatcccatctagtctggtgggcgttatcgacggcagcttcgaaatcgggaacctccttgtgataactttcgtaagctatttcggagccaaattgcatagacccaaaattataggagccggatgtgtcatcatgggtgtcggtacgttgctcatcgccatgcctcaattcttcatggagcagtataagtatgagagatatagcccttcctccaattcgacactgagcatctctccctgtctgctggagagtagcagccagctacccgtgtccgtgatggaaaaatccaaatccaagattagcaacggatgcgtgcagaccgtcgcaattatcgggcccattttcggctttctgttgggatccctgtgtgccaaattgtatgtggatattggatttgtgaatctggaccatattaccataactccaaaggatccgcaatgggtgggggcctggtggctgggttacctcatcgctggcatcatcagccttcttgccgctgttccattttggtatctgcccaagagcctgcctcgctcgcagtctcgagaggactcgaactctagctctgagaagtcgaagttcataattgatgaccacaccgattatcaaacaccccagggtgaaaacgcaaagataatggagatggctcgcgacttcttgcccagcctgaaaaacctgtttggcaacccggtctatttcctgtacctctgcacatcaactgttcagttcaacagtctgtttggcatggtgacatacaagcccaaatatatagaacagcagtacggacagagtagcagtcgggcgaattttgtcattgggcttatcaacattccagcggtcgccctcggtatcttttccggggggattgttatgaagaagtttcgtatcagtgtgtgtggagcagctaagctgtacctgggcagtagcgtgtttggatatctcctgtttcttagcctgttcgccttagggtgcgagaatagtgacgtagccggcttaacggtgtcttaccaggggaccaagcccgtctcatatcacgagcgcgccctgtttagcgactgcaacagcaggtgtaagtgcagcgaaacgaaatgggagccaatgtgcggagagaacggaatcacttatgtaagtgcctgtctcgctggctgtcagacttcaaaccgttccggtaagaatatcatattttacaactgcacatgtgtgggtatagccgcgtctaagtcaggcaatagtagcggtatcgttggaaggtgtcagaaagataacggatgcccacagatgttcctctacttcttggtgatcagcgtcatcaccagctatacactgagtcttggggggatcccaggctatatcctcctgctcaggtgcatcaagccacaactgaaatccttcgctctgggaatctacaccctcgcaatccgcgtgctcgcaggaataccggcccctgtgtactttggagtattaatcgatacttcttgcctcaagtggggcttcaaacgctgcggctcccgtgggtcttgccggctctatgactctaacgttttcaggcacatttacctcggcctgactgtcatcctaggaacggtaagtattcttctgtcaatcgcagtgttatttatcttgaaaaagaactacgtcagtaaacaccgttcgtttatcaccaagcgagagaggaccatggtgtctactcggtttcagaaagagaattataccacgagtgatcatctgctgcagccaaactattggcccggcaaagagacccaactctag

SEQ ID NO: 135692 - DNA, 1839 bp, Artificial Sequence
  Description of Artificial Sequence: Synthetic coding sequence
atgggggtaggcactctgttgatcgccatgccccagtttttcatggaacaatataagtatgagaggtatagcccttcgtcaaacagtacgctgtcaataagtccctgcttgctggagagctcatcacaactccctgtgagtgtgatggaaaagtcaaagagtaaaatttctaatgaatgcgaagtcgatacaagctctagcatgtggatttacgtgtttctgggtaaccttctgcggggaattggcgagacacccatccaacctttgggtattgcttatctcgatgatttcgcctcagaagacaatgccgccttttatatcggttgtgtccaaaccgtggccattattggaccaatcttcggctttctactgggctccttatgcgcaaaactgtatgtagatatcgggtttgttaacctggatcacatcaccattacacccaaggacccccaatgggtgggagcctggtggctcgggtacctgattgccggcatcatttcattattggccgctgtgccattctggtacctccccaagagcctgccacgttcgcagtccagggaagactcgaacagttccagtgagaagagtaagtttattattgacgaccacaccgactaccaaaccccccagggagagaatgctaagatcatggaaatggctcgcgacttcttgccgtctctgaaaaacctcttcggtaacccggtgtacttcctgtacctctgtacaagcactgttcagtttaatagtctgttcggaatggttacttacaaaccaaaatatattgaacagcagtacgggcagtcttctagcagggccaacttcgtaattggactcattaacatccccgcagtcgcattagggatcttttcagggggaattgtaatgaagaagtttcggatcagtgtctgcggagccgctaagctctatttaggatcaagcgtattcggctacctcctctttctgtcattattcgccttggggtgcgagaacagcgacgtcgctggattaaccgtctcttaccaaggcacgaaaccagtcagttaccatgagagggccctgttctcagattgcaactccaggtgcaagtgtagcgaaaccaaatgggagcctatgtgtggagagaacggtatcacctacgtgtcagcgtgtttagccggatgccagaccagtaacagatccgggaaaaatattatcttctacaactgcacctgcgtaggaattgcagcttcaaagtctggaaactcaagcggtatcgttggcagatgccagaaagacaatggatgtccccagatgttcttgtacttcctggtaataagcgtgatcacaagctacaccctatcgttgggtggcatcccgggctacatcctgctacttaggtgtatcaagccccaactcaaaagcttcgctctcggaatatacacactggctatcagagttttggcggggatacctgcccccgtctacttcggggtgctgattgacactagctgcctgaagtggggattcaaacggtgcggctcaaggggctcctgtaggctttatgacagtaatgtattccgttatcaaatcaagtcaatcccagctagtcattgctactcaatcccagacctgcataatgctacagacaccaataaattctcttgtcatttcaccgcctgtaagacatacatttccggaacgaattgcgatacggggcatagcgtcaattcacccaagcactgttctacgtttcacttcaaagagaaactatgtttcaaaactcagaaattttataatcaggagagaaaaaacaatggtgtttataagatccccaagggcaaacttcattacaaatag

SEQ ID NO: 135693 - DNA, 2193 bp, Artificial Sequence
  Description of Artificial Sequence: Synthetic coding sequence
atggacacgtcaagcaaggaaaatatccaacttttttgtaagacttcagtgcagccggtgggcaggccgtcgtttaaaaccgaataccccagctctgaagagaaacaaccttgctgcggggaacttaaagtcttcctatgcgccctctcctttgtgtacttcgctaaggcattggccgagggctatctaaaatctacaattacccagatcgaacggcggttcgacattccaagctctcttgtgggagtgattgatggctcttttgagatcggcaatctcctcgttatcacttttgtgtcctatttcggcgccaaactgcaccgccctaaaattatcggtgccgggtgcgtgatcatgggcgtgggtacattgctgattgccatgccacagttttttatggaacagtacaagtacgagcggtacagcccgagtagtaattccacattgtcaatatcaccatgtctgctggagtcatcttcccaactccctgtgtccgtgatggagaagagcaagtccaaaatcagtaatgaatgcgaggtagatactagttctagcatgtggatttacgtgtttcttggaaatctgctgagaggtataggagagacacccattcagccactgggtatcgcctacctggatgatttcgcgtctgaggacaacgctgcgttctatataggctgcgtgcagactgtggccatcataggacccatttttgggtttttgctgggcagcctatgcgcgaagctctacgtcgacattggttttgtgaacttggatcacatcacgatcacaccaaaagaccctcagtgggtcggagcttggtggttgggttatcttatcgctggtatcatcagcttgctggcagccgtccctttctggtacttgccgaaatctctgccccggagtcagagcagggaggactccaacagctcctctgagaaatctaaattcatcattgatgaccacacagactatcagacaccccagggtgagaatgccaaaataatggaaatggcaagagactttctgcctagtttaaagaacctcttcggcaatcccgtctactttttgtatctatgtacaagcacagtacagtttaattcactgtttggcatggtgacatataaaccgaaatacatcgaacagcagtacggccagtcttcttcccgggccaattttgtcatcggactcatcaacatccccgctgtggcccttggaatatttagtggcggcattgttatgaaaaagtttcggatctcagtatgtggcgctgctaagctttatctcggaagttccgttttcggctatctgctatttctctcgctttttgcactcggatgcgagaatagcgacgtagccggcctcacggtgtcatatcagggaaccaagcccgtctcttaccacgagagggccctgttctcagactgtaattccaggtgcaagtgttccgagacgaagtgggagcctatgtgcggagagaatggcataacgtatgtctccgcctgcttggccgggtgccagacttccaatcgctccggcaagaacattatattctacaactgcacgtgcgtgggaatcgcagccagcaagtcggggaactctagtggcattgtaggtaggtgccagaaggataatgggtgcccccagatgtttctctacttcctggtgattagtgtcatcacatcctacacactgagcctcgggggcatccccggatacattctgctgctgcgctgtataaaaccacagctgaaatctttcgccctcgggatctataccctcgcgattcgggtgctggctggcatcccagcccccgtgtatttcggggtgctgatagatacgagctgcttgaagtggggctttaagcgctgcgggtcacgcggcagctgtcgcctgtacgacagcaacgtgtttcgatatcagataaaatctataccagcgtctcattgctattctattccagacttgcataatgctactgacaccaacaaattcagttgccatttcacagcttgtaagacatacattagcgggactaattgtgacactggccattcagtcaattccccaaaacactgttcgacctttcactttaaagagaaattgtgtttcaaaactcagaaattctataaccaggaaagaaaaaacaatggggtttataaaatccctaagggaaagctccattataagtag

SEQ ID NO: 135694 - DNA, 1932 bp, Artificial Sequence
  Description of Artificial Sequence: Synthetic coding sequence
atggggctgctcccaaaactgggggcttcccagggcagcgacacaagcaccagtcgtgctgggcgctgcgcaaggtctgtgttcggaaacattaaagtgtttgtcctgtgtcagggccttctccagctctgtcagctgctttatagtgcttactttaagtcttcattgacaacgatcgaaaaacgattcggcctgtcctcatcttcatccggtctgatcagtagcttgaacgaaatttctaacgctatactgataatatttgtgagttattttgggtctcgcgtccataggccacgactgatcggaatagggggcttatttctggccgcaggagctttcatcctgactctgccacactttttgagcgaaccatatcagtatactctggctagtactggcaataattcccgactgcaagccgagctatgccagaagcattggcaggacctccctccctctaaatgccacagcactacgcagaatccccagaaggaaacttctagtatgtgggggcttatggtggtggcacaactactggcagggatcggtacggtccccattcagcctttcggcatctcgtacgtggatgactttagcgagccctctaacagtcctctgtatatatctattctgtttgcaatcagtgttttcggccctgcattcggctatctgctaggatccgtgatgctccaaatttttgtggactatggacgggtgaatacagccgctgtgaacctggtccccggggacccccgatggattggagcgtggtggctgggtctgcttatttctagcgccctgcttgtattaacaagttttccattcttcttctttcctcgcgctatgcctatcggcgcaaagcgggctcctgctactgccgacgaagccagaaagctcgaagaggcaaaaagccgcggatctttggtggacttcattaaacgcttcccctgcatctttctgaggttgttaatgaactctctgttcgttttggtagtgttggcgcaatgtactttttcgagtgttattgccggtctgtcgacatttctaaataagttcttggagaagcagtacggcacctcagctgcctacgccaatttcctaataggggctgtgaacttacctgctgcggctctgggcatgctatttgggggcatactgatgaagcggtttgtgttcagcctgcaggccatccctcgtattgccactactataatcaccatttccatgattctatgtgtgccattgtttttcatgggctgctctactcctactgtagccgaagtgtatcccccatccaccagcagctccatccatccacagagtccagcttgtcgccgcgactgcagttgtccagattccattttccaccccgtctgtggggataacggcattgagtacctgtcgccctgtcatgctggatgctctaatattaacatgtcatcggctacctcaaagcagctcatctacctgaactgttcttgtgtcaccggcggctcagcttcagccaagaccgggtcgtgtcctgtgccttgcgcgcacttcctcctcccggccatctttttgatctcatttgtcagcttgattgcgtgtatctcccacaacccgctgtatatgatggtcctccgagtcgtgaaccaggaagagaagtcttttgcgattggggtgcaattccttctgatgagattacttgcctggctgccatcaccggccctgtacggcctgactattgaccactcttgtatcagatggaactccctgtgtctgggacgccgaggcgcctgtgcctactatgacaatgatgcacttcgggacaggtacctgggccttcaaatgggctacaaggcattgggaatgctactgctttgcttcattagttggcgtgtgaagaagaataaggaatacaacgtccagaaagccgcagggctgatttag

SEQ ID NO: 135695 - DNA, 1248 bp, Artificial Sequence
  Description of Artificial Sequence: Synthetic coding sequence
atgggtctcctcccaaagctgggagccagccagggctccgatacctcaaccagtagagccggacgatgcgctcgtagcgtgtttggcaacatcaaagtgttcgttttgtgccagggactgttgcagctgtgtcaactcctctactctgcatactttaaaagctctctgactactatcgaaaaacgcttcggattgtcctcctccagcagtggcctgatctcaagcctaaacgaaatctcaaacgccatacttattatttttgtgtcatacttcggatcacgcgtgcacagacccaggttgattggcataggcggactgttcttagccgcaggcgcctttattctgacccttccgcactttctgagcgaaccgtaccaatataccctcgcctccactgggaataactcccgacttcaggcagagttgtgtcagaaacactggcaggatctcccacccagtaagtgccacagcacaactcaaaatccccaaaaagagacctccagcatgtggggcctaatggttgttgcacaactgcttgctggcatagggacagtgcccatccagccgttcggcatctcatatgttgatgatttttccgagccctctaactcacccctctacatttcaatcctcttcgcgattagcgtgttcgggccggcatttgggtatcttctgggtagcgtaatgcttcagatttttgtggattacggccgtgtgaatacagccgccgtgaatcttgtcccgggcgacccaagatggatcggcgcctggtggctcgggctgcttatatcgtcagccttacttgtgctgacatctttccctttttttttcttcccacgagccatgcccatcggcgctaaacgtgcccccgccaccgccgacgaagcgcggaaactggaagaagccaagagtcgaggctctttggtcgacttcatcaaaagatttccctgcatatttctcaggctgctgatgaatagcctgttcgttctggtggtcctcgcacagtgtacattttcatcggtgattgccggactgagcacatttttgaacaagttcctggagaagcagtacggtacgagcgcagcctacgcgaactttctcattgcccaccaggttctgtatattaggtctctactcccagctgccggcactgcaagggcacaaattctctcctccactaggtctgtggagaccatggagtcctccacaagtccactcgccatgcctgcggcagcaaccagcacatag

SEQ ID NO: 135696 - DNA, 2133 bp, Artificial Sequence
  Description of Artificial Sequence: Synthetic coding sequence
atgcaaggcaaaaaaccgggagggtcttccggcggagggcggtctggagagttgcagggtgatgaagcccagagaaataagaaaaagaagaagaaggtgagctgtttttccaatattaagatcttcctggtgtcagagtgcgccctgatgctggcacaaggcaccgttggcgcctaccttgtatcggtcttgaccacactcgaaaggcgctttaatttgcagtcggcagatgtgggggttatagccagttcgttcgagattggcaatctcgcccttattctgtttgtctcatatttcggcgctcgtggtcacagaccacggttaataggctgtggaggaattgtgatggcgctgggcgcactcctatccgccctacccgaattccttactcaccaatacaaatacgaagcaggggagattcgctggggtgctgagggccgcgacgtttgtgcggccaacggttcaggaggcgatgagggacctgacccagatttgatttgcaggaaccgcacagccacgaatatgatgtacctgctgctgataggtgctcaggtgttgcttggcataggtgccacccctgtgcaaccattaggagtgagctacatcgatgaccacgtgcggcgcaaagactctagcctttatatcggaatattattcacgatgcttgtgtttggtcccgcctgtgggttcatccttggctctttttgcaccaagatatatgtcgacgcagtctttatagacacatctaacctggacattaccccggacgatccccgctggatcggggcttggtggggggggttcctgctctgcggagcattgctgttttttagcagcttattgatgttcggctttccccagagtctgccacctcacagcgagcctgccatggagagcgagcaagccatgctatcagagagggagtacgaacgcccgaaaccttctaacggggtactgcgtcacccattagagcccgacagctcagcctcctgtttccagcagctgagggtaatcccaaaggtgaccaagcacctgttatcaaatcctgtgttcacgtgtatcattttagctgcctgtatggagatcgcggtcgtcgcaggttttgccgcctttctcggtaagtacttagaacagcagtttaacctgaccacgtcttctgccaatcagctgctcggcatgacagcgataccctgtgcttgccttggtatctttttaggtggattgcttgttaaaaagctcagcctctccgctctgggcgcgatcagaatggcaatgctggtcaatctagtaagcactgcctgctatgtgagcttcctgtttttaggctgcgatactggcccagtcgccggggttacagttccttacggcaattctacagctcctggaagtgccctggatccctacagtccatgtaacaacaactgtgagtgccagaccgactcatttactcctgtgtgtggcgctgatggtataacatatctctcagcatgtttcgccgggtgtaattctacgaacctaacaggttgtgcctgtctgacaaccgtgccggcagaaaacgccacagtcgtgccaggcaaatgccccagccccggttgccaggaagccttcttgacctttctgtgcgtgatgtgtatctgcagtctcattggggctatggctcagacaccctcagtcattatcctgatcagaactgtatcgcccgagctaaagtcctatgcgttaggtgtgctcttcctgctcctccggctccttggtttcattcctcctccgctaatctttggggccgggattgattcaacctgtctcttctggagcacattttgtggagagcagggagcctgcgtcctctatgataacgtagtctatcggtatctgtacgtgtccatcgccatcgctctgaagtccttcgcctttatcttgtatacaacaacttggcagtgtcttaggaagaattataaacggtacatcaaaaaccatgaggggggactctctacatcagagttcttcgcaagcacacttaccctggacaatctgggcagagatccagtccccgctaatcagactcacagaactaaattcatctacaatcttgaagatcacgagtggtgtgaaaacatggagtcagtgttgtag

SEQ ID NO: 135697 - DNA, 1356 bp, Artificial Sequence
  Description of Artificial Sequence: Synthetic coding sequence
atgagggagatcgtgcacattcagatcggacagtgtggcaatcagattggtgccaagttctgggaaatgatcggggaagaacatggaattgacctcgctggtagcgacagaggagcttccgcactgcagctggaaaggatcagcgtatattataacgaggcttatggtcgaaagtatgtgccgcgcgccgtcttagtcgacttggaaccaggaaccatggatagtataaggagcagcaagttgggagctctctttcaaccggatagttttgtccacggcaactccggggctgggaataactgggccaagggccactataccgagggggctgaattgatcgagaatgttttagaagttgtcaggcatgagagcgagtcctgcgactgcctgcagggtttccagattgtgcatagcctaggcgggggcaccggaagcggaatgggcaccctcctgatgaacaaaatccgagaagaatatcccgatcgcatcatgaacagtttctctgtaatgccctcaccaaaagtttctgatacagtggtcgagccttataacgccgttctttctatccaccaattaatcgagaatgctgacgcatgtttttgcatcgacaacgaggcactttacgacatctgcttcagaaccctgaaactgaccacccccacttatggcgacctgaatcacttagttagtcttacgatgagtggcattacaaccagcctgaggtttccagggcagctgaacgcagatctccggaagctggccgtcaacatggtaccctttcccaggctgcactttttcatgccagggttcgccccattaactgcccagggttctcaacagtaccgggctctgtccgtcgccgaacttacacagcagatgtttgatgcaagaaataccatggcagcctgtgatctcaggagaggccgctatctcacagtggcgtgtatcttccgtggtaagatgtcaacaaaagaggtagaccagcagttgctgtcagtgcagactcgaaacagctcttgcttcgtggagtggattcctaacaacgtgaaggttgccgtctgcgatatcccaccacgcggcctgagcatggccgccacatttatcgggaacaataccgcaatacaagagatctttaaccgagtctcagagcacttttccgctatgttcaaaaggaaggccttcgttcactggtacacttccgagggaatggatataaacgagttcggagaggctgaaaacaatatccatgatctagtgagtgagtaccaacagttccaggatgcaaaagctgtgctggaggaggatgaagaagtgaccgaagaggcagaaatggaaccagaagataaaggccactag

SEQ ID NO: 135698 - DNA, 1749 bp, Artificial Sequence
  Description of Artificial Sequence: Synthetic coding sequence
atgcctttgcatcagctgggggacaaacccctaaccttcccctcacctaactctgccatggaaaatggactggatcatactcctcccagccgccgggcctcccctggaacccccctatcccccggaagcctgcggtcagcagctcacagccccttagatacaagtaaacagcccctctgccaactgtgggcagaaaaacatggggccagaggcacacatgaggttaggtatgtgtccgccggacaatcagtggcgtgtgggtggtgggcgtttgccccaccttgcctgcaggtgttaaacactcccaaggggatcctgttcttcctctgcgcagctgcgtttctgcaaggcatgaccgtaaatggcttcatcaacactgtgataacctccctggagagaagatacgatttacattcttatcagtccggactgatcgccagttcttatgatatagcggcttgtctatgtttgacctttgtttcctacttcggcgggagtggtcacaaaccaagatggcttggttggggggtgctgctcatgggtaccggaagcctagtgttcgctttgccacactttaccgcaggaaggtacgaggtggagctggatgccggggtgagaacttgccccgccaatcccggagccgtctgcgctgacagcacctctggattgtccagataccaattagtgttcatgttgggccaatttctccatggagtgggagcaacaccactttacacgctcggagttacctatttggggatgtctactttctcccccaaatttttagaaagtcagttcagtctgtcagctagtgaagccgccaccctattcgggtatctcgttgtacccgccgggggcgggggaacttttctaggcggcttcttcgtcaataaattgaggctcagaggctccgcagtgatcaagttttgcctgttttgcaccgttgtctcgctgctgggcattctggtgttctctctccactgccccagtgtgccaatggctggggttactgcctcctacgggggaagcctgttgcctgagggacacctcaatctgacagcgccctgcaatgctgcgtgctcctgccaaccagagcactactctcccgtgtgcggctcagatgggttaatgtatttcagtctatgtcatgctggatgccctgcagccaccgagactaacgtcgatggacagaaagtctacagagactgttcttgcatcccccagaatttatcctccggatttggccatgcgaccgctggcaagtgtacatccacgtgtcaacggaaaccattactccttgtgttcatatttgttgtcatattcttcaccttcctgagtagtatcccagcccttaccgctaccctgcgctgcgtacgagaccctcaaaggagttttgccctcggcatccagtggatagtcgtgagaattctgggtgggatcccgggtcccatcgcgtttggctgggtgatcgataaagcctgcttgctgtggcaggatcagtgtgggcaacagggtagctgcctggtttaccagaacagcgccatgtccagatacattttgatcatgggtctcttgtacaaggttcttggcgtgctgtttttcgccatcgcctcaagcagggctgcttccgatcaccgccctcggccgcctggacacggtggccatagcgcctttccagacgatcgtaccgttccactaggggatgcgatcactagagagctgctctttgacctccagcctagcacctag

SEQ ID NO: 135699 - DNA, 2169 bp, Artificial Sequence
  Description of Artificial Sequence: Synthetic coding sequence
atgccacttcaccagctgggggataaaccactcacttttccaagccccaactcagccatggagaatggactggatcacactcccccctctcgcagagcgagcccaggaacaccactgtccccaggctctttacgcagcgccgctcactctcccctggacaccagtaaacaacctttgtgtcagttgtgggccgaaaagcatggcgcccggggcacacatgaggtgaggtatgtctcagcaggccagagcgtcgcttgcggatggtgggctttcgctcccccctgtctacaggtgctgaacacgccaaagggcatcttgtttttcctgtgtgcggctgctttcctgcagggcatgactgtcaacggctttataaataccgtgatcacttcgcttgagcgtaggtacgatcttcactcctaccaatctggcctcattgcgtcgagctacgacatagccgcttgcctgtgcctgactttcgtgtcttacttcggaggtagcgggcataaacctaggtggttgggatggggcgtcctgctgatgggcaccgggtcattggtcttcgcactgccccacttcaccgccgggagatacgaggtggaactcgatgccggcgtgcgcacgtgtcctgcgaacccaggagccgtatgtgctgatagcacaagcgggttgtctcgataccagcttgtatttatgctggggcagtttctgcacggcgtcggggccacaccactgtacaccttgggtgtgacatatctggatgaaaatgtcaagtcatcttgtagtcccgtctacatcgcgattttttataccgcagcaattctgggccctgctgcgggctatctgatcggcggtgcactgctgaacatctacaccgaaatgggccgccgcactgagctcaccaccgagtctcccttgtgggtcggcgcttggtgggttggctttttgggctccggcgcagcagccttctttacagctgttcccatccttggctatccgagacagctccctggcagccagcgctacgccgtgatgcgggctgctgagatgcaccagcttaaggatagcagtagaggtgaagccagcaacccggacttcggcaaaaccatccgtgatctgccattgtccatctggcttctgctgaagaaccctacattcattctgctctgtctcgctggcgccaccgaagctactcttattacaggcatgtctactttctctccaaagttcctggaatctcaattctctctctcagctagcgaagccgctactctctttggctatctggtcgtccccgcgggtgggggggggacttttctcggcggctttttcgtaaataaactgcgcctgcgggggagcgctgttattaagttctgccttttctgcaccgtcgtttccctgctaggcatcctggtgttctcccttcattgcccatctgttcctatggcaggtgttactgcgagttatggcgggagcctgctacccgagggtcaccttaacctgacagcaccctgtaacgcagcatgcagctgccagcctgagcattactcccctgtctgcgggagtgacggactgatgtacttctccctgtgtcacgctggttgtccagccgcaacagaaacaaacgtggacggtcagaaggtctatcgcgactgcagttgtatcccgcagaatctgtcaagtgggttcggacatgccacagcaggcaaatgcaccagcacctgccagaggaaacctctgttgctcgtgttcatatttgtggtaatcttctttacctttctaagctcgatccccgccctgactgcgaccttgcggtgcgtgcgggatcctcagaggtcttttgcactcggaatacaatggattgtggtgcgcattctgggcggaattcccgggcccatagcatttggttgggtaatcgacaaagcctgtctcctgtggcaggatcaatgtgggcagcagggttcctgtctcgtgtaccagaattccgctatgtccagatacattctaatcatgggattgctctacaaggtcctgggcgttctgtttttcgcaatagcgtgcttcttgtacaaaccactctcagaaagctccgacggactggaaacatgcctaccaagtcagtcttccgcacctgatagtgcaactgattcacagttacaaagttctgtttag

SEQ ID NO: 135700 - DNA, 2169 bp, Artificial Sequence
  Description of Artificial Sequence: Synthetic coding sequence
atgcctctgcaccagctgggcgataaaccactcactttccccagcccaaattctgctatggaaaatggcttggaccacacacctccatcccgtcgcgcctcccccggtacacctttgagccctggaagtttgagatcagccgcccactctcccctggatacttctaagcaaccactgtgccagctgtgggcagagaagcacggtgctcggggaacccatgaggtcagatacgttagtgccggccagagcgtggcgtgtggctggtgggcctttgctcctccgtgccttcaggtgctaaatacaccaaaggggattctctttttcctgtgtgctgccgcttttcttcaaggaatgacagttaacggtttcataaatacagtgatcacttccctagagaggcgctatgacctgcactcatatcaatccggtcttattgctagttcctacgacatcgcagcgtgtttgtgcctgaccttcgtcagttacttcggcggcagtggacacaaaccaaggtggttaggatggggagtgctcttaatgggcaccggttctctcgtcttcgctctgccgcatttcacggctggcagatatgaagtggaattagatgctggggtgcgcacctgtccagctaaccctggggccgtgtgtgccgacagtacaagcgggctctcgcggtaccaattggtttttatgctgggccagttcctccatggggtgggggctaccccgttgtacactttgggggtgacatacctggacgagaacgtgaagagctcttgctcccctgtgtatattgcgatcttttacaccgccgccatcctggggcccgcagctgggtaccttatcggaggagcccttttaaacatttacacagagatgggccgaaggacagagctgacgacagagtctcctctctgggtaggagcgtggtgggtcggtttcttaggatctggggcggctgccttttttaccgccgtacctattctcggatacccaaggcagctaccagggagtcagcggtacgccgtgatgagggctgctgagatgcatcagctaaaagactcatctagaggagaagctagcaatccggattttggtaaaacaatccgcgatttgccactctccatttggctgctcctaaaaaaccctacttttatcctgttgtgtctggcgggagccacggaggcaaccctgatcacaggcatgagtaccttctcgcccaagttcttagaatcccagttttcattgtccgcttctgaagccgctacactcttcggctaccttgtggtacctgccggtggtgggggaaccttccttggcggcttcttcgtaaacaagcttagattgagaggttcagccgtgatcaagttctgtctattttgcacggtggttagcttactcggaattttggttttcagtctccactgtccttccgtgccgatggcaggggtcactgcttcgtacggtggctctctgctgcccgagggacacctaaatttaaccgccccttgcaacgcggcctgtagttgccagccggagcattactcccctgtatgtggttctgatgggctgatgtacttctcattatgtcatgccggatgtcctgccgcgaccgagactaatgtcgatggtcagaaagtgtaccgagattgtagctgtattccacaaaacctaagtagcggttttggccatgctactgcgggcaaatgcacgtccacgttcctgtacataccacaacagcattcttgtacaaatggtaactccacaaccggcgctcttcaggagacccccaggtccaagcgggcctgccgatgtgtgcgggatccacaacgctctttcgccctagggatacagtggatcgtggtgagaatactcggtggaatccctggccctatcgcttttgggtgggtgatcgacaaagcatgtcttttgtggcaagatcagtgtggccagcaaggttcgtgtctcgtgtaccagaacagtgccatgtctaggtacattctcattatggggctgctctataaggtgctgggagtgttgttttttgctattgcttgtttcctctataagcccctctcagaatcctctgacggactcgaaacgtgcttgccaagtcaatctagtgcgccggatagtgccactgactcccagctgcagtcttcagtgtag

SEQ ID NO: 135701 - DNA, 456 bp, Artificial Sequence
  Description of Artificial Sequence: Synthetic coding sequence
actacagctctctgtgccgcaaggacagcgagctgtacctcccattgtgccacacagggggctctgcaacccagaagacggatgtggaccgctcgtcgttgtgtgcgggatccacagcggtctttcgctctcggtatccagtggattgtggtgcgaattctgggaggcattccaggccctattgccttcggctgggtcatcgataaagcttgcttgctttggcaagatcaatgtgggcagcaggggagctgcctggtatatcagaatagtgccatgagtcgttatatccttatcatgggtctgctgtataaggtgctgggtgtgctgttctttgctattgcatgtttcctgtataagccgcttagtgagtcttccgatggcctggagacctgtctgccctctcagtcctcggctccagactccgcgacggattcgcagttacagtccagcgtgtag

SEQ ID NO: 135702 - DNA, 1863 bp, Artificial Sequence
  Description of Artificial Sequence: Synthetic coding sequence
atgcctcttcatcaactgggggacaagcccctcacatttccatcgcctaatagtgctatggagaatggactagaccacacacccccaagccggcgcgctagtcccggaactcccctgtctcccggatccctgcggtccgccgctcattctccgttagatacatccaaacagcccctatgccagttatgggccgaaaagcatggcgcccggggaacccacgaagtgagatacgtgtcagccggtcaatccgtcgcctgtgggtggtgggcgtttgcccctccttgccttcaggtgcttaacacccccaagggaatcttattctttctctgcgctgctgccttcctgcagggtatgacagtgaacggatttattaatacagtgattacatccctcgagcgacgatatgatctgcacagctaccagagcggcttaattgcgtctagttacgacattgcagcatgcctgtgccttacttttgttagttatttcggaggttctgggcacaagccccgttggttgggatggggggttcttctcatgggtaccgggagtcttgtttttgctctaccccacttcaccgccggtcggtacgaagtcgaactagacgccggggtccgcacgtgtcccgctaacccgggtgcggtttgcgccgactccactagcggactttctagatatcagctggtgttcatgttggggcaattcctgcacggcgtgggcgcaacccctttgtatacactgggtgtgacctacctggacgagaacgtgaagtcctcctgctcccctgtgtatattgccatattctatactgccgcaattctgggccctgctgctggatatcttatcggaggggccctgctcaacatctacacggagatgggccgaagaacagagctgaccacagaaagccctctgtgggtcggggcctggtgggtcgggttcctggggtctggtgccgcggctttcttcacagcagttcccatcctgggctatcctcgccagctgcctggtagtcaacgctacgccgttatgcgggctgcagaaatgcatcaactgaaggattcttcccgcggagaggcttcgaatcccgattttggcaaaactatcagggacctccctttgagcatctggcttttgctgaagaatccaactttcattcttttgtgcctagccggggcaacagaggcaacactcattaccggtatgtcgacattcagcccaaagttcttggagtcccagttttccctctccgcctcagaggcagctacgctttttggataccttgtcgtgccagcgggaggcgggggaaccttcttggggggcttttttgttaataagttgaggctgcggggcagcgccgtcattaagttctgtctgttttgtaccgtggtgtcactacttggaattctggtgttctctctgcattgccccagcgtcccaatggctggcgtgactgcatcttacgggggatctctcttaccagaaggccatctaaatctcacagcaccatgtaacgcagcttgcagctgtcagccagaacattattcgcctgtttgtggatcggacgggctgatgtacttcagcctatgccacgcaggctgccctgcggctacagagaccaatgtcgacggacagaaggtatccggggccgcagcctacaggccttgccctcccctcgatcctggcaaagggcctccttgcctgccgctggtgattggagcgatcgtagggctcccacgatgtaccgaaacagtggccgtgagcctgcgcatcttccccctggttctggccatgcctctccaggggaatgcgcttcagctggtacgggagagcccttccttttggtttagctatagcctgtag

SEQ ID NO: 135703 - DNA, 2160 bp, Artificial Sequence
  Description of Artificial Sequence: Synthetic coding sequence
atgttcgttggggtggccaggcactccggaagccaggacgaggtgtccagaggggtcgagcccctggaggccgcgcgcgcgcagccagctaaagatcgcagggccaaagggacacctaaaagttcaaagcccggaaagaagcatcggtaccttaggctcttgcccgaagcccttatacggtttggcgggtttagaaaacgtaagaaggcgaagagttcagtgagcaagaagccaggggaggttgatgacagcctcgagcaaccttgtggtctcggatgtttagtatcaacgtgttgcgaatgctgcaataacattcgctgtttcatgatcttctattgcatcctcctcatttgtcagggtgtagtattcggcctgatcgatgtttccattggggatttccagaaagagtaccagctcaagaccatcgaaaagttagccctcgagaagagctacgacattagcagcggcctggtagccatcttcattgctttctacggcgacagaaaaaaggtcatctggttcgtggcctctagcttcttaattgggctcgggtctctcttgtgcgcttttccctcaattaacgaggagaacaaacagagtaaggtgggcattgaggacatctgcgaagaaattaaagttgtaagcggctgtcagtccagtggaatctctttccagagtaagtacctgtcctttttcatcctcggtcagacggtgcagggaatcgctggtatgccattatacatcctagggattacattcattgacgagaatgtggctacccactccgcaggcatttatctgggcatcgctgaatgtacgtctatgataggctatgccctgggatacgtgctgggtgccccactcgtgaaagtccctgagaacactacttcagccaccaataccacagtgaataatggtagccccgagtggctgtggacttggtggattaactttctgttcgctgcagtggtggcctggtgcaccctcattccactgagctgcttcccaaacaacatgcctggatctacaagaatcaaggcccgcaaaaggaagcagttgcatttcttcgattcgagactaaaggacctgaaactgggcacaaatataaaggacctttgcgccgccctctggatcctcatgaagaaccccgtactgatttgtttggccttatccaaggctacagaatacttggtgatcatcggggcatccgaattcctgccaatttacctggagaaccaattcatccttacaccgacagtggcaaccacgttggcaggtttggtcttgatcccaggcggcgccctcggccagttattgggcggggtgattgtgtctactttagaaatgtcttgtaaagcgctgatgagattcatcatggtgacatccgtgattagccttatcctgctcgtctttatcatcttcgtcagatgtaacccggtgcagtttgccggcattaacgaagattacgatggtacgggaaagttaggaaatttgactgcgccctgtaatgagaagtgccgctgcagctcatcaatctactcatctatttgcgggcgcgacgacatagagtacttcagtccttgtttcgcaggttgcacatactctaaggcccaaaaccaaaaaaagatgtactacaactgttcgtgtattaaagaggggctcattacagcggatgccgaaggggactttattgacgctcgccccggaaagtgcgatgccaaatgctacaaattaccccttttcattgctttcattttttccaccctgatattcagtggattttctggcgtgcctattgtgttggcgatgacccgtgttgtgccagacaaacttcggtccctggcacttggagtgtcctatgtcatcctgcgcattttcggaacgattccaggaccgagtatttttaagatgagcggggagacgtcctgtattcttcgagatgttaataagtgtggacacaccggacgctgttggatctataacaagaccaaaatggccttcttgctggtcgggatatgttttctgtgcaaactgtgcacgattattttcaccactatcgcattctttatttataaaaggaggcttaacgagaatacggactttcctgatgtcaccgtcaagaatcctaaagtcaaaaaaaaggaggaaacagatttatag

SEQ ID NO: 135704 - DNA, 1401 bp, Artificial Sequence
  Description of Artificial Sequence: Synthetic coding sequence
atgtttgttggcgttgccagacacagcggctctcaggacgaagtgtctcgtggagtggagcctctggaagcagctagagctcagcctgcgaaagaccgacgtgcaaagggaacccctaagagttctaagcccggcaagaagcaccggtatttgcgcctgttgcccgaagctctgatcaggttcggcggatttcgcaagaggaaaaaagccaagagtagcgtctccaaaaagcctggagaggttgatgattcactggaacaaccatgtgggctgggttgtctagtcagcacttgctgcgagtgctgtaacaatatacggtgcttcatgattttttattgtatcctcctgatttgccagggagtggtctttggcctcattgatgtatccatcggcgacttccagaaggaataccagctgaagaccatcgaaaagctggcacttgaaaagtcatatgatatcagttctggcctggtcgccatcttcatcgctttttatggtgaccgcaagaaggtgatctggtttgtggccagtagttttctgatcggcctggggtcactactttgcgccttcccctcaattaatgaagaaaacaagcaatccaaggttggaattgaaggtatagccgagtgtactagcatgatcggctacgctctcgggtacgtgctcggagccccattggtgaaagtgcccgagaacaccacatcagctaccaaaaccggtaagctcgggaatctgactgccccctgcaacgagaagtgtcgctgttccagttccatttactctagtatctgtggacgagatgatatcgaatacttttctccgtgcttcgcaggatgtacatactccaaagcgcaaaaccagaaaaagatgtactacaattgctcctgtatcaaggaagggctgattacagcagacgccgagggtgatttcatcgatgccaggcctggaaaatgcgatgcaaagtgttacaagttgcctctatttattgctttcatatttagcactctgatatttagcgggttcagtggagttcccattgtgctcgccatgacacgggttgttcctgacaagctgaggtccctcgcacttggcgtgagctatgttatcctccgcatcttcgggactataccaggcccgtccatctttaagatgtccggcgagacaagctgcatcctgagagacgtgaacaagtgtggacatacaggcagatgctggatttataacaaaaccaagatggcgtttctgctggttgggatctgctttttatgtaagctgtgcacaatcatttttacgactatagcattcttcatttacaaacgaaggttaaacgagaacacagacttccccgatgtcactgtgaaaaatcctaaggtgaaaaaaaaagaagaaacggacctgtag

SEQ ID NO: 135705 - DNA, 1974 bp, Artificial Sequence
  Description of Artificial Sequence: Synthetic coding sequence
atgttcgttggggtggcaaggcacagtggcagccaagatgaggtcagtcgcggtgtggaaccacttgaggccgcccgcgcgcagcctgctaaagacagacgggccaaaggaactcccaaatcctcaaaacccggaaagaaacacaggtacctacggttattacccgaggctcttatccggttcggtggattcagaaagcgaaaaaaggctaaatcaagtgtaagtaagaagcctggggaggtcgatgatagcttagaacagccatgcgggctgggttgtctggtgtctacatgctgtgagtgttgtaataatatccggtgttttatgatattttattgtatactcctgatatgtcagggcgtggtgttcgggttgatcgatgtctcaattggggacttccaaaaagagtatcagctgaaaactattgagaagctagcgctggaaaaatcttacgatatctcttccggtttagtcgcaatctttatcgccttctatggcgataggaaaaaagtgatctggttcgttgcgtctagttttctgatcggtctgggtagtctgttgtgcgccttccctagtattaatgaggagaataaacagtcgaaagtagggattgagggcatcgcagaatgtacatcgatgatagggtacgcactggggtatgtcctgggggcacctctggtaaaagtacccgagaacactacttctgccacaaatactacagtgaacaacgggagtccagaatggttatggacctggtggattaattttctgtttgccgctgtcgttgcatggtgtacactgattccactgtcctgtttcccaaacaatatgcctggcagcacgcggattaaggctcgcaagcggaaacaattgcactttttcgatagtcgcttaaaagatctgaaactcgggacaaacataaaagacctttgtgccgcactgtggattctgatgaagaatcctgtactgatctgcctagctctgagcaaggcgactgagtatttagtgattatcggggcctcagagtttctcccaatctacctggaaaatcagttcattctgactccaactgtcgccacgactctggccggcctggtgttaatccctggcggcgctcttggccagctcctggggggcgttatagtgagcactctggagatgagctgtaaggcattgatgcgctttatcatggttacctctgttatctcattaatcctgctggtgttcataatcttcgtgaggtgcaaccctgttcagtttgctggtattaacgaggactatgatgggaccgggaagctggggaacctcactgctccctgcaacgagaagtgccggtgctcttcatccatctatagttccatctgtggacgtgatgacatcgagtacttctcaccctgctttgctggatgcacctactccaaagcacagaaccaaaagaagatgtactataattgttcctgcatcaaggaagggcttattactgctgacgccgagggcgactttattgacgcccggcctgggaagtgtgatgctaagtgttacaagctgccacttttcatcgccttcatcttctccacacttatcttttcagggttcagcggggtgcctattgttctagccatgactcgcgtggtgccagataagctacgctctctcgcccttggtgtaagttatgtaattctgcgaatcttcggcaccattccagggccttctatctttaaaatgtcaggtgaaacttcttgtattctgagggatgtgaacaagtgtggacacacaggccgctgttggatctacaataagacaaaaatggcctttctgttagtgggcatttgcttcttatgtaagttgtgcaccattattttcactacaatcgccttcttcatttacaagcggcgcctcaatgagaatacagactttccagatgtgactgtgaagaatccaaaggtgaagaaaaaagaagagaccgatctgtag

SEQ ID NO: 135706 - DNA, 2160 bp, Artificial Sequence
  Description of Artificial Sequence: Synthetic coding sequence
atgtttgtgggagtggctcggcactcggggtcccaagatgaagtttcacgcggtgtggagcctctggaggccgcccgagctcagcctgcgaaagatcgccgcgccaaggggaccccgaagtcctcaaagccaggaaagaaacatcggtacctgcgccttctgccggaagctctcatccgatttgggggattccggaagaggaaaaaagctaagtccagtgttagcaagaagcccggagaagttgacgactcactagaacaaccatgcggactgggttgccttgttagtacatgctgtgagtgttgtaacaatattaggtgttttatgattttttattgtatcctcctcatttgtcaaggagtggttttcggattaatagacgtgtcaattggtgatttccagaaagagtatcaacttaaaaccatcgaaaagctggccctggaaaaaagctatgatatcagctcgggactcgtggccatcttcattgctttctatggggatagaaaaaaagtgatatggttcgtcgcctcctcctttctcatcggcctgggtagcctgctctgtgcatttccttcgatcaacgaggaaaacaagcaatctaaagtcggcattgaggacatttgtgaagaaatcaaggtcgtcagcggatgtcagagctcaggaatctcttttcagagcaagtacctgtctttcttcatcctcgggcagactgtacagggcattgccggaatgcccctttatatcctgggaatcacattcatagatgaaaacgtggcaacacactcagcaggcatttatctcggcatcgcagagtgtaccagcatgattggttacgccttgggatatgtcttaggtgcacccttggtcaaggtgcccgagaacacgacatcagcaaccaatacaactgtgaacaacggttcgcccgagtggctctggacctggtggatcaactttctgttcgcagcggtagtggcatggtgcacattgattccactgtcctgcttcccaaataatatgcccggcagcacacgaatcaaggcaaggaaacgaaaacagcttcactttttcgatagccgcttgaaagatctgaagctggggaccaatattaaggacctttgtgccgctttgtggatcctgatgaagaaccccgtcctgatttgtttggcgctcagcaaggccactgagtatctagtcatcatcggtgcatcagaattcttgcccatttatctggaaaaccaattcattctcacacctaccgtggcgacaactctggctgggctcgtattgatcccgggcggggctctgggtcagctgctgggtggtgtgatcgtgagtaccctggaaatgagctgcaaagccctgatgaggtttatcatggtaactagcgtgatcagcctcatcctgctcgtgttcattatctttgtgcgatgcaatccagtgcaattcgccggcatcaatgaagactatgacggaacaggcaagctaggcaacctcacagctccgtgcaacgagaagtgccgttgttctagctcaatttatagcagtatttgcggccgcgacgacatcgagtatttctccccctgcttcgccggttgcacttatagcaaggcccaaaaccaaaaaaagatgtattacaattgttcttgcataaaggagggcctgatcacggccgatgccgagggagatttcattgacgcacgtcctggcaagtgcgacgcaaagtgttataaacttcctctgttcattgcattcatcttttctaccctgatcttctcagggtttagtggagttcctattgtcctggccatgaccagggtggttcctgacaagctccggtccttggctctgggggttagttacgtgattctcagaatctttggcacaatacctggcccttctattttcaaaatgtccggagaaacaagctgcatcctacgggacgtaaataaatgcggccacaccggacggtgctggatctataacaagacaaagatggcctttcttctcgtcgggatttgctttctttgtaaactttgtactataatctttactacaatagcattctttatctataagagaaggctgaacgagaatacagactttccagatgtgactgtcaaaaatcctaaggtgaagaagaaagaggagacagatctctag

SEQ ID NO: 135707 - DNA, 78 bp, Artificial Sequence
  Description of Artificial Sequence: Synthetic coding sequence
ctcaatgagaacacagattttcccgatgtcaccgttaaaaaccctaaggtgaagaagaaggaggagaccgatctttag

SEQ ID NO: 135708 - DNA, 1401 bp, Artificial Sequence
  Description of Artificial Sequence: Synthetic coding sequence
atgttcgtgggcgtggctaggcacagcggtagccaggacgaggtcagtcgaggcgtcgagcctctggaggcggctcgggcccaacccgctaaggatagacgggctaagggaactcctaaatcgtcaaaaccggggaaaaagcacaggtatctgagactgctgccggaggccttaattcggtttgggggatttagaaagagaaagaaggctaagagcagcgtgtctaagaaacctggtgaggtagatgattcgctggaacagccatgcggcctaggatgtcttgtgtccacctgctgcgaatgttgcaataacatacggtgcttcatgattttctactgtatcctgttgatctgccagggagtcgtgttcggcctgatagatgtgtcaatcggggacttccaaaaggagtaccagctgaagacaatcgagaagttagcactagagaagtcttacgacatctcctctggacttgtggcaatctttatcgcattttacggggatcgaaaaaaggtgatctggtttgtggctagctctttcctgatcggcctgggaagtttactgtgtgcttttccatcgatcaatgaggaaaacaaacagagcaaggtgggcatagaagggatcgccgagtgcacctccatgattggctatgctctcgggtatgttttaggagccccgctggttaaggtgcctgagaacacaaccagtgctaccaagacaggcaaattagggaatctgactgcaccttgtaatgaaaagtgccggtgtagttcttcaatctattcaagcatttgcggccgggatgacattgaatatttttctccatgctttgcaggatgcacttatagcaaggctcagaaccagaagaagatgtattacaattgctcttgtatcaaggaggggttaatcactgccgacgccgagggagattttatcgatgcgaggccgggcaaatgcgacgccaagtgttataagctgccactgttcatcgccttcattttctcaactttaatcttttccggtttttctggtgtacccattgtcctggccatgaccagggtagtccccgacaaactaaggtctttagctctgggcgtgtcctatgtcatcctcaggatctttgggacgatccccggtccgtccatcttcaagatgtcaggagagacttcgtgcatcttgcgggatgtgaataaatgcggccacaccggaagatgttggatttataataagacaaagatggcattcctgctagtcgggatctgttttctatgcaagctctgtacgatcattttcacaactatcgccttctttatctataagaggcggttgaatgaaaatacagattttcccgacgtaaccgttaaaaatcctaaggtcaaaaagaaggaagaaaccgatctctag

SEQ ID NO: 135709 - DNA, 351 bp, Artificial Sequence
  Description of Artificial Sequence: Synthetic coding sequence
atgctaagctgtcgccttcagtgcgcattggccgcactgtcaattgtgttggccctgggctgcgtgaccggcgcaccgagcgatcctagattgagacaattcctccagaagtctcttgccgctgctgccggcaaacaggagctcgccaaatactttctggctgagcttctcagtgaaccgaatcagacagaaaacgatgccctagaacctgaagacctgtctcaggcagctgagcaagatgagatgcgactggagctgcaacgtagcgccaactccaatcccgccatggcaccacgcgaaagaaaggctgggtgtaagaattttttttggaaaaccttcacgtcctgctag

SEQ ID NO: 135710 - DNA, 1176 bp, Artificial Sequence
  Description of Artificial Sequence: Synthetic coding sequence
atgttccccaacggcaccgcgagcagcccttccagcagcccttctcccagcccgggctcatgcggcgagggtggaggcagtaggggccctggcgcaggggctgcggacgggatggaagagcctggccgaaatgcttcacagaatgggaccctgtcagaagggcaggggtcagccatcctgatcagctttatttattcggttgtctgcctcgtggggctttgcggtaacagcatggtgatctacgtaatcttgaggtatgccaagatgaagaccgcgacaaacatctacatcttgaacctggcaatagcggatgaactgctgatgctgtccgttccatttttggtcacatcaacacttcttagacactggccctttggcgccctcttgtgcagactggtgctcagtgtagatgccgtcaatatgtttacatcaatatactgcttgacggtgctgtccgttgaccgttacgtggcggtggtgcatcccatcaaggcagcaagatatagacggccgacagtggcaaaggtagtcaatctgggcgtgtgggtgttgagtctgctcgtgatcctgccgattgtagtgttcagcagaacagctgccaacagtgatggaaccgtcgcctgtaacatgctgatgcctgagccagcccaacgctggctcgtcggctttgtgctgtatacgtttcttatggggttcttactgccagtgggggctatttgcctgtgttacgtactgataatcgctaagatgcggatggtggccctcaaggccggatggcagcagagaaagaggtcagagagaaagataacgttaatggtcatgatggtggttatggtgttcgtcatctgttggatgcctttttacgtagtccagctagtcaacgtcttcgctgagcaggatgatgccaccgttagtcagctgtctgtaatattgggctatgccaattcttgcgccaaccccatcttgtacggatttctctctgataacttcaaacgctcatttcagagaattctgtgtctgtcttggatggataatgccgcagaggagccagtcgactattatgccactgccctgaagtcccgggcatacagcgtagaggatttccagccagagaatctggaaagcggcggagtctttaggaacggaacatgcacttcgcggattacgaccctgtag

SEQ ID NO: 135711 - DNA, 1257 bp, Artificial Sequence
  Description of Artificial Sequence: Synthetic coding sequence
atggatatgcttcatccctcaagtgtgtctactacctctgaaccagaaaatgctagtagtgcctggccacccgacgccacgcttggtaacgtttctgcgggcccctcccccgctgggctggccgtgtccggcgtccttatccccctggtgtacctggtcgtgtgtgtggttggtctgctgggcaattccctggtgatctatgtcgtcctgaggcacaccgcctcaccgagcgtgaccaatgtttacattttgaatttggctctggctgatgagctcttcatgctagggctgcctttcctggcagctcagaacgcacttagttactggcccttcgggtcacttatgtgccgcctcgtaatggctgttgacggcatcaaccaattcacatctattttctgcctgaccgttatgtcagtcgacagatacctggccgtggtgcaccctacaagatctgcccgctggcgcacggcccccgttgctcgcacagtatcagccgccgtgtgggtggccagcgccgtggtggttctgccagttgtcgtctttagcggtgtgccgcgcggaatgtccacatgccacatgcaatggcctgagccagcagccgcctggcgggcgggctttatcatttacactgccgcacttggattcttcggacctctgctggtcatttgtctgtgttacctgttgattgtggtcaaggtgagatccgccggaagacgggtttgggccccctcgtgtcagagacgccgaaggagcgagcgtcgtgtgacaagaatggtagtagcagttgttgccctgtttgtactgtgctggatgccattctatgtcctcaacatagtgaacgtcgtctgcccgctgccagaagaacccgcttttttcggactgtacttcctggtggtggcactcccatatgctaattcttgcgctaacccaatactttatggcttcctgtcgtaccgcttcaagcaggggtttagaagggttttgctgagaccttctaggcgcgtccgctcacaggagcctaccgtaggaccacccgaaaagacggaagaggaagatgaagaggaggaagacggtgaggagagccgggagggaggaaagggcaaggaaatgaatggacgcgttagccaaatcacccagccaggcaccagcggtcaagagaggccaccttccagagtggcatctaaggaacagcagttgttaccccaggaagcgagtactggtgagaaatcatcaacaatgaggatatcatatttgtag

SEQ ID NO: 135712 - DNA, 1257 bp, Artificial Sequence
  Description of Artificial Sequence: Synthetic coding sequence
atggatatgctccatccttctagtgtgtctacaacctctgagcccgagaacgccagtagcgcttggcctccagacgctacactcggaaacgtgagtgccggccccagcccagcagggctcgccgtgagtggggtacttatcccactggtttacctcgtagtgtgcgtcgtggggctgctaggaaacagtctggtgatctatgttgtgttgagacacaccgcttccccaagtgtgactaatgtgtacattctgaacctcgcactggccgacgaattgtttatgcttggattgccatttttagcagcgcaaaatgcactgagttattggccatttggctccctgatgtgccggctcgtgatggctgttgacggcatcaaccagtttacttccatcttttgcttgacggttatgtccgtggacaggtacctagcagtggtccaccctactcggagcgccagatggcggacggcccctgtcgcaaggactgtttctgcggctgtctgggtcgcttcggccgttgtcgtgctccccgtggtagtgtttagcggggtgcctaggggaatgtcgacgtgccacatgcaatggcccgagcctgctgcggcatggcgagcggggtttatcatttacacggcagcgctgggcttcttcggtccattgctagttatatgcctctgctatttgctgatcgtcgtgaaagtgcggagtgctggacgccgtgtgtgggccccatcttgtcagaggcgcaggcgctcggagcgtagggtaactcgtatggtggtggctgtggtcgctctgtttgtgctttgctggatgccattttacgtactaaatatcgtcaacgtggtctgccccttgcctgaggaacctgccttcttcgggctctatttcctggtcgtcgctttaccctacgctaattcatgcgccaaccccatcttgtatgggttcttatcctaccgctttaagcagggcttcaggagagtgctgctccgcccttcacgccgggtgagatcacaggaaccgacggtgggacctcccgaaaagacagaggaagaggatgaagaagaggaagacggagaggagtctagggaaggcggcaagggcaaagaaatgaacggcagggtgtcccagatcacccagcccggaacttccggacaggaaagacccccaagcagggtggctagcaaagagcagcagctgctcccccaagaagcgagcactggcgaaaaatcttccaccatgcgcatcagctacttgtag

SEQ ID NO: 135713 - DNA, 1167 bp, Artificial Sequence
  Description of Artificial Sequence: Synthetic coding sequence
atgtcagccccatccacactgccgcctggcggggaagagggactgggtactgcctggcccagtgccgcaaacgccagctccgcccccgcagaagcggaagaggctgtggccgggccaggcgacgctcgcgctgccgggatggttgctatacaatgtatatacgctctagtgtgtctggtgggccttgtggggaatgccctggtaatttttgttatcctcagatatgcaaaaatgaagaccgctactaatatttacctattgaatcttgctgtggccgatgagctgtttatgctctcagtcccctttgtggcatcaagtgccgccctgaggcactggcctttcggctcagttctctgtagggctgtcctctccgtggacggtctcaacatgttcacaagcgtcttttgcctcaccgtcctgtctgttgaccggtacgtagctgtagtgcatcctttgcgcgccgcaacctaccgacggccctccgtcgccaagttaattaacttaggtgtctggctggccagccttctggtcactctaccaatagctatcttcgccgatactcgccccgcccggggagggcaggcggtggcctgcaacctccagtggccccatcccgcctggagtgcagtgtttgtggtgtacaccttcctcctgggctttctgctacctgtgctggcaatcggcctgtgttacctgttgattgtcggcaagatgcgcgccgtggctcttagggcaggctggcagcaaagacgtcggagtgagaaaaaaattactcggctggttcttatggtggtcgtggttttcgtgctgtgctggatgcctttttacgtcgtacagctactgaatttatttgtgacaagtctggacgccactgtaaatcacgtttcactaattctgagttatgccaactcctgtgccaaccctattctgtacggattcctgagcgacaactttaggcgattttttcaaagggtgctctgtctcaggtgctgtcttcttgaaggtgccggcggggcagaagaggaacctctggattattacgcaaccgcattaaagtccaaggggggagctgggtgtatgtgtccacccctcccatgtcagcaggaagccttgcaaccagaacccgggcgcaaacggattccattgacgaggacgacgaccttttag

SEQ ID NO: 135714 - DNA, 1095 bp, Artificial Sequence
  Description of Artificial Sequence: Synthetic coding sequence
atggaacctctcttcccagcttcaacacctagctggaatgccagctcacccggggcggcaagtggagggggtgataacaggaccctcgtgggccccgctccaagcgcaggtgccagggccgtcctcgtgccagtcttatatttacttgtgtgcgcagccggcctgggaggtaatacactggtgatttacgtggttctacgcttcgccaaaatgaagaccgtgactaatatctacattcttaacctggctgtggcggatgtgctctacatgctcggtctccctttcctggccactcagaatgcagcctccttttggcctttcggcccagttctgtgtaggctggtcatgacgcttgacggtgtgaaccaatttaccagcgttttttgtctaacagtcatgtcagtggacagatatctggccgtcgtacaccccctttccagcgctcgctggagacgcccacgggtggctaagctggccagtgcagcggcctgggtgctgtcgctgtgcatgtcacttcctcttctagttttcgcggatgttcaggagggcggcacatgtaatgcctcttggccagaaccagtgggcctttggggtgcagtattcataatatatactgctgtcctgggcttctttgctcctctgttggtgatttgcctctgctacctcctgattgttgtgaaagtaagggcggccggagtgcgagtcggatgcgttaggcggcggtcagaacgtaaggtcaccagaatggtcctggtcgttgtgctggtgtttgcaggttgttggctgccctttttcactgtcaacatcgtcaatctggccgtggcattaccccaggaacccgctagcgccggcctctatttcttcgtggtaattttgtcctacgcaaattcttgtgcaaatccggtcctttacggctttttgtcagacaattttcggcaatcattccaaaaagttctatgtctccgcaagggatccggagccaaggacgccgatgcgacagagccgaggcccgatagaattcgccaacagcaggaggcgaccccaccggcacaccgtgcagctgccaatggtttgatgcagacctcgaagctctag

SEQ ID NO: 135715 - DNA, 1095 bp, Artificial Sequence
  Description of Artificial Sequence: Synthetic coding sequence
atggagccccttttcccagcctcaaccccatcgtggaacgctagttcacccggcgctgccagcggcgggggggacaatagaaccctggtgggccctgcaccttccgccggtgcccgagctgtcctggtacccgtgctctatctgctggtttgcgctgccggtcttgggggaaatacattggtcatatatgttgtgcttcggtttgccaagatgaagacagtgacaaacatctatattctcaatctggccgtggctgacgttctgtacatgctcgggcttccgttcttggccacccagaatgcagcctctttctggccattcgggcctgtgctctgcagattggtcatgaccttagatggggtgaaccagttcacctccgtgttttgtctgacggtgatgtctgtggatcgatacctggccgtggtacaccccctatcctcggccagatggcggcgcccccgggtggcaaaattagcctctgctgctgcttgggtgttgtctttgtgtatgagtctgccattgctggttttcgctgatgtacaggaagggggcacctgtaacgccagttggcctgagcccgttggcttatggggggctgtatttatcatttatactgccgtcctggggtttttcgcccctctgctggtcatatgcttatgctacctgcttatagtggtaaaagtgcgggccgccggcgtgagagtgggctgcgtcaggcgccgcagcgaaagaaaggtgaccaggatggtccttgtcgtcgttcttgtctttgctggatgctggctgccattttttactgttaatatagtaaatctggcagtcgcactccctcaggagccagcttccgccggattatacttctttgtcgtgatcttgtcttacgcgaattcttgtgccaaccctgtgctatatggcttcctcagtgacaattttcgacaatcatttcagaaggtgctttgcctgcgaaaagggtcaggcgctaaagatgctgatgcaaccgagccccgaccggatagaattcggcagcaacaggaggctaccccccccgcacatagagctgccgccaacgggcttatgcagacttcaaaactgtag

SEQ ID NO: 135716 - DNA, 822 bp, Artificial Sequence
  Description of Artificial Sequence: Synthetic coding sequence
atggagccattgtttcccgctagcacccccagctggaacgctagtagtccaggagccgcctctggtggcggcgacaaccgcacactagtcggacctgctccaagtgcgggagcccgtgcagtcttagtgcccgtgctttatttgctcgtgtgcgccgcaggactaggcggcaacacactggtcatctatgttgttttgcgattcgccaagatgaagactgttaccaacatctacatactgaatctggccgtggcagatgtactttacatgctcgggctgccattcctggccacccagaatgctgctagtttctggccgttcgggcccgtcctctgtaggctcgtaatgacccttgatggtgtcaaccagttcacctccgtgttttgtttaactgttatgagtgtggatcgttatctcgctgtggtgcaccccttgagcagtgcacgctggagacgaccaagagtggccaaactcgcgtccgctgcagcctgggtgctttccttgtgcatgtccctcccccttctcgtgtttgccgatgttcaggaggggggcacttgtaatgcctcctggcccgaaccagtgggtctctggggggctgtttttattatatatactgctgtgctggggttttttgccccactgttacgcggttcaggcagggccggggacgccaacggaaggccctgggagagtaggcggctgcctccgaggatagttttgccccccccaccccaaaccccagcttttcccggcgcacctggaccagagcgggggccccgggagccctgctgggggctttggggtacgttagcactcctctag

SEQ ID NO: 135717 - DNA, 6978 bp, Artificial Sequence
  Description of Artificial Sequence: Synthetic coding sequence
atggccaccaacatcgagcagatctttaggtcttttgtcgtgtccaaatttcgggagattcagcaggagctgtcatctggtaggaatgagggccagctgaatggcgaaacgaatacccccatcgaggggaatcaggctggcgacgctgcggctagcgcacgtagtcttcctaacgaagagattgtgcaaaagattgaggaggtactgagtggagtactggacactgaactgcgttacaaacccgacttgaaggaggggtccagaaagtctagatgcgtgtctgttcaaactgaccctaccgatgaaatccccaccaaaaaaagcaagaaacacaaaaagcataagaataagaagaagaaaaagaaaaaagaaaaggagaaaaaatataaacggcagcccgaggagtctgagtccaaaaccaaatcgcacgatgacgggaacattgatctggaatctgatagttttctgaaatttgactctgaaccaagtgctgtcgccctggagttgccaacaagagcctttgggccgagcgaaaccaatgaaagtcccgctgtagtgctggaaccccctgtcgtaagtatggaagtgtcagagccccatattctagaaactttaaaacctgcgacaaagaccgctgagctgtcagtggtgtctacctcagttatttccgaacagtcggaacagtctgtcgcggtcatgcccgaaccttccatgaccaagatcctcgattcattcgccgccgccccagtgccaaccacgacccttgtcctcaagtcaagcgagccggtggtgactatgtctgttgagtaccagatgaagtctgtcttgaagagcgttgagagcacttcacctgaacctagcaaaatcatgctcgttgagcctcccgtcgcgaaggtgctggagccaagtgagaccctggtcgtgtcaagtgaaacccctacggaggtttacccagagcccagcacatcgaccactatggacttccccgagtctagtgctattgaagctcttcgcttgcctgaacagcccgtggatgttccatccgagatcgccgatagctccatgacccgtccacaggaattaccagaactgcccaaaaccacagcgctggaattacaggaatcttcggtcgccagcgctatggagttacccggccccccagccacgtctatgccggaacttcagggcccaccagtgacacccgtcctcgagttgcctggtccatctgccacaccagttcccgagctccctggcccactgtctacgccagtccccgaactgccaggcccccccgcaaccgctgtccctgaattgcccgggccaagcgtgacacccgtgcctcaactctctcaggagctgccagggttgcccgcgccgagcatggggctggagccgccacaggaggtgcctgaaccaccagtgatggctcaggagctgcccggcctaccccttgttactgcagccgtggagctgcctgagcagccagccgtaaccgttgcaatggagctgaccgagcaaccagtaacaaccactgaactcgaacaaccggtaggcatgactacggtggagcatccgggccatccagaagtgactaccgccacaggcttactgggtcaacccgaagccacaatggtgctggaactgcccgggcaacctgtggccaccactgcactcgaactgccgggacaaccatctgtaactggtgtcccagagcttccaggactgccctctgctaccagagccctcgaactctccggacaaccagtggccaccggagcactcgaacttcctggaccactgatggcagcaggcgcgctggaatttagtggacaaagtggagccgccggcgccctggagcttttggggcagcccctcgcgaccggagtcctagagcttccgggccagccgggtgcccccgaactccccggccaacctgtggctacggtggcccttgaaatatccgtccaaagcgttgtcacaacatccgagctgagcaccatgaccgtgtcccagtccctggaagtgccgagtacgaccgcactcgagtcctacaataccgtcgcccaggagctacccacaaccctagtgggggagacgtcagtgactgttggagtcgacccattgatggcccctgagagtcatattcttgctagtaatacaatggaaacccatattctggcgagcaacactatggacagtcagatgcttgcttcgaacaccatggactcacagatgcttgcaagcaacactatggacagtcagatgcttgcttccagtactatggacagccagatgttggcaacttcctctatggacagtcagatgctggccactagttccatggatagtcagatgctggctaccagtacaatggactcccaaatgctggctaccagtagtatggacagccagatgctggccactagcagtatggactctcagatgttggccacctcaagtatggactctcaaatgctggctaccagctccatggattcccagatgctggccacatccacgatggactcccagatgctggccaccagtaccatggactcccagatgctcgcaacaagctccatggacagccagatgctggcaagcgggaccatggacagtcagatgctagctagtgggactatggatgcccaaatgctggcttcagggacaatggacgctcagatgctggcttctagtacccaggactcggccatgctaggctctaaaagtcccgatccctacaggctggcccaagacccttaccggctcgctcaagacccgtaccgccttggccacgacccatacagacttggtcacgacgcctacaggctgggacaggatccgtatagactgggacacgacccttaccgattgaccccagacccgtatcggatgtccccacgaccatatcgaatcgctccaaggagttatcggatagctcctcgtccctacaggctggcacctcgacctctgatgctggccagccgccgcagcatgatgatgagctatgcagccgagcgcagcatgatgagttcttatgaacgctcgatgatgtcctatgagcggtctatgatgagccccatggccgaacgctcgatgatgtctgcgtacgagaggtctatgatgtctgcatacgaacgcagcatgatgagtccaatggccgaacggtcaatgatgagcgcctatgaaagatccatgatgtcagcatacgagaggtcaatgatgtcgccaatggccgaccggagtatgatgtccatgggagccgacaggagtatgatgtcttcatatagtgccgctgacaggtcaatgatgtccagctatagcgctgcggaccgatctatgatgtcctcttataccgcagaccggtcaatgatgagcatggccgccgatagctacaccgattcctatactgacacctacactgaagcatacatggtgccccctctgccacccgaggagccacctacaatgccgcccctaccccccgaggaacccccaatgaccccgcctctgcctcctgaagagccccccgaaggacctgctctgccgactgagcagtctgccctgaccgcagagaacacttggccaaccgaggtccctagttcaccgtcagaggaatcagtgagccagcctgagccccccgtgtcccaatctgaaatctccgaaccatccgccgttcccactgactatagcgtatctgcctcggacccatccgtcctcgttagcgaagccgccgtgacagttccggaaccacctcctgaaccagagtcatcgataacgcttaccccagtggagagcgcagtggttgccgaggaacatgaggtggtccccgaacggcccgtgacatgcatggtgagtgagaccccagccatgagtgccgaaccaactgttttggcttctgaacctcctgttatgagtgagaccgcggagacatttgattccatgagagcaagtggacatgtggcttccgaggtgtccacgagcctgcttgttcccgccgtaactactccggtcctggccgaatccattttagaaccacccgccatggccgccccggaatcttccgctatggctgtattggagtctagtgccgttacagtcctcgagtccagtaccgtaacagttcttgagtcctctactgtgaccgtcttggaaccttcagtggtcacagtgcccgaaccacccgtggtggcagagcccgattatgtcaccattcccgtgccagtggtgagcgcattggagccgtcagtgcccgtacttgaacccgccgtctcagttctccaaccctctatgatagtttcagaaccgtcggtgtctgtgcaagaatctacagtgactgtctcggaaccagcagttacagtgtccgaacagacccaggtcatacccactgaggtggctattgaaagtacaccgatgattctcgagtcatctattatgagttcacacgtaatgaagggtattaatctgagttcaggggatcagaatcttgcacccgagatcggaatgcaagaaatcgcgctgcactccggcgaggaacctcacgcagaggaacacctaaaaggtgatttctatgagtccgagcatggtataaatattgatcttaatatcaacaatcatctcatagctaaggagatggagcacaacacagtttgtgctgccgggacctccccagttggcgagatcggggaggagaaaatattgccgaccagcgagaccaagcagcgaaccgtcctagacacttacccgggtgttagcgaggcagatgccggagagaccctgtctagcactgggccgtttgccctagaaccggacgccacagggacatccaaggggatcgaattcactacggcaagcacactcagccttgttaataagtacgacgttgatctctctttaactacccaggacaccgagcatgacatggtcataagcaccagtccctccggaggcagtgaggctgatatcgagggccccctgcccgcaaaagacatccacctggatctcccatccaataacaatctggtatccaaagacactgaggaacccctgcccgttaaggaatctgaccagaccctggcagctctcttgagccccaaggaatcttccgggggagagaaagaagttcccccgccacccaaggagacccttccggactctggttttagcgctaacatcgaagacataaatgaagccgacctcgtacgcccccttctgccaaaagacatggaacgcttgacaagtctgcgtgcagggatagagggcccactgcttgcgtcagacgtaggccgtgacagatccgcggcctctcctgtcgtctctagcatgcctgagcgggcctcagaatcgtcctccgaggagaaagatgattatgagatattcgtaaaggtgaaggacacacacgagaaaagcaagaaaaataaaaatcgagacaaaggggaaaaagagaagaagcgggacagcagccttcgcagtcgaagtaagaggtccaagtcctcagagcataagagtaggaagagaacatccgaatcaaggtctagagcccggaagcgatcaagcaaatcaaagtctcatcggtcccagacgcggtcccgctctcggtcccgcagaaggcgtcggagttctaggagccggagcaagtccagagggagaaggagcgtgtcaaaggaaaagcgaaagcggtcgcctaaacatcgctcaaagagccgcgaaagaaaacgcaagcgatcaagttcacgcgacaaccgaaaaacggtgagagcccgtagccggaccccctcaaggcgcagccgctcccacacaccgtcaagacggcggagaagcagatccgttggccgcaggaggtctttctctatatctccatccagacgtagtcgcactccatcccggcgcagccgcaccccatcccggagaagtcgcaccccgtccagacgttcccgcacaccttcacgcaggagccgcacaccatctagaaggtctaggactccttccaggcgtcgtcggagccgtagcgtcgtgcgtcgccgctctttttctatttctccagtgcgccttcggcggagtcgcacccctctgcgaagaaggttttctcggagcccaatcaggcggaagcgaagcaggtcaagcgaacgtggtagatccccaaagagactgaccgacctggacaaggcccagttgcttgagatcgcaaaagccaacgcagctgctatgtgcgccaaggccggggtgccattgcctccgaatctcaagccagcgcctccacctaccatcgaggaaaaggtggcaaagaaatcaggcggggctactatagaagagttaaccgaaaaatgtaagcagatcgcccagagcaaggaggacgacgatgtgatcgtgaacaagccacatgtgtcagacgaggaggaagaggaacctcccttctatcatcatcctttcaagttgtcagagccaaaacctatctttttcaatctgaatatcgcagctgccaagcccacaccccctaaatctcaggttacccttacgaaagagtttcctgtatccagcggcagtcagcacaggaaaaaggaagcggatagcgtgtatggcgagtgggtgcctgtggagaagaatggtgaggagaacaaggatgacgataacgtcttctcctctaacctgccctcagaacccgtggacatcagtactgccatgtctgagcgagccctggcgcagaagagattgtccgagaacgcctttgacttggaagccatgtctatgcttaacagagcccaagagaggatcgacgcctgggcccagctcaatagtattccgggccagtttaccgggtctactggagtgcaggtgttgacacaggagcagttagcaaatactggcgcccaggcttggattaagaaaggacagatcttggtagccgtcttcctcccacggtccgtcccagctgtcctctttactacactgcttttaccccgaccccgcatttcatcttag

SEQ ID NO: 135718 - DNA, 6912 bp, Artificial Sequence
  Description of Artificial Sequence: Synthetic coding sequence
atggcgacgaatatagagcagatatttaggagttttgtggtcagcaagttcagggaaatccaacaagagttgtcttctggacggaatgagggtcaactgaatggcgaaacaaacactcctatcgagggcaaccaggccggtgacgccgccgcgagtgctaggtccctgccaaacgaggaaatcgtccagaagatcgaggaggttctgtcgggcgtcctcgacactgagctgcgatacaaacctgacttgaaggagggttccagaaaatctcgctgtgtatccgtgcagaccgatccgaccgatgagatccccacgaagaaaagtaaaaagcataaaaaacacaaaaacaagaagaagaagaaaaaaaaggagaaagagaagaaatacaagcggcagccagaggagtcagagtccaagacgaaatcacacgacgacggcaacatcgatctcgagtccgactccttccttaagtttgatagcgagcctagcgctgtggctcttgaactccctacgagggccttcggcccttccgagaccaatgaaagcccggctgttgtgctggaacctccggtggtgtccatggaggtaagcgagcctcatattctggagactctgaaaccggcaactaagaccgctgagttgagtgtcgtgtcaacatcagtgatctcagaacaatcggaacaatccgtagctgttatgcctgagccttcaatgactaaaatcctggatagctttgcggctgcccctgtaccaacaaccaccctggtcctcaaatcctcagagcccgtagtcaccatgagcgtggagtatcagatgaagagcgtgctcaagtccgtagagtctaccagcccggagccctccaagattatgctcgtcgagccccctgttgccaaagtgctggagccttcagaaactttggtggtgtcctctgaaactccaacggaggtgtaccccgagccgagtacatctacaacaatggatttcccagaatcctctgccatcgaagccctgcgccttccagaacagcccgtggacgtcccaagtgagatcgctgattcttctatgaccagaccgcaggagctccctgaattgcccaagacaactgcattggaacttcaggagagctctgttgcctccgccatggagttaccaggacccccagccacctctatgcctgaactgcagggccctcccgtaactccggttctggaattgccgggcccctcagcaacaccggttcctgaactgccagggccactcagcacacctgtgcccgagctcccagggccacctgcgacagccgtaccagagctaccaggtccttcggtcactcctgtcccccagctttcacaggaattacctgggctgcccgcaccttccatgggactggaacccccacaggaagtacctgagccacctgtgatggcccaagagctgcctgggttgcctctcgttacagcagccgtggaactgcctgagcagcccgccgtaaccgtagcgatggagttgaccgaacagcctgtcacaaccacggagctggagcagcctgtcggtatgacaacagtcgaacatccgggacacccggaggttactaccgcaacggggctgctgggtcagccggaagccacaatggttctggaactccccggccagcccgtcgccacaactgccctcgagttgccaggccagcctagcgtaacaggcgttcccgagctgcctggactcccatctgctactagagccctggagctgagtggccagcctgtggccacgggtgccctcgagctgccagggccacttatggccgccggcgccctggaattcagtgggcagagcggggccgctggtgctctggagctattgggccagcccctcgccacgggtgtgttagagctccctggccagccaggggcccctgaactgccgggacagcccgtggcaacagtggcgctggaaatcagcgtgcagagtgtcgtgactacctcagagttatcaaccatgaccgtcagtcagtccctcgaagtcccgtcaacaacagctctagagagttacaatacagtggctcaagaactgcccacgaccctggttggtgaaaccagtgtgaccgtaggcgtggaccccctgatggcccctgaatcgcatattctagcgagcaatactatggagacccacatattggctagcaatactatggatagccaaatgctggcttctaatacgatggactcacagatgttggcctctaacactatggacagccagatgctagcaagctccacgatggactcacagatgctggcgacctcctccatggacagccagatgttggctacctcgtctatggactctcagatgcttgcaactagcaccatggatagtcagatgctcgctactagttctatggactcccagatgttggccaccagtagcatggactcccaaatgttggccacttcgtctatggactcacaaatgctcgctacaagttctatggattcccagatgctggcgacttctaccatggattcacagatgcttgcaacctctacaatggactcccagatgctagcgacaagcagtatggattcccaaatgctcgcatctggcactatggattcgcagatgctggcatcaggaacgatggacgcacagatgctggcctcaggcaccatggacgctcaaatgctagcctccagtacccaggattcggcaatgctgggttccaaatccccagacccttatcgtcttgcccaggatccttacagactcgcacaggatccatatcgacttgggcacgatccttatcgtctggggcatgacgcctaccgtctcggacaagacccgtaccgactggggcacgacccatatagattaactcctgatccatatcgaatgagtcctcgcccgtaccggattgcgccccgctcctatcgtattgccccaagaccctatagattggccccgcggccactgatgcttgctagccggcggagtatgatgatgagttacgccgccgaacgatccatgatgtcttcctacgagcgcagtatgatgtcttatgaacgcagcatgatgtctccgatggcggagaggagtatgatgtcggcctatgaacggagcatgatgagcgcctacgaacgtagcatgatgagccccatggctgagcgctccatgatgtcagcttacgagcggagcatgatgtctgcatacgagagatcaatgatgtcacccatggctgatcgctctatgatgagcatgggggcggacagaagcatgatgtctagctactccgcggccgacagatctatgatgtccagttactcagcagccgataggagtatgatgtcctcgtatacggccgatcgcagtatgatgagcatggctgctgactcttataccgactcatatactgacacgtataccgaagcctacatggttccccctttgccgcctgaagaaccacctacaatgccaccgcttccacccgaagaaccccctatgacccccccattgccacctgaggaacctccggaaggacccgcactcccaaccgagcagagcgcactaactgcggagaacacctggcccactgaagttcctagctcccctagcgaggaatcagttagccaacctgaacccccagtctcacagagcgagatctctgagccatccgccgtgccaacggactacagtgtgtccgcgtcagatccctctgtcctcgtgagtgaggctgcggtgaccgtccctgagccccctccagagcctgagagttccattaccctaactccagtggagtcagccgtggttgcagaggagcacgaagtcgtgcctgaacgccccgtgacatgcatggtttccgagacacccgcgatgagcgcggagcccacagtactggctagcgagcctcccgtgatgtctgaaacagctgaaacatttgatagtatgagagccagcggccacgtcgcctctgaagtgagcactagtcttttagtccctgccgtgacaactcctgttctcgctgagagtatcttggagcctcctgccatggcagctcccgagagttctgccatggcagtcctggaatcaagtgcagtgactgtgctggagtctagcaccgttaccgtgctggaatccagcaccgtaacagtgcttgagccgagcgttgttaccgtgccagaaccccccgtagtagccgagcctgattatgtcacaatcccagtgccggtcgtctccgctctcgagcctagtgtccctgtgttagaacctgctgtgagtgtactccagccatctatgatagtgtcagagccctctgtgtcagtgcaggagtccacagtcaccgtgtcagagccagctgtgaccgtatctgagcaaacccaggtaattcctactgaagttgcaatcgaaagtacacctatgatcttagagagtagcattatgtccagtcacgtcatgaaaggtatcaatctttctagcggtgaccaaaatttggctcccgaaataggaatgcaggagatagctctgcactccggtgaagaaccacacgcagaagaacatctcaagggggatttctacgagagtgagcacggaatcaatatcgatcttaacattaataatcacctgatagcgaaagaaatggagcacaacacagtatgtgccgcaggaactagcccagttggagagatcggtgaggaaaagattctccctacttccgagacaaaacagcgtactgttttggatacttatccaggggtgtcagaggccgatgccggggagactctctcctcgactggcccattcgcccttgagcctgatgcaaccggaacctccaagggaatcgagtttactacagcaagtaccctaagcctggtaaacaaatatgacgtggatttgtcccttaccacacaagatacagaacacgacatggtgattagcactagcccgtccgggggctccgaagctgacatcgaaggcccacttccagctaaggacatccatctggacctgccatccaataacaatttagtttcaaaagacactgaggaacctcttcctgttaaagagtcagatcagacccttgccgccttgctgtccccgaaagagtccagcgggggtgagaaggaggtgcccccgcccccaaaggagaccctgcccgatagcggctttagtgccaacatcgaagacatcaacgaggctgacttagttaggccactactccctaaggatatggagcgtctgacctcgctgcgggccggtatcgaaggacccctccttgctagcgatgtgggcagagacaggtctgccgctagtcccgtggtcagtagtatgcccgaacgggcctccgagagcagctcggaggagaaggatgactacgaaatctttgtaaaggtgaaagacacccatgaaaagagcaagaaaaacaaaaatagagataaaggcgaaaaggaaaaaaagcgggactcatcactcaggtctcgcagtaaacggtccaagagctcagaacacaagagcagaaaacgaaccagcgaatccagaagtcgcgcacggaagcgctctagcaaatcgaaatcccaccgatctcagacaagaagccgcagtcgatcaagaagaagacgcagatcaagccgctctagatccaaatcacggggccgccgtagtgtctcaaaggaaaagcgcaagagaagcccaaagcacagatcaaaatcacgcgaaaggaaacgaaagcggagttccagtagagataaccggaagactgtgagggctcggtcaagaacaccttctaggcgtagccggtcacacactcctagccgtcggaggaggtcccggtccgtgggccgtcgccgcagtttctccatctccccctcaaggcgcagcaggactccctctcggcggagccggacaccttcccgacggagccgcacgcctagtcggaggtccagaacaccttctcgaaggtccaggaccccaagcaggcggagccgcaccccaagtagaagacgtcgatcgcgctctgtggtccgaaggaggtcgttctcaatcagcccagttcggctgaggagatcccgcacaccactacggaggcggttcagccgttctcccattcggcgcaagaggagccgatcttccgagcgtggtcgctcccccaaacggcttacagacttggataaagcacagctacttgagatcgccaaggcaaatgcagccgcaatgtgtgcgaaagcaggggtaccgttaccacccaacctcaagccagcaccacctcccaccatcgaggagaaggtggctaagaagagtgggggggccacaattgaggaactgaccgaaaaatgtaagcaaattgcacagtccaaggaggacgacgatgtgatcgtcaataagcctcacgtgtcggatgaggaagaggaggaacctcccttttatcaccacccattcaaactgtcggaacctaagcctatcttctttaatttaaatatcgctgccgcaaaacctacaccaccaaagagtcaagttacactgacaaaggaatttcccgtgtcctcaggatcacagcataggaagaaagaggccgactctgtgtacggggagtgggtgcctgtagaaaaaaacggcgaggagaacaaagacgatgacaacgttttttcgtctaacctgcccagtgaggggcgtgtgaagcgacagggtcgtgtgcgcagacagatgaagcagccagccgccagccatctcactgtaacccgctgcaatagcctctgcgggactaagccgcagagtgaaaaacatcgcattgcggagaatagcgttataacatcgctacccaacatcgggccaagccttcatttgtgggaaggatctccaaggtacaactatctggcctccagattcgcctcgcgtctctactcatcccgcttctggtggtag

SEQ ID NO: 135719 - DNA, 7281 bp, Artificial Sequence
  Description of Artificial Sequence: Synthetic coding sequence
atggccacaaacatcgagcagatttttcgatcttttgttgtcagcaagtttagggaaatacagcaggaacttagttcaggtcggaatgaaggacagcttaacggagaaaccaacactccaatagaagggaaccaagctggcgacgcggccgccagcgctaggagcctgccaaatgaggagattgtgcagaagattgaggaggtgctgagtggagtgctggataccgagctcaggtacaagcccgacctgaaggagggaagtagaaagtcgcgctgcgtaagcgtgcagacagatcctactgacgagattcccactaaaaagagtaaaaagcacaagaagcataaaaacaaaaagaagaagaaaaaaaaggagaaggagaaaaagtataaacgccagcccgaggaatctgagtccaagactaagagccatgacgacgggaacatcgatctggagtccgattcctttcttaagttcgacagcgagcctagtgccgttgctttagaattgcccaccagggccttcgggccctccgaaaccaatgaatccccagcagtcgtgctggagccacccgtggttagcatggaggtgagtgaaccccatatactcgagacgctaaagcccgcgacaaaaacagccgaactgtcagtcgtcagtacttctgtgattagcgagcagtccgaacagagcgtagcagtcatgcctgagccatccatgacaaaaatactcgacagcttcgccgccgctcctgtaccaaccactaccctcgtgctgaagtcctccgagccagtagtgactatgtccgtagagtatcaaatgaaatcggtgctgaaatcagtggagagcaccagtcccgaaccatctaaaataatgctagtcgagccgccggttgccaaagtgctggaaccaagtgaaacactggttgtgagtagtgaaactcctactgaagtctaccccgagccttccactagcaccacgatggatttcccagagtctagtgcgatcgaagctttgcggttgccagaacagcctgtagacgtcccaagcgagatcgccgacagctcaatgacccggccacaggaacttcccgagctgcctaaaacaactgcgctggaactgcaggagagctctgtcgcttccgccatggaattgcccggcccccccgctacgtccatgcccgaactgcaaggacctcccgtgaccccggtgctggaactccctgggccgtccgctaccccagtgcccgaactacccggtccccttagcacccctgtccctgagctcccggggcctccggctactgccgtgccagagctgcccgggcccagcgtcacaccagtaccccaacttagccaggagctccccggcctccctgctccgagtatgggcctcgagccgccacaggaagtcccagaaccaccagtgatggcccaggagctgccaggactgccgctcgtgactgcagccgtagagttaccagaacagcctgcagtgacggtggccatggagctgaccgagcagcccgtcacaaccacagaattggaacagccggtcggaatgactacagtggagcaccccggtcacccagaggtaactactgctactggactgctggggcagcctgaggcaactatggtgctggagcttcctggccagcctgttgcaacaacagcgctggaactgcctggacaaccttctgttactggggtccccgagttaccaggactgccatctgccacccgagcgctggagctgtctggacagcccgtggccactggtgccctggaacttcctgggcccctcatggccgccggtgcactggaattcagcgggcagagtggagcggcaggcgccctggagttactcgggcagccattagctacaggtgtgctggagcttcccggacagcctggggcacctgaacttccagggcaacccgtggccacagtcgccctcgagattagcgtacagagcgttgtcactaccagcgagctgtctacgatgacagtaagccaatccctcgaagtgccctcaactaccgcgctggaaagctataatactgtggctcaagaattacccactactctggtgggggagacatctgttacagtcggtgtcgatccactgatggccccagaatcgcacatactggctagtaatacaatggagactcacattctggcgagcaatactatggattctcagatgttagcctcaaacacaatggactcacaaatgctggcatctaacaccatggatagccagatgcttgctagctcgacaatggatagccaaatgctggcaacatcttctatggacagtcagatgcttgccacatcttcaatggactcccagatgttagccaccagcacgatggactctcagatgctggccacaagctccatggattcacagatgctcgctacttctagcatggattctcaaatgttggcaaccagctcaatggactcgcagatgctagccacgagcagcatggactcgcagatgctggcaacctctactatggattctcagatgttggcaaccagtacaatggactctcagatgctggctacctcttctatggattcacagatgctggcctccgggactatggattctcagatgttagcttctggcacaatggatgcacaaatgctggccagcggaaccatggatgcacagatgctcgcttcctcaacccaggactcagccatgctaggcagtaagagccccgatccctacagattggcccaagatccctacaggttagcgcaagacccctataggctcggtcacgatccatacagactcggccacgacgcctatcgactcggccaggatccgtatcggcttgggcatgatccttaccggctcacacccgacccctaccgcatgagccctcgcccctacaggatcgcaccacgttcgtaccggatcgctcctagaccttacaggctcgcaccacgcccactgatgctggcgtccagaagaagtatgatgatgtcctatgctgccgagagatccatgatgtcaagttatgaacgtagcatgatgtcgtacgaaaggtctatgatgtcccccatggccgaacggagcatgatgtccgcctatgaacgctccatgatgagcgcttatgaaaggagcatgatgagcccaatggcggaacggtcaatgatgtctgcatatgagcgatccatgatgtccgcctatgagcggtcaatgatgagtcccatggctgacagatctatgatgtcaatgggagcagacagaagcatgatgtcatcttactcagccgccgaccgctccatgatgagctcgtacagtgctgccgatcggagtatgatgagttcttacaccgccgaccgaagtatgatgagcatggccgccgacagctatacagacagctatactgacacatacacagaagcttatatggtgcctccccttccacctgaagagccccccaccatgcctccacttcccccagaagagccccccatgacaccacctctgccacctgaagagccccctgagggcccggctttgcccactgagcaatcagcgctcactgccgagaatacttggcccaccgaggtgccatcaagtcctagcgaagaatctgtatctcagcctgagccaccagtatcacagagcgaaattagcgagccctccgctgttcccaccgattacagcgttagtgcctccgacccaagcgtattagtgtctgaagccgcagtgacggtacccgaacctcctcctgagcccgaatcatctattactctcactccagtcgaaagcgcagttgtcgcagaagaacacgaggtggtgcctgagagacccgtgacctgcatggtctcggagactccagcaatgagcgcagaacccaccgtgttggcttcagagccccctgtgatgtctgagactgccgagacctttgattcaatgagagcaagcggacacgtcgcgagcgaggtctccacttcccttctggtgcctgctgtgaccactcctgttttagccgaatcaatcctcgagcctccagctatggcagctcccgagtctagcgccatggctgtcctcgaaagctccgccgtaactgtgctggagagcagcaccgtgactgtgctcgagtcctctactgttacagtactggaaccttcagtagttacggttccagagccacctgtcgtggccgagcctgactacgtgactatcccggtgcctgttgtcagtgcgctggagccttctgtgcccgtcctggagcccgctgtgagcgttttgcagccatctatgatcgtcagcgagccaagtgtgagtgtgcaggagtctacagttacagtctcagagcccgccgtaaccgttagcgaacaaacccaggtgataccaacagaagtggccattgagagcacacccatgatcctggaatcctccatcatgtcttcacacgtcatgaaaggcatcaacctgagctctggcgatcaaaatctggctccagaaatcggcatgcaggagatagccctgcattcaggtgaagagccgcatgccgaggagcacttgaaaggcgatttctacgagtccgagcatggtattaacatcgacctcaatattaacaaccacctgattgcaaaggagatggaacacaacacggtttgcgcagctggcacctcacctgtgggcgaaatcggtgaagaaaaaattctccctacgagcgagaccaaacaacgaacagtgctagatacctatccaggagtgtcggaagccgacgccggtgagacattatcctcaacaggcccatttgcgctggagcctgatgctacaggaactagcaaagggatagagttcactactgccagcaccctgagcctggtaaacaaatatgacgtcgatctgtccctaactacccaggatacagaacatgacatggtcatatcaacctccccttcaggtggctctgaagccgatatcgaagggccgctgcccgctaaggatatccacttagacctgccgagtaacaacaatctggtgagcaaggacaccgaggagcctctgcccgtgaaggaatcagaccaaactctcgcggcgctcttgtcccctaaggaaagtagtggcggcgagaaagaggtgcctccacctcccaaggagacccttcccgatagtggcttcagcgctaatatagaggatatcaacgaggccgatctcgtcagaccattgctccctaaagatatggagaggcttacaagcctcagagctgggatcgaaggaccgctgctggcctctgacgtgggccgcgatagatctgccgcctcccctgtggtcagttcgatgccagagcgcgcctccgagagcagttcagaggaaaaggacgattacgaaatcttcgtcaaagtcaaagatacacacgagaagagtaaaaagaataaaaatcgcgataagggggagaaggagaagaaaagagatagctctctcagaagcaggtcaaaaagaagtaaatcaagcgagcataagagtcggaagcgtactagtgaatcaaggagtagggcacggaaacggagttcaaagagcaagtcgcatcgctcacaaacgagaagtcgcagccggtcccggcgtcgcaggagaagctcccggtccagaagtaagtcccgcggccggcgttcagtgtcaaaggaaaagagaaagaggagcccaaagcatcgcagtaaatctcgggaacgaaagaggaagcgctcttcctcccgcgataataggaagacagtccgggcgagatcccgcacgccaagccggcggagccgctcccacactcctagtcgccggcgccgaagccgttctgtcggccgacgcagatctttttcaatatcccccagtcgaagaagcaggaccccatcaagacgtagccgaacaccgtctcggagatccaggaccccttcaaggcgcagccgcactccaagccggagatcacggaccccctctcggaggagcagaaccccatctaggaggcgtaggtcacgaagcgtggtgagaagaaggagtttttccattagccccgtacggctgcgtcggtcccgaacccccctccggcgtcggttttctagaagccctatccgtaggaaaaggtctcggagtagcgagaggggacgctccccgaaaaggctcactgatcttgataaggctcagctgcttgagattgcgaaagcaaacgctgccgctatgtgtgccaaggcaggagttccgctgccaccaaaccttaagccagctcctcctccaaccattgaggagaaggttgccaagaaatcaggcggtgccaccatagaggaactgacagagaaatgcaaacagatcgcacagtccaaggaggatgatgatgtgattgtgaacaagccgcacgtgtcagacgaagaagaagaagagcccccattctaccaccatccatttaaactgagcgagccgaagccaatttttttcaacttaaatatcgctgcggcgaaacccaccccaccaaaatcacaggtcacactcacgaaggagtttccggtctcctccggctcccagcatagaaagaaagaagccgatagcgtgtatggggaatgggtgccggtggagaaaaacggtgaagaaaacaaggacgacgataatgtttttagctctaatctgccttctgagcccgtcgatattagcactgctatgagcgagcgcgctctggcacaaaagcgcctttctgaaaacgcttttgacctcgaggctatgagcatgttaaaccgcgctcaggagcgcatagacgcgtgggcacagctgaacagtatcccaggccagtttacaggatctacaggagtccaggtgctgactcaggaacagctggcgaataccggcgcccaggcttggatcaaaaaagatcagtttctgcgggctgcaccagtcacaggaggtatgggggctgtactcatgaggaaaatggggtggagggagggtgagggactcggtaagaacaaggaggggaataaagagccaattctggtagatttcaagaccgacaggaaagggttagttgccgtgggcgaaagagcacagaagcgctccggtaactttagcgccgctatgaaagatctttccggtaaacacccggtatcagccctgatggaaatctgtaacaagaggcgatggcaacctcccgagtttttgctagttcatgattctgggccagaccacagaaaacattttctctttcgtgtgctgcgcaatggcgcactgacgaggcctaactgcatgttttttctgaatcgctactag

SEQ ID NO: 135720 - DNA, 1584 bp, Artificial Sequence
  Description of Artificial Sequence: Synthetic coding sequence
atggcgccagagcggttgcgaagccgggctctttccgctttcaagctcaggggacttctccttcgcggtgaagctatcaaatatctgacagaggccctgcagagcatttccgaactggagttagaggataagctcgaaaaaataattaacgccgtcgagaaacagcctctgagtagcaacatgatagaaaggtcagtggtggaagctgccgttcaggagtgtagccagagcgtggacgaaacaattgagcacgtgtttaatattattggcgcttttgatattcctcgcttcgtctacaacagcgagcgcaagaagtttctgcccctgctcatgaccaaccaccccgcacccaatctgtttgggacaccccgagataaggctgagatgtttagggaacgctacaccatcttgcaccagcgtacccatcggcacgagctgttcactcctccagtgattggaagtcacccggacgaatcagggtctaagtttcagctaaaaacaatcgagactctgctcggctccacaaccaaaattggcgacgcaatcgtgctgggaatgattactcagttaaaggaaggaaaatttttcctggaggatcctacaggtaccgtgcaactcgatctctcaaaggcacagtttcatagcggactgtacacggaagcctgcttcgtgctagctgaaggatggttcgaagatcaagtctttcatgtgaatgcgttcggcttcccaccaactgagccaagttctactaccagagcatattatggcaacattaactttttcggagggccctcaaacacaagtgtgaaaaccagcgccaaactcaaacaactcgaagaggaaaacaaggacgctatgtttgtgtttctaagtgacgtgtggctggaccaggtggaggtgctcgagaaactgcggataatgtttgctggctatagccctgctcctcctacctgcttcatcctctgcggaaacttctcatcggccccatacgggaaaaaccaagtgcaagccctcaaggatagcctgaagacacttgctgatattatctgcgaataccctgatatacatcagagctccagatttgtgtttgtgcccggccctgaagaccctggcttcggttccattctgccaagacctcctctcgccgagagtattaccaacgagtttcggcagagggtgccattctcagtcttcacgaccaatccatgccggatccagtattgtacccaggaaatcaccgtgttccgcgaggatctggtgaataaaatgtgccgaaattgcgtgaggttcccctctagtaatctggcaatccccaatcactttgtcaagactatcctttcccagggccacctgacaccgctgcctctgtatgtgtgtcctgtctactgggcctacgattatgcacttcgggtctacccagttcctgacttgctggtaatcgcagataaatacgaccctttcacaacaacaaataccgagtgtctgtgcattaaccctggctcgttcccacgttctggtttctcctttaaagttttttatcctagcaataagactgtcgaggattcaaaactgcaggggttttag

SEQ ID NO: 135721 - DNA, 3900 bp, Artificial Sequence
  Description of Artificial Sequence: Synthetic coding sequence
atgcagcaggccccacagccctacgaatttttcagcgaagaaaattcacctaaatggagggggttgcttgtctctgcgttgcgcaaggtgcaggaacaggtgcacccgacactctctgcaaatgaagagtcactgtactatattgaagaactaattttccaactactcaataaactgtgtatggctcagccgcggactgtgcaggacgttgaagagagagttcagaagaccttcccgcaccctattgacaagtgggctattgccgatgcccagtctgcaatagagaagcgaaaacggaggaatccccttctcctccccgtcgataagatccacccaagcctcaaggaagtgctgggctacaaggtcgattatcatgtctccctctacattgtcgcagtgctcgagtatattagcgccgatatcctgaagcttgccggcaactacgtatttaacattcggcattatgagatttcccaacaggacataaaggttagtatgtgcgccgacaaagtgcttatggacatgttcgaccaggacgatatagggttggtgagcctgtgcgaagatgaacctagtagtagcggagagttgaactactacgacttagtgcgaaccgagatcgctgaggagcggcagtacctgagggaactgaatatgatcattaaagtatttcgtgaggcattcctgtccgaccgcaagttatttaagcccagtgacatagaaaagattttttctaatatcagcgacatccacgaactaactgtgaagctgcttggcctgatcgaagacacggtcgagatgaccgacgagtcctccccccaccctctcgccgggtcctgcttcgaggacttagcagaggagcaggcttttgatccttacgagacactgtcccaggatatcctctctcccgagttccacgagcatttcaacaaactgatggccagacctgcagtagctctacacttccagcaacttaaggcatgttctgaggaacaggaggatagagagtgtttgaatcaggcaatcacagccctgatgaacctccagggctcaatggaccggatttacaagcagtatagtccacggcgccgcccaggagaccccgtttgtccgttttactcccaccagctccgaagcaaacatctcgcgatcaagaaaatgaatgaaatccagaagaacatagacggatgggagggaaaggacatcggccagtgttgcaacgagtttatcatggaaggacccctcacccgaataggggctaagcacgaacgacacatcttcctctttgatggccttatgatctcgtgcaagcctaatcatggacaaactcggctgccggggtactcttccgccgaatatagactgaaggagaagtttgtgatgcgcaaaatacagatctgcgataaggaggacacctgtgaacataagcacgcctttgaactagtgagcaaagacgaaaactctatcattttcgcagccaaatctgcagaggaaaaaaataactggatggctgcactcattagtttgcactatcggagcacattggatcgcatgctggactcagtgctccttaaggaggaaaacgagcagcccttaagattgccatcaccagaggtttacaggtttgtggtgaaggatagcgaggagaacattgtgttcgaggacaatctgcagagtaggtccggcatccccattatcaagggaggaactgttgttaagctgatcgagaggctcacctatcacatgtatgccgatccaaactttgtgcgcacctttctgacgacataccgctctttttgcaagccccaggaattgctcagcctgctgatcgaacgcttcgagattcccgaaccggagcctacagacgcagataagcttgctatagagaaaggcgaacagcccatctcagcagatttaaagcggtttagaaaggaatacgtgcagcccgttcagttaaggattctcaatgtgttccgccactgggtggaacatcatttttacgattttgaaagggacttagagctgctggaaagactcgagtcatttattagctcagtaaggggcaaggctatgaagaagtgggttgagagcatcgcgaaaatcatcagacgcaaaaagcaggcgcaggctaacggggtcagccacaacataacattcgaatctccaccacctccaatcgagtggcatatatctaagcctggtcaatttgagacgtttgacctcatgacgctacatcccatagaaattgcccgacaactcacgctgctcgaaagcgacctgtaccgaaaagtgcagcctagcgagttagtggggagtgtgtggaccaaagaagacaaagagatcaattcacccaatctcctgaaaatgatcagacacacaacaaatttgacactgtggtttgagaagtgcattgtggaggcagaaaactttgaggaacgcgtggcagttctgagcaggatcatcgagatcttgcaggtcttccaggacttaaacaatttcaatggtgtgctcgagatagtttctgcagttaacagcgtgagcgtgtacaggctggaccacacattcgaggcactgcaggagcgcaagagaaagatcctcgatgaagccgtagaattgtcacaggatcattttaaaaaatatctggtcaagcttaagtcgattaatccaccttgcgtgcccttctttggtatttacttgacgaacatccttaagactgaggagggcaacaacgattttctcaagaagaaggggaaggatctcattaactttagtaaacgaagaaaagtggcagagattacaggtgagatccagcagtaccaaaaccagccgtattgcctgcgcattgagcctgacatgcgcagattcttcgaaaatttgaacccaatgggctctgcaagcgagaaagagtttacggactatctgtttaacaaatccttagagatcgagccccggaattgcaagcagcccccaaggtttccacgaaaatccacattcagcctcaaaagcccaggtattagacctaacactggtaggcacggctcaacctctggcaccttgcggggccatcccaccccgctcgaacgcgagccatgcaaaatcagtttttcacgcatcgcagaaaccgagttggaaagtacagtatccgccccaaccagcccaaatactcccagcacccctcctgtctccgccagttctgatctgtcagtattcctcgacgtggatctgaacagttcatgcggtagcaattccatcttcgccccggtactcctgccacattctaagagttttttctctagctgcggctccctgcataagctgagcgaggaacctcttatcccccccccacttcctccacgcaagaagtttgaccacgacgcctctaattcgaaaggaaatatgaaatcagacgatgacccacctgcaataccacctcgtcagccacctccacctaaggtcaagccccgtgtgccagtgcccactggtgcgtttgacggaccactccactccccacccccacctcctccccgcgatcctctcccagacacccccccgcctgtgcccctgcgcccaccagagcatttcatcaactgccccttcaacctccaacctccacccctggggcacttgcaccgcgacagcgactggctccgcgacatcagcacatgtccgaactctccctccacacctccgagcacccctagcccaagagtgccccgacgatgttacgttttgagtagcagccaaaataacctggcacatcctcccgctccccccgtgccaccacgccagaactccagcccacaccttcctaagctcccccctaagacttataagcgcgaattgagccaccctcccttatataggttacccctgctagagaacgcggagactccccagtag

SEQ ID NO: 135722 - DNA, 1389 bp, Artificial Sequence
  Description of Artificial Sequence: Synthetic coding sequence
atgctactcttggctcgctgcctgttattggtgctggttagcagcctattggtgtgtagcgggctcgcctgcgggccagggcggggttttgggaagcgacgacaccccaaaaagctgacccctctcgcatacaaacagtttataccgaacgtggccgagaagactctgggagccagcggaagatacgagggaaaaatctcaaggaattccgaaaggttcaaggagctgactccgaattataatccagacattatcttcaaggacgaagagaacacaggtgcggaccgtctgatgactcaaaggtgtaaagacaaactgaacgccctggccattagtgtaatgaatcagtggcccggggtcaagctgagagttaccgaggggtgggacgaagatggccaccatagcgaggagtctttgcactacgaaggccgtgccgtcgatattaccaccagcgatcgagacaggtctaaatacggaatgctcgctcggctcgccgtggaggctggcttcgactgggtatattatgaaagtaaggctcatatccattgcagcgtgaaggcagaaaacagtgttgccgcaaaaagtgggggctgctttccgggatcagcgactgtgcacctcgaacaaggcggtacaaaattggtgaaagatctgtcccccggggatagagttttggcggcagacgatcaagggaggctgctgtacagtgattttctgacgttccttgatcgggacgacggggctaagaaagtcttttacgtgatcgagaccagggagccgcgcgagcggctgctcctcacagctgcacacctcttatttgtggctccccacaacgatagtgccacaggagaaccagaagctagctctggatctggccctccaagcggtggggctttaggtcctagggcactgtttgcttctagagtcagacctggccagagggtgtatgtcgtagccgaaagggatggggaccggcgcctccttcccgctgccgtacacagtgtgacactgtctgaggaagccgcaggggcttatgctcctctgaccgctcaaggcaccatcttaattaatcgtgtcctggcctcttgttacgccgttatcgaggaacacagctgggcccatagagccttcgcgccctttaggctggcccacgccctcctggcagcccttgccccggccagaactgacagagggggggacagcgggggaggcgataggggcgggggcggaggcagagtggcccttaccgctcccggagccgctgacgcaccaggggcaggggcaaccgccggtatccattggtattctcagctactctatcagataggcacatggcttctggatagtgaggccttgcacccacttggtatggcggtcaagagttcctag

SEQ ID NO: 135723 - DNA, 3456 bp, Artificial Sequence
  Description of Artificial Sequence: Synthetic coding sequence
atgtctagcgaatgcgatggagggtctaaggcagtgatgaatggtctggcccccggatcaaatggccaggacaaggctactgcggatcctctcagggctcgaagcatttccgctgtcaagatcatacccgtgaagacagtgaagaatgcctctggactcgtgctgccaactgatatggaccttactaagatttgtacgggtaagggtgccgtcactctccgtgcttcttcctcttaccgagagaccccctccagcagtcctgccagtccacaggaaacacgccaacacgaatcaaagcccggacttgaacccgaacccagcagtgccgatgagtggagattgagctcttccgctgatgccaacggtaacgcccagccttctagtctggctgcgaagggctatagaagtgtacatcctaacttgccatctgataagtcacaggatgcaacttctagtagcgctgcacagccagaggttattgtggtgcctctgtacctggtgaacactgaccgcggacaggagggcacagcccgcccccccactcccctgggccccctgggctgtgtgccaaccatccctgctaccgcatctgccgcctctccacttaccttccctactctggacgactttattcctcctcacctgcaacgttggcctcaccactcccagcccgcacgggccagcgggagctttgcaccaatttcccagaccccaccttcattttcccccccaccaccattggtgccacctgcccccgaggatttgcgtcgggtaagtgagcccgacctgaccggggccgttagctctacagattcatccccgctccttaatgaagtatcctcatcgctgatcggaacagactcacaagctttcccctccgtgtcaaagcccagctccgcctacccatcaactaccatcgtcaacccaactattgtgctgcttcaacacaatagggaacagcaaaagagactgagcagtttatccgatcccgtgagtgagcggagggtcggcgaacaggatagcgccccgactcaggagaaacccacctccccagggaaggcaattgaaaagcgtgccaaagatgatagccgaagggtggtcaagagcacccaggacctcagtgatgtgtccatggatgaagtagggatcccactgaggaatacagagcgctccaaagattggtacaagacaatgtttaagcagatccacaagcttaatagagacacacccgaagaaaacccctacttccctacatataagtttcccgaactgcctgaaattcagcagactagcgaagaaaccaagagttgctctgtgatgagtcccaggcttgaatgcagtgggaccgtgattgcgcactgctccctgaaactgcttgactcaagcaacccccccacctcagcctcccaggtcgcaggaacagcagacgatgatagcgacctctattccccccggtactcatttagcgaggataccaaaagcccacttagcgttccacgaagtaaaagcgaaatgagttacatagacggggagaaagttgtgaagagatctgcgacacttcctctgcctgcacgtagttcttcactgaaatcatcctcagagcggaatgactgggagcctcccgacaagaaggtggacacccgcaagtacagagctgagccaaaaagcatttacgagtatcagcccgggaagtcaagcgtcctaacgaatgagaagatgtctagagacatcagcccagaggaaatcgatcttaagaatgagccctggtataaattctttagcgagctcgagtttggaaagccccctccgaagaaaatatgggactatacgccaggcgactgcagcattcttccccgagaagaccgaaaaaccaatctcgacaaagatctgtcactgtgccagacagagctcgaggccgatctggaaaagatggagactctgaacaaggctccctccgctaatgtcccccaaagttccgctatttctcctaccccagaaatatcctccgagacccccggctacatctacagctctaatttccacgctgtaaagagagagtctgatggcgctcctggcgacctgacatccctggaaaatgagagacaaatctataagagtgtgctggaagggggggatattccactgcagggtcttagtggtttgaagcgccctagctccagcgcaagcactaaagactctgaatcccccaggcactttatacccgccgactatctcgagtctacagaggaattcattcggcgccggcacgacgacaaggagaagttactggccgatcagaggaggttgaagcgagaacaagaagaggctgacattgcggcccgcaggcacaccggcgtaatccctacccatcatcaattcattactaatgagaggtttggcgacctgcttaacatcgatgacactgccaagagaaagtccggaagcgagatgcgacctgcccgggccaaatttgactttaaggcccagaccctgaaagaactacctctacagaagggcgatatcgtgtacatctacaaacagatcgatcagaattggtacgagggagaacatcacggccgggtggggatcttccccagaacctatatcgagctcctgcctcctgcggagaaagctcagcccaagaaactcactcctgtccaagtgctggagtacggcgaagccatcgccaaattcaacttcaacggcgatacgcaggtagagatgtctttcaggaagggcgagcgtataactcttctccgacaggtggacgagaactggtacgaaggtagaatccccggcacctcccggcagggtatatttcccataacatacgtggacgttattaaaaggccgctggtgaagaaccctgtggattatatggatttacccttttcatcaagtccctcacgcagcgctactgcctccccgcagccgtggcgtgaggaatcagggcagtacgagcgtaaagcggaaaggggtgctggcgaacgaggtccaggaggacccaagatctctaagaagagctgcctcaagccaagcgacgttgtgcgatgtctcagcaccgagcagaggctgagcgatctcaacactcctgaggaatctcggcccggaaagccactgggatccgcctttcctgggtctgaggccgagcaaaccgagaggcaccggggaggggaacaggcgggcagaaaggccgctcgcaggggcggcagccagcagcctcaggcccagcagcggcgggtaactcctgataggtctcaaacttcacaggacttgtttagctatcaggctctgtactcctacatcccccaaaacgacgatgagctggagttaagagatggggacatagtggacgtcatggaaaagtgcgatgatggttggtttgtagggacatcgaggcgtactaaacagttcgggacttttccaggaaattatgtcaagccattatacctttag

SEQ ID NO: 135724 - DNA, 2346 bp, Artificial Sequence
  Description of Artificial Sequence: Synthetic coding sequence
atgtcatccgagtgcgacggaggctccaaggctgtcatgaacggcttggctccggggagtaacgggcaggacaaagccactgcggatccactgcgcgcacgcagcatctctgctgtgaagattattcccgtgaagaccgttaagaatgcctcaggtctggtgctcccaacagatatggacctcacaaagatctgcactggcaagggggccgtgaccctacgcgcctcctccagttatcgagagacgccaagcagctctccggcttccccccaggaaacaaggcaacatgagagtaagcctggccttgagccagaaccttcgagtgcagatgagtggcggctaagcagctcagctgacgccaacggcaatgcccagccttcaagcttggctgctaagggctatcgtagtgttcatcccaatttacccagtgacaaatcacaagactcaagccctcttctgaatgaagttagcagcagccttattgggacggacagccaagcctttcctagcgttagcaaaccctcgagtgcctatccctccactaccatcgtgaatcctactatcgtactattgcagcacaatagggaacagcagaagcggttaagcagtctgagcgaccctgtcagcgaacgacgagtgggggagcaggacagcgcacccacccaggagaaaccgacttccccaggaaaggccatcgaaaagcgagccaaagacgacagccgtagagtagtgaaaagcacccaggacctttccgatgtatctatggacgaggtgggaattccactccgaaacactgaaaggtcgaaggattggtacaaaacaatgtttaagcagatccataaattgaatagggatgacgacagcgatctgtactctccgcgctatagtttcagtgaagacaccaaatcccccctcagtgtgcccaggtcgaagtctgagatgtcctatatcgacggagagaaagtggtgaagcgcagcgcaactctgccgctacctgccaggtcatcctcactgaagagtagctcagagcgtaatgattgggagcccccagataagaaagtggacacaaggaaatatagagcagagcctaaaagcatttacgagtaccaacccgggaaaagctctgtactaacgaacgaaaaaatgtcaagcgccatttccccaacaccagaaatcagttctgagacgcctgggtatatatatagcagcaacttccatgcagttaagcgtgaatccgacggtgctccaggcgacctgacttctctagagaacgaacggcagatctataaaagtgtactggagggaggggacattcccctgcagggactatcggggttaaagcgcccttcatcatctgcctctaccaaagattccgaatctcctcggcatttcatacctgctgattacctcgaaagcacagaggagttcattcggcgccgccacgatgataaagagaaattgctggccgaccagagaagactgaagagggagcaagaagaggccgacatagcagcacggcggcacactggggtgatcccgactcaccaccaattcatcacgaacgagcggtttggtgatctccttaatattgatgatacagctaaacggaagagcggctcagagatgagacctgcacgcgccaagtttgacttcaaggcccagaccctgaaagagctgcccctccagaagggagacatcgtatatatctataagcagatagatcaaaattggtatgaaggggagcatcacggtagagtgggcatctttcctcgaacttacattgagctgctgccccccgctgagaaagcccagcctaaaaagctcacacctgtccaggtgttagaatatggcgaagccatagccaagtttaattttaacggcgacacacaggtcgagatgagtttccgtaagggcgaaagaatcactctactccggcaagtggacgaaaactggtatgaaggacggatccccgggaccagtcgccaggggattttcccaattacctatgtggatgtgattaagaggcctcttgtcaaaaatcccgtcgactatatggacctacctttcagctcatctcctagcagaagtgcaactgcctctccccagcagccgcaagcccagcagagaagggtgactccggatcgttcacagactagccaggatctattcagctaccaagccctgtattcttatattccccagaatgatgacgagttagagctccgggacggcgatatagtcgatgttatggagaaatgcgatgacggctggttcgtagggacttctagaagaacaaagcagtttggaaccttccctggcaattatgtgaagcccctctatctgtag

SEQ ID NO: 135725 - DNA, 2541 bp, Artificial Sequence
  Description of Artificial Sequence: Synthetic coding sequence
atgagttccgaatgcgatggtgggtccaaggccgtgatgaatggactcgcaccggggagtaatggccaagataaagcaacagcagaccccttgcgcgcaaggtcaatcagtgccgtcaagatcatcccagttaagacagtgaaaaacgcatccggcttggtcttgccgaccgatatggacctgacgaagatatgtacgggcaagggtgccgtgacactgagagctagctcttcttacagggagacccctagctccagcccggcctcaccacaggaaacccggcagcacgagagtaagcccgatgaatggaggctgtccagcagtgccgacgccaatggcaatgcccagccctcatctctggcagctaaaggttaccggtcagtgcaccccaacctgcccagtgataagtcccaggattcatctcctctgctaaatgaggtgagcagctctctgataggaaccgacagccaggctttcccctccgtcagcaagccctccagcgcctacccctccaccaccatagtgaatcccacgatcgtattactgcaacataatcgggagcagcagaaaagactgtcgtccctatctgaccccgtcagcgaacgtcgcgtcggggagcaggactccgcgccaactcaagaaaaacccacttcacccggcaaggccattgagaaacgtgcaaaagacgatagccggagagtagtcaagtccactcaggacctgtccgatgtgtctatggatgaagtaggtatccccctgaggaacactgagagaagtaaagattggtacaaaacaatgttcaaacaaatccataaactgaatagagacaccccagaggagaatccctactttcccacgtacaaatttccggagcttccagagatccagcagacatctgaagaagataacccctacaccccaacttaccagttcccagccagcaccccgagccctaaatccgaagatgatgactcggatctgtacagcccccgctactccttcagcgaagacacaaagtcgcctctgagtgtgccccgctctaagagtgagatgtcatacatcgacggagagaaggtggtcaagagatccgccacgctgccattacccgcccgctcaagtagcctcaaatcctcttcagagcggaacgattgggaaccaccagacaagaaggtggacacccggaaatacagggccgaacccaaaagtatctacgagtaccagcccggaaaaagcagcgtgcttacaaacgaaaagatgagtcgcgatatttcacccgaggagattgacctaaaaaacgagccatggtacaaattcttctccgagctggagttcgggaagccgtcttctgcgataagtcctacaccagagatcagttcagagacacctgggtatatatatagttcaaatttccatgcagtcaagcgagaaagcgacggggcgcctggcgatctgacaagccttgaaaatgagcgccagatctataagagtgtgcttgaggggggagacatccctctgcagggtctgagcggcctgaaacgtccctctagcagtgcttccacgaaagatagcgagagccctaggcacttcattcctgccgattatctggaatccactgaggaatttattaggagacgtcatgacgacaaggagaagctcttggccgaccagcgtcgactgaaaagggagcaggaagaggccgacatcgcagcacggcgacataccggagtgataccaacgcaccatcagttcattacaaatgagcgcttcggggatctgttgaatatcgacgatactgctaagcgaaagtcaggctcagagatgagaccggctcgtgcgaagttcgatttcaaggcccagacactgaaagagctacctctgcagaagggcgacattgtatatatttataagcagattgaccaaaactggtatgagggcgagcatcacggcagagttggaattttccccaggacttacattgagttgctgcctcctgccgagaaagcccagcccaagaagctgacgcccgtacaagttcttgagtacggggaagctatcgcaaaattcaacttcaatggcgatacacaagtggagatgagcttccggaaaggagagaggatcaccctccttcggcaggtggacgagaactggtatgaaggccggatcccaggtacttcacgtcagggaatattcccgatcacatatgtggacgtcatcaagcgacccttggtgaagaatccagttgattatatggacctgcccttcagttcctctccttcccgtagtgcaacagcttccccgcagcagccccaagcccaacagagaagagtcaccccagacagatctcagacgtcccaagacctcttctcttatcaagccctctactcatatatcccgcagaacgatgatgagcttgagcttagagacggtgacatcgttgacgtcatggagaaatgtgacgacggatggtttgtgggaacatcaaggcgcactaaacagtttggcacattccctggcaactacgtgaagccactctacctgtag

SEQ ID NO: 135726 - DNA, 2718 bp, Artificial Sequence
  Description of Artificial Sequence: Synthetic coding sequence
atgtcctcagagtgcgatggcggttctaaagcagtgatgaatggattggcgcctggctctaatggtcaggataaggccaccgcggacccactgcgggcccggagcatatcggccgttaaaatcatccctgtcaaaacagtgaagaacgcaagtggtctggtccttccaaccgacatggacctgaccaaaatctgtacaggtaaaggggccgttactttacgggctagcagctcctacagggaaacccctagcagcagtccagcaagcccgcaagaaacacggcagcacgagagtaagccaggtcttgaaccagagccatcaagcgcagacgaatggcggctgtcaagttctgccgacgcaaacggcaatgctcagccaagcagcctcgctgccaaaggttataggagcgtgcatcccaatttgccttccgacaagagccaaaggtggccacaccatagtcagccagcccgcgcgtccgggagcttcgctccgatttcccagacaccaccgagctttagccccccccccccactggtccctcccgcacccgaagacttgaggcgagttagtgaacccgatctcaccggcgccgtatctagtactgattcctcccctcttctgaatgaggtctcatcttcactgatcgggaccgattcgcaggcctttccaagcgttagtaaaccatcttctgcttacccctccacaaccatagtgaaccccaccatcgtcctccttcagcacaatcgggagcagcaaaagaggctcagtagtttatctgatccagtgagtgaacggagagtaggggagcaggactcagcccccacccaggagaaacctacctcacctggaaaggcgattgaaaagagggccaaagatgactctcgcagagtagtgaaatcaacccaggacctctcagacgttagcatggacgaggttggtatacctctgaggaatacagaaaggtcaaaggactggtataagacgatgtttaagcagattcacaagcttaaccgcgacgatgactcagacctatactcccccagatactcattttccgaggacaccaagtcgccactctcggtaccccgctccaaatctgagatgtcctatattgacggagagaaagtggtcaagagatcagcaaccttgccattacccgctcgcagtagctctctgaaatcctcatccgagagaaacgactgggaacccccagataaaaaggtcgacacaaggaagtatcgagccgagcccaaatccatatatgaataccaaccgggaaagagttccgtcctcacgaatgagaaaatgagtagagatataagccccgaggaaatcgacctgaaaaacgagccatggtacaaattcttctcagagttggaatttggaaagccaccacctaaaaagatctgggactacacaccaggcgattgctctattctgccccgcgaagatagaaagtcctcggctatcagcccaacccccgagatatcctcggaaacccccgggtatatctatagtagcaacttccacgcggtgaaaagagagagcgatggcgccccgggggatctcacgtcgttggaaaacgaacgacaaatttataaatccgtactggagggcggggatatccctctccaagggctgtctgggttgaagaggccctcctcttcggcaagtactaaagattcagagtcaccccgtcacttcatccccgccgactacttagaatccacagaagagttcatcagacgaaggcacgacgacaaggagaagctcttggccgaccaacggagactgaagcgggagcaggaggaagctgacattgccgcccgccgtcataccggcgtgatcccgacacaccaccagtttatcaccaacgaaagattcggcgacttgctgaacattgatgacaccgccaagcggaagagtggcagcgagatgaggcctgcacgtgctaagttcgattttaaagctcagacacttaaggagctcccactgcagaagggggacatagtgtacatttataagcagatcgatcagaattggtacgaaggagagcatcatggaagggtgggcatcttcccacgaacctacatcgaactgctgccccccgcagagaaggcccagcccaagaagctgactcccgttcaagtcctggagtatggagaggcaatcgcgaaattcaactttaatggagatactcaggtcgaaatgtcttttcgtaaaggagaaagaattaccctgcttagacaggtggacgaaaactggtatgaggggcgaattcctggtactagtcggcaggggatctttcctattacgtatgtggacgtcatcaagcgccctctcgtcaagaacccagtggactatatggacctgccttttagtagttctccttcccggtccgccactgcatcacctcaattgtcacaccactcacttcgagcaggtccggatctgacagaaagtgaaaagagttatgtgcagccacaggctcagcagcggagggttactcctgatcggtcccagacaagtcaggatttatttagctaccaggccctctacagctatatacctcagaatgatgacgaactggagttacgtgatggcgacattgtcgatgtcatggaaaaatgcgatgacggatggttcgtgggcacatcaaggcggacaaaacagtttggtaccttcccggggaattacgtcaaacccttgtatctgtag

SEQ ID NO: 135727 - DNA, 3015 bp, Artificial Sequence
  Description of Artificial Sequence: Synthetic coding sequence
atgagcagcgagtgtgacggtggtagcaaggcagtgatgaacggattggctccgggttccaacggacaggacaaagcaacagccgaccccttgcgagccagatcaattagcgcagtgaagattatccctgtgaagaccgtcaagaacgcctccgggctcgtccttcccacagacatggacttaacgaagatctgtactggtaaaggagcggtcactctgcgagccagcagcagctatagagagaccccaagcagctctccagcatcgccccaggaaactaggcaacatgagtctaagccagatgaatggaggctcagttcctccgctgacgctaacggtaacgcccaaccgagtagcctggccgcgaagggttacagatctgtccaccccaacctgccctctgataagagccaggacgcgacctcctctagcgccgcacaaccagaagtgattgtagtcccactgtatctggtgaacacagacaggggacaggagggtaccgctcggccacctacccctttaggccccctcggctgtgtgcccacaataccggccactgcctcagctgccagcccattgacttttccaacactcgatgattttatcccaccccatctgcaacgttggcctcatcactctcaaccggccagagccagcggcagctttgctcccataagccaaacacccccttcattctctccacctccgccgctggttccacccgcccctgaagatctgcgcagagtgagcgagcccgacctcacaggcgctgtgagctctacggattcaagcccattgctgaacgaagtgtccagttcactgattggaacagatagtcaagcgttccccagcgtatctaaaccttccagcgcctacccctcaactacaattgtgaatcccaccatagtactgttgcagcacaatagggagcaacaaaaacgtctctccagtctgtcggaccctgtctccgagcgcagggttggcgagcaggattccgcgcccacccaggaaaagcctacaagtcccggcaaagcgattgaaaaaagagccaaggatgatagccgaagagtggtgaaatctacccaggacctgtcagacgtgtcaatggatgaggtgggcatccccctcaggaacacagaacgctcaaaggactggtataaaacaatgtttaaacagatccataaactgaatagagatacccctgaggagaacccctacttccccacctacaagttccccgagttgcccgagatccagcagacctccgaggacgatgatagtgatttatactcgccgagatactctttctccgaagatacaaagtcgcccctgtcagttccacgttctaaatctgagatgtcctatatcgatggggaaaaggtggtgaaacgctccgccacactgccactgcctgcacgttcatcttctctcaagtctagttctgaaaggaatgactgggaacctcccgacaagaaagtggacacccggaaatacagagctgagcccaagtccatatacgaatatcagcccggtaaatccagcgtgcttacgaatgagaaaatgagtagggatatcagcccagaggagattgatctgaagaatgagccatggtacaaattctttagtgagcttgagttcggaaagcctccgcccaaaaagatctgggactatacccctggcgactgctcaatactccctagggaagaccgtaagaccaacttggacaaggacctgagcttgtgccaaacggagttggaggccgatttagagaagatggaaacgctgaataaggctccctcagcaaatgtgcctcagtcttccgccatttctccaacacctgaaatttctagcgagacacccggctatatatattccagtaacttccacgccgtgaaacgcgagagtgacggagcaccaggcgacctcacatctcttgagaacgaaaggcagatttataaatccgtgctggaggggggtgacattcctttacagggcctttcgggactgaagagaccttcttcctcggcatcaacaaaagacagcgaaagcccacggcatttcattccagccgactacctggaatcgacggaagaattcatccggaggcggcatgatgataaagaaaaactgctggctgaccagcggcggctgaaacgtgagcaagaggaagctgatattgccgctagacgtcatacaggcgtgatccccactcaccatcagttcattaccaatgagcgcttcggggacttgttgaatatcgacgacaccgccaaacgtaagtcaggtagcgagatgcggccagcccgggctaaattcgactttaaggctcagactcttaaagagctccccctgcagaaaggcgatatcgtctatatctacaagcagatcgaccagaattggtatgagggcgaacatcacgggcgcgtgggaatctttccacgtacttacatagaactgctccctcccgccgagaaagcgcagccaaaaaaactcacccctgtgcaagttttagagtatggggaagctatcgccaaatttaatttcaacggggatacccaagtagagatgtcgttcaggaagggcgagagaatcactttgctgcgccaggtggacgagaattggtatgaggggcggatacctggtacatccaggcagggtatctttcctattacctacgtggatgtcattaagaggccgctcgtgaagaatcctgtagattatatggacctccctttcagctcttctccatcccgcagcgccaccgcctcaccgcagcagccgcaggcccagcagcggagggtcaccccagaccggtcccagactagccaggatttgttctcatatcaagcactgtatagctacataccgcagaacgatgacgagcttgaattaagagatggtgatatagtggatgttatggagaagtgtgacgacgggtggttcgtggggacctcaagacgtaccaagcaattcggcacgtttcccggaaattacgtgaaacccctctacctgtag

SEQ ID NO: 135728 - DNA, 3879 bp, Artificial Sequence
  Description of Artificial Sequence: Synthetic coding sequence
atgtccagcgaatgcgacggtggctccaaagcagttatgaacgggctggccccaggatctaacggtcaggataaggcaactgccgacccgctgcgcgcgagatccattagtgccgttaaaataatccccgtgaagaccgtgaagaatgctagcggcctcgtcctacccaccgatatggatttgacaaagatctgtacagggaagggcgccgttaccctgcgagccagctcatcttacagggagacccctagcagctcccccgcatccccacaagagacaaggcagcatgagtctaagcctggcctggagcccgagccatcttccgctgatgagtggcggttgagctcttccgctgatgccaacggtaatgcccagccttcttctctggccgcgaaagggtaccggagcgtgcaccccaacctcccctctgataaaagtcaggacgctacttcctccagtgctgcccagccagaagtgattgtcgtcccactttacctagtcaacacagaccgcggtcaagaaggaactgctcggcctcccactccattagggcccctaggttgcgttcctaccatacccgctacagcttcagctgccagccccctgaccttcccaacactggacgacttcatacctccacacctgcaacgatggccacatcattctcaacccgcaagagcctcaggctctttcgctccgatctcacaaaccccaccatcgttctctcctcctcctcccctggttcctccagcccctgaggacttgagaagggtttctgaacctgatctaaccggcgctgtgtcatccaccgattcatcaccgctgctgaacgaggtgtccagttcactgatagggaccgattctcaagcgttccctagtgtctctaagccatcaagtgcttaccccagcaccacaattgtgaacccaactatcgttctgctgcaacacaaccgggagcagcagaagagattatcgtcccttagtgatcccgtgtctgaacgacgtgtcggagaacaagatagcgcgcccacgcaggagaagcccacatcccccggcaaagcgatcgaaaaaagagcaaaagatgactcacgtcgcgtggttaagtctacacaggacctgagcgacgtttctatggatgaagttggcatcccccttcggaatacagagaggagtaaggactggtacaagacaatgttcaaacagatccacaagctcaatagagacacccctgaagagaacccgtacttccctacttataagttcccggagctgccggagattcagcagacttccgaggaggacaacccctataccccaacgtatcaattcccagcgagcacacccagtccaaagtctgaggacgacgacagcgatctgtactccccgcggtatagcttcagcgaggacaccaagtctcctctgagcgtccctagatcaaaaagtgaaatgagttatatagatggtgagaaggtcgtgaaacgctctgccactctgcccctgcctgccaggtcaagcagcctcaaaagctcctcggaacggaacgactgggaaccccctgataagaaagttgatactagaaagtacagggccgagcccaagtccatttatgagtaccagccaggaaaaagcagtgtgctgacaaacgaaaaaatgtcccgcgacatttcccccgaggagatcgacctaaaaaatgagccctggtataaattcttcagcgagctggagtttgggaaacctcctcctaagaagatttgggattatacaccaggggactgttcaattttgccgcgagaagaccggaagacaaacttagacaaggatttgagcttgtgccaaacagagctggaggccgatctcgaaaagatggaaactcttaataaggccccaagtgctaacgtgccccagagctccgcaatctccccaactcccgagatttcgagcgagactccaggttatatttactcaagtaatttccatgccgtcaagcgcgagtctgacggcgccccaggtgacttaacaagcctggagaatgaacgtcagatctacaagagtgttctggaggggggggacattcccctacaagggttatccgggttgaagagacctagctcttcggcttctacgaaagacagcgagagcccccgacatttcataccagctgattacctggaatccacagaggagtttatccgccgacgccacgatgacaaggagaagctgctagcagatcagcgacggctcaagcgcgagcaagaggaagctgatatcgccgctcggcgtcacaccggtgtgatacccacgcaccaccagttcattaccaatgaaaggttcggcgacctgctcaacattgacgatactgcgaagcgaaaaagcggcagtgagatgaggccagcccgggcaaagtttgattttaaggcccaaaccttgaaggagctaccgctgcagaaaggcgacatcgtgtacatctacaaacaaattgaccaaaattggtatgagggtgaacatcatggacgagtgggaattttcccaagaacctacattgagcttctaccgccagctgagaaggcacagccaaagaaactaactccagttcaggtcctggaatacggggaggctatcgctaagttcaacttcaatggtgacacacaggttgaaatgtcattccgcaagggtgaaagaatcaccctgctgaggcaagtggacgagaattggtacgaaggacgaattcccgggacatctagacagggcatttttccgattacctatgtcgacgtgattaagcggcctttggtgaagaaccccgtggactacatggacctgcccttcagctctagtccaagtaggtctgcaaccgcgagcccccaattttcatctcactccaaattgatcaccccagcgccatccagtttgcctcactctcggcgcgccttatcacctgagatgcacgctgtgacttcagagtggatcagcctgacggtcggggttcctggacgtagatccctcgcattaacgccaccacttccaccactgcccgaggcttccatctacaatactgatcatcttgccttgtcaccaagggcaagcccctctttgagtctgtccctccctcacctttcgtggagcgatcggccaacgccacgctcagtagcctctcccctggcgctcccatccccccataagacatacagccttgccccgacatcccaagccagtctccacatgaacggagacggaggcgtgcatacccccagctccggaattcaccaggatagctttcttcaattgccactgggtagcagtgactctgtgatttcacagctctcagacgcctttagctcccaaagcaagcgccagccgtggcgggaggaatcagggcagtacgaacgcaaagctgagcgcggagcgggcgaacgagggcccggcggcccgaagatctcaaagaaatcttgcttgaaaccctccgacgtggtacgatgtttgagcaccgaacagcgactgagcgatcttaacacacccgaagagagccggcctggaaagcccctgggcagtgcatttcctggttccgaggccgaacaaaccgagaggcaccgcggcggcgagcaggccggacgaaaagccgcacgtcgcggaggttcacagcagccccaagcacagcagaggagggtgacgccagatcggagccagacaagtcaggacctgttcagctatcaggccctgtattcttacatcccccaaaacgacgatgaactcgagctcagggacggtgatattgtggatgttatggagaagtgtgatgacggctggttcgttggtacaagccgccggaccaaacagtttggtacattccctggtaattacgtgaagccgctttatctgtag

SEQ ID NO: 135729 - DNA, 3801 bp, Artificial Sequence
  Description of Artificial Sequence: Synthetic coding sequence
atgtccagtgaatgtgatgggggatccaaggcagtgatgaacgggctggcacccggaagcaacggacaggataaagcgacagccgatccattacgagccaggagcattagcgcagtgaaaattatccctgtcaagacagtgaagaatgctagtggactggtgttacctaccgatatggatcttacgaagatatgtaccggcaagggagcagttactctccgggcctcttcgagttatagggaaacgcctagctcaagcccagcctccccccaggaaacacggcagcatgagagcaagccaggactggaacccgaacccagctctgccgacgagtggcgtctctcatctagcgccgacgctaacggaaacgcccagccttcttctctggctgctaagggctaccgctccgtacatcctaacttgccctccgataagtctcaggatgcaacatctagcagcgccgctcagccagaggtcatcgtggtgcctctgtatcttgtcaacacagatagggggcaggagggcacggctaggcctccgactcccttgggtcccctggggtgtgtgcctactatcccagccaccgccagtgcagcctcccccctgacgttccctactctggatgatttcatcccgccgcacctccagaggtggccccaccacagtcaaccagcacgtgctagcgggtcttttgcccccattagtcagacacccccaagcttctccccccccccccctctcgtgcctcctgcccccgaggatttacggagagtatcagagccggatctgacgggcgccgttagttctaccgactcgagcccacttctgaatgaagtgagctcatcactgatcgggactgactcgcaggccttcccatccgtgtctaaaccttcttccgcctacccctcgaccacaattgtgaatccgaccattgtgctcctgcagcataaccgcgagcagcagaaacgtctctcatccctgagtgaccccgtctctgagcgacgagttggggaacaggattccgcgccaacacaggagaaacccacaagccccggaaaagccatagagaaacgggccaaggatgactctcgccgggtagtgaagtcaacccaagacctgtctgacgtgagcatggatgaagttgggataccactgcgcaacactgagaggtccaaagattggtataagactatgtttaaacaaatacataagctgaacagagatgatgatagcgatctgtactcacctcgatatagcttttctgaggacaccaaatctccacttagcgtaccccgcagcaagtccgaaatgtcttatatagacggggaaaaagtggtgaagaggtctgctactctccccctgcctgcgcggagtagcagcctgaaatccagctcagagcgcaacgactgggagccacccgataaaaaagtggacacaagaaagtacagagccgaaccaaaatctatttacgagtaccaaccaggcaagtcatccgtgcttacaaatgagaagatgtcgagagatatttctcctgaggaaatagatctcaaaaacgaaccctggtacaagtttttttcggagctggagtttgggaagcccccgcctaagaagatctgggactatacccccggcgactgttccattctacccagggaggacagaaagacaaacttagataaagatctttcgctttgccagacagaactggaggccgacctggaaaagatggagacgttgaacaaagctccgtccgctaatgttccccaatcctcagcgatctcccccactcccgaaattagctcagaaacccccggctatatttactcttccaatttccacgcggtgaagagggagtccgatggtgctcctggggacctcaccagtttggaaaatgagagacagatctataagagtgtgttggaggggggggatatacctctgcagggtctttccggtttaaagcgtccatcaagctctgcaagcactaaggattctgaatctcctcgccactttatccccgcagactacctcgagtctactgaggaattcattcggcgcaggcatgacgataaggaaaagctgttggccgaccagaggcggctgaaaagagagcaggaagaggctgacatagccgctaggcggcacacaggtgtgatccccacccatcaccagttcatcacaaacgaacgcttcggcgatctcctaaacattgatgatacagccaaacgaaagtcaggaagcgagatgcggccagctagagccaagttcgatttcaaggctcagacgctgaaggaattaccattgcaaaagggagatatcgtgtacatctacaaacaaatcgatcaaaactggtatgaaggtgagcaccatggaagagtggggatattcccaagaacatacattgaactgttgccaccagcagagaaggcacagccgaaaaagctgaccccagtgcaggtactggagtacggagaagctatcgctaagttcaattttaacggcgatacacaggtggaaatgagttttagaaagggcgaacgaattacccttctgaggcaggtggatgagaactggtatgaggggcggattccaggcacgtcccgtcaaggcatcttccctatcacttacgtagacgtgatcaagcgcccgcttgtgaaaaacccggtcgactatatggatctgcccttctcttccagcccatcacgtagcgcaacggcctcaccacagtttagcagtcattctaagctgatcactcctgctccatctagtcttccccactcacgccgggcactgagtcctgagatgcatgcggtcacttccgagtggatatctctaaccgtcggcgtcccgggccggcggtcactggcccttacccctcctctgccccctcttcccgaggccagcatatacaatactgaccatctggcactctcccctcgggcatccccctccctaagtctgtccctaccacacctctcttggtcagatagaccaaccccaagaagcgtagcctcaccactggcgcttccctctcctcacaagacatattctctggcgcccaccagtcaagcttccctgcatatgaatggcgatggaggtgtccataccccttcttcaggcatccaccaggattcctttctgcagttgccgttaggctcgtcggactcagtgataagccagttaagcgatgctttctctagtcagagtaaacgccagccgtggagagaggaatcaggccagtacgaacgaaaagctgaacggggagcaggcgaacgcggtcccggaggcccgaagattagcaagaaatcctgtctgaagccatccgacgtagtgagatgcctgtcaaccgagcagcgactgagcgatctgaatacacctgaagaatccagacccggtaagccactcggatcagcatttcctggttcagaggccgagcagactgagcggcaccggggcggcgagcaggccggacgcaaggccgcccgccgcggtggctcacagctaagccaccacagcttaagagccggacctgacctgacggaatccgagaaatcgtacgttcaaccacaggctcagcagcggagagtgacccctgatcggagccagacgtcacaggatctgttctcctatcaggcgctgtacagttacatccctcaaaacgatgacgagttggagctcagagatggagatatcgtggatgtcatggagaagtgcgacgacggatggttcgtagggacatctcggaggaccaagcagttcggtacttttcctggcaattacgttaaacctctgtacctctag

SEQ ID NO: 135730 - DNA, 2436 bp, Artificial Sequence
  Description of Artificial Sequence: Synthetic coding sequence
atgtctagcgaatgtgacggggggagtaaggcagtaatgaatggcctggcaccaggctcaaacgggcaggacaaggatatggatcttacaaaaatttgcacaggcaagggcgctgtgaccctgcgtgcctcgagttcttacagagagaccccttcaagctctcctgcttctccgcaagagacgcggcagcatgagtccaaacctggacttgagccagagcctagctctgcggacgagtggaggctctctagcagcgccgacgccaatggaaacgcccagccatcctcgcttgctgccaaagggtaccgatcggtccacccaaatttgccttccgataagtctcaggattccagtcccctcctgaatgaagtgagttctagcctcattgggaccgactcgcaggctttccccagcgtcagcaagcccagctcagcttacccttccaccaccattgtcaacccaaccatagttctgctgcagcacaaccgggaacaacagaagaggctgagttccctcagtgaccccgtcagcgagaggagggtcggggagcaagactctgcgcccacgcaagagaaaccaacttctcctggcaaagccattgagaagcgggcaaaggacgatagtcgccgtgtggtgaaaagtacccaggatctgtccgacgtgtctatggacgaagtgggaattcccctgcgcaacacggagcggtctaaggactggtacaaaacaatgtttaagcagattcacaaacttaaccgggacgacgactctgacctctatagtccacgatacagcttttctgaagatactaaaagtcccctatctgtgccaagatcgaagtctgagatgtcatacatcgacggagaaaaagtggtgaaacgctctgctaccttgccactaccggcacggagttccagcttaaaatcttctagcgagcgaaacgactgggaaccacccgacaaaaaggtcgacaccagaaagtaccgcgccgagccaaaaagtatttacgagtatcagcccggcaaatcctcggtgctgacaaacgaaaaaatgagccgggatattagcccagaggaaatcgacctgaagaacgagccctggtataagttctttagcgaactggagtttggaaaacctaccaatctggacaaggacctttctctctgccaaacagaactggaggccgacctggagaagatggaaaccctcaataaggcgccttcggcgaatgtacctcagtcctctgccatctcaccgactcccgaaatttcgagcgaaacacctgggtatatatactcgtccaacttccacgctgtcaaaagagaaagcgacggagcgcccggcgatttgacaagtctagagaacgaacgccaaatctacaaaagtgttcttgagggtggcgatatccccctgcaagggctctcggggctgaaaagaccctcctcctcggcctccacaaaagacagcgaatctccaaggcattttattccagccgattacctcgagtctactgaagaatttatccggaggcggcacgatgacaaggagaaactgcttgctgaccagaggcgcctgaaaagggaacaagaggaagccgatatcgctgcccgccgtcacaccggagttatccccacccaccatcaattcattaccaacgagaggttcggcgacctgcttaatatcgacgacacagcaaaaaggaaaagtggcagcgagatgcgtccagcccgggccaaatttgacttcaaggctcagacacttaaagagttgccactgcagaagggggatatcgtctatatttataagcagatcgatcagaattggtacgaaggggagcaccacggcagagtgggcatcttcccacggacgtacattgagttactgcctcccgccgaaaaggctcagcccaaaaaactgactcctgtccaggttcttgagtatggtgaagctattgcgaagttcaatttcaatggtgacacacaggtggagatgtccttccgcaaaggagaaaggatcaccctgctgaggcaggtagacgagaactggtatgaggggcgcattccagggacctctcgccagggcatcttcccgatcacatacgtggacgtgatcaaacgcccccttgttaaaaaccccgtggactacatggatctccctttttcttcctcaccatcaagaagcgcaaccgccagccctcaacagccccaggctcagcaacggcgtgtgacaccggatagatcgcagacctcccaggacttgttttcttatcaggccctttattcctatattccgcagaatgatgacgaactcgaactccgcgacggtgatattgtcgatgtaatggagaaatgtgacgatggctggttcgtcgggacatccagaaggaccaagcagttcgggaccttccctgggaactatgtgaaaccactctatctttag

SEQ ID NO: 135731 - DNA, 2055 bp, Artificial Sequence
  Description of Artificial Sequence: Synthetic coding sequence
atgagctccgagtgcgacggcggatcaaaggctgtgatgaatggtctggctccgggcagtaatggccaagataaagatatggatctgaccaaaatctgtaccgggaaaggcgctgtgacattacgcgcttccagttcctaccgagagaccccctcatccagcccggcatccccccaggagactaggcagcacgaatccaaaccggacgaatggaggctgagctcaagtgcagacgcaaacggaaacgcccagccatcttctctcgcggcaaagggctatcgatcagtccatcctaatttgcctagtgacaaatcacaggatagttcacccctgctgaacgaagtgtcaagttcgctgattggcacagattctcaggcgtttccaagtgtgtccaagcctagttctgcttacccatctactactatcgtgaatcccaccatagttctgctccagcacaaccgggagcaacagaaaaggttaagcagtctttccgacccagtgtctgagcgtcgagtgggggagcaggatagcgcccccacccaggaaaagccaactagcccaggcaaagccattgagaagcgtgcaaaagatgattccagacgggtggttaagtccacacaagatttaagtgacgtgagtatggatgaggtgggcattcctctgcgcaacaccgagcggtctaaggattggtataaaaccatgttcaaacagattcataagctcaaccgagatgacgattccgatctctattccccccggtactccttctcagaggacaccaagagccccctatcggtcccccggtctaagagcgagatgagttacatagatggtgagaaagtggttaagaggtcggcaactctgcctctgccagccagatcatcaagcctaaagtcttctagtgaaagaaacgattgggagcccccagataagaaggtcgatactcgcaagtaccgcgcagagcctaaatccatttacgagtaccaaccgggcaagtcgagtgtgctcacaaatgagaagatgtctagcgctatcagtccaacgccagagatcagcagcgagactcccggctacatatattctagcaacttccacgccgttaagagagaatctgacggcgcgcccggagatttgacctctctagaaaacgagagacaaatctataaatctgtgctcgaaggtggcgatatcccacttcagggtcttagcgggctcaagaggccttcttcatctgcatcaacaaaggacagcgaaagtccgaggcacttcattccagctgattacctcgaatccacagaagaatttatacgacgccgccacgacgataaggagatgcgccctgcgagagcaaaattcgattttaaagcccagacattaaaggaactgcccctacagaaaggagacattgtgtacatctacaagcagattgatcaaaattggtacgaaggcgaacaccacgggcgagtgggcattttcccccgaacctacatagagctgctgccaccagcggaaaaagcacagccgaaaaagctcacacctgttcaggtcctggagtacggtgaggcaatcgccaagtttaactttaatggggacacacaggtagaaatgtcatttcgaaaaggcgagcgtataaccttgctgagacaggtggatgagaattggtacgagggtaggatacctggcaccagcagacaaggcatctttccaattacctacgtggatgtaattaagcgcccattggtgaaaaaccccgtggattacatggacctaccatttagctctagcccgtcacgtagcgcaaccgcatctccccagcagccccaagcccagcaacggcgggtgactccggataggagccagacttctcaggatctgttcagttaccaggctttatattcttatattccgcagaatgacgatgaattggaattacgagatggtgatatcgtcgacgttatggagaaatgtgacgacgggtggttcgtgggcacaagtaggagaacaaagcagttcggaaccttccccggcaactacgtcaaaccattatacctgtag

SEQ ID NO: 135732 - DNA, 2718 bp, Artificial Sequence
  Description of Artificial Sequence: Synthetic coding sequence
atgagcagcgaatgcgatggtgggtcaaaagccgtgatgaatggtctcgcccctggatcaaacggacaggataaggcaactgccgaccccctgcgagccaggtcaataagcgccgtgaagatcattcctgtcaagaccgtaaagaatgcaagcggcctagttctgcccaccgacatggacttaacaaagatatgcacgggaaagggcgctgtgaccttgcgcgcttctagtagctaccgggagacaccctcaagtagtcccgcatctcctcaggagacgagacagcatgaatcaaaaccgggcctggagccagaacctagcagcgccgacgagtggagactgtcatcttctgctgatgctaatggcaatgcgcaaccatcaagccttgccgcaaaaggatataggagtgttcaccctaacttaccttctgataagtctcagagatggccccaccattcacaacccgctagagcttctggctcgtttgctcccatttcacaaaccccaccgtctttctctcctccaccaccgctggttccccccgcaccggaggacttgagaagagtgtccgaacccgatctcactggagctgtttctagtaccgattcatcccctctattgaacgaagtaagctcctccttaataggcacagactcccaggcgttcccatccgtgtcaaaaccttccagtgcctacccaagcaccaccatcgttaaccctacaattgtattgttgcagcataaccgggagcagcagaagagactgtccagtttgtccgaccctgttagcgaaagaagagtgggcgagcaggactccgccccaactcaggagaagccaacgtccccaggcaaggctatagaaaaaagggcaaaggacgacagtagacgtgtcgtaaagtcaacccaggatttaagtgacgttagcatggacgaagtcggaatcccactacgcaacaccgagcggtcgaaggactggtacaagacaatgtttaaacagattcacaaacttaacagggatgacgattcagacctgtactcacctaggtattcattttcagaggataccaagagccccctgtccgtgccccggagcaagagtgaaatgagttacatcgacggtgagaaggtcgtgaaacgcagtgctactttaccccttcccgcaagatcttcttccttaaagtccagttcggagagaaatgactgggaacctccggacaagaaagtggatacccgaaaatatcgggccgaaccgaaatctatctatgagtatcagcctggtaaatccagcgtgcttacaaacgaaaaaatgtcgcgggacatcagtcctgaagaaatcgatcttaagaacgaaccgtggtataaatttttcagcgaactggagtttgggaaaccaccccccaagaaaatatgggattacacccctggggattgctctatactcccaagggaggacagaaagtcctccgcaatcagccccactccggagattagttccgaaactcctggttacatctactcatccaactttcatgcggtgaagagggagagcgatggcgctccgggagacctcacctctctcgagaacgaaagacagatctataagtccgtactggagggcggcgatattcctctccaaggtctgagcggcctcaagcgccccagctcgagcgcctccacaaaagacagcgaatctccaaggcacttcatccccgcagactacttagaatctaccgaagaattcatccgcagacgacacgatgataaagagaaactgttggctgaccagcgacgcctgaagcgagagcaggaagaagcagatattgctgccagacggcacacaggagtgatacctacgcaccaccagtttataacaaacgagaggttcggcgatttattgaatatcgacgataccgcaaagagaaagtcaggatccgaaatgcgtccagctagggcaaagtttgacttcaaggctcagacactcaaagaactgcctctgcagaagggagatatagtttacatctacaagcagatcgatcagaattggtacgagggggagcatcatggaagagtcggcatctttccccgaacctatatcgaattactaccacccgccgaaaaagcacagcctaagaaacttactccagtccaggttttggagtacggggaagcgattgctaaattcaattttaacggggatactcaggtcgagatgtccttccgaaaaggtgagagaatcactctgctcaggcaggtagacgagaattggtacgaagggcggatccctggtacatcccgccagggaatatttccaatcacctacgttgatgtgatcaaacggcccttggtcaaaaatcctgtagactatatggatctgccttttagctcatccccatcccgctcagctacggccagtccccagttaagccatcacagcctccgcgcaggccctgatctaacagaaagtgaaaaatcatatgttcagccccaagcacaacaacgccgtgtcacacccgatagaagccagacaagccaggacctgttcagttaccaggctctgtattcctacattccgcaaaatgatgatgaactggagctccgggacggagatatcgtcgacgttatggagaagtgtgatgatggttggtttgttggcacttcgcggcgcactaaacagttcggcaccttccccggcaactacgtgaaacctttgtatctttag

SEQ ID NO: 135733 - DNA, 3456 bp, Artificial Sequence
  Description of Artificial Sequence: Synthetic coding sequence
atgtcatccgagtgtgacggggggtccaaagctgttatgaacgggctggcccctggatccaatggccaggacaaggctactgccgaccctctacgggccaggagcattagtgcagtgaaaataatacctgttaaaacagttaagaacgcctccggcctagtgttgcccaccgacatggacctgacaaagatctgtacaggcaaaggcgccgtgaccctgcgggcctcgagttcatatagggagacaccatcctcatcaccagcttctccacaggaaactcgacaacacgaaagcaagcccggcctggaaccagagccgtccagcgcagatgagtggagactctcttcttccgcagatgcgaatggtaatgcacaaccatcctctctggcggcaaaaggatacaggagcgtccatcccaacctccctagcgataaatctcaggatgccacatcttcgagcgctgcccagcccgaagtgatcgtggtcccgttatacctggttaataccgatagaggccaggaaggtacagcaaggccgcccacacctctcggccccctagggtgtgtccccaccatacccgcgacagcttctgcggcctctcccctgaccttcccaacactcgacgactttatccctccccatctccagaggtggccccaccattcacaacctgctagagcgtcagggtccttcgcacccatctcacaaacgcctccgtctttcagtccacctccccccctggtgcccccagcaccggaggatctgcgccgggtcagtgagccggacctgaccggagctgtgtcttccaccgactccagccccctgctcaacgaggtgagctccagcctgataggaacagacagccaggccttcccctccgtttcaaaaccttcttcagcttatccttccaccaccatcgttaacccgacaattgtgctgctgcagcacaatagagaacagcagaagcgactctcctcccttagtgatcctgtgtcagagcgccgcgtgggggaacaggacagcgctcccacacaggagaagccgacaagcccaggaaaggcgattgagaagcgagctaaggacgacagccggagggtcgtgaaatccacccaggatctctccgatgtctctatggacgaggtgggcatacccctccggaacacggagagatctaaggattggtacaagacgatgttcaagcagatccataaattaaaccgcgatacccctgaagagaatccctacttcccaacctacaagttccctgaactgcccgagatacagcagacttccgaggagacaaagagctgctcggtcatgtcccctagacttgagtgctccggaaccgtcatcgcacactgttcactcaaactgctggattcctctaaccctccaacaagcgcaagccaggtggcgggtacggccgacgatgattctgatctgtacagcccccggtattcattcagcgaggacactaaaagccccctgagcgtgcctcgaagcaagtcagaaatgagctatatagatggtgagaaagtggttaaacgatcagcaacgctaccccttccagctaggtcctcctcattaaagagcagcagtgagcgcaatgactgggagccccctgacaagaaggtcgacacccgaaagtatagagccgagcccaagagtatctacgaatatcaacccggtaagtcatctgtcctgaccaatgaaaagatgtccagagatatctccccagaagaaattgacctcaaaaacgagccttggtataaattctttagtgagctcgagttcggaaaaccaccccccaaaaagatctgggactataccccaggagactgcagcatattgcctcgagaggatcgtaaaacaaacctagacaaggacctctccctgtgccaaaccgaattagaggcagacctcgagaaaatggagaccttgaacaaggcaccctccgctaatgtccctcagagtagtgccattagtcctacaccagaaatttccagcgaaaccccgggatatatctacagcagcaattttcacgctgttaaacgggaaagtgacggagcaccaggagacctcacctcattggaaaatgagcgacagatttacaaatcagttctagagggtggagatatccctcttcagggtctcagtggtctgaaaagaccctcatcctccgctagcactaaagactcggagtcccctcgacactttattcctgctgattaccttgagagtaccgaggaattcatccgtcggagacatgacgacaaagaaaaactgctagctgaccagaggagactgaaacgtgaacaggaagaggctgatatcgcagccagacggcatactggcgtcatacccactcatcaccagttcatcacgaacgagcgattcggggatctcctgaatattgatgatactgccaagcgcaagtctggctccgagatgcgccccgcccgagccaagttcgattttaaggcgcaaacactgaaggagcttccgctgcagaagggagatatcgtgtatatctacaagcagatcgaccagaactggtatgagggagaacaccatggccgggtcggtattttcccaagaacatatatcgagcttctgcctccagcggagaaggcccagcctaaaaagctcacacctgtacaggtattagaatacggcgaagccatcgccaaatttaatttcaatggcgatactcaagtcgaaatgtcatttcggaagggggagcgaattaccctacttagacaggttgatgagaactggtacgaaggacgtattcctgggacttctagacagggaatatttcccattacctacgttgatgtgatcaagcgtccactggtgaagaatccagtcgattacatggatctgcccttctcaagctctccttcgcgctccgctaccgcgtcccctcagccatggagagaagaatctgggcagtacgagaggaaagctgagcgcggggctggcgagaggggccctggcggcccaaaaatttctaagaagtcctgcctgaagccatcggacgtggtaaggtgcctgtctacagaacagcggctgtccgatctgaatacgccagaagagtcaaggcctggaaagcccctgggatcagccttccccggtagcgaggctgaacagactgagcgacaccgaggcggtgagcaagccgggcggaaggcagcccggcggggaggctcccaacagccacaagcccagcagaggagggtgaccccagaccgctctcaaacgtctcaggatcttttttcttatcaggccctctatagctacatcccccaaaacgacgatgaattagagttacgggatggagatatagtcgacgtcatggaaaaatgcgacgacgggtggtttgtggggacttccagacggacaaaacagttcggaactttccctgggaactacgtcaaacctctttacctctag

SEQ ID NO: 135734 - DNA, 3879 bp, Artificial Sequence
  Description of Artificial Sequence: Synthetic coding sequence
atgagttcagagtgcgatggcggcagtaaagccgtgatgaatgggctggcccctggcagtaacggacaggataaagcaacagctgatcccctgagggctcgttctatttctgccgtcaaaataatccccgtaaaaaccgtgaaaaacgcttctggcttggtgctgccaaccgatatggacttgaccaagatctgcactggtaaaggagcggtgactctccgtgcatcttcttcttatcgagaaacaccttctagctcaccagcaagcccgcaggaaactagacaacatgaatcgaagcctggattggagccggaaccgagtagcgcagatgagtggaggctgtcttcatcggccgacgcgaacggcaatgcccagccatcttccctcgccgccaagggttatagatctgtacatccgaaccttccctcagacaagagtcaggacgcaacctcctcatctgccgctcagcccgaagttatcgtcgtgccactttatctcgtcaatacagacagaggccaggaaggtactgccaggccccctaccccgcttggccccctgggatgcgtccccacaatcccagcgactgcttccgcagccagcccactgacgtttccgactttggatgacttcatccctccacacctccaacggtggccacatcactcccagccagcccgggcatccgggtcttttgccccaatttctcaaacaccaccatcctttagtccacccccccccctggtgccaccagcacccgaggatctgaggagggtcagcgaacccgatcttacaggagctgtttcatcaacggattcgagccccctgttaaatgaagtaagctcgtctctgattggtactgattctcaagctttcccgagcgtttcaaaaccaagcagtgcttatcctagcacaaccatcgtgaaccccaccatcgtgctgttgcaacacaatagagaacagcagaaaaggctgagtagtttgagcgacccggttagtgagcgacgtgtcggagagcaagattccgctcctacccaggagaagccaacgtctcccggcaaagccatagagaaaagggccaaagatgactctagacgtgtggtcaaaagcactcaggacttgagcgacgtcagcatggatgaggtcggcatcccactcaggaataccgagaggtccaaggactggtacaaaaccatgtttaaacaaatccacaagctcaatagagatacacccgaggagaacccatatttccctacctacaaattccctgagctgccggaaatacaacagacaagcgaagaggataacccttacacgcctacataccaattccccgcctcaacgcctagccccaaaagtgaggatgatgattccgacctgtactctccgcggtactctttttccgaagacacgaagagccctctgagcgtgcctcgatctaagtctgagatgtcatacatcgacggcgagaaggtagtgaagcgatctgccacgttgcctttgcccgcacgttcttctagccttaagtcttccagtgaacggaatgattgggagccaccagacaagaaggtggacacaaggaagtatagggccgaacctaagagtatttacgaatatcagccgggtaagagttccgtactaaccaatgagaagatgagcagggatattagccctgaggagatcgacctaaagaacgagccatggtacaagttttttagtgagctggaattcggcaagccgccacccaaaaagatctgggattataccccaggtgattgctcaatcctgccccgagaggatcgcaagaccaatctcgataaagacctttctctgtgccagacagagcttgaggcagatctggagaagatggagacactaaataaggctccttccgccaacgtgcctcaatctagcgcaatcagcccaacacctgagattagtagcgaaacccctggttacatttactctagcaactttcatgcagtcaagagagaaagcgatggagcccctggtgacctgacctcactcgagaatgaacggcaaatatacaagtctgttctggaggggggcgatattcccctccagggtctctcaggtctgaagcgacctagttcctctgcatccacaaaggacagtgaatctccaagacatttcattccggcagactacttggagtcgaccgaagagttcatccgccggaggcatgatgacaaagaaaagctcctggccgaccaacgccggctgaaacgtgagcaggaagaggctgacatcgctgctcgccggcacacgggggtaattccaacccatcaccagttcataaccaatgagcgattcggcgacctcctgaacatagacgacaccgctaagcgcaaatcaggaagcgaaatgagaccggcccgggcaaaatttgattttaaggcgcagacactcaaagagctgcccctgcaaaagggtgatatcgtttatatttacaaacagatcgaccagaattggtacgaaggtgagcaccatggccgggtcggcatctttccacgcacctacattgagttactgccccctgctgagaaggcgcagcctaagaaactcaccccagtgcaggtgttggagtatggggaagcaattgcaaagttcaacttcaacggggatacccaggtggagatgagtttcagaaagggtgagaggattacccttctcaggcaagtggacgaaaactggtacgaaggtcgaatacccgggacatctcgacagggcatcttccctatcacctatgtagacgttatcaaacgacctctcgtcaaaaatcccgtggactatatggatctgccattttcttcttctccttcaaggtccgcaacagctagcccccaatttagttcacactcgaaattgatcactcccgccccctccagcctgcctcactccagacgggccctgagcccggaaatgcacgccgtgacatctgagtggatctccctcactgtgggcgtcccagggcgcagaagtctggctctaactccccccttacctcctctacctgaagcctctatttacaacacagaccacctagcactgtccccacgtgccagtcctagtctttctctgagtctgccgcacctctcatggtccgaccggccgacgccccgaagcgtggcttcccctctcgcactcccaagtcctcataagacatacagtctggcgcccacaagccaagcgagtctgcatatgaacggtgacggcggtgtccacacaccgagctctggtatccaccaggactcttttctacagctgcccttaggaagctcggacagcgtgatttcgcaattatctgatgccttttcttctcaaagtaagaggcagccttggagagaggagagcggccagtacgagcggaaggcagagcgtggggcaggcgaaagagggcctgggggacccaagatctcaaaaaagagttgcctgaagcccagtgatgtagttcgatgcctgagcactgaacaacggttgagtgatcttaacacccctgaggaatccagacccggaaagcccctgggttctgcattcccagggtcggaggccgagcaaacggagagacacagggggggcgaacaagccggtcggaaggccgccaggaggggtggtagtcaacaaccgcaggcgcagcaaagaagagtgactcccgaccggtctcaaacttcccaggaccttttttcctatcaggccctgtactcatacataccgcagaacgatgacgaactggaactgcgggacggcgacattgtggatgtgatggagaaatgcgatgatggatggttcgttggcacctcaagacggacgaagcagttcgggaccttcccgggtaattacgtaaagccactgtacttatag

SEQ ID NO: 135735 - DNA, 2451 bp, Artificial Sequence
  Description of Artificial Sequence: Synthetic coding sequence
atgtccagcgagtgcgatgggggctccaaagcggtgatgaacggccttgcgccaggctctaatggccaggacaaggatatggatctgactaaaatatgtacaggcaagggagctgtgacactgcgagctagttcctcctacagagagacaccttcatcctctcctgcaagtccccaggaaactcggcagcacgagagcaagccagggttagagcctgaaccttcttccgcagacgaatggaggttgtccagcagcgccgacgcaaacggcaacgctcagccaagtagcctggctgctaaaggctaccggagcgtgcacccaaacctacccagcgacaagtcccaggacgccactagttcttccgccgctcagccggaagtaattgtagtacctttgtatctggtgaatacagacagggggcaggagggcaccgcccgcccccctacgcctctcggtccactgggatgcgtgcctactatccccgccaccgcctcagccgccagtcccctaacctttcctacactggacgatttcatcccaccgcacctccagcggtggcctcaccactcccagcctgccagggcttctggctcatttgcgcccatcagccagacgcccccctctttttcaccacctccacctctggtcccacctgctcctgaggatctccgcagggtgtctgagccggacctaacgggagctgtgtctagtacagactcttcaccgctgctcaacgaggtgagtagctccctgatcggcacagatagtcaggcctttccctccgtgagcaagccgtctagtgcttatccaagtacgacaattgtcaaccccactatagtgcttttacagcataacagagagcaacagaagagactttcctcattatcagatccagtcagcgagcggagggttggcgagcaggatagcgcacccacccaggagaaaccgacatccccagggaaagctattgaaaaaagagccaaagacgactctcgccgggttgtgaagtccactcaagatctctcggatgtaagcatggatgaagttggtatccccttgcgcaatactgaacgctccaaagattggtacaagaccatgtttaaacaaatccacaaattaaatagggacgacgactcagatctgtacagcccccgctacagcttctccgaagacaccaagagtccattgagtgtgcccaggtctaagtccgagatgtcttacatcgacggcgagaaggtggtgaagcgctcagcaacattgccgttacctgcacgttcttccagtttgaaatcaagctcagagcgcaatgactgggagcctcctgacaaaaaggtggataccaggaagtatcgggctgagccaaaatccatttatgaatatcagcccggaaagtcaagcgttcttacgaatgaaaaaatgagtagtgccatatcaccgacaccggagatttctagcgaaacacctggctatatttactcatccaacttccatgcagtaaagcgggagtctgatggcgcccccggagacctgacctccctcgagaatgagcggcagatttacaagtcagtcctcgaggggggggacattcccttgcagggactctctggcctgaaaagacctagtagctcagcctcgacgaaagattcagagagtccaaggcatttcattcccgcagattatctcgaaagcacagaagagttcatccggagacgccacgacgataaggagatgcgaccagcaagagctaagtttgatttcaaagcacagacacttaaggagctgccactgcagaaaggggatatagtgtacatttataagcaaatcgaccagaactggtacgagggagagcaccacggacgcgtcggtatcttcccccgaacctatatcgagctcttaccacccgccgaaaaagctcagcccaaaaaactcacacccgtgcaggttctcgagtacggagaggcaatcgcaaaattcaacttcaacggcgatacacaggtggaaatgtcattccgcaagggagagcggataacactccttcggcaggtagacgagaattggtatgaagggcgtatacctggcacctcgaggcagggaattttcccgatcacatatgtagacgtcataaaacggccgttagttaaaaacccagtggattacatggaccttcccttttcatcttctccatcccggtctgccactgcgtccccgcagcaaccccaagcccaacaaaggcgcgttaccccagatcgcagtcaaacttctcaggatctgttctcgtatcaggcactgtacagttatataccacagaacgatgatgaactcgaactccgggatggagatatcgttgacgtgatggagaagtgtgatgatgggtggttcgtgggaacgtctagacggacaaaacagttcggtacctttccaggtaactatgtgaaacccctgtacctgtag

SEQ ID NO: 135736 - DNA, 3015 bp, Artificial Sequence
  Description of Artificial Sequence: Synthetic coding sequence
atgagttctgaatgcgacggcggctctaaagccgtcatgaatggactggctcccggttcaaacggtcaggacaaagctaccgccgatccattgagagccagaagcattagcgcggttaaaataattccagtcaaaacagtgaagaatgcaagtgggctcgttctgcccaccgacatggacctcacaaagatctgtactggcaagggagccgttacgctacgggcctcctcgagctaccgcgaaaccccatctagctcccccgctagcccccaggaaaccagacagcacgaaagcaagcccgacgagtggagattatcgtccagtgccgacgcgaatggaaatgcccagccaagtagcctggccgctaaaggctaccgctctgttcacccaaatctcccttctgacaaaagccaggatgctacttcgtcctccgccgcccagcctgaggtaatcgtggtgccactctacttggtcaacactgatagggggcaagagggcactgctagacctcctacccctctcggaccgttgggctgcgtgcctaccattcccgccactgcttccgcagcctcgcctctcacttttccaacccttgatgactttataccacctcacctccagcggtggccccaccactcacagcctgccagagcgtcagggagttttgctcctatttcccagacacccccctcattttcaccccccccccccctagtgccgcctgccccagaagatctcagaagggtatccgagccggacctcacgggcgcagtgtcgagcacagattcaagtccgctactgaatgaagttagttcatcactgattgggaccgattcccaggcctttccgtctgtgtctaagccctcatccgcctatccctccaccacaattgttaatcccacaatcgtgttgctccaacacaaccgggagcagcagaagcgcctcagctctctatccgatccagtttccgaaaggcgggtgggagagcaggattctgcgccaacccaggaaaagcctacctcccctggcaaggcaatcgaaaaaagggccaaggatgattctcggagagtcgtcaagagcacgcaggatcttagcgacgtgtccatggatgaagtgggcattcctcttagaaacacggagcgctctaaggactggtataagacgatgtttaagcagatccacaagctcaatagagatacccctgaggaaaacccttacttcccgacatacaaattccctgaactccctgaaatccagcaaacatcggaggacgacgattccgacctctactccccgaggtactccttcagtgaggatacaaaatcccctctctctgttccccgctctaagtcagaaatgtcttacatagatggcgaaaaggtagtgaaaagaagtgctactctgcccctgccagctcgaagtagttccttaaagtcctcgagcgagcgaaatgattgggaaccacctgataagaaggtcgatactcggaaatacagagccgagcctaaaagtatctacgagtaccagccaggcaaatcaagcgttctcactaatgaaaagatgtcccgggatataagccccgaagagatcgacctcaagaacgagccttggtacaagtttttttctgagctggagtttggaaagccaccccccaaaaaaatctgggattatacaccgggcgactgcagtattctgcctcgcgaagatcggaagacaaatctcgacaaagatctttccctgtgtcagacagagctggaagccgacttagaaaaaatggaaacactgaataaggctccatccgctaatgtgcctcaaagcagcgctattagtcctacacctgaaatcagctcagaaacccccggctatatttactctagcaattttcacgccgtgaagagagagtctgatggagcgccaggcgatttgacctcgttggaaaacgagagacagatctacaaaagcgttctcgaaggaggcgatattcctctgcaggggttgtcagggctaaaacgcccctcaagcagcgcttcaacaaaggattctgagtcccccaggcactttatacccgccgattatttagaaagcaccgaagagtttattaggcgaagacacgatgacaaggaaaagcttcttgcagaccagcggcgcctgaagcgcgagcaggaggaggccgatatagccgcacggcgccacacaggggtgattcctactcaccaccagtttatcacaaacgagagattcggtgatctgctgaacattgatgacactgctaaaaggaaatctggtagtgaaatgaggcccgctagagccaagtttgattttaaagcacagaccctaaaagagctgccccttcagaagggagacattgtctacatctataaacagatagatcaaaattggtatgagggtgagcaccatggccgggtaggtatttttccaagaacctacatcgaattgctgcctccagcagagaaggcccagccgaaaaaattgaccccagtccaggtgctggaatacggagaagctattgctaagtttaacttcaacggcgatacccaggttgaaatgagttttaggaagggcgagcggatcacattgcttagacaggtagatgagaactggtacgaagggaggatacccggaacaagcagacagggaatttttcccatcacttacgttgacgtcatcaagcgccctctcgtaaagaacccagtggactacatggacttaccattctcaagctcgccgtccaggtctgcaaccgcttccccgcagcagccacaggctcagcagaggagagtcactccagacagaagccagacatctcaggatctattttcctaccaggccctttacagctatatacctcagaacgacgatgagctggaactgcgcgatggcgacattgttgatgttatggaaaaatgcgatgacggctggtttgttggaacttcaagacggaccaaacagtttggaaccttccctggcaattacgtgaagcctttgtacctctag

SEQ ID NO: 135737 - DNA, 2016 bp, Artificial Sequence
  Description of Artificial Sequence: Synthetic coding sequence
atgcagggacccccacggagcctgagggccggcttgagtttggatgactttattccagggcatctgcaaagtcatattggcagttctagcaggggtacgcgggtccctgtgattcggaacggcggcagcaataccctcaacttccagtttcacgaccccgcacccaggactgtttgcaacggcgggtacacacctcgcagggatgcatcccaacatccagacccggcgtggtatcagacctggccagggcccggaagcaaaccaagcgcctccaccaaaatacctgccagccagcatactcagaattggagcgcgacgtggaccaaagactcaaaacgacgagacaaaagatgggtgaagtacgaaggcataggccccgttgacgaaagtggcatgcctatcgctccgaggtcatccgttgatcgtccccgggactggtatagacggatgtttcagcaaattcatcgaaagatgccagacctacagctcgactggacttttgaggagccgcccagagatcctcgacatctaggggcacagcagaggcctgcccaccgacctggccccgcaacctctagttcaggtcgctcttgggaccactccgaagagctgccacggtccacttttaactaccggccaggcgcattttctactgtgctgcagccttctaaccaggttctgagaagacgagagaaagtggataatgtatggaccgaggaatcctggaatcagttcttgcaggaattagagactgggcagaggccaaagaagccattagttgacgacccaggagagaaaccgtcccagcccatcgaagtgctgttggagagggagctcgctgaactgtcagcagaacttgataaggacctacgtgccattgagaccagactcccttcacctaagtctagtcccgcacccagacgcgctcccgaacaaaggccccctgctggacccgcctccgcctggtctagttcctacccacatgctccttatttgggttctgctcggagtctttcaccccacaaaatggctgatgggggctcgccttttctcggaagaagggacttcgtttacccctcaagcaccagagacccaagcgccagcaatgggggggggagtccagccaggagagaggaaaagaagaggaaagctgctaggctgaagttcgattttcaggcccagtctccaaaagagctgacattacagaaaggggacatcgtctatatccataaggaggtggacaagaattggctagagggagaacaccacggccgcctcggcatctttcctgctaactacgtggaggtattacctgccgacgaaattcccaagccaattaaacctcctacgtatcaggtgttggagtacggggaagcagttgcccagtacacctttaagggcgacctggaggttgagctgagcttccgcaagggtgaacatatttgtttgattcggaaggtgaacgagaattggtacgagggaaggatcactggcacaggcagacagggaattttcccagcctcatacgtgcaagtgagtcgggaaccgcgcctgcgcttgtgtgatgatggtccacagttacccacctcacctcgattgaccgccgccgctagaagcgccagacatccaagctcgccctccgccctgcggagcccagccgacccaatcgatttaggcggacagacttccccaaggcgcaccggcttcagctttccaacccaggagccgagaccgcaaacccaaaacctggggacacccggtcctgcattatcacattcccggggaccctctcaccctctcgacttgggaaccagttcacccaacacctctcaaatccactggaccccttaccgcgccatgtatcagtatagaccgcagaatgaggacgaattggagctaagggagggggatagagtggatgtgatgcagcagtgcgatgatggctggtttgttggagtgagtaggcgtactcagaagttcggaaccttccccggcaactatgtggccccagtgtag

SEQ ID NO: 135738 - DNA, 990 bp, Artificial Sequence
  Description of Artificial Sequence: Synthetic coding sequence
atggccgacggaggaagtccattcctgggccgcagggatttcgtctacccttccagcaccagagatccgagcgccagtaatggaggaggctccccggccaggagagaagagaaaaagcggaaagcagcaagactgaaatttgactttcaggcccagtctccaaaagagctgaccttgcagaagggagatattgtgtacatccacaaggaggtggataagaactggctcgagggagagcatcatggtcgcctgggaatctttcctgctaactatgtagaggtcttgcctgcagacgagattccaaagccaatcaagccgcccacataccaggtgttggagtatggcgaggcggttgcacagtacactttcaagggagatctggaggtggaactctcttttaggaagggagagcacatttgtctcatccgaaaggtcaatgagaattggtacgagggccggatcacaggaaccggacgccagggaatttttcccgcatcttacgttcaggttagcagggagccgcgtttacggctgtgtgatgatggccctcagctgcctacgagcccacgcctgacagccgccgccagaagtgccaggcacccatctagcccctctgcgcttcgaagccctgcggacccaatagatctgggaggtcagaccagtcctcgtcgcacagggttctcttttcccacccaggagcctagaccccaaacccagaatttagggacacctggtcccgctttatcacattctcgcgggccgtcacatcctctggacctgggcactagtagccccaacacgtctcaaatccattggaccccgtaccgcgcaatgtatcagtaccgccctcagaatgaagatgagctcgagctgagggaaggtgatagggtcgacgtcatgcaacaatgtgacgatggctggttcgtgggcgtatctagaagaacacagaaatttgggactttcccaggcaactacgtggcgccagtttag

SEQ ID NO: 135739 - DNA, 1074 bp, Artificial Sequence
  Description of Artificial Sequence: Synthetic coding sequence
atggccgcggctgcaaaacccaataatctgtccctagtcgtgcacggaccaggcgatctaagattagagaactatcctataccagagcctggtccaaacgaagttttgttgcgaatgcactctgtcggaatatgtgggagtgacgttcattactgggaatacggtcgcatcggcaacttcatcgtgaagaagcccatggttctgggtcacgaggccagcggaactgtcgagaaagtgggcagctctgtcaagcatcttaagcccggtgatcgagttgcgattgaaccgggagcccccagggagaatgatgagttttgcaagatgggccgatacaacctctcaccatccattttcttctgtgcaacccctccagacgatgggaatctctgtaggttttacaagcataacgctgctttttgctacaaattacctgataacgttacctttgaggaaggtgctctaattgaacccctgtctgtggggatccacgcttgtagaaggggcggtgtgacgctgggccacaaggtgctggtttgtggcgccggccccattggaatggtgacactgttagtggctaaagccatgggggcagctcaggtggtggtcaccgacttgtctgccacgagactctccaaggcaaaggaaatcggggctgatctagttctgcagatctcaaaagagtcacctcaggaaatagcccgcaaggtggagggccagttaggctgcaaaccagaggtgactatagagtgtaccggggctgaggcttctattcaggccggaatctatgcaacgaggtcggggggcaaccttgtgctcgtgggcctaggatcagagatgaccacagtgcctctgctccatgcagctataagagaggttgatattaagggtgttttccggtactgcaatacatggcccgtcgcaatatccatgctcgctagcaaatcagtcaatgttaagcctctggtaactcacagattccccctcgaaaaggcgctggaggcctttgagacttttaaaaaaggattaggcctgaagatcatgctgaagtgcgaccccagtgaccagaacccatag

SEQ ID NO: 135740 - DNA, 597 bp, Artificial Sequence
  Description of Artificial Sequence: Synthetic coding sequence
atggcctacccagggcatcctggggcgggcggcgggtactaccccggaggctatgggggcgcgcccgggggccctgccttccctgggcaaacccaagacccgctttacggttactttgctgctgtcgccggccaggacggccaaattgacgcggatgagttgcagaggtgcctcacccaaagcggtattgccggtgggtataaaccattcaatctggaaacttgccggcttatggtctcaatgctagatcgggacatgagtggcactatgggcttcaatgagttcaaagagctctgggctgtcctgaacggctggcgacaacactttatctcctttgacactgatcggtccggtacggtcgatccccaggagctccaaaaggctttgacaaccatgggctttaggctgtcccctcaggccgtgaacagcattgcgaagcgctatagtacgaatggaaagataacctttgacgattacattgcctgctgcgtgaagctccgcgccctgactgactcatttcgcagacgcgataccgctcagcagggcgtggtaaacttcccatatgacgatttcattcagtgcgtaatgtctgtttag

SEQ ID NO: 135741 - DNA, 552 bp, Artificial Sequence
  Description of Artificial Sequence: Synthetic coding sequence
atgcagtacgggggcgccccgggagggcctgccttccctggccagacccaggaccccctctacggctactttgccgcagtagctggccaggacggccagatcgacgccgatgaattacaaagatgcttaacacaatctggtattgcaggggggtacaaaccctttaatttagaaacatgccgcctgatggtctcaatgttggacagggatatgtcaggcactatgggtttcaacgagttcaaggagttatgggccgtcctgaacggttggaggcagcactttatttcctttgacacagatcggtcagggacagtcgatccccaggagctacagaaggctctgactaccatgggttttcgcttatcacctcaagccgtgaacagtattgccaaaaggtattccaccaacgggaaaatcacctttgacgattatatagcctgttgcgtgaagctgcgcgcgctcactgattctttcagaagacgggacaccgcccaacagggcgtggtgaacttcccttatgatgattttatccagtgtgtgatgtctgtttag

SEQ ID NO: 135742 - DNA, 543 bp, Artificial Sequence
  Description of Artificial Sequence: Synthetic coding sequence
atgcagtacggcggtgcccccgggggtccagccttcccaggtcagactcaagacccattatatggatacttcgccgccgtcgcaggtcaagacggccagattgacgccgatgagctgcaacgctgcctaacacaatctggaattgcaggcgggtataaaccctttaacctcgaaacttgtagactcatggtgtccatgttggatagagacatgagcgggacaatgggttttaatgagttcaaagagctgtgggctgtgctgaacgggtggcggcagcactttatatcatttgatactgatcggagtggaaccgtggatccccaggagctgcaaaaggccctgaccaccatggggtttagacttagcccccaggcggtcaacagtattgccaaaagatacagcacaaacggaaagatcacctttgatgactacatcgcctgctgcgtaaagctgcgtgcccttaccgattcttttcgcagaagggacacagcccagcaaggcgttgtgaattttccatacgatgacgtatctctgcgcaattag

SEQ ID NO: 135743 - DNA, 6645 bp, Artificial Sequence
  Description of Artificial Sequence: Synthetic coding sequence
atggcaacacggagtagccggcgggagtcaagactgcccttcctttttacattggttgcactcttgccccccggcgcgctgtgcgaggtgtggactcagcgccttcatggcggcagcgccccactcccacaagacagaggatttctggtggtccagggcgatccaagagaactgcgtttgtgggctaggggagatgcacggggggcttcgagagctgatgaaaagccgcttagaaggaaacgaagtgctgctctccaaccagagccgattaaagtgtacggccaagtcagtctgaacgactctcataaccagatggttgtccactgggccggagagaaaagcaatgttattgtggccctggcaagagattccctggctctcgcccggccaaagtcatcagacgtctacgtgagctacgactatggaaaaagctttaagaaaatcagtgacaagctgaatttcggtttgggtaaccggtcagaggccgtgatagctcagttctaccatagtccagccgataacaagcggtatatctttgccgatgcctatgcacagtacctttggatcacatttgatttctgtaataccttgcagggattctcaattccctttcgtgccgccgatttactactgcacagtaaggcctctaacttgctactagggttcgatagatctcatccaaataagcagctgtggaaatccgacgattttggacaaacatggatcatgatacaagagcacgttaaatctttcagctggggtattgacccctacgacaaaccaaataccatttacattgaacggcacgaaccgtctggttactcaacggtgttcagatcaacggatttctttcagtcacgcgagaaccaggaggtgatcctggaagaagtccgcgacttccagttaagggataagtatatgttcgctactaaagttgtgcatctattggggtctgagcagcagagcagcgtacagctgtgggtgagcttcggcaggaagcccatgcgcgctgcccagtttgttacacgccatcctattaacgaatactacattgcagatgcgagtgaggaccaggtgtttgtctgcgtgtcccatagtaacaacagaactaacctctatatctccgaagcagagggtctaaaattcagccttagcctggagaacgtgttgtattactcgcccggcggagcggggagtgataccctggtaaggtatttcgcaaatgagccttttgcggattttcaccgggtagagggtctgcaaggcgtttacattgctacattaattaatggttccatgaacgaggaaaacatgagaagtgtgataacgtttgacaaaggcggcacctgggaattcctacaggcaccggctttcactggatacggagagaaaatcaattgtgaactcagccaggggtgctccctccatttggcccaaagactgagccagcttctcaatttacagttacgacgcatgccaatactgtccaaggagagcgccccgggcctcattatcgctacggggagcgtcggaaagaatctggcctcaaaaactaacgtgtacatctccagctctgcgggcgctcggtggcgcgaggccttgccggggccccattattacacctggggcgatcacggcggaattataacagccatcgcacagggcatggagaccaatgagcttaaatacagtacaaatgaaggtgaaacttggaagacattcattttcagcgagaaaccagtttttgtctatggactcctgactgagcccggggagaagagcacggtctttactatttttggcagcaacaaggagaacgtacatagctggctgatcctgcaagtcaacgcgacggacgccttaggggtgccttgcacagagaatgactacaagttgtggagcccttccgatgagaggggaaatgaatgtctcttgggccacaaaaccgtgttcaagcgccgcacgcctcatgccacgtgcttcaacggagaggacttcgaccgaccagtggtggtgtcaaactgctcatgcaccagagaggattacgagtgcgactttggcttcaaaatgtccgaagacctgtctctagaggtctgtgtgcccgaccctgaattcagcggcaagtcttacagtccaccagttccctgtccggtcggttcaacgtataggcgaacgaggggctatcggaagatcagcggagatacctgctccggtggcgatgtagaggcgaggctcgaaggggagctggttccatgccctctggccgaagagaatgaatttattctttatgccgtgcggaagagtatctatcggtacgacctggcgtccggcgccaccgagcagttgcctcttaccggactgagggccgcagttgcgctggattttgactatgagcataattgcctatattggtcagatctggccctggatgtgatccagcgcctgtgcctgaatgggagcaccgggcaagaagtcattattaactcaggcttagagaccgtcgaagccctcgcattcgagccacttagtcagttactctactgggtggacgccgggtttaagaaaattgaagtggctaaccccgatggcgacttcagacttacaattgtcaactcaagcgtgctcgaccggccgagggccctggttcttgtgcctcaggagggggtgatgttctggaccgattggggtgacctcaagcccggcatctacagatctaatatggacggatctgctgcatatcacctcgtgtcagaggacgtaaaatggcctaacgggatatccgtcgacgaccagtggatctactggacggacgcctatcttgagtgtatcgaacgcatcacgttttcgggacaacagaggtcagtgatcctggataatctgccgcatccatatgcaatcgctgtgttcaagaacgagatttattgggatgactggagccaactcagtatctttagggcctcaaaatatagcgggagtcagatggagatcctcgccaatcaactaactggcctgatggacatgaagattttctacaagggaaagaatacgggcagcaacgcctgcgtcccaaggccctgcagtcttctgtgcttgcccaaggcaaataactcacgttcttgcagatgtcccgaggacgtgtccagctctgtcttgccctctggggatctcatgtgtgattgccctcagggataccagctaaagaataacacctgcgtcaagcaggaaaatacttgcctgaggaaccaatatagatgcagtaacgggaactgcattaacagcatatggtggtgtgactttgacaatgattgtggggacatgtctgacgagcggaactgcccgactaccatctgtgatttggacactcagtttaggtgccaggaatctgggacctgtattccactctcttacaagtgtgatctagaagacgattgtggggacaattcggatgagagccattgtgagatgcaccagtgccgttcagacgagtataattgctcttcgggcatgtgtattcgttcctcctgggtctgtgatggggacaacgattgtagagattggtccgatgaagccaactgcacagcaatttaccatacctgcgaggccagtaactttcaatgccgtaatggacactgcatcccgcagcggtgggcatgtgacggggatacggattgccaggacggaagtgacgaagacccggtgaactgcgaaaagaagtgcaacggcttccgctgtcccaacggcacatgcatcccatccagcaagcactgcgatgggcttcgggattgctccgacggcagtgatgaacagcactgtgagcccctgtgtacgcattttatggatttcgtgtgcaaaaaccgacagcagtgcctctttcattccatggtgtgcgacggcattatccaatgcagggatggcagtgatgaggatgcggcattcgcaggctgtagccaggatcccgagttccacaaggtatgtgacgagtttgggtttcagtgccagaatggagtgtgcattagcctgatctggaagtgtgacggtatggatgactgcggggactatagtgatgaggcaaattgcgaaaatcccaccgaagccccaaactgttcgagatacttccagttcaggtgcgagaacgggcactgtatcccgaatagatggaagtgtgatagggaaaacgactgtggcgactggagcgacgagaaagactgtggagatagccacatcctgcctttctccacacctgggccatcaacctgcctccccaattactatcgatgtagttctggcacctgtgtgatggatacttgggtctgtgacggatatagggactgtgcagatggctccgacgaggaggcttgcccgcttctagctaacgtgacagctgcctctacacccactcaactagggcggtgtgacagattcgagtttgagtgccatcaaccaaaaacctgcatcccgaattggaaacgttgtgacgggcaccaggattgccaagatggacgggacgaagcgaattgccccactcactcaacactgacatgcatgagcagagagttccagtgcgaggacggcgaagcctgcatcgtgctctccgagagatgcgatggattcctcgactgtagcgatgagtctgacgaaaaggcttgttctgatgagttgaccgtgtacaaagtgcagaatttgcagtggaccgctgatttcagcggcgatgtgaccctcacgtggatgcgtcctaagaaaatgcccagcgcttcctgtgtctataatgtatattatagggtagtgggagaaagcatatggaaaacactggagacccactctaacaagaccaacacagtcctaaaagtgctgaaacctgacactacctaccaggtgaaagtccaggttcagtgtttaagcaaggctcataacaccaacgacttcgtgacgcttaggacacctgagggactaccggacgccccacgtaaccttcagctatccctgcctcgcgaggccgagggagttattgttggacattgggccccccctattcatactcacgggctgataagagaatacatcgtggagtactcgcgttccggaagcaagatgtgggccagtcagcgggctgcaagcaatttcactgaaattaagaatctgcttgttaatactctatatacagtgcgcgtcgcggccgtgacctctcgcggcatcggcaattggagtgactctaagtcaataacaaccataaaaggcaaagtcatcccaccacctgatatccacatcgatagctacggcgagaactacttgtccttcacgttaactatggagtccgatatcaaggtaaatgggtacgtcgtcaacctgttctgggccttcgatacacacaagcaggagaggaggacccttaacttcagagggagtatcttgagccacaaagtgggcaatctcacagcccacacgagctacgagatatccgcctgggccaaaaccgatcttggcgacagtcccctagccttcgaacacgtaatgactcgcggtgtgcggccaccagccccttcccttaaagcaaaggcaatcaatcaaaccgcggtagaatgcacctggacaggaccacggaatgtggtgtacgggatcttttatgccacaagtttcttggatctttataggaaccctaagagtctaacaacctctctgcataacaaaaccgtgatagtgtctaaggatgaacaatacctttttctggtccgggtggtcgtgccctatcagggaccctcatctgactacgtggtggtcaaaatgattcccgacagtaggttgccccctaggcatcttcacgtcgtgcatactggaaagacaagtgtagtgatcaaatgggaatctccctatgattccccagaccaggacctgttgtacgccgttgcggtgaaggatctgatacggaaaaccgaccggagctacaaagttaaatccaggaactccacagtagagtacaccctgaacaaactggagcccggagggaaataccatattatagtgcaactcggaaatatgagtaaagactctagcattaagattacaacagtctctctgtccgcgcctgatgccttaaagatcattaccgagaacgaccatgtgctcctgttctggaagagccttgccctgaaggaaaaacacttcaacgagagccgcgggtatgagatccatatgtttgacagcgccatgaatatcactgcctacctcggaaacacaacagataactttttcaaaatatccaatctcaaaatgggccacaactacaccttcacggtgcaggccagatgcctctttggtaatcagatttgtggagagccagcaattctactgtacgatgaactggggagtggcgctgatgcttccgctacacaggccgcccgctctacagacgtagctgcagtcgtggtgcctatcctgtttcttatcttattgtcactaggtgttggttttgccatcctctacactaaacatagacggcttcagtccagtttcacagcgtttgctaattctcattacagctctcggttgggtagcgccatcttttcttctggcgatgatctgggggaggatgatgaagatgctcccatgattactgggttttcagatgatgtaccgatggtcatagcatag

SEQ ID NO: 135744 - DNA, 3507 bp, Artificial Sequence
  Description of Artificial Sequence: Synthetic coding sequence
atgggcaaggtgggagctggtggcggctctcaggcccgattgagcgcccttttagctggagccggtttgttaatactgtgtgcacccggcgtgtgcggaggcggatcttgctgcccctcaccccatcctagttctgccccacgctccgcctccacccccagggggtttagccatcagggccggcccggtcgagctcctgccactccactccctcttgtggtgcgcccgctcttctctgtggctccgggtgacagagctctcagcctagagcgggctagaggaaccggcgcttccatggcagtggcagccagatccggccgccgacgccgcagtggagcagaccaagagaaggcggagcgaggggaaggggcctctaggagccctcgtggcgtgttaagggacggaggccaacaggaacctggaaccagggaaagagatcccgacaaggcaacacgctttcgaatggaagagttgcgcctgacatcaacaacattcgctctcacgggcgactctgctcacaatcaggccatggtgcactggagtggccacaactctagcgtaatccttatccttacaaagctgtacgattacaacctggggtccatcaccgaatccagcctctggcgctctactgattacggtacgacttacgaaaagctgaacgacaaggtgggtctgaaaaccatccttagttatctgtatgtctgccccaccaacaaaagaaaaatcatgttactgacagatcctgagatagaaagctccctgctgatttcgtccgacgaaggcgctacttatcagaaatatagactgaatttctatatccagagcttactcttccaccctaagcaggaggactggatcttagcctattcccaggatcaaaaactatactcctccgccgagtttggcaggaggtggcaactcattcaggagggagtcgtcccaaaccggttttactggtccgtgatgggatccaacaaggagcctgacttggtccacctcgaagctaggacagtcgatggtcactctcattatctgacttgcagaatgcaaaattgtacggaggctaaccgcaaccagcctttccctggatacatagacccggattcacttattgtgcaagaccactacgtatttgtccagctcacttccggcggcaggccacattactatgtgagttacagacgcaacgcttttgcccagatgaagctgccaaaatacgccctccccaaggacatgcacgtcatctcaaccgacgagaaccaagtctttgccgccgtgcaggagtggaatcagaacgatacttataacctgtatataagtgatacaagaggcgtttactttactctagccctggaaaacgtgcaaagcagccgcggacccgaagggaacatcatgattgatctgtatgaggttgccggcataaaagggatgttcctagctaacaaaaaaatagataaccaggtgaaaaccttcataacatataacaaggggagggactggagactgcttcaggccccagataccgatctgcgaggcgatcccgttcattgtttattgccttattgtagtctccacctccatcttaaagtgtcagaaaatccttacacgtccggcatcattgcgagtaaagataccgcaccctccatcatcgtggcctctggaaacatcggatctgagctgtcagacactgacatctcaatgtttgtgtcttccgacgccggcaacacctggcgccagatctttgaggaggagcactccgtgctgtatctggaccaaggaggggtgttggtggccatgaaacacactagtctgcctattcggcacctgtggctcagtttcgatgagggtcggtcctggagcaagtacagttttacatccattcctctgttcgtggacggcgtgctgggggagcccggtgaagaaacactgattatgaccgtgttcggtcacttctcccaccgtagtgaatggcagctggttaaggtcgattacaagtcaattttcgataggagatgtgctgaagaggactaccgcccctggcaattgcattctcagggtgaagcctgtatcatgggggcaaaacgaatttacaagaagcggaaatctgagagaaaatgtatgcagggaaagtatgccggcgccatggagagcgaaccctgcgtgtgcacggaggctgactttgattgcgactacggatatgaacgacacagtaatggacagtgcttgcccgcgttctggttcaatccctccagcctctcaaaggactgtagcctgggtcagtcctatctgaactctaccggctacagaaaagtggtgagcaacaattgtacagatggagtccgagaacagtacaccgccaaaccacagaaatgccccggcaaggcccctaggggtctgcggattgtgaccgcagatggcaaactgaccgcagagcagggacacaacgtcactttaatggttcagctggaggagggcgatgtgcagagaaccctgatacaggtggactttggagacggcattgctgtctcgtatgtcaacctctcatctatggaagatggtatcaaacacgtttatcagaatgtgggaatctttagagtgacagtgcaggtagacaattctctgggctcagactctgccgtgctgtacttgcacgtgacttgtcccctggagcacgtacacttaagtttgccattcgtgactacaaaaaacaaggaggtgaacgctaccgcagtgctttggcctagccaagtggggaccttaacttatgtgtggtggtacggcaacaatactgaacccctcattacacttgaagggtctatttcttttcggttcaccagcgagggaatgaacaccattactgtacaggtaagcgcagggaacgccattctgcaggacacaaaaaccattgctgtgtacgaagaattccgctcactgaggttgagcttctcgcctaacttggacgactacaaccccgatatccctgagtggagaagggatatcggtcgcgttattaagaagagcttggtggaggcaactggagtgcctggccagcatattctcgtggctgttctccccggtctaccaacgacagcggaactttttgtccttccttatcaggacccagctggagaaaacaagcgcagcaccgacgatctcgagcaaatcagcgagctgctgatccatacccttaaccaaaattctgtccattttgagctaaagccaggagtgagagtgttggtgcatgctgcccacctgactgctgctccgctcgttgacttgacccccacacactctggatctgctatgctgatgctgctgtccgtcgtgttcgtggggctggcagtgtttgttatctataagtttaaacgacgagttgcgctcccgagtccgccctctccatccactcagccaggcgacagcagcctgcggctccagagggctagacacgctacaccacccagtactcccaaacgggggtctgcaggtgcacagtacgccatctag

SEQ ID NO: 135745 - DNA, 3597 bp, Artificial Sequence
  Description of Artificial Sequence: Synthetic coding sequence
atggggaaagtcggggcaggtggaggctctcaggccagactgtccgccctgttggctggagccggattgctcattctttgtgcccctggggtgtgtggagggggatcctgctgtccttcaccgcatcctagtagtgccccccgaagcgcatcaactcccagggggttctcacatcagggccggccaggccgagcccccgccactccccttccactagtagttaggccactcttcagcgtagccccaggcgatcgcgccctgagtttagaacgcgcacggggtaccggtgcaagcatggcagtggccgctcgcagcggccgtcggcgaagaagtggtgcagaccaggagaaagcagagagaggtgagggcgccagtcgctctccaagaggggtgttgcgggacggggggcagcaggagcccgggacaagagagagagaccccgataaggccaccagattcaggatggaggaactgcgacttacttctacaacatttgcgttaaccggcgactctgcccacaatcaggccatggttcactggtctggacacaactcatctgtgatcctcatactgacaaaactgtacgactataacctgggatctattacggagtctagtctctggcgatcgactgattatggaacaacctatgaaaaattaaatgacaaagtcggattgaaaaccatcttgagttacctttacgtgtgcccaaccaacaagagaaaaattatgctccttacagatcctgaaatcgaatcctcgttacttatctctagtgacgagggagccacttaccagaagtatcgcctcaacttttatattcagtcccttctctttcaccctaaacaagaggattggattctcgcttactcgcaagaccagaaactctactcaagtgcggaattcggccgtcgttggcaactcattcaggagggagtggtgccaaaccggttttattggtcagtaatgggaagcaataaggagcctgacctggtccacctcgaggcaagaactgtcgacggccactcgcattatctgacatgtcgcatgcagaattgcacagaagctaatcgtaatcagccatttcctgggtatattgaccccgatagcttgatcgtacaggaccactacgtattcgtccagttgacttccggcggacgaccacactactatgtgagttatcgaagaaatgcattcgcacagatgaagttgccaaagtatgctctacccaaagacatgcatgtcataagtactgatgaaaatcaggtgttcgcagcggtccaggagtggaaccagaatgacacttataacctgtacatctccgacacgaggggtgtgtacttcaccttggccctggagaatgtgcagtcgagccgaggccccgagggaaacattatgattgacctgtatgaggtggcaggaatcaagggtatgttcctcgctaataagaagatcgataatcaagtcaagacctttattacctacaacaaaggtagagactggcgactcttgcaagctcccgacacagatctgagaggtgacccggtgcattgcctgctgccctactgctcgttacatttacacctgaaggtgtctgagaacccctacaccagcggcattatcgcgagtaaggacacagccccttctatcatcgtcgcctccgggaacattggaagtgagttgtcagatacggatatctcaatgtttgtctcctcagatgccggcaacacatggaggcagatattcgaagaggaacattcagtgctctacctcgaccaagggggcgtactggtggccatgaagcacacctcgctacccattcggcacctgtggctctcattcgacgaagggagatcctggtccaaatatagctttaccagcattcctctgtttgtagatggagtgctcggagagccgggcgaggaaaccctgattatgacagtttttggacactttagtcaccggagtgagtggcagctcgtgaaggtagattacaaatccatttttgaccggcgttgcgccgaagaagactatcggccctggcagttgcacagccagggcgaggcctgtataatgggcgccaagcgcatctataagaaacggaaaagcgaacgaaaatgtatgcagggcaagtacgccggagctatggaatcagagccttgtgtgtgcacagaagccgacttcgactgcgactatggctatgaacgtcactcaaacgggcagtgcctgcctgcattctggtttaacccttccagtttgtcaaaggattgcagcctaggacagagctatctgaacagcacagggtacaggaaggtcgttagcaataactgcacagatggggtgagagagcaatatactgccaagccccagaagtgtcccggcaaagctccccggggtctgcggatcgttacggcagacggcaaactgactgccgagcagggacataatgtgacactcatggtgcagttggaggaaggcgacgtccagcgaacgctcatccaggtggatttcggggatggaatagcagttagctacgtaaacttgagttcaatggaggatggaatcaagcacgtgtatcagaatgtgggcattttccgggtaaccgtacaggtcgacaacagcctcggatcagatagtgctgtcttgtatctccatgttacatgtcctcttgaacatgtccatctgagcctgccattcgtaacaaccaaaaacaaggaggtgaatgcaactgctgtgctctggcctagtcaggttggaacacttacttacgtctggtggtatggcaataatacagagcctctgatcacgttggagggtagtatcagcttcaggttcacaagtgagggaatgaataccatcacggtccaagtctccgccgggaacgcgatacttcaagacactaagaccatcgccgtgtacgaagagttccgttcactgcggctcagcttttcaccgaaccttgatgactacaatcctgatattcctgaatggcgcagagatattggacgcgtgatcaaaaaaagtttagtagaggccacgggcgtacccggacagcacatcctcgtagcggtccttccaggtttgcctactaccgccgagctcttcgtgctaccgtatcaggaccctgccggcgagaataagaggagcactgatgatctggaacaaatctctgagctccttatccatacgcttaaccagaactccgttcatttcgaactgaagccaggtgtgagagtgctggtacatgccgctcatctcactgctgctccgctagtggacctgactcccactcactccggcagtgctatgctaatgctcctatctgtggtatttgtgggtctggcagtgttcgtcatttataagttcaaacgaaaaattcctgggattaatgtatatgcacagatgcagaatgagaaagagcaggagatgatcagtcccgtgagccacagtgaatccagacctaacgtgccacagacagagctgagaagacctgggcagctgatagacgaaaaagtggagagtcagctcattggaagcatctccattgtggctgagaaccagtccaccaaggagatccctacatacgttaacgtgtag

SEQ ID NO: 135746 - DNA, 2145 bp, Artificial Sequence
  Description of Artificial Sequence: Synthetic coding sequence
atgattgatttatacgaggtggctgggatcaaaggaatgttcctggcaaacaagaaaattgacaatcaagtcaaaaccttcataacttataacaagggaagagattggcgactgctacaggcccctgacaccgatctgcgtggggaccccgtccactgcctcttgccctactgctccctgcacctgcatcttaaggtcagcgaaaacccttacacatctggcatcatagcaagtaaggataccgccccatcgattatcgtagcatccggcaacattgggagcgagttgagtgatacagatatcagcatgttcgtgtctagcgacgctgggaacacatggcggcaaatattcgaagaggagcactccgttctttatcttgaccagggcggagtattagtcgccatgaaacatacctctctgccgatcaggcacctgtggctctcctttgacgagggcagatcatggagtaaatattcatttacctctattccactgtttgtggatggagttctcggagagccaggcgaagaaaccctgataatgacggtattcggccatttttcccaccggagcgagtggcagttggtcaaagtggattataagagcattttcgaccggagatgcgccgaagaggattacagaccttggcaactgcactcccaaggcgaagcttgcatcatgggagctaagcgcatttacaagaaacgtaagtctgagagaaaatgtatgcagggcaagtacgccggagcaatggagtccgagccatgcgtctgcactgaagccgacttcgactgcgattatggatacgagaggcactctaatggccagtgtcttcccgctttctggttcaatccttcatctctgagcaaggactgctcactgggtcagtcctacctcaattcaaccggctaccggaaggtcgtctccaataattgtaccgacggagttagagaacagtacaccgccaaacctcagaaatgccctggaaaggccccaagggggcttagaattgtgaccgccgatgggaagctgacggccgaacagggccacaacgtgaccctgatggtgcagctggaagagggagacgtgcagcgcacacttatccaggtcgactttggcgacggcattgccgtaagctatgtgaatctctcttcgatggaggacggtattaagcatgtctaccagaacgtgggcatctttcgcgtcaccgtgcaggtggacaattcgctcggcagcgacagtgccgttctgtatctccacgtgacttgccccctggagcacgtgcacctgagtttgccctttgtcacaactaaaaataaggaggttaacgctaccgccgtgctttggccctcccaggtgggcacattaacatacgtgtggtggtacggtaataacaccgaacctctgatcacgctggaagggtccatctccttccggttcacctccgagggcatgaacactattacagtgcaggtgagcgccggaaatgccattctgcaggacaccaagactattgctgtttatgaggaatttcggtctttgaggctctcattctcacctaacttagatgactataatcccgatatccccgaatggagacgggacattggaagggtcataaagaaatctcttgtggaagccaccggtgttcctggccagcacatcctcgtggcagttctgccgggcttacccactaccgctgagttgttcgtgctgccgtaccaggaccctgccggagaaaataagagatctactgacgatctagaacagatatccgagttgctcatccacaccctgaaccagaatagcgtgcactttgaactcaagccaggggtaagggtgctggtccacgctgctcacctgacagccgcacccctcgtagacctgacgcctacccacagtggttccgcaatgctgatgcttttgagtgtggtgttcgtggggctggcagttttcgttatctacaagtttaagcggaaaattccgggtatcaacgtttatgcccagatgcaaaacgagaaggaacaggagatgatcagcccagtcagccactctgagagcagacccaacgtgcctcagaccgagctgcgtcggcccggtcagctcatcgatgagaaggtggagtcacagctgatcggcgagtag

SEQ ID NO: 135747 - DNA, 642 bp, Artificial Sequence
  Description of Artificial Sequence: Synthetic coding sequence
tgactagatgattacaacccagatattcctgagtggaggagagacataggccgggttataaagaaatcccttgttgaggccacgggggtgcctggtcaacacatactggtggcagttctgcctggtcttcccaccaccgccgagctctttgttttaccataccaggacccagcaggggagaataaacgctctacagacgacctggagcagatctccgaactgctgatccatacccttaatcagaacagcgtgcacttcgaacttaagcctggagttagggtgttggttcacgcagctcacttgacagctgctcccctggttgatctgacccctacgcatagcgggtccgctatgctgatgctcctgagcgtcgtatttgtgggcttggcggttttcgtgatatataaatttaaacgcaaaattccaggaataaacgtgtacgcgcaaatgcaaaacgagaaggagcaggaaatgattagcccggtgtcccactccgagagcaggccaaatgtgccacagaccgagcttcgtcgcccaggccagcttattgacgaaaaagtcgagtctcaactcatcggatccattagtatcgtggctgagaatcagagcaccaaggagattcccacatacgttaacgtgtag

SEQ ID NO: 135748 - DNA, 3009 bp, Artificial Sequence
  Description of Artificial Sequence: Synthetic coding sequence
atgggaaaagtgctagagagcagcctttggagaagcagcgattttgggacaagctacaccaagctgacactgcagcccggggtaaccacagttatagacaacttttacatatgcccaaccaacaaaagaaaagtgatcttggtgagcagttccttatctgatagggatcagtctttgttcctgagcgctgacgaaggcgccaccttccaaaagcagcctattccgttctttgtggaaacactgattttccaccctaaggaggaagacaaggtgctcgcatacacgaaggagtctaaattgtatgtaagctcggacctgggcaaaaagtggactctgttacaggaacgggtgactaaagatcacgtgttttggagtgtttccggggtggatgccgatcccgacctggtccacgtggaggcgcaggatctcggcggagacttccgttacgtgacctgcgcaattcacaactgctcggagaagatgctgaccgctccatttgcgggacctatcgaccacggcagcctgaccgttcaggacgattacatcttcttcaaggccacttccgccaatcagacaaaatattatgttagctaccgcaggaatgagtttgtgctcatgaagctccccaagtacgctctcccaaaggatctccaaattatcagcacagacgagtcccaggtgttcgtagccgtccaggagtggtaccagatggatacgtacaatttataccagagcgatcccagaggagttaggtatgccctggtgttacaggacgtacggtcgagtcggcaagctgaggagagcgtattgatagatattctcgaggtgagaggggtaaagggagtatttctggccaaccaaaaaattgacgggaaggtgatgaccctgatcacctacaataaaggccgagattgggattatttaaggccaccttcaatggatatgaacggaaaaccaacaaattgtaagccacctgactgccacctccaccttcacttgaggtgggctgacaatccttacgtttccggaaccgtacatacgaaggacaccgccccaggcttgattatgggagcgggcaacctcggatctcagttagtcgagtataaagaagaaatgtacatcacctccgattgcggccatacatggcgtcaggtgtttgaggaagaacaccatatcctatatctggaccatggcggcgtgattgtggcaatcaaggatacatccattcccctgaagatcctaaaattttccgtcgacgagggtctgacctggtccactcataactttacctctacttccgtctttgtggatgggctgctttctgaacctggcgacgaaacgctggtcatgaccgtatttgggcacatcagttttcgctctgattgggaactggtcaaagtggatttccgtccatccttttctaggcaatgtggcgaggaagattactcttcttgggagctctccaatctacagggcgataggtgcataatgggacagcagcgatcattccgcaagaggaagtccacctcttggtgtatcaagggccgtagcttcacctctgctctgacttcaagggtctgcgaatgcagagattctgattttctgtgtgattatggcttcgagaggagcagcagttctgagtccagcactaataaatgttccgccaacttttggtttaacccgttgtctcctccagacgattgtgctctgggacagacgtacacatctagtttgggataccgcaaggttgtttccaacgtctgcgagggcggcgttgatatgcaacagagtcaggtgcaactccaatgccctctgacccctcctcggggtttacaggttagcattcagggagaagctgtggcagttaggcctggtgaggacgttctctttgtagtgaggcaggaacagggggacgtgctgacaaccaagtatcaggtggacctgggtgatgggtttaaggcaatgtacgtgaacttgacactgacgggggagcccatccgtcataggtatgagtcccctggcatctacagggtttccgtgcgagctgagaatactgccggtcacgatgaggcagtcctctttgttcaggttaatagccccctgcaggcgttatacctagaagtcgtgccagtgattgggctcaatcaagaggtgaatctcaccgctgtgctgctccctctaaatcctaatctgaccgtgttttactggtggatcggacacagcctgcagccgctcctctctctggataatagcgtgacgactagattctctgacacaggagacgtgagggtgacagtccaggccgcttgcggcaatagcgtcctgcaggacagtcgcgtactcagagtcctggatcagttccaggtcatgccactgcaattctcaaaagagctcgacgcttacaaccctaacaccccagaatggcgggaggacgtcggattggtcgtgacacggttgcttagtaaagaaacctccgtccctcaggaactactggttacggtggtcaagcctgggctgcctactctcgctgatttgtatgtgcttcttcccccaccacgtcccactagaaagagatctctcagcagcgacaagaggctggccgcaatccagcaagtgctgaacgctcagaaaattagtttcctgttacgtggcggggttagagtcctcgtggccctgcgcgatacgggcacaggggccgagcagctgggggggggcggcggctactgggctgtggtggtgctgtttgtgatcggtctgttcgccgctggtgcgtttattctctataaattcaagagtagaaagcggcccggacgaaccgtgtacgcacagatgcacaatgaaaaagagcaggagatgacgagtcccgtgtctcatagcgaggacgtccaaggggctgtgcagggagaggaatttatcgacgacgacctagattcacaaacattagggaaccatagtggtgtcgtgctgtccatcaattctcgagagatgcactcttatctcgtgagctag

SEQ ID NO: 135749 - DNA, 3480 bp, Artificial Sequence
  Description of Artificial Sequence: Synthetic coding sequence
atggcccatcggggtccctctagggccagcaaaggcccgggccccacggcccgggcgccctcccccggcgccccccctcctccaagatcacctcgctctcggcctctgctgctgcttctcctgcttctgggtgcttgtggtgccgcaggccgctctccagagccaggcaggctgggccctcacgcccagctcacacgcgtccctagaagccccccagctgggcgggccgaacctggaggaggagaagacagacaggctcggggtaccgagcccggagctcccgggcccagccctggccctgctccaggaccaggtgaggatggggcccctgccgccggatatcgccgctgggagagagccgcccccctggcaggtgtggccagccgcgcacaggtctccctgatttctactagcttcgtgctgaaaggagatgccacccacaatcaggccatggtgcactggacaggggaaaatagctcggtgatcctgatattgactaaatactaccacgccgatatgggaaaggtcctcgagtcttctctctggagaagtagcgactttggaacttcatataccaaactgacactccagcccggagtcaccacagtcatcgacaacttttacatttgcccaactaacaagagaaaagtgatccttgtatccagctctttgagcgacagggatcagtcccttttcctgagcgctgatgaaggggcgaccttccaaaaacagcctatccctttcttcgtagagactctgatctttcaccctaaggaggaagacaaggtattggcatataccaaggagtctaagctttacgtttctagcgacttaggcaagaagtggaccctcctgcaggagcgggtgactaaagatcacgtgttttggtccgtctccggtgtggacgccgatcctgacctcgtacatgtagaggcccaggacctagggggggattttcgctacgttacctgtgcaattcacaactgcagtgagaagatgctgactgcacccttcgccgggcctatcgaccacggctcacttactgtccaggatgattacatcttttttaaggctacttccgctaatcaaaccaagtattatgtgagctatagacgaaacgaatttgtgctcatgaagttgcccaaatacgcgctccctaaagatcttcagattatcagcacggacgagtcacaggttttcgtggcggttcaagaatggtatcagatggacacgtataacctctaccagagtgaccctcggggtgtgcgctacgctctcgtgctccaggatgttcgctcatccagacaggcggaagaaagtgtcctgattgacatcttagaagtgcgaggggttaagggggtcttcctagcaaatcagaaaattgacgggaaagttatgaccctaatcacatacaataagggacgcgactgggactatcttaggcctccatccatggatatgaatgggaaacccacaaattgtaaaccgccggactgtcatctgcatctccatttacgttgggcggacaacccgtacgtgagtgggactgtacataccaaggacacagcgcctggcctcattatgggggcagggaatctcggaagtcaattggttgagtacaaggaggagatgtacatcacgagcgattgcgggcacacttggagacaggttttcgaggaagagcatcatatcctctacctggatcatggaggagtgatcgtggctatcaaagacacctccattcccctgaaaatcctgaaatttagtgtggatgaaggcctgacctggagcacccataattttacttccacatcagtcttcgttgacggtctcctgagtgagccaggggacgaaaccctggtcatgacggtttttggacatatctctttcaggtccgattgggaattagtgaaagtggactttcgtccatccttttctagacagtgcggagaagaggattattcaagttgggagctgtccaacctgcagggagataggtgcataatgggccagcagaggagcttccgcaaacgcaaaagcacatcttggtgtatcaagggaagaagcttcactagtgccctcacatcacgcgtatgtgagtgtcgcgacagtgatttcctgtgcgattatgggtttgagaggagcagttccagcgagtcctccacaaacaaatgctcagctaatttctggtttaatccactgtcaccgccagacgattgcgccttgggacagacgtataccagcagcctcggttatcggaaagtggtgtctaatgtttgtgagggtggcgtggacatgcagcagtctcaagttcagctgcaatgccccctcactcctccgagggggctacaggtgtcaatacaaggcgaggcggttgcggttcgacccggagaggatgtcttgtttgtggtgagacaggagcagggagatgttctaaccaccaagtatcaggtggacttgggtgacgggtttaaggccatgtacgtgaacctgaccctcacgggcgagcccatacgtcacaggtatgaatcacccggcatttaccgtgttagcgttcgcgcggaaaacacggctggccacgacgaagcagtgttgttcgtccaggtcaacagccccctccaagctctgtaccttgaggtggtccctgtgattggtttaaaccaagaggtgaatcttacagccgttctgctgcccctgaacccaaatcttacagtcttttattggtggattggacatagccttcaaccgttgctatcccttgataacagtgttactacaaggttcagcgatactggagatgtccgcgttaccgtacaggcagcctgcggcaactctgtcctgcaagatagtagggtactccgcgtgctggatcagtttcaagttatgccactgcagttttctaaagaactcgacgcctacaacccaaatacccccgaatggcgtgaggatgttggattagttgtcactaggctgctgtcaaaagagacaagcgtacctcaagagttactcgtaacagttgttaaaccgggacttcccacgttagctgacttatacgtcttactgccacctcccagaccaacccggaaacggagtctgtcctccgacaagcgcttggccgcaattcagcaagtgctcaacgctcagaaaattagtttcctcttaaggggcggggtcagagtgctggtggccctgagggacacaggaacaggtgctgagcagctgggtggcggcggaggctattgggccgtcgttgttctgtttgtaattggcctcttcgcagccggtgcattcatactctacaaatttaagagaaagcgccccggccgtaccgtgtatgctcagatgcataacgagaaggagcaggaaatgacatcacctgtctcccattctgaggacgttcagggtgccgtgcaaggaaaccactccggcgtcgtgctaagcataaatagtcgcgagatgcactcatatcttgtcagttag

SEQ ID NO: 135750 - DNA, 594 bp, Artificial Sequence
  Description of Artificial Sequence: Synthetic coding sequence
atgggggagcggaagatcttcaagaagaggaaacctggcgcccagtgcgccctggggagagatcactcaggcagcgttgtctccgaaccctgtgtgtgtgctaactgggacttcgagtgcgattacggttacgagcgccacggtgagagccagtgcgtgcccgctttttggtacaaccccgcatctccatctaaggactgttctctcggtcagtcatacctgaattctaccgggtacagacggatagtgagcaacaattgcacagacggactgagagagaagtataccgcaaaagcgcaaatgtgtcccgggaaagctcctcggggcttgcacgtagtgacaaccgatggccgcctggtagcggaacaggggcataacgcaaccttcataattctgatggaagagggggacctgcagcgcaccaacattcaactagatttcggggacggaatcgctgtgagttacgccaacttttcccccatcgaagacggaatcaaacacgtatataagagcgcaggcatcttccaagtgactgcttacgccgagaacaaccttgggagcgacaccgccgtgctgttcctgcatgtggtgtag

SEQ ID NO: 135751 - DNA, 3669 bp, Artificial Sequence
  Description of Artificial Sequence: Synthetic coding sequence
atggaggcagctcggactgaacgacctgccggcaggccaggggccccactggtcagaacaggcctcttgctgttgagcacatgggtgctagcaggtgcagaaatcacctgggacgcaacaggcggccctgggcggccagcggcaccagcgtcaaggcctcctgccctgagtcccctgtcaccccgagcagttgcgagccagtggcctgaagaactggcatcagctaggagagccgctgtcttgggcagaagagccgggccagagcttctgcctcagcagggtggcggacgtggtggtgaaatgcaggttgaggccgggggcaccagccccgccggcgaaaggagagggagaggaatccccgcccctgctaaacttgggggagctagaaggtccaggagagctcagccccccattacacaggagaggggtgatgcatgggctactgcccctgccgacggtagcaggggctccagacccctggcaaaaggctccagggaggaggtgaaagctcccagagccggaggcagtgccgctgaagatttacgcctgcctagtacatctttcgcactcactggcgactcagcccacaatcaagccatggtccactggagcggacacaactctagtgtaatattgatcttgacgaagttatacgactttaacctggggtccgtgactgaaagctcactgtggcggtccaccgattacgggacaacatatgagaaacttaatgataaggtagggttgaagacagttctatcctacctgtatgtgaatccaacaaacaaacggaagataatgcttttgtccgaccccgaaatggagtcctcaattctcataagcagcgatgaaggagctacgtatcaaaaatataggctgaccttctatatccaaagcctcctgttccaccccaagcaggaagactgggtgctcgcttatagcctagatcagaagctgtactcatctatggacttcggcagacggtggcaattaatgcatgagaggatcacccctaataggttctactggtccgtggccggcctagacaaggaggctgatcttgtccatatggaggtgagaacgacagatgggtacgcccactatctcacctgtaggatccaagagtgtgcagagacgaccagatccggtccattcgcccggtccatagatatctcctccctggttgtacaggacgagtacatctttattcaggtgaccacaagtgggagagcaagctattacgttagctaccgcagagaggcctttgcacagatcaagctccctaaatatagcctgcccaaggacatgcacatcatatccaccgatgagaatcaggtgtttgccgctgtccaggaatggaaccagaatgatacctacaacctgtacatttccgatactcggggaatctactttaccctagccatggagaacatcaagagttcccgcgggctgatgggaaatattattatcgagttgtacgaggtggcgggcatcaaaggcattttcttggccaataagaaggtcgacgatcaggttaagacatatataacctataacaaagggcgggattggaggttgcttcaggctccagatgtggatctgcgcggcagcccggtgcactgccttcttcccttctgttctctgcatcttcacttacaactttcagagaatccgtattcctccggtagaatcagcagcaaggagacagccccaggccttgtagtcgccactggtaatatcggccccgaattgtcctacaccgatattggtgtattcatatcttccgatggcggaaacacgtggcggcagatcttcgatgaggagtataacgtctggtttctcgattgggggggcgccctggtggccatgaaacacacaccactcccggtgcggcatctttgggtctcattcgatgaaggtcacagctgggataaatacgggtttaccagcgtacctctgttcgtggatggagccctagtggaggctgggatggaaacccacataatgacagtattcgggcatttctccctgaggagcgagtggcagcttgtaaaagtggattacaagtcaatcttctccagacactgcaccaaggaggattaccagacgtggcacctcctgaaccagggggagccctgtgtcatgggcgagcgaaaaatttttaaaaaaagaaagcctggggctcagtgtgccctaggcagagaccactcaggaagcgtggtgagtgaaccctgtgtgtgtgccaattgggacttcgagtgtgattacggctacgagcgccacggggagtctcagtgtgtccccgccttttggtacaacccagcctcccctagcaaagattgcagcttgggtcaatcgtatctgaacagcacgggctacaggcgcatcgtatccaataattgcactgacggcctgcgtgagaagtatacagcgaaggcccaaatgtgcccaggcaaagcccccaggggcctccacgtggtgaccaccgacggtcggctcgtcgcggagcaggggcacaacgccacattcatcatactgatggaggagggggatctccagagaactaacattcagctcgactttggtgatggtatagccgtgagctacgctaatttctcccctatagaggatggaataaagcatgtgtacaagagtgcagggatctttcaggttaccgcatacgcagagaacaatctgggctccgataccgcagttcttttcttacacgtggtatgtcctgtagagcatgtacacctcagggtgccgtttgtggctattagaaacaaagaggtgaatattagtgccgtggtatggccttcccagttagggactctgacttatttctggtggttcgggaacagcacaaagccactgatcacccttgactcttcaataagcttcacatttcttgcggaaggcacagatactataactgtgcaggtggcagccgggaacgctctgattcaggataccaaggaaatcgctgtgcatgagtactttcagagccagcttctgagttttagtcctaacctggattaccataaccccgacattccagaatggcggaaagacataggcaatgtgattaagcgagccctggtgaaagtgacatcagttcctgaggatcagattctcatcgctgtattcccagggctgccgacttccgcagagctgtttattctgcctccaaagaatctgacagaaagaagaaaaggaaatgagggagacctggaacagatcgtggaaaccctcttcaatgctttaaatcaaaacctagtccagtttgagctgaaaccaggcgttcaagtgatcgtgtacgtcacacagctgacccttgcgccgctggtggactcatccgcggggcactcatcttccgctatgctcatgctactgtctgtagttttcgtaggcttggcagtgttcctgatttataagttcaaacgcaagattccttggattaatatctacgcccaggtccagcacgataaagagcaggagatgattgggagtgtctctcagagcgagaacgcccccaaaattactctgtccgatttcactgagcctgaggagttactggacaaggagttggatacccgggtaataggcgggattgccactattgccaactctgagtcaacaaaggagattccaaactgtacttcagtgtag

SEQ ID NO: 135752 - DNA, 462 bp, Artificial Sequence
  Description of Artificial Sequence: Synthetic coding sequence
gagaacccctattcaagcggccgcatcagcagtaaagagaccgcgcccggtctggtggtggccaccggtaacattgggcctgagctatcctacactgacatcggggtttttatttcctccgacggcggcaacacttggcggcagatttttgacgaggagtataatgtatggttcttggattgggggggtgcactcgttgctatgaaacacaccccactgccagttcgccatctttgggtgagcttcgacgaggggcacagttgggacaagtatggtttcactagtgtacccctttttgtcgatggagccctggtcgaggccggcatggagactcatattatgaccgactatggctatgaacgtcacggcgagagtcagtgtgttccagcgttctggtataaccctgcgtctccctccaaagattgcagtttgggtcagtcctaccttaacagtacgggatag

SEQ ID NO: 135753 - DNA, 1410 bp, Artificial Sequence
  Description of Artificial Sequence: Synthetic coding sequence
atggggaccgtccatgcccggagccttgaaccgctgcccagcagtggcccagacttcggcggattgggggaggaagctgagttcgtcgaagtggagcccgaggctaaacaggagattctcgagaacaaggacgtggtcgtgcagcatgtacattttgacggactgggcaggacaaaagacgacattattatttgtgaaattggagacgtctttaaggccaagaatctgatcgaggtaatgagaaagagccacgaggctcgggaaaagctccttagacttggcatctttcggcaagtcgacgtcctgatcgatacctgccaaggagacgatgcactccctaatgggctcgatgtgacatttgaagtgactgaactgcgacggctgacaggtagctataataccatggtgggcaataatgaagggtctatggttttgggtctgaaactcccaaatctgttaggtcgtgccgagaaggtgacattccaattctcctacggcactaaggaaacctcctacggtctctccttctttaagcctcgcccaggaaactttgagaggaatttctccgttaacctgtacaaggtgactggtcagtttccttggagttctctgcgcgaaacggatcgcgggatgtctgctgagtactctttcccaatatggaagacatcccatactgtcaaatgggaaggagtgtggcgagagctgggttgcctcagcagaaccgcttcatttgcagtgaggaaagaatctgggcacagtctgaaaagtagcttgtcgcacgccatggtaattgacagcagaaatagcagcattctcccacgcagaggtgcccttctgaaggttaatcaagaattggctggctacactggcggagatgtgagcttcatcaaagaggacttcgagctgcaactgaacaagcagttgatttttgactcagttttcagcgcttccttttggggaggaatgctggtacccattggtgataaaccgagcagtatcgccgaccgtttctatcttggcggaccgacttctattcgtgggttttcaatgcactctatagggccacagagcgagggcgactatctcggcggtgaggcctactgggccgggggcctgcatctgtacactccgctcccttttcgacccggccaaggtggatttggggaactgtttaggacacactttttccttaacgccggaaacctttgcaatctcaactatggagagggaccaaaagctcatatcagaaaactggccgaatgtattcgatggagctacggcgccggaatcgtactgaggttgggaaacatcgcaagacttgaattaaactactgcgtgcccatgggtgtccagactggagaccgaatttgtgacggcgtgcagtttggtgctggaatacgattcctttag

SEQ ID NO: 135754 - DNA, 780 bp, Artificial Sequence
  Description of Artificial Sequence: Synthetic coding sequence
atgagtgccgaatattcttttcctatttggaagacctcacacactgttaaatgggaaggagtgtggagggagctggggtgtctgagtcgaactgcaagcttcgccgtgcggaaagagagtggccactctctgaagtcgtcactctcccacgcaatggtgattgattctaggaacagctcaatcttgcctagacgaggggctttactgaaggtgaatcaggagctggctggttataccggcggcgatgtcagttttattaaggaggacttcgagctgcagctcaacaagcagctcatttttgattccgtcttctcagcatctttttggggggggatgttggtgccaattggagataaacccagcagtatcgcggacaggttttaccttggcggtcccactagcattcggggatttagcatgcatagtattggaccacagtcagaaggagactaccttggcggagaggcttattgggctggcggacttcacctatatactcccctgccattccgtccaggacaaggggggttcggggagctgttcagaactcatttctttcttaacgccggaaatctgtgcaacttaaattacggcgaaggccccaaagctcatatccgtaagttggcagaatgcattaggtggtcctatggggccgggattgtgctgaggctgggaaatatcgctcgacttgagctgaactactgtgtgcctatgggggtacaaacaggagaccggatttgcgatggagtgcagtttggcgcaggcattaggtttttatag

SEQ ID NO: 135755 - DNA, 1425 bp, Artificial Sequence
  Description of Artificial Sequence: Synthetic coding sequence
atggcctctgggggagggggatgcagcgcaagcgagagattaccccctcccttccccggcttggagccggaatccgagggtgcggcaggtgggtccgagccagaggccggcgacagcgataccgaaggcgaagatatcttcacaggagccgccgtggtgtctaagcaccagagccccaaaattactacttcactcctccctataaacaatggtagtaaagagaatggaatccacgaggagcaagatcaagaacctcaggatctcttcgccgacgccaccgtggaactcagcctcgactccactcagaataaccagaaaaaggtgctggccaaaaccctcatctctctacccccacaggaagccaccaactcttctaaaccacaaccaacatacgaagagctggaagaggaggaacaggaggatcagttcgatctcactgtaggaatcaccgatccagaaaagattggcgacggtatgaacgcttacgttgcctataaagtcactacccaaacatccctccctctgttcagatctaaacagtttgctgtcaagcggcgcttttctgattttctgggtctttacgagaaactgagcgaaaagcactcgcaaaatggtttcattgttcctcccccacctgagaagtccctgattggcatgaccaaagtcaaggtagggaaggaggattcctcttctgctgagtttctcgagaaacggcgggcggccctcgaaagatacctgcagaggattgtgaatcacccgacgatgttgcaggatcctgacgtacgggagttcctggagaaagaggagctgccaagagccgtggggacacagactttgtccggagctgggctgctgaaaatgtttaacaaggcgaccgacgcagtgagcaagatgaccatcaagatgaacgagtcagacatttggtttgaggaaaaactgcaggaagtggagtgcgaggagcagcgcctccgtaaactgcatgctgttgtggaaaccctcgtcaatcaccggaaggaattagccctgaatacagctcaattcgcgaaaagtttggctatgttgggcagctcagaagacaatacagcactaagcagagccctatcccagttggctgaagtcgaagagaagatcgaacaattacaccaggaacaagcaaacaacgacttttttcttctcgcggagctgttgtctgactacatccggctcttggcaatcgtgaggtgggagtcgcgggttacacagtacgagcgagattttgagcggatctctaccgtcgtgagaaaggaagtcattaggttcgagaaggaaaagtcaaaagatttcaagaatcacgtaattaaatatctggaaacgctactttactcccaacagcagctcgcgaaatattgggaggcctttctccctgaagcaaaggctatctcttag
